United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 96

SEQ ID NO: 3415203 - RNA, 22 nt, Pseudomonas aeruginosa PA01
cuuccggacugcccagcgccgc

SEQ ID NO: 3415204 - RNA, 18 nt, Pseudomonas aeruginosa PA01
cuuccggcagccagccgc

SEQ ID NO: 3415205 - RNA, 20 nt, Pseudomonas aeruginosa PA01
cuuccggcagccagccgccg

SEQ ID NO: 3415206 - RNA, 23 nt, Pseudomonas aeruginosa PA01
cuuccggcagccagccgccgaag

SEQ ID NO: 3415207 - RNA, 13 nt, Pseudomonas aeruginosa PA01
cuuccggcccggc

SEQ ID NO: 3415208 - RNA, 17 nt, Pseudomonas aeruginosa PA01
cuuccggcccggccagg

SEQ ID NO: 3415209 - RNA, 23 nt, Pseudomonas aeruginosa PA01
cuuccggcgcuccacagcugcca

SEQ ID NO: 3415210 - RNA, 13 nt, Pseudomonas aeruginosa PA01
cuuccggcuccag

SEQ ID NO: 3415211 - RNA, 16 nt, Pseudomonas aeruginosa PA01
cuuccggcucgccgcg

SEQ ID NO: 3415212 - RNA, 22 nt, Pseudomonas aeruginosa PA01
cuuccggcuuuuucauucggcu

SEQ ID NO: 3415213 - RNA, 17 nt, Pseudomonas aeruginosa PA01
cuuccgggcugcgcucg

SEQ ID NO: 3415214 - RNA, 19 nt, Pseudomonas aeruginosa PA01
cuuccggguugaaggcgcg

SEQ ID NO: 3415215 - RNA, 15 nt, Pseudomonas aeruginosa PA01
cuuccguagguggau

SEQ ID NO: 3415216 - RNA, 13 nt, Pseudomonas aeruginosa PA01
cuuccuacaucuu

SEQ ID NO: 3415217 - RNA, 16 nt, Pseudomonas aeruginosa PA01
cuuccuccaucgccuc

SEQ ID NO: 3415218 - RNA, 16 nt, Pseudomonas aeruginosa PA01
cuuccuccucgccgcu

SEQ ID NO: 3415219 - RNA, 13 nt, Pseudomonas aeruginosa PA01
cuuccucgcccuc

SEQ ID NO: 3415220 - RNA, 19 nt, Pseudomonas aeruginosa PA01
cuuccucgcccucauggcu

SEQ ID NO: 3415221 - RNA, 23 nt, Pseudomonas aeruginosa PA01
cuuccucgcccucauggcuguag

SEQ ID NO: 3415222 - RNA, 14 nt, Pseudomonas aeruginosa PA01
cuuccucgcugccu

SEQ ID NO: 3415223 - RNA, 21 nt, Pseudomonas aeruginosa PA01
cuuccucggacuugcuccaga

SEQ ID NO: 3415224 - RNA, 17 nt, Pseudomonas aeruginosa PA01
cuuccucggccgccagg

SEQ ID NO: 3415225 - RNA, 20 nt, Pseudomonas aeruginosa PA01
cuuccucggccgccaggcgc

SEQ ID NO: 3415226 - RNA, 21 nt, Pseudomonas aeruginosa PA01
cuuccucggccgccaggcgcg

SEQ ID NO: 3415227 - RNA, 11 nt, Pseudomonas aeruginosa PA01
cuuccucggcg

SEQ ID NO: 3415228 - RNA, 21 nt, Pseudomonas aeruginosa PA01
cuuccucggcgaccaccgcga

SEQ ID NO: 3415229 - RNA, 15 nt, Pseudomonas aeruginosa PA01
cuuccucggugucgg

SEQ ID NO: 3415230 - RNA, 20 nt, Pseudomonas aeruginosa PA01
cuuccucggugucggccaac

SEQ ID NO: 3415231 - RNA, 17 nt, Pseudomonas aeruginosa PA01
cuuccugcacgcugcgc

SEQ ID NO: 3415232 - RNA, 18 nt, Pseudomonas aeruginosa PA01
cuuccugcacgcugcgcc

SEQ ID NO: 3415233 - RNA, 20 nt, Pseudomonas aeruginosa PA01
cuuccugccagcgcgucggc

SEQ ID NO: 3415234 - RNA, 19 nt, Pseudomonas aeruginosa PA01
cuuccugcugguugaccag

SEQ ID NO: 3415235 - RNA, 14 nt, Pseudomonas aeruginosa PA01
cuuccuggaccucc

SEQ ID NO: 3415236 - RNA, 17 nt, Pseudomonas aeruginosa PA01
cuuccuggccgggaacc

SEQ ID NO: 3415237 - RNA, 19 nt, Pseudomonas aeruginosa PA01
cuuccugggaauugcgcac

SEQ ID NO: 3415238 - RNA, 21 nt, Pseudomonas aeruginosa PA01
cuuccugggagaacuuuuccc

SEQ ID NO: 3415239 - RNA, 18 nt, Pseudomonas aeruginosa PA01
cuuccugggaugccgggc

SEQ ID NO: 3415240 - RNA, 19 nt, Pseudomonas aeruginosa PA01
cuuccugggaugccgggcc

SEQ ID NO: 3415241 - RNA, 20 nt, Pseudomonas aeruginosa PA01
cuuccugggaugccgggccg

SEQ ID NO: 3415242 - RNA, 14 nt, Pseudomonas aeruginosa PA01
cuuccugggcuucg

SEQ ID NO: 3415243 - RNA, 23 nt, Pseudomonas aeruginosa PA01
cuuccugugcgaggcuggccucg

SEQ ID NO: 3415244 - RNA, 15 nt, Pseudomonas aeruginosa PA01
cuuccuucucccggc

SEQ ID NO: 3415245 - RNA, 14 nt, Pseudomonas aeruginosa PA01
cuuccuugcgcggg

SEQ ID NO: 3415246 - RNA, 19 nt, Pseudomonas aeruginosa PA01
cuuccuugcugaagcccag

SEQ ID NO: 3415247 - RNA, 20 nt, Pseudomonas aeruginosa PA01
cuuccuugcugaagcccagg

SEQ ID NO: 3415248 - RNA, 21 nt, Pseudomonas aeruginosa PA01
cuuccuugcugaagcccaggc

SEQ ID NO: 3415249 - RNA, 16 nt, Pseudomonas aeruginosa PA01
cuuccuuggcgggaug

SEQ ID NO: 3415250 - RNA, 15 nt, Pseudomonas aeruginosa PA01
cuuccuugucgauca

SEQ ID NO: 3415251 - RNA, 17 nt, Pseudomonas aeruginosa PA01
cuucgaacccgcccucg

SEQ ID NO: 3415252 - RNA, 14 nt, Pseudomonas aeruginosa PA01
cuucgaaccgcaga

SEQ ID NO: 3415253 - RNA, 17 nt, Pseudomonas aeruginosa PA01
cuucgaaccgcagaaga

SEQ ID NO: 3415254 - RNA, 17 nt, Pseudomonas aeruginosa PA01
cuucgaacgugcgcgca

SEQ ID NO: 3415255 - RNA, 18 nt, Pseudomonas aeruginosa PA01
cuucgaagacccccugcc

SEQ ID NO: 3415256 - RNA, 23 nt, Pseudomonas aeruginosa PA01
cuucgaagacccccugccgcccu

SEQ ID NO: 3415257 - RNA, 16 nt, Pseudomonas aeruginosa PA01
cuucgaagccgagcug

SEQ ID NO: 3415258 - RNA, 19 nt, Pseudomonas aeruginosa PA01
cuucgacaugggccgcgca

SEQ ID NO: 3415259 - RNA, 23 nt, Pseudomonas aeruginosa PA01
cuucgacgaacucgacgcgccag

SEQ ID NO: 3415260 - RNA, 22 nt, Pseudomonas aeruginosa PA01
cuucgacgacaccugcaacgcc

SEQ ID NO: 3415261 - RNA, 23 nt, Pseudomonas aeruginosa PA01
cuucgacgacaccugcaacgccc

SEQ ID NO: 3415262 - RNA, 17 nt, Pseudomonas aeruginosa PA01
cuucgacuaccugggga

SEQ ID NO: 3415263 - RNA, 17 nt, Pseudomonas aeruginosa PA01
cuucgagcaacacaugc

SEQ ID NO: 3415264 - RNA, 17 nt, Pseudomonas aeruginosa PA01
cuucgagcaccccgagc

SEQ ID NO: 3415265 - RNA, 16 nt, Pseudomonas aeruginosa PA01
cuucgagcacuuccca

SEQ ID NO: 3415266 - RNA, 17 nt, Pseudomonas aeruginosa PA01
cuucgagcacuucccag

SEQ ID NO: 3415267 - RNA, 18 nt, Pseudomonas aeruginosa PA01
cuucgagcacuucccagg

SEQ ID NO: 3415268 - RNA, 20 nt, Pseudomonas aeruginosa PA01
cuucgagccuggccaggcgc

SEQ ID NO: 3415269 - RNA, 20 nt, Pseudomonas aeruginosa PA01
cuucgaggcgggcgucggcg

SEQ ID NO: 3415270 - RNA, 23 nt, Pseudomonas aeruginosa PA01
cuucgaggcgggcgucggcgucg

SEQ ID NO: 3415271 - RNA, 20 nt, Pseudomonas aeruginosa PA01
cuucgaguagguccaggcgu

SEQ ID NO: 3415272 - RNA, 15 nt, Pseudomonas aeruginosa PA01
cuucgaucacccggu

SEQ ID NO: 3415273 - RNA, 14 nt, Pseudomonas aeruginosa PA01
cuucgaugcgccgc

SEQ ID NO: 3415274 - RNA, 17 nt, Pseudomonas aeruginosa PA01
cuucgaugcgccgcagg

SEQ ID NO: 3415275 - RNA, 21 nt, Pseudomonas aeruginosa PA01
cuucgauugcuacagcaauua

SEQ ID NO: 3415276 - RNA, 18 nt, Pseudomonas aeruginosa PA01
cuucgauugucuccagga

SEQ ID NO: 3415277 - RNA, 18 nt, Pseudomonas aeruginosa PA01
cuucgcaaagcgagcgcc

SEQ ID NO: 3415278 - RNA, 20 nt, Pseudomonas aeruginosa PA01
cuucgcaaagcgagcgcccg

SEQ ID NO: 3415279 - RNA, 15 nt, Pseudomonas aeruginosa PA01
cuucgcaccagccgg

SEQ ID NO: 3415280 - RNA, 16 nt, Pseudomonas aeruginosa PA01
cuucgcaccagccggc

SEQ ID NO: 3415281 - RNA, 18 nt, Pseudomonas aeruginosa PA01
cuucgcaccagccggccg

SEQ ID NO: 3415282 - RNA, 18 nt, Pseudomonas aeruginosa PA01
cuucgcaggagucgacga

SEQ ID NO: 3415283 - RNA, 15 nt, Pseudomonas aeruginosa PA01
cuucgcauuccaccu

SEQ ID NO: 3415284 - RNA, 17 nt, Pseudomonas aeruginosa PA01
cuucgccagcggccagg

SEQ ID NO: 3415285 - RNA, 24 nt, Pseudomonas aeruginosa PA01
cuucgccagcggccagggcgaggc

SEQ ID NO: 3415286 - RNA, 22 nt, Pseudomonas aeruginosa PA01
cuucgccaguuccuugaggucg

SEQ ID NO: 3415287 - RNA, 20 nt, Pseudomonas aeruginosa PA01
cuucgcccagguaggcgaug

SEQ ID NO: 3415288 - RNA, 14 nt, Pseudomonas aeruginosa PA01
cuucgcccgccgcc

SEQ ID NO: 3415289 - RNA, 16 nt, Pseudomonas aeruginosa PA01
cuucgcccgccgccug

SEQ ID NO: 3415290 - RNA, 12 nt, Pseudomonas aeruginosa PA01
cuucgcccggcu

SEQ ID NO: 3415291 - RNA, 13 nt, Pseudomonas aeruginosa PA01
cuucgcccggcuc

SEQ ID NO: 3415292 - RNA, 14 nt, Pseudomonas aeruginosa PA01
cuucgcccggcucg

SEQ ID NO: 3415293 - RNA, 17 nt, Pseudomonas aeruginosa PA01
cuucgcccggcucgacc

SEQ ID NO: 3415294 - RNA, 17 nt, Pseudomonas aeruginosa PA01
cuucgcccuacgcggca

SEQ ID NO: 3415295 - RNA, 19 nt, Pseudomonas aeruginosa PA01
cuucgcccucagcagcgcc

SEQ ID NO: 3415296 - RNA, 21 nt, Pseudomonas aeruginosa PA01
cuucgccgaaagcacgcgcau

SEQ ID NO: 3415297 - RNA, 22 nt, Pseudomonas aeruginosa PA01
cuucgccgaccagguccgccac

SEQ ID NO: 3415298 - RNA, 16 nt, Pseudomonas aeruginosa PA01
cuucgccgaucaccag

SEQ ID NO: 3415299 - RNA, 14 nt, Pseudomonas aeruginosa PA01
cuucgccgcccgcg

SEQ ID NO: 3415300 - RNA, 16 nt, Pseudomonas aeruginosa PA01
cuucgccgcccgcgcc

SEQ ID NO: 3415301 - RNA, 18 nt, Pseudomonas aeruginosa PA01
cuucgccgcccgcgccuc

SEQ ID NO: 3415302 - RNA, 12 nt, Pseudomonas aeruginosa PA01
cuucgccgccgc

SEQ ID NO: 3415303 - RNA, 14 nt, Pseudomonas aeruginosa PA01
cuucgccggccugc

SEQ ID NO: 3415304 - RNA, 18 nt, Pseudomonas aeruginosa PA01
cuucgccggccugcgcgc

SEQ ID NO: 3415305 - RNA, 21 nt, Pseudomonas aeruginosa PA01
cuucgccggguguuuuuccuc

SEQ ID NO: 3415306 - RNA, 22 nt, Pseudomonas aeruginosa PA01
cuucgccggguguuuuuccucg

SEQ ID NO: 3415307 - RNA, 16 nt, Pseudomonas aeruginosa PA01
cuucgccgucgagcca

SEQ ID NO: 3415308 - RNA, 21 nt, Pseudomonas aeruginosa PA01
cuucgccgucgagccagccca

SEQ ID NO: 3415309 - RNA, 12 nt, Pseudomonas aeruginosa PA01
cuucgccuggcg

SEQ ID NO: 3415310 - RNA, 14 nt, Pseudomonas aeruginosa PA01
cuucgccuggcgcg

SEQ ID NO: 3415311 - RNA, 16 nt, Pseudomonas aeruginosa PA01
cuucgccuggcgcgac

SEQ ID NO: 3415312 - RNA, 18 nt, Pseudomonas aeruginosa PA01
cuucgccuggcgcgacga

SEQ ID NO: 3415313 - RNA, 19 nt, Pseudomonas aeruginosa PA01
cuucgccuugcccuggccg

SEQ ID NO: 3415314 - RNA, 20 nt, Pseudomonas aeruginosa PA01
cuucgccuugcccuggccgg

SEQ ID NO: 3415315 - RNA, 19 nt, Pseudomonas aeruginosa PA01
cuucgcgaucggcguccgc

SEQ ID NO: 3415316 - RNA, 15 nt, Pseudomonas aeruginosa PA01
cuucgcgcagcucgg

SEQ ID NO: 3415317 - RNA, 12 nt, Pseudomonas aeruginosa PA01
cuucgcgcagga

SEQ ID NO: 3415318 - RNA, 22 nt, Pseudomonas aeruginosa PA01
cuucgcgcggauauagcugguc

SEQ ID NO: 3415319 - RNA, 19 nt, Pseudomonas aeruginosa PA01
cuucgcgcgggguggccgu

SEQ ID NO: 3415320 - RNA, 22 nt, Pseudomonas aeruginosa PA01
cuucgcgcgggguggccgugca

SEQ ID NO: 3415321 - RNA, 23 nt, Pseudomonas aeruginosa PA01
cuucgcgcgggguggccgugcag

SEQ ID NO: 3415322 - RNA, 15 nt, Pseudomonas aeruginosa PA01
cuucgcgcuccaggc

SEQ ID NO: 3415323 - RNA, 17 nt, Pseudomonas aeruginosa PA01
cuucgcgcucgacgaug

SEQ ID NO: 3415324 - RNA, 23 nt, Pseudomonas aeruginosa PA01
cuucgcggaucucaggaccuucc

SEQ ID NO: 3415325 - RNA, 17 nt, Pseudomonas aeruginosa PA01
cuucgcgggccaggccg

SEQ ID NO: 3415326 - RNA, 17 nt, Pseudomonas aeruginosa PA01
cuucgcgggugaccugg

SEQ ID NO: 3415327 - RNA, 18 nt, Pseudomonas aeruginosa PA01
cuucgcgguagacgcagg

SEQ ID NO: 3415328 - RNA, 16 nt, Pseudomonas aeruginosa PA01
cuucgcgguuggauuc

SEQ ID NO: 3415329 - RNA, 15 nt, Pseudomonas aeruginosa PA01
cuucgcgugggccag

SEQ ID NO: 3415330 - RNA, 19 nt, Pseudomonas aeruginosa PA01
cuucgcguucgcuccgggc

SEQ ID NO: 3415331 - RNA, 19 nt, Pseudomonas aeruginosa PA01
cuucgcuggaccaggcggc

SEQ ID NO: 3415332 - RNA, 16 nt, Pseudomonas aeruginosa PA01
cuucggacguaggacg

SEQ ID NO: 3415333 - RNA, 17 nt, Pseudomonas aeruginosa PA01
cuucggagaacagcgag

SEQ ID NO: 3415334 - RNA, 14 nt, Pseudomonas aeruginosa PA01
cuucggagcgaggc

SEQ ID NO: 3415335 - RNA, 21 nt, Pseudomonas aeruginosa PA01
cuucggaggucgagcagaguu

SEQ ID NO: 3415336 - RNA, 14 nt, Pseudomonas aeruginosa PA01
cuucggcaagcacc

SEQ ID NO: 3415337 - RNA, 19 nt, Pseudomonas aeruginosa PA01
cuucggcaggaccucgggc

SEQ ID NO: 3415338 - RNA, 19 nt, Pseudomonas aeruginosa PA01
cuucggccaguucgagcag

SEQ ID NO: 3415339 - RNA, 22 nt, Pseudomonas aeruginosa PA01
cuucggcgacacagacgcagcc

SEQ ID NO: 3415340 - RNA, 21 nt, Pseudomonas aeruginosa PA01
cuucggcgcauagccaccgcc

SEQ ID NO: 3415341 - RNA, 22 nt, Pseudomonas aeruginosa PA01
cuucggcgcauagccaccgccg

SEQ ID NO: 3415342 - RNA, 19 nt, Pseudomonas aeruginosa PA01
cuucggcgccggagcuggu

SEQ ID NO: 3415343 - RNA, 13 nt, Pseudomonas aeruginosa PA01
cuucggcgcgccg

SEQ ID NO: 3415344 - RNA, 15 nt, Pseudomonas aeruginosa PA01
cuucggcgcgcggca

SEQ ID NO: 3415345 - RNA, 16 nt, Pseudomonas aeruginosa PA01
cuucggcgcgcggcag

SEQ ID NO: 3415346 - RNA, 21 nt, Pseudomonas aeruginosa PA01
cuucggcgcgcggcagcacca

SEQ ID NO: 3415347 - RNA, 22 nt, Pseudomonas aeruginosa PA01
cuucggcgcgcggcagcaccag

SEQ ID NO: 3415348 - RNA, 14 nt, Pseudomonas aeruginosa PA01
cuucggcgcggugc

SEQ ID NO: 3415349 - RNA, 16 nt, Pseudomonas aeruginosa PA01
cuucggcgcggugccg

SEQ ID NO: 3415350 - RNA, 19 nt, Pseudomonas aeruginosa PA01
cuucggcggauaacgcuac

SEQ ID NO: 3415351 - RNA, 14 nt, Pseudomonas aeruginosa PA01
cuucggcggcgccg

SEQ ID NO: 3415352 - RNA, 18 nt, Pseudomonas aeruginosa PA01
cuucggcggcgccgguga

SEQ ID NO: 3415353 - RNA, 15 nt, Pseudomonas aeruginosa PA01
cuucggcggcgcgcu

SEQ ID NO: 3415354 - RNA, 14 nt, Pseudomonas aeruginosa PA01
cuucggcggcuucg

SEQ ID NO: 3415355 - RNA, 20 nt, Pseudomonas aeruginosa PA01
cuucggcgguggggccgccg

SEQ ID NO: 3415356 - RNA, 18 nt, Pseudomonas aeruginosa PA01
cuucggcgugauccgcag

SEQ ID NO: 3415357 - RNA, 18 nt, Pseudomonas aeruginosa PA01
cuucggcgugcauggccg

SEQ ID NO: 3415358 - RNA, 21 nt, Pseudomonas aeruginosa PA01
cuucggcgugcauggccgggc

SEQ ID NO: 3415359 - RNA, 16 nt, Pseudomonas aeruginosa PA01
cuucggcuccagcacc

SEQ ID NO: 3415360 - RNA, 18 nt, Pseudomonas aeruginosa PA01
cuucggcuccagcaccag

SEQ ID NO: 3415361 - RNA, 15 nt, Pseudomonas aeruginosa PA01
cuucggcuucaacgc

SEQ ID NO: 3415362 - RNA, 15 nt, Pseudomonas aeruginosa PA01
cuucgggagagcccg

SEQ ID NO: 3415363 - RNA, 21 nt, Pseudomonas aeruginosa PA01
cuucgggagagcccgggcgca

SEQ ID NO: 3415364 - RNA, 18 nt, Pseudomonas aeruginosa PA01
cuucggucgcgccccgcc

SEQ ID NO: 3415365 - RNA, 19 nt, Pseudomonas aeruginosa PA01
cuucggucgcgccccgcca

SEQ ID NO: 3415366 - RNA, 18 nt, Pseudomonas aeruginosa PA01
cuucgguggauucgaagg

SEQ ID NO: 3415367 - RNA, 16 nt, Pseudomonas aeruginosa PA01
cuucgguggcgaccag

SEQ ID NO: 3415368 - RNA, 17 nt, Pseudomonas aeruginosa PA01
cuucgguggcgaccagg

SEQ ID NO: 3415369 - RNA, 18 nt, Pseudomonas aeruginosa PA01
cuucgguggcggcgacga

SEQ ID NO: 3415370 - RNA, 21 nt, Pseudomonas aeruginosa PA01
cuucggugucguauuccaggg

SEQ ID NO: 3415371 - RNA, 23 nt, Pseudomonas aeruginosa PA01
cuucguaggugaagcccaggcgc

SEQ ID NO: 3415372 - RNA, 21 nt, Pseudomonas aeruginosa PA01
cuucguccaugcucgccaccu

SEQ ID NO: 3415373 - RNA, 18 nt, Pseudomonas aeruginosa PA01
cuucguccggccgcccga

SEQ ID NO: 3415374 - RNA, 13 nt, Pseudomonas aeruginosa PA01
cuucguccucgug

SEQ ID NO: 3415375 - RNA, 16 nt, Pseudomonas aeruginosa PA01
cuucguccugcugcug

SEQ ID NO: 3415376 - RNA, 23 nt, Pseudomonas aeruginosa PA01
cuucguccugcugcuggccuucg

SEQ ID NO: 3415377 - RNA, 15 nt, Pseudomonas aeruginosa PA01
cuucgucgcgcaggc

SEQ ID NO: 3415378 - RNA, 15 nt, Pseudomonas aeruginosa PA01
cuucgucgcgcuuca

SEQ ID NO: 3415379 - RNA, 16 nt, Pseudomonas aeruginosa PA01
cuucgucgcgcuucag

SEQ ID NO: 3415380 - RNA, 16 nt, Pseudomonas aeruginosa PA01
cuucgugcuggcggau

SEQ ID NO: 3415381 - RNA, 13 nt, Pseudomonas aeruginosa PA01
cuucguuccugau

SEQ ID NO: 3415382 - RNA, 16 nt, Pseudomonas aeruginosa PA01
cuucguugccauagcc

SEQ ID NO: 3415383 - RNA, 21 nt, Pseudomonas aeruginosa PA01
cuucguuuucaggcgacgccg

SEQ ID NO: 3415384 - RNA, 22 nt, Pseudomonas aeruginosa PA01
cuucguuuucaggcgacgccgc

SEQ ID NO: 3415385 - RNA, 13 nt, Pseudomonas aeruginosa PA01
cuucuaccuggcg

SEQ ID NO: 3415386 - RNA, 15 nt, Pseudomonas aeruginosa PA01
cuucuaccuggcgcu

SEQ ID NO: 3415387 - RNA, 20 nt, Pseudomonas aeruginosa PA01
cuucuccagaaucucccgca

SEQ ID NO: 3415388 - RNA, 16 nt, Pseudomonas aeruginosa PA01
cuucuccagcaggguc

SEQ ID NO: 3415389 - RNA, 19 nt, Pseudomonas aeruginosa PA01
cuucucccagaagucgcug

SEQ ID NO: 3415390 - RNA, 16 nt, Pseudomonas aeruginosa PA01
cuucuccccagaugcc

SEQ ID NO: 3415391 - RNA, 15 nt, Pseudomonas aeruginosa PA01
cuucuccgauuccug

SEQ ID NO: 3415392 - RNA, 16 nt, Pseudomonas aeruginosa PA01
cuucuccgauuccugc

SEQ ID NO: 3415393 - RNA, 17 nt, Pseudomonas aeruginosa PA01
cuucuccgauuccugcg

SEQ ID NO: 3415394 - RNA, 23 nt, Pseudomonas aeruginosa PA01
cuucuccgauuccugcggcuugc

SEQ ID NO: 3415395 - RNA, 18 nt, Pseudomonas aeruginosa PA01
cuucuccgccagccagcc

SEQ ID NO: 3415396 - RNA, 20 nt, Pseudomonas aeruginosa PA01
cuucuccggggcccggcagg

SEQ ID NO: 3415397 - RNA, 22 nt, Pseudomonas aeruginosa PA01
cuucuccggggcccggcaggca

SEQ ID NO: 3415398 - RNA, 15 nt, Pseudomonas aeruginosa PA01
cuucuccucggccga

SEQ ID NO: 3415399 - RNA, 17 nt, Pseudomonas aeruginosa PA01
cuucuccucggccgaca

SEQ ID NO: 3415400 - RNA, 17 nt, Pseudomonas aeruginosa PA01
cuucucgaacagcuccu

SEQ ID NO: 3415401 - RNA, 18 nt, Pseudomonas aeruginosa PA01
cuucucgaacagcuccuc

SEQ ID NO: 3415402 - RNA, 19 nt, Pseudomonas aeruginosa PA01
cuucucgaagcgcgccugc

SEQ ID NO: 3415403 - RNA, 21 nt, Pseudomonas aeruginosa PA01
cuucucgaagcgcgccugcuc

SEQ ID NO: 3415404 - RNA, 19 nt, Pseudomonas aeruginosa PA01
cuucucgacgaaggcgcgc

SEQ ID NO: 3415405 - RNA, 11 nt, Pseudomonas aeruginosa PA01
cuucucggcga

SEQ ID NO: 3415406 - RNA, 17 nt, Pseudomonas aeruginosa PA01
cuucucgguagggccga

SEQ ID NO: 3415407 - RNA, 21 nt, Pseudomonas aeruginosa PA01
cuucucguagcgcucguaggu

SEQ ID NO: 3415408 - RNA, 23 nt, Pseudomonas aeruginosa PA01
cuucucgucgaaggugaagcugc

SEQ ID NO: 3415409 - RNA, 23 nt, Pseudomonas aeruginosa PA01
cuucucgucgccgccguugagga

SEQ ID NO: 3415410 - RNA, 22 nt, Pseudomonas aeruginosa PA01
cuucugcaauugcuugcgcucg

SEQ ID NO: 3415411 - RNA, 15 nt, Pseudomonas aeruginosa PA01
cuucugcaggccgug

SEQ ID NO: 3415412 - RNA, 14 nt, Pseudomonas aeruginosa PA01
cuucugcagggcgg

SEQ ID NO: 3415413 - RNA, 16 nt, Pseudomonas aeruginosa PA01
cuucugcagggcggcu

SEQ ID NO: 3415414 - RNA, 14 nt, Pseudomonas aeruginosa PA01
cuucugcgagccgc

SEQ ID NO: 3415415 - RNA, 17 nt, Pseudomonas aeruginosa PA01
cuucugcgagccgcgcg

SEQ ID NO: 3415416 - RNA, 13 nt, Pseudomonas aeruginosa PA01
cuucugcgccucc

SEQ ID NO: 3415417 - RNA, 16 nt, Pseudomonas aeruginosa PA01
cuucugcgccuccucg

SEQ ID NO: 3415418 - RNA, 22 nt, Pseudomonas aeruginosa PA01
cuucugcgcguugcagcgccug

SEQ ID NO: 3415419 - RNA, 18 nt, Pseudomonas aeruginosa PA01
cuucugcuggccgcgcag

SEQ ID NO: 3415420 - RNA, 22 nt, Pseudomonas aeruginosa PA01
cuucugcuggccgcgcaggaag

SEQ ID NO: 3415421 - RNA, 22 nt, Pseudomonas aeruginosa PA01
cuucuggaaaucggcguccugg

SEQ ID NO: 3415422 - RNA, 19 nt, Pseudomonas aeruginosa PA01
cuucugguucguccgcgcg

SEQ ID NO: 3415423 - RNA, 19 nt, Pseudomonas aeruginosa PA01
cuucugucccugggccaug

SEQ ID NO: 3415424 - RNA, 14 nt, Pseudomonas aeruginosa PA01
cuucugugggcagc

SEQ ID NO: 3415425 - RNA, 22 nt, Pseudomonas aeruginosa PA01
cuucuucagcagcgggcguccg

SEQ ID NO: 3415426 - RNA, 20 nt, Pseudomonas aeruginosa PA01
cuucuuccccgccacuucca

SEQ ID NO: 3415427 - RNA, 19 nt, Pseudomonas aeruginosa PA01
cuucuucccgcccaucaac

SEQ ID NO: 3415428 - RNA, 15 nt, Pseudomonas aeruginosa PA01
cuucuuccuggccgg

SEQ ID NO: 3415429 - RNA, 15 nt, Pseudomonas aeruginosa PA01
cuucuugacccgcug

SEQ ID NO: 3415430 - RNA, 22 nt, Pseudomonas aeruginosa PA01
cuucuugucgagguagguccag

SEQ ID NO: 3415431 - RNA, 14 nt, Pseudomonas aeruginosa PA01
cuucuugucgucgg

SEQ ID NO: 3415432 - RNA, 22 nt, Pseudomonas aeruginosa PA01
cuucuuuuaucgaaucggcgca

SEQ ID NO: 3415433 - RNA, 20 nt, Pseudomonas aeruginosa PA01
cuucuuuuuuucaccgcuca

SEQ ID NO: 3415434 - RNA, 18 nt, Pseudomonas aeruginosa PA01
cuugaaaacugucggcgg

SEQ ID NO: 3415435 - RNA, 23 nt, Pseudomonas aeruginosa PA01
cuugaacaccucuucgccauccu

SEQ ID NO: 3415436 - RNA, 17 nt, Pseudomonas aeruginosa PA01
cuugaacagcaggaugc

SEQ ID NO: 3415437 - RNA, 20 nt, Pseudomonas aeruginosa PA01
cuugaccaccgccaggcugg

SEQ ID NO: 3415438 - RNA, 16 nt, Pseudomonas aeruginosa PA01
cuugaccacggcgagg

SEQ ID NO: 3415439 - RNA, 13 nt, Pseudomonas aeruginosa PA01
cuugaccagcggc

SEQ ID NO: 3415440 - RNA, 17 nt, Pseudomonas aeruginosa PA01
cuugaccagcggcccgg

SEQ ID NO: 3415441 - RNA, 18 nt, Pseudomonas aeruginosa PA01
cuugaccaucuuuuccug

SEQ ID NO: 3415442 - RNA, 21 nt, Pseudomonas aeruginosa PA01
cuugacccgcaguuccuuggg

SEQ ID NO: 3415443 - RNA, 19 nt, Pseudomonas aeruginosa PA01
cuugacccucugguuggcc

SEQ ID NO: 3415444 - RNA, 21 nt, Pseudomonas aeruginosa PA01
cuugacccucugguuggccga

SEQ ID NO: 3415445 - RNA, 23 nt, Pseudomonas aeruginosa PA01
cuugacccucugguuggccgaaa

SEQ ID NO: 3415446 - RNA, 19 nt, Pseudomonas aeruginosa PA01
cuugaccgccgccugggug

SEQ ID NO: 3415447 - RNA, 14 nt, Pseudomonas aeruginosa PA01
cuugaccucgacgc

SEQ ID NO: 3415448 - RNA, 17 nt, Pseudomonas aeruginosa PA01
cuugaccucgacgccga

SEQ ID NO: 3415449 - RNA, 16 nt, Pseudomonas aeruginosa PA01
cuugaccugcugggcc

SEQ ID NO: 3415450 - RNA, 16 nt, Pseudomonas aeruginosa PA01
cuugaccuugcucuuc

SEQ ID NO: 3415451 - RNA, 23 nt, Pseudomonas aeruginosa PA01
cuugaccuugcucuucuggcuga

SEQ ID NO: 3415452 - RNA, 17 nt, Pseudomonas aeruginosa PA01
cuugacgaaaaagccgg

SEQ ID NO: 3415453 - RNA, 23 nt, Pseudomonas aeruginosa PA01
cuugacgaaaaagccggaagcgc

SEQ ID NO: 3415454 - RNA, 19 nt, Pseudomonas aeruginosa PA01
cuugacgaaggcggcagcg

SEQ ID NO: 3415455 - RNA, 17 nt, Pseudomonas aeruginosa PA01
cuugacgaucuucugca

SEQ ID NO: 3415456 - RNA, 19 nt, Pseudomonas aeruginosa PA01
cuugacgaugccguucagg

SEQ ID NO: 3415457 - RNA, 16 nt, Pseudomonas aeruginosa PA01
cuugacguucaggcug

SEQ ID NO: 3415458 - RNA, 14 nt, Pseudomonas aeruginosa PA01
cuugagcacccggg

SEQ ID NO: 3415459 - RNA, 16 nt, Pseudomonas aeruginosa PA01
cuugagcacccgggcg

SEQ ID NO: 3415460 - RNA, 14 nt, Pseudomonas aeruginosa PA01
cuugagcagccagg

SEQ ID NO: 3415461 - RNA, 18 nt, Pseudomonas aeruginosa PA01
cuugagcagccaggcgaa

SEQ ID NO: 3415462 - RNA, 20 nt, Pseudomonas aeruginosa PA01
cuugagcaggguguugauca

SEQ ID NO: 3415463 - RNA, 13 nt, Pseudomonas aeruginosa PA01
cuugagcauggcg

SEQ ID NO: 3415464 - RNA, 15 nt, Pseudomonas aeruginosa PA01
cuugagccuugcccc

SEQ ID NO: 3415465 - RNA, 16 nt, Pseudomonas aeruginosa PA01
cuugagcgccagcagg

SEQ ID NO: 3415466 - RNA, 21 nt, Pseudomonas aeruginosa PA01
cuugagcgccgaaggcgucgg

SEQ ID NO: 3415467 - RNA, 19 nt, Pseudomonas aeruginosa PA01
cuugagcggaucgucgcgg

SEQ ID NO: 3415468 - RNA, 15 nt, Pseudomonas aeruginosa PA01
cuugagcggcgcccu

SEQ ID NO: 3415469 - RNA, 20 nt, Pseudomonas aeruginosa PA01
cuugaggaaguggccggugu

SEQ ID NO: 3415470 - RNA, 21 nt, Pseudomonas aeruginosa PA01
cuugaggaaguugcgcagcaa

SEQ ID NO: 3415471 - RNA, 23 nt, Pseudomonas aeruginosa PA01
cuugaggaaguugcgcagcaacu

SEQ ID NO: 3415472 - RNA, 18 nt, Pseudomonas aeruginosa PA01
cuugaggaugucgcggcu

SEQ ID NO: 3415473 - RNA, 19 nt, Pseudomonas aeruginosa PA01
cuugaggaugucgcggcug

SEQ ID NO: 3415474 - RNA, 16 nt, Pseudomonas aeruginosa PA01
cuugaggccuuucuuc

SEQ ID NO: 3415475 - RNA, 16 nt, Pseudomonas aeruginosa PA01
cuugagguaggccagc

SEQ ID NO: 3415476 - RNA, 22 nt, Pseudomonas aeruginosa PA01
cuugagguaggccagccccaga

SEQ ID NO: 3415477 - RNA, 19 nt, Pseudomonas aeruginosa PA01
cuugaggucguccaccucc

SEQ ID NO: 3415478 - RNA, 20 nt, Pseudomonas aeruginosa PA01
cuugaggucguccaccucca

SEQ ID NO: 3415479 - RNA, 14 nt, Pseudomonas aeruginosa PA01
cuugagucgcaggc

SEQ ID NO: 3415480 - RNA, 20 nt, Pseudomonas aeruginosa PA01
cuugaguucccagaccuggc

SEQ ID NO: 3415481 - RNA, 22 nt, Pseudomonas aeruginosa PA01
cuugaguucccagaccuggccg

SEQ ID NO: 3415482 - RNA, 23 nt, Pseudomonas aeruginosa PA01
cuugaguucccagaccuggccgc

SEQ ID NO: 3415483 - RNA, 24 nt, Pseudomonas aeruginosa PA01
cuugaguucccagaccuggccgcu

SEQ ID NO: 3415484 - RNA, 17 nt, Pseudomonas aeruginosa PA01
cuugauacccaccggcu

SEQ ID NO: 3415485 - RNA, 18 nt, Pseudomonas aeruginosa PA01
cuugaucaccaccacgcc

SEQ ID NO: 3415486 - RNA, 17 nt, Pseudomonas aeruginosa PA01
cuugaucaccgcggugc

SEQ ID NO: 3415487 - RNA, 16 nt, Pseudomonas aeruginosa PA01
cuugaucacgccgaag

SEQ ID NO: 3415488 - RNA, 17 nt, Pseudomonas aeruginosa PA01
cuugaucacggugaugg

SEQ ID NO: 3415489 - RNA, 15 nt, Pseudomonas aeruginosa PA01
cuugaucacguccag

SEQ ID NO: 3415490 - RNA, 19 nt, Pseudomonas aeruginosa PA01
cuugaucagccgcaggcag

SEQ ID NO: 3415491 - RNA, 21 nt, Pseudomonas aeruginosa PA01
cuugaucagccgcaggcagaa

SEQ ID NO: 3415492 - RNA, 22 nt, Pseudomonas aeruginosa PA01
cuugaucgagcccuugcgcggc

SEQ ID NO: 3415493 - RNA, 19 nt, Pseudomonas aeruginosa PA01
cuugaucgagucgccggcg

SEQ ID NO: 3415494 - RNA, 18 nt, Pseudomonas aeruginosa PA01
cuugaucgcacggcggga

SEQ ID NO: 3415495 - RNA, 23 nt, Pseudomonas aeruginosa PA01
cuugaucgcacggcgggacagga

SEQ ID NO: 3415496 - RNA, 21 nt, Pseudomonas aeruginosa PA01
cuugaugaagcccgcggcauc

SEQ ID NO: 3415497 - RNA, 22 nt, Pseudomonas aeruginosa PA01
cuugaugucagcguagcuguuc

SEQ ID NO: 3415498 - RNA, 20 nt, Pseudomonas aeruginosa PA01
cuugcaauccgugcgccggg

SEQ ID NO: 3415499 - RNA, 15 nt, Pseudomonas aeruginosa PA01
cuugcacaccugguc

SEQ ID NO: 3415500 - RNA, 15 nt, Pseudomonas aeruginosa PA01
cuugcacauccagcc

SEQ ID NO: 3415501 - RNA, 21 nt, Pseudomonas aeruginosa PA01
cuugcagcaacucgccgccga

SEQ ID NO: 3415502 - RNA, 16 nt, Pseudomonas aeruginosa PA01
cuugcagcaccgccug

SEQ ID NO: 3415503 - RNA, 20 nt, Pseudomonas aeruginosa PA01
cuugcagcaccgccuggucg

SEQ ID NO: 3415504 - RNA, 21 nt, Pseudomonas aeruginosa PA01
cuugcagccagccgucgucgu

SEQ ID NO: 3415505 - RNA, 16 nt, Pseudomonas aeruginosa PA01
cuugcaggaguaggca

SEQ ID NO: 3415506 - RNA, 14 nt, Pseudomonas aeruginosa PA01
cuugcagggccgcc

SEQ ID NO: 3415507 - RNA, 16 nt, Pseudomonas aeruginosa PA01
cuugcagucgcggaag

SEQ ID NO: 3415508 - RNA, 18 nt, Pseudomonas aeruginosa PA01
cuugccaagguguggccg

SEQ ID NO: 3415509 - RNA, 23 nt, Pseudomonas aeruginosa PA01
cuugccaagguguggccgagccc

SEQ ID NO: 3415510 - RNA, 22 nt, Pseudomonas aeruginosa PA01
cuugccagggcagggaguccgc

SEQ ID NO: 3415511 - RNA, 21 nt, Pseudomonas aeruginosa PA01
cuugccauccuccagcacuac

SEQ ID NO: 3415512 - RNA, 17 nt, Pseudomonas aeruginosa PA01
cuugcccaacuccagcu

SEQ ID NO: 3415513 - RNA, 14 nt, Pseudomonas aeruginosa PA01
cuugccccaggugc

SEQ ID NO: 3415514 - RNA, 22 nt, Pseudomonas aeruginosa PA01
cuugcccggauuuugggcagcg

SEQ ID NO: 3415515 - RNA, 15 nt, Pseudomonas aeruginosa PA01
cuugcccucagggaa

SEQ ID NO: 3415516 - RNA, 16 nt, Pseudomonas aeruginosa PA01
cuugcccucggcgccc

SEQ ID NO: 3415517 - RNA, 17 nt, Pseudomonas aeruginosa PA01
cuugcccucggcgcccg

SEQ ID NO: 3415518 - RNA, 18 nt, Pseudomonas aeruginosa PA01
cuugcccucggcgcccgc

SEQ ID NO: 3415519 - RNA, 23 nt, Pseudomonas aeruginosa PA01
cuugcccucggcgcccgccugca

SEQ ID NO: 3415520 - RNA, 12 nt, Pseudomonas aeruginosa PA01
cuugcccuggcc

SEQ ID NO: 3415521 - RNA, 13 nt, Pseudomonas aeruginosa PA01
cuugcccuggccg

SEQ ID NO: 3415522 - RNA, 17 nt, Pseudomonas aeruginosa PA01
cuugcccuugaagcgcu

SEQ ID NO: 3415523 - RNA, 21 nt, Pseudomonas aeruginosa PA01
cuugccgacaagccuccagcg

SEQ ID NO: 3415524 - RNA, 20 nt, Pseudomonas aeruginosa PA01
cuugccgaccuucaucaggc

SEQ ID NO: 3415525 - RNA, 22 nt, Pseudomonas aeruginosa PA01
cuugccgaccuucaucaggcgg

SEQ ID NO: 3415526 - RNA, 18 nt, Pseudomonas aeruginosa PA01
cuugccgacgccgcggcc

SEQ ID NO: 3415527 - RNA, 14 nt, Pseudomonas aeruginosa PA01
cuugccgagcgcga

SEQ ID NO: 3415528 - RNA, 20 nt, Pseudomonas aeruginosa PA01
cuugccgagcgcgaucagcc

SEQ ID NO: 3415529 - RNA, 14 nt, Pseudomonas aeruginosa PA01
cuugccgagcuggg

SEQ ID NO: 3415530 - RNA, 15 nt, Pseudomonas aeruginosa PA01
cuugccgagcugggc

SEQ ID NO: 3415531 - RNA, 21 nt, Pseudomonas aeruginosa PA01
cuugccgaucaugggggccag

SEQ ID NO: 3415532 - RNA, 18 nt, Pseudomonas aeruginosa PA01
cuugccgaugucgccggc

SEQ ID NO: 3415533 - RNA, 21 nt, Pseudomonas aeruginosa PA01
cuugccgaugucgccggcaug

SEQ ID NO: 3415534 - RNA, 17 nt, Pseudomonas aeruginosa PA01
cuugccgcacaguugcg

SEQ ID NO: 3415535 - RNA, 18 nt, Pseudomonas aeruginosa PA01
cuugccgcaggucuuguc

SEQ ID NO: 3415536 - RNA, 13 nt, Pseudomonas aeruginosa PA01
cuugccgccgccg

SEQ ID NO: 3415537 - RNA, 22 nt, Pseudomonas aeruginosa PA01
cuugccgcgagcuuggcccugg

SEQ ID NO: 3415538 - RNA, 15 nt, Pseudomonas aeruginosa PA01
cuugccgcgcccggc

SEQ ID NO: 3415539 - RNA, 17 nt, Pseudomonas aeruginosa PA01
cuugccgcgcccggcca

SEQ ID NO: 3415540 - RNA, 19 nt, Pseudomonas aeruginosa PA01
cuugccgcgcccggccagg

SEQ ID NO: 3415541 - RNA, 20 nt, Pseudomonas aeruginosa PA01
cuugccgcgcccggccaggc

SEQ ID NO: 3415542 - RNA, 19 nt, Pseudomonas aeruginosa PA01
cuugccgcucaggcugugc

SEQ ID NO: 3415543 - RNA, 16 nt, Pseudomonas aeruginosa PA01
cuugccgcugcgcauc

SEQ ID NO: 3415544 - RNA, 21 nt, Pseudomonas aeruginosa PA01
cuugccgcuggugaucgacca

SEQ ID NO: 3415545 - RNA, 18 nt, Pseudomonas aeruginosa PA01
cuugccggaaagcaguuc

SEQ ID NO: 3415546 - RNA, 11 nt, Pseudomonas aeruginosa PA01
cuugccggcau

SEQ ID NO: 3415547 - RNA, 13 nt, Pseudomonas aeruginosa PA01
cuugccggcaucg

SEQ ID NO: 3415548 - RNA, 12 nt, Pseudomonas aeruginosa PA01
cuugccggcgcc

SEQ ID NO: 3415549 - RNA, 14 nt, Pseudomonas aeruginosa PA01
cuugccggcgccau

SEQ ID NO: 3415550 - RNA, 13 nt, Pseudomonas aeruginosa PA01
cuugccggcgcgc

SEQ ID NO: 3415551 - RNA, 16 nt, Pseudomonas aeruginosa PA01
cuugccggcggcgcug

SEQ ID NO: 3415552 - RNA, 16 nt, Pseudomonas aeruginosa PA01
cuugccgguaucgcgc

SEQ ID NO: 3415553 - RNA, 17 nt, Pseudomonas aeruginosa PA01
cuugccgguaucgcgcu

SEQ ID NO: 3415554 - RNA, 16 nt, Pseudomonas aeruginosa PA01
cuugccggucugcugc

SEQ ID NO: 3415555 - RNA, 17 nt, Pseudomonas aeruginosa PA01
cuugccggucugcugcg

SEQ ID NO: 3415556 - RNA, 21 nt, Pseudomonas aeruginosa PA01
cuugccggucugcugcgcgca

SEQ ID NO: 3415557 - RNA, 23 nt, Pseudomonas aeruginosa PA01
cuugccggucugcugcgcgcacc

SEQ ID NO: 3415558 - RNA, 19 nt, Pseudomonas aeruginosa PA01
cuugccggugcggucguug

SEQ ID NO: 3415559 - RNA, 14 nt, Pseudomonas aeruginosa PA01
cuugccguccagcc

SEQ ID NO: 3415560 - RNA, 17 nt, Pseudomonas aeruginosa PA01
cuugccguccagccggc

SEQ ID NO: 3415561 - RNA, 19 nt, Pseudomonas aeruginosa PA01
cuugccguccagccggcgc

SEQ ID NO: 3415562 - RNA, 15 nt, Pseudomonas aeruginosa PA01
cuugccguccagcga

SEQ ID NO: 3415563 - RNA, 18 nt, Pseudomonas aeruginosa PA01
cuugccgucgguguccgc

SEQ ID NO: 3415564 - RNA, 18 nt, Pseudomonas aeruginosa PA01
cuugccguggcuccugga

SEQ ID NO: 3415565 - RNA, 20 nt, Pseudomonas aeruginosa PA01
cuugccguggcuccuggagg

SEQ ID NO: 3415566 - RNA, 14 nt, Pseudomonas aeruginosa PA01
cuugccguugcuca

SEQ ID NO: 3415567 - RNA, 16 nt, Pseudomonas aeruginosa PA01
cuugccguuggcgucg

SEQ ID NO: 3415568 - RNA, 16 nt, Pseudomonas aeruginosa PA01
cuugccuuccaccggg

SEQ ID NO: 3415569 - RNA, 19 nt, Pseudomonas aeruginosa PA01
cuugccuuccaccgggaag

SEQ ID NO: 3415570 - RNA, 16 nt, Pseudomonas aeruginosa PA01
cuugccuuccaggcug

SEQ ID NO: 3415571 - RNA, 16 nt, Pseudomonas aeruginosa PA01
cuugcgaaaagcccgc

SEQ ID NO: 3415572 - RNA, 17 nt, Pseudomonas aeruginosa PA01
cuugcgaaaagcccgcc

SEQ ID NO: 3415573 - RNA, 13 nt, Pseudomonas aeruginosa PA01
cuugcgaucgagg

SEQ ID NO: 3415574 - RNA, 18 nt, Pseudomonas aeruginosa PA01
cuugcgcaccagggccag

SEQ ID NO: 3415575 - RNA, 21 nt, Pseudomonas aeruginosa PA01
cuugcgcaccagggccaggag

SEQ ID NO: 3415576 - RNA, 16 nt, Pseudomonas aeruginosa PA01
cuugcgcaccgcgccg

SEQ ID NO: 3415577 - RNA, 13 nt, Pseudomonas aeruginosa PA01
cuugcgcaggcgg

SEQ ID NO: 3415578 - RNA, 15 nt, Pseudomonas aeruginosa PA01
cuugcgcagggcggc

SEQ ID NO: 3415579 - RNA, 22 nt, Pseudomonas aeruginosa PA01
cuugcgcaugguuaccucguug

SEQ ID NO: 3415580 - RNA, 16 nt, Pseudomonas aeruginosa PA01
cuugcgccagagcagg

SEQ ID NO: 3415581 - RNA, 18 nt, Pseudomonas aeruginosa PA01
cuugcgccagagcaggcg

SEQ ID NO: 3415582 - RNA, 14 nt, Pseudomonas aeruginosa PA01
cuugcgccaggccc

SEQ ID NO: 3415583 - RNA, 18 nt, Pseudomonas aeruginosa PA01
cuugcgccaggcccggcg

SEQ ID NO: 3415584 - RNA, 15 nt, Pseudomonas aeruginosa PA01
cuugcgccaggccuu

SEQ ID NO: 3415585 - RNA, 14 nt, Pseudomonas aeruginosa PA01
cuugcgcccggcgc

SEQ ID NO: 3415586 - RNA, 13 nt, Pseudomonas aeruginosa PA01
cuugcgcccggcu

SEQ ID NO: 3415587 - RNA, 14 nt, Pseudomonas aeruginosa PA01
cuugcgcccggcuu

SEQ ID NO: 3415588 - RNA, 16 nt, Pseudomonas aeruginosa PA01
cuugcgcccggcuucg

SEQ ID NO: 3415589 - RNA, 17 nt, Pseudomonas aeruginosa PA01
cuugcgccgccucgcgc

SEQ ID NO: 3415590 - RNA, 18 nt, Pseudomonas aeruginosa PA01
cuugcgccggcugccgcg

SEQ ID NO: 3415591 - RNA, 15 nt, Pseudomonas aeruginosa PA01
cuugcgcgccaccag

SEQ ID NO: 3415592 - RNA, 14 nt, Pseudomonas aeruginosa PA01
cuugcgcgccgccg

SEQ ID NO: 3415593 - RNA, 15 nt, Pseudomonas aeruginosa PA01
cuugcgcgccgccgc

SEQ ID NO: 3415594 - RNA, 12 nt, Pseudomonas aeruginosa PA01
cuugcgcggcag

SEQ ID NO: 3415595 - RNA, 14 nt, Pseudomonas aeruginosa PA01
cuugcgcggcgccg

SEQ ID NO: 3415596 - RNA, 17 nt, Pseudomonas aeruginosa PA01
cuugcgcgugcuggugc

SEQ ID NO: 3415597 - RNA, 15 nt, Pseudomonas aeruginosa PA01
cuugcgcuccuuggc

SEQ ID NO: 3415598 - RNA, 19 nt, Pseudomonas aeruginosa PA01
cuugcgcuccuuggcuggc

SEQ ID NO: 3415599 - RNA, 18 nt, Pseudomonas aeruginosa PA01
cuugcgcucgagccggcu

SEQ ID NO: 3415600 - RNA, 19 nt, Pseudomonas aeruginosa PA01
cuugcgcucgagccggcug

SEQ ID NO: 3415601 - RNA, 13 nt, Pseudomonas aeruginosa PA01
cuugcgcucuggc

SEQ ID NO: 3415602 - RNA, 14 nt, Pseudomonas aeruginosa PA01
cuugcgcuggccgg

SEQ ID NO: 3415603 - RNA, 16 nt, Pseudomonas aeruginosa PA01
cuugcgcuggccggca

SEQ ID NO: 3415604 - RNA, 18 nt, Pseudomonas aeruginosa PA01
cuugcgcuggccggcaac

SEQ ID NO: 3415605 - RNA, 18 nt, Pseudomonas aeruginosa PA01
cuugcgcuguuccgccgu

SEQ ID NO: 3415606 - RNA, 18 nt, Pseudomonas aeruginosa PA01
cuugcggcaguccucgcc

SEQ ID NO: 3415607 - RNA, 19 nt, Pseudomonas aeruginosa PA01
cuugcggcaguccucgccg

SEQ ID NO: 3415608 - RNA, 18 nt, Pseudomonas aeruginosa PA01
cuugcggcccaccaccac

SEQ ID NO: 3415609 - RNA, 16 nt, Pseudomonas aeruginosa PA01
cuugcggcccgccucg

SEQ ID NO: 3415610 - RNA, 16 nt, Pseudomonas aeruginosa PA01
cuugcggcgccgaggc

SEQ ID NO: 3415611 - RNA, 14 nt, Pseudomonas aeruginosa PA01
cuugcggcgcggcc

SEQ ID NO: 3415612 - RNA, 17 nt, Pseudomonas aeruginosa PA01
cuugcggcgcggcccgu

SEQ ID NO: 3415613 - RNA, 20 nt, Pseudomonas aeruginosa PA01
cuugcggcgcggcccguccg

SEQ ID NO: 3415614 - RNA, 18 nt, Pseudomonas aeruginosa PA01
cuugcggucauccgccgg

SEQ ID NO: 3415615 - RNA, 19 nt, Pseudomonas aeruginosa PA01
cuugcggucauccgccggc

SEQ ID NO: 3415616 - RNA, 17 nt, Pseudomonas aeruginosa PA01
cuugcgguuauccgccg

SEQ ID NO: 3415617 - RNA, 18 nt, Pseudomonas aeruginosa PA01
cuugcgguuauccgccgc

SEQ ID NO: 3415618 - RNA, 23 nt, Pseudomonas aeruginosa PA01
cuugcgguuauccgccgccgggc

SEQ ID NO: 3415619 - RNA, 19 nt, Pseudomonas aeruginosa PA01
cuugcguaccagcgcgcag

SEQ ID NO: 3415620 - RNA, 16 nt, Pseudomonas aeruginosa PA01
cuugcguccugccucg

SEQ ID NO: 3415621 - RNA, 15 nt, Pseudomonas aeruginosa PA01
cuugcguuccuccuc

SEQ ID NO: 3415622 - RNA, 16 nt, Pseudomonas aeruginosa PA01
cuugcguucgcuccag

SEQ ID NO: 3415623 - RNA, 17 nt, Pseudomonas aeruginosa PA01
cuugcuacgggucaguc

SEQ ID NO: 3415624 - RNA, 23 nt, Pseudomonas aeruginosa PA01
cuugcuacgggucaguccuuguc

SEQ ID NO: 3415625 - RNA, 23 nt, Pseudomonas aeruginosa PA01
cuugcucgcggcguaggccucgg

SEQ ID NO: 3415626 - RNA, 18 nt, Pseudomonas aeruginosa PA01
cuugcugaagcccaggcg

SEQ ID NO: 3415627 - RNA, 21 nt, Pseudomonas aeruginosa PA01
cuugcugccggcguccuugcc

SEQ ID NO: 3415628 - RNA, 22 nt, Pseudomonas aeruginosa PA01
cuugcugccggcguccuugccg

SEQ ID NO: 3415629 - RNA, 14 nt, Pseudomonas aeruginosa PA01
cuugcuggcgcgau

SEQ ID NO: 3415630 - RNA, 18 nt, Pseudomonas aeruginosa PA01
cuugcuggcgcgauccgc

SEQ ID NO: 3415631 - RNA, 17 nt, Pseudomonas aeruginosa PA01
cuugcuguugccgcugc

SEQ ID NO: 3415632 - RNA, 22 nt, Pseudomonas aeruginosa PA01
cuugcuguugccgcugcaggcc

SEQ ID NO: 3415633 - RNA, 13 nt, Pseudomonas aeruginosa PA01
cuuggacagcguc

SEQ ID NO: 3415634 - RNA, 17 nt, Pseudomonas aeruginosa PA01
cuuggagcgggcgccgg

SEQ ID NO: 3415635 - RNA, 23 nt, Pseudomonas aeruginosa PA01
cuuggcaaucaucgcgucgccga

SEQ ID NO: 3415636 - RNA, 13 nt, Pseudomonas aeruginosa PA01
cuuggcaccgcgc

SEQ ID NO: 3415637 - RNA, 16 nt, Pseudomonas aeruginosa PA01
cuuggcaccgcgcagc

SEQ ID NO: 3415638 - RNA, 19 nt, Pseudomonas aeruginosa PA01
cuuggcacggccggcggug

SEQ ID NO: 3415639 - RNA, 21 nt, Pseudomonas aeruginosa PA01
cuuggccacgacccugcuggc

SEQ ID NO: 3415640 - RNA, 14 nt, Pseudomonas aeruginosa PA01
cuuggccacgcugc

SEQ ID NO: 3415641 - RNA, 18 nt, Pseudomonas aeruginosa PA01
cuuggccacguccuuggu

SEQ ID NO: 3415642 - RNA, 17 nt, Pseudomonas aeruginosa PA01
cuuggccagcagcaucg

SEQ ID NO: 3415643 - RNA, 14 nt, Pseudomonas aeruginosa PA01
cuuggccagcaggc

SEQ ID NO: 3415644 - RNA, 19 nt, Pseudomonas aeruginosa PA01
cuuggccagcccuuucagc

SEQ ID NO: 3415645 - RNA, 14 nt, Pseudomonas aeruginosa PA01
cuuggccagccgcg

SEQ ID NO: 3415646 - RNA, 15 nt, Pseudomonas aeruginosa PA01
cuuggccagcgcggc

SEQ ID NO: 3415647 - RNA, 16 nt, Pseudomonas aeruginosa PA01
cuuggccagcgcggcg

SEQ ID NO: 3415648 - RNA, 21 nt, Pseudomonas aeruginosa PA01
cuuggccagcgcggugcgcgc

SEQ ID NO: 3415649 - RNA, 21 nt, Pseudomonas aeruginosa PA01
cuuggccaggucgcgcagggc

SEQ ID NO: 3415650 - RNA, 15 nt, Pseudomonas aeruginosa PA01
cuuggccauggcgcu

SEQ ID NO: 3415651 - RNA, 19 nt, Pseudomonas aeruginosa PA01
cuuggccaugggcacgccg

SEQ ID NO: 3415652 - RNA, 17 nt, Pseudomonas aeruginosa PA01
cuuggcccugcgcgcgc

SEQ ID NO: 3415653 - RNA, 19 nt, Pseudomonas aeruginosa PA01
cuuggccuccggacgcugc

SEQ ID NO: 3415654 - RNA, 21 nt, Pseudomonas aeruginosa PA01
cuuggccuccggacgcugcau

SEQ ID NO: 3415655 - RNA, 19 nt, Pseudomonas aeruginosa PA01
cuuggccuugccguccagc

SEQ ID NO: 3415656 - RNA, 22 nt, Pseudomonas aeruginosa PA01
cuuggcgaaaucgagcugcucg

SEQ ID NO: 3415657 - RNA, 16 nt, Pseudomonas aeruginosa PA01
cuuggcgaggcgcgcc

SEQ ID NO: 3415658 - RNA, 19 nt, Pseudomonas aeruginosa PA01
cuuggcgaggcgcgccugg

SEQ ID NO: 3415659 - RNA, 17 nt, Pseudomonas aeruginosa PA01
cuuggcgauguucaccg

SEQ ID NO: 3415660 - RNA, 12 nt, Pseudomonas aeruginosa PA01
cuuggcgcaggu

SEQ ID NO: 3415661 - RNA, 20 nt, Pseudomonas aeruginosa PA01
cuuggcgcagguagucgcuc

SEQ ID NO: 3415662 - RNA, 19 nt, Pseudomonas aeruginosa PA01
cuuggcgcgacugucgagc

SEQ ID NO: 3415663 - RNA, 19 nt, Pseudomonas aeruginosa PA01
cuuggcgcgcagggcaucg

SEQ ID NO: 3415664 - RNA, 22 nt, Pseudomonas aeruginosa PA01
cuuggcgcgcagggcaucgaug

SEQ ID NO: 3415665 - RNA, 18 nt, Pseudomonas aeruginosa PA01
cuuggcgcgcgacagaua

SEQ ID NO: 3415666 - RNA, 23 nt, Pseudomonas aeruginosa PA01
cuuggcgcgcgacagauagcagg

SEQ ID NO: 3415667 - RNA, 15 nt, Pseudomonas aeruginosa PA01
cuuggcgcgcuggca

SEQ ID NO: 3415668 - RNA, 16 nt, Pseudomonas aeruginosa PA01
cuuggcggcgaucgcc

SEQ ID NO: 3415669 - RNA, 14 nt, Pseudomonas aeruginosa PA01
cuuggcggcgccau

SEQ ID NO: 3415670 - RNA, 19 nt, Pseudomonas aeruginosa PA01
cuuggcgggcucgcccauc

SEQ ID NO: 3415671 - RNA, 21 nt, Pseudomonas aeruginosa PA01
cuuggcggucagcgacuggcc

SEQ ID NO: 3415672 - RNA, 23 nt, Pseudomonas aeruginosa PA01
cuuggcggucagcgacuggcccu

SEQ ID NO: 3415673 - RNA, 17 nt, Pseudomonas aeruginosa PA01
cuuggcuuccuggcgcc

SEQ ID NO: 3415674 - RNA, 16 nt, Pseudomonas aeruginosa PA01
cuugggaucggcgauc

SEQ ID NO: 3415675 - RNA, 16 nt, Pseudomonas aeruginosa PA01
cuugggcgccucgccg

SEQ ID NO: 3415676 - RNA, 21 nt, Pseudomonas aeruginosa PA01
cuugggcgccucgccgcggca

SEQ ID NO: 3415677 - RNA, 15 nt, Pseudomonas aeruginosa PA01
cuuggucacgccguu

SEQ ID NO: 3415678 - RNA, 19 nt, Pseudomonas aeruginosa PA01
cuuggucacgccguucagg

SEQ ID NO: 3415679 - RNA, 21 nt, Pseudomonas aeruginosa PA01
cuuggucacgccguucagggu

SEQ ID NO: 3415680 - RNA, 23 nt, Pseudomonas aeruginosa PA01
cuuggucaggccgaccagcgccg

SEQ ID NO: 3415681 - RNA, 13 nt, Pseudomonas aeruginosa PA01
cuuggucagggug

SEQ ID NO: 3415682 - RNA, 14 nt, Pseudomonas aeruginosa PA01
cuuggucaggucga

SEQ ID NO: 3415683 - RNA, 14 nt, Pseudomonas aeruginosa PA01
cuuggucaucaccu

SEQ ID NO: 3415684 - RNA, 13 nt, Pseudomonas aeruginosa PA01
cuuggucgcgguc

SEQ ID NO: 3415685 - RNA, 13 nt, Pseudomonas aeruginosa PA01
cuuggucgggcgc

SEQ ID NO: 3415686 - RNA, 16 nt, Pseudomonas aeruginosa PA01
cuuggucucgaucagc

SEQ ID NO: 3415687 - RNA, 15 nt, Pseudomonas aeruginosa PA01
cuugguguagccgag

SEQ ID NO: 3415688 - RNA, 18 nt, Pseudomonas aeruginosa PA01
cuugguguagccgagcac

SEQ ID NO: 3415689 - RNA, 16 nt, Pseudomonas aeruginosa PA01
cuuggugucggccgcc

SEQ ID NO: 3415690 - RNA, 17 nt, Pseudomonas aeruginosa PA01
cuuguacagggcgcgga

SEQ ID NO: 3415691 - RNA, 15 nt, Pseudomonas aeruginosa PA01
cuuguacucgccggu

SEQ ID NO: 3415692 - RNA, 15 nt, Pseudomonas aeruginosa PA01
cuuguagcagccgca

SEQ ID NO: 3415693 - RNA, 22 nt, Pseudomonas aeruginosa PA01
cuuguaguagcgcccgacgaaa

SEQ ID NO: 3415694 - RNA, 19 nt, Pseudomonas aeruginosa PA01
cuuguauaccagcggcugg

SEQ ID NO: 3415695 - RNA, 13 nt, Pseudomonas aeruginosa PA01
cuuguccaccacc

SEQ ID NO: 3415696 - RNA, 16 nt, Pseudomonas aeruginosa PA01
cuuguccaccaccgac

SEQ ID NO: 3415697 - RNA, 17 nt, Pseudomonas aeruginosa PA01
cuuguccacgucguagg

SEQ ID NO: 3415698 - RNA, 13 nt, Pseudomonas aeruginosa PA01
cuuguccaggcgc

SEQ ID NO: 3415699 - RNA, 18 nt, Pseudomonas aeruginosa PA01
cuuguccaggcgcugcuc

SEQ ID NO: 3415700 - RNA, 14 nt, Pseudomonas aeruginosa PA01
cuuguccgagaccg

SEQ ID NO: 3415701 - RNA, 17 nt, Pseudomonas aeruginosa PA01
cuuguccgagaccggca

SEQ ID NO: 3415702 - RNA, 18 nt, Pseudomonas aeruginosa PA01
cuuguccgcgcgcuucca

SEQ ID NO: 3415703 - RNA, 13 nt, Pseudomonas aeruginosa PA01
cuuguccggcccg

SEQ ID NO: 3415704 - RNA, 15 nt, Pseudomonas aeruginosa PA01
cuuguccggcccgga

SEQ ID NO: 3415705 - RNA, 21 nt, Pseudomonas aeruginosa PA01
cuuguccucaucggggcugcu

SEQ ID NO: 3415706 - RNA, 15 nt, Pseudomonas aeruginosa PA01
cuuguccuccagcug

SEQ ID NO: 3415707 - RNA, 17 nt, Pseudomonas aeruginosa PA01
cuuguccuccagcugcg

SEQ ID NO: 3415708 - RNA, 23 nt, Pseudomonas aeruginosa PA01
cuuguccuccagcugcgccugca

SEQ ID NO: 3415709 - RNA, 18 nt, Pseudomonas aeruginosa PA01
cuuguccugcggccgggu

SEQ ID NO: 3415710 - RNA, 20 nt, Pseudomonas aeruginosa PA01
cuuguccuggauaagccgcg

SEQ ID NO: 3415711 - RNA, 21 nt, Pseudomonas aeruginosa PA01
cuuguccuggauaagccgcgc

SEQ ID NO: 3415712 - RNA, 17 nt, Pseudomonas aeruginosa PA01
cuuguccuucggccagu

SEQ ID NO: 3415713 - RNA, 12 nt, Pseudomonas aeruginosa PA01
cuuguccuuggc

SEQ ID NO: 3415714 - RNA, 15 nt, Pseudomonas aeruginosa PA01
cuuguccuuggccuc

SEQ ID NO: 3415715 - RNA, 14 nt, Pseudomonas aeruginosa PA01
cuugucgaccagcg

SEQ ID NO: 3415716 - RNA, 17 nt, Pseudomonas aeruginosa PA01
cuugucgaccagcggcg

SEQ ID NO: 3415717 - RNA, 15 nt, Pseudomonas aeruginosa PA01
cuugucgauggucag

SEQ ID NO: 3415718 - RNA, 16 nt, Pseudomonas aeruginosa PA01
cuugucgauggucagg

SEQ ID NO: 3415719 - RNA, 18 nt, Pseudomonas aeruginosa PA01
cuugucgauggucaggau

SEQ ID NO: 3415720 - RNA, 19 nt, Pseudomonas aeruginosa PA01
cuugucgauggucaggauc

SEQ ID NO: 3415721 - RNA, 22 nt, Pseudomonas aeruginosa PA01
cuugucgcagcggccguagcag

SEQ ID NO: 3415722 - RNA, 14 nt, Pseudomonas aeruginosa PA01
cuugucgccgguga

SEQ ID NO: 3415723 - RNA, 16 nt, Pseudomonas aeruginosa PA01
cuugucgccggugagg

SEQ ID NO: 3415724 - RNA, 22 nt, Pseudomonas aeruginosa PA01
cuugugcugcucgcagagggcg

SEQ ID NO: 3415725 - RNA, 20 nt, Pseudomonas aeruginosa PA01
cuuguggccgaucuccuggu

SEQ ID NO: 3415726 - RNA, 14 nt, Pseudomonas aeruginosa PA01
cuuguggccggucu

SEQ ID NO: 3415727 - RNA, 19 nt, Pseudomonas aeruginosa PA01
cuugugggcaugcucggcc

SEQ ID NO: 3415728 - RNA, 15 nt, Pseudomonas aeruginosa PA01
cuuguguccgccgag

SEQ ID NO: 3415729 - RNA, 19 nt, Pseudomonas aeruginosa PA01
cuuguucaggguggcgacc

SEQ ID NO: 3415730 - RNA, 19 nt, Pseudomonas aeruginosa PA01
cuuguucggcuggaccucc

SEQ ID NO: 3415731 - RNA, 22 nt, Pseudomonas aeruginosa PA01
cuuguugacguucugcccgccg

SEQ ID NO: 3415732 - RNA, 15 nt, Pseudomonas aeruginosa PA01
cuuguugagcuggcc

SEQ ID NO: 3415733 - RNA, 22 nt, Pseudomonas aeruginosa PA01
cuuguugcgcuccacccaggcg

SEQ ID NO: 3415734 - RNA, 23 nt, Pseudomonas aeruginosa PA01
cuuuauccacgcgguuccacucc

SEQ ID NO: 3415735 - RNA, 13 nt, Pseudomonas aeruginosa PA01
cuuucagcgccgc

SEQ ID NO: 3415736 - RNA, 15 nt, Pseudomonas aeruginosa PA01
cuuucagcggcugcc

SEQ ID NO: 3415737 - RNA, 19 nt, Pseudomonas aeruginosa PA01
cuuucagguccuugaucac

SEQ ID NO: 3415738 - RNA, 14 nt, Pseudomonas aeruginosa PA01
cuuucaggugggcc

SEQ ID NO: 3415739 - RNA, 22 nt, Pseudomonas aeruginosa PA01
cuuuccacccgaaagccgaagc

SEQ ID NO: 3415740 - RNA, 15 nt, Pseudomonas aeruginosa PA01
cuuuccaccgccagc

SEQ ID NO: 3415741 - RNA, 15 nt, Pseudomonas aeruginosa PA01
cuuuccagcccggcg

SEQ ID NO: 3415742 - RNA, 14 nt, Pseudomonas aeruginosa PA01
cuuuccaggcgccg

SEQ ID NO: 3415743 - RNA, 15 nt, Pseudomonas aeruginosa PA01
cuuuccgaagccccg

SEQ ID NO: 3415744 - RNA, 22 nt, Pseudomonas aeruginosa PA01
cuuuccgaagccccggaccggc

SEQ ID NO: 3415745 - RNA, 23 nt, Pseudomonas aeruginosa PA01
cuuuccggcccacgcucagugcg

SEQ ID NO: 3415746 - RNA, 16 nt, Pseudomonas aeruginosa PA01
cuuuccggcgcggccu

SEQ ID NO: 3415747 - RNA, 20 nt, Pseudomonas aeruginosa PA01
cuuuccggcgcggccugcag

SEQ ID NO: 3415748 - RNA, 24 nt, Pseudomonas aeruginosa PA01
cuuuccggcgcggccugcagcgac

SEQ ID NO: 3415749 - RNA, 20 nt, Pseudomonas aeruginosa PA01
cuuuccggcuugaccgccgc

SEQ ID NO: 3415750 - RNA, 23 nt, Pseudomonas aeruginosa PA01
cuuuccgucucaggcgccaggcc

SEQ ID NO: 3415751 - RNA, 14 nt, Pseudomonas aeruginosa PA01
cuuuccucaucucc

SEQ ID NO: 3415752 - RNA, 17 nt, Pseudomonas aeruginosa PA01
cuuuccugcgccucguc

SEQ ID NO: 3415753 - RNA, 16 nt, Pseudomonas aeruginosa PA01
cuuuccugcuccagca

SEQ ID NO: 3415754 - RNA, 18 nt, Pseudomonas aeruginosa PA01
cuuuccuggccgacccgc

SEQ ID NO: 3415755 - RNA, 17 nt, Pseudomonas aeruginosa PA01
cuuucggaacagcgccu

SEQ ID NO: 3415756 - RNA, 22 nt, Pseudomonas aeruginosa PA01
cuuucggggugcaggggcgcag

SEQ ID NO: 3415757 - RNA, 17 nt, Pseudomonas aeruginosa PA01
cuuucguuucagcgcca

SEQ ID NO: 3415758 - RNA, 14 nt, Pseudomonas aeruginosa PA01
cuuucugcccggcu

SEQ ID NO: 3415759 - RNA, 16 nt, Pseudomonas aeruginosa PA01
cuuucugcccggcuuc

SEQ ID NO: 3415760 - RNA, 15 nt, Pseudomonas aeruginosa PA01
cuuucuucugcugug

SEQ ID NO: 3415761 - RNA, 18 nt, Pseudomonas aeruginosa PA01
cuuugaccuuggacuugu

SEQ ID NO: 3415762 - RNA, 20 nt, Pseudomonas aeruginosa PA01
cuuugagggucagaccagcc

SEQ ID NO: 3415763 - RNA, 12 nt, Pseudomonas aeruginosa PA01
cuuugccugaug

SEQ ID NO: 3415764 - RNA, 11 nt, Pseudomonas aeruginosa PA01
cuuugccugga

SEQ ID NO: 3415765 - RNA, 13 nt, Pseudomonas aeruginosa PA01
cuuugccuggaaa

SEQ ID NO: 3415766 - RNA, 16 nt, Pseudomonas aeruginosa PA01
cuuugccuggaaaaag

SEQ ID NO: 3415767 - RNA, 18 nt, Pseudomonas aeruginosa PA01
cuuugccuggaaaaagac

SEQ ID NO: 3415768 - RNA, 19 nt, Pseudomonas aeruginosa PA01
cuuugcgcagccacccgcu

SEQ ID NO: 3415769 - RNA, 20 nt, Pseudomonas aeruginosa PA01
cuuugcgcagccacccgcuc

SEQ ID NO: 3415770 - RNA, 14 nt, Pseudomonas aeruginosa PA01
cuuugggagcagga

SEQ ID NO: 3415771 - RNA, 23 nt, Pseudomonas aeruginosa PA01
cuuuucaauuccgccgcggcaau

SEQ ID NO: 3415772 - RNA, 17 nt, Pseudomonas aeruginosa PA01
cuuuuccaccggccgcg

SEQ ID NO: 3415773 - RNA, 20 nt, Pseudomonas aeruginosa PA01
cuuuucccgcaccggcgcgc

SEQ ID NO: 3415774 - RNA, 21 nt, Pseudomonas aeruginosa PA01
cuccaugcgggagagcgccgu

SEQ ID NO: 3415775 - RNA, 17 nt, Pseudomonas aeruginosa PA01
cuccauuagcgucgcgc

SEQ ID NO: 3415776 - RNA, 18 nt, Pseudomonas aeruginosa PA01
cuccauuagcgucgcgcg

SEQ ID NO: 3415777 - RNA, 22 nt, Pseudomonas aeruginosa PA01
cucccaacagucgucgcgcagc

SEQ ID NO: 3415778 - RNA, 20 nt, Pseudomonas aeruginosa PA01
cucccaacuggucuugccga

SEQ ID NO: 3415779 - RNA, 21 nt, Pseudomonas aeruginosa PA01
cucccaccgcuuucagcgccg

SEQ ID NO: 3415780 - RNA, 19 nt, Pseudomonas aeruginosa PA01
cucccagaagucgcuggcc

SEQ ID NO: 3415781 - RNA, 22 nt, Pseudomonas aeruginosa PA01
cucccagccacagaggucgcug

SEQ ID NO: 3415782 - RNA, 21 nt, Pseudomonas aeruginosa PA01
cucccaggcgucgccgacuuc

SEQ ID NO: 3415783 - RNA, 15 nt, Pseudomonas aeruginosa PA01
cucccaggcuggcgg

SEQ ID NO: 3415784 - RNA, 16 nt, Pseudomonas aeruginosa PA01
cucccaggcuggcggc

SEQ ID NO: 3415785 - RNA, 22 nt, Pseudomonas aeruginosa PA01
cucccagugcgagucggcgacg

SEQ ID NO: 3415786 - RNA, 23 nt, Pseudomonas aeruginosa PA01
cucccagugcgagucggcgacga

SEQ ID NO: 3415787 - RNA, 20 nt, Pseudomonas aeruginosa PA01
cucccaugaaaaauggccgc

SEQ ID NO: 3415788 - RNA, 15 nt, Pseudomonas aeruginosa PA01
cuccccacucggcca

SEQ ID NO: 3415789 - RNA, 19 nt, Pseudomonas aeruginosa PA01
cuccccagacccucucccu

SEQ ID NO: 3415790 - RNA, 16 nt, Pseudomonas aeruginosa PA01
cuccccagcaggcagg

SEQ ID NO: 3415791 - RNA, 18 nt, Pseudomonas aeruginosa PA01
cucccccacguacuccag

SEQ ID NO: 3415792 - RNA, 15 nt, Pseudomonas aeruginosa PA01
cucccccagcgggcg

SEQ ID NO: 3415793 - RNA, 21 nt, Pseudomonas aeruginosa PA01
cucccccagcgggcggucgcg

SEQ ID NO: 3415794 - RNA, 17 nt, Pseudomonas aeruginosa PA01
cucccccgcgccgccgg

SEQ ID NO: 3415795 - RNA, 12 nt, Pseudomonas aeruginosa PA01
cucccccucuuc

SEQ ID NO: 3415796 - RNA, 20 nt, Pseudomonas aeruginosa PA01
cucccccucuucggagcgag

SEQ ID NO: 3415797 - RNA, 16 nt, Pseudomonas aeruginosa PA01
cuccccgccgccaggc

SEQ ID NO: 3415798 - RNA, 11 nt, Pseudomonas aeruginosa PA01
cuccccgcucc

SEQ ID NO: 3415799 - RNA, 19 nt, Pseudomonas aeruginosa PA01
cuccccgcucccgcggccc

SEQ ID NO: 3415800 - RNA, 17 nt, Pseudomonas aeruginosa PA01
cuccccggcccgcgccg

SEQ ID NO: 3415801 - RNA, 18 nt, Pseudomonas aeruginosa PA01
cuccccggcccgcgccgc

SEQ ID NO: 3415802 - RNA, 13 nt, Pseudomonas aeruginosa PA01
cuccccgucccuc

SEQ ID NO: 3415803 - RNA, 19 nt, Pseudomonas aeruginosa PA01
cuccccgucccucagguag

SEQ ID NO: 3415804 - RNA, 14 nt, Pseudomonas aeruginosa PA01
cuccccguccuggc

SEQ ID NO: 3415805 - RNA, 15 nt, Pseudomonas aeruginosa PA01
cuccccucaggcgcc

SEQ ID NO: 3415806 - RNA, 17 nt, Pseudomonas aeruginosa PA01
cuccccucaggcgccgc

SEQ ID NO: 3415807 - RNA, 18 nt, Pseudomonas aeruginosa PA01
cuccccugccgaaccgcc

SEQ ID NO: 3415808 - RNA, 17 nt, Pseudomonas aeruginosa PA01
cuccccugcuaagggag

SEQ ID NO: 3415809 - RNA, 19 nt, Pseudomonas aeruginosa PA01
cuccccuggaaugccggcc

SEQ ID NO: 3415810 - RNA, 21 nt, Pseudomonas aeruginosa PA01
cuccccuggaaugccggccgg

SEQ ID NO: 3415811 - RNA, 20 nt, Pseudomonas aeruginosa PA01
cuccccuguggucaggcgcc

SEQ ID NO: 3415812 - RNA, 23 nt, Pseudomonas aeruginosa PA01
cuccccuguggucaggcgccagg

SEQ ID NO: 3415813 - RNA, 17 nt, Pseudomonas aeruginosa PA01
cucccgaggcgaucgcc

SEQ ID NO: 3415814 - RNA, 20 nt, Pseudomonas aeruginosa PA01
cucccgaggcgaucgccgcg

SEQ ID NO: 3415815 - RNA, 20 nt, Pseudomonas aeruginosa PA01
cucccgaguucaccaccccg

SEQ ID NO: 3415816 - RNA, 16 nt, Pseudomonas aeruginosa PA01
cucccgcaaccugcca

SEQ ID NO: 3415817 - RNA, 17 nt, Pseudomonas aeruginosa PA01
cucccgcaaccugccag

SEQ ID NO: 3415818 - RNA, 23 nt, Pseudomonas aeruginosa PA01
cucccgcagauagggcaucagcc

SEQ ID NO: 3415819 - RNA, 14 nt, Pseudomonas aeruginosa PA01
cucccgcaggcgcu

SEQ ID NO: 3415820 - RNA, 19 nt, Pseudomonas aeruginosa PA01
cucccgcaggcgcuucagc

SEQ ID NO: 3415821 - RNA, 23 nt, Pseudomonas aeruginosa PA01
cucccgcaggcgcuucagcgccu

SEQ ID NO: 3415822 - RNA, 13 nt, Pseudomonas aeruginosa PA01
cucccgcgauucg

SEQ ID NO: 3415823 - RNA, 18 nt, Pseudomonas aeruginosa PA01
cucccgcgauucgccggg

SEQ ID NO: 3415824 - RNA, 19 nt, Pseudomonas aeruginosa PA01
cucccgcgauucgccgggc

SEQ ID NO: 3415825 - RNA, 18 nt, Pseudomonas aeruginosa PA01
cucccgcgccagcgccgc

SEQ ID NO: 3415826 - RNA, 19 nt, Pseudomonas aeruginosa PA01
cucccgcgccagcgccgcc

SEQ ID NO: 3415827 - RNA, 21 nt, Pseudomonas aeruginosa PA01
cucccgcgccagcgccgccag

SEQ ID NO: 3415828 - RNA, 14 nt, Pseudomonas aeruginosa PA01
cucccgcgccagcu

SEQ ID NO: 3415829 - RNA, 14 nt, Pseudomonas aeruginosa PA01
cucccggcucgccg

SEQ ID NO: 3415830 - RNA, 14 nt, Pseudomonas aeruginosa PA01
cucccggcugguca

SEQ ID NO: 3415831 - RNA, 16 nt, Pseudomonas aeruginosa PA01
cucccggcuggucaga

SEQ ID NO: 3415832 - RNA, 14 nt, Pseudomonas aeruginosa PA01
cucccgggccucuc

SEQ ID NO: 3415833 - RNA, 17 nt, Pseudomonas aeruginosa PA01
cucccuacgaugcuggc

SEQ ID NO: 3415834 - RNA, 13 nt, Pseudomonas aeruginosa PA01
cucccucgccgac

SEQ ID NO: 3415835 - RNA, 15 nt, Pseudomonas aeruginosa PA01
cucccugaagggaga

SEQ ID NO: 3415836 - RNA, 15 nt, Pseudomonas aeruginosa PA01
cucccugcucgcgca

SEQ ID NO: 3415837 - RNA, 14 nt, Pseudomonas aeruginosa PA01
cucccuucagggag

SEQ ID NO: 3415838 - RNA, 15 nt, Pseudomonas aeruginosa PA01
cucccuucagggaga

SEQ ID NO: 3415839 - RNA, 17 nt, Pseudomonas aeruginosa PA01
cucccuucagggagagg

SEQ ID NO: 3415840 - RNA, 15 nt, Pseudomonas aeruginosa PA01
cucccuugccgccgg

SEQ ID NO: 3415841 - RNA, 13 nt, Pseudomonas aeruginosa PA01
cuccgaagggaac

SEQ ID NO: 3415842 - RNA, 19 nt, Pseudomonas aeruginosa PA01
cuccgaagggaacccgcgg

SEQ ID NO: 3415843 - RNA, 22 nt, Pseudomonas aeruginosa PA01
cuccgaagggaacccgcggcgc

SEQ ID NO: 3415844 - RNA, 17 nt, Pseudomonas aeruginosa PA01
cuccgacgccccccacu

SEQ ID NO: 3415845 - RNA, 14 nt, Pseudomonas aeruginosa PA01
cuccgagacgcugc

SEQ ID NO: 3415846 - RNA, 17 nt, Pseudomonas aeruginosa PA01
cuccgagcaggccuugc

SEQ ID NO: 3415847 - RNA, 14 nt, Pseudomonas aeruginosa PA01
cuccgaggccacca

SEQ ID NO: 3415848 - RNA, 17 nt, Pseudomonas aeruginosa PA01
cuccgagggccgcgccg

SEQ ID NO: 3415849 - RNA, 18 nt, Pseudomonas aeruginosa PA01
cuccgagggccgcgccga

SEQ ID NO: 3415850 - RNA, 19 nt, Pseudomonas aeruginosa PA01
cuccgagggccgcgccgac

SEQ ID NO: 3415851 - RNA, 16 nt, Pseudomonas aeruginosa PA01
cuccgaguccugcugc

SEQ ID NO: 3415852 - RNA, 21 nt, Pseudomonas aeruginosa PA01
cuccgaugaagcaggcggagu

SEQ ID NO: 3415853 - RNA, 23 nt, Pseudomonas aeruginosa PA01
cuccgauggcgcuggaacagcgg

SEQ ID NO: 3415854 - RNA, 19 nt, Pseudomonas aeruginosa PA01
cuccgcaucuucugcgcgu

SEQ ID NO: 3415855 - RNA, 14 nt, Pseudomonas aeruginosa PA01
cuccgccagcacca

SEQ ID NO: 3415856 - RNA, 21 nt, Pseudomonas aeruginosa PA01
cuccgccagcaccacccggcc

SEQ ID NO: 3415857 - RNA, 13 nt, Pseudomonas aeruginosa PA01
cuccgccagccag

SEQ ID NO: 3415858 - RNA, 16 nt, Pseudomonas aeruginosa PA01
cuccgccagccagccg

SEQ ID NO: 3415859 - RNA, 22 nt, Pseudomonas aeruginosa PA01
cuccgccagccagccgcgcgcc

SEQ ID NO: 3415860 - RNA, 23 nt, Pseudomonas aeruginosa PA01
cuccgccagccagccgcgcgccg

SEQ ID NO: 3415861 - RNA, 19 nt, Pseudomonas aeruginosa PA01
cuccgccagccccaggccg

SEQ ID NO: 3415862 - RNA, 18 nt, Pseudomonas aeruginosa PA01
cuccgccaggaccuccug

SEQ ID NO: 3415863 - RNA, 20 nt, Pseudomonas aeruginosa PA01
cuccgccaggaccuccugca

SEQ ID NO: 3415864 - RNA, 13 nt, Pseudomonas aeruginosa PA01
cuccgccaggccg

SEQ ID NO: 3415865 - RNA, 17 nt, Pseudomonas aeruginosa PA01
cuccgccaggccgcgca

SEQ ID NO: 3415866 - RNA, 13 nt, Pseudomonas aeruginosa PA01
cuccgccaggucg

SEQ ID NO: 3415867 - RNA, 20 nt, Pseudomonas aeruginosa PA01
cuccgccaggucgaucccca

SEQ ID NO: 3415868 - RNA, 21 nt, Pseudomonas aeruginosa PA01
cuccgcccaguucuucgccgc

SEQ ID NO: 3415869 - RNA, 15 nt, Pseudomonas aeruginosa PA01
cuccgccccggcaag

SEQ ID NO: 3415870 - RNA, 20 nt, Pseudomonas aeruginosa PA01
cuccgccccggcaagcgccg

SEQ ID NO: 3415871 - RNA, 22 nt, Pseudomonas aeruginosa PA01
cuccgccccggcaagcgccggc

SEQ ID NO: 3415872 - RNA, 20 nt, Pseudomonas aeruginosa PA01
cuccgccgaacgccaccagg

SEQ ID NO: 3415873 - RNA, 14 nt, Pseudomonas aeruginosa PA01
cuccgccgccguga

SEQ ID NO: 3415874 - RNA, 13 nt, Pseudomonas aeruginosa PA01
cuccgccgcuucc

SEQ ID NO: 3415875 - RNA, 15 nt, Pseudomonas aeruginosa PA01
cuccgccgcuuccgc

SEQ ID NO: 3415876 - RNA, 13 nt, Pseudomonas aeruginosa PA01
cuccgccgggggu

SEQ ID NO: 3415877 - RNA, 18 nt, Pseudomonas aeruginosa PA01
cuccgccggggguguuga

SEQ ID NO: 3415878 - RNA, 22 nt, Pseudomonas aeruginosa PA01
cuccgccggggguguugaaagc

SEQ ID NO: 3415879 - RNA, 14 nt, Pseudomonas aeruginosa PA01
cuccgccucgaucu

SEQ ID NO: 3415880 - RNA, 15 nt, Pseudomonas aeruginosa PA01
cuccgccugaccgcu

SEQ ID NO: 3415881 - RNA, 16 nt, Pseudomonas aeruginosa PA01
cuccgccugaccgcug

SEQ ID NO: 3415882 - RNA, 17 nt, Pseudomonas aeruginosa PA01
cuccgccugcacgucgg

SEQ ID NO: 3415883 - RNA, 14 nt, Pseudomonas aeruginosa PA01
cuccgccuggcgga

SEQ ID NO: 3415884 - RNA, 21 nt, Pseudomonas aeruginosa PA01
cuccgccuggcggauaucgcg

SEQ ID NO: 3415885 - RNA, 19 nt, Pseudomonas aeruginosa PA01
cuccgcgauguccccggcc

SEQ ID NO: 3415886 - RNA, 22 nt, Pseudomonas aeruginosa PA01
cuccgcgauguccccggccagc

SEQ ID NO: 3415887 - RNA, 23 nt, Pseudomonas aeruginosa PA01
cuccgcgauguccccggccagca

SEQ ID NO: 3415888 - RNA, 20 nt, Pseudomonas aeruginosa PA01
cuccgcgccgggcuggccgu

SEQ ID NO: 3415889 - RNA, 22 nt, Pseudomonas aeruginosa PA01
cuccgcgccgggcuggccgucg

SEQ ID NO: 3415890 - RNA, 15 nt, Pseudomonas aeruginosa PA01
cuccgcggccggcuu

SEQ ID NO: 3415891 - RNA, 16 nt, Pseudomonas aeruginosa PA01
cuccgcggccggcuuc

SEQ ID NO: 3415892 - RNA, 19 nt, Pseudomonas aeruginosa PA01
cuccgcggccggcuucagc

SEQ ID NO: 3415893 - RNA, 18 nt, Pseudomonas aeruginosa PA01
cuccgcguguucgcggcu

SEQ ID NO: 3415894 - RNA, 22 nt, Pseudomonas aeruginosa PA01
cuccgcucagucgaccgucgcc

SEQ ID NO: 3415895 - RNA, 15 nt, Pseudomonas aeruginosa PA01
cuccgcucugcuggc

SEQ ID NO: 3415896 - RNA, 18 nt, Pseudomonas aeruginosa PA01
cuccgcucugcuggccac

SEQ ID NO: 3415897 - RNA, 21 nt, Pseudomonas aeruginosa PA01
cuccgcucugcuggccacccu

SEQ ID NO: 3415898 - RNA, 14 nt, Pseudomonas aeruginosa PA01
cuccgcuuccgccc

SEQ ID NO: 3415899 - RNA, 14 nt, Pseudomonas aeruginosa PA01
cuccggaacgccug

SEQ ID NO: 3415900 - RNA, 18 nt, Pseudomonas aeruginosa PA01
cuccggaacgccugcauc

SEQ ID NO: 3415901 - RNA, 12 nt, Pseudomonas aeruginosa PA01
cuccggacgccg

SEQ ID NO: 3415902 - RNA, 13 nt, Pseudomonas aeruginosa PA01
cuccggacgccga

SEQ ID NO: 3415903 - RNA, 14 nt, Pseudomonas aeruginosa PA01
cuccggacugccga

SEQ ID NO: 3415904 - RNA, 16 nt, Pseudomonas aeruginosa PA01
cuccggacugccgaug

SEQ ID NO: 3415905 - RNA, 14 nt, Pseudomonas aeruginosa PA01
cuccggaggcgcac

SEQ ID NO: 3415906 - RNA, 14 nt, Pseudomonas aeruginosa PA01
cuccggauggcuga

SEQ ID NO: 3415907 - RNA, 18 nt, Pseudomonas aeruginosa PA01
cuccggauggcugacccg

SEQ ID NO: 3415908 - RNA, 20 nt, Pseudomonas aeruginosa PA01
cuccggauggcugacccgcu

SEQ ID NO: 3415909 - RNA, 21 nt, Pseudomonas aeruginosa PA01
cuccggauggcugacccgcug

SEQ ID NO: 3415910 - RNA, 14 nt, Pseudomonas aeruginosa PA01
cuccggcacgcugc

SEQ ID NO: 3415911 - RNA, 18 nt, Pseudomonas aeruginosa PA01
cuccggcacgcugccgcc

SEQ ID NO: 3415912 - RNA, 13 nt, Pseudomonas aeruginosa PA01
cuccggcagcagg

SEQ ID NO: 3415913 - RNA, 13 nt, Pseudomonas aeruginosa PA01
cuccggcagcguc

SEQ ID NO: 3415914 - RNA, 22 nt, Pseudomonas aeruginosa PA01
cuccggcaggcgcuccuggugc

SEQ ID NO: 3415915 - RNA, 19 nt, Pseudomonas aeruginosa PA01
cuccggcauaccgcccguc

SEQ ID NO: 3415916 - RNA, 17 nt, Pseudomonas aeruginosa PA01
cuccggcgcagcccagc

SEQ ID NO: 3415917 - RNA, 18 nt, Pseudomonas aeruginosa PA01
cuccggcgcagcccagcc

SEQ ID NO: 3415918 - RNA, 19 nt, Pseudomonas aeruginosa PA01
cuccggcgcagcccagccg

SEQ ID NO: 3415919 - RNA, 14 nt, Pseudomonas aeruginosa PA01
cuccggcgccaggc

SEQ ID NO: 3415920 - RNA, 17 nt, Pseudomonas aeruginosa PA01
cuccggcgccaggcccu

SEQ ID NO: 3415921 - RNA, 17 nt, Pseudomonas aeruginosa PA01
cuccggcgccaggccgg

SEQ ID NO: 3415922 - RNA, 21 nt, Pseudomonas aeruginosa PA01
cuccggcgccaggccggagcc

SEQ ID NO: 3415923 - RNA, 23 nt, Pseudomonas aeruginosa PA01
cuccggcgccaggccggagccgc

SEQ ID NO: 3415924 - RNA, 12 nt, Pseudomonas aeruginosa PA01
cuccggcgccgg

SEQ ID NO: 3415925 - RNA, 15 nt, Pseudomonas aeruginosa PA01
cuccggcgccgggcu

SEQ ID NO: 3415926 - RNA, 21 nt, Pseudomonas aeruginosa PA01
cuccggcgccgggcuguagug

SEQ ID NO: 3415927 - RNA, 16 nt, Pseudomonas aeruginosa PA01
cuccggcgcguuggcu

SEQ ID NO: 3415928 - RNA, 19 nt, Pseudomonas aeruginosa PA01
cuccggcgcguuggcuggc

SEQ ID NO: 3415929 - RNA, 14 nt, Pseudomonas aeruginosa PA01
cuccggcucucccc

SEQ ID NO: 3415930 - RNA, 15 nt, Pseudomonas aeruginosa PA01
cuccggcucuccccg

SEQ ID NO: 3415931 - RNA, 16 nt, Pseudomonas aeruginosa PA01
cuccggcucuccccgc

SEQ ID NO: 3415932 - RNA, 15 nt, Pseudomonas aeruginosa PA01
cuccgggaacagccc

SEQ ID NO: 3415933 - RNA, 16 nt, Pseudomonas aeruginosa PA01
cuccgggaacagcccg

SEQ ID NO: 3415934 - RNA, 19 nt, Pseudomonas aeruginosa PA01
cuccgggaacagcccgucg

SEQ ID NO: 3415935 - RNA, 18 nt, Pseudomonas aeruginosa PA01
cuccgggcagaccagcag

SEQ ID NO: 3415936 - RNA, 21 nt, Pseudomonas aeruginosa PA01
cuccgggcagaccagcagcgc

SEQ ID NO: 3415937 - RNA, 13 nt, Pseudomonas aeruginosa PA01
cuccgggccgagg

SEQ ID NO: 3415938 - RNA, 20 nt, Pseudomonas aeruginosa PA01
cuccgggccgagggcugaga

SEQ ID NO: 3415939 - RNA, 21 nt, Pseudomonas aeruginosa PA01
cuccgggccgagggcugagac

SEQ ID NO: 3415940 - RNA, 23 nt, Pseudomonas aeruginosa PA01
cuccgggccgagggcugagacgc

SEQ ID NO: 3415941 - RNA, 17 nt, Pseudomonas aeruginosa PA01
cuccgggcguaacggcu

SEQ ID NO: 3415942 - RNA, 16 nt, Pseudomonas aeruginosa PA01
cuccgggcuccaccag

SEQ ID NO: 3415943 - RNA, 18 nt, Pseudomonas aeruginosa PA01
cuccgggcuggccaccag

SEQ ID NO: 3415944 - RNA, 21 nt, Pseudomonas aeruginosa PA01
cuccgggcuggccaccagcac

SEQ ID NO: 3415945 - RNA, 20 nt, Pseudomonas aeruginosa PA01
cuccggggcccggcaggcag

SEQ ID NO: 3415946 - RNA, 22 nt, Pseudomonas aeruginosa PA01
cuccggggucaguuccaggucg

SEQ ID NO: 3415947 - RNA, 20 nt, Pseudomonas aeruginosa PA01
cuccggggugaagcucuucu

SEQ ID NO: 3415948 - RNA, 13 nt, Pseudomonas aeruginosa PA01
cuccgggucgggc

SEQ ID NO: 3415949 - RNA, 16 nt, Pseudomonas aeruginosa PA01
cuccggguugaccgcc

SEQ ID NO: 3415950 - RNA, 16 nt, Pseudomonas aeruginosa PA01
cuccggucaaggcaga

SEQ ID NO: 3415951 - RNA, 15 nt, Pseudomonas aeruginosa PA01
cuccgguggcgguug

SEQ ID NO: 3415952 - RNA, 16 nt, Pseudomonas aeruginosa PA01
cuccgguucggcaagg

SEQ ID NO: 3415953 - RNA, 21 nt, Pseudomonas aeruginosa PA01
cuccgguucggcaaggcgcag

SEQ ID NO: 3415954 - RNA, 19 nt, Pseudomonas aeruginosa PA01
cuccguagggcgacgcccg

SEQ ID NO: 3415955 - RNA, 17 nt, Pseudomonas aeruginosa PA01
cuccgucaaugcggccu

SEQ ID NO: 3415956 - RNA, 22 nt, Pseudomonas aeruginosa PA01
cuccgucaaugcggccugcaac

SEQ ID NO: 3415957 - RNA, 13 nt, Pseudomonas aeruginosa PA01
cuccguccagugc

SEQ ID NO: 3415958 - RNA, 18 nt, Pseudomonas aeruginosa PA01
cuccguccagugcggcag

SEQ ID NO: 3415959 - RNA, 22 nt, Pseudomonas aeruginosa PA01
cuccguccagugcggcagucgg

SEQ ID NO: 3415960 - RNA, 16 nt, Pseudomonas aeruginosa PA01
cuccgucgcuucgccc

SEQ ID NO: 3415961 - RNA, 18 nt, Pseudomonas aeruginosa PA01
cuccgucgcuucgcccgc

SEQ ID NO: 3415962 - RNA, 14 nt, Pseudomonas aeruginosa PA01
cuccgugcuggccg

SEQ ID NO: 3415963 - RNA, 15 nt, Pseudomonas aeruginosa PA01
cuccgugcuggccgg

SEQ ID NO: 3415964 - RNA, 19 nt, Pseudomonas aeruginosa PA01
cuccgugcuggccggcagc

SEQ ID NO: 3415965 - RNA, 22 nt, Pseudomonas aeruginosa PA01
cuccgugucggcggcgccuucg

SEQ ID NO: 3415966 - RNA, 17 nt, Pseudomonas aeruginosa PA01
cuccguugaccugguug

SEQ ID NO: 3415967 - RNA, 20 nt, Pseudomonas aeruginosa PA01
cuccucagaggcgaccagcc

SEQ ID NO: 3415968 - RNA, 22 nt, Pseudomonas aeruginosa PA01
cuccuccagcaggaccuggccg

SEQ ID NO: 3415969 - RNA, 23 nt, Pseudomonas aeruginosa PA01
cuccuccagcaggaccuggccgu

SEQ ID NO: 3415970 - RNA, 15 nt, Pseudomonas aeruginosa PA01
cuccuccagcaucca

SEQ ID NO: 3415971 - RNA, 15 nt, Pseudomonas aeruginosa PA01
cuccuccagccgcgg

SEQ ID NO: 3415972 - RNA, 14 nt, Pseudomonas aeruginosa PA01
cuccuccagcgccg

SEQ ID NO: 3415973 - RNA, 15 nt, Pseudomonas aeruginosa PA01
cuccuccagcgccgc

SEQ ID NO: 3415974 - RNA, 21 nt, Pseudomonas aeruginosa PA01
cuccuccagcgccgccaggcg

SEQ ID NO: 3415975 - RNA, 23 nt, Pseudomonas aeruginosa PA01
cuccuccagcgccgccaggcgcg

SEQ ID NO: 3415976 - RNA, 16 nt, Pseudomonas aeruginosa PA01
cuccuccagcguggcg

SEQ ID NO: 3415977 - RNA, 16 nt, Pseudomonas aeruginosa PA01
cuccuccaguuccucg

SEQ ID NO: 3415978 - RNA, 15 nt, Pseudomonas aeruginosa PA01
cuccucccgccccuc

SEQ ID NO: 3415979 - RNA, 16 nt, Pseudomonas aeruginosa PA01
cuccucccgccccucc

SEQ ID NO: 3415980 - RNA, 22 nt, Pseudomonas aeruginosa PA01
cuccucccgccccuccaguucc

SEQ ID NO: 3415981 - RNA, 13 nt, Pseudomonas aeruginosa PA01
cuccuccgccccg

SEQ ID NO: 3415982 - RNA, 14 nt, Pseudomonas aeruginosa PA01
cuccuccgccugca

SEQ ID NO: 3415983 - RNA, 14 nt, Pseudomonas aeruginosa PA01
cuccuccgggaaga

SEQ ID NO: 3415984 - RNA, 16 nt, Pseudomonas aeruginosa PA01
cuccuccuccaucucg

SEQ ID NO: 3415985 - RNA, 15 nt, Pseudomonas aeruginosa PA01
cuccuccucgcucca

SEQ ID NO: 3415986 - RNA, 20 nt, Pseudomonas aeruginosa PA01
cuccucgaacaacuggacga

SEQ ID NO: 3415987 - RNA, 13 nt, Pseudomonas aeruginosa PA01
cuccucgacggcg

SEQ ID NO: 3415988 - RNA, 17 nt, Pseudomonas aeruginosa PA01
cuccucgacggcgggag

SEQ ID NO: 3415989 - RNA, 23 nt, Pseudomonas aeruginosa PA01
cuccucgacggcgggagcggccu

SEQ ID NO: 3415990 - RNA, 17 nt, Pseudomonas aeruginosa PA01
cuccucgauaaacggcg

SEQ ID NO: 3415991 - RNA, 13 nt, Pseudomonas aeruginosa PA01
cuccucgauccgc

SEQ ID NO: 3415992 - RNA, 12 nt, Pseudomonas aeruginosa PA01
cuccucgaugaa

SEQ ID NO: 3415993 - RNA, 22 nt, Pseudomonas aeruginosa PA01
cuccucgaugaaacgcagggcc

SEQ ID NO: 3415994 - RNA, 23 nt, Pseudomonas aeruginosa PA01
cuccucgaugaaacgcagggccg

SEQ ID NO: 3415995 - RNA, 13 nt, Pseudomonas aeruginosa PA01
cuccucgccgccg

SEQ ID NO: 3415996 - RNA, 16 nt, Pseudomonas aeruginosa PA01
cuccucgccgccgacc

SEQ ID NO: 3415997 - RNA, 14 nt, Pseudomonas aeruginosa PA01
cuccucgccgcucc

SEQ ID NO: 3415998 - RNA, 15 nt, Pseudomonas aeruginosa PA01
cuccucgccgcuccg

SEQ ID NO: 3415999 - RNA, 23 nt, Pseudomonas aeruginosa PA01
cuccucgccguacagcaggcagg

SEQ ID NO: 3416000 - RNA, 12 nt, Pseudomonas aeruginosa PA01
cuccucgcgcag

SEQ ID NO: 3416001 - RNA, 13 nt, Pseudomonas aeruginosa PA01
cuccucgcgcagc

SEQ ID NO: 3416002 - RNA, 18 nt, Pseudomonas aeruginosa PA01
cuccucgcgcagcggcuc

SEQ ID NO: 3416003 - RNA, 11 nt, Pseudomonas aeruginosa PA01
cuccucgcgcu

SEQ ID NO: 3416004 - RNA, 18 nt, Pseudomonas aeruginosa PA01
cuccucgcgcugcccggc

SEQ ID NO: 3416005 - RNA, 17 nt, Pseudomonas aeruginosa PA01
cuccucggcagcgcugg

SEQ ID NO: 3416006 - RNA, 19 nt, Pseudomonas aeruginosa PA01
cuccucggcagcgcuggcg

SEQ ID NO: 3416007 - RNA, 23 nt, Pseudomonas aeruginosa PA01
cuccucggcagcgcuggcgauca

SEQ ID NO: 3416008 - RNA, 13 nt, Pseudomonas aeruginosa PA01
cuccucggccaac

SEQ ID NO: 3416009 - RNA, 22 nt, Pseudomonas aeruginosa PA01
cuccucggccgacaggcuggug

SEQ ID NO: 3416010 - RNA, 11 nt, Pseudomonas aeruginosa PA01
cuccucggccu

SEQ ID NO: 3416011 - RNA, 17 nt, Pseudomonas aeruginosa PA01
cuccucggccugggcgc

SEQ ID NO: 3416012 - RNA, 22 nt, Pseudomonas aeruginosa PA01
cuccucggccugggcgcaggcc

SEQ ID NO: 3416013 - RNA, 19 nt, Pseudomonas aeruginosa PA01
cuccucggccuugcuggcg

SEQ ID NO: 3416014 - RNA, 13 nt, Pseudomonas aeruginosa PA01
cuccucugccugc

SEQ ID NO: 3416015 - RNA, 13 nt, Pseudomonas aeruginosa PA01
cuccugccgccga

SEQ ID NO: 3416016 - RNA, 11 nt, Pseudomonas aeruginosa PA01
cuccugccgcg

SEQ ID NO: 3416017 - RNA, 20 nt, Pseudomonas aeruginosa PA01
cuccugcggcuggcgaacca

SEQ ID NO: 3416018 - RNA, 14 nt, Pseudomonas aeruginosa PA01
cuccugcucgaucc

SEQ ID NO: 3416019 - RNA, 23 nt, Pseudomonas aeruginosa PA01
cuccugcucgauccagccggcau

SEQ ID NO: 3416020 - RNA, 14 nt, Pseudomonas aeruginosa PA01
cuccugcugggcgu

SEQ ID NO: 3416021 - RNA, 18 nt, Pseudomonas aeruginosa PA01
cuccuggaaagaccggcg

SEQ ID NO: 3416022 - RNA, 20 nt, Pseudomonas aeruginosa PA01
cuccuggaggacgcgggcuu

SEQ ID NO: 3416023 - RNA, 18 nt, Pseudomonas aeruginosa PA01
cuccuggagguagcugcg

SEQ ID NO: 3416024 - RNA, 21 nt, Pseudomonas aeruginosa PA01
cuccuggagguagcugcgccg

SEQ ID NO: 3416025 - RNA, 23 nt, Pseudomonas aeruginosa PA01
cuccuggagguagcugcgccgcc

SEQ ID NO: 3416026 - RNA, 18 nt, Pseudomonas aeruginosa PA01
cuccuggauacgcucggc

SEQ ID NO: 3416027 - RNA, 22 nt, Pseudomonas aeruginosa PA01
cuccuggaugcuccgcgccuca

SEQ ID NO: 3416028 - RNA, 13 nt, Pseudomonas aeruginosa PA01
cuccuggcaggcu

SEQ ID NO: 3416029 - RNA, 13 nt, Pseudomonas aeruginosa PA01
cuccuggcggcgu

SEQ ID NO: 3416030 - RNA, 17 nt, Pseudomonas aeruginosa PA01
cuccugggccgacgcuu

SEQ ID NO: 3416031 - RNA, 17 nt, Pseudomonas aeruginosa PA01
cuccuggggaaucugcg

SEQ ID NO: 3416032 - RNA, 18 nt, Pseudomonas aeruginosa PA01
cuccuggggaaucugcgc

SEQ ID NO: 3416033 - RNA, 20 nt, Pseudomonas aeruginosa PA01
cuccugggucgacugcuggg

SEQ ID NO: 3416034 - RNA, 14 nt, Pseudomonas aeruginosa PA01
cuccuggugcggca

SEQ ID NO: 3416035 - RNA, 16 nt, Pseudomonas aeruginosa PA01
cuccuggugcggcacc

SEQ ID NO: 3416036 - RNA, 24 nt, Pseudomonas aeruginosa PA01
cuccuggugcggcaccagccaggu

SEQ ID NO: 3416037 - RNA, 15 nt, Pseudomonas aeruginosa PA01
cuccugugccuuggc

SEQ ID NO: 3416038 - RNA, 18 nt, Pseudomonas aeruginosa PA01
cuccuguugcuggccggu

SEQ ID NO: 3416039 - RNA, 16 nt, Pseudomonas aeruginosa PA01
cuccuucgagccuggc

SEQ ID NO: 3416040 - RNA, 18 nt, Pseudomonas aeruginosa PA01
cuccuucgguaccugguc

SEQ ID NO: 3416041 - RNA, 23 nt, Pseudomonas aeruginosa PA01
cuccuugaaggcuuccuggaagc

SEQ ID NO: 3416042 - RNA, 15 nt, Pseudomonas aeruginosa PA01
cuccuugccguggcu

SEQ ID NO: 3416043 - RNA, 16 nt, Pseudomonas aeruginosa PA01
cuccuugcgccaggcc

SEQ ID NO: 3416044 - RNA, 14 nt, Pseudomonas aeruginosa PA01
cuccuugcgccguu

SEQ ID NO: 3416045 - RNA, 20 nt, Pseudomonas aeruginosa PA01
cuccuuucggaacagcgccu

SEQ ID NO: 3416046 - RNA, 17 nt, Pseudomonas aeruginosa PA01
cuccuuuggcgucgaug

SEQ ID NO: 3416047 - RNA, 18 nt, Pseudomonas aeruginosa PA01
cucgaacaacuggacgaa

SEQ ID NO: 3416048 - RNA, 16 nt, Pseudomonas aeruginosa PA01
cucgaacaccaggcgc

SEQ ID NO: 3416049 - RNA, 18 nt, Pseudomonas aeruginosa PA01
cucgaacaccaggcgcca

SEQ ID NO: 3416050 - RNA, 21 nt, Pseudomonas aeruginosa PA01
cucgaacaccaggcgccaggg

SEQ ID NO: 3416051 - RNA, 18 nt, Pseudomonas aeruginosa PA01
cucgaacaccggcgagca

SEQ ID NO: 3416052 - RNA, 21 nt, Pseudomonas aeruginosa PA01
cucgaacagcaccgagcaggc

SEQ ID NO: 3416053 - RNA, 14 nt, Pseudomonas aeruginosa PA01
cucgaacagcagca

SEQ ID NO: 3416054 - RNA, 17 nt, Pseudomonas aeruginosa PA01
cucgaacagcagcaagc

SEQ ID NO: 3416055 - RNA, 21 nt, Pseudomonas aeruginosa PA01
cucgaacagcagcaagccgau

SEQ ID NO: 3416056 - RNA, 14 nt, Pseudomonas aeruginosa PA01
cucgaacagcuccu

SEQ ID NO: 3416057 - RNA, 15 nt, Pseudomonas aeruginosa PA01
cucgaacagcuccuc

SEQ ID NO: 3416058 - RNA, 12 nt, Pseudomonas aeruginosa PA01
cucgaacauggc

SEQ ID NO: 3416059 - RNA, 14 nt, Pseudomonas aeruginosa PA01
cucgaaccccuggc

SEQ ID NO: 3416060 - RNA, 13 nt, Pseudomonas aeruginosa PA01
cucgaaccggaaa

SEQ ID NO: 3416061 - RNA, 15 nt, Pseudomonas aeruginosa PA01
cucgaacggcggauc

SEQ ID NO: 3416062 - RNA, 17 nt, Pseudomonas aeruginosa PA01
cucgaacugcuccuggg

SEQ ID NO: 3416063 - RNA, 21 nt, Pseudomonas aeruginosa PA01
cucgaagaaaaggcccggcgu

SEQ ID NO: 3416064 - RNA, 15 nt, Pseudomonas aeruginosa PA01
cucgaagagcuggcg

SEQ ID NO: 3416065 - RNA, 16 nt, Pseudomonas aeruginosa PA01
cucgaagagcuggcgg

SEQ ID NO: 3416066 - RNA, 19 nt, Pseudomonas aeruginosa PA01
cucgaagcccagcgccugc

SEQ ID NO: 3416067 - RNA, 13 nt, Pseudomonas aeruginosa PA01
cucgaagcccugc

SEQ ID NO: 3416068 - RNA, 13 nt, Pseudomonas aeruginosa PA01
cucgaagccgccg

SEQ ID NO: 3416069 - RNA, 14 nt, Pseudomonas aeruginosa PA01
cucgaagcgcgccu

SEQ ID NO: 3416070 - RNA, 16 nt, Pseudomonas aeruginosa PA01
cucgaagcgcgccugc

SEQ ID NO: 3416071 - RNA, 23 nt, Pseudomonas aeruginosa PA01
cucgaagcggaucucgucgccga

SEQ ID NO: 3416072 - RNA, 16 nt, Pseudomonas aeruginosa PA01
cucgaagcuccagcgu

SEQ ID NO: 3416073 - RNA, 20 nt, Pseudomonas aeruginosa PA01
cucgaagcuccagcgugccc

SEQ ID NO: 3416074 - RNA, 16 nt, Pseudomonas aeruginosa PA01
cucgaagcucuucgcc

SEQ ID NO: 3416075 - RNA, 14 nt, Pseudomonas aeruginosa PA01
cucgaagcuggcca

SEQ ID NO: 3416076 - RNA, 17 nt, Pseudomonas aeruginosa PA01
cucgaaggccggcaaag

SEQ ID NO: 3416077 - RNA, 13 nt, Pseudomonas aeruginosa PA01
cucgaaggucagc

SEQ ID NO: 3416078 - RNA, 16 nt, Pseudomonas aeruginosa PA01
cucgaaguccugcagg

SEQ ID NO: 3416079 - RNA, 21 nt, Pseudomonas aeruginosa PA01
cucgaauaaaaaaccggccaa

SEQ ID NO: 3416080 - RNA, 15 nt, Pseudomonas aeruginosa PA01
cucgacaggucggcg

SEQ ID NO: 3416081 - RNA, 16 nt, Pseudomonas aeruginosa PA01
cucgacaggucggcga

SEQ ID NO: 3416082 - RNA, 18 nt, Pseudomonas aeruginosa PA01
cucgacauacuccgccgc

SEQ ID NO: 3416083 - RNA, 19 nt, Pseudomonas aeruginosa PA01
cucgacaucgucucgcgac

SEQ ID NO: 3416084 - RNA, 23 nt, Pseudomonas aeruginosa PA01
cucgacaucgucucgcgacacgu

SEQ ID NO: 3416085 - RNA, 20 nt, Pseudomonas aeruginosa PA01
cucgacauggaucaccgcca

SEQ ID NO: 3416086 - RNA, 14 nt, Pseudomonas aeruginosa PA01
cucgaccaccucgg

SEQ ID NO: 3416087 - RNA, 19 nt, Pseudomonas aeruginosa PA01
cucgaccagaucggcaugg

SEQ ID NO: 3416088 - RNA, 22 nt, Pseudomonas aeruginosa PA01
cucgaccagaucggcauggccg

SEQ ID NO: 3416089 - RNA, 14 nt, Pseudomonas aeruginosa PA01
cucgaccagcgccg

SEQ ID NO: 3416090 - RNA, 16 nt, Pseudomonas aeruginosa PA01
cucgaccagcgccgcg

SEQ ID NO: 3416091 - RNA, 18 nt, Pseudomonas aeruginosa PA01
cucgaccagcgccgcggc

SEQ ID NO: 3416092 - RNA, 21 nt, Pseudomonas aeruginosa PA01
cucgaccagcgccgcggcgac

SEQ ID NO: 3416093 - RNA, 23 nt, Pseudomonas aeruginosa PA01
cucgaccagguccggcagcgccu

SEQ ID NO: 3416094 - RNA, 17 nt, Pseudomonas aeruginosa PA01
cucgaccaucggcggcg

SEQ ID NO: 3416095 - RNA, 16 nt, Pseudomonas aeruginosa PA01
cucgaccccggaaagg

SEQ ID NO: 3416096 - RNA, 21 nt, Pseudomonas aeruginosa PA01
cucgacccgguuaccggcgac

SEQ ID NO: 3416097 - RNA, 13 nt, Pseudomonas aeruginosa PA01
cucgacccuggcg

SEQ ID NO: 3416098 - RNA, 15 nt, Pseudomonas aeruginosa PA01
cucgacccuggcgcc

SEQ ID NO: 3416099 - RNA, 17 nt, Pseudomonas aeruginosa PA01
cucgacccuggcgccga

SEQ ID NO: 3416100 - RNA, 18 nt, Pseudomonas aeruginosa PA01
cucgacccuggcgccgac

SEQ ID NO: 3416101 - RNA, 20 nt, Pseudomonas aeruginosa PA01
cucgacccuggcgccgaccu

SEQ ID NO: 3416102 - RNA, 22 nt, Pseudomonas aeruginosa PA01
cucgacccuggcgccgaccucc

SEQ ID NO: 3416103 - RNA, 22 nt, Pseudomonas aeruginosa PA01
cucgaccgccugcucgcggcug

SEQ ID NO: 3416104 - RNA, 15 nt, Pseudomonas aeruginosa PA01
cucgaccgcgccggc

SEQ ID NO: 3416105 - RNA, 16 nt, Pseudomonas aeruginosa PA01
cucgaccgcgccggcg

SEQ ID NO: 3416106 - RNA, 14 nt, Pseudomonas aeruginosa PA01
cucgaccucggccg

SEQ ID NO: 3416107 - RNA, 16 nt, Pseudomonas aeruginosa PA01
cucgaccuggccacgc

SEQ ID NO: 3416108 - RNA, 19 nt, Pseudomonas aeruginosa PA01
cucgaccuggccacgcccg

SEQ ID NO: 3416109 - RNA, 12 nt, Pseudomonas aeruginosa PA01
cucgaccuggcu

SEQ ID NO: 3416110 - RNA, 14 nt, Pseudomonas aeruginosa PA01
cucgaccugguagc

SEQ ID NO: 3416111 - RNA, 14 nt, Pseudomonas aeruginosa PA01
cucgaccuugcccu

SEQ ID NO: 3416112 - RNA, 19 nt, Pseudomonas aeruginosa PA01
cucgacgaaauaaugcggc

SEQ ID NO: 3416113 - RNA, 20 nt, Pseudomonas aeruginosa PA01
cucgacgauauccacgccgu

SEQ ID NO: 3416114 - RNA, 22 nt, Pseudomonas aeruginosa PA01
cucgacgauauccacgccgucg

SEQ ID NO: 3416115 - RNA, 23 nt, Pseudomonas aeruginosa PA01
cucgacgauauccacgccgucgc

SEQ ID NO: 3416116 - RNA, 14 nt, Pseudomonas aeruginosa PA01
cucgacgaucaggu

SEQ ID NO: 3416117 - RNA, 21 nt, Pseudomonas aeruginosa PA01
cucgacgaucaggugcaggaa

SEQ ID NO: 3416118 - RNA, 23 nt, Pseudomonas aeruginosa PA01
cucgacgaucaggugcaggaaca

SEQ ID NO: 3416119 - RNA, 17 nt, Pseudomonas aeruginosa PA01
cucgacgcagagcgcca

SEQ ID NO: 3416120 - RNA, 22 nt, Pseudomonas aeruginosa PA01
cucgacgcccgcuugcgccgcc

SEQ ID NO: 3416121 - RNA, 13 nt, Pseudomonas aeruginosa PA01
cucgacgccgagc

SEQ ID NO: 3416122 - RNA, 19 nt, Pseudomonas aeruginosa PA01
cucgacgccgagccagccg

SEQ ID NO: 3416123 - RNA, 20 nt, Pseudomonas aeruginosa PA01
cucgacgccgagccagccgc

SEQ ID NO: 3416124 - RNA, 16 nt, Pseudomonas aeruginosa PA01
cucgacgcugcccagc

SEQ ID NO: 3416125 - RNA, 19 nt, Pseudomonas aeruginosa PA01
cucgacgcugcccagcccg

SEQ ID NO: 3416126 - RNA, 15 nt, Pseudomonas aeruginosa PA01
cucgacggcaccagc

SEQ ID NO: 3416127 - RNA, 17 nt, Pseudomonas aeruginosa PA01
cucgacggcaccagcgc

SEQ ID NO: 3416128 - RNA, 13 nt, Pseudomonas aeruginosa PA01
cucgacggcgauc

SEQ ID NO: 3416129 - RNA, 19 nt, Pseudomonas aeruginosa PA01
cucgacggcgaucucagcc

SEQ ID NO: 3416130 - RNA, 18 nt, Pseudomonas aeruginosa PA01
cucgacggcgggagcggc

SEQ ID NO: 3416131 - RNA, 22 nt, Pseudomonas aeruginosa PA01
cucgacggcgggagcggccuga

SEQ ID NO: 3416132 - RNA, 16 nt, Pseudomonas aeruginosa PA01
cucgacgggcgcuucc

SEQ ID NO: 3416133 - RNA, 18 nt, Pseudomonas aeruginosa PA01
cucgacguaggcggcgaa

SEQ ID NO: 3416134 - RNA, 13 nt, Pseudomonas aeruginosa PA01
cucgacuuccgcc

SEQ ID NO: 3416135 - RNA, 16 nt, Pseudomonas aeruginosa PA01
cucgacuucuucgcug

SEQ ID NO: 3416136 - RNA, 20 nt, Pseudomonas aeruginosa PA01
cucgacuucuucgcuggacc

SEQ ID NO: 3416137 - RNA, 21 nt, Pseudomonas aeruginosa PA01
cucgagauugucgcgauccac

SEQ ID NO: 3416138 - RNA, 14 nt, Pseudomonas aeruginosa PA01
cucgagcaccacca

SEQ ID NO: 3416139 - RNA, 15 nt, Pseudomonas aeruginosa PA01
cucgagcaccaccac

SEQ ID NO: 3416140 - RNA, 14 nt, Pseudomonas aeruginosa PA01
cucgagcaccgcgg

SEQ ID NO: 3416141 - RNA, 17 nt, Pseudomonas aeruginosa PA01
cucgagcaugucggcgg

SEQ ID NO: 3416142 - RNA, 22 nt, Pseudomonas aeruginosa PA01
cucgagccgaacuccgguguca

SEQ ID NO: 3416143 - RNA, 13 nt, Pseudomonas aeruginosa PA01
cucgagccggcug

SEQ ID NO: 3416144 - RNA, 13 nt, Pseudomonas aeruginosa PA01
cucgagcuugagg

SEQ ID NO: 3416145 - RNA, 13 nt, Pseudomonas aeruginosa PA01
cucgaggacgugc

SEQ ID NO: 3416146 - RNA, 12 nt, Pseudomonas aeruginosa PA01
cucgaggccgag

SEQ ID NO: 3416147 - RNA, 17 nt, Pseudomonas aeruginosa PA01
cucgaggccgagccggc

SEQ ID NO: 3416148 - RNA, 22 nt, Pseudomonas aeruginosa PA01
cucgagggcgaccgccaggcgg

SEQ ID NO: 3416149 - RNA, 12 nt, Pseudomonas aeruginosa PA01
cucgaggggcga

SEQ ID NO: 3416150 - RNA, 20 nt, Pseudomonas aeruginosa PA01
cucgagggugucguagaggc

SEQ ID NO: 3416151 - RNA, 15 nt, Pseudomonas aeruginosa PA01
cucgaggucggccug

SEQ ID NO: 3416152 - RNA, 19 nt, Pseudomonas aeruginosa PA01
cucgaggucggccuggcug

SEQ ID NO: 3416153 - RNA, 20 nt, Pseudomonas aeruginosa PA01
cucgagguucucgacccgcu

SEQ ID NO: 3416154 - RNA, 14 nt, Pseudomonas aeruginosa PA01
cucgaguucgcgcg

SEQ ID NO: 3416155 - RNA, 20 nt, Pseudomonas aeruginosa PA01
cucgauagcguccaggugcg

SEQ ID NO: 3416156 - RNA, 19 nt, Pseudomonas aeruginosa PA01
cucgaucaaccccuggauc

SEQ ID NO: 3416157 - RNA, 18 nt, Pseudomonas aeruginosa PA01
cucgaucacccgcgaggc

SEQ ID NO: 3416158 - RNA, 14 nt, Pseudomonas aeruginosa PA01
cucgaucagccggc

SEQ ID NO: 3416159 - RNA, 17 nt, Pseudomonas aeruginosa PA01
cucgaucagccggcgcg

SEQ ID NO: 3416160 - RNA, 13 nt, Pseudomonas aeruginosa PA01
cucgaucagcgcc

SEQ ID NO: 3416161 - RNA, 14 nt, Pseudomonas aeruginosa PA01
cucgaucagcgccg

SEQ ID NO: 3416162 - RNA, 15 nt, Pseudomonas aeruginosa PA01
cucgaucagcgccgg

SEQ ID NO: 3416163 - RNA, 15 nt, Pseudomonas aeruginosa PA01
cucgaucagcgcggc

SEQ ID NO: 3416164 - RNA, 16 nt, Pseudomonas aeruginosa PA01
cucgaucagcgcggcc

SEQ ID NO: 3416165 - RNA, 16 nt, Pseudomonas aeruginosa PA01
cucgaucaggccuucc

SEQ ID NO: 3416166 - RNA, 21 nt, Pseudomonas aeruginosa PA01
cucgaucagugcaucggccgc

SEQ ID NO: 3416167 - RNA, 13 nt, Pseudomonas aeruginosa PA01
cucgaucaucgcc

SEQ ID NO: 3416168 - RNA, 17 nt, Pseudomonas aeruginosa PA01
cucgaucaucgccagcg

SEQ ID NO: 3416169 - RNA, 19 nt, Pseudomonas aeruginosa PA01
cucgaucaucgccagcggc

SEQ ID NO: 3416170 - RNA, 20 nt, Pseudomonas aeruginosa PA01
cucgaucaucgccagcggcg

SEQ ID NO: 3416171 - RNA, 14 nt, Pseudomonas aeruginosa PA01
cucgauccagccgg

SEQ ID NO: 3416172 - RNA, 14 nt, Pseudomonas aeruginosa PA01
cucgaucccggcgc

SEQ ID NO: 3416173 - RNA, 15 nt, Pseudomonas aeruginosa PA01
cucgaucccggcgcg

SEQ ID NO: 3416174 - RNA, 15 nt, Pseudomonas aeruginosa PA01
cucgauccgcugggc

SEQ ID NO: 3416175 - RNA, 13 nt, Pseudomonas aeruginosa PA01
cucgaucgccucg

SEQ ID NO: 3416176 - RNA, 23 nt, Pseudomonas aeruginosa PA01
cucgaucggcagggcgccgacca

SEQ ID NO: 3416177 - RNA, 16 nt, Pseudomonas aeruginosa PA01
cucgaucggcccgggc

SEQ ID NO: 3416178 - RNA, 20 nt, Pseudomonas aeruginosa PA01
cucgaucggcccgggcgcca

SEQ ID NO: 3416179 - RNA, 22 nt, Pseudomonas aeruginosa PA01
cucgaugaaaccggccucgaca

SEQ ID NO: 3416180 - RNA, 16 nt, Pseudomonas aeruginosa PA01
cucgaugaacagcgcg

SEQ ID NO: 3416181 - RNA, 16 nt, Pseudomonas aeruginosa PA01
cucgaugaacagugcg

SEQ ID NO: 3416182 - RNA, 21 nt, Pseudomonas aeruginosa PA01
cucgaugaaugcgcaggucgc

SEQ ID NO: 3416183 - RNA, 16 nt, Pseudomonas aeruginosa PA01
cucgaugccaucgagg

SEQ ID NO: 3416184 - RNA, 20 nt, Pseudomonas aeruginosa PA01
cucgaugccaucgaggccag

SEQ ID NO: 3416185 - RNA, 21 nt, Pseudomonas aeruginosa PA01
cucgaugccaucgaggccagg

SEQ ID NO: 3416186 - RNA, 17 nt, Pseudomonas aeruginosa PA01
cucgaugcccgccagca

SEQ ID NO: 3416187 - RNA, 18 nt, Pseudomonas aeruginosa PA01
cucgaugcccgccagcag

SEQ ID NO: 3416188 - RNA, 19 nt, Pseudomonas aeruginosa PA01
cucgaugcccgccagcagg

SEQ ID NO: 3416189 - RNA, 22 nt, Pseudomonas aeruginosa PA01
cucgaugcccgccagcaggcgc

SEQ ID NO: 3416190 - RNA, 18 nt, Pseudomonas aeruginosa PA01
cucgaugcccgccucgcg

SEQ ID NO: 3416191 - RNA, 20 nt, Pseudomonas aeruginosa PA01
cucgaugcccgccucgcgca

SEQ ID NO: 3416192 - RNA, 14 nt, Pseudomonas aeruginosa PA01
cucgauggcgcggu

SEQ ID NO: 3416193 - RNA, 15 nt, Pseudomonas aeruginosa PA01
cucgauggcggcggc

SEQ ID NO: 3416194 - RNA, 22 nt, Pseudomonas aeruginosa PA01
cucgauggugaacgccaggcag

SEQ ID NO: 3416195 - RNA, 22 nt, Pseudomonas aeruginosa PA01
cucgauggugaucacgucggcg

SEQ ID NO: 3416196 - RNA, 23 nt, Pseudomonas aeruginosa PA01
cucgauggugaucacgucggcgu

SEQ ID NO: 3416197 - RNA, 17 nt, Pseudomonas aeruginosa PA01
cucgcaaaggucggcga

SEQ ID NO: 3416198 - RNA, 20 nt, Pseudomonas aeruginosa PA01
cucgcaaaggucggcgaagg

SEQ ID NO: 3416199 - RNA, 19 nt, Pseudomonas aeruginosa PA01
cucgcaaguuacgcgcagc

SEQ ID NO: 3416200 - RNA, 12 nt, Pseudomonas aeruginosa PA01
cucgcaccaggc

SEQ ID NO: 3416201 - RNA, 23 nt, Pseudomonas aeruginosa PA01
cucgcagagcgccagccagcgcg

SEQ ID NO: 3416202 - RNA, 15 nt, Pseudomonas aeruginosa PA01
cucgcagagggcgau

SEQ ID NO: 3416203 - RNA, 12 nt, Pseudomonas aeruginosa PA01
cucgcagcaggc

SEQ ID NO: 3416204 - RNA, 18 nt, Pseudomonas aeruginosa PA01
cucgcagcaggcguucgg

SEQ ID NO: 3416205 - RNA, 20 nt, Pseudomonas aeruginosa PA01
cucgcagcaggcguucggcg

SEQ ID NO: 3416206 - RNA, 17 nt, Pseudomonas aeruginosa PA01
cucgcagccgcgcucgg

SEQ ID NO: 3416207 - RNA, 19 nt, Pseudomonas aeruginosa PA01
cucgcagccgcgcucggcc

SEQ ID NO: 3416208 - RNA, 14 nt, Pseudomonas aeruginosa PA01
cucgcagccggcgg

SEQ ID NO: 3416209 - RNA, 15 nt, Pseudomonas aeruginosa PA01
cucgcagccgguggu

SEQ ID NO: 3416210 - RNA, 21 nt, Pseudomonas aeruginosa PA01
cucgcaguacagcucggcgcc

SEQ ID NO: 3416211 - RNA, 17 nt, Pseudomonas aeruginosa PA01
cucgccaaccaggaagg

SEQ ID NO: 3416212 - RNA, 16 nt, Pseudomonas aeruginosa PA01
cucgccaagcuggcga

SEQ ID NO: 3416213 - RNA, 21 nt, Pseudomonas aeruginosa PA01
cucgccaagcuggcgaucgac

SEQ ID NO: 3416214 - RNA, 16 nt, Pseudomonas aeruginosa PA01
cucgccaccccgcucc

SEQ ID NO: 3416215 - RNA, 22 nt, Pseudomonas aeruginosa PA01
cucgccacgcuucugcgccucc

SEQ ID NO: 3416216 - RNA, 22 nt, Pseudomonas aeruginosa PA01
cucgccacugauaccgcuggcc

SEQ ID NO: 3416217 - RNA, 21 nt, Pseudomonas aeruginosa PA01
cucgccagaugacgauggccg

SEQ ID NO: 3416218 - RNA, 14 nt, Pseudomonas aeruginosa PA01
cucgccagcccggc

SEQ ID NO: 3416219 - RNA, 15 nt, Pseudomonas aeruginosa PA01
cucgccagcccggca

SEQ ID NO: 3416220 - RNA, 15 nt, Pseudomonas aeruginosa PA01
cucgccagcgcgcgc

SEQ ID NO: 3416221 - RNA, 19 nt, Pseudomonas aeruginosa PA01
cucgccaugacacaccacg

SEQ ID NO: 3416222 - RNA, 19 nt, Pseudomonas aeruginosa PA01
cucgccauucucgccauga

SEQ ID NO: 3416223 - RNA, 13 nt, Pseudomonas aeruginosa PA01
cucgcccagcagg

SEQ ID NO: 3416224 - RNA, 17 nt, Pseudomonas aeruginosa PA01
cucgcccagcaggcgcg

SEQ ID NO: 3416225 - RNA, 20 nt, Pseudomonas aeruginosa PA01
cucgcccagcaggcgcgccc

SEQ ID NO: 3416226 - RNA, 22 nt, Pseudomonas aeruginosa PA01
cucgcccagggcguggucggcg

SEQ ID NO: 3416227 - RNA, 16 nt, Pseudomonas aeruginosa PA01
cucgccccagacccag

SEQ ID NO: 3416228 - RNA, 21 nt, Pseudomonas aeruginosa PA01
cucgccccagacccaggugcg

SEQ ID NO: 3416229 - RNA, 14 nt, Pseudomonas aeruginosa PA01
cucgccccgccggg

SEQ ID NO: 3416230 - RNA, 15 nt, Pseudomonas aeruginosa PA01
cucgccccgccggga

SEQ ID NO: 3416231 - RNA, 15 nt, Pseudomonas aeruginosa PA01
cucgccccggcggcg

SEQ ID NO: 3416232 - RNA, 18 nt, Pseudomonas aeruginosa PA01
cucgcccgaccccacgcc

SEQ ID NO: 3416233 - RNA, 13 nt, Pseudomonas aeruginosa PA01
cucgcccgccucg

SEQ ID NO: 3416234 - RNA, 15 nt, Pseudomonas aeruginosa PA01
cucgcccucgaagcc

SEQ ID NO: 3416235 - RNA, 18 nt, Pseudomonas aeruginosa PA01
cucgcccucgaagcccug

SEQ ID NO: 3416236 - RNA, 22 nt, Pseudomonas aeruginosa PA01
cucgcccucucccuucaggagg

SEQ ID NO: 3416237 - RNA, 23 nt, Pseudomonas aeruginosa PA01
cucgcccugcuuggccagcgcgg

SEQ ID NO: 3416238 - RNA, 20 nt, Pseudomonas aeruginosa PA01
cucgcccuugaccagucccg

SEQ ID NO: 3416239 - RNA, 17 nt, Pseudomonas aeruginosa PA01
cucgcccuugcgccgcg

SEQ ID NO: 3416240 - RNA, 18 nt, Pseudomonas aeruginosa PA01
cucgcccuugggaccggg

SEQ ID NO: 3416241 - RNA, 12 nt, Pseudomonas aeruginosa PA01
cucgccgaccag

SEQ ID NO: 3416242 - RNA, 14 nt, Pseudomonas aeruginosa PA01
cucgccgaccagcu

SEQ ID NO: 3416243 - RNA, 14 nt, Pseudomonas aeruginosa PA01
cucgccgaccgcca

SEQ ID NO: 3416244 - RNA, 14 nt, Pseudomonas aeruginosa PA01
cucgccgacuucca

SEQ ID NO: 3416245 - RNA, 18 nt, Pseudomonas aeruginosa PA01
cucgccgacuuccaggcg

SEQ ID NO: 3416246 - RNA, 19 nt, Pseudomonas aeruginosa PA01
cucgccgacuuccaggcgc

SEQ ID NO: 3416247 - RNA, 16 nt, Pseudomonas aeruginosa PA01
cucgccgaucuccucc

SEQ ID NO: 3416248 - RNA, 21 nt, Pseudomonas aeruginosa PA01
cucgccgaucuccuccgcccc

SEQ ID NO: 3416249 - RNA, 15 nt, Pseudomonas aeruginosa PA01
cucgccgaugcccgg

SEQ ID NO: 3416250 - RNA, 17 nt, Pseudomonas aeruginosa PA01
cucgccgaugcccgggc

SEQ ID NO: 3416251 - RNA, 15 nt, Pseudomonas aeruginosa PA01
cucgccgccagcagg

SEQ ID NO: 3416252 - RNA, 16 nt, Pseudomonas aeruginosa PA01
cucgccgccagcagga

SEQ ID NO: 3416253 - RNA, 13 nt, Pseudomonas aeruginosa PA01
cucgccgccgagc

SEQ ID NO: 3416254 - RNA, 11 nt, Pseudomonas aeruginosa PA01
cucgccgccgg

SEQ ID NO: 3416255 - RNA, 16 nt, Pseudomonas aeruginosa PA01
cucgccgccggcgagg

SEQ ID NO: 3416256 - RNA, 16 nt, Pseudomonas aeruginosa PA01
cucgccgccgggcgcg

SEQ ID NO: 3416257 - RNA, 19 nt, Pseudomonas aeruginosa PA01
cucgccgccgggcgcgcgc

SEQ ID NO: 3416258 - RNA, 21 nt, Pseudomonas aeruginosa PA01
cucgccgccgggcgcgcgccu

SEQ ID NO: 3416259 - RNA, 18 nt, Pseudomonas aeruginosa PA01
cucgccgccuucggcagg

SEQ ID NO: 3416260 - RNA, 14 nt, Pseudomonas aeruginosa PA01
cucgccgcgcacgu

SEQ ID NO: 3416261 - RNA, 14 nt, Pseudomonas aeruginosa PA01
cucgccgcgcucca

SEQ ID NO: 3416262 - RNA, 14 nt, Pseudomonas aeruginosa PA01
cucgccgcgcucgc

SEQ ID NO: 3416263 - RNA, 17 nt, Pseudomonas aeruginosa PA01
cucgccgcgcucgcgca

SEQ ID NO: 3416264 - RNA, 17 nt, Pseudomonas aeruginosa PA01
cucgccgcuccacaccc

SEQ ID NO: 3416265 - RNA, 13 nt, Pseudomonas aeruginosa PA01
cucgccgcuccgc

SEQ ID NO: 3416266 - RNA, 14 nt, Pseudomonas aeruginosa PA01
cucgccgcuccgcg

SEQ ID NO: 3416267 - RNA, 15 nt, Pseudomonas aeruginosa PA01
cucgccgcuccgcgc

SEQ ID NO: 3416268 - RNA, 20 nt, Pseudomonas aeruginosa PA01
cucgccgcuccgcgccacgc

SEQ ID NO: 3416269 - RNA, 18 nt, Pseudomonas aeruginosa PA01
cucgccggcacuguuccu

SEQ ID NO: 3416270 - RNA, 22 nt, Pseudomonas aeruginosa PA01
cucgccggcauuggcacccugg

SEQ ID NO: 3416271 - RNA, 13 nt, Pseudomonas aeruginosa PA01
cucgccggccagu

SEQ ID NO: 3416272 - RNA, 12 nt, Pseudomonas aeruginosa PA01
cucgccggccug

SEQ ID NO: 3416273 - RNA, 23 nt, Pseudomonas aeruginosa PA01
cucgccggcgaucuccgccaggc

SEQ ID NO: 3416274 - RNA, 20 nt, Pseudomonas aeruginosa PA01
cucgccggcgcgggcggccu

SEQ ID NO: 3416275 - RNA, 22 nt, Pseudomonas aeruginosa PA01
cucgccggcgcgggcggccucg

SEQ ID NO: 3416276 - RNA, 18 nt, Pseudomonas aeruginosa PA01
cucgccggcguccuccuc

SEQ ID NO: 3416277 - RNA, 21 nt, Pseudomonas aeruginosa PA01
cucgccggcguccuccuccag

SEQ ID NO: 3416278 - RNA, 19 nt, Pseudomonas aeruginosa PA01
cucgccgggaaucgccagc

SEQ ID NO: 3416279 - RNA, 20 nt, Pseudomonas aeruginosa PA01
cucgccgggaaucgccagca

SEQ ID NO: 3416280 - RNA, 21 nt, Pseudomonas aeruginosa PA01
cucgccgggaaucgccagcag

SEQ ID NO: 3416281 - RNA, 23 nt, Pseudomonas aeruginosa PA01
cucgccgggaaucgccagcaggc

SEQ ID NO: 3416282 - RNA, 22 nt, Pseudomonas aeruginosa PA01
cucgccgggcgucugcccgguc

SEQ ID NO: 3416283 - RNA, 16 nt, Pseudomonas aeruginosa PA01
cucgccgggucgccgc

SEQ ID NO: 3416284 - RNA, 17 nt, Pseudomonas aeruginosa PA01
cucgccgggucgccgca

SEQ ID NO: 3416285 - RNA, 19 nt, Pseudomonas aeruginosa PA01
cucgccgggucgccgcagc

SEQ ID NO: 3416286 - RNA, 19 nt, Pseudomonas aeruginosa PA01
cucgccggguuguccaggc

SEQ ID NO: 3416287 - RNA, 21 nt, Pseudomonas aeruginosa PA01
cucgccggguuguccaggcga

SEQ ID NO: 3416288 - RNA, 19 nt, Pseudomonas aeruginosa PA01
cucgccggucagguaggca

SEQ ID NO: 3416289 - RNA, 15 nt, Pseudomonas aeruginosa PA01
cucgccggucgcgcu

SEQ ID NO: 3416290 - RNA, 16 nt, Pseudomonas aeruginosa PA01
cucgccggucgcgcuc

SEQ ID NO: 3416291 - RNA, 20 nt, Pseudomonas aeruginosa PA01
cucgccggucgcgcucaggc

SEQ ID NO: 3416292 - RNA, 12 nt, Pseudomonas aeruginosa PA01
cucgccguaacc

SEQ ID NO: 3416293 - RNA, 20 nt, Pseudomonas aeruginosa PA01
cucgccguacagcaggcagg

SEQ ID NO: 3416294 - RNA, 18 nt, Pseudomonas aeruginosa PA01
cucgccgucaucgagcag

SEQ ID NO: 3416295 - RNA, 17 nt, Pseudomonas aeruginosa PA01
cucgccgucggcgguca

SEQ ID NO: 3416296 - RNA, 17 nt, Pseudomonas aeruginosa PA01
cucgccgucgucgggau

SEQ ID NO: 3416297 - RNA, 13 nt, Pseudomonas aeruginosa PA01
cucgccuaccggc

SEQ ID NO: 3416298 - RNA, 19 nt, Pseudomonas aeruginosa PA01
cucgccucccggcucgccg

SEQ ID NO: 3416299 - RNA, 20 nt, Pseudomonas aeruginosa PA01
cucgccucccggcucgccga

SEQ ID NO: 3416300 - RNA, 22 nt, Pseudomonas aeruginosa PA01
cucgccuccgggcggaggcgag

SEQ ID NO: 3416301 - RNA, 14 nt, Pseudomonas aeruginosa PA01
cucgccucgcgcca

SEQ ID NO: 3416302 - RNA, 15 nt, Pseudomonas aeruginosa PA01
cucgccugcggcgcc

SEQ ID NO: 3416303 - RNA, 21 nt, Pseudomonas aeruginosa PA01
cucgccugguaggcggcgacg

SEQ ID NO: 3416304 - RNA, 18 nt, Pseudomonas aeruginosa PA01
cucgcgacacgugcccca

SEQ ID NO: 3416305 - RNA, 13 nt, Pseudomonas aeruginosa PA01
cucgcgacccugg

SEQ ID NO: 3416306 - RNA, 15 nt, Pseudomonas aeruginosa PA01
cucgcgagauggcgu

SEQ ID NO: 3416307 - RNA, 15 nt, Pseudomonas aeruginosa PA01
cucgcgagcuggcgc

SEQ ID NO: 3416308 - RNA, 17 nt, Pseudomonas aeruginosa PA01
cucgcgaucgaucggcu

SEQ ID NO: 3416309 - RNA, 22 nt, Pseudomonas aeruginosa PA01
cucgcgaugcugugcagggagg

SEQ ID NO: 3416310 - RNA, 15 nt, Pseudomonas aeruginosa PA01
cucgcgcaaccagcc

SEQ ID NO: 3416311 - RNA, 19 nt, Pseudomonas aeruginosa PA01
cucgcgcaacgccgacggc

SEQ ID NO: 3416312 - RNA, 19 nt, Pseudomonas aeruginosa PA01
cucgcgcaacgccuugcca

SEQ ID NO: 3416313 - RNA, 18 nt, Pseudomonas aeruginosa PA01
cucgcgcaagcgcccggc

SEQ ID NO: 3416314 - RNA, 16 nt, Pseudomonas aeruginosa PA01
cucgcgcaccgcggcc

SEQ ID NO: 3416315 - RNA, 17 nt, Pseudomonas aeruginosa PA01
cucgcgcaccgcggcca

SEQ ID NO: 3416316 - RNA, 18 nt, Pseudomonas aeruginosa PA01
cucgcgcaccgcggccag

SEQ ID NO: 3416317 - RNA, 17 nt, Pseudomonas aeruginosa PA01
cucgcgcaccgcggcga

SEQ ID NO: 3416318 - RNA, 12 nt, Pseudomonas aeruginosa PA01
cucgcgcagcag

SEQ ID NO: 3416319 - RNA, 16 nt, Pseudomonas aeruginosa PA01
cucgcgcagcaggauc

SEQ ID NO: 3416320 - RNA, 19 nt, Pseudomonas aeruginosa PA01
cucgcgcagcaggauccag

SEQ ID NO: 3416321 - RNA, 20 nt, Pseudomonas aeruginosa PA01
cucgcgcagccacuggcgga

SEQ ID NO: 3416322 - RNA, 14 nt, Pseudomonas aeruginosa PA01
cucgcgcagccagg

SEQ ID NO: 3416323 - RNA, 15 nt, Pseudomonas aeruginosa PA01
cucgcgcagccaggc

SEQ ID NO: 3416324 - RNA, 16 nt, Pseudomonas aeruginosa PA01
cucgcgcagcggcgga

SEQ ID NO: 3416325 - RNA, 19 nt, Pseudomonas aeruginosa PA01
cucgcgcagcggcggauac

SEQ ID NO: 3416326 - RNA, 20 nt, Pseudomonas aeruginosa PA01
cucgcgccagagaucgccca

SEQ ID NO: 3416327 - RNA, 13 nt, Pseudomonas aeruginosa PA01
cucgcgccagccc

SEQ ID NO: 3416328 - RNA, 18 nt, Pseudomonas aeruginosa PA01
cucgcgccagccccaggc

SEQ ID NO: 3416329 - RNA, 14 nt, Pseudomonas aeruginosa PA01
cucgcgccgcgcca

SEQ ID NO: 3416330 - RNA, 17 nt, Pseudomonas aeruginosa PA01
cucgcgccgcgccagca

SEQ ID NO: 3416331 - RNA, 19 nt, Pseudomonas aeruginosa PA01
cucgcgccgcgccagcagg

SEQ ID NO: 3416332 - RNA, 14 nt, Pseudomonas aeruginosa PA01
cucgcgccggcgcg

SEQ ID NO: 3416333 - RNA, 13 nt, Pseudomonas aeruginosa PA01
cucgcgcggcacc

SEQ ID NO: 3416334 - RNA, 16 nt, Pseudomonas aeruginosa PA01
cucgcgcggggcgcgc

SEQ ID NO: 3416335 - RNA, 16 nt, Pseudomonas aeruginosa PA01
cucgcgcucggcggcc

SEQ ID NO: 3416336 - RNA, 19 nt, Pseudomonas aeruginosa PA01
cucgcgcucggcggccucg

SEQ ID NO: 3416337 - RNA, 13 nt, Pseudomonas aeruginosa PA01
cucgcgcuggacc

SEQ ID NO: 3416338 - RNA, 20 nt, Pseudomonas aeruginosa PA01
cucgcgcuggacccgcaccu

SEQ ID NO: 3416339 - RNA, 11 nt, Pseudomonas aeruginosa PA01
cucgcgcuucc

SEQ ID NO: 3416340 - RNA, 14 nt, Pseudomonas aeruginosa PA01
cucgcgcuuccggc

SEQ ID NO: 3416341 - RNA, 18 nt, Pseudomonas aeruginosa PA01
cucgcggaagcguugcuc

SEQ ID NO: 3416342 - RNA, 17 nt, Pseudomonas aeruginosa PA01
cucgcggaagucggcgg

SEQ ID NO: 3416343 - RNA, 17 nt, Pseudomonas aeruginosa PA01
cucgcggacgcuggcga

SEQ ID NO: 3416344 - RNA, 18 nt, Pseudomonas aeruginosa PA01
cucgcggacgcuggcgau

SEQ ID NO: 3416345 - RNA, 14 nt, Pseudomonas aeruginosa PA01
cucgcggagcugga

SEQ ID NO: 3416346 - RNA, 15 nt, Pseudomonas aeruginosa PA01
cucgcggaucugcuc

SEQ ID NO: 3416347 - RNA, 17 nt, Pseudomonas aeruginosa PA01
cucgcggcaucccgccc

SEQ ID NO: 3416348 - RNA, 14 nt, Pseudomonas aeruginosa PA01
cucgcggcgcggcg

SEQ ID NO: 3416349 - RNA, 16 nt, Pseudomonas aeruginosa PA01
cucgcggcgcggcggg

SEQ ID NO: 3416350 - RNA, 13 nt, Pseudomonas aeruginosa PA01
cucgcggcgcucg

SEQ ID NO: 3416351 - RNA, 19 nt, Pseudomonas aeruginosa PA01
cucgcggcggaugccggcg

SEQ ID NO: 3416352 - RNA, 15 nt, Pseudomonas aeruginosa PA01
cucgcggcggcaggc

SEQ ID NO: 3416353 - RNA, 18 nt, Pseudomonas aeruginosa PA01
cucgcggcguaggccucg

SEQ ID NO: 3416354 - RNA, 21 nt, Pseudomonas aeruginosa PA01
cucgcggcguucggaccuguc

SEQ ID NO: 3416355 - RNA, 18 nt, Pseudomonas aeruginosa PA01
cucgcggcuggccgccuc

SEQ ID NO: 3416356 - RNA, 13 nt, Pseudomonas aeruginosa PA01
cucgcgggccgcc

SEQ ID NO: 3416357 - RNA, 15 nt, Pseudomonas aeruginosa PA01
cucgcgggccgccug

SEQ ID NO: 3416358 - RNA, 19 nt, Pseudomonas aeruginosa PA01
cucgcgggcgacgugggcc

SEQ ID NO: 3416359 - RNA, 20 nt, Pseudomonas aeruginosa PA01
cucgcgggucaccaccggga

SEQ ID NO: 3416360 - RNA, 22 nt, Pseudomonas aeruginosa PA01
cucgcgggucaccaccgggaug

SEQ ID NO: 3416361 - RNA, 16 nt, Pseudomonas aeruginosa PA01
cucgcgggucaccagc

SEQ ID NO: 3416362 - RNA, 15 nt, Pseudomonas aeruginosa PA01
cucgcgggucugcgc

SEQ ID NO: 3416363 - RNA, 16 nt, Pseudomonas aeruginosa PA01
cucgcgggucugcgcc

SEQ ID NO: 3416364 - RNA, 15 nt, Pseudomonas aeruginosa PA01
cucgcggucccggga

SEQ ID NO: 3416365 - RNA, 18 nt, Pseudomonas aeruginosa PA01
cucgcgguuauccgccgc

SEQ ID NO: 3416366 - RNA, 22 nt, Pseudomonas aeruginosa PA01
cucgcgguuauccgccgccggg

SEQ ID NO: 3416367 - RNA, 16 nt, Pseudomonas aeruginosa PA01
cucgcgguucgaggac

SEQ ID NO: 3416368 - RNA, 20 nt, Pseudomonas aeruginosa PA01
cucgcgguucugcuccuggg

SEQ ID NO: 3416369 - RNA, 20 nt, Pseudomonas aeruginosa PA01
cucgcguagcgcuucccgcg

SEQ ID NO: 3416370 - RNA, 17 nt, Pseudomonas aeruginosa PA01
cucgcguagcugggcga

SEQ ID NO: 3416371 - RNA, 19 nt, Pseudomonas aeruginosa PA01
cucgcguucaucgucggca

SEQ ID NO: 3416372 - RNA, 22 nt, Pseudomonas aeruginosa PA01
cucgcguucaucgucggcagcc

SEQ ID NO: 3416373 - RNA, 14 nt, Pseudomonas aeruginosa PA01
cucgcguuccagca

SEQ ID NO: 3416374 - RNA, 17 nt, Pseudomonas aeruginosa PA01
cucgcguucgcggucgg

SEQ ID NO: 3416375 - RNA, 14 nt, Pseudomonas aeruginosa PA01
cucgcuacggaagg

SEQ ID NO: 3416376 - RNA, 15 nt, Pseudomonas aeruginosa PA01
cucgcuacggaaggu

SEQ ID NO: 3416377 - RNA, 22 nt, Pseudomonas aeruginosa PA01
cucgcuagucuuccugcacgcu

SEQ ID NO: 3416378 - RNA, 20 nt, Pseudomonas aeruginosa PA01
cucgcuaucaggcauccccg

SEQ ID NO: 3416379 - RNA, 15 nt, Pseudomonas aeruginosa PA01
cucgcuccaacgcag

SEQ ID NO: 3416380 - RNA, 12 nt, Pseudomonas aeruginosa PA01
cucgcuccagag

SEQ ID NO: 3416381 - RNA, 14 nt, Pseudomonas aeruginosa PA01
cucgcuccagagga

SEQ ID NO: 3416382 - RNA, 15 nt, Pseudomonas aeruginosa PA01
cucgcuccccugccg

SEQ ID NO: 3416383 - RNA, 16 nt, Pseudomonas aeruginosa PA01
cucgcuccgagcaggc

SEQ ID NO: 3416384 - RNA, 15 nt, Pseudomonas aeruginosa PA01
cucgcuccuccgggc

SEQ ID NO: 3416385 - RNA, 14 nt, Pseudomonas aeruginosa PA01
cucgcucugcgccg

SEQ ID NO: 3416386 - RNA, 18 nt, Pseudomonas aeruginosa PA01
cucgcucugcgccgcggc

SEQ ID NO: 3416387 - RNA, 19 nt, Pseudomonas aeruginosa PA01
cucgcugaaauccaccagc

SEQ ID NO: 3416388 - RNA, 20 nt, Pseudomonas aeruginosa PA01
cucgcugaaauccaccagca

SEQ ID NO: 3416389 - RNA, 21 nt, Pseudomonas aeruginosa PA01
cucgcugaaauccaccagcac

SEQ ID NO: 3416390 - RNA, 14 nt, Pseudomonas aeruginosa PA01
cucgcugacccagg

SEQ ID NO: 3416391 - RNA, 16 nt, Pseudomonas aeruginosa PA01
cucgcugacccaggcu

SEQ ID NO: 3416392 - RNA, 22 nt, Pseudomonas aeruginosa PA01
cucgcugacccaggcuucggcg

SEQ ID NO: 3416393 - RNA, 23 nt, Pseudomonas aeruginosa PA01
cucgcugacccaggcuucggcgc

SEQ ID NO: 3416394 - RNA, 21 nt, Pseudomonas aeruginosa PA01
cucgcugacuuccaucagcuc

SEQ ID NO: 3416395 - RNA, 19 nt, Pseudomonas aeruginosa PA01
cucgcugaguuugcccagc

SEQ ID NO: 3416396 - RNA, 23 nt, Pseudomonas aeruginosa PA01
cucgcugaguuugcccagcgccg

SEQ ID NO: 3416397 - RNA, 16 nt, Pseudomonas aeruginosa PA01
cucgcugcccgacggc

SEQ ID NO: 3416398 - RNA, 15 nt, Pseudomonas aeruginosa PA01
cucgcugccgccgca

SEQ ID NO: 3416399 - RNA, 16 nt, Pseudomonas aeruginosa PA01
cucgcugccgccgcag

SEQ ID NO: 3416400 - RNA, 20 nt, Pseudomonas aeruginosa PA01
cucgcugccuaccgucacgc

SEQ ID NO: 3416401 - RNA, 18 nt, Pseudomonas aeruginosa PA01
cucgcugccuggggacgg

SEQ ID NO: 3416402 - RNA, 20 nt, Pseudomonas aeruginosa PA01
cucgcugccuggggacggca

SEQ ID NO: 3416403 - RNA, 22 nt, Pseudomonas aeruginosa PA01
cucgcugccuggggacggcagg

SEQ ID NO: 3416404 - RNA, 16 nt, Pseudomonas aeruginosa PA01
cucgcugcgcagaugc

SEQ ID NO: 3416405 - RNA, 23 nt, Pseudomonas aeruginosa PA01
cucgcugcgggcguagcgcggca

SEQ ID NO: 3416406 - RNA, 23 nt, Pseudomonas aeruginosa PA01
cucgcugcgugcguugcgcggca

SEQ ID NO: 3416407 - RNA, 24 nt, Pseudomonas aeruginosa PA01
cucgcugcgugcguugcgcggcag

SEQ ID NO: 3416408 - RNA, 19 nt, Pseudomonas aeruginosa PA01
cucgcugggcgccggcagg

SEQ ID NO: 3416409 - RNA, 20 nt, Pseudomonas aeruginosa PA01
cucgcugggcgggcguccgu

SEQ ID NO: 3416410 - RNA, 19 nt, Pseudomonas aeruginosa PA01
cucgcuguaguuguucggc

SEQ ID NO: 3416411 - RNA, 14 nt, Pseudomonas aeruginosa PA01
cucgcuguccagca

SEQ ID NO: 3416412 - RNA, 12 nt, Pseudomonas aeruginosa PA01
cucgcuguccau

SEQ ID NO: 3416413 - RNA, 15 nt, Pseudomonas aeruginosa PA01
cucgcugucgccgag

SEQ ID NO: 3416414 - RNA, 16 nt, Pseudomonas aeruginosa PA01
cucgcugucgccgagc

SEQ ID NO: 3416415 - RNA, 17 nt, Pseudomonas aeruginosa PA01
cucgcugucgcucagcg

SEQ ID NO: 3416416 - RNA, 14 nt, Pseudomonas aeruginosa PA01
cucgcuucagcgag

SEQ ID NO: 3416417 - RNA, 15 nt, Pseudomonas aeruginosa PA01
cucgcuucagcgagc

SEQ ID NO: 3416418 - RNA, 21 nt, Pseudomonas aeruginosa PA01
cucggaaaccucgccggucag

SEQ ID NO: 3416419 - RNA, 15 nt, Pseudomonas aeruginosa PA01
cucggaaucggcgau

SEQ ID NO: 3416420 - RNA, 16 nt, Pseudomonas aeruginosa PA01
cucggaaucggcgauc

SEQ ID NO: 3416421 - RNA, 18 nt, Pseudomonas aeruginosa PA01
cucggacaagggccagag

SEQ ID NO: 3416422 - RNA, 22 nt, Pseudomonas aeruginosa PA01
cucggaccagaggcugacccgc

SEQ ID NO: 3416423 - RNA, 16 nt, Pseudomonas aeruginosa PA01
cucggacggcucgcgc

SEQ ID NO: 3416424 - RNA, 17 nt, Pseudomonas aeruginosa PA01
cucggacggcucgcgca

SEQ ID NO: 3416425 - RNA, 14 nt, Pseudomonas aeruginosa PA01
cucggagagcagcc

SEQ ID NO: 3416426 - RNA, 13 nt, Pseudomonas aeruginosa PA01
cucggagugaggc

SEQ ID NO: 3416427 - RNA, 21 nt, Pseudomonas aeruginosa PA01
cucggauaugccgcucagcgg

SEQ ID NO: 3416428 - RNA, 13 nt, Pseudomonas aeruginosa PA01
cucggaucaggcg

SEQ ID NO: 3416429 - RNA, 14 nt, Pseudomonas aeruginosa PA01
cucggaucaggcgg

SEQ ID NO: 3416430 - RNA, 23 nt, Pseudomonas aeruginosa PA01
cucggaucaggcgggcuccgccg

SEQ ID NO: 3416431 - RNA, 17 nt, Pseudomonas aeruginosa PA01
cucggauuccagcgcgg

SEQ ID NO: 3416432 - RNA, 15 nt, Pseudomonas aeruginosa PA01
cucggcaagcgaacc

SEQ ID NO: 3416433 - RNA, 13 nt, Pseudomonas aeruginosa PA01
cucggcaaucgcg

SEQ ID NO: 3416434 - RNA, 21 nt, Pseudomonas aeruginosa PA01
cucggcaaucgcggggugauu

SEQ ID NO: 3416435 - RNA, 19 nt, Pseudomonas aeruginosa PA01
cucggcacgcagcagcuuc

SEQ ID NO: 3416436 - RNA, 13 nt, Pseudomonas aeruginosa PA01
cucggcacgcgug

SEQ ID NO: 3416437 - RNA, 16 nt, Pseudomonas aeruginosa PA01
cucggcacgcguggcg

SEQ ID NO: 3416438 - RNA, 20 nt, Pseudomonas aeruginosa PA01
cucggcacgcguggcgagug

SEQ ID NO: 3416439 - RNA, 18 nt, Pseudomonas aeruginosa PA01
cucggcacucagccagcg

SEQ ID NO: 3416440 - RNA, 21 nt, Pseudomonas aeruginosa PA01
cucggcacucagccagcggcg

SEQ ID NO: 3416441 - RNA, 21 nt, Pseudomonas aeruginosa PA01
cucggcagcgcuacgcaggcc

SEQ ID NO: 3416442 - RNA, 18 nt, Pseudomonas aeruginosa PA01
cucggcagcgcuggcgau

SEQ ID NO: 3416443 - RNA, 20 nt, Pseudomonas aeruginosa PA01
cucggcagggcgcccgcccg

SEQ ID NO: 3416444 - RNA, 18 nt, Pseudomonas aeruginosa PA01
cucggcauccucgccccg

SEQ ID NO: 3416445 - RNA, 22 nt, Pseudomonas aeruginosa PA01
cucggcauccucgccccgccgg

SEQ ID NO: 3416446 - RNA, 23 nt, Pseudomonas aeruginosa PA01
cucggcauccucgccccgccggg

SEQ ID NO: 3416447 - RNA, 18 nt, Pseudomonas aeruginosa PA01
cucggcaucgaccaugcc

SEQ ID NO: 3416448 - RNA, 17 nt, Pseudomonas aeruginosa PA01
cucggcauucgacccgc

SEQ ID NO: 3416449 - RNA, 18 nt, Pseudomonas aeruginosa PA01
cucggcauucgacccgcc

SEQ ID NO: 3416450 - RNA, 22 nt, Pseudomonas aeruginosa PA01
cucggcauucgacccgccgacc

SEQ ID NO: 3416451 - RNA, 22 nt, Pseudomonas aeruginosa PA01
cucggccaaugcccggaccugg

SEQ ID NO: 3416452 - RNA, 17 nt, Pseudomonas aeruginosa PA01
cucggccagcaaugccc

SEQ ID NO: 3416453 - RNA, 12 nt, Pseudomonas aeruginosa PA01
cucggccagcca

SEQ ID NO: 3416454 - RNA, 21 nt, Pseudomonas aeruginosa PA01
cucggccagccagggcagcag

SEQ ID NO: 3416455 - RNA, 22 nt, Pseudomonas aeruginosa PA01
cucggccagccagggcagcagg

SEQ ID NO: 3416456 - RNA, 15 nt, Pseudomonas aeruginosa PA01
cucggccagcgccgc

SEQ ID NO: 3416457 - RNA, 16 nt, Pseudomonas aeruginosa PA01
cucggccagcucgccg

SEQ ID NO: 3416458 - RNA, 17 nt, Pseudomonas aeruginosa PA01
cucggccagcucgccga

SEQ ID NO: 3416459 - RNA, 19 nt, Pseudomonas aeruginosa PA01
cucggccagcucgccgaac

SEQ ID NO: 3416460 - RNA, 19 nt, Pseudomonas aeruginosa PA01
cucggccaggaccagggcg

SEQ ID NO: 3416461 - RNA, 20 nt, Pseudomonas aeruginosa PA01
cucggccaggaccagggcgg

SEQ ID NO: 3416462 - RNA, 21 nt, Pseudomonas aeruginosa PA01
cucggccaggaccagggcggg

SEQ ID NO: 3416463 - RNA, 11 nt, Pseudomonas aeruginosa PA01
cucggccaggc

SEQ ID NO: 3416464 - RNA, 18 nt, Pseudomonas aeruginosa PA01
cucggccaggcgccaggg

SEQ ID NO: 3416465 - RNA, 13 nt, Pseudomonas aeruginosa PA01
cucggccaggcgg

SEQ ID NO: 3416466 - RNA, 21 nt, Pseudomonas aeruginosa PA01
cucggccaggcgguuccagac

SEQ ID NO: 3416467 - RNA, 11 nt, Pseudomonas aeruginosa PA01
cucggccaggg

SEQ ID NO: 3416468 - RNA, 22 nt, Pseudomonas aeruginosa PA01
cucggccagguacuuggccacg

SEQ ID NO: 3416469 - RNA, 19 nt, Pseudomonas aeruginosa PA01
cucggccaguucgcggcgc

SEQ ID NO: 3416470 - RNA, 20 nt, Pseudomonas aeruginosa PA01
cucggccaguucgcggcgca

SEQ ID NO: 3416471 - RNA, 16 nt, Pseudomonas aeruginosa PA01
cucggccaguucgucg

SEQ ID NO: 3416472 - RNA, 21 nt, Pseudomonas aeruginosa PA01
cucggccauaccuccagccag

SEQ ID NO: 3416473 - RNA, 17 nt, Pseudomonas aeruginosa PA01
cucggccaucagcgcca

SEQ ID NO: 3416474 - RNA, 18 nt, Pseudomonas aeruginosa PA01
cucggccaucagcgccag

SEQ ID NO: 3416475 - RNA, 17 nt, Pseudomonas aeruginosa PA01
cucggccaugccggcca

SEQ ID NO: 3416476 - RNA, 23 nt, Pseudomonas aeruginosa PA01
cucggccaugccggccaggaagg

SEQ ID NO: 3416477 - RNA, 19 nt, Pseudomonas aeruginosa PA01
cucggccauggucucgcug

SEQ ID NO: 3416478 - RNA, 23 nt, Pseudomonas aeruginosa PA01
cucggcccaugaaaaagcccggc

SEQ ID NO: 3416479 - RNA, 21 nt, Pseudomonas aeruginosa PA01
cucggcccggagccaacgccc

SEQ ID NO: 3416480 - RNA, 20 nt, Pseudomonas aeruginosa PA01
cucggcccgggccuggugca

SEQ ID NO: 3416481 - RNA, 17 nt, Pseudomonas aeruginosa PA01
cucggcccuggcggcga

SEQ ID NO: 3416482 - RNA, 18 nt, Pseudomonas aeruginosa PA01
cucggcccuggcggcgaa

SEQ ID NO: 3416483 - RNA, 15 nt, Pseudomonas aeruginosa PA01
cucggccgacaggcu

SEQ ID NO: 3416484 - RNA, 17 nt, Pseudomonas aeruginosa PA01
cucggccgacaggcugg

SEQ ID NO: 3416485 - RNA, 21 nt, Pseudomonas aeruginosa PA01
cucggccgcaucgaccuugcc

SEQ ID NO: 3416486 - RNA, 14 nt, Pseudomonas aeruginosa PA01
cucggccgccagca

SEQ ID NO: 3416487 - RNA, 13 nt, Pseudomonas aeruginosa PA01
cucggccgccagg

SEQ ID NO: 3416488 - RNA, 14 nt, Pseudomonas aeruginosa PA01
cucggccgccaggc

SEQ ID NO: 3416489 - RNA, 16 nt, Pseudomonas aeruginosa PA01
cucggccgccaggcgc

SEQ ID NO: 3416490 - RNA, 14 nt, Pseudomonas aeruginosa PA01
cucggccgccuggc

SEQ ID NO: 3416491 - RNA, 12 nt, Pseudomonas aeruginosa PA01
cucggccggcag

SEQ ID NO: 3416492 - RNA, 13 nt, Pseudomonas aeruginosa PA01
cucggccggcagg

SEQ ID NO: 3416493 - RNA, 21 nt, Pseudomonas aeruginosa PA01
cucggccgugugccugagcug

SEQ ID NO: 3416494 - RNA, 13 nt, Pseudomonas aeruginosa PA01
cucggccucggcg

SEQ ID NO: 3416495 - RNA, 22 nt, Pseudomonas aeruginosa PA01
cucggccucggcgucgcgcagg

SEQ ID NO: 3416496 - RNA, 19 nt, Pseudomonas aeruginosa PA01
cucggccugaucaucuggg

SEQ ID NO: 3416497 - RNA, 22 nt, Pseudomonas aeruginosa PA01
cucggccugaucaucugggcca

SEQ ID NO: 3416498 - RNA, 19 nt, Pseudomonas aeruginosa PA01
cucggccugcugcgccggc

SEQ ID NO: 3416499 - RNA, 23 nt, Pseudomonas aeruginosa PA01
cucggccugcugcgccggcacgg

SEQ ID NO: 3416500 - RNA, 19 nt, Pseudomonas aeruginosa PA01
cucggccugggcgcaggcc

SEQ ID NO: 3416501 - RNA, 20 nt, Pseudomonas aeruginosa PA01
cucggccugggcgcaggccg

SEQ ID NO: 3416502 - RNA, 21 nt, Pseudomonas aeruginosa PA01
cucggccugggcgcaggccga

SEQ ID NO: 3416503 - RNA, 18 nt, Pseudomonas aeruginosa PA01
cucggccuggugcaccug

SEQ ID NO: 3416504 - RNA, 20 nt, Pseudomonas aeruginosa PA01
cucggccuggugcaccuggc

SEQ ID NO: 3416505 - RNA, 21 nt, Pseudomonas aeruginosa PA01
cucggccuggugcaccuggcg

SEQ ID NO: 3416506 - RNA, 22 nt, Pseudomonas aeruginosa PA01
cucggccuggugcaccuggcga

SEQ ID NO: 3416507 - RNA, 20 nt, Pseudomonas aeruginosa PA01
cucggccuguaccgcuuccu

SEQ ID NO: 3416508 - RNA, 17 nt, Pseudomonas aeruginosa PA01
cucggccuugagcgccg

SEQ ID NO: 3416509 - RNA, 17 nt, Pseudomonas aeruginosa PA01
cucggccuugcuggcga

SEQ ID NO: 3416510 - RNA, 18 nt, Pseudomonas aeruginosa PA01
cucggcgaagucgccguc

SEQ ID NO: 3416511 - RNA, 13 nt, Pseudomonas aeruginosa PA01
cucggcgaccacc

SEQ ID NO: 3416512 - RNA, 15 nt, Pseudomonas aeruginosa PA01
cucggcgaccacccg

SEQ ID NO: 3416513 - RNA, 16 nt, Pseudomonas aeruginosa PA01
cucggcgaccacccgg

SEQ ID NO: 3416514 - RNA, 14 nt, Pseudomonas aeruginosa PA01
cucggcgaccaccg

SEQ ID NO: 3416515 - RNA, 23 nt, Pseudomonas aeruginosa PA01
cucggcgaccuugcgcaccaggg

SEQ ID NO: 3416516 - RNA, 15 nt, Pseudomonas aeruginosa PA01
cucggcgacgaggac

SEQ ID NO: 3416517 - RNA, 16 nt, Pseudomonas aeruginosa PA01
cucggcgacuucgcau

SEQ ID NO: 3416518 - RNA, 18 nt, Pseudomonas aeruginosa PA01
cucggcgagccgccgggc

SEQ ID NO: 3416519 - RNA, 15 nt, Pseudomonas aeruginosa PA01
cucggcgaggaacag

SEQ ID NO: 3416520 - RNA, 21 nt, Pseudomonas aeruginosa PA01
cucggcgaggaacagcaccag

SEQ ID NO: 3416521 - RNA, 15 nt, Pseudomonas aeruginosa PA01
cucggcgaggccggc

SEQ ID NO: 3416522 - RNA, 18 nt, Pseudomonas aeruginosa PA01
cucggcgaguucgcgcag

SEQ ID NO: 3416523 - RNA, 20 nt, Pseudomonas aeruginosa PA01
cucggcgaguucgcgcaggc

SEQ ID NO: 3416524 - RNA, 22 nt, Pseudomonas aeruginosa PA01
cucggcgaguucgcgcaggcgg

SEQ ID NO: 3416525 - RNA, 15 nt, Pseudomonas aeruginosa PA01
cucggcgaucacccg

SEQ ID NO: 3416526 - RNA, 22 nt, Pseudomonas aeruginosa PA01
cucggcgaucacccggcgaagc

SEQ ID NO: 3416527 - RNA, 18 nt, Pseudomonas aeruginosa PA01
cucggcgauccgcgcuuc

SEQ ID NO: 3416528 - RNA, 14 nt, Pseudomonas aeruginosa PA01
cucggcgaugccgc

SEQ ID NO: 3416529 - RNA, 16 nt, Pseudomonas aeruginosa PA01
cucggcgaugccgccg

SEQ ID NO: 3416530 - RNA, 23 nt, Pseudomonas aeruginosa PA01
cucggcgaugccggagagcagca

SEQ ID NO: 3416531 - RNA, 13 nt, Pseudomonas aeruginosa PA01
cucggcgauggcg

SEQ ID NO: 3416532 - RNA, 17 nt, Pseudomonas aeruginosa PA01
cucggcgauggcgcgcg

SEQ ID NO: 3416533 - RNA, 20 nt, Pseudomonas aeruginosa PA01
cucggcgauggcgcgcgggc

SEQ ID NO: 3416534 - RNA, 23 nt, Pseudomonas aeruginosa PA01
cucggcgauggcgcgcgggccuu

SEQ ID NO: 3416535 - RNA, 18 nt, Pseudomonas aeruginosa PA01
cucggcgauucgcggcga

SEQ ID NO: 3416536 - RNA, 17 nt, Pseudomonas aeruginosa PA01
cucggcgcaggcaugga

SEQ ID NO: 3416537 - RNA, 19 nt, Pseudomonas aeruginosa PA01
cucggcgccauaggccagc

SEQ ID NO: 3416538 - RNA, 20 nt, Pseudomonas aeruginosa PA01
cucggcgccauaggccagca

SEQ ID NO: 3416539 - RNA, 16 nt, Pseudomonas aeruginosa PA01
cucggcgcccagggcu

SEQ ID NO: 3416540 - RNA, 13 nt, Pseudomonas aeruginosa PA01
cucggcgcccgcc

SEQ ID NO: 3416541 - RNA, 14 nt, Pseudomonas aeruginosa PA01
cucggcgcccuggc

SEQ ID NO: 3416542 - RNA, 15 nt, Pseudomonas aeruginosa PA01
cucggcgcccuggcc

SEQ ID NO: 3416543 - RNA, 16 nt, Pseudomonas aeruginosa PA01
cucggcgcccugggug

SEQ ID NO: 3416544 - RNA, 14 nt, Pseudomonas aeruginosa PA01
cucggcgccgagca

SEQ ID NO: 3416545 - RNA, 19 nt, Pseudomonas aeruginosa PA01
cucggcgccgaucuccgcu

SEQ ID NO: 3416546 - RNA, 14 nt, Pseudomonas aeruginosa PA01
cucggcgccgucga

SEQ ID NO: 3416547 - RNA, 16 nt, Pseudomonas aeruginosa PA01
cucggcgccgucgauc

SEQ ID NO: 3416548 - RNA, 23 nt, Pseudomonas aeruginosa PA01
cucggcgccgucgaucagguagg

SEQ ID NO: 3416549 - RNA, 19 nt, Pseudomonas aeruginosa PA01
cucggcgcgauccuccgcc

SEQ ID NO: 3416550 - RNA, 23 nt, Pseudomonas aeruginosa PA01
cucggcgcgauccuccgccagcc

SEQ ID NO: 3416551 - RNA, 14 nt, Pseudomonas aeruginosa PA01
cucggcgcgcgccc

SEQ ID NO: 3416552 - RNA, 20 nt, Pseudomonas aeruginosa PA01
cucggcgcgcgcccccuggc

SEQ ID NO: 3416553 - RNA, 13 nt, Pseudomonas aeruginosa PA01
cucggcgcucggc

SEQ ID NO: 3416554 - RNA, 16 nt, Pseudomonas aeruginosa PA01
cucggcgcugccggcc

SEQ ID NO: 3416555 - RNA, 18 nt, Pseudomonas aeruginosa PA01
cucggcgcugccggccag

SEQ ID NO: 3416556 - RNA, 13 nt, Pseudomonas aeruginosa PA01
cucggcgcuggcc

SEQ ID NO: 3416557 - RNA, 18 nt, Pseudomonas aeruginosa PA01
cucggcgcuuucgcucug

SEQ ID NO: 3416558 - RNA, 20 nt, Pseudomonas aeruginosa PA01
cucggcggacagcccgcgcu

SEQ ID NO: 3416559 - RNA, 12 nt, Pseudomonas aeruginosa PA01
cucggcggcagg

SEQ ID NO: 3416560 - RNA, 16 nt, Pseudomonas aeruginosa PA01
cucggcggcaggcugc

SEQ ID NO: 3416561 - RNA, 21 nt, Pseudomonas aeruginosa PA01
cucggcggcaggcugcgccgc

SEQ ID NO: 3416562 - RNA, 22 nt, Pseudomonas aeruginosa PA01
cucggcggcaggcugcgccgcu

SEQ ID NO: 3416563 - RNA, 16 nt, Pseudomonas aeruginosa PA01
cucggcggccaggcgg

SEQ ID NO: 3416564 - RNA, 18 nt, Pseudomonas aeruginosa PA01
cucggcggccauugccgc

SEQ ID NO: 3416565 - RNA, 10 nt, Pseudomonas aeruginosa PA01
cucggcggcg

SEQ ID NO: 3416566 - RNA, 13 nt, Pseudomonas aeruginosa PA01
cucggcggcgagc

SEQ ID NO: 3416567 - RNA, 19 nt, Pseudomonas aeruginosa PA01
cucggcggcgagcgccgcg

SEQ ID NO: 3416568 - RNA, 21 nt, Pseudomonas aeruginosa PA01
cucggcggcgagcgccgcggc

SEQ ID NO: 3416569 - RNA, 16 nt, Pseudomonas aeruginosa PA01
cucggcggcgagcggg

SEQ ID NO: 3416570 - RNA, 19 nt, Pseudomonas aeruginosa PA01
cucggcggcgcgaaccagc

SEQ ID NO: 3416571 - RNA, 21 nt, Pseudomonas aeruginosa PA01
cucggcggcgcgaaccagcag

SEQ ID NO: 3416572 - RNA, 16 nt, Pseudomonas aeruginosa PA01
cucggcggcgcgcagc

SEQ ID NO: 3416573 - RNA, 23 nt, Pseudomonas aeruginosa PA01
cucggcggcggccugcucgcgca

SEQ ID NO: 3416574 - RNA, 17 nt, Pseudomonas aeruginosa PA01
cucggcggcggucgcga

SEQ ID NO: 3416575 - RNA, 13 nt, Pseudomonas aeruginosa PA01
cucggcgggagag

SEQ ID NO: 3416576 - RNA, 18 nt, Pseudomonas aeruginosa PA01
cucggcgggagagggcgg

SEQ ID NO: 3416577 - RNA, 22 nt, Pseudomonas aeruginosa PA01
cucggcgggagagggcggcgac

SEQ ID NO: 3416578 - RNA, 13 nt, Pseudomonas aeruginosa PA01
cucggcgggcugc

SEQ ID NO: 3416579 - RNA, 14 nt, Pseudomonas aeruginosa PA01
cucggcggggcgca

SEQ ID NO: 3416580 - RNA, 19 nt, Pseudomonas aeruginosa PA01
cucggcggggcgcagcagg

SEQ ID NO: 3416581 - RNA, 21 nt, Pseudomonas aeruginosa PA01
cucggcggguauccgccgggc

SEQ ID NO: 3416582 - RNA, 22 nt, Pseudomonas aeruginosa PA01
cucggcggguauccgccgggcc

SEQ ID NO: 3416583 - RNA, 20 nt, Pseudomonas aeruginosa PA01
cucggcggucaggccaagcu

SEQ ID NO: 3416584 - RNA, 17 nt, Pseudomonas aeruginosa PA01
cucggcggugaccggau

SEQ ID NO: 3416585 - RNA, 17 nt, Pseudomonas aeruginosa PA01
cucggcguagccggcca

SEQ ID NO: 3416586 - RNA, 20 nt, Pseudomonas aeruginosa PA01
cucggcguagccggccaggg

SEQ ID NO: 3416587 - RNA, 16 nt, Pseudomonas aeruginosa PA01
cucggcguagcgcugg

SEQ ID NO: 3416588 - RNA, 22 nt, Pseudomonas aeruginosa PA01
cucggcguccuugggaucgucg

SEQ ID NO: 3416589 - RNA, 15 nt, Pseudomonas aeruginosa PA01
cucggcgucgcgcag

SEQ ID NO: 3416590 - RNA, 17 nt, Pseudomonas aeruginosa PA01
cucggcgucgcgcaggc

SEQ ID NO: 3416591 - RNA, 14 nt, Pseudomonas aeruginosa PA01
cucggcgucgcgcu

SEQ ID NO: 3416592 - RNA, 16 nt, Pseudomonas aeruginosa PA01
cucggcgucggcaugg

SEQ ID NO: 3416593 - RNA, 14 nt, Pseudomonas aeruginosa PA01
cucggcgucgucga

SEQ ID NO: 3416594 - RNA, 17 nt, Pseudomonas aeruginosa PA01
cucggcgucgucgaucg

SEQ ID NO: 3416595 - RNA, 16 nt, Pseudomonas aeruginosa PA01
cucggcgugccgggcc

SEQ ID NO: 3416596 - RNA, 17 nt, Pseudomonas aeruginosa PA01
cucggcgugccgggccg

SEQ ID NO: 3416597 - RNA, 22 nt, Pseudomonas aeruginosa PA01
cucggcgugccgggccggccag

SEQ ID NO: 3416598 - RNA, 18 nt, Pseudomonas aeruginosa PA01
cucggcuaccccacgcga

SEQ ID NO: 3416599 - RNA, 14 nt, Pseudomonas aeruginosa PA01
cucggcuacgaacc

SEQ ID NO: 3416600 - RNA, 16 nt, Pseudomonas aeruginosa PA01
cucggcuccagccagg

SEQ ID NO: 3416601 - RNA, 20 nt, Pseudomonas aeruginosa PA01
cucggcuccaggaccggcag

SEQ ID NO: 3416602 - RNA, 14 nt, Pseudomonas aeruginosa PA01
cucggcugccgcca

SEQ ID NO: 3416603 - RNA, 15 nt, Pseudomonas aeruginosa PA01
cucggcugccgccag

SEQ ID NO: 3416604 - RNA, 16 nt, Pseudomonas aeruginosa PA01
cucggcugccgccagc

SEQ ID NO: 3416605 - RNA, 19 nt, Pseudomonas aeruginosa PA01
cucggcuuccaucaccgcg

SEQ ID NO: 3416606 - RNA, 19 nt, Pseudomonas aeruginosa PA01
cucggcuugacuggcaguc

SEQ ID NO: 3416607 - RNA, 22 nt, Pseudomonas aeruginosa PA01
cucggcuugacuggcaguccag

SEQ ID NO: 3416608 - RNA, 16 nt, Pseudomonas aeruginosa PA01
cucgggcaccagcacg

SEQ ID NO: 3416609 - RNA, 17 nt, Pseudomonas aeruginosa PA01
cucgggcaccagcacgg

SEQ ID NO: 3416610 - RNA, 17 nt, Pseudomonas aeruginosa PA01
cucgggccaugagcagg

SEQ ID NO: 3416611 - RNA, 15 nt, Pseudomonas aeruginosa PA01
cucgggccggagcag

SEQ ID NO: 3416612 - RNA, 16 nt, Pseudomonas aeruginosa PA01
cucgggccggagcagg

SEQ ID NO: 3416613 - RNA, 22 nt, Pseudomonas aeruginosa PA01
cucgggcgagaaucgccgaggc

SEQ ID NO: 3416614 - RNA, 12 nt, Pseudomonas aeruginosa PA01
cucgggcgccgu

SEQ ID NO: 3416615 - RNA, 21 nt, Pseudomonas aeruginosa PA01
cucgggcggaucgagcagcgg

SEQ ID NO: 3416616 - RNA, 22 nt, Pseudomonas aeruginosa PA01
cucgggcgggaucuccgcgcca

SEQ ID NO: 3416617 - RNA, 16 nt, Pseudomonas aeruginosa PA01
cucggggaagcgcggc

SEQ ID NO: 3416618 - RNA, 16 nt, Pseudomonas aeruginosa PA01
cucggggaaggucacc

SEQ ID NO: 3416619 - RNA, 23 nt, Pseudomonas aeruginosa PA01
cucggggauguccgccgcccagu

SEQ ID NO: 3416620 - RNA, 20 nt, Pseudomonas aeruginosa PA01
cucggggccgaggucgacca

SEQ ID NO: 3416621 - RNA, 19 nt, Pseudomonas aeruginosa PA01
cucggggcgccuccagcgg

SEQ ID NO: 3416622 - RNA, 15 nt, Pseudomonas aeruginosa PA01
cucgggggugcccau

SEQ ID NO: 3416623 - RNA, 19 nt, Pseudomonas aeruginosa PA01
cucgggggugcccaucagg

SEQ ID NO: 3416624 - RNA, 22 nt, Pseudomonas aeruginosa PA01
cucgggggugcccaucaggcuc

SEQ ID NO: 3416625 - RNA, 20 nt, Pseudomonas aeruginosa PA01
cucggggucgucgcuggcgg

SEQ ID NO: 3416626 - RNA, 18 nt, Pseudomonas aeruginosa PA01
cucggggugcgcggcgaa

SEQ ID NO: 3416627 - RNA, 19 nt, Pseudomonas aeruginosa PA01
cucggguuuggcgcccgcc

SEQ ID NO: 3416628 - RNA, 16 nt, Pseudomonas aeruginosa PA01
cucgguaaagcccagg

SEQ ID NO: 3416629 - RNA, 20 nt, Pseudomonas aeruginosa PA01
cucgguagccggccaaccac

SEQ ID NO: 3416630 - RNA, 17 nt, Pseudomonas aeruginosa PA01
cucgguauggcugcugu

SEQ ID NO: 3416631 - RNA, 19 nt, Pseudomonas aeruginosa PA01
cucgguauuguggccccag

SEQ ID NO: 3416632 - RNA, 16 nt, Pseudomonas aeruginosa PA01
cucggucagcggcgca

SEQ ID NO: 3416633 - RNA, 14 nt, Pseudomonas aeruginosa PA01
cucggucagcuccc

SEQ ID NO: 3416634 - RNA, 18 nt, Pseudomonas aeruginosa PA01
cucggucaggcgcuggug

SEQ ID NO: 3416635 - RNA, 23 nt, Pseudomonas aeruginosa PA01
cucgguccaacccauguggcgca

SEQ ID NO: 3416636 - RNA, 17 nt, Pseudomonas aeruginosa PA01
cucgguccagaucgcca

SEQ ID NO: 3416637 - RNA, 18 nt, Pseudomonas aeruginosa PA01
cucggucgagccccacgu

SEQ ID NO: 3416638 - RNA, 14 nt, Pseudomonas aeruginosa PA01
cucggucgccgcca

SEQ ID NO: 3416639 - RNA, 15 nt, Pseudomonas aeruginosa PA01
cucggucgccgccag

SEQ ID NO: 3416640 - RNA, 17 nt, Pseudomonas aeruginosa PA01
cucggucgccgccagca

SEQ ID NO: 3416641 - RNA, 14 nt, Pseudomonas aeruginosa PA01
cucggucgggcggg

SEQ ID NO: 3416642 - RNA, 16 nt, Pseudomonas aeruginosa PA01
cucggugaccaccagg

SEQ ID NO: 3416643 - RNA, 19 nt, Pseudomonas aeruginosa PA01
cucggugaccaccaggcgg

SEQ ID NO: 3416644 - RNA, 17 nt, Pseudomonas aeruginosa PA01
cucggugaccaccuuga

SEQ ID NO: 3416645 - RNA, 14 nt, Pseudomonas aeruginosa PA01
cucggugagcaggc

SEQ ID NO: 3416646 - RNA, 21 nt, Pseudomonas aeruginosa PA01
cucggugagcaggcgccggac

SEQ ID NO: 3416647 - RNA, 23 nt, Pseudomonas aeruginosa PA01
cucggugaggaacuugucgacca

SEQ ID NO: 3416648 - RNA, 13 nt, Pseudomonas aeruginosa PA01
cucggugagguag

SEQ ID NO: 3416649 - RNA, 18 nt, Pseudomonas aeruginosa PA01
cucggugauaccgccggc

SEQ ID NO: 3416650 - RNA, 19 nt, Pseudomonas aeruginosa PA01
cucggugauaccgccggcg

SEQ ID NO: 3416651 - RNA, 20 nt, Pseudomonas aeruginosa PA01
cucggugauaccgccggcgg

SEQ ID NO: 3416652 - RNA, 22 nt, Pseudomonas aeruginosa PA01
cucggugauaccgccggcggcg

SEQ ID NO: 3416653 - RNA, 23 nt, Pseudomonas aeruginosa PA01
cucggugauaccgccggcggcga

SEQ ID NO: 3416654 - RNA, 19 nt, Pseudomonas aeruginosa PA01
cucggugcagaugaccagc

SEQ ID NO: 3416655 - RNA, 18 nt, Pseudomonas aeruginosa PA01
cucggugccgucaugcac

SEQ ID NO: 3416656 - RNA, 22 nt, Pseudomonas aeruginosa PA01
cucggugccgucaugcacuucg

SEQ ID NO: 3416657 - RNA, 15 nt, Pseudomonas aeruginosa PA01
cucggugccuuccca

SEQ ID NO: 3416658 - RNA, 20 nt, Pseudomonas aeruginosa PA01
cucggugccuucccagccga

SEQ ID NO: 3416659 - RNA, 21 nt, Pseudomonas aeruginosa PA01
cucggugccuucccagccgag

SEQ ID NO: 3416660 - RNA, 22 nt, Pseudomonas aeruginosa PA01
cucggugccuucccagccgagg

SEQ ID NO: 3416661 - RNA, 23 nt, Pseudomonas aeruginosa PA01
cucggugccuucccagccgaggc

SEQ ID NO: 3416662 - RNA, 15 nt, Pseudomonas aeruginosa PA01
cucggugcgccccag

SEQ ID NO: 3416663 - RNA, 18 nt, Pseudomonas aeruginosa PA01
cucggugcgccccaggug

SEQ ID NO: 3416664 - RNA, 12 nt, Pseudomonas aeruginosa PA01
cucggugcguag

SEQ ID NO: 3416665 - RNA, 23 nt, Pseudomonas aeruginosa PA01
cucggugcguagcgacaggcccu

SEQ ID NO: 3416666 - RNA, 17 nt, Pseudomonas aeruginosa PA01
cucggugggcuugccgg

SEQ ID NO: 3416667 - RNA, 13 nt, Pseudomonas aeruginosa PA01
cucggugguguag

SEQ ID NO: 3416668 - RNA, 13 nt, Pseudomonas aeruginosa PA01
cucgguguagcug

SEQ ID NO: 3416669 - RNA, 14 nt, Pseudomonas aeruginosa PA01
cucgguguagcuga

SEQ ID NO: 3416670 - RNA, 21 nt, Pseudomonas aeruginosa PA01
cucgguguaggcgaucuggcg

SEQ ID NO: 3416671 - RNA, 17 nt, Pseudomonas aeruginosa PA01
cucggugucggccaacu

SEQ ID NO: 3416672 - RNA, 17 nt, Pseudomonas aeruginosa PA01
cucggugucggugaugc

SEQ ID NO: 3416673 - RNA, 19 nt, Pseudomonas aeruginosa PA01
cucggugugaucaccagcc

SEQ ID NO: 3416674 - RNA, 13 nt, Pseudomonas aeruginosa PA01
cucgguuccagcu

SEQ ID NO: 3416675 - RNA, 22 nt, Pseudomonas aeruginosa PA01
cucgguuccagcucgucgauga

SEQ ID NO: 3416676 - RNA, 13 nt, Pseudomonas aeruginosa PA01
cucgguugccagg

SEQ ID NO: 3416677 - RNA, 15 nt, Pseudomonas aeruginosa PA01
cucgguugccaggcc

SEQ ID NO: 3416678 - RNA, 17 nt, Pseudomonas aeruginosa PA01
cucgguugccaggccgg

SEQ ID NO: 3416679 - RNA, 21 nt, Pseudomonas aeruginosa PA01
cucgguugccaggccggcgca

SEQ ID NO: 3416680 - RNA, 16 nt, Pseudomonas aeruginosa PA01
cucgguuuccaggaug

SEQ ID NO: 3416681 - RNA, 17 nt, Pseudomonas aeruginosa PA01
cucgguuuccggccagg

SEQ ID NO: 3416682 - RNA, 21 nt, Pseudomonas aeruginosa PA01
cucgguuuccggccaggcgcg

SEQ ID NO: 3416683 - RNA, 14 nt, Pseudomonas aeruginosa PA01
cucguacaugcgcg

SEQ ID NO: 3416684 - RNA, 15 nt, Pseudomonas aeruginosa PA01
cucguagcagccacg

SEQ ID NO: 3416685 - RNA, 18 nt, Pseudomonas aeruginosa PA01
cucguagccggcgcggcg

SEQ ID NO: 3416686 - RNA, 20 nt, Pseudomonas aeruginosa PA01
cucguagcggucgugcagca

SEQ ID NO: 3416687 - RNA, 22 nt, Pseudomonas aeruginosa PA01
cucguagcggucgugcagcagc

SEQ ID NO: 3416688 - RNA, 14 nt, Pseudomonas aeruginosa PA01
cucguaggccgacu

SEQ ID NO: 3416689 - RNA, 20 nt, Pseudomonas aeruginosa PA01
cucguaggccgacucgcgau

SEQ ID NO: 3416690 - RNA, 21 nt, Pseudomonas aeruginosa PA01
cucguaggccgacucgcgauc

SEQ ID NO: 3416691 - RNA, 15 nt, Pseudomonas aeruginosa PA01
cucguaggcggcgcg

SEQ ID NO: 3416692 - RNA, 15 nt, Pseudomonas aeruginosa PA01
cucguaggcguccug

SEQ ID NO: 3416693 - RNA, 19 nt, Pseudomonas aeruginosa PA01
cucguaggcguccuggcga

SEQ ID NO: 3416694 - RNA, 22 nt, Pseudomonas aeruginosa PA01
cucguagggguaggggucggcc

SEQ ID NO: 3416695 - RNA, 23 nt, Pseudomonas aeruginosa PA01
cucguagggguaggggucggccu

SEQ ID NO: 3416696 - RNA, 20 nt, Pseudomonas aeruginosa PA01
cucguagucgaucaggaaca

SEQ ID NO: 3416697 - RNA, 17 nt, Pseudomonas aeruginosa PA01
cucgucacccgcgccug

SEQ ID NO: 3416698 - RNA, 15 nt, Pseudomonas aeruginosa PA01
cucgucaucauccug

SEQ ID NO: 3416699 - RNA, 20 nt, Pseudomonas aeruginosa PA01
cucgucauggcgcacgccgc

SEQ ID NO: 3416700 - RNA, 16 nt, Pseudomonas aeruginosa PA01
cucguccagcaggccc

SEQ ID NO: 3416701 - RNA, 13 nt, Pseudomonas aeruginosa PA01
cucguccaggccg

SEQ ID NO: 3416702 - RNA, 14 nt, Pseudomonas aeruginosa PA01
cucguccagguccg

SEQ ID NO: 3416703 - RNA, 15 nt, Pseudomonas aeruginosa PA01
cucguccagguccgc

SEQ ID NO: 3416704 - RNA, 17 nt, Pseudomonas aeruginosa PA01
cucguccauguugcggc

SEQ ID NO: 3416705 - RNA, 13 nt, Pseudomonas aeruginosa PA01
cucguccgacagc

SEQ ID NO: 3416706 - RNA, 14 nt, Pseudomonas aeruginosa PA01
cucguccucggcgu

SEQ ID NO: 3416707 - RNA, 22 nt, Pseudomonas aeruginosa PA01
cucguccucggggaagcgcggc

SEQ ID NO: 3416708 - RNA, 15 nt, Pseudomonas aeruginosa PA01
cucguccuuggugcu

SEQ ID NO: 3416709 - RNA, 20 nt, Pseudomonas aeruginosa PA01
cucgucgaagcgcaguaccc

SEQ ID NO: 3416710 - RNA, 20 nt, Pseudomonas aeruginosa PA01
cucgucgacgcccuggcgcu

SEQ ID NO: 3416711 - RNA, 14 nt, Pseudomonas aeruginosa PA01
cucgucgacgcuca

SEQ ID NO: 3416712 - RNA, 21 nt, Pseudomonas aeruginosa PA01
cucgucgacgcucagcacccu

SEQ ID NO: 3416713 - RNA, 11 nt, Pseudomonas aeruginosa PA01
cucgucgacgg

SEQ ID NO: 3416714 - RNA, 17 nt, Pseudomonas aeruginosa PA01
cucgucgagcagcgcgc

SEQ ID NO: 3416715 - RNA, 19 nt, Pseudomonas aeruginosa PA01
cucgucgagcagcgcgcgg

SEQ ID NO: 3416716 - RNA, 21 nt, Pseudomonas aeruginosa PA01
cucgucgagcaucugccgggc

SEQ ID NO: 3416717 - RNA, 15 nt, Pseudomonas aeruginosa PA01
cucgucgagcgcagc

SEQ ID NO: 3416718 - RNA, 19 nt, Pseudomonas aeruginosa PA01
cucgucgagcgcagcgaca

SEQ ID NO: 3416719 - RNA, 18 nt, Pseudomonas aeruginosa PA01
cucgucgccaugcggcag

SEQ ID NO: 3416720 - RNA, 20 nt, Pseudomonas aeruginosa PA01
cucgucgccaugcggcaggc

SEQ ID NO: 3416721 - RNA, 14 nt, Pseudomonas aeruginosa PA01
cucgucgcccuuca

SEQ ID NO: 3416722 - RNA, 18 nt, Pseudomonas aeruginosa PA01
cucgucgccgacccugca

SEQ ID NO: 3416723 - RNA, 20 nt, Pseudomonas aeruginosa PA01
cucgucgccgacccugcacc

SEQ ID NO: 3416724 - RNA, 22 nt, Pseudomonas aeruginosa PA01
cucgucgccgacccugcacccu

SEQ ID NO: 3416725 - RNA, 12 nt, Pseudomonas aeruginosa PA01
cucgucgccgcc

SEQ ID NO: 3416726 - RNA, 18 nt, Pseudomonas aeruginosa PA01
cucgucgccgcccggcag

SEQ ID NO: 3416727 - RNA, 20 nt, Pseudomonas aeruginosa PA01
cucgucgccgcccggcagcg

SEQ ID NO: 3416728 - RNA, 23 nt, Pseudomonas aeruginosa PA01
cucgucgccgcccggcagcggcu

SEQ ID NO: 3416729 - RNA, 14 nt, Pseudomonas aeruginosa PA01
cucgucgcgccagg

SEQ ID NO: 3416730 - RNA, 16 nt, Pseudomonas aeruginosa PA01
cucgucgcgccaggcg

SEQ ID NO: 3416731 - RNA, 20 nt, Pseudomonas aeruginosa PA01
cucgucggcggggcgcaccg

SEQ ID NO: 3416732 - RNA, 13 nt, Pseudomonas aeruginosa PA01
cucgucguagucg

SEQ ID NO: 3416733 - RNA, 16 nt, Pseudomonas aeruginosa PA01
cucgucguucagccca

SEQ ID NO: 3416734 - RNA, 20 nt, Pseudomonas aeruginosa PA01
cucgucguucagcccacccc

SEQ ID NO: 3416735 - RNA, 23 nt, Pseudomonas aeruginosa PA01
cucgucguucagcccacccccag

SEQ ID NO: 3416736 - RNA, 13 nt, Pseudomonas aeruginosa PA01
cucgucuuccuug

SEQ ID NO: 3416737 - RNA, 18 nt, Pseudomonas aeruginosa PA01
cucgucuuccuugcugaa

SEQ ID NO: 3416738 - RNA, 23 nt, Pseudomonas aeruginosa PA01
cucgugcaacggcacgaccuucu

SEQ ID NO: 3416739 - RNA, 19 nt, Pseudomonas aeruginosa PA01
cucgugcagcaagccgcag

SEQ ID NO: 3416740 - RNA, 23 nt, Pseudomonas aeruginosa PA01
cucgugcagcaagccgcagcgcc

SEQ ID NO: 3416741 - RNA, 19 nt, Pseudomonas aeruginosa PA01
cucgugcagguagccgcgc

SEQ ID NO: 3416742 - RNA, 21 nt, Pseudomonas aeruginosa PA01
cucgugcagguagccgcgccg

SEQ ID NO: 3416743 - RNA, 23 nt, Pseudomonas aeruginosa PA01
cucgugcagguagccgcgccggc

SEQ ID NO: 3416744 - RNA, 17 nt, Pseudomonas aeruginosa PA01
cucgugccaucaggccg

SEQ ID NO: 3416745 - RNA, 18 nt, Pseudomonas aeruginosa PA01
cucgugccaucaggccgc

SEQ ID NO: 3416746 - RNA, 16 nt, Pseudomonas aeruginosa PA01
cucgugcuccaccucg

SEQ ID NO: 3416747 - RNA, 17 nt, Pseudomonas aeruginosa PA01
cucgugcuccaccucgg

SEQ ID NO: 3416748 - RNA, 23 nt, Pseudomonas aeruginosa PA01
cucgugcucggggaacacgcgcu

SEQ ID NO: 3416749 - RNA, 22 nt, Pseudomonas aeruginosa PA01
cucgugcuuggugucggccgcc

SEQ ID NO: 3416750 - RNA, 23 nt, Pseudomonas aeruginosa PA01
cucgugcuuggugucggccgcca

SEQ ID NO: 3416751 - RNA, 22 nt, Pseudomonas aeruginosa PA01
cucguggacccgugcgccccag

SEQ ID NO: 3416752 - RNA, 13 nt, Pseudomonas aeruginosa PA01
cucguggcgcgcc

SEQ ID NO: 3416753 - RNA, 15 nt, Pseudomonas aeruginosa PA01
cucguggcgcgccgc

SEQ ID NO: 3416754 - RNA, 13 nt, Pseudomonas aeruginosa PA01
cucguggcuggcg

SEQ ID NO: 3416755 - RNA, 18 nt, Pseudomonas aeruginosa PA01
cucguggcuggcgccgcg

SEQ ID NO: 3416756 - RNA, 14 nt, Pseudomonas aeruginosa PA01
cucgugggccagca

SEQ ID NO: 3416757 - RNA, 14 nt, Pseudomonas aeruginosa PA01
cucguggggccaga

SEQ ID NO: 3416758 - RNA, 20 nt, Pseudomonas aeruginosa PA01
cucguggggccagaagcgcu

SEQ ID NO: 3416759 - RNA, 14 nt, Pseudomonas aeruginosa PA01
cucgugguugaggc

SEQ ID NO: 3416760 - RNA, 20 nt, Pseudomonas aeruginosa PA01
cucgugguugaggcgcucgu

SEQ ID NO: 3416761 - RNA, 13 nt, Pseudomonas aeruginosa PA01
cucgugucgacuc

SEQ ID NO: 3416762 - RNA, 21 nt, Pseudomonas aeruginosa PA01
cucguguuccggcaggaccuu

SEQ ID NO: 3416763 - RNA, 13 nt, Pseudomonas aeruginosa PA01
cucguucagcagc

SEQ ID NO: 3416764 - RNA, 14 nt, Pseudomonas aeruginosa PA01
cucguucagcagca

SEQ ID NO: 3416765 - RNA, 21 nt, Pseudomonas aeruginosa PA01
cucguuccacgggucgcagcc

SEQ ID NO: 3416766 - RNA, 17 nt, Pseudomonas aeruginosa PA01
cucguucgcccagaccu

SEQ ID NO: 3416767 - RNA, 17 nt, Pseudomonas aeruginosa PA01
cucguucgucgccgacu

SEQ ID NO: 3416768 - RNA, 18 nt, Pseudomonas aeruginosa PA01
cucguugauuccgccgga

SEQ ID NO: 3416769 - RNA, 19 nt, Pseudomonas aeruginosa PA01
cucguugcacgcaggccgc

SEQ ID NO: 3416770 - RNA, 15 nt, Pseudomonas aeruginosa PA01
cucguugcaggcacg

SEQ ID NO: 3416771 - RNA, 22 nt, Pseudomonas aeruginosa PA01
cucguugcaggcacggaagcgc

SEQ ID NO: 3416772 - RNA, 14 nt, Pseudomonas aeruginosa PA01
cucguugcccggcu

SEQ ID NO: 3416773 - RNA, 19 nt, Pseudomonas aeruginosa PA01
cucguugcccggcuugccg

SEQ ID NO: 3416774 - RNA, 22 nt, Pseudomonas aeruginosa PA01
cucguugcggaaagcgacgccg

SEQ ID NO: 3416775 - RNA, 14 nt, Pseudomonas aeruginosa PA01
cucguuggcggcca

SEQ ID NO: 3416776 - RNA, 22 nt, Pseudomonas aeruginosa PA01
cucuaccaggcgguuggcccgc

SEQ ID NO: 3416777 - RNA, 22 nt, Pseudomonas aeruginosa PA01
cucuaccgagaucaccuugucg

SEQ ID NO: 3416778 - RNA, 13 nt, Pseudomonas aeruginosa PA01
cucuacuaccgcc

SEQ ID NO: 3416779 - RNA, 19 nt, Pseudomonas aeruginosa PA01
cucuaucagggucuucagg

SEQ ID NO: 3416780 - RNA, 16 nt, Pseudomonas aeruginosa PA01
cucucaggagcgccgc

SEQ ID NO: 3416781 - RNA, 17 nt, Pseudomonas aeruginosa PA01
cucuccacuaccgccga

SEQ ID NO: 3416782 - RNA, 15 nt, Pseudomonas aeruginosa PA01
cucuccccgcucccg

SEQ ID NO: 3416783 - RNA, 22 nt, Pseudomonas aeruginosa PA01
cucucccugaagggagagggaa

SEQ ID NO: 3416784 - RNA, 20 nt, Pseudomonas aeruginosa PA01
cucucgaacaccaggcgcca

SEQ ID NO: 3416785 - RNA, 15 nt, Pseudomonas aeruginosa PA01
cucucgacuugaaca

SEQ ID NO: 3416786 - RNA, 18 nt, Pseudomonas aeruginosa PA01
cucucgaggacgugcacc

SEQ ID NO: 3416787 - RNA, 15 nt, Pseudomonas aeruginosa PA01
cucucgccgccuucg

SEQ ID NO: 3416788 - RNA, 12 nt, Pseudomonas aeruginosa PA01
cucucgccggcc

SEQ ID NO: 3416789 - RNA, 15 nt, Pseudomonas aeruginosa PA01
cucucgccggccugg

SEQ ID NO: 3416790 - RNA, 14 nt, Pseudomonas aeruginosa PA01
cucucgccucggcg

SEQ ID NO: 3416791 - RNA, 11 nt, Pseudomonas aeruginosa PA01
cucucgcgcag

SEQ ID NO: 3416792 - RNA, 20 nt, Pseudomonas aeruginosa PA01
cucucgcgcagcaggaucca

SEQ ID NO: 3416793 - RNA, 12 nt, Pseudomonas aeruginosa PA01
cucucgcugcgc

SEQ ID NO: 3416794 - RNA, 17 nt, Pseudomonas aeruginosa PA01
cucucggugaccaccag

SEQ ID NO: 3416795 - RNA, 20 nt, Pseudomonas aeruginosa PA01
cucucguugugggacgaagc

SEQ ID NO: 3416796 - RNA, 16 nt, Pseudomonas aeruginosa PA01
cucucucgccucggcg

SEQ ID NO: 3416797 - RNA, 12 nt, Pseudomonas aeruginosa PA01
cucucucugcau

SEQ ID NO: 3416798 - RNA, 15 nt, Pseudomonas aeruginosa PA01
cucucugcauggcac

SEQ ID NO: 3416799 - RNA, 14 nt, Pseudomonas aeruginosa PA01
cucugaccgcgccc

SEQ ID NO: 3416800 - RNA, 18 nt, Pseudomonas aeruginosa PA01
cucugagggacacggcga

SEQ ID NO: 3416801 - RNA, 23 nt, Pseudomonas aeruginosa PA01
cucugagggacacggcgaccugc

SEQ ID NO: 3416802 - RNA, 11 nt, Pseudomonas aeruginosa PA01
cucugccggug

SEQ ID NO: 3416803 - RNA, 15 nt, Pseudomonas aeruginosa PA01
cucugcgccaggcgg

SEQ ID NO: 3416804 - RNA, 14 nt, Pseudomonas aeruginosa PA01
cucugcguucugcu

SEQ ID NO: 3416805 - RNA, 12 nt, Pseudomonas aeruginosa PA01
cucugcucggcc

SEQ ID NO: 3416806 - RNA, 15 nt, Pseudomonas aeruginosa PA01
cucugcucggccagc

SEQ ID NO: 3416807 - RNA, 19 nt, Pseudomonas aeruginosa PA01
cucugcucggccagcgcca

SEQ ID NO: 3416808 - RNA, 18 nt, Pseudomonas aeruginosa PA01
cucugcuggccacccuug

SEQ ID NO: 3416809 - RNA, 21 nt, Pseudomonas aeruginosa PA01
cucugcuucugucccugggcc

SEQ ID NO: 3416810 - RNA, 15 nt, Pseudomonas aeruginosa PA01
cucuggccauagaaa

SEQ ID NO: 3416811 - RNA, 23 nt, Pseudomonas aeruginosa PA01
cucuggcccagcuugauguagga

SEQ ID NO: 3416812 - RNA, 15 nt, Pseudomonas aeruginosa PA01
cucuggccgcgcucc

SEQ ID NO: 3416813 - RNA, 17 nt, Pseudomonas aeruginosa PA01
cucuggccgcgcuccaa

SEQ ID NO: 3416814 - RNA, 17 nt, Pseudomonas aeruginosa PA01
cucuggccguucuccag

SEQ ID NO: 3416815 - RNA, 13 nt, Pseudomonas aeruginosa PA01
cucuggcgcaggg

SEQ ID NO: 3416816 - RNA, 17 nt, Pseudomonas aeruginosa PA01
cucuggcugaagacccu

SEQ ID NO: 3416817 - RNA, 16 nt, Pseudomonas aeruginosa PA01
cucuggcugcuggcga

SEQ ID NO: 3416818 - RNA, 21 nt, Pseudomonas aeruginosa PA01
cucugggccaugaccucggcc

SEQ ID NO: 3416819 - RNA, 22 nt, Pseudomonas aeruginosa PA01
cucugggccaugaccucggcca

SEQ ID NO: 3416820 - RNA, 20 nt, Pseudomonas aeruginosa PA01
cucuggguuuccguaagauc

SEQ ID NO: 3416821 - RNA, 15 nt, Pseudomonas aeruginosa PA01
cucugguagccgcag

SEQ ID NO: 3416822 - RNA, 18 nt, Pseudomonas aeruginosa PA01
cucugguagcugcggccg

SEQ ID NO: 3416823 - RNA, 21 nt, Pseudomonas aeruginosa PA01
cucugguagcugcggccgagc

SEQ ID NO: 3416824 - RNA, 22 nt, Pseudomonas aeruginosa PA01
cucuggucaugacgggcgguau

SEQ ID NO: 3416825 - RNA, 15 nt, Pseudomonas aeruginosa PA01
cucuggucgaacacu

SEQ ID NO: 3416826 - RNA, 17 nt, Pseudomonas aeruginosa PA01
cucuguagggucgcagc

SEQ ID NO: 3416827 - RNA, 21 nt, Pseudomonas aeruginosa PA01
cucugucggagagggagcgcc

SEQ ID NO: 3416828 - RNA, 18 nt, Pseudomonas aeruginosa PA01
cucuguuccucggcggcg

SEQ ID NO: 3416829 - RNA, 16 nt, Pseudomonas aeruginosa PA01
cucuguuucgggucgc

SEQ ID NO: 3416830 - RNA, 23 nt, Pseudomonas aeruginosa PA01
cucuucacauggugggcgccgcu

SEQ ID NO: 3416831 - RNA, 18 nt, Pseudomonas aeruginosa PA01
cucuucagcacgcguccg

SEQ ID NO: 3416832 - RNA, 16 nt, Pseudomonas aeruginosa PA01
cucuucagcgguccgc

SEQ ID NO: 3416833 - RNA, 16 nt, Pseudomonas aeruginosa PA01
cucuuccacgcgccga

SEQ ID NO: 3416834 - RNA, 19 nt, Pseudomonas aeruginosa PA01
cucuuccagggucggcacc

SEQ ID NO: 3416835 - RNA, 19 nt, Pseudomonas aeruginosa PA01
cucuucccggcucggcacg

SEQ ID NO: 3416836 - RNA, 20 nt, Pseudomonas aeruginosa PA01
cucuucccggcucggcacgc

SEQ ID NO: 3416837 - RNA, 18 nt, Pseudomonas aeruginosa PA01
cucuuccgcgcugaccug

SEQ ID NO: 3416838 - RNA, 19 nt, Pseudomonas aeruginosa PA01
cucuuccgcgcugaccugg

SEQ ID NO: 3416839 - RNA, 14 nt, Pseudomonas aeruginosa PA01
cucuuccucgcugc

SEQ ID NO: 3416840 - RNA, 17 nt, Pseudomonas aeruginosa PA01
cucuuccuggaccuccg

SEQ ID NO: 3416841 - RNA, 18 nt, Pseudomonas aeruginosa PA01
cucuucgccauccuugag

SEQ ID NO: 3416842 - RNA, 21 nt, Pseudomonas aeruginosa PA01
cucuucggagcgaggcgcgug

SEQ ID NO: 3416843 - RNA, 13 nt, Pseudomonas aeruginosa PA01
cucuucggcggcc

SEQ ID NO: 3416844 - RNA, 14 nt, Pseudomonas aeruginosa PA01
cucuucggcggcca

SEQ ID NO: 3416845 - RNA, 14 nt, Pseudomonas aeruginosa PA01
cucuucgucggcga

SEQ ID NO: 3416846 - RNA, 14 nt, Pseudomonas aeruginosa PA01
cucuucgucgguca

SEQ ID NO: 3416847 - RNA, 19 nt, Pseudomonas aeruginosa PA01
cucuucuugaucacuucca

SEQ ID NO: 3416848 - RNA, 21 nt, Pseudomonas aeruginosa PA01
cucuugaaaacugucggcgga

SEQ ID NO: 3416849 - RNA, 12 nt, Pseudomonas aeruginosa PA01
cucuugaggucg

SEQ ID NO: 3416850 - RNA, 19 nt, Pseudomonas aeruginosa PA01
cucuugccgacaagccucc

SEQ ID NO: 3416851 - RNA, 18 nt, Pseudomonas aeruginosa PA01
cucuugggcucugccuuc

SEQ ID NO: 3416852 - RNA, 13 nt, Pseudomonas aeruginosa PA01
cucuuggucauca

SEQ ID NO: 3416853 - RNA, 21 nt, Pseudomonas aeruginosa PA01
cucuuggucgcggucuggaug

SEQ ID NO: 3416854 - RNA, 16 nt, Pseudomonas aeruginosa PA01
cucuuguaagcauuaa

SEQ ID NO: 3416855 - RNA, 16 nt, Pseudomonas aeruginosa PA01
cucuuucaccuggucg

SEQ ID NO: 3416856 - RNA, 16 nt, Pseudomonas aeruginosa PA01
cucuuuccgggucauu

SEQ ID NO: 3416857 - RNA, 17 nt, Pseudomonas aeruginosa PA01
cugaaaaaaggggaugc

SEQ ID NO: 3416858 - RNA, 18 nt, Pseudomonas aeruginosa PA01
cugaaacgcgcguccuuc

SEQ ID NO: 3416859 - RNA, 14 nt, Pseudomonas aeruginosa PA01
cugaacaagcccug

SEQ ID NO: 3416860 - RNA, 13 nt, Pseudomonas aeruginosa PA01
cugaacagcgcca

SEQ ID NO: 3416861 - RNA, 18 nt, Pseudomonas aeruginosa PA01
cugaacagcgccaccagc

SEQ ID NO: 3416862 - RNA, 19 nt, Pseudomonas aeruginosa PA01
cugaacagcgccaccagca

SEQ ID NO: 3416863 - RNA, 13 nt, Pseudomonas aeruginosa PA01
cugaacagcuggc

SEQ ID NO: 3416864 - RNA, 21 nt, Pseudomonas aeruginosa PA01
cugaacaucagguuccgugga

SEQ ID NO: 3416865 - RNA, 18 nt, Pseudomonas aeruginosa PA01
cugaaccgcgucaugcuc

SEQ ID NO: 3416866 - RNA, 19 nt, Pseudomonas aeruginosa PA01
cugaaccgcgucaugcucu

SEQ ID NO: 3416867 - RNA, 20 nt, Pseudomonas aeruginosa PA01
cugaacgcgcccggccaggc

SEQ ID NO: 3416868 - RNA, 21 nt, Pseudomonas aeruginosa PA01
cugaacuggaucggccccacc

SEQ ID NO: 3416869 - RNA, 22 nt, Pseudomonas aeruginosa PA01
cugaacuggaucggccccaccu

SEQ ID NO: 3416870 - RNA, 21 nt, Pseudomonas aeruginosa PA01
cugaacuguucgaucucgcgu

SEQ ID NO: 3416871 - RNA, 11 nt, Pseudomonas aeruginosa PA01
cugaagaagcu

SEQ ID NO: 3416872 - RNA, 14 nt, Pseudomonas aeruginosa PA01
cugaagacccugca

SEQ ID NO: 3416873 - RNA, 16 nt, Pseudomonas aeruginosa PA01
cugaagauaucgccuu

SEQ ID NO: 3416874 - RNA, 16 nt, Pseudomonas aeruginosa PA01
cugaagaucgccacga

SEQ ID NO: 3416875 - RNA, 17 nt, Pseudomonas aeruginosa PA01
cugaagaucgccacgau

SEQ ID NO: 3416876 - RNA, 13 nt, Pseudomonas aeruginosa PA01
cugaagcccaggc

SEQ ID NO: 3416877 - RNA, 24 nt, Pseudomonas aeruginosa PA01
cugaagcccaggcgucgcgccagc

SEQ ID NO: 3416878 - RNA, 19 nt, Pseudomonas aeruginosa PA01
cugaagccccagcccaggg

SEQ ID NO: 3416879 - RNA, 20 nt, Pseudomonas aeruginosa PA01
cugaagccccaguccucgua

SEQ ID NO: 3416880 - RNA, 13 nt, Pseudomonas aeruginosa PA01
cugaagcggccgc

SEQ ID NO: 3416881 - RNA, 14 nt, Pseudomonas aeruginosa PA01
cugaagcggccgcc

SEQ ID NO: 3416882 - RNA, 21 nt, Pseudomonas aeruginosa PA01
cugaagcggccgccgaaaugc

SEQ ID NO: 3416883 - RNA, 17 nt, Pseudomonas aeruginosa PA01
cugaagcugucgcccuc

SEQ ID NO: 3416884 - RNA, 13 nt, Pseudomonas aeruginosa PA01
cugaaggaccagc

SEQ ID NO: 3416885 - RNA, 23 nt, Pseudomonas aeruginosa PA01
cugaaggcgcggggcgaggucgg

SEQ ID NO: 3416886 - RNA, 13 nt, Pseudomonas aeruginosa PA01
cugaaggcgggcu

SEQ ID NO: 3416887 - RNA, 15 nt, Pseudomonas aeruginosa PA01
cugaaggucgccgcg

SEQ ID NO: 3416888 - RNA, 17 nt, Pseudomonas aeruginosa PA01
cugaaggucgccgcgcu

SEQ ID NO: 3416889 - RNA, 19 nt, Pseudomonas aeruginosa PA01
cugaaggucgccgcgcuga

SEQ ID NO: 3416890 - RNA, 16 nt, Pseudomonas aeruginosa PA01
cugaaguccuggccga

SEQ ID NO: 3416891 - RNA, 23 nt, Pseudomonas aeruginosa PA01
cugacauccuuggucagggugcc

SEQ ID NO: 3416892 - RNA, 15 nt, Pseudomonas aeruginosa PA01
cugaccaccaggaag

SEQ ID NO: 3416893 - RNA, 16 nt, Pseudomonas aeruginosa PA01
cugaccaccagggcga

SEQ ID NO: 3416894 - RNA, 19 nt, Pseudomonas aeruginosa PA01
cugaccaccagggcgaugg

SEQ ID NO: 3416895 - RNA, 16 nt, Pseudomonas aeruginosa PA01
cugaccacccggugca

SEQ ID NO: 3416896 - RNA, 14 nt, Pseudomonas aeruginosa PA01
cugaccacgcagag

SEQ ID NO: 3416897 - RNA, 16 nt, Pseudomonas aeruginosa PA01
cugaccacgcagagcg

SEQ ID NO: 3416898 - RNA, 13 nt, Pseudomonas aeruginosa PA01
cugaccaggucgu

SEQ ID NO: 3416899 - RNA, 20 nt, Pseudomonas aeruginosa PA01
cugaccaucgucgcuuccgg

SEQ ID NO: 3416900 - RNA, 20 nt, Pseudomonas aeruginosa PA01
cugacccaggcuucggcgcg

SEQ ID NO: 3416901 - RNA, 14 nt, Pseudomonas aeruginosa PA01
cugaccccggccug

SEQ ID NO: 3416902 - RNA, 20 nt, Pseudomonas aeruginosa PA01
cugaccccggccuggcuggc

SEQ ID NO: 3416903 - RNA, 15 nt, Pseudomonas aeruginosa PA01
cugacccgcaccggc

SEQ ID NO: 3416904 - RNA, 16 nt, Pseudomonas aeruginosa PA01
cugacccgcugcugga

SEQ ID NO: 3416905 - RNA, 19 nt, Pseudomonas aeruginosa PA01
cugacccgcuguccgccgg

SEQ ID NO: 3416906 - RNA, 20 nt, Pseudomonas aeruginosa PA01
cugacccgcuguccgccggc

SEQ ID NO: 3416907 - RNA, 23 nt, Pseudomonas aeruginosa PA01
cugacccgcuguccgccggccuc

SEQ ID NO: 3416908 - RNA, 21 nt, Pseudomonas aeruginosa PA01
cugaccgcgaauggcagcagg

SEQ ID NO: 3416909 - RNA, 23 nt, Pseudomonas aeruginosa PA01
cugaccgcgaauggcagcaggca

SEQ ID NO: 3416910 - RNA, 15 nt, Pseudomonas aeruginosa PA01
cugaccgcgagcgcc

SEQ ID NO: 3416911 - RNA, 17 nt, Pseudomonas aeruginosa PA01
cugaccgcgagcgccgc

SEQ ID NO: 3416912 - RNA, 19 nt, Pseudomonas aeruginosa PA01
cugaccgcgagcgccgccu

SEQ ID NO: 3416913 - RNA, 19 nt, Pseudomonas aeruginosa PA01
cugaccgcgugggccggca

SEQ ID NO: 3416914 - RNA, 23 nt, Pseudomonas aeruginosa PA01
cugaccggcaucgaccagcagcg

SEQ ID NO: 3416915 - RNA, 13 nt, Pseudomonas aeruginosa PA01
cugaccggccgca

SEQ ID NO: 3416916 - RNA, 17 nt, Pseudomonas aeruginosa PA01
cugaccggccgcagcag

SEQ ID NO: 3416917 - RNA, 18 nt, Pseudomonas aeruginosa PA01
cugaccggccgcagcagg

SEQ ID NO: 3416918 - RNA, 15 nt, Pseudomonas aeruginosa PA01
cugaccgggcggauc

SEQ ID NO: 3416919 - RNA, 15 nt, Pseudomonas aeruginosa PA01
cugaccguccuggcc

SEQ ID NO: 3416920 - RNA, 18 nt, Pseudomonas aeruginosa PA01
cugaccguccuggcccug

SEQ ID NO: 3416921 - RNA, 19 nt, Pseudomonas aeruginosa PA01
cugaccguccuggcccugc

SEQ ID NO: 3416922 - RNA, 20 nt, Pseudomonas aeruginosa PA01
cugaccguucguccuuuccu

SEQ ID NO: 3416923 - RNA, 24 nt, Pseudomonas aeruginosa PA01
cugaccucgauggcguguucgucg

SEQ ID NO: 3416924 - RNA, 19 nt, Pseudomonas aeruginosa PA01
cugacgaaggcuggagcgc

SEQ ID NO: 3416925 - RNA, 17 nt, Pseudomonas aeruginosa PA01
cugacgaaguccuugug

SEQ ID NO: 3416926 - RNA, 19 nt, Pseudomonas aeruginosa PA01
cugacgaggacgccgccgg

SEQ ID NO: 3416927 - RNA, 21 nt, Pseudomonas aeruginosa PA01
cugacgcaagcgcucggccug

SEQ ID NO: 3416928 - RNA, 23 nt, Pseudomonas aeruginosa PA01
cugacgcaagcgcucggccugcg

SEQ ID NO: 3416929 - RNA, 16 nt, Pseudomonas aeruginosa PA01
cugacgcgcagcgccg

SEQ ID NO: 3416930 - RNA, 22 nt, Pseudomonas aeruginosa PA01
cugacgcgcagcgccgccgcgu

SEQ ID NO: 3416931 - RNA, 13 nt, Pseudomonas aeruginosa PA01
cugacgcuggcga

SEQ ID NO: 3416932 - RNA, 13 nt, Pseudomonas aeruginosa PA01
cugacggcaagga

SEQ ID NO: 3416933 - RNA, 19 nt, Pseudomonas aeruginosa PA01
cugacggcaaggaccugcu

SEQ ID NO: 3416934 - RNA, 20 nt, Pseudomonas aeruginosa PA01
cugacggcaaggaccugcug

SEQ ID NO: 3416935 - RNA, 15 nt, Pseudomonas aeruginosa PA01
cugacggcggaaggc

SEQ ID NO: 3416936 - RNA, 12 nt, Pseudomonas aeruginosa PA01
cugacggcgugg

SEQ ID NO: 3416937 - RNA, 17 nt, Pseudomonas aeruginosa PA01
cugacggcguggcggau

SEQ ID NO: 3416938 - RNA, 16 nt, Pseudomonas aeruginosa PA01
cugacggucugccagc

SEQ ID NO: 3416939 - RNA, 20 nt, Pseudomonas aeruginosa PA01
cugacggucugccagcucug

SEQ ID NO: 3416940 - RNA, 14 nt, Pseudomonas aeruginosa PA01
cugacgucgacgca

SEQ ID NO: 3416941 - RNA, 17 nt, Pseudomonas aeruginosa PA01
cugacgucgacgcagcg

SEQ ID NO: 3416942 - RNA, 20 nt, Pseudomonas aeruginosa PA01
cugacgucgacgcagcgcgc

SEQ ID NO: 3416943 - RNA, 22 nt, Pseudomonas aeruginosa PA01
cugacgucgacgcagcgcgcgu

SEQ ID NO: 3416944 - RNA, 19 nt, Pseudomonas aeruginosa PA01
cugacguugccgcgcgggc

SEQ ID NO: 3416945 - RNA, 21 nt, Pseudomonas aeruginosa PA01
cugacguugccgcgcgggccg

SEQ ID NO: 3416946 - RNA, 17 nt, Pseudomonas aeruginosa PA01
cugacuuccaucagcuc

SEQ ID NO: 3416947 - RNA, 21 nt, Pseudomonas aeruginosa PA01
cugagaccuuccugccagcgc

SEQ ID NO: 3416948 - RNA, 14 nt, Pseudomonas aeruginosa PA01
cugagaucagcgcc

SEQ ID NO: 3416949 - RNA, 14 nt, Pseudomonas aeruginosa PA01
cugagcaccgggac

SEQ ID NO: 3416950 - RNA, 13 nt, Pseudomonas aeruginosa PA01
cugagcaggaacu

SEQ ID NO: 3416951 - RNA, 23 nt, Pseudomonas aeruginosa PA01
cugagcaggaacucgaucagcgc

SEQ ID NO: 3416952 - RNA, 22 nt, Pseudomonas aeruginosa PA01
cugagcaggccgacggcgcgcu

SEQ ID NO: 3416953 - RNA, 23 nt, Pseudomonas aeruginosa PA01
cugagcaggccgacggcgcgcug

SEQ ID NO: 3416954 - RNA, 23 nt, Pseudomonas aeruginosa PA01
cugagcagggucaugccuagcac

SEQ ID NO: 3416955 - RNA, 19 nt, Pseudomonas aeruginosa PA01
cugagcagucgccuggccc

SEQ ID NO: 3416956 - RNA, 22 nt, Pseudomonas aeruginosa PA01
cugagcagucgccuggcccugg

SEQ ID NO: 3416957 - RNA, 21 nt, Pseudomonas aeruginosa PA01
cugagcaguugcgggcgcagg

SEQ ID NO: 3416958 - RNA, 11 nt, Pseudomonas aeruginosa PA01
cugagccggcc

SEQ ID NO: 3416959 - RNA, 19 nt, Pseudomonas aeruginosa PA01
cugagcgcauugacacgga

SEQ ID NO: 3416960 - RNA, 20 nt, Pseudomonas aeruginosa PA01
cugagcgccucgaucgccuc

SEQ ID NO: 3416961 - RNA, 13 nt, Pseudomonas aeruginosa PA01
cugagcggcggca

SEQ ID NO: 3416962 - RNA, 18 nt, Pseudomonas aeruginosa PA01
cugagcgugacccgcgcu

SEQ ID NO: 3416963 - RNA, 16 nt, Pseudomonas aeruginosa PA01
cugagcugccgcuucg

SEQ ID NO: 3416964 - RNA, 17 nt, Pseudomonas aeruginosa PA01
cugagcuuaaggcaggu

SEQ ID NO: 3416965 - RNA, 19 nt, Pseudomonas aeruginosa PA01
cugaggauguagccggcuu

SEQ ID NO: 3416966 - RNA, 20 nt, Pseudomonas aeruginosa PA01
cugaggccgguguagcgacg

SEQ ID NO: 3416967 - RNA, 13 nt, Pseudomonas aeruginosa PA01
cugaggcguucca

SEQ ID NO: 3416968 - RNA, 19 nt, Pseudomonas aeruginosa PA01
cugagggacacggcgaccu

SEQ ID NO: 3416969 - RNA, 16 nt, Pseudomonas aeruginosa PA01
cugagggucagccgca

SEQ ID NO: 3416970 - RNA, 19 nt, Pseudomonas aeruginosa PA01
cugagggucagccgcaggc

SEQ ID NO: 3416971 - RNA, 18 nt, Pseudomonas aeruginosa PA01
cugagucgcuucacucau

SEQ ID NO: 3416972 - RNA, 21 nt, Pseudomonas aeruginosa PA01
cugaguuugcccagcgccgcc

SEQ ID NO: 3416973 - RNA, 19 nt, Pseudomonas aeruginosa PA01
cugauaccgcuggccaggu

SEQ ID NO: 3416974 - RNA, 23 nt, Pseudomonas aeruginosa PA01
cugauaucguuguucagcagggu

SEQ ID NO: 3416975 - RNA, 15 nt, Pseudomonas aeruginosa PA01
cugaucacccgcccg

SEQ ID NO: 3416976 - RNA, 18 nt, Pseudomonas aeruginosa PA01
cugaucacccgcccgccg

SEQ ID NO: 3416977 - RNA, 22 nt, Pseudomonas aeruginosa PA01
cugaucacguagaugccggugc

SEQ ID NO: 3416978 - RNA, 17 nt, Pseudomonas aeruginosa PA01
cugaucagcccgcugag

SEQ ID NO: 3416979 - RNA, 21 nt, Pseudomonas aeruginosa PA01
cugaucaggaggaucgccagg

SEQ ID NO: 3416980 - RNA, 19 nt, Pseudomonas aeruginosa PA01
cugaucaggccgaggaugc

SEQ ID NO: 3416981 - RNA, 21 nt, Pseudomonas aeruginosa PA01
cugaucagguugccggcgugc

SEQ ID NO: 3416982 - RNA, 19 nt, Pseudomonas aeruginosa PA01
cugaucaguaccggcagcg

SEQ ID NO: 3416983 - RNA, 23 nt, Pseudomonas aeruginosa PA01
cugaucaguaccggcagcgccga

SEQ ID NO: 3416984 - RNA, 21 nt, Pseudomonas aeruginosa PA01
cugaucaguucggagaaggag

SEQ ID NO: 3416985 - RNA, 15 nt, Pseudomonas aeruginosa PA01
cugaucaucagcagg

SEQ ID NO: 3416986 - RNA, 21 nt, Pseudomonas aeruginosa PA01
cugaucaucagcagggucagg

SEQ ID NO: 3416987 - RNA, 15 nt, Pseudomonas aeruginosa PA01
cugaucaucugggcc

SEQ ID NO: 3416988 - RNA, 16 nt, Pseudomonas aeruginosa PA01
cugaucaucugggcca

SEQ ID NO: 3416989 - RNA, 19 nt, Pseudomonas aeruginosa PA01
cugauccgcguuaccgucc

SEQ ID NO: 3416990 - RNA, 20 nt, Pseudomonas aeruginosa PA01
cugaucgcgaauccggucgg

SEQ ID NO: 3416991 - RNA, 14 nt, Pseudomonas aeruginosa PA01
cugaucgcuccgcu

SEQ ID NO: 3416992 - RNA, 17 nt, Pseudomonas aeruginosa PA01
cugaucggccgccagug

SEQ ID NO: 3416993 - RNA, 23 nt, Pseudomonas aeruginosa PA01
cugaugaaucgccucccuggcga

SEQ ID NO: 3416994 - RNA, 16 nt, Pseudomonas aeruginosa PA01
cugaugaugccgcggc

SEQ ID NO: 3416995 - RNA, 15 nt, Pseudomonas aeruginosa PA01
cugaugccgcgguag

SEQ ID NO: 3416996 - RNA, 17 nt, Pseudomonas aeruginosa PA01
cugaugccggcgucggc

SEQ ID NO: 3416997 - RNA, 16 nt, Pseudomonas aeruginosa PA01
cugcaaaaaagcgcgc

SEQ ID NO: 3416998 - RNA, 22 nt, Pseudomonas aeruginosa PA01
cugcaacacccaggccugggug

SEQ ID NO: 3416999 - RNA, 22 nt, Pseudomonas aeruginosa PA01
cugcaacacguagcgcaggucg

SEQ ID NO: 3417000 - RNA, 14 nt, Pseudomonas aeruginosa PA01
cugcaacacgucgg

SEQ ID NO: 3417001 - RNA, 23 nt, Pseudomonas aeruginosa PA01
cugcaacaguggguaggccaggc

SEQ ID NO: 3417002 - RNA, 17 nt, Pseudomonas aeruginosa PA01
cugcaacauggcgucgg

SEQ ID NO: 3417003 - RNA, 14 nt, Pseudomonas aeruginosa PA01
cugcaacgagagga

SEQ ID NO: 3417004 - RNA, 17 nt, Pseudomonas aeruginosa PA01
cugcaacgccagcaggc

SEQ ID NO: 3417005 - RNA, 16 nt, Pseudomonas aeruginosa PA01
cugcaacgcccgcgag

SEQ ID NO: 3417006 - RNA, 23 nt, Pseudomonas aeruginosa PA01
cugcaacgcccgcgagccguccu

SEQ ID NO: 3417007 - RNA, 14 nt, Pseudomonas aeruginosa PA01
cugcaacgccgcca

SEQ ID NO: 3417008 - RNA, 14 nt, Pseudomonas aeruginosa PA01
cugcaacgccggcc

SEQ ID NO: 3417009 - RNA, 17 nt, Pseudomonas aeruginosa PA01
cugcaacgccggcccgu

SEQ ID NO: 3417010 - RNA, 17 nt, Pseudomonas aeruginosa PA01
cugcaacgccuggugca

SEQ ID NO: 3417011 - RNA, 19 nt, Pseudomonas aeruginosa PA01
cugcaacguccucgcgccg

SEQ ID NO: 3417012 - RNA, 22 nt, Pseudomonas aeruginosa PA01
cugcaacuccgccuguccaccg

SEQ ID NO: 3417013 - RNA, 17 nt, Pseudomonas aeruginosa PA01
cugcaacucggcgccgu

SEQ ID NO: 3417014 - RNA, 19 nt, Pseudomonas aeruginosa PA01
cugcaacucggcgucgcgc

SEQ ID NO: 3417015 - RNA, 19 nt, Pseudomonas aeruginosa PA01
cugcaacugacggcggaag

SEQ ID NO: 3417016 - RNA, 13 nt, Pseudomonas aeruginosa PA01
cugcaacuggccg

SEQ ID NO: 3417017 - RNA, 14 nt, Pseudomonas aeruginosa PA01
cugcaacuggccga

SEQ ID NO: 3417018 - RNA, 13 nt, Pseudomonas aeruginosa PA01
cugcaaggcggug

SEQ ID NO: 3417019 - RNA, 17 nt, Pseudomonas aeruginosa PA01
cugcaaggcggugacca

SEQ ID NO: 3417020 - RNA, 22 nt, Pseudomonas aeruginosa PA01
cugcaaggcggugaccagcggc

SEQ ID NO: 3417021 - RNA, 23 nt, Pseudomonas aeruginosa PA01
cugcaaggcggugaccagcggca

SEQ ID NO: 3417022 - RNA, 16 nt, Pseudomonas aeruginosa PA01
cugcaaggcuucggcg

SEQ ID NO: 3417023 - RNA, 22 nt, Pseudomonas aeruginosa PA01
cugcaaggcuucggcggucagg

SEQ ID NO: 3417024 - RNA, 21 nt, Pseudomonas aeruginosa PA01
cugcaagggcacuucguccag

SEQ ID NO: 3417025 - RNA, 23 nt, Pseudomonas aeruginosa PA01
cugcaaucgcugccggucaggcu

SEQ ID NO: 3417026 - RNA, 22 nt, Pseudomonas aeruginosa PA01
cugcaauggggcggccggcgcg

SEQ ID NO: 3417027 - RNA, 22 nt, Pseudomonas aeruginosa PA01
cugcaauuccaccggcuggccg

SEQ ID NO: 3417028 - RNA, 23 nt, Pseudomonas aeruginosa PA01
cugcaauuccaccggcuggccgc

SEQ ID NO: 3417029 - RNA, 23 nt, Pseudomonas aeruginosa PA01
cugcaauucgcagagaucggcgg

SEQ ID NO: 3417030 - RNA, 17 nt, Pseudomonas aeruginosa PA01
cugcacagccauagcgc

SEQ ID NO: 3417031 - RNA, 19 nt, Pseudomonas aeruginosa PA01
cugcacagccauagcgccg

SEQ ID NO: 3417032 - RNA, 20 nt, Pseudomonas aeruginosa PA01
cugcacagccauagcgccgg

SEQ ID NO: 3417033 - RNA, 21 nt, Pseudomonas aeruginosa PA01
cugcacagccauagcgccggc

SEQ ID NO: 3417034 - RNA, 22 nt, Pseudomonas aeruginosa PA01
cugcacagccauagcgccggca

SEQ ID NO: 3417035 - RNA, 19 nt, Pseudomonas aeruginosa PA01
cugcacagggacgcggcgu

SEQ ID NO: 3417036 - RNA, 22 nt, Pseudomonas aeruginosa PA01
cugcacagguugacgaugcggc

SEQ ID NO: 3417037 - RNA, 16 nt, Pseudomonas aeruginosa PA01
cugcacaugcaccacc

SEQ ID NO: 3417038 - RNA, 19 nt, Pseudomonas aeruginosa PA01
cugcacaugcaccaccugc

SEQ ID NO: 3417039 - RNA, 22 nt, Pseudomonas aeruginosa PA01
cugcacaugcaccaccugcuug

SEQ ID NO: 3417040 - RNA, 14 nt, Pseudomonas aeruginosa PA01
cugcaccacgcagg

SEQ ID NO: 3417041 - RNA, 18 nt, Pseudomonas aeruginosa PA01
cugcaccacgcaggcgcg

SEQ ID NO: 3417042 - RNA, 19 nt, Pseudomonas aeruginosa PA01
cugcaccacguucggcgcg

SEQ ID NO: 3417043 - RNA, 13 nt, Pseudomonas aeruginosa PA01
cugcaccagcagg

SEQ ID NO: 3417044 - RNA, 16 nt, Pseudomonas aeruginosa PA01
cugcaccagcaggucg

SEQ ID NO: 3417045 - RNA, 18 nt, Pseudomonas aeruginosa PA01
cugcaccagcaggucgag

SEQ ID NO: 3417046 - RNA, 14 nt, Pseudomonas aeruginosa PA01
cugcaccagccagu

SEQ ID NO: 3417047 - RNA, 19 nt, Pseudomonas aeruginosa PA01
cugcaccagccaguccggc

SEQ ID NO: 3417048 - RNA, 22 nt, Pseudomonas aeruginosa PA01
cugcaccagccaguccggcagc

SEQ ID NO: 3417049 - RNA, 17 nt, Pseudomonas aeruginosa PA01
cugcaccaggcucgccc

SEQ ID NO: 3417050 - RNA, 19 nt, Pseudomonas aeruginosa PA01
cugcaccaggcucgccccg

SEQ ID NO: 3417051 - RNA, 14 nt, Pseudomonas aeruginosa PA01
cugcacccuuggcg

SEQ ID NO: 3417052 - RNA, 21 nt, Pseudomonas aeruginosa PA01
cugcacccuuggcgcagguag

SEQ ID NO: 3417053 - RNA, 12 nt, Pseudomonas aeruginosa PA01
cugcaccgcgcg

SEQ ID NO: 3417054 - RNA, 19 nt, Pseudomonas aeruginosa PA01
cugcaccgcgcggaucccc

SEQ ID NO: 3417055 - RNA, 14 nt, Pseudomonas aeruginosa PA01
cugcaccgggccga

SEQ ID NO: 3417056 - RNA, 15 nt, Pseudomonas aeruginosa PA01
cugcaccgggccgac

SEQ ID NO: 3417057 - RNA, 20 nt, Pseudomonas aeruginosa PA01
cugcaccgggccgaccugcc

SEQ ID NO: 3417058 - RNA, 16 nt, Pseudomonas aeruginosa PA01
cugcaccgucauggug

SEQ ID NO: 3417059 - RNA, 20 nt, Pseudomonas aeruginosa PA01
cugcaccgugcgcgcggccu

SEQ ID NO: 3417060 - RNA, 22 nt, Pseudomonas aeruginosa PA01
cugcaccgugcgcgcggccugu

SEQ ID NO: 3417061 - RNA, 13 nt, Pseudomonas aeruginosa PA01
cugcaccuuggcc

SEQ ID NO: 3417062 - RNA, 14 nt, Pseudomonas aeruginosa PA01
cugcaccuuggcca

SEQ ID NO: 3417063 - RNA, 14 nt, Pseudomonas aeruginosa PA01
cugcacgcccaggc

SEQ ID NO: 3417064 - RNA, 23 nt, Pseudomonas aeruginosa PA01
cugcacgcccaggcgcucggcga

SEQ ID NO: 3417065 - RNA, 23 nt, Pseudomonas aeruginosa PA01
cugcacgcccaucgccaccagca

SEQ ID NO: 3417066 - RNA, 19 nt, Pseudomonas aeruginosa PA01
cugcacgcugcgccggcgc

SEQ ID NO: 3417067 - RNA, 23 nt, Pseudomonas aeruginosa PA01
cugcacgcuggugaugucgcggc

SEQ ID NO: 3417068 - RNA, 20 nt, Pseudomonas aeruginosa PA01
cugcacggagugggccgcgu

SEQ ID NO: 3417069 - RNA, 18 nt, Pseudomonas aeruginosa PA01
cugcacggcaacgucgcg

SEQ ID NO: 3417070 - RNA, 20 nt, Pseudomonas aeruginosa PA01
cugcacggcaacgucgcgga

SEQ ID NO: 3417071 - RNA, 17 nt, Pseudomonas aeruginosa PA01
cugcacggcgacccgca

SEQ ID NO: 3417072 - RNA, 20 nt, Pseudomonas aeruginosa PA01
cugcacguggaguucaccgu

SEQ ID NO: 3417073 - RNA, 21 nt, Pseudomonas aeruginosa PA01
cugcacguugcugugcugcac

SEQ ID NO: 3417074 - RNA, 20 nt, Pseudomonas aeruginosa PA01
cugcagacgguucagcagcg

SEQ ID NO: 3417075 - RNA, 21 nt, Pseudomonas aeruginosa PA01
cugcagacgguucagcagcgg

SEQ ID NO: 3417076 - RNA, 22 nt, Pseudomonas aeruginosa PA01
cugcagacgguucagcagcggc

SEQ ID NO: 3417077 - RNA, 23 nt, Pseudomonas aeruginosa PA01
cugcagauaaagcuggaccaccg

SEQ ID NO: 3417078 - RNA, 18 nt, Pseudomonas aeruginosa PA01
cugcagcaggaucagcgc

SEQ ID NO: 3417079 - RNA, 13 nt, Pseudomonas aeruginosa PA01
cugcagcaggucg

SEQ ID NO: 3417080 - RNA, 14 nt, Pseudomonas aeruginosa PA01
cugcagcaucaggc

SEQ ID NO: 3417081 - RNA, 15 nt, Pseudomonas aeruginosa PA01
cugcagcaucaggcg

SEQ ID NO: 3417082 - RNA, 15 nt, Pseudomonas aeruginosa PA01
cugcagccagcuuca

SEQ ID NO: 3417083 - RNA, 16 nt, Pseudomonas aeruginosa PA01
cugcagccuggcgucg

SEQ ID NO: 3417084 - RNA, 20 nt, Pseudomonas aeruginosa PA01
cugcagcgacuccagccagg

SEQ ID NO: 3417085 - RNA, 13 nt, Pseudomonas aeruginosa PA01
cugcagcgcccca

SEQ ID NO: 3417086 - RNA, 14 nt, Pseudomonas aeruginosa PA01
cugcagcgccccag

SEQ ID NO: 3417087 - RNA, 20 nt, Pseudomonas aeruginosa PA01
cugcagcgccccagcaccuc

SEQ ID NO: 3417088 - RNA, 20 nt, Pseudomonas aeruginosa PA01
cugcagcgccucguggaaca

SEQ ID NO: 3417089 - RNA, 23 nt, Pseudomonas aeruginosa PA01
cugcagcgccucguggaacagcg

SEQ ID NO: 3417090 - RNA, 15 nt, Pseudomonas aeruginosa PA01
cugcagcgcgcgcug

SEQ ID NO: 3417091 - RNA, 14 nt, Pseudomonas aeruginosa PA01
cugcagcucggccu

SEQ ID NO: 3417092 - RNA, 15 nt, Pseudomonas aeruginosa PA01
cugcagcucggccug

SEQ ID NO: 3417093 - RNA, 19 nt, Pseudomonas aeruginosa PA01
cugcagcucggccuggucc

SEQ ID NO: 3417094 - RNA, 23 nt, Pseudomonas aeruginosa PA01
cugcagcucggccugguccggca

SEQ ID NO: 3417095 - RNA, 22 nt, Pseudomonas aeruginosa PA01
cugcagcuugugggcaugcucg

SEQ ID NO: 3417096 - RNA, 20 nt, Pseudomonas aeruginosa PA01
cugcaggaaggcuuccggcu

SEQ ID NO: 3417097 - RNA, 15 nt, Pseudomonas aeruginosa PA01
cugcaggacccgcga

SEQ ID NO: 3417098 - RNA, 22 nt, Pseudomonas aeruginosa PA01
cugcaggacgaagucgccggca

SEQ ID NO: 3417099 - RNA, 14 nt, Pseudomonas aeruginosa PA01
cugcaggaucgaga

SEQ ID NO: 3417100 - RNA, 20 nt, Pseudomonas aeruginosa PA01
cugcaggccgaauccgccgg

SEQ ID NO: 3417101 - RNA, 21 nt, Pseudomonas aeruginosa PA01
cugcaggccgaauccgccggc

SEQ ID NO: 3417102 - RNA, 11 nt, Pseudomonas aeruginosa PA01
cugcaggccgu

SEQ ID NO: 3417103 - RNA, 15 nt, Pseudomonas aeruginosa PA01
cugcaggccgugcca

SEQ ID NO: 3417104 - RNA, 17 nt, Pseudomonas aeruginosa PA01
cugcaggcgcuccagac

SEQ ID NO: 3417105 - RNA, 20 nt, Pseudomonas aeruginosa PA01
cugcaggcgguagcgccgcg

SEQ ID NO: 3417106 - RNA, 13 nt, Pseudomonas aeruginosa PA01
cugcaggcucagc

SEQ ID NO: 3417107 - RNA, 13 nt, Pseudomonas aeruginosa PA01
cugcagggcaucg

SEQ ID NO: 3417108 - RNA, 19 nt, Pseudomonas aeruginosa PA01
cugcagggcaucgaccaga

SEQ ID NO: 3417109 - RNA, 16 nt, Pseudomonas aeruginosa PA01
cugcagggcaucgcgc

SEQ ID NO: 3417110 - RNA, 17 nt, Pseudomonas aeruginosa PA01
cugcagggcaucgcgca

SEQ ID NO: 3417111 - RNA, 18 nt, Pseudomonas aeruginosa PA01
cugcagggcaucgcgcau

SEQ ID NO: 3417112 - RNA, 13 nt, Pseudomonas aeruginosa PA01
cugcagggccagg

SEQ ID NO: 3417113 - RNA, 21 nt, Pseudomonas aeruginosa PA01
cugcagggccagggaggcgcu

SEQ ID NO: 3417114 - RNA, 15 nt, Pseudomonas aeruginosa PA01
cugcagggccucgcu

SEQ ID NO: 3417115 - RNA, 17 nt, Pseudomonas aeruginosa PA01
cugcagggccucgcugu

SEQ ID NO: 3417116 - RNA, 15 nt, Pseudomonas aeruginosa PA01
cugcagggcggcgcu

SEQ ID NO: 3417117 - RNA, 13 nt, Pseudomonas aeruginosa PA01
cugcagggcggcu

SEQ ID NO: 3417118 - RNA, 20 nt, Pseudomonas aeruginosa PA01
cugcagggcggcuuccaggu

SEQ ID NO: 3417119 - RNA, 18 nt, Pseudomonas aeruginosa PA01
cugcagggcgucgccggg

SEQ ID NO: 3417120 - RNA, 16 nt, Pseudomonas aeruginosa PA01
cugcagguagcgcugc

SEQ ID NO: 3417121 - RNA, 20 nt, Pseudomonas aeruginosa PA01
cugcagguagcgcugcgccc

SEQ ID NO: 3417122 - RNA, 23 nt, Pseudomonas aeruginosa PA01
cugcagguagcgcugcgcccgcu

SEQ ID NO: 3417123 - RNA, 22 nt, Pseudomonas aeruginosa PA01
cugcagguggcguugcagggug

SEQ ID NO: 3417124 - RNA, 23 nt, Pseudomonas aeruginosa PA01
cugcagguggcguugcagggugc

SEQ ID NO: 3417125 - RNA, 19 nt, Pseudomonas aeruginosa PA01
cugcagguuguccagggca

SEQ ID NO: 3417126 - RNA, 14 nt, Pseudomonas aeruginosa PA01
cugcaucaccaggc

SEQ ID NO: 3417127 - RNA, 16 nt, Pseudomonas aeruginosa PA01
cugcaucaccaggcug

SEQ ID NO: 3417128 - RNA, 23 nt, Pseudomonas aeruginosa PA01
cugcaucaccaggcugccgccgu

SEQ ID NO: 3417129 - RNA, 20 nt, Pseudomonas aeruginosa PA01
cugcaucacguacggcgccu

SEQ ID NO: 3417130 - RNA, 15 nt, Pseudomonas aeruginosa PA01
cugcaucggcgcgcc

SEQ ID NO: 3417131 - RNA, 14 nt, Pseudomonas aeruginosa PA01
cugcaucggcucgg

SEQ ID NO: 3417132 - RNA, 16 nt, Pseudomonas aeruginosa PA01
cugcaucggcucggca

SEQ ID NO: 3417133 - RNA, 22 nt, Pseudomonas aeruginosa PA01
cugcaugaaaaagcccggccgc

SEQ ID NO: 3417134 - RNA, 18 nt, Pseudomonas aeruginosa PA01
cugcaugagugucgccau

SEQ ID NO: 3417135 - RNA, 21 nt, Pseudomonas aeruginosa PA01
cugcaugagugucgccaucag

SEQ ID NO: 3417136 - RNA, 19 nt, Pseudomonas aeruginosa PA01
cugcaugccggccgucgcg

SEQ ID NO: 3417137 - RNA, 21 nt, Pseudomonas aeruginosa PA01
cugcaugccgggguccgccgg

SEQ ID NO: 3417138 - RNA, 22 nt, Pseudomonas aeruginosa PA01
cugcaugccguccggguggguc

SEQ ID NO: 3417139 - RNA, 19 nt, Pseudomonas aeruginosa PA01
cugcaugcuuuugaacacc

SEQ ID NO: 3417140 - RNA, 22 nt, Pseudomonas aeruginosa PA01
cugcaugcuuuugaacaccagc

SEQ ID NO: 3417141 - RNA, 11 nt, Pseudomonas aeruginosa PA01
cugcauggcuu

SEQ ID NO: 3417142 - RNA, 21 nt, Pseudomonas aeruginosa PA01
cugcaugggcucgcgcggggc

SEQ ID NO: 3417143 - RNA, 20 nt, Pseudomonas aeruginosa PA01
cugcauggggauggucgaga

SEQ ID NO: 3417144 - RNA, 22 nt, Pseudomonas aeruginosa PA01
cugcauguccgcaggcaggucg

SEQ ID NO: 3417145 - RNA, 20 nt, Pseudomonas aeruginosa PA01
cugcauguccgccaguuccg

SEQ ID NO: 3417146 - RNA, 14 nt, Pseudomonas aeruginosa PA01
cugccaaccgcgcu

SEQ ID NO: 3417147 - RNA, 15 nt, Pseudomonas aeruginosa PA01
cugccacaguuucau

SEQ ID NO: 3417148 - RNA, 17 nt, Pseudomonas aeruginosa PA01
cugccacaguuucaugg

SEQ ID NO: 3417149 - RNA, 18 nt, Pseudomonas aeruginosa PA01
cugccacccggcgcccgg

SEQ ID NO: 3417150 - RNA, 22 nt, Pseudomonas aeruginosa PA01
cugccacccggcgcccggcgca

SEQ ID NO: 3417151 - RNA, 16 nt, Pseudomonas aeruginosa PA01
cugccacccggcucgg

SEQ ID NO: 3417152 - RNA, 22 nt, Pseudomonas aeruginosa PA01
cugccaccgagggcaggaacca

SEQ ID NO: 3417153 - RNA, 13 nt, Pseudomonas aeruginosa PA01
cugccacucggug

SEQ ID NO: 3417154 - RNA, 15 nt, Pseudomonas aeruginosa PA01
cugccacucggugca

SEQ ID NO: 3417155 - RNA, 18 nt, Pseudomonas aeruginosa PA01
cugccagaaaacccagcg

SEQ ID NO: 3417156 - RNA, 19 nt, Pseudomonas aeruginosa PA01
cugccagaaaacccagcga

SEQ ID NO: 3417157 - RNA, 15 nt, Pseudomonas aeruginosa PA01
cugccagaaggccug

SEQ ID NO: 3417158 - RNA, 14 nt, Pseudomonas aeruginosa PA01
cugccagaccgugg

SEQ ID NO: 3417159 - RNA, 15 nt, Pseudomonas aeruginosa PA01
cugccagaccguggc

SEQ ID NO: 3417160 - RNA, 17 nt, Pseudomonas aeruginosa PA01
cugccagaccguggcgc

SEQ ID NO: 3417161 - RNA, 21 nt, Pseudomonas aeruginosa PA01
cugccagaccguggcgcuacg

SEQ ID NO: 3417162 - RNA, 13 nt, Pseudomonas aeruginosa PA01
cugccagagcgcu

SEQ ID NO: 3417163 - RNA, 16 nt, Pseudomonas aeruginosa PA01
cugccagagcgcugcc

SEQ ID NO: 3417164 - RNA, 18 nt, Pseudomonas aeruginosa PA01
cugccagaggaucggcca

SEQ ID NO: 3417165 - RNA, 14 nt, Pseudomonas aeruginosa PA01
cugccagcaggccg

SEQ ID NO: 3417166 - RNA, 16 nt, Pseudomonas aeruginosa PA01
cugccagcaggccgag

SEQ ID NO: 3417167 - RNA, 21 nt, Pseudomonas aeruginosa PA01
cugccagcaggccgagcccga

SEQ ID NO: 3417168 - RNA, 15 nt, Pseudomonas aeruginosa PA01
cugccagcgccgccg

SEQ ID NO: 3417169 - RNA, 12 nt, Pseudomonas aeruginosa PA01
cugccagcgcgu

SEQ ID NO: 3417170 - RNA, 18 nt, Pseudomonas aeruginosa PA01
cugccagcgcgucggcac

SEQ ID NO: 3417171 - RNA, 21 nt, Pseudomonas aeruginosa PA01
cugccagcgcgucggcacgcc

SEQ ID NO: 3417172 - RNA, 13 nt, Pseudomonas aeruginosa PA01
cugccagcgggcg

SEQ ID NO: 3417173 - RNA, 14 nt, Pseudomonas aeruginosa PA01
cugccagcucuggc

SEQ ID NO: 3417174 - RNA, 16 nt, Pseudomonas aeruginosa PA01
cugccaggagcacgcc

SEQ ID NO: 3417175 - RNA, 21 nt, Pseudomonas aeruginosa PA01
cugccaggagcacgccgugca

SEQ ID NO: 3417176 - RNA, 23 nt, Pseudomonas aeruginosa PA01
cugccaggggcuagucgcgcagc

SEQ ID NO: 3417177 - RNA, 20 nt, Pseudomonas aeruginosa PA01
cugccagguuggcaacugcg

SEQ ID NO: 3417178 - RNA, 14 nt, Pseudomonas aeruginosa PA01
cugccagugcucga

SEQ ID NO: 3417179 - RNA, 14 nt, Pseudomonas aeruginosa PA01
cugccaguggcggc

SEQ ID NO: 3417180 - RNA, 22 nt, Pseudomonas aeruginosa PA01
cugccauccgcgccgaccagcc

SEQ ID NO: 3417181 - RNA, 18 nt, Pseudomonas aeruginosa PA01
cugccaucgaugugagcc

SEQ ID NO: 3417182 - RNA, 16 nt, Pseudomonas aeruginosa PA01
cugcccaccaccagga

SEQ ID NO: 3417183 - RNA, 19 nt, Pseudomonas aeruginosa PA01
cugcccagcccgccuucca

SEQ ID NO: 3417184 - RNA, 13 nt, Pseudomonas aeruginosa PA01
cugcccagcgccg

SEQ ID NO: 3417185 - RNA, 15 nt, Pseudomonas aeruginosa PA01
cugcccagcgccgcc

SEQ ID NO: 3417186 - RNA, 16 nt, Pseudomonas aeruginosa PA01
cugcccagcgccgcca

SEQ ID NO: 3417187 - RNA, 21 nt, Pseudomonas aeruginosa PA01
cugcccagcgccgccagcagg

SEQ ID NO: 3417188 - RNA, 22 nt, Pseudomonas aeruginosa PA01
cugcccagcgccgccagcaggu

SEQ ID NO: 3417189 - RNA, 23 nt, Pseudomonas aeruginosa PA01
cugcccagggcccagagcagcac

SEQ ID NO: 3417190 - RNA, 18 nt, Pseudomonas aeruginosa PA01
cugcccaucgccuccacg

SEQ ID NO: 3417191 - RNA, 13 nt, Pseudomonas aeruginosa PA01
cugccccacaggc

SEQ ID NO: 3417192 - RNA, 14 nt, Pseudomonas aeruginosa PA01
cugccccacaggcc

SEQ ID NO: 3417193 - RNA, 15 nt, Pseudomonas aeruginosa PA01
cugccccacaggccc

SEQ ID NO: 3417194 - RNA, 22 nt, Pseudomonas aeruginosa PA01
cugccccacaggcccugcagcg

SEQ ID NO: 3417195 - RNA, 13 nt, Pseudomonas aeruginosa PA01
cugccccacuucc

SEQ ID NO: 3417196 - RNA, 20 nt, Pseudomonas aeruginosa PA01
cugccccacuuccggcccgg

SEQ ID NO: 3417197 - RNA, 21 nt, Pseudomonas aeruginosa PA01
cugccccacuuccggcccggc

SEQ ID NO: 3417198 - RNA, 15 nt, Pseudomonas aeruginosa PA01
cugccccagcaucgc

SEQ ID NO: 3417199 - RNA, 17 nt, Pseudomonas aeruginosa PA01
cugccccagcaucgccg

SEQ ID NO: 3417200 - RNA, 17 nt, Pseudomonas aeruginosa PA01
cugccccggcuuggcgg

SEQ ID NO: 3417201 - RNA, 18 nt, Pseudomonas aeruginosa PA01
cugccccgggcgccgggu

SEQ ID NO: 3417202 - RNA, 16 nt, Pseudomonas aeruginosa PA01
cugccccgugcaccga

SEQ ID NO: 3417203 - RNA, 19 nt, Pseudomonas aeruginosa PA01
cugccccgugcaccgaggc

SEQ ID NO: 3417204 - RNA, 22 nt, Pseudomonas aeruginosa PA01
cugccccgugcaccgaggcgcg

SEQ ID NO: 3417205 - RNA, 20 nt, Pseudomonas aeruginosa PA01
cugccccucacaccaccagc

SEQ ID NO: 3417206 - RNA, 22 nt, Pseudomonas aeruginosa PA01
cugccccucacaccaccagcau

SEQ ID NO: 3417207 - RNA, 16 nt, Pseudomonas aeruginosa PA01
cugccccuggcucagg

SEQ ID NO: 3417208 - RNA, 17 nt, Pseudomonas aeruginosa PA01
cugccccuggcucaggc

SEQ ID NO: 3417209 - RNA, 13 nt, Pseudomonas aeruginosa PA01
cugccccuugagc

SEQ ID NO: 3417210 - RNA, 13 nt, Pseudomonas aeruginosa PA01
cugcccgaccggg

SEQ ID NO: 3417211 - RNA, 20 nt, Pseudomonas aeruginosa PA01
cugcccgaccgguuccagcg

SEQ ID NO: 3417212 - RNA, 24 nt, Pseudomonas aeruginosa PA01
cugcccgaccgguuccagcggccg

SEQ ID NO: 3417213 - RNA, 13 nt, Pseudomonas aeruginosa PA01
cugcccgacgaag

SEQ ID NO: 3417214 - RNA, 22 nt, Pseudomonas aeruginosa PA01
cugcccgacgaaguugcaggcc

SEQ ID NO: 3417215 - RNA, 20 nt, Pseudomonas aeruginosa PA01
cugcccgacggcuugaucac

SEQ ID NO: 3417216 - RNA, 21 nt, Pseudomonas aeruginosa PA01
cugcccgccggcgcccugggc

SEQ ID NO: 3417217 - RNA, 12 nt, Pseudomonas aeruginosa PA01
cugcccgcgccu

SEQ ID NO: 3417218 - RNA, 13 nt, Pseudomonas aeruginosa PA01
cugcccgcgccuc

SEQ ID NO: 3417219 - RNA, 12 nt, Pseudomonas aeruginosa PA01
cugcccgcgucc

SEQ ID NO: 3417220 - RNA, 15 nt, Pseudomonas aeruginosa PA01
cugcccgcgucccau

SEQ ID NO: 3417221 - RNA, 17 nt, Pseudomonas aeruginosa PA01
cugcccggagcggcugc

SEQ ID NO: 3417222 - RNA, 22 nt, Pseudomonas aeruginosa PA01
cugcccggcauaggcgccagcc

SEQ ID NO: 3417223 - RNA, 14 nt, Pseudomonas aeruginosa PA01
cugcccggccaugc

SEQ ID NO: 3417224 - RNA, 19 nt, Pseudomonas aeruginosa PA01
cugcccggccaugccgccg

SEQ ID NO: 3417225 - RNA, 16 nt, Pseudomonas aeruginosa PA01
cugcccggcgcgacgc

SEQ ID NO: 3417226 - RNA, 21 nt, Pseudomonas aeruginosa PA01
cugcccggcgcgacgcuccag

SEQ ID NO: 3417227 - RNA, 20 nt, Pseudomonas aeruginosa PA01
cugcccggcucguucauguc

SEQ ID NO: 3417228 - RNA, 21 nt, Pseudomonas aeruginosa PA01
cugcccggcucguucaugucg

SEQ ID NO: 3417229 - RNA, 11 nt, Pseudomonas aeruginosa PA01
cugcccggcuu

SEQ ID NO: 3417230 - RNA, 13 nt, Pseudomonas aeruginosa PA01
cugcccggcuucg

SEQ ID NO: 3417231 - RNA, 14 nt, Pseudomonas aeruginosa PA01
cugcccuccugcuc

SEQ ID NO: 3417232 - RNA, 16 nt, Pseudomonas aeruginosa PA01
cugcccucgaccaggu

SEQ ID NO: 3417233 - RNA, 19 nt, Pseudomonas aeruginosa PA01
cugcccucgaccagguccg

SEQ ID NO: 3417234 - RNA, 13 nt, Pseudomonas aeruginosa PA01
cugcccucgacga

SEQ ID NO: 3417235 - RNA, 13 nt, Pseudomonas aeruginosa PA01
cugcccuggcgcg

SEQ ID NO: 3417236 - RNA, 14 nt, Pseudomonas aeruginosa PA01
cugcccuggcgcgc

SEQ ID NO: 3417237 - RNA, 16 nt, Pseudomonas aeruginosa PA01
cugcccuggcgcgcgc

SEQ ID NO: 3417238 - RNA, 17 nt, Pseudomonas aeruginosa PA01
cugccgaacagcaggga

SEQ ID NO: 3417239 - RNA, 21 nt, Pseudomonas aeruginosa PA01
cugccgaacagcagggaggcg

SEQ ID NO: 3417240 - RNA, 17 nt, Pseudomonas aeruginosa PA01
cugccgaaccgccucag

SEQ ID NO: 3417241 - RNA, 22 nt, Pseudomonas aeruginosa PA01
cugccgaagaucgacaggccgc

SEQ ID NO: 3417242 - RNA, 21 nt, Pseudomonas aeruginosa PA01
cugccgaagccuucgucgaug

SEQ ID NO: 3417243 - RNA, 16 nt, Pseudomonas aeruginosa PA01
cugccgaagggaaaca

SEQ ID NO: 3417244 - RNA, 20 nt, Pseudomonas aeruginosa PA01
cugccgaagggaaacaccag

SEQ ID NO: 3417245 - RNA, 22 nt, Pseudomonas aeruginosa PA01
cugccgaagggaaacaccaggc

SEQ ID NO: 3417246 - RNA, 21 nt, Pseudomonas aeruginosa PA01
cugccgagaaucugcccggcc

SEQ ID NO: 3417247 - RNA, 16 nt, Pseudomonas aeruginosa PA01
cugccgagcaggguca

SEQ ID NO: 3417248 - RNA, 21 nt, Pseudomonas aeruginosa PA01
cugccgagcagggucacgccg

SEQ ID NO: 3417249 - RNA, 15 nt, Pseudomonas aeruginosa PA01
cugccgagcaggugc

SEQ ID NO: 3417250 - RNA, 16 nt, Pseudomonas aeruginosa PA01
cugccgagcaggugca

SEQ ID NO: 3417251 - RNA, 19 nt, Pseudomonas aeruginosa PA01
cugccgaggaacucgcggu

SEQ ID NO: 3417252 - RNA, 21 nt, Pseudomonas aeruginosa PA01
cugccgaggaacucgcggucc

SEQ ID NO: 3417253 - RNA, 21 nt, Pseudomonas aeruginosa PA01
cugccgaggcugaucugccgg

SEQ ID NO: 3417254 - RNA, 19 nt, Pseudomonas aeruginosa PA01
cugccgaggguguagagga

SEQ ID NO: 3417255 - RNA, 22 nt, Pseudomonas aeruginosa PA01
cugccgaucagccauuggccga

SEQ ID NO: 3417256 - RNA, 23 nt, Pseudomonas aeruginosa PA01
cugccgaucagccauuggccgac

SEQ ID NO: 3417257 - RNA, 18 nt, Pseudomonas aeruginosa PA01
cugccgaucgccgcgcgg

SEQ ID NO: 3417258 - RNA, 18 nt, Pseudomonas aeruginosa PA01
cugccgaugcugaucacc

SEQ ID NO: 3417259 - RNA, 17 nt, Pseudomonas aeruginosa PA01
cugccgaugggccuuca

SEQ ID NO: 3417260 - RNA, 17 nt, Pseudomonas aeruginosa PA01
cugccgauggucucucu

SEQ ID NO: 3417261 - RNA, 22 nt, Pseudomonas aeruginosa PA01
cugccgauggugauacgcagga

SEQ ID NO: 3417262 - RNA, 15 nt, Pseudomonas aeruginosa PA01
cugccgcaccgccuc

SEQ ID NO: 3417263 - RNA, 18 nt, Pseudomonas aeruginosa PA01
cugccgcaccgccucgau

SEQ ID NO: 3417264 - RNA, 15 nt, Pseudomonas aeruginosa PA01
cugccgcagcgccuc

SEQ ID NO: 3417265 - RNA, 18 nt, Pseudomonas aeruginosa PA01
cugccgcagcgccucccg

SEQ ID NO: 3417266 - RNA, 20 nt, Pseudomonas aeruginosa PA01
cugccgcagcgccucccggg

SEQ ID NO: 3417267 - RNA, 16 nt, Pseudomonas aeruginosa PA01
cugccgcaggcgggcg

SEQ ID NO: 3417268 - RNA, 20 nt, Pseudomonas aeruginosa PA01
cugccgcaggcgggcgccau

SEQ ID NO: 3417269 - RNA, 21 nt, Pseudomonas aeruginosa PA01
cugccgcaguagaugccgcgu

SEQ ID NO: 3417270 - RNA, 12 nt, Pseudomonas aeruginosa PA01
cugccgccagcu

SEQ ID NO: 3417271 - RNA, 15 nt, Pseudomonas aeruginosa PA01
cugccgccagcucau

SEQ ID NO: 3417272 - RNA, 13 nt, Pseudomonas aeruginosa PA01
cugccgcccggcc

SEQ ID NO: 3417273 - RNA, 14 nt, Pseudomonas aeruginosa PA01
cugccgcccggcca

SEQ ID NO: 3417274 - RNA, 16 nt, Pseudomonas aeruginosa PA01
cugccgcccggccagg

SEQ ID NO: 3417275 - RNA, 20 nt, Pseudomonas aeruginosa PA01
cugccgcccggccaggccac

SEQ ID NO: 3417276 - RNA, 13 nt, Pseudomonas aeruginosa PA01
cugccgcccucgg

SEQ ID NO: 3417277 - RNA, 15 nt, Pseudomonas aeruginosa PA01
cugccgcccucgggc

SEQ ID NO: 3417278 - RNA, 13 nt, Pseudomonas aeruginosa PA01
cugccgcccuucg

SEQ ID NO: 3417279 - RNA, 22 nt, Pseudomonas aeruginosa PA01
cugccgccgcagagccagccgc

SEQ ID NO: 3417280 - RNA, 12 nt, Pseudomonas aeruginosa PA01
cugccgccgccg

SEQ ID NO: 3417281 - RNA, 16 nt, Pseudomonas aeruginosa PA01
cugccgccgccgucga

SEQ ID NO: 3417282 - RNA, 19 nt, Pseudomonas aeruginosa PA01
cugccgccgcgcccggcgc

SEQ ID NO: 3417283 - RNA, 15 nt, Pseudomonas aeruginosa PA01
cugccgccgcgcugc

SEQ ID NO: 3417284 - RNA, 19 nt, Pseudomonas aeruginosa PA01
cugccgccgucuccgccgc

SEQ ID NO: 3417285 - RNA, 15 nt, Pseudomonas aeruginosa PA01
cugccgccuucgcgg

SEQ ID NO: 3417286 - RNA, 16 nt, Pseudomonas aeruginosa PA01
cugccgcgacaggaug

SEQ ID NO: 3417287 - RNA, 12 nt, Pseudomonas aeruginosa PA01
cugccgcgccgg

SEQ ID NO: 3417288 - RNA, 16 nt, Pseudomonas aeruginosa PA01
cugccgcgcguggcuu

SEQ ID NO: 3417289 - RNA, 18 nt, Pseudomonas aeruginosa PA01
cugccgcuaucgcuggcg

SEQ ID NO: 3417290 - RNA, 19 nt, Pseudomonas aeruginosa PA01
cugccgcuaucgcuggcgc

SEQ ID NO: 3417291 - RNA, 20 nt, Pseudomonas aeruginosa PA01
cugccgcuaucgcuggcgca

SEQ ID NO: 3417292 - RNA, 17 nt, Pseudomonas aeruginosa PA01
cugccgcucguuggcgg

SEQ ID NO: 3417293 - RNA, 15 nt, Pseudomonas aeruginosa PA01
cugccgcucuggcug

SEQ ID NO: 3417294 - RNA, 19 nt, Pseudomonas aeruginosa PA01
cugccgcucuggcugcugg

SEQ ID NO: 3417295 - RNA, 21 nt, Pseudomonas aeruginosa PA01
cugccgcucuggcugcuggcg

SEQ ID NO: 3417296 - RNA, 13 nt, Pseudomonas aeruginosa PA01
cugccgcuggcgg

SEQ ID NO: 3417297 - RNA, 14 nt, Pseudomonas aeruginosa PA01
cugccgcuggcggc

SEQ ID NO: 3417298 - RNA, 23 nt, Pseudomonas aeruginosa PA01
cugccgcuggcggccuucggcgu

SEQ ID NO: 3417299 - RNA, 15 nt, Pseudomonas aeruginosa PA01
cugccgcuucggcug

SEQ ID NO: 3417300 - RNA, 24 nt, Pseudomonas aeruginosa PA01
cugccgcuucggcugcugcugcgg

SEQ ID NO: 3417301 - RNA, 14 nt, Pseudomonas aeruginosa PA01
cugccggacgcgau

SEQ ID NO: 3417302 - RNA, 22 nt, Pseudomonas aeruginosa PA01
cugccggccagggucgccagca

SEQ ID NO: 3417303 - RNA, 23 nt, Pseudomonas aeruginosa PA01
cugccggccagggucgccagcag

SEQ ID NO: 3417304 - RNA, 13 nt, Pseudomonas aeruginosa PA01
cugccggccaggu

SEQ ID NO: 3417305 - RNA, 16 nt, Pseudomonas aeruginosa PA01
cugccggccagguagc

SEQ ID NO: 3417306 - RNA, 13 nt, Pseudomonas aeruginosa PA01
cugccggcccucg

SEQ ID NO: 3417307 - RNA, 20 nt, Pseudomonas aeruginosa PA01
cugccggcgcagaucgcggc

SEQ ID NO: 3417308 - RNA, 23 nt, Pseudomonas aeruginosa PA01
cugccggcgcgcacggaggcgcu

SEQ ID NO: 3417309 - RNA, 18 nt, Pseudomonas aeruginosa PA01
cugccggcguccuugccg

SEQ ID NO: 3417310 - RNA, 22 nt, Pseudomonas aeruginosa PA01
cugccggcgucguccugcgcgg

SEQ ID NO: 3417311 - RNA, 21 nt, Pseudomonas aeruginosa PA01
cugccggcuugcugcaggugg

SEQ ID NO: 3417312 - RNA, 23 nt, Pseudomonas aeruginosa PA01
cugccgggcaagcucgacgagcc

SEQ ID NO: 3417313 - RNA, 13 nt, Pseudomonas aeruginosa PA01
cugccgggccagc

SEQ ID NO: 3417314 - RNA, 13 nt, Pseudomonas aeruginosa PA01
cugccgggcgcgc

SEQ ID NO: 3417315 - RNA, 14 nt, Pseudomonas aeruginosa PA01
cugccgggcgcgcu

SEQ ID NO: 3417316 - RNA, 17 nt, Pseudomonas aeruginosa PA01
cugccgguacgcaccag

SEQ ID NO: 3417317 - RNA, 15 nt, Pseudomonas aeruginosa PA01
cugccggucggccuu

SEQ ID NO: 3417318 - RNA, 20 nt, Pseudomonas aeruginosa PA01
cugccggugugccgucaggc

SEQ ID NO: 3417319 - RNA, 14 nt, Pseudomonas aeruginosa PA01
cugccguacagccc

SEQ ID NO: 3417320 - RNA, 22 nt, Pseudomonas aeruginosa PA01
cugccguacagcccccgccggc

SEQ ID NO: 3417321 - RNA, 17 nt, Pseudomonas aeruginosa PA01
cugccguauccgcggca

SEQ ID NO: 3417322 - RNA, 20 nt, Pseudomonas aeruginosa PA01
cugccguauccgcggcaggg

SEQ ID NO: 3417323 - RNA, 20 nt, Pseudomonas aeruginosa PA01
cugccgucacuugaaguccc

SEQ ID NO: 3417324 - RNA, 16 nt, Pseudomonas aeruginosa PA01
cugccguccaggcgcg

SEQ ID NO: 3417325 - RNA, 15 nt, Pseudomonas aeruginosa PA01
cugccgucggcgccc

SEQ ID NO: 3417326 - RNA, 18 nt, Pseudomonas aeruginosa PA01
cugccgucggcgcccuuc

SEQ ID NO: 3417327 - RNA, 16 nt, Pseudomonas aeruginosa PA01
cugccguucgcccgcg

SEQ ID NO: 3417328 - RNA, 21 nt, Pseudomonas aeruginosa PA01
cugccguucgcccgcggcggc

SEQ ID NO: 3417329 - RNA, 23 nt, Pseudomonas aeruginosa PA01
cugccguucgucaccggcgccac

SEQ ID NO: 3417330 - RNA, 16 nt, Pseudomonas aeruginosa PA01
cugccguugcaggccc

SEQ ID NO: 3417331 - RNA, 17 nt, Pseudomonas aeruginosa PA01
cugccguugcaggccca

SEQ ID NO: 3417332 - RNA, 19 nt, Pseudomonas aeruginosa PA01
cugccguugcaggcccagc

SEQ ID NO: 3417333 - RNA, 16 nt, Pseudomonas aeruginosa PA01
cugccguugcggcccu

SEQ ID NO: 3417334 - RNA, 18 nt, Pseudomonas aeruginosa PA01
cugccguugcggcccuuc

SEQ ID NO: 3417335 - RNA, 20 nt, Pseudomonas aeruginosa PA01
cugccucggaggccuuuucc

SEQ ID NO: 3417336 - RNA, 23 nt, Pseudomonas aeruginosa PA01
cugccucgguuuccggccaggcg

SEQ ID NO: 3417337 - RNA, 14 nt, Pseudomonas aeruginosa PA01
cugccugcaccggg

SEQ ID NO: 3417338 - RNA, 15 nt, Pseudomonas aeruginosa PA01
cugccugcaccgggc

SEQ ID NO: 3417339 - RNA, 19 nt, Pseudomonas aeruginosa PA01
cugccugcagguagcgcug

SEQ ID NO: 3417340 - RNA, 15 nt, Pseudomonas aeruginosa PA01
cugccugcgcagggc

SEQ ID NO: 3417341 - RNA, 19 nt, Pseudomonas aeruginosa PA01
cugccugcgcagggcuucc

SEQ ID NO: 3417342 - RNA, 21 nt, Pseudomonas aeruginosa PA01
cugccuucgacguagaccugg

SEQ ID NO: 3417343 - RNA, 20 nt, Pseudomonas aeruginosa PA01
cugcgaaaaagaacgccccg

SEQ ID NO: 3417344 - RNA, 21 nt, Pseudomonas aeruginosa PA01
cugcgaaccgagacccuggcg

SEQ ID NO: 3417345 - RNA, 23 nt, Pseudomonas aeruginosa PA01
cugcgaaccgagacccuggcgcu

SEQ ID NO: 3417346 - RNA, 19 nt, Pseudomonas aeruginosa PA01
cugcgaauagacgccgcug

SEQ ID NO: 3417347 - RNA, 17 nt, Pseudomonas aeruginosa PA01
cugcgaaucgucgccgg

SEQ ID NO: 3417348 - RNA, 19 nt, Pseudomonas aeruginosa PA01
cugcgaauugcgcuggaag

SEQ ID NO: 3417349 - RNA, 14 nt, Pseudomonas aeruginosa PA01
cugcgacaguucgc

SEQ ID NO: 3417350 - RNA, 23 nt, Pseudomonas aeruginosa PA01
cugcgacaguucgcggaacuucg

SEQ ID NO: 3417351 - RNA, 17 nt, Pseudomonas aeruginosa PA01
cugcgacaucuccaggc

SEQ ID NO: 3417352 - RNA, 23 nt, Pseudomonas aeruginosa PA01
cugcgacaucuccaggccgcuca

SEQ ID NO: 3417353 - RNA, 19 nt, Pseudomonas aeruginosa PA01
cugcgacaugccgguuccc

SEQ ID NO: 3417354 - RNA, 16 nt, Pseudomonas aeruginosa PA01
cugcgacugacggugg

SEQ ID NO: 3417355 - RNA, 12 nt, Pseudomonas aeruginosa PA01
cugcgagcaggu

SEQ ID NO: 3417356 - RNA, 14 nt, Pseudomonas aeruginosa PA01
cugcgagcaggucc

SEQ ID NO: 3417357 - RNA, 22 nt, Pseudomonas aeruginosa PA01
cugcgagcagguccugucccag

SEQ ID NO: 3417358 - RNA, 14 nt, Pseudomonas aeruginosa PA01
cugcgagccgcgcg

SEQ ID NO: 3417359 - RNA, 14 nt, Pseudomonas aeruginosa PA01
cugcgagcgcuuca

SEQ ID NO: 3417360 - RNA, 22 nt, Pseudomonas aeruginosa PA01
cugcgagcgcuucauccugcgc

SEQ ID NO: 3417361 - RNA, 14 nt, Pseudomonas aeruginosa PA01
cugcgaggcgucga

SEQ ID NO: 3417362 - RNA, 15 nt, Pseudomonas aeruginosa PA01
cugcgaggcgucgau

SEQ ID NO: 3417363 - RNA, 16 nt, Pseudomonas aeruginosa PA01
cugcgaggcgucgauc

SEQ ID NO: 3417364 - RNA, 20 nt, Pseudomonas aeruginosa PA01
cugcgaguaguagcguuccu

SEQ ID NO: 3417365 - RNA, 20 nt, Pseudomonas aeruginosa PA01
cugcgaguugaucggcgugg

SEQ ID NO: 3417366 - RNA, 15 nt, Pseudomonas aeruginosa PA01
cugcgauauggccga

SEQ ID NO: 3417367 - RNA, 21 nt, Pseudomonas aeruginosa PA01
cugcgaucagggccucgccac

SEQ ID NO: 3417368 - RNA, 13 nt, Pseudomonas aeruginosa PA01
cugcgcaacugcc

SEQ ID NO: 3417369 - RNA, 15 nt, Pseudomonas aeruginosa PA01
cugcgcaccaugccc

SEQ ID NO: 3417370 - RNA, 19 nt, Pseudomonas aeruginosa PA01
cugcgcaccaugcccgcug

SEQ ID NO: 3417371 - RNA, 16 nt, Pseudomonas aeruginosa PA01
cugcgcaccucggcca

SEQ ID NO: 3417372 - RNA, 18 nt, Pseudomonas aeruginosa PA01
cugcgcaccucggccagg

SEQ ID NO: 3417373 - RNA, 13 nt, Pseudomonas aeruginosa PA01
cugcgcagaugcg

SEQ ID NO: 3417374 - RNA, 12 nt, Pseudomonas aeruginosa PA01
cugcgcagcuag

SEQ ID NO: 3417375 - RNA, 13 nt, Pseudomonas aeruginosa PA01
cugcgcaggccga

SEQ ID NO: 3417376 - RNA, 15 nt, Pseudomonas aeruginosa PA01
cugcgcaggccgaga

SEQ ID NO: 3417377 - RNA, 13 nt, Pseudomonas aeruginosa PA01
cugcgcaggcugg

SEQ ID NO: 3417378 - RNA, 12 nt, Pseudomonas aeruginosa PA01
cugcgcagggcg

SEQ ID NO: 3417379 - RNA, 12 nt, Pseudomonas aeruginosa PA01
cugcgcagggcu

SEQ ID NO: 3417380 - RNA, 13 nt, Pseudomonas aeruginosa PA01
cugcgcaucgccu

SEQ ID NO: 3417381 - RNA, 16 nt, Pseudomonas aeruginosa PA01
cugcgcaucgccuggg

SEQ ID NO: 3417382 - RNA, 16 nt, Pseudomonas aeruginosa PA01
cugcgcauuguucggg

SEQ ID NO: 3417383 - RNA, 17 nt, Pseudomonas aeruginosa PA01
cugcgcauuguucgggg

SEQ ID NO: 3417384 - RNA, 16 nt, Pseudomonas aeruginosa PA01
cugcgccagcaucgca

SEQ ID NO: 3417385 - RNA, 21 nt, Pseudomonas aeruginosa PA01
cugcgccaggcuuuccgccga

SEQ ID NO: 3417386 - RNA, 21 nt, Pseudomonas aeruginosa PA01
cugcgccaguuccuucgccga

SEQ ID NO: 3417387 - RNA, 13 nt, Pseudomonas aeruginosa PA01
cugcgccaugccg

SEQ ID NO: 3417388 - RNA, 23 nt, Pseudomonas aeruginosa PA01
cugcgccaugccguucaggccgg

SEQ ID NO: 3417389 - RNA, 24 nt, Pseudomonas aeruginosa PA01
cugcgccaugccguucaggccggc

SEQ ID NO: 3417390 - RNA, 19 nt, Pseudomonas aeruginosa PA01
cugcgccauucacuucccc

SEQ ID NO: 3417391 - RNA, 16 nt, Pseudomonas aeruginosa PA01
cugcgcccagggacgc

SEQ ID NO: 3417392 - RNA, 22 nt, Pseudomonas aeruginosa PA01
cugcgcccagggacgcgccggc

SEQ ID NO: 3417393 - RNA, 14 nt, Pseudomonas aeruginosa PA01
cugcgcccccagcg

SEQ ID NO: 3417394 - RNA, 16 nt, Pseudomonas aeruginosa PA01
cugcgcccccagcgcc

SEQ ID NO: 3417395 - RNA, 17 nt, Pseudomonas aeruginosa PA01
cugcgcccccagcgccc

SEQ ID NO: 3417396 - RNA, 19 nt, Pseudomonas aeruginosa PA01
cugcgccccggucucgcgc

SEQ ID NO: 3417397 - RNA, 20 nt, Pseudomonas aeruginosa PA01
cugcgccccggucucgcgca

SEQ ID NO: 3417398 - RNA, 21 nt, Pseudomonas aeruginosa PA01
cugcgccccggucucgcgcag

SEQ ID NO: 3417399 - RNA, 17 nt, Pseudomonas aeruginosa PA01
cugcgcccgcucgaccc

SEQ ID NO: 3417400 - RNA, 18 nt, Pseudomonas aeruginosa PA01
cugcgcccuagucgaggg

SEQ ID NO: 3417401 - RNA, 18 nt, Pseudomonas aeruginosa PA01
cugcgcccucaagucucc

SEQ ID NO: 3417402 - RNA, 21 nt, Pseudomonas aeruginosa PA01
cugcgcccucaagucuccagc

SEQ ID NO: 3417403 - RNA, 23 nt, Pseudomonas aeruginosa PA01
cugcgcccucaagucuccagcga

SEQ ID NO: 3417404 - RNA, 13 nt, Pseudomonas aeruginosa PA01
cugcgccgaaggc

SEQ ID NO: 3417405 - RNA, 14 nt, Pseudomonas aeruginosa PA01
cugcgccgaaggcg

SEQ ID NO: 3417406 - RNA, 18 nt, Pseudomonas aeruginosa PA01
cugcgccgaaggcgucag

SEQ ID NO: 3417407 - RNA, 17 nt, Pseudomonas aeruginosa PA01
cugcgccgcagcggcca

SEQ ID NO: 3417408 - RNA, 22 nt, Pseudomonas aeruginosa PA01
cugcgccgccuuucugcccggc

SEQ ID NO: 3417409 - RNA, 20 nt, Pseudomonas aeruginosa PA01
cugcgccgcguucgccgagc

SEQ ID NO: 3417410 - RNA, 19 nt, Pseudomonas aeruginosa PA01
cugcgccggcacggcaucg

SEQ ID NO: 3417411 - RNA, 20 nt, Pseudomonas aeruginosa PA01
cugcgccgggaugcucaccg

SEQ ID NO: 3417412 - RNA, 22 nt, Pseudomonas aeruginosa PA01
cugcgccgggaugcucaccgcg

SEQ ID NO: 3417413 - RNA, 24 nt, Pseudomonas aeruginosa PA01
cugcgccgggaugcucaccgcgcu

SEQ ID NO: 3417414 - RNA, 18 nt, Pseudomonas aeruginosa PA01
cugcgccucacggucgca

SEQ ID NO: 3417415 - RNA, 22 nt, Pseudomonas aeruginosa PA01
cugcgccucgaccuggccacgc

SEQ ID NO: 3417416 - RNA, 15 nt, Pseudomonas aeruginosa PA01
cugcgccucgcuggc

SEQ ID NO: 3417417 - RNA, 14 nt, Pseudomonas aeruginosa PA01
cugcgccucggccc

SEQ ID NO: 3417418 - RNA, 18 nt, Pseudomonas aeruginosa PA01
cugcgccucggcccuggc

SEQ ID NO: 3417419 - RNA, 21 nt, Pseudomonas aeruginosa PA01
cugcgccucggcccuggcggc

SEQ ID NO: 3417420 - RNA, 14 nt, Pseudomonas aeruginosa PA01
cugcgccugcagcu

SEQ ID NO: 3417421 - RNA, 16 nt, Pseudomonas aeruginosa PA01
cugcgccugcagcucg

SEQ ID NO: 3417422 - RNA, 19 nt, Pseudomonas aeruginosa PA01
cugcgccugcagcucggug

SEQ ID NO: 3417423 - RNA, 18 nt, Pseudomonas aeruginosa PA01
cugcgccuggccgcgcag

SEQ ID NO: 3417424 - RNA, 21 nt, Pseudomonas aeruginosa PA01
cugcgcgaagccaggaagcgg

SEQ ID NO: 3417425 - RNA, 23 nt, Pseudomonas aeruginosa PA01
cugcgcgaagccaggaagcggcg

SEQ ID NO: 3417426 - RNA, 13 nt, Pseudomonas aeruginosa PA01
cugcgcgaggagc

SEQ ID NO: 3417427 - RNA, 17 nt, Pseudomonas aeruginosa PA01
cugcgcgaggagccgua

SEQ ID NO: 3417428 - RNA, 18 nt, Pseudomonas aeruginosa PA01
cugcgcgaucccccgccc

SEQ ID NO: 3417429 - RNA, 13 nt, Pseudomonas aeruginosa PA01
cugcgcgcaccag

SEQ ID NO: 3417430 - RNA, 15 nt, Pseudomonas aeruginosa PA01
cugcgcgcaccaggc

SEQ ID NO: 3417431 - RNA, 13 nt, Pseudomonas aeruginosa PA01
cugcgcgcaucga

SEQ ID NO: 3417432 - RNA, 15 nt, Pseudomonas aeruginosa PA01
cugcgcgccaccacc

SEQ ID NO: 3417433 - RNA, 19 nt, Pseudomonas aeruginosa PA01
cugcgcgccaccaccguca

SEQ ID NO: 3417434 - RNA, 14 nt, Pseudomonas aeruginosa PA01
cugcgcgccucuuc

SEQ ID NO: 3417435 - RNA, 17 nt, Pseudomonas aeruginosa PA01
cugcgcgccucuuccug

SEQ ID NO: 3417436 - RNA, 23 nt, Pseudomonas aeruginosa PA01
cugcgcgccucuuccuggaccuc

SEQ ID NO: 3417437 - RNA, 20 nt, Pseudomonas aeruginosa PA01
cugcgcgccucuucgcagga

SEQ ID NO: 3417438 - RNA, 13 nt, Pseudomonas aeruginosa PA01
cugcgcgcggccc

SEQ ID NO: 3417439 - RNA, 13 nt, Pseudomonas aeruginosa PA01
cugcgcggccugc

SEQ ID NO: 3417440 - RNA, 18 nt, Pseudomonas aeruginosa PA01
cugcgcggccugcgccgg

SEQ ID NO: 3417441 - RNA, 13 nt, Pseudomonas aeruginosa PA01
cugcgcggcgacg

SEQ ID NO: 3417442 - RNA, 13 nt, Pseudomonas aeruginosa PA01
cugcgcgggucgu

SEQ ID NO: 3417443 - RNA, 21 nt, Pseudomonas aeruginosa PA01
cugcgcgggucguacaccgcg

SEQ ID NO: 3417444 - RNA, 23 nt, Pseudomonas aeruginosa PA01
cugcgcgggugucgcgacgguga

SEQ ID NO: 3417445 - RNA, 18 nt, Pseudomonas aeruginosa PA01
cugcgcguacaucccgcc

SEQ ID NO: 3417446 - RNA, 20 nt, Pseudomonas aeruginosa PA01
cugcgcguacaucccgccga

SEQ ID NO: 3417447 - RNA, 23 nt, Pseudomonas aeruginosa PA01
cugcgcguguacccccaccgggc

SEQ ID NO: 3417448 - RNA, 18 nt, Pseudomonas aeruginosa PA01
cugcgcguugcagcgccu

SEQ ID NO: 3417449 - RNA, 19 nt, Pseudomonas aeruginosa PA01
cugcgcguugcagcgccug

SEQ ID NO: 3417450 - RNA, 14 nt, Pseudomonas aeruginosa PA01
cugcgcuccaggcg

SEQ ID NO: 3417451 - RNA, 15 nt, Pseudomonas aeruginosa PA01
cugcgcuccaggcgg

SEQ ID NO: 3417452 - RNA, 18 nt, Pseudomonas aeruginosa PA01
cugcgcuccaggcgguag

SEQ ID NO: 3417453 - RNA, 24 nt, Pseudomonas aeruginosa PA01
cugcgcucggauuccagcgcggug

SEQ ID NO: 3417454 - RNA, 14 nt, Pseudomonas aeruginosa PA01
cugcgcugagcagg

SEQ ID NO: 3417455 - RNA, 15 nt, Pseudomonas aeruginosa PA01
cugcgcugagcagga

SEQ ID NO: 3417456 - RNA, 17 nt, Pseudomonas aeruginosa PA01
cugcgcugccagcgccg

SEQ ID NO: 3417457 - RNA, 21 nt, Pseudomonas aeruginosa PA01
cugcgcugccagcgccgccgc

SEQ ID NO: 3417458 - RNA, 12 nt, Pseudomonas aeruginosa PA01
cugcgcuggccg

SEQ ID NO: 3417459 - RNA, 18 nt, Pseudomonas aeruginosa PA01
cugcgcuguucgggucgc

SEQ ID NO: 3417460 - RNA, 19 nt, Pseudomonas aeruginosa PA01
cugcgcuuccggcagccag

SEQ ID NO: 3417461 - RNA, 20 nt, Pseudomonas aeruginosa PA01
cugcgcuuccggcagccagc

SEQ ID NO: 3417462 - RNA, 17 nt, Pseudomonas aeruginosa PA01
cugcggaaaccgggaug

SEQ ID NO: 3417463 - RNA, 12 nt, Pseudomonas aeruginosa PA01
cugcggaagagg

SEQ ID NO: 3417464 - RNA, 12 nt, Pseudomonas aeruginosa PA01
cugcggaccaca

SEQ ID NO: 3417465 - RNA, 13 nt, Pseudomonas aeruginosa PA01
cugcggaccacag

SEQ ID NO: 3417466 - RNA, 21 nt, Pseudomonas aeruginosa PA01
cugcggaccgcagaaccagac

SEQ ID NO: 3417467 - RNA, 23 nt, Pseudomonas aeruginosa PA01
cugcggacuaccuucgaucaccc

SEQ ID NO: 3417468 - RNA, 22 nt, Pseudomonas aeruginosa PA01
cugcggaucaacuccgccaggc

SEQ ID NO: 3417469 - RNA, 23 nt, Pseudomonas aeruginosa PA01
cugcggaucgaggaauuccggca

SEQ ID NO: 3417470 - RNA, 12 nt, Pseudomonas aeruginosa PA01
cugcggaucgau

SEQ ID NO: 3417471 - RNA, 22 nt, Pseudomonas aeruginosa PA01
cugcggauggcgcggggccccg

SEQ ID NO: 3417472 - RNA, 18 nt, Pseudomonas aeruginosa PA01
cugcggaugggcgacgac

SEQ ID NO: 3417473 - RNA, 20 nt, Pseudomonas aeruginosa PA01
cugcggauucaucggcggca

SEQ ID NO: 3417474 - RNA, 23 nt, Pseudomonas aeruginosa PA01
cugcggauucaucggcggcaggc

SEQ ID NO: 3417475 - RNA, 22 nt, Pseudomonas aeruginosa PA01
cugcggcaagugggucacggug

SEQ ID NO: 3417476 - RNA, 22 nt, Pseudomonas aeruginosa PA01
cugcggcacgaaccauugcggc

SEQ ID NO: 3417477 - RNA, 20 nt, Pseudomonas aeruginosa PA01
cugcggcaggcgccaaccgg

SEQ ID NO: 3417478 - RNA, 19 nt, Pseudomonas aeruginosa PA01
cugcggcaggguggcgcau

SEQ ID NO: 3417479 - RNA, 14 nt, Pseudomonas aeruginosa PA01
cugcggccagcgcc

SEQ ID NO: 3417480 - RNA, 22 nt, Pseudomonas aeruginosa PA01
cugcggccccaaggggccgcgc

SEQ ID NO: 3417481 - RNA, 15 nt, Pseudomonas aeruginosa PA01
cugcggcccgagggc

SEQ ID NO: 3417482 - RNA, 22 nt, Pseudomonas aeruginosa PA01
cugcggccgcaaccagcccugg

SEQ ID NO: 3417483 - RNA, 12 nt, Pseudomonas aeruginosa PA01
cugcggccggcg

SEQ ID NO: 3417484 - RNA, 15 nt, Pseudomonas aeruginosa PA01
cugcggccggcgcgu

SEQ ID NO: 3417485 - RNA, 13 nt, Pseudomonas aeruginosa PA01
cugcggccgggug

SEQ ID NO: 3417486 - RNA, 16 nt, Pseudomonas aeruginosa PA01
cugcggcggaaggcgg

SEQ ID NO: 3417487 - RNA, 16 nt, Pseudomonas aeruginosa PA01
cugcggcggcaccacg

SEQ ID NO: 3417488 - RNA, 17 nt, Pseudomonas aeruginosa PA01
cugcggcggcaggucgg

SEQ ID NO: 3417489 - RNA, 24 nt, Pseudomonas aeruginosa PA01
cugcggcggcaggucggacaggca

SEQ ID NO: 3417490 - RNA, 17 nt, Pseudomonas aeruginosa PA01
cugcggcggucccagac

SEQ ID NO: 3417491 - RNA, 19 nt, Pseudomonas aeruginosa PA01
cugcggcggucccagacca

SEQ ID NO: 3417492 - RNA, 21 nt, Pseudomonas aeruginosa PA01
cugcggcggucccagaccagc

SEQ ID NO: 3417493 - RNA, 14 nt, Pseudomonas aeruginosa PA01
cugcggcguagugg

SEQ ID NO: 3417494 - RNA, 23 nt, Pseudomonas aeruginosa PA01
cugcggcugcagggccagggagg

SEQ ID NO: 3417495 - RNA, 16 nt, Pseudomonas aeruginosa PA01
cugcggcuggcgaacc

SEQ ID NO: 3417496 - RNA, 14 nt, Pseudomonas aeruginosa PA01
cugcggcuugccca

SEQ ID NO: 3417497 - RNA, 21 nt, Pseudomonas aeruginosa PA01
cugcgggaacuuggcgcgcag

SEQ ID NO: 3417498 - RNA, 22 nt, Pseudomonas aeruginosa PA01
cugcgggaugcccgucaggccu

SEQ ID NO: 3417499 - RNA, 15 nt, Pseudomonas aeruginosa PA01
cugcgggcgccgccg

SEQ ID NO: 3417500 - RNA, 17 nt, Pseudomonas aeruginosa PA01
cugcgggcugcgugcca

SEQ ID NO: 3417501 - RNA, 16 nt, Pseudomonas aeruginosa PA01
cugcggggccggacgc

SEQ ID NO: 3417502 - RNA, 22 nt, Pseudomonas aeruginosa PA01
cugcggggccggacgcgacugc

SEQ ID NO: 3417503 - RNA, 18 nt, Pseudomonas aeruginosa PA01
cugcggggccugcugcgg

SEQ ID NO: 3417504 - RNA, 19 nt, Pseudomonas aeruginosa PA01
cugcggggcgcucagggug

SEQ ID NO: 3417505 - RNA, 15 nt, Pseudomonas aeruginosa PA01
cugcgggucauuggc

SEQ ID NO: 3417506 - RNA, 16 nt, Pseudomonas aeruginosa PA01
cugcgggucauuggcg

SEQ ID NO: 3417507 - RNA, 19 nt, Pseudomonas aeruginosa PA01
cugcggguucagucggcca

SEQ ID NO: 3417508 - RNA, 21 nt, Pseudomonas aeruginosa PA01
cugcggguucagucggccagg

SEQ ID NO: 3417509 - RNA, 20 nt, Pseudomonas aeruginosa PA01
cugcggguugccgcagagca

SEQ ID NO: 3417510 - RNA, 14 nt, Pseudomonas aeruginosa PA01
cugcgguaccagcg

SEQ ID NO: 3417511 - RNA, 20 nt, Pseudomonas aeruginosa PA01
cugcgguaccagcgcaccag

SEQ ID NO: 3417512 - RNA, 15 nt, Pseudomonas aeruginosa PA01
cugcgguaggugaug

SEQ ID NO: 3417513 - RNA, 18 nt, Pseudomonas aeruginosa PA01
cugcgguccggcgaaguc

SEQ ID NO: 3417514 - RNA, 17 nt, Pseudomonas aeruginosa PA01
cugcggugucccuucuu

SEQ ID NO: 3417515 - RNA, 19 nt, Pseudomonas aeruginosa PA01
cugcgguugaaauggcaac

SEQ ID NO: 3417516 - RNA, 18 nt, Pseudomonas aeruginosa PA01
cugcgguuuuccugcccc

SEQ ID NO: 3417517 - RNA, 15 nt, Pseudomonas aeruginosa PA01
cugcgucagcgaggc

SEQ ID NO: 3417518 - RNA, 22 nt, Pseudomonas aeruginosa PA01
cugcgucagcgaggcgggcgcg

SEQ ID NO: 3417519 - RNA, 15 nt, Pseudomonas aeruginosa PA01
cugcguccuggucgc

SEQ ID NO: 3417520 - RNA, 13 nt, Pseudomonas aeruginosa PA01
cugcgucgcagag

SEQ ID NO: 3417521 - RNA, 17 nt, Pseudomonas aeruginosa PA01
cugcgucgcagagacgc

SEQ ID NO: 3417522 - RNA, 14 nt, Pseudomonas aeruginosa PA01
cugcgucgucgcgg

SEQ ID NO: 3417523 - RNA, 17 nt, Pseudomonas aeruginosa PA01
cugcgucgucgcggcgc

SEQ ID NO: 3417524 - RNA, 19 nt, Pseudomonas aeruginosa PA01
cugcgucgucgcggcgccu

SEQ ID NO: 3417525 - RNA, 22 nt, Pseudomonas aeruginosa PA01
cugcgucguuggccggcugcuc

SEQ ID NO: 3417526 - RNA, 15 nt, Pseudomonas aeruginosa PA01
cugcgugccagggcu

SEQ ID NO: 3417527 - RNA, 14 nt, Pseudomonas aeruginosa PA01
cugcgugcgccgcu

SEQ ID NO: 3417528 - RNA, 20 nt, Pseudomonas aeruginosa PA01
cugcgugcgccgcucgcgca

SEQ ID NO: 3417529 - RNA, 16 nt, Pseudomonas aeruginosa PA01
cugcgugcgccguagc

SEQ ID NO: 3417530 - RNA, 18 nt, Pseudomonas aeruginosa PA01
cugcgugcgccguagcaa

SEQ ID NO: 3417531 - RNA, 19 nt, Pseudomonas aeruginosa PA01
cugcguggaaccgcggcgc

SEQ ID NO: 3417532 - RNA, 22 nt, Pseudomonas aeruginosa PA01
cugcguggguagccgcccaccg

SEQ ID NO: 3417533 - RNA, 16 nt, Pseudomonas aeruginosa PA01
cugcguuucgccgggc

SEQ ID NO: 3417534 - RNA, 15 nt, Pseudomonas aeruginosa PA01
cugcuaggcuggaag

SEQ ID NO: 3417535 - RNA, 18 nt, Pseudomonas aeruginosa PA01
cugcuaggcuggaagccg

SEQ ID NO: 3417536 - RNA, 22 nt, Pseudomonas aeruginosa PA01
cugcuaggcuggaagccgcgcu

SEQ ID NO: 3417537 - RNA, 13 nt, Pseudomonas aeruginosa PA01
cugcucaccaggu

SEQ ID NO: 3417538 - RNA, 14 nt, Pseudomonas aeruginosa PA01
cugcucacggccga

SEQ ID NO: 3417539 - RNA, 11 nt, Pseudomonas aeruginosa PA01
cugcucagcgc

SEQ ID NO: 3417540 - RNA, 13 nt, Pseudomonas aeruginosa PA01
cugcucagcgcgc

SEQ ID NO: 3417541 - RNA, 14 nt, Pseudomonas aeruginosa PA01
cugcucagcgcgcu

SEQ ID NO: 3417542 - RNA, 17 nt, Pseudomonas aeruginosa PA01
cugcucagcgcgcucgg

SEQ ID NO: 3417543 - RNA, 19 nt, Pseudomonas aeruginosa PA01
cugcucagcgcgcucggcc

SEQ ID NO: 3417544 - RNA, 20 nt, Pseudomonas aeruginosa PA01
cugcucagcgcgcucggccu

SEQ ID NO: 3417545 - RNA, 21 nt, Pseudomonas aeruginosa PA01
cugcucagcgcgcucggccug

SEQ ID NO: 3417546 - RNA, 22 nt, Pseudomonas aeruginosa PA01
cugcucagcgcgcucggccugg

SEQ ID NO: 3417547 - RNA, 20 nt, Pseudomonas aeruginosa PA01
cugcucagcggcccagcgcc

SEQ ID NO: 3417548 - RNA, 21 nt, Pseudomonas aeruginosa PA01
cugcucagcggcccagcgccc

SEQ ID NO: 3417549 - RNA, 13 nt, Pseudomonas aeruginosa PA01
cugcucagggccg

SEQ ID NO: 3417550 - RNA, 18 nt, Pseudomonas aeruginosa PA01
cugcucagggccgcgccg

SEQ ID NO: 3417551 - RNA, 21 nt, Pseudomonas aeruginosa PA01
cugcucagggccgcgccgagc

SEQ ID NO: 3417552 - RNA, 22 nt, Pseudomonas aeruginosa PA01
cugcucauucggccagcgcggc

SEQ ID NO: 3417553 - RNA, 13 nt, Pseudomonas aeruginosa PA01
cugcuccagcagg

SEQ ID NO: 3417554 - RNA, 19 nt, Pseudomonas aeruginosa PA01
cugcuccagcagggccagc

SEQ ID NO: 3417555 - RNA, 20 nt, Pseudomonas aeruginosa PA01
cugcuccaucaguugcgcgc

SEQ ID NO: 3417556 - RNA, 13 nt, Pseudomonas aeruginosa PA01
cugcucccuggcg

SEQ ID NO: 3417557 - RNA, 15 nt, Pseudomonas aeruginosa PA01
cugcucccuggcgga

SEQ ID NO: 3417558 - RNA, 17 nt, Pseudomonas aeruginosa PA01
cugcuccggacugccga

SEQ ID NO: 3417559 - RNA, 16 nt, Pseudomonas aeruginosa PA01
cugcuccggaucgcgc

SEQ ID NO: 3417560 - RNA, 14 nt, Pseudomonas aeruginosa PA01
cugcuccgggcggc

SEQ ID NO: 3417561 - RNA, 13 nt, Pseudomonas aeruginosa PA01
cugcuccuccccg

SEQ ID NO: 3417562 - RNA, 19 nt, Pseudomonas aeruginosa PA01
cugcuccuccccguccugg

SEQ ID NO: 3417563 - RNA, 15 nt, Pseudomonas aeruginosa PA01
cugcuccuccgacgc

SEQ ID NO: 3417564 - RNA, 21 nt, Pseudomonas aeruginosa PA01
cugcuccucggcagcgcuggc

SEQ ID NO: 3417565 - RNA, 16 nt, Pseudomonas aeruginosa PA01
cugcuccugcaggccc

SEQ ID NO: 3417566 - RNA, 21 nt, Pseudomonas aeruginosa PA01
cugcuccugcaggcccugcca

SEQ ID NO: 3417567 - RNA, 21 nt, Pseudomonas aeruginosa PA01
cugcuccuuucggaacagcgc

SEQ ID NO: 3417568 - RNA, 16 nt, Pseudomonas aeruginosa PA01
cugcucgaacggcgga

SEQ ID NO: 3417569 - RNA, 20 nt, Pseudomonas aeruginosa PA01
cugcucgaacugcuccuggg

SEQ ID NO: 3417570 - RNA, 20 nt, Pseudomonas aeruginosa PA01
cugcucgaccaccucggcgu

SEQ ID NO: 3417571 - RNA, 16 nt, Pseudomonas aeruginosa PA01
cugcucgaccgccugc

SEQ ID NO: 3417572 - RNA, 23 nt, Pseudomonas aeruginosa PA01
cugcucgaccgccugcucgcggc

SEQ ID NO: 3417573 - RNA, 19 nt, Pseudomonas aeruginosa PA01
cugcucgagauugucgcga

SEQ ID NO: 3417574 - RNA, 14 nt, Pseudomonas aeruginosa PA01
cugcucgaggaugg

SEQ ID NO: 3417575 - RNA, 18 nt, Pseudomonas aeruginosa PA01
cugcucgaucaaccccug

SEQ ID NO: 3417576 - RNA, 18 nt, Pseudomonas aeruginosa PA01
cugcucgauccagccggc

SEQ ID NO: 3417577 - RNA, 19 nt, Pseudomonas aeruginosa PA01
cugcucgauccagccggca

SEQ ID NO: 3417578 - RNA, 21 nt, Pseudomonas aeruginosa PA01
cugcucgauccagccggcauc

SEQ ID NO: 3417579 - RNA, 22 nt, Pseudomonas aeruginosa PA01
cugcucgauccagccggcaucc

SEQ ID NO: 3417580 - RNA, 19 nt, Pseudomonas aeruginosa PA01
cugcucgauggcggccugg

SEQ ID NO: 3417581 - RNA, 20 nt, Pseudomonas aeruginosa PA01
cugcucgauggcggccuggu

SEQ ID NO: 3417582 - RNA, 15 nt, Pseudomonas aeruginosa PA01
cugcucgcagccggu

SEQ ID NO: 3417583 - RNA, 19 nt, Pseudomonas aeruginosa PA01
cugcucgccaugggcgcgu

SEQ ID NO: 3417584 - RNA, 14 nt, Pseudomonas aeruginosa PA01
cugcucgccgccgg

SEQ ID NO: 3417585 - RNA, 15 nt, Pseudomonas aeruginosa PA01
cugcucgccgccggc

SEQ ID NO: 3417586 - RNA, 17 nt, Pseudomonas aeruginosa PA01
cugcucgccgccggcga

SEQ ID NO: 3417587 - RNA, 17 nt, Pseudomonas aeruginosa PA01
cugcucgccgcugaagu

SEQ ID NO: 3417588 - RNA, 15 nt, Pseudomonas aeruginosa PA01
cugcucgccggcgcg

SEQ ID NO: 3417589 - RNA, 15 nt, Pseudomonas aeruginosa PA01
cugcucgccucgggc

SEQ ID NO: 3417590 - RNA, 17 nt, Pseudomonas aeruginosa PA01
cugcucgccucgggcca

SEQ ID NO: 3417591 - RNA, 11 nt, Pseudomonas aeruginosa PA01
cugcucgcgca

SEQ ID NO: 3417592 - RNA, 20 nt, Pseudomonas aeruginosa PA01
cugcucgcgcaccgcggcca

SEQ ID NO: 3417593 - RNA, 15 nt, Pseudomonas aeruginosa PA01
cugcucgcgcagcca

SEQ ID NO: 3417594 - RNA, 16 nt, Pseudomonas aeruginosa PA01
cugcucgcgcagccag

SEQ ID NO: 3417595 - RNA, 14 nt, Pseudomonas aeruginosa PA01
cugcucgcgcuucu

SEQ ID NO: 3417596 - RNA, 15 nt, Pseudomonas aeruginosa PA01
cugcucgcggcuggc

SEQ ID NO: 3417597 - RNA, 17 nt, Pseudomonas aeruginosa PA01
cugcucgcggcuggccg

SEQ ID NO: 3417598 - RNA, 19 nt, Pseudomonas aeruginosa PA01
cugcucgcggcuggccgcc

SEQ ID NO: 3417599 - RNA, 20 nt, Pseudomonas aeruginosa PA01
cugcucgcggcuggccgccu

SEQ ID NO: 3417600 - RNA, 11 nt, Pseudomonas aeruginosa PA01
cugcucgcggg

SEQ ID NO: 3417601 - RNA, 17 nt, Pseudomonas aeruginosa PA01
cugcucgcgggucacca

SEQ ID NO: 3417602 - RNA, 19 nt, Pseudomonas aeruginosa PA01
cugcucgcugcccgacggc

SEQ ID NO: 3417603 - RNA, 22 nt, Pseudomonas aeruginosa PA01
cugcucggaaaccucgccgguc

SEQ ID NO: 3417604 - RNA, 23 nt, Pseudomonas aeruginosa PA01
cugcucggcauucgacccgccga

SEQ ID NO: 3417605 - RNA, 16 nt, Pseudomonas aeruginosa PA01
cugcucggccagcgcc

SEQ ID NO: 3417606 - RNA, 18 nt, Pseudomonas aeruginosa PA01
cugcucggccagcgccac

SEQ ID NO: 3417607 - RNA, 21 nt, Pseudomonas aeruginosa PA01
cugcucggccuuguccgcgcg

SEQ ID NO: 3417608 - RNA, 14 nt, Pseudomonas aeruginosa PA01
cugcucggcgcccu

SEQ ID NO: 3417609 - RNA, 16 nt, Pseudomonas aeruginosa PA01
cugcucggcgcccugg

SEQ ID NO: 3417610 - RNA, 14 nt, Pseudomonas aeruginosa PA01
cugcucgggcgucu

SEQ ID NO: 3417611 - RNA, 20 nt, Pseudomonas aeruginosa PA01
cugcucgggcgucuccugcc

SEQ ID NO: 3417612 - RNA, 17 nt, Pseudomonas aeruginosa PA01
cugcucguccaggccgc

SEQ ID NO: 3417613 - RNA, 19 nt, Pseudomonas aeruginosa PA01
cugcucguccaggccgcag

SEQ ID NO: 3417614 - RNA, 13 nt, Pseudomonas aeruginosa PA01
cugcucgucgaug

SEQ ID NO: 3417615 - RNA, 14 nt, Pseudomonas aeruginosa PA01
cugcucgucgaugc

SEQ ID NO: 3417616 - RNA, 18 nt, Pseudomonas aeruginosa PA01
cugcucgucgaugcugcc

SEQ ID NO: 3417617 - RNA, 17 nt, Pseudomonas aeruginosa PA01
cugcucuucggcggcca

SEQ ID NO: 3417618 - RNA, 20 nt, Pseudomonas aeruginosa PA01
cugcucuucggcggccagcg

SEQ ID NO: 3417619 - RNA, 20 nt, Pseudomonas aeruginosa PA01
cugcucuuucuugucgguca

SEQ ID NO: 3417620 - RNA, 17 nt, Pseudomonas aeruginosa PA01
cugcugaauucccgcuc

SEQ ID NO: 3417621 - RNA, 22 nt, Pseudomonas aeruginosa PA01
cugcugaauucccgcuccaggc

SEQ ID NO: 3417622 - RNA, 23 nt, Pseudomonas aeruginosa PA01
cugcugaauucccgcuccaggcc

SEQ ID NO: 3417623 - RNA, 17 nt, Pseudomonas aeruginosa PA01
cugcugagcagucgccu

SEQ ID NO: 3417624 - RNA, 19 nt, Pseudomonas aeruginosa PA01
cugcugagcagucgccugg

SEQ ID NO: 3417625 - RNA, 20 nt, Pseudomonas aeruginosa PA01
cugcugagcagucgccuggc

SEQ ID NO: 3417626 - RNA, 22 nt, Pseudomonas aeruginosa PA01
cugcugcaacauggcgucggcg

SEQ ID NO: 3417627 - RNA, 20 nt, Pseudomonas aeruginosa PA01
cugcugcagcaucaggcgcu

SEQ ID NO: 3417628 - RNA, 13 nt, Pseudomonas aeruginosa PA01
cugcugcagggcc

SEQ ID NO: 3417629 - RNA, 13 nt, Pseudomonas aeruginosa PA01
cugcugcccggca

SEQ ID NO: 3417630 - RNA, 14 nt, Pseudomonas aeruginosa PA01
cugcugcccggcau

SEQ ID NO: 3417631 - RNA, 21 nt, Pseudomonas aeruginosa PA01
cugcugccgcguuccuugugc

SEQ ID NO: 3417632 - RNA, 12 nt, Pseudomonas aeruginosa PA01
cugcugccggcc

SEQ ID NO: 3417633 - RNA, 13 nt, Pseudomonas aeruginosa PA01
cugcugcgccggc

SEQ ID NO: 3417634 - RNA, 13 nt, Pseudomonas aeruginosa PA01
cugcugcgccugg

SEQ ID NO: 3417635 - RNA, 14 nt, Pseudomonas aeruginosa PA01
cugcugcgccuggc

SEQ ID NO: 3417636 - RNA, 15 nt, Pseudomonas aeruginosa PA01
cugcugcgccuggcc

SEQ ID NO: 3417637 - RNA, 18 nt, Pseudomonas aeruginosa PA01
cugcugcgccuggccgcg

SEQ ID NO: 3417638 - RNA, 21 nt, Pseudomonas aeruginosa PA01
cugcugcgccuggccgcgcag

SEQ ID NO: 3417639 - RNA, 23 nt, Pseudomonas aeruginosa PA01
cugcugcgccuggccgcgcagga

SEQ ID NO: 3417640 - RNA, 13 nt, Pseudomonas aeruginosa PA01
cugcugcgcgcac

SEQ ID NO: 3417641 - RNA, 15 nt, Pseudomonas aeruginosa PA01
cugcugcggcgguug

SEQ ID NO: 3417642 - RNA, 18 nt, Pseudomonas aeruginosa PA01
cugcugcggcuucgcgug

SEQ ID NO: 3417643 - RNA, 20 nt, Pseudomonas aeruginosa PA01
cugcugcgggcgcugcaugg

SEQ ID NO: 3417644 - RNA, 21 nt, Pseudomonas aeruginosa PA01
cugcugcggggccggacgcga

SEQ ID NO: 3417645 - RNA, 14 nt, Pseudomonas aeruginosa PA01
cugcugcucgccau

SEQ ID NO: 3417646 - RNA, 16 nt, Pseudomonas aeruginosa PA01
cugcugcugcggcuuc

SEQ ID NO: 3417647 - RNA, 14 nt, Pseudomonas aeruginosa PA01
cugcugcugcucag

SEQ ID NO: 3417648 - RNA, 15 nt, Pseudomonas aeruginosa PA01
cugcugcugcucagc

SEQ ID NO: 3417649 - RNA, 15 nt, Pseudomonas aeruginosa PA01
cugcuggacggcgga

SEQ ID NO: 3417650 - RNA, 18 nt, Pseudomonas aeruginosa PA01
cugcuggacggcggacug

SEQ ID NO: 3417651 - RNA, 22 nt, Pseudomonas aeruginosa PA01
cugcuggauccucgccucgcgc

SEQ ID NO: 3417652 - RNA, 16 nt, Pseudomonas aeruginosa PA01
cugcuggcaucgguga

SEQ ID NO: 3417653 - RNA, 12 nt, Pseudomonas aeruginosa PA01
cugcuggccacc

SEQ ID NO: 3417654 - RNA, 14 nt, Pseudomonas aeruginosa PA01
cugcuggccacccu

SEQ ID NO: 3417655 - RNA, 16 nt, Pseudomonas aeruginosa PA01
cugcuggccaccgcgg

SEQ ID NO: 3417656 - RNA, 17 nt, Pseudomonas aeruginosa PA01
cugcuggccaccgcggc

SEQ ID NO: 3417657 - RNA, 19 nt, Pseudomonas aeruginosa PA01
cugcuggccaccgcggcgu

SEQ ID NO: 3417658 - RNA, 20 nt, Pseudomonas aeruginosa PA01
cugcuggccaccgcggcguc

SEQ ID NO: 3417659 - RNA, 11 nt, Pseudomonas aeruginosa PA01
cugcuggccgc

SEQ ID NO: 3417660 - RNA, 12 nt, Pseudomonas aeruginosa PA01
cugcuggccgcg

SEQ ID NO: 3417661 - RNA, 14 nt, Pseudomonas aeruginosa PA01
cugcuggccgcgca

SEQ ID NO: 3417662 - RNA, 17 nt, Pseudomonas aeruginosa PA01
cugcuggccggugccgc

SEQ ID NO: 3417663 - RNA, 21 nt, Pseudomonas aeruginosa PA01
cugcuggccugggacggcgug

SEQ ID NO: 3417664 - RNA, 16 nt, Pseudomonas aeruginosa PA01
cugcuggcgaagcugg

SEQ ID NO: 3417665 - RNA, 18 nt, Pseudomonas aeruginosa PA01
cugcuggcgaagcugggg

SEQ ID NO: 3417666 - RNA, 21 nt, Pseudomonas aeruginosa PA01
cugcuggcgaagcuggggcug

SEQ ID NO: 3417667 - RNA, 18 nt, Pseudomonas aeruginosa PA01
cugcuggcgagcgucgag

SEQ ID NO: 3417668 - RNA, 15 nt, Pseudomonas aeruginosa PA01
cugcuggcgcagcca

SEQ ID NO: 3417669 - RNA, 19 nt, Pseudomonas aeruginosa PA01
cugcuggcgccgcuggcgu

SEQ ID NO: 3417670 - RNA, 12 nt, Pseudomonas aeruginosa PA01
cugcuggcugcc

SEQ ID NO: 3417671 - RNA, 14 nt, Pseudomonas aeruginosa PA01
cugcuggcuggcag

SEQ ID NO: 3417672 - RNA, 20 nt, Pseudomonas aeruginosa PA01
cugcuggcuggcagguugau

SEQ ID NO: 3417673 - RNA, 13 nt, Pseudomonas aeruginosa PA01
cugcuggcuguag

SEQ ID NO: 3417674 - RNA, 18 nt, Pseudomonas aeruginosa PA01
cugcugggccagcgccgu

SEQ ID NO: 3417675 - RNA, 15 nt, Pseudomonas aeruginosa PA01
cugcugggcggcgag

SEQ ID NO: 3417676 - RNA, 16 nt, Pseudomonas aeruginosa PA01
cugcugggcgucgaac

SEQ ID NO: 3417677 - RNA, 21 nt, Pseudomonas aeruginosa PA01
cugcuggggaacugggcgagc

SEQ ID NO: 3417678 - RNA, 14 nt, Pseudomonas aeruginosa PA01
cugcugggucaucg

SEQ ID NO: 3417679 - RNA, 15 nt, Pseudomonas aeruginosa PA01
cugcugggucaucga

SEQ ID NO: 3417680 - RNA, 15 nt, Pseudomonas aeruginosa PA01
cugcugggugaugca

SEQ ID NO: 3417681 - RNA, 15 nt, Pseudomonas aeruginosa PA01
cugcugguagcugcu

SEQ ID NO: 3417682 - RNA, 20 nt, Pseudomonas aeruginosa PA01
cugcugguagcugcugccgg

SEQ ID NO: 3417683 - RNA, 23 nt, Pseudomonas aeruginosa PA01
cugcugguagcugcugccggcuu

SEQ ID NO: 3417684 - RNA, 20 nt, Pseudomonas aeruginosa PA01
cugcugguagugcuggcgca

SEQ ID NO: 3417685 - RNA, 17 nt, Pseudomonas aeruginosa PA01
cugcugguugaccaggc

SEQ ID NO: 3417686 - RNA, 18 nt, Pseudomonas aeruginosa PA01
cugcugguugaccaggcc

SEQ ID NO: 3417687 - RNA, 20 nt, Pseudomonas aeruginosa PA01
cugcugucguuccggcucag

SEQ ID NO: 3417688 - RNA, 21 nt, Pseudomonas aeruginosa PA01
cugcugugcgucgagggccuu

SEQ ID NO: 3417689 - RNA, 16 nt, Pseudomonas aeruginosa PA01
cugcuuaccuugccgg

SEQ ID NO: 3417690 - RNA, 12 nt, Pseudomonas aeruginosa PA01
cugcuucaggcg

SEQ ID NO: 3417691 - RNA, 15 nt, Pseudomonas aeruginosa PA01
cugcuucaggcgcgc

SEQ ID NO: 3417692 - RNA, 17 nt, Pseudomonas aeruginosa PA01
cugcuucaggcgcgcgg

SEQ ID NO: 3417693 - RNA, 16 nt, Pseudomonas aeruginosa PA01
cugcuuccagaccucg

SEQ ID NO: 3417694 - RNA, 18 nt, Pseudomonas aeruginosa PA01
cugcuuccagaccucgag

SEQ ID NO: 3417695 - RNA, 19 nt, Pseudomonas aeruginosa PA01
cugcuucgaacgugcgcgc

SEQ ID NO: 3417696 - RNA, 19 nt, Pseudomonas aeruginosa PA01
cugcuucgaccagggcauc

SEQ ID NO: 3417697 - RNA, 14 nt, Pseudomonas aeruginosa PA01
cugcuucggcagcc

SEQ ID NO: 3417698 - RNA, 15 nt, Pseudomonas aeruginosa PA01
cugcuucggcagccu

SEQ ID NO: 3417699 - RNA, 20 nt, Pseudomonas aeruginosa PA01
cugcuucugguugcucacca

SEQ ID NO: 3417700 - RNA, 17 nt, Pseudomonas aeruginosa PA01
cugcuucugucccuggg

SEQ ID NO: 3417701 - RNA, 22 nt, Pseudomonas aeruginosa PA01
cugcuucugucccugggccaug

SEQ ID NO: 3417702 - RNA, 18 nt, Pseudomonas aeruginosa PA01
cugcuugaaauggcggac

SEQ ID NO: 3417703 - RNA, 13 nt, Pseudomonas aeruginosa PA01
cugcuugaacacc

SEQ ID NO: 3417704 - RNA, 14 nt, Pseudomonas aeruginosa PA01
cugcuugaccacca

SEQ ID NO: 3417705 - RNA, 13 nt, Pseudomonas aeruginosa PA01
cugcuugaccuug

SEQ ID NO: 3417706 - RNA, 19 nt, Pseudomonas aeruginosa PA01
cugcuugaccuugcucuuc

SEQ ID NO: 3417707 - RNA, 13 nt, Pseudomonas aeruginosa PA01
cugcuugcgcacc

SEQ ID NO: 3417708 - RNA, 16 nt, Pseudomonas aeruginosa PA01
cugcuugcgccguggc

SEQ ID NO: 3417709 - RNA, 17 nt, Pseudomonas aeruginosa PA01
cugcuugcgccguggca

SEQ ID NO: 3417710 - RNA, 12 nt, Pseudomonas aeruginosa PA01
cugcuugcgcgc

SEQ ID NO: 3417711 - RNA, 15 nt, Pseudomonas aeruginosa PA01
cugcuugcgcgccgc

SEQ ID NO: 3417712 - RNA, 16 nt, Pseudomonas aeruginosa PA01
cugcuugcgcgccgcc

SEQ ID NO: 3417713 - RNA, 18 nt, Pseudomonas aeruginosa PA01
cugcuugcgcgccgccgc

SEQ ID NO: 3417714 - RNA, 14 nt, Pseudomonas aeruginosa PA01
cugcuugcgcgcgg

SEQ ID NO: 3417715 - RNA, 16 nt, Pseudomonas aeruginosa PA01
cugcuugcgcgcggcg

SEQ ID NO: 3417716 - RNA, 12 nt, Pseudomonas aeruginosa PA01
cugcuugcgcug

SEQ ID NO: 3417717 - RNA, 20 nt, Pseudomonas aeruginosa PA01
cugcuugcgcuggccggcaa

SEQ ID NO: 3417718 - RNA, 12 nt, Pseudomonas aeruginosa PA01
cugcuuggccag

SEQ ID NO: 3417719 - RNA, 14 nt, Pseudomonas aeruginosa PA01
cugcuuggccagcg

SEQ ID NO: 3417720 - RNA, 18 nt, Pseudomonas aeruginosa PA01
cugcuuggccagcgcggu

SEQ ID NO: 3417721 - RNA, 21 nt, Pseudomonas aeruginosa PA01
cugcuuggccagcgcggugcg

SEQ ID NO: 3417722 - RNA, 14 nt, Pseudomonas aeruginosa PA01
cugcuuggccaggc

SEQ ID NO: 3417723 - RNA, 16 nt, Pseudomonas aeruginosa PA01
cugcuuggccaggcgc

SEQ ID NO: 3417724 - RNA, 17 nt, Pseudomonas aeruginosa PA01
cugcuuggccaggcgcu

SEQ ID NO: 3417725 - RNA, 18 nt, Pseudomonas aeruginosa PA01
cugcuuggccaggcgcuu

SEQ ID NO: 3417726 - RNA, 19 nt, Pseudomonas aeruginosa PA01
cugcuuggccaggcgcuug

SEQ ID NO: 3417727 - RNA, 15 nt, Pseudomonas aeruginosa PA01
cugcuuggcggcggu

SEQ ID NO: 3417728 - RNA, 16 nt, Pseudomonas aeruginosa PA01
cugcuuggcggcggug

SEQ ID NO: 3417729 - RNA, 20 nt, Pseudomonas aeruginosa PA01
cugcuugggcgccucgccgc

SEQ ID NO: 3417730 - RNA, 16 nt, Pseudomonas aeruginosa PA01
cugcuuguccuuccag

SEQ ID NO: 3417731 - RNA, 15 nt, Pseudomonas aeruginosa PA01
cugcuuuccggccca

SEQ ID NO: 3417732 - RNA, 17 nt, Pseudomonas aeruginosa PA01
cugcuuugggagcagga

SEQ ID NO: 3417733 - RNA, 18 nt, Pseudomonas aeruginosa PA01
cuggaaagaccggcgccc

SEQ ID NO: 3417734 - RNA, 18 nt, Pseudomonas aeruginosa PA01
cuggaaaucggcguccug

SEQ ID NO: 3417735 - RNA, 22 nt, Pseudomonas aeruginosa PA01
cuggaaaucggcguccuggucg

SEQ ID NO: 3417736 - RNA, 22 nt, Pseudomonas aeruginosa PA01
cuggaaauggcggucgccgacc

SEQ ID NO: 3417737 - RNA, 15 nt, Pseudomonas aeruginosa PA01
cuggaaauucagcgc

SEQ ID NO: 3417738 - RNA, 17 nt, Pseudomonas aeruginosa PA01
cuggaaauucagcgcuu

SEQ ID NO: 3417739 - RNA, 14 nt, Pseudomonas aeruginosa PA01
cuggaacaccaggc

SEQ ID NO: 3417740 - RNA, 16 nt, Pseudomonas aeruginosa PA01
cuggaacaccaggccg

SEQ ID NO: 3417741 - RNA, 18 nt, Pseudomonas aeruginosa PA01
cuggaacaccaggccgca

SEQ ID NO: 3417742 - RNA, 19 nt, Pseudomonas aeruginosa PA01
cuggaacaccaggccgcaa

SEQ ID NO: 3417743 - RNA, 23 nt, Pseudomonas aeruginosa PA01
cuggaacaccaggccgcaagcgg

SEQ ID NO: 3417744 - RNA, 16 nt, Pseudomonas aeruginosa PA01
cuggaaccggccggca

SEQ ID NO: 3417745 - RNA, 18 nt, Pseudomonas aeruginosa PA01
cuggaaccggccggcagg

SEQ ID NO: 3417746 - RNA, 18 nt, Pseudomonas aeruginosa PA01
cuggaacggccaggucuu

SEQ ID NO: 3417747 - RNA, 14 nt, Pseudomonas aeruginosa PA01
cuggaacuagcccu

SEQ ID NO: 3417748 - RNA, 22 nt, Pseudomonas aeruginosa PA01
cuggaacuagcccucgaccugg

SEQ ID NO: 3417749 - RNA, 14 nt, Pseudomonas aeruginosa PA01
cuggaacuggucgg

SEQ ID NO: 3417750 - RNA, 19 nt, Pseudomonas aeruginosa PA01
cuggaagaaggcgaucauc

SEQ ID NO: 3417751 - RNA, 14 nt, Pseudomonas aeruginosa PA01
cuggaagccgcgcu

SEQ ID NO: 3417752 - RNA, 20 nt, Pseudomonas aeruginosa PA01
cuggaagcggguucccugcg

SEQ ID NO: 3417753 - RNA, 23 nt, Pseudomonas aeruginosa PA01
cuggaagcggguucccugcgccu

SEQ ID NO: 3417754 - RNA, 19 nt, Pseudomonas aeruginosa PA01
cuggaaggccgcgccgaga

SEQ ID NO: 3417755 - RNA, 15 nt, Pseudomonas aeruginosa PA01
cuggaaggcgcuggg

SEQ ID NO: 3417756 - RNA, 17 nt, Pseudomonas aeruginosa PA01
cuggaaggcgcugggcg

SEQ ID NO: 3417757 - RNA, 23 nt, Pseudomonas aeruginosa PA01
cuggaaguauucggcgggaacgc

SEQ ID NO: 3417758 - RNA, 12 nt, Pseudomonas aeruginosa PA01
cuggaagucgcc

SEQ ID NO: 3417759 - RNA, 20 nt, Pseudomonas aeruginosa PA01
cuggaagucgcccugcccgg

SEQ ID NO: 3417760 - RNA, 16 nt, Pseudomonas aeruginosa PA01
cuggaagucguccagc

SEQ ID NO: 3417761 - RNA, 24 nt, Pseudomonas aeruginosa PA01
cuggaagucguccagcagguucgg

SEQ ID NO: 3417762 - RNA, 21 nt, Pseudomonas aeruginosa PA01
cuggaaguuguacagcgaggc

SEQ ID NO: 3417763 - RNA, 17 nt, Pseudomonas aeruginosa PA01
cuggaauaccccgcgga

SEQ ID NO: 3417764 - RNA, 18 nt, Pseudomonas aeruginosa PA01
cuggaauaccccgcggac

SEQ ID NO: 3417765 - RNA, 17 nt, Pseudomonas aeruginosa PA01
cuggaaugccggccggg

SEQ ID NO: 3417766 - RNA, 23 nt, Pseudomonas aeruginosa PA01
cuggaaugccggccggggccggc

SEQ ID NO: 3417767 - RNA, 22 nt, Pseudomonas aeruginosa PA01
cuggaauucaggcuuccucgaa

SEQ ID NO: 3417768 - RNA, 16 nt, Pseudomonas aeruginosa PA01
cuggaauucgccgcgc

SEQ ID NO: 3417769 - RNA, 19 nt, Pseudomonas aeruginosa PA01
cuggaauucgccgcgcgcc

SEQ ID NO: 3417770 - RNA, 21 nt, Pseudomonas aeruginosa PA01
cuggaauucgccgcgcgccau

SEQ ID NO: 3417771 - RNA, 20 nt, Pseudomonas aeruginosa PA01
cuggacaagguuugcgccgc

SEQ ID NO: 3417772 - RNA, 22 nt, Pseudomonas aeruginosa PA01
cuggacaagguuugcgccgccg

SEQ ID NO: 3417773 - RNA, 15 nt, Pseudomonas aeruginosa PA01
cuggacaccgaugcc

SEQ ID NO: 3417774 - RNA, 19 nt, Pseudomonas aeruginosa PA01
cuggacaccgaugccgaag

SEQ ID NO: 3417775 - RNA, 14 nt, Pseudomonas aeruginosa PA01
cuggacacggucca

SEQ ID NO: 3417776 - RNA, 16 nt, Pseudomonas aeruginosa PA01
cuggacaggcgcaggg

SEQ ID NO: 3417777 - RNA, 21 nt, Pseudomonas aeruginosa PA01
cuggaccaccguggcgccggc

SEQ ID NO: 3417778 - RNA, 18 nt, Pseudomonas aeruginosa PA01
cuggaccaggcggccggu

SEQ ID NO: 3417779 - RNA, 13 nt, Pseudomonas aeruginosa PA01
cuggaccaggucg

SEQ ID NO: 3417780 - RNA, 17 nt, Pseudomonas aeruginosa PA01
cuggaccaguucagcgc

SEQ ID NO: 3417781 - RNA, 18 nt, Pseudomonas aeruginosa PA01
cuggaccaguucagcgcg

SEQ ID NO: 3417782 - RNA, 19 nt, Pseudomonas aeruginosa PA01
cuggaccaguucagcgcgc

SEQ ID NO: 3417783 - RNA, 17 nt, Pseudomonas aeruginosa PA01
cuggaccauggccggcg

SEQ ID NO: 3417784 - RNA, 13 nt, Pseudomonas aeruginosa PA01
cuggaccccgccc

SEQ ID NO: 3417785 - RNA, 19 nt, Pseudomonas aeruginosa PA01
cuggacccgcaccuggacc

SEQ ID NO: 3417786 - RNA, 20 nt, Pseudomonas aeruginosa PA01
cuggacccgcaccuggaccg

SEQ ID NO: 3417787 - RNA, 22 nt, Pseudomonas aeruginosa PA01
cuggacccgcaccuggaccggg

SEQ ID NO: 3417788 - RNA, 23 nt, Pseudomonas aeruginosa PA01
cuggacccguugccgaccgagca

SEQ ID NO: 3417789 - RNA, 20 nt, Pseudomonas aeruginosa PA01
cuggaccuccgccaggaccu

SEQ ID NO: 3417790 - RNA, 21 nt, Pseudomonas aeruginosa PA01
cuggaccuccuggcgcgucgg

SEQ ID NO: 3417791 - RNA, 22 nt, Pseudomonas aeruginosa PA01
cuggaccucggguuuggcgccc

SEQ ID NO: 3417792 - RNA, 13 nt, Pseudomonas aeruginosa PA01
cuggaccuggccg

SEQ ID NO: 3417793 - RNA, 19 nt, Pseudomonas aeruginosa PA01
cuggacgaacgagaagccg

SEQ ID NO: 3417794 - RNA, 20 nt, Pseudomonas aeruginosa PA01
cuggacgaaugcccgugcgc

SEQ ID NO: 3417795 - RNA, 18 nt, Pseudomonas aeruginosa PA01
cuggacgacgcuggccug

SEQ ID NO: 3417796 - RNA, 17 nt, Pseudomonas aeruginosa PA01
cuggacgcgcuuguccu

SEQ ID NO: 3417797 - RNA, 22 nt, Pseudomonas aeruginosa PA01
cuggacgugcaggaucaccugc

SEQ ID NO: 3417798 - RNA, 18 nt, Pseudomonas aeruginosa PA01
cuggacgugggaaaucac

SEQ ID NO: 3417799 - RNA, 14 nt, Pseudomonas aeruginosa PA01
cuggacucgcgcca

SEQ ID NO: 3417800 - RNA, 18 nt, Pseudomonas aeruginosa PA01
cuggagaaacucgcgggc

SEQ ID NO: 3417801 - RNA, 21 nt, Pseudomonas aeruginosa PA01
cuggagaaacucgcgggcgcg

SEQ ID NO: 3417802 - RNA, 23 nt, Pseudomonas aeruginosa PA01
cuggagaaacucgcgggcgcgca

SEQ ID NO: 3417803 - RNA, 16 nt, Pseudomonas aeruginosa PA01
cuggagaaauccggcu

SEQ ID NO: 3417804 - RNA, 22 nt, Pseudomonas aeruginosa PA01
cuggagaaauccggcuggcgcc

SEQ ID NO: 3417805 - RNA, 18 nt, Pseudomonas aeruginosa PA01
cuggagcagaaccgccag

SEQ ID NO: 3417806 - RNA, 15 nt, Pseudomonas aeruginosa PA01
cuggagcagcagcgc

SEQ ID NO: 3417807 - RNA, 17 nt, Pseudomonas aeruginosa PA01
cuggagcagcagcgccg

SEQ ID NO: 3417808 - RNA, 19 nt, Pseudomonas aeruginosa PA01
cuggagcagcagcgccgcg

SEQ ID NO: 3417809 - RNA, 13 nt, Pseudomonas aeruginosa PA01
cuggagcagggcg

SEQ ID NO: 3417810 - RNA, 15 nt, Pseudomonas aeruginosa PA01
cuggagcagggcgau

SEQ ID NO: 3417811 - RNA, 16 nt, Pseudomonas aeruginosa PA01
cuggagcugcgcgcga

SEQ ID NO: 3417812 - RNA, 17 nt, Pseudomonas aeruginosa PA01
cuggagcugcgcgcgau

SEQ ID NO: 3417813 - RNA, 17 nt, Pseudomonas aeruginosa PA01
cuggagcuugccggcga

SEQ ID NO: 3417814 - RNA, 17 nt, Pseudomonas aeruginosa PA01
cuggagguucggcaggu

SEQ ID NO: 3417815 - RNA, 15 nt, Pseudomonas aeruginosa PA01
cuggaguaucgcccu

SEQ ID NO: 3417816 - RNA, 16 nt, Pseudomonas aeruginosa PA01
cuggaguugugccagc

SEQ ID NO: 3417817 - RNA, 20 nt, Pseudomonas aeruginosa PA01
cuggauacgcuuggccaggu

SEQ ID NO: 3417818 - RNA, 15 nt, Pseudomonas aeruginosa PA01
cuggauacgggcgcc

SEQ ID NO: 3417819 - RNA, 19 nt, Pseudomonas aeruginosa PA01
cuggauacgggcgccaggg

SEQ ID NO: 3417820 - RNA, 15 nt, Pseudomonas aeruginosa PA01
cuggauaucugggcc

SEQ ID NO: 3417821 - RNA, 19 nt, Pseudomonas aeruginosa PA01
cuggauaucugggccaucg

SEQ ID NO: 3417822 - RNA, 23 nt, Pseudomonas aeruginosa PA01
cuggaucaccgcggcgcugaagg

SEQ ID NO: 3417823 - RNA, 23 nt, Pseudomonas aeruginosa PA01
cuggaucaggaagguccaggccc

SEQ ID NO: 3417824 - RNA, 19 nt, Pseudomonas aeruginosa PA01
cuggauccgugccaggcgc

SEQ ID NO: 3417825 - RNA, 22 nt, Pseudomonas aeruginosa PA01
cuggauccgugccaggcgcucg

SEQ ID NO: 3417826 - RNA, 18 nt, Pseudomonas aeruginosa PA01
cuggaucgaucucgucgg

SEQ ID NO: 3417827 - RNA, 21 nt, Pseudomonas aeruginosa PA01
cuggaucgaucucgucggcgg

SEQ ID NO: 3417828 - RNA, 17 nt, Pseudomonas aeruginosa PA01
cuggaucgccuugcgcg

SEQ ID NO: 3417829 - RNA, 17 nt, Pseudomonas aeruginosa PA01
cuggaucggccccaccu

SEQ ID NO: 3417830 - RNA, 18 nt, Pseudomonas aeruginosa PA01
cuggaucggccccaccug

SEQ ID NO: 3417831 - RNA, 23 nt, Pseudomonas aeruginosa PA01
cuggaucucggcggccaggcggc

SEQ ID NO: 3417832 - RNA, 18 nt, Pseudomonas aeruginosa PA01
cuggaucugcgggaacuu

SEQ ID NO: 3417833 - RNA, 24 nt, Pseudomonas aeruginosa PA01
cuggaucugguggaacagcaucag

SEQ ID NO: 3417834 - RNA, 18 nt, Pseudomonas aeruginosa PA01
cuggaugaaacgggcgau

SEQ ID NO: 3417835 - RNA, 20 nt, Pseudomonas aeruginosa PA01
cuggaugaacgacuccagcu

SEQ ID NO: 3417836 - RNA, 17 nt, Pseudomonas aeruginosa PA01
cuggaugcagccggggc

SEQ ID NO: 3417837 - RNA, 22 nt, Pseudomonas aeruginosa PA01
cuggaugcagccggggcucagg

SEQ ID NO: 3417838 - RNA, 17 nt, Pseudomonas aeruginosa PA01
cuggauggucacgccga

SEQ ID NO: 3417839 - RNA, 18 nt, Pseudomonas aeruginosa PA01
cuggauggucacgccgag

SEQ ID NO: 3417840 - RNA, 19 nt, Pseudomonas aeruginosa PA01
cuggaugucgcuggccagc

SEQ ID NO: 3417841 - RNA, 14 nt, Pseudomonas aeruginosa PA01
cuggaugucggcga

SEQ ID NO: 3417842 - RNA, 17 nt, Pseudomonas aeruginosa PA01
cuggauucggccugccg

SEQ ID NO: 3417843 - RNA, 14 nt, Pseudomonas aeruginosa PA01
cuggcaaccgucga

SEQ ID NO: 3417844 - RNA, 15 nt, Pseudomonas aeruginosa PA01
cuggcaacggcgggc

SEQ ID NO: 3417845 - RNA, 23 nt, Pseudomonas aeruginosa PA01
cuggcaccggccaggcgcugguc

SEQ ID NO: 3417846 - RNA, 23 nt, Pseudomonas aeruginosa PA01
cuggcagacgcugcucgacggca

SEQ ID NO: 3417847 - RNA, 15 nt, Pseudomonas aeruginosa PA01
cuggcaggcucaccg

SEQ ID NO: 3417848 - RNA, 17 nt, Pseudomonas aeruginosa PA01
cuggcaggcucaccgcg

SEQ ID NO: 3417849 - RNA, 20 nt, Pseudomonas aeruginosa PA01
cuggcaggcucaccgcguaa

SEQ ID NO: 3417850 - RNA, 19 nt, Pseudomonas aeruginosa PA01
cuggcagggcgcguccagc

SEQ ID NO: 3417851 - RNA, 23 nt, Pseudomonas aeruginosa PA01
cuggcagggcgcguccagcucca

SEQ ID NO: 3417852 - RNA, 23 nt, Pseudomonas aeruginosa PA01
cuggcagguaucgcugggcgccu

SEQ ID NO: 3417853 - RNA, 21 nt, Pseudomonas aeruginosa PA01
cuggcagguugauccugggcg

SEQ ID NO: 3417854 - RNA, 22 nt, Pseudomonas aeruginosa PA01
cuggcagguugauccugggcgc

SEQ ID NO: 3417855 - RNA, 17 nt, Pseudomonas aeruginosa PA01
cuggcaguccagggcgg

SEQ ID NO: 3417856 - RNA, 12 nt, Pseudomonas aeruginosa PA01
cuggcagucguc

SEQ ID NO: 3417857 - RNA, 14 nt, Pseudomonas aeruginosa PA01
cuggcagucgucgc

SEQ ID NO: 3417858 - RNA, 17 nt, Pseudomonas aeruginosa PA01
cuggcagucgucgcagc

SEQ ID NO: 3417859 - RNA, 16 nt, Pseudomonas aeruginosa PA01
cuggcagugcgccggc

SEQ ID NO: 3417860 - RNA, 17 nt, Pseudomonas aeruginosa PA01
cuggcagugcgccggca

SEQ ID NO: 3417861 - RNA, 17 nt, Pseudomonas aeruginosa PA01
cuggcaguugcaguacc

SEQ ID NO: 3417862 - RNA, 18 nt, Pseudomonas aeruginosa PA01
cuggcaguugcaguaccu

SEQ ID NO: 3417863 - RNA, 18 nt, Pseudomonas aeruginosa PA01
cuggcauacacaugcagg

SEQ ID NO: 3417864 - RNA, 20 nt, Pseudomonas aeruginosa PA01
cuggcauaccgcguucaccg

SEQ ID NO: 3417865 - RNA, 17 nt, Pseudomonas aeruginosa PA01
cuggcaucggugaccug

SEQ ID NO: 3417866 - RNA, 23 nt, Pseudomonas aeruginosa PA01
cuggcauggcuuuccaggcgccg

SEQ ID NO: 3417867 - RNA, 12 nt, Pseudomonas aeruginosa PA01
cuggccaccagc

SEQ ID NO: 3417868 - RNA, 14 nt, Pseudomonas aeruginosa PA01
cuggccaccagcac

SEQ ID NO: 3417869 - RNA, 17 nt, Pseudomonas aeruginosa PA01
cuggccaccagcaccug

SEQ ID NO: 3417870 - RNA, 21 nt, Pseudomonas aeruginosa PA01
cuggccacccuugcgcccggc

SEQ ID NO: 3417871 - RNA, 21 nt, Pseudomonas aeruginosa PA01
cuggccacccuuguggccgau

SEQ ID NO: 3417872 - RNA, 14 nt, Pseudomonas aeruginosa PA01
cuggccaccgccag

SEQ ID NO: 3417873 - RNA, 16 nt, Pseudomonas aeruginosa PA01
cuggccaccgccagga

SEQ ID NO: 3417874 - RNA, 13 nt, Pseudomonas aeruginosa PA01
cuggccaccgcgg

SEQ ID NO: 3417875 - RNA, 14 nt, Pseudomonas aeruginosa PA01
cuggccaccgcggc

SEQ ID NO: 3417876 - RNA, 20 nt, Pseudomonas aeruginosa PA01
cuggccaccgggaucagcgg

SEQ ID NO: 3417877 - RNA, 17 nt, Pseudomonas aeruginosa PA01
cuggccaccgucggaug

SEQ ID NO: 3417878 - RNA, 24 nt, Pseudomonas aeruginosa PA01
cuggccaccgucggauggccgucc

SEQ ID NO: 3417879 - RNA, 18 nt, Pseudomonas aeruginosa PA01
cuggccacgaacaggcug

SEQ ID NO: 3417880 - RNA, 17 nt, Pseudomonas aeruginosa PA01
cuggccacguccagcgg

SEQ ID NO: 3417881 - RNA, 19 nt, Pseudomonas aeruginosa PA01
cuggccacguccagcggca

SEQ ID NO: 3417882 - RNA, 20 nt, Pseudomonas aeruginosa PA01
cuggccacguccagcggcau

SEQ ID NO: 3417883 - RNA, 17 nt, Pseudomonas aeruginosa PA01
cuggccagaaggucggg

SEQ ID NO: 3417884 - RNA, 19 nt, Pseudomonas aeruginosa PA01
cuggccagaaggucgggga

SEQ ID NO: 3417885 - RNA, 23 nt, Pseudomonas aeruginosa PA01
cuggccagaaggucggggagagg

SEQ ID NO: 3417886 - RNA, 18 nt, Pseudomonas aeruginosa PA01
cuggccagaauuccagca

SEQ ID NO: 3417887 - RNA, 20 nt, Pseudomonas aeruginosa PA01
cuggccagaauuccagcagg

SEQ ID NO: 3417888 - RNA, 20 nt, Pseudomonas aeruginosa PA01
cuggccagcaccagucccug

SEQ ID NO: 3417889 - RNA, 23 nt, Pseudomonas aeruginosa PA01
cuggccagcaccagucccuggcc

SEQ ID NO: 3417890 - RNA, 23 nt, Pseudomonas aeruginosa PA01
cuggccagcaggcuggcggcauc

SEQ ID NO: 3417891 - RNA, 12 nt, Pseudomonas aeruginosa PA01
cuggccagcgcu

SEQ ID NO: 3417892 - RNA, 24 nt, Pseudomonas aeruginosa PA01
cuggccagcgcuuccaccgccugc

SEQ ID NO: 3417893 - RNA, 17 nt, Pseudomonas aeruginosa PA01
cuggccaggcgcuccuc

SEQ ID NO: 3417894 - RNA, 22 nt, Pseudomonas aeruginosa PA01
cuggccaggcgcuccuccagcg

SEQ ID NO: 3417895 - RNA, 14 nt, Pseudomonas aeruginosa PA01
cuggccagggcaug

SEQ ID NO: 3417896 - RNA, 17 nt, Pseudomonas aeruginosa PA01
cuggccaguuccauguc

SEQ ID NO: 3417897 - RNA, 21 nt, Pseudomonas aeruginosa PA01
cuggccaguuccaugucgcug

SEQ ID NO: 3417898 - RNA, 22 nt, Pseudomonas aeruginosa PA01
cuggccaguuccaugucgcugg

SEQ ID NO: 3417899 - RNA, 20 nt, Pseudomonas aeruginosa PA01
cuggccauccgcccugcggg

SEQ ID NO: 3417900 - RNA, 21 nt, Pseudomonas aeruginosa PA01
cuggccaugcguugcggcaug

SEQ ID NO: 3417901 - RNA, 19 nt, Pseudomonas aeruginosa PA01
cuggccauucgcuucggcc

SEQ ID NO: 3417902 - RNA, 16 nt, Pseudomonas aeruginosa PA01
cuggcccacggcgccu

SEQ ID NO: 3417903 - RNA, 17 nt, Pseudomonas aeruginosa PA01
cuggcccagcuugaugu

SEQ ID NO: 3417904 - RNA, 18 nt, Pseudomonas aeruginosa PA01
cuggcccaguugcccggc

SEQ ID NO: 3417905 - RNA, 20 nt, Pseudomonas aeruginosa PA01
cuggcccaguugcccggccu

SEQ ID NO: 3417906 - RNA, 21 nt, Pseudomonas aeruginosa PA01
cuggcccgggguauggccuuc

SEQ ID NO: 3417907 - RNA, 14 nt, Pseudomonas aeruginosa PA01
cuggcccuccaucc

SEQ ID NO: 3417908 - RNA, 16 nt, Pseudomonas aeruginosa PA01
cuggcccuccauccag

SEQ ID NO: 3417909 - RNA, 19 nt, Pseudomonas aeruginosa PA01
cuggcccuccauccagucu

SEQ ID NO: 3417910 - RNA, 22 nt, Pseudomonas aeruginosa PA01
cuggcccucggcguucaccgcg

SEQ ID NO: 3417911 - RNA, 22 nt, Pseudomonas aeruginosa PA01
cuggcccugcaacaggacccag

SEQ ID NO: 3417912 - RNA, 16 nt, Pseudomonas aeruginosa PA01
cuggcccuggaccucg

SEQ ID NO: 3417913 - RNA, 22 nt, Pseudomonas aeruginosa PA01
cuggcccuggauaucugggcca

SEQ ID NO: 3417914 - RNA, 22 nt, Pseudomonas aeruginosa PA01
cuggcccuggcgcaggcggcgc

SEQ ID NO: 3417915 - RNA, 20 nt, Pseudomonas aeruginosa PA01
cuggcccugguacagcgccu

SEQ ID NO: 3417916 - RNA, 23 nt, Pseudomonas aeruginosa PA01
cuggccgaaauugaccagguacg

SEQ ID NO: 3417917 - RNA, 15 nt, Pseudomonas aeruginosa PA01
cuggccgaauaggcg

SEQ ID NO: 3417918 - RNA, 20 nt, Pseudomonas aeruginosa PA01
cuggccgaccaguaccaggc

SEQ ID NO: 3417919 - RNA, 16 nt, Pseudomonas aeruginosa PA01
cuggccgacccgcagc

SEQ ID NO: 3417920 - RNA, 17 nt, Pseudomonas aeruginosa PA01
cuggccgacccgcagcg

SEQ ID NO: 3417921 - RNA, 20 nt, Pseudomonas aeruginosa PA01
cuggccgacccgcagcggcg

SEQ ID NO: 3417922 - RNA, 22 nt, Pseudomonas aeruginosa PA01
cuggccgacccgcagcggcgcu

SEQ ID NO: 3417923 - RNA, 17 nt, Pseudomonas aeruginosa PA01
cuggccgagcaucagca

SEQ ID NO: 3417924 - RNA, 23 nt, Pseudomonas aeruginosa PA01
cuggccgagccgcuuggagcggg

SEQ ID NO: 3417925 - RNA, 15 nt, Pseudomonas aeruginosa PA01
cuggccgagcgccgc

SEQ ID NO: 3417926 - RNA, 18 nt, Pseudomonas aeruginosa PA01
cuggccgagcgccgccug

SEQ ID NO: 3417927 - RNA, 20 nt, Pseudomonas aeruginosa PA01
cuggccgagcgccgccuggg

SEQ ID NO: 3417928 - RNA, 22 nt, Pseudomonas aeruginosa PA01
cuggccgagcgccgccugggcc

SEQ ID NO: 3417929 - RNA, 16 nt, Pseudomonas aeruginosa PA01
cuggccgagcgggaag

SEQ ID NO: 3417930 - RNA, 16 nt, Pseudomonas aeruginosa PA01
cuggccgagcugccgc

SEQ ID NO: 3417931 - RNA, 18 nt, Pseudomonas aeruginosa PA01
cuggccgaggacccggcg

SEQ ID NO: 3417932 - RNA, 19 nt, Pseudomonas aeruginosa PA01
cuggccgagggcgcgcagu

SEQ ID NO: 3417933 - RNA, 13 nt, Pseudomonas aeruginosa PA01
cuggccgaucagc

SEQ ID NO: 3417934 - RNA, 11 nt, Pseudomonas aeruginosa PA01
cuggccgaugc

SEQ ID NO: 3417935 - RNA, 19 nt, Pseudomonas aeruginosa PA01
cuggccgaugccgaccuug

SEQ ID NO: 3417936 - RNA, 14 nt, Pseudomonas aeruginosa PA01
cuggccgcccaggu

SEQ ID NO: 3417937 - RNA, 13 nt, Pseudomonas aeruginosa PA01
cuggccgccucgc

SEQ ID NO: 3417938 - RNA, 18 nt, Pseudomonas aeruginosa PA01
cuggccgccucgcgccgc

SEQ ID NO: 3417939 - RNA, 21 nt, Pseudomonas aeruginosa PA01
cuggccgccucgcgccgcgcc

SEQ ID NO: 3417940 - RNA, 18 nt, Pseudomonas aeruginosa PA01
cuggccgccuggccggcc

SEQ ID NO: 3417941 - RNA, 22 nt, Pseudomonas aeruginosa PA01
cuggccgccuggccggccagcc

SEQ ID NO: 3417942 - RNA, 15 nt, Pseudomonas aeruginosa PA01
cuggccgcgcaggaa

SEQ ID NO: 3417943 - RNA, 17 nt, Pseudomonas aeruginosa PA01
cuggccgcgcaggaaga

SEQ ID NO: 3417944 - RNA, 19 nt, Pseudomonas aeruginosa PA01
cuggccgcgcgaccgcggc

SEQ ID NO: 3417945 - RNA, 22 nt, Pseudomonas aeruginosa PA01
cuggccgcgcgaccgcggcgcu

SEQ ID NO: 3417946 - RNA, 14 nt, Pseudomonas aeruginosa PA01
cuggccgcgcggcu

SEQ ID NO: 3417947 - RNA, 22 nt, Pseudomonas aeruginosa PA01
cuggccgcgcggcuugccggcg

SEQ ID NO: 3417948 - RNA, 13 nt, Pseudomonas aeruginosa PA01
cuggccgcgcucc

SEQ ID NO: 3417949 - RNA, 18 nt, Pseudomonas aeruginosa PA01
cuggccgcgcuccaacag

SEQ ID NO: 3417950 - RNA, 20 nt, Pseudomonas aeruginosa PA01
cuggccgcgcuccaacaggc

SEQ ID NO: 3417951 - RNA, 23 nt, Pseudomonas aeruginosa PA01
cuggccgcgcuccaacaggcauu

SEQ ID NO: 3417952 - RNA, 22 nt, Pseudomonas aeruginosa PA01
cuggccgcggugggcuccagcg

SEQ ID NO: 3417953 - RNA, 15 nt, Pseudomonas aeruginosa PA01
cuggccgcguucgcc

SEQ ID NO: 3417954 - RNA, 16 nt, Pseudomonas aeruginosa PA01
cuggccgcugccgcuc

SEQ ID NO: 3417955 - RNA, 22 nt, Pseudomonas aeruginosa PA01
cuggccgcugccgcucuggcug

SEQ ID NO: 3417956 - RNA, 20 nt, Pseudomonas aeruginosa PA01
cuggccgcuguggaaguacg

SEQ ID NO: 3417957 - RNA, 23 nt, Pseudomonas aeruginosa PA01
cuggccgcuguggaaguacggcg

SEQ ID NO: 3417958 - RNA, 13 nt, Pseudomonas aeruginosa PA01
cuggccggcagca

SEQ ID NO: 3417959 - RNA, 16 nt, Pseudomonas aeruginosa PA01
cuggccggcagcagcg

SEQ ID NO: 3417960 - RNA, 13 nt, Pseudomonas aeruginosa PA01
cuggccggccagc

SEQ ID NO: 3417961 - RNA, 13 nt, Pseudomonas aeruginosa PA01
cuggccggccucg

SEQ ID NO: 3417962 - RNA, 18 nt, Pseudomonas aeruginosa PA01
cuggccggccucggcggc

SEQ ID NO: 3417963 - RNA, 13 nt, Pseudomonas aeruginosa PA01
cuggccggcgaug

SEQ ID NO: 3417964 - RNA, 21 nt, Pseudomonas aeruginosa PA01
cuggccggcgauggccgccug

SEQ ID NO: 3417965 - RNA, 23 nt, Pseudomonas aeruginosa PA01
cuggccggcgauggccgccugca

SEQ ID NO: 3417966 - RNA, 13 nt, Pseudomonas aeruginosa PA01
cuggccggcggcg

SEQ ID NO: 3417967 - RNA, 20 nt, Pseudomonas aeruginosa PA01
cuggccggcguacuucggcg

SEQ ID NO: 3417968 - RNA, 17 nt, Pseudomonas aeruginosa PA01
cuggccgggaaccagca

SEQ ID NO: 3417969 - RNA, 19 nt, Pseudomonas aeruginosa PA01
cuggccgggaaccagcaug

SEQ ID NO: 3417970 - RNA, 23 nt, Pseudomonas aeruginosa PA01
cuggccgggggucgcggcgaccu

SEQ ID NO: 3417971 - RNA, 17 nt, Pseudomonas aeruginosa PA01
cuggccggugacauucg

SEQ ID NO: 3417972 - RNA, 22 nt, Pseudomonas aeruginosa PA01
cuggccggugacauucgacagc

SEQ ID NO: 3417973 - RNA, 14 nt, Pseudomonas aeruginosa PA01
cuggccggugacga

SEQ ID NO: 3417974 - RNA, 21 nt, Pseudomonas aeruginosa PA01
cuggccggugccauacagcgc

SEQ ID NO: 3417975 - RNA, 23 nt, Pseudomonas aeruginosa PA01
cuggccggugccauacagcgccc

SEQ ID NO: 3417976 - RNA, 16 nt, Pseudomonas aeruginosa PA01
cuggccgucccugacc

SEQ ID NO: 3417977 - RNA, 21 nt, Pseudomonas aeruginosa PA01
cuggccgucccugaccagcag

SEQ ID NO: 3417978 - RNA, 23 nt, Pseudomonas aeruginosa PA01
cuggccgucccugaccagcaggg

SEQ ID NO: 3417979 - RNA, 18 nt, Pseudomonas aeruginosa PA01
cuggccgucgacccgccu

SEQ ID NO: 3417980 - RNA, 19 nt, Pseudomonas aeruginosa PA01
cuggccgucgacccgccuc

SEQ ID NO: 3417981 - RNA, 20 nt, Pseudomonas aeruginosa PA01
cuggccgucgaggucggcga

SEQ ID NO: 3417982 - RNA, 17 nt, Pseudomonas aeruginosa PA01
cuggccgucggccugcu

SEQ ID NO: 3417983 - RNA, 23 nt, Pseudomonas aeruginosa PA01
cuggccgucgggauagucguucu

SEQ ID NO: 3417984 - RNA, 17 nt, Pseudomonas aeruginosa PA01
cuggccgucuuccaggg

SEQ ID NO: 3417985 - RNA, 19 nt, Pseudomonas aeruginosa PA01
cuggccgucuuccagggcg

SEQ ID NO: 3417986 - RNA, 23 nt, Pseudomonas aeruginosa PA01
cuggccgucuuccagggcggcgc

SEQ ID NO: 3417987 - RNA, 19 nt, Pseudomonas aeruginosa PA01
cuggccgugcucgaugauc

SEQ ID NO: 3417988 - RNA, 22 nt, Pseudomonas aeruginosa PA01
cuggccgugcucgaugaucgac

SEQ ID NO: 3417989 - RNA, 14 nt, Pseudomonas aeruginosa PA01
cuggccguucucca

SEQ ID NO: 3417990 - RNA, 19 nt, Pseudomonas aeruginosa PA01
cuggccguugaccagcgcg

SEQ ID NO: 3417991 - RNA, 17 nt, Pseudomonas aeruginosa PA01
cuggccguugcgcaggc

SEQ ID NO: 3417992 - RNA, 15 nt, Pseudomonas aeruginosa PA01
cuggccguuggcgaa

SEQ ID NO: 3417993 - RNA, 23 nt, Pseudomonas aeruginosa PA01
cuggccucagggcgcgaaguagc

SEQ ID NO: 3417994 - RNA, 15 nt, Pseudomonas aeruginosa PA01
cuggccucggcgauc

SEQ ID NO: 3417995 - RNA, 12 nt, Pseudomonas aeruginosa PA01
cuggccucguug

SEQ ID NO: 3417996 - RNA, 13 nt, Pseudomonas aeruginosa PA01
cuggccugcagca

SEQ ID NO: 3417997 - RNA, 16 nt, Pseudomonas aeruginosa PA01
cuggccugcagcaggu

SEQ ID NO: 3417998 - RNA, 13 nt, Pseudomonas aeruginosa PA01
cuggccugcaggu

SEQ ID NO: 3417999 - RNA, 12 nt, Pseudomonas aeruginosa PA01
cuggccugccga

SEQ ID NO: 3418000 - RNA, 15 nt, Pseudomonas aeruginosa PA01
cuggccugccgaugg

SEQ ID NO: 3418001 - RNA, 18 nt, Pseudomonas aeruginosa PA01
cuggccugccgaugggcc

SEQ ID NO: 3418002 - RNA, 19 nt, Pseudomonas aeruginosa PA01
cuggccuggaacuggucgg

SEQ ID NO: 3418003 - RNA, 20 nt, Pseudomonas aeruginosa PA01
cuggccuggaacuggucggg

SEQ ID NO: 3418004 - RNA, 21 nt, Pseudomonas aeruginosa PA01
cuggccuggaacuggucgggg

SEQ ID NO: 3418005 - RNA, 12 nt, Pseudomonas aeruginosa PA01
cuggccuggcca

SEQ ID NO: 3418006 - RNA, 13 nt, Pseudomonas aeruginosa PA01
cuggccuggccac

SEQ ID NO: 3418007 - RNA, 14 nt, Pseudomonas aeruginosa PA01
cuggccuggccacc

SEQ ID NO: 3418008 - RNA, 15 nt, Pseudomonas aeruginosa PA01
cuggccuggccaccc

SEQ ID NO: 3418009 - RNA, 16 nt, Pseudomonas aeruginosa PA01
cuggccuggccacccu

SEQ ID NO: 3418010 - RNA, 20 nt, Pseudomonas aeruginosa PA01
cuggccugggguagccggcc

SEQ ID NO: 3418011 - RNA, 15 nt, Pseudomonas aeruginosa PA01
cuggccuuggccacg

SEQ ID NO: 3418012 - RNA, 14 nt, Pseudomonas aeruginosa PA01
cuggccuuggccau

SEQ ID NO: 3418013 - RNA, 22 nt, Pseudomonas aeruginosa PA01
cuggcgaaccaguccagcacgg

SEQ ID NO: 3418014 - RNA, 23 nt, Pseudomonas aeruginosa PA01
cuggcgaacgaugguggucggca

SEQ ID NO: 3418015 - RNA, 15 nt, Pseudomonas aeruginosa PA01
cuggcgaacggcugg

SEQ ID NO: 3418016 - RNA, 16 nt, Pseudomonas aeruginosa PA01
cuggcgaacggcuggu

SEQ ID NO: 3418017 - RNA, 20 nt, Pseudomonas aeruginosa PA01
cuggcgaacggcuggucggc

SEQ ID NO: 3418018 - RNA, 15 nt, Pseudomonas aeruginosa PA01
cuggcgaaugccuuc

SEQ ID NO: 3418019 - RNA, 16 nt, Pseudomonas aeruginosa PA01
cuggcgaaugccuucg

SEQ ID NO: 3418020 - RNA, 22 nt, Pseudomonas aeruginosa PA01
cuggcgaauuuccugcuggcga

SEQ ID NO: 3418021 - RNA, 11 nt, Pseudomonas aeruginosa PA01
cuggcgaccgg

SEQ ID NO: 3418022 - RNA, 15 nt, Pseudomonas aeruginosa PA01
cuggcgacggcucug

SEQ ID NO: 3418023 - RNA, 23 nt, Pseudomonas aeruginosa PA01
cuggcgacgucccuuccccgauc

SEQ ID NO: 3418024 - RNA, 13 nt, Pseudomonas aeruginosa PA01
cuggcgagcaggg

SEQ ID NO: 3418025 - RNA, 18 nt, Pseudomonas aeruginosa PA01
cuggcgaggaacacccag

SEQ ID NO: 3418026 - RNA, 21 nt, Pseudomonas aeruginosa PA01
cuggcgaggaacacccagaag

SEQ ID NO: 3418027 - RNA, 16 nt, Pseudomonas aeruginosa PA01
cuggcgaggacgccgg

SEQ ID NO: 3418028 - RNA, 20 nt, Pseudomonas aeruginosa PA01
cuggcgaggacgccgggcug

SEQ ID NO: 3418029 - RNA, 21 nt, Pseudomonas aeruginosa PA01
cuggcgaggacgccgggcugg

SEQ ID NO: 3418030 - RNA, 21 nt, Pseudomonas aeruginosa PA01
cuggcgaggauuuccucgcgc

SEQ ID NO: 3418031 - RNA, 18 nt, Pseudomonas aeruginosa PA01
cuggcgaguggcgaagcc

SEQ ID NO: 3418032 - RNA, 19 nt, Pseudomonas aeruginosa PA01
cuggcgaguggcgaagcca

SEQ ID NO: 3418033 - RNA, 16 nt, Pseudomonas aeruginosa PA01
cuggcgaucaccaggg

SEQ ID NO: 3418034 - RNA, 23 nt, Pseudomonas aeruginosa PA01
cuggcgaucaccagggugcgcuc

SEQ ID NO: 3418035 - RNA, 19 nt, Pseudomonas aeruginosa PA01
cuggcgaucaucgcgcacu

SEQ ID NO: 3418036 - RNA, 16 nt, Pseudomonas aeruginosa PA01
cuggcgaucucggcgc

SEQ ID NO: 3418037 - RNA, 19 nt, Pseudomonas aeruginosa PA01
cuggcgaucucggcgcggg

SEQ ID NO: 3418038 - RNA, 21 nt, Pseudomonas aeruginosa PA01
cuggcgaucucggcgcgggca

SEQ ID NO: 3418039 - RNA, 16 nt, Pseudomonas aeruginosa PA01
cuggcgaugcccuggc

SEQ ID NO: 3418040 - RNA, 18 nt, Pseudomonas aeruginosa PA01
cuggcgaugcccuggccg

SEQ ID NO: 3418041 - RNA, 20 nt, Pseudomonas aeruginosa PA01
cuggcgaugcccuggccgcu

SEQ ID NO: 3418042 - RNA, 20 nt, Pseudomonas aeruginosa PA01
cuggcgauggaugacccgcu

SEQ ID NO: 3418043 - RNA, 21 nt, Pseudomonas aeruginosa PA01
cuggcgauguagcugccggcg

SEQ ID NO: 3418044 - RNA, 19 nt, Pseudomonas aeruginosa PA01
cuggcgauucuccugggcg

SEQ ID NO: 3418045 - RNA, 17 nt, Pseudomonas aeruginosa PA01
cuggcgcaacagaucuu

SEQ ID NO: 3418046 - RNA, 16 nt, Pseudomonas aeruginosa PA01
cuggcgcaacgccggc

SEQ ID NO: 3418047 - RNA, 20 nt, Pseudomonas aeruginosa PA01
cuggcgcaacgccggcaggu

SEQ ID NO: 3418048 - RNA, 17 nt, Pseudomonas aeruginosa PA01
cuggcgcaacugcgcca

SEQ ID NO: 3418049 - RNA, 20 nt, Pseudomonas aeruginosa PA01
cuggcgcaacugcgccagcc

SEQ ID NO: 3418050 - RNA, 20 nt, Pseudomonas aeruginosa PA01
cuggcgcacacggucgagac

SEQ ID NO: 3418051 - RNA, 13 nt, Pseudomonas aeruginosa PA01
cuggcgcacggcc

SEQ ID NO: 3418052 - RNA, 16 nt, Pseudomonas aeruginosa PA01
cuggcgcacggccugc

SEQ ID NO: 3418053 - RNA, 19 nt, Pseudomonas aeruginosa PA01
cuggcgcacggccugcacc

SEQ ID NO: 3418054 - RNA, 19 nt, Pseudomonas aeruginosa PA01
cuggcgcagacaggccucc

SEQ ID NO: 3418055 - RNA, 20 nt, Pseudomonas aeruginosa PA01
cuggcgcagacaggccucca

SEQ ID NO: 3418056 - RNA, 16 nt, Pseudomonas aeruginosa PA01
cuggcgcagcagcagg

SEQ ID NO: 3418057 - RNA, 15 nt, Pseudomonas aeruginosa PA01
cuggcgcagccaggc

SEQ ID NO: 3418058 - RNA, 19 nt, Pseudomonas aeruginosa PA01
cuggcgcagccaggcgaug

SEQ ID NO: 3418059 - RNA, 14 nt, Pseudomonas aeruginosa PA01
cuggcgcagccgcu

SEQ ID NO: 3418060 - RNA, 15 nt, Pseudomonas aeruginosa PA01
cuggcgcagccgcug

SEQ ID NO: 3418061 - RNA, 16 nt, Pseudomonas aeruginosa PA01
cuggcgcagccgcugc

SEQ ID NO: 3418062 - RNA, 15 nt, Pseudomonas aeruginosa PA01
cuggcgcagccguuc

SEQ ID NO: 3418063 - RNA, 20 nt, Pseudomonas aeruginosa PA01
cuggcgcagccguucccggu

SEQ ID NO: 3418064 - RNA, 14 nt, Pseudomonas aeruginosa PA01
cuggcgcagcggca

SEQ ID NO: 3418065 - RNA, 15 nt, Pseudomonas aeruginosa PA01
cuggcgcagcggcag

SEQ ID NO: 3418066 - RNA, 16 nt, Pseudomonas aeruginosa PA01
cuggcgcagcggcagc

SEQ ID NO: 3418067 - RNA, 17 nt, Pseudomonas aeruginosa PA01
cuggcgcagcggcagcg

SEQ ID NO: 3418068 - RNA, 14 nt, Pseudomonas aeruginosa PA01
cuggcgcaggaccg

SEQ ID NO: 3418069 - RNA, 17 nt, Pseudomonas aeruginosa PA01
cuggcgcaggaccgcca

SEQ ID NO: 3418070 - RNA, 18 nt, Pseudomonas aeruginosa PA01
cuggcgcaggaccgccau

SEQ ID NO: 3418071 - RNA, 12 nt, Pseudomonas aeruginosa PA01
cuggcgcaggcg

SEQ ID NO: 3418072 - RNA, 15 nt, Pseudomonas aeruginosa PA01
cuggcgcaggcggcg

SEQ ID NO: 3418073 - RNA, 15 nt, Pseudomonas aeruginosa PA01
cuggcgcauccgccc

SEQ ID NO: 3418074 - RNA, 13 nt, Pseudomonas aeruginosa PA01
cuggcgcauggcg

SEQ ID NO: 3418075 - RNA, 17 nt, Pseudomonas aeruginosa PA01
cuggcgcauggcgcucu

SEQ ID NO: 3418076 - RNA, 22 nt, Pseudomonas aeruginosa PA01
cuggcgccagcguugcaggucg

SEQ ID NO: 3418077 - RNA, 15 nt, Pseudomonas aeruginosa PA01
cuggcgccaggccgc

SEQ ID NO: 3418078 - RNA, 12 nt, Pseudomonas aeruginosa PA01
cuggcgccgaug

SEQ ID NO: 3418079 - RNA, 13 nt, Pseudomonas aeruginosa PA01
cuggcgccgaugc

SEQ ID NO: 3418080 - RNA, 17 nt, Pseudomonas aeruginosa PA01
cuggcgccgcuggcgug

SEQ ID NO: 3418081 - RNA, 18 nt, Pseudomonas aeruginosa PA01
cuggcgccgcuggcgugg

SEQ ID NO: 3418082 - RNA, 14 nt, Pseudomonas aeruginosa PA01
cuggcgccggugca

SEQ ID NO: 3418083 - RNA, 13 nt, Pseudomonas aeruginosa PA01
cuggcgccgucau

SEQ ID NO: 3418084 - RNA, 12 nt, Pseudomonas aeruginosa PA01
cuggcgccuggc

SEQ ID NO: 3418085 - RNA, 14 nt, Pseudomonas aeruginosa PA01
cuggcgccuggccu

SEQ ID NO: 3418086 - RNA, 15 nt, Pseudomonas aeruginosa PA01
cuggcgccuggccug

SEQ ID NO: 3418087 - RNA, 20 nt, Pseudomonas aeruginosa PA01
cuggcgcgagaagccagcca

SEQ ID NO: 3418088 - RNA, 22 nt, Pseudomonas aeruginosa PA01
cuggcgcgagaagccagccagg

SEQ ID NO: 3418089 - RNA, 17 nt, Pseudomonas aeruginosa PA01
cuggcgcgauccgcgcg

SEQ ID NO: 3418090 - RNA, 20 nt, Pseudomonas aeruginosa PA01
cuggcgcgauccgcgcggca

SEQ ID NO: 3418091 - RNA, 16 nt, Pseudomonas aeruginosa PA01
cuggcgcgccuccugc

SEQ ID NO: 3418092 - RNA, 13 nt, Pseudomonas aeruginosa PA01
cuggcgcgcgccc

SEQ ID NO: 3418093 - RNA, 15 nt, Pseudomonas aeruginosa PA01
cuggcgcgcgcgcca

SEQ ID NO: 3418094 - RNA, 17 nt, Pseudomonas aeruginosa PA01
cuggcgcgcugcggcag

SEQ ID NO: 3418095 - RNA, 18 nt, Pseudomonas aeruginosa PA01
cuggcgcgcugcggcagg

SEQ ID NO: 3418096 - RNA, 19 nt, Pseudomonas aeruginosa PA01
cuggcgcgcugcggcaggg

SEQ ID NO: 3418097 - RNA, 11 nt, Pseudomonas aeruginosa PA01
cuggcgcggca

SEQ ID NO: 3418098 - RNA, 13 nt, Pseudomonas aeruginosa PA01
cuggcgcggcaaa

SEQ ID NO: 3418099 - RNA, 20 nt, Pseudomonas aeruginosa PA01
cuggcgcggcaaagugcggu

SEQ ID NO: 3418100 - RNA, 17 nt, Pseudomonas aeruginosa PA01
cuggcgcgucaugccgc

SEQ ID NO: 3418101 - RNA, 21 nt, Pseudomonas aeruginosa PA01
cuggcgcgucaugccgccguc

SEQ ID NO: 3418102 - RNA, 14 nt, Pseudomonas aeruginosa PA01
cuggcgcgucgcug

SEQ ID NO: 3418103 - RNA, 23 nt, Pseudomonas aeruginosa PA01
cuggcgcgucgcugccgccgcgc

SEQ ID NO: 3418104 - RNA, 24 nt, Pseudomonas aeruginosa PA01
cuggcgcgucgcugccgccgcgcc

SEQ ID NO: 3418105 - RNA, 13 nt, Pseudomonas aeruginosa PA01
cuggcgcgucggc

SEQ ID NO: 3418106 - RNA, 14 nt, Pseudomonas aeruginosa PA01
cuggcgcgucggcc

SEQ ID NO: 3418107 - RNA, 16 nt, Pseudomonas aeruginosa PA01
cuggcgcgucggccgc

SEQ ID NO: 3418108 - RNA, 18 nt, Pseudomonas aeruginosa PA01
cuggcgcgucggccgcuc

SEQ ID NO: 3418109 - RNA, 18 nt, Pseudomonas aeruginosa PA01
cuggcgcguugugccgcc

SEQ ID NO: 3418110 - RNA, 22 nt, Pseudomonas aeruginosa PA01
cuggcgcguugugccgccaccu

SEQ ID NO: 3418111 - RNA, 19 nt, Pseudomonas aeruginosa PA01
cuggcgcuaccgcgcaugg

SEQ ID NO: 3418112 - RNA, 16 nt, Pseudomonas aeruginosa PA01
cuggcgcucagcgccg

SEQ ID NO: 3418113 - RNA, 17 nt, Pseudomonas aeruginosa PA01
cuggcgcucagcgccgc

SEQ ID NO: 3418114 - RNA, 18 nt, Pseudomonas aeruginosa PA01
cuggcgcucagcgccgcu

SEQ ID NO: 3418115 - RNA, 21 nt, Pseudomonas aeruginosa PA01
cuggcgcucucgaacaccagg

SEQ ID NO: 3418116 - RNA, 13 nt, Pseudomonas aeruginosa PA01
cuggcgcugaaca

SEQ ID NO: 3418117 - RNA, 14 nt, Pseudomonas aeruginosa PA01
cuggcgcugaacaa

SEQ ID NO: 3418118 - RNA, 19 nt, Pseudomonas aeruginosa PA01
cuggcgcugaacaagcccu

SEQ ID NO: 3418119 - RNA, 13 nt, Pseudomonas aeruginosa PA01
cuggcgcugcgcg

SEQ ID NO: 3418120 - RNA, 17 nt, Pseudomonas aeruginosa PA01
cuggcgcugcgcggcgu

SEQ ID NO: 3418121 - RNA, 22 nt, Pseudomonas aeruginosa PA01
cuggcgcugguccuugaucgga

SEQ ID NO: 3418122 - RNA, 20 nt, Pseudomonas aeruginosa PA01
cuggcgcuguaggcgagcag

SEQ ID NO: 3418123 - RNA, 21 nt, Pseudomonas aeruginosa PA01
cuggcgcugucgcccgggcgc

SEQ ID NO: 3418124 - RNA, 14 nt, Pseudomonas aeruginosa PA01
cuggcgcuugccgc

SEQ ID NO: 3418125 - RNA, 19 nt, Pseudomonas aeruginosa PA01
cuggcgcuugccgcgcccg

SEQ ID NO: 3418126 - RNA, 21 nt, Pseudomonas aeruginosa PA01
cuggcgcuugccgcgcccggc

SEQ ID NO: 3418127 - RNA, 22 nt, Pseudomonas aeruginosa PA01
cuggcgcuugccgcgcccggcc

SEQ ID NO: 3418128 - RNA, 23 nt, Pseudomonas aeruginosa PA01
cuggcgcuugccgcgcccggcca

SEQ ID NO: 3418129 - RNA, 19 nt, Pseudomonas aeruginosa PA01
cuggcgcuugggcgcggag

SEQ ID NO: 3418130 - RNA, 20 nt, Pseudomonas aeruginosa PA01
cuggcgcuugggcgcggaga

SEQ ID NO: 3418131 - RNA, 15 nt, Pseudomonas aeruginosa PA01
cuggcggaaaagccc

SEQ ID NO: 3418132 - RNA, 17 nt, Pseudomonas aeruginosa PA01
cuggcggaacagcucgg

SEQ ID NO: 3418133 - RNA, 19 nt, Pseudomonas aeruginosa PA01
cuggcggaaggugccuucg

SEQ ID NO: 3418134 - RNA, 16 nt, Pseudomonas aeruginosa PA01
cuggcggaccgccucg

SEQ ID NO: 3418135 - RNA, 15 nt, Pseudomonas aeruginosa PA01
cuggcggagaaacuu

SEQ ID NO: 3418136 - RNA, 19 nt, Pseudomonas aeruginosa PA01
cuggcggauaucgcgccgc

SEQ ID NO: 3418137 - RNA, 22 nt, Pseudomonas aeruginosa PA01
cuggcggauaucgcgccgcgau

SEQ ID NO: 3418138 - RNA, 21 nt, Pseudomonas aeruginosa PA01
cuggcggauaucgcgugguga

SEQ ID NO: 3418139 - RNA, 16 nt, Pseudomonas aeruginosa PA01
cuggcggaucaccggc

SEQ ID NO: 3418140 - RNA, 14 nt, Pseudomonas aeruginosa PA01
cuggcggaucuucg

SEQ ID NO: 3418141 - RNA, 22 nt, Pseudomonas aeruginosa PA01
cuggcggauguaguccagcgcc

SEQ ID NO: 3418142 - RNA, 20 nt, Pseudomonas aeruginosa PA01
cuggcggcauaggcccggcg

SEQ ID NO: 3418143 - RNA, 15 nt, Pseudomonas aeruginosa PA01
cuggcggcaucggcg

SEQ ID NO: 3418144 - RNA, 19 nt, Pseudomonas aeruginosa PA01
cuggcggcaucggcgccgc

SEQ ID NO: 3418145 - RNA, 24 nt, Pseudomonas aeruginosa PA01
cuggcggcaugccguugggccagg

SEQ ID NO: 3418146 - RNA, 13 nt, Pseudomonas aeruginosa PA01
cuggcggccaggg

SEQ ID NO: 3418147 - RNA, 22 nt, Pseudomonas aeruginosa PA01
cuggcggccgaguucgcgcagg

SEQ ID NO: 3418148 - RNA, 13 nt, Pseudomonas aeruginosa PA01
cuggcggccuucg

SEQ ID NO: 3418149 - RNA, 18 nt, Pseudomonas aeruginosa PA01
cuggcggcgacgaagguc

SEQ ID NO: 3418150 - RNA, 14 nt, Pseudomonas aeruginosa PA01
cuggcggcucggcu

SEQ ID NO: 3418151 - RNA, 13 nt, Pseudomonas aeruginosa PA01
cuggcggcugagc

SEQ ID NO: 3418152 - RNA, 20 nt, Pseudomonas aeruginosa PA01
cuggcggcugagcuguuuca

SEQ ID NO: 3418153 - RNA, 12 nt, Pseudomonas aeruginosa PA01
cuggcggcuggc

SEQ ID NO: 3418154 - RNA, 14 nt, Pseudomonas aeruginosa PA01
cuggcggcugggcu

SEQ ID NO: 3418155 - RNA, 21 nt, Pseudomonas aeruginosa PA01
cuggcgggcuuuuucauuucc

SEQ ID NO: 3418156 - RNA, 17 nt, Pseudomonas aeruginosa PA01
cuggcggggucgcgccg

SEQ ID NO: 3418157 - RNA, 18 nt, Pseudomonas aeruginosa PA01
cuggcggggucgcgccgg

SEQ ID NO: 3418158 - RNA, 19 nt, Pseudomonas aeruginosa PA01
cuggcggggucgcgccggu

SEQ ID NO: 3418159 - RNA, 23 nt, Pseudomonas aeruginosa PA01
cuggcggggucgcgccgguggcg

SEQ ID NO: 3418160 - RNA, 17 nt, Pseudomonas aeruginosa PA01
cuggcgggugaucuuga

SEQ ID NO: 3418161 - RNA, 15 nt, Pseudomonas aeruginosa PA01
cuggcggucgccgcc

SEQ ID NO: 3418162 - RNA, 19 nt, Pseudomonas aeruginosa PA01
cuggcggucgccgccggcg

SEQ ID NO: 3418163 - RNA, 22 nt, Pseudomonas aeruginosa PA01
cuggcgguugaugccgacgucg

SEQ ID NO: 3418164 - RNA, 23 nt, Pseudomonas aeruginosa PA01
cuggcguaccucgccaggcuggc

SEQ ID NO: 3418165 - RNA, 23 nt, Pseudomonas aeruginosa PA01
cuggcguacuugggcaucagcuc

SEQ ID NO: 3418166 - RNA, 20 nt, Pseudomonas aeruginosa PA01
cuggcguagaagucguccuc

SEQ ID NO: 3418167 - RNA, 19 nt, Pseudomonas aeruginosa PA01
cuggcguagcguugcgcga

SEQ ID NO: 3418168 - RNA, 21 nt, Pseudomonas aeruginosa PA01
cuggcgucccggguucugcuc

SEQ ID NO: 3418169 - RNA, 21 nt, Pseudomonas aeruginosa PA01
cuggcgucgaaugcggcgugg

SEQ ID NO: 3418170 - RNA, 15 nt, Pseudomonas aeruginosa PA01
cuggcgucgaccgcc

SEQ ID NO: 3418171 - RNA, 13 nt, Pseudomonas aeruginosa PA01
cuggcgucgacgc

SEQ ID NO: 3418172 - RNA, 16 nt, Pseudomonas aeruginosa PA01
cuggcgucgacgccga

SEQ ID NO: 3418173 - RNA, 20 nt, Pseudomonas aeruginosa PA01
cuggcgucgaugccgaaucc

SEQ ID NO: 3418174 - RNA, 13 nt, Pseudomonas aeruginosa PA01
cuggcgucgccuu

SEQ ID NO: 3418175 - RNA, 19 nt, Pseudomonas aeruginosa PA01
cuggcgucgccuuccacca

SEQ ID NO: 3418176 - RNA, 15 nt, Pseudomonas aeruginosa PA01
cuggcguggccggcg

SEQ ID NO: 3418177 - RNA, 16 nt, Pseudomonas aeruginosa PA01
cuggcguucucggcca

SEQ ID NO: 3418178 - RNA, 15 nt, Pseudomonas aeruginosa PA01
cuggcguugcugauc

SEQ ID NO: 3418179 - RNA, 18 nt, Pseudomonas aeruginosa PA01
cuggcguuuuucauuucc

SEQ ID NO: 3418180 - RNA, 15 nt, Pseudomonas aeruginosa PA01
cuggcuacgcuccgu

SEQ ID NO: 3418181 - RNA, 21 nt, Pseudomonas aeruginosa PA01
cuggcuagcccgucggcgacg

SEQ ID NO: 3418182 - RNA, 15 nt, Pseudomonas aeruginosa PA01
cuggcucaggcacuc

SEQ ID NO: 3418183 - RNA, 16 nt, Pseudomonas aeruginosa PA01
cuggcucaucucguug

SEQ ID NO: 3418184 - RNA, 13 nt, Pseudomonas aeruginosa PA01
cuggcuccacugc

SEQ ID NO: 3418185 - RNA, 16 nt, Pseudomonas aeruginosa PA01
cuggcuccacugcuug

SEQ ID NO: 3418186 - RNA, 17 nt, Pseudomonas aeruginosa PA01
cuggcuccacugcuugg

SEQ ID NO: 3418187 - RNA, 14 nt, Pseudomonas aeruginosa PA01
cuggcucgaucggc

SEQ ID NO: 3418188 - RNA, 17 nt, Pseudomonas aeruginosa PA01
cuggcucgaucggcagg

SEQ ID NO: 3418189 - RNA, 19 nt, Pseudomonas aeruginosa PA01
cuggcucuguuccucggcg

SEQ ID NO: 3418190 - RNA, 18 nt, Pseudomonas aeruginosa PA01
cuggcucuugccgcgagc

SEQ ID NO: 3418191 - RNA, 16 nt, Pseudomonas aeruginosa PA01
cuggcugaagacccug

SEQ ID NO: 3418192 - RNA, 17 nt, Pseudomonas aeruginosa PA01
cuggcugaagccgggca

SEQ ID NO: 3418193 - RNA, 15 nt, Pseudomonas aeruginosa PA01
cuggcugacagcuug

SEQ ID NO: 3418194 - RNA, 16 nt, Pseudomonas aeruginosa PA01
cuggcugaggcguucc

SEQ ID NO: 3418195 - RNA, 13 nt, Pseudomonas aeruginosa PA01
cuggcugcccagu

SEQ ID NO: 3418196 - RNA, 21 nt, Pseudomonas aeruginosa PA01
cuggcugcccaguugcgcggc

SEQ ID NO: 3418197 - RNA, 23 nt, Pseudomonas aeruginosa PA01
cuggcugcccaguugcgcggcga

SEQ ID NO: 3418198 - RNA, 23 nt, Pseudomonas aeruginosa PA01
cuggcugccgaggguguagagga

SEQ ID NO: 3418199 - RNA, 14 nt, Pseudomonas aeruginosa PA01
cuggcugcgcgcca

SEQ ID NO: 3418200 - RNA, 14 nt, Pseudomonas aeruginosa PA01
cuggcugcuggcga

SEQ ID NO: 3418201 - RNA, 15 nt, Pseudomonas aeruginosa PA01
cuggcugcuggcgaa

SEQ ID NO: 3418202 - RNA, 17 nt, Pseudomonas aeruginosa PA01
cuggcugcuggcgaagc

SEQ ID NO: 3418203 - RNA, 20 nt, Pseudomonas aeruginosa PA01
cuggcuggaguagcugaagc

SEQ ID NO: 3418204 - RNA, 14 nt, Pseudomonas aeruginosa PA01
cuggcuggcagguu

SEQ ID NO: 3418205 - RNA, 14 nt, Pseudomonas aeruginosa PA01
cuggcuggccagca

SEQ ID NO: 3418206 - RNA, 16 nt, Pseudomonas aeruginosa PA01
cuggcuggccagcagg

SEQ ID NO: 3418207 - RNA, 20 nt, Pseudomonas aeruginosa PA01
cuggcuggccucagggcgcg

SEQ ID NO: 3418208 - RNA, 23 nt, Pseudomonas aeruginosa PA01
cuggcuggccuuguacagggcgc

SEQ ID NO: 3418209 - RNA, 21 nt, Pseudomonas aeruginosa PA01
cuggcugguaacgggcgaacc

SEQ ID NO: 3418210 - RNA, 14 nt, Pseudomonas aeruginosa PA01
cuggcugucgagcg

SEQ ID NO: 3418211 - RNA, 19 nt, Pseudomonas aeruginosa PA01
cuggcugucgagcgaagcg

SEQ ID NO: 3418212 - RNA, 23 nt, Pseudomonas aeruginosa PA01
cugggaaagaccgaacaucagca

SEQ ID NO: 3418213 - RNA, 19 nt, Pseudomonas aeruginosa PA01
cugggaacccuugcgcagg

SEQ ID NO: 3418214 - RNA, 15 nt, Pseudomonas aeruginosa PA01
cugggaauggcggau

SEQ ID NO: 3418215 - RNA, 15 nt, Pseudomonas aeruginosa PA01
cugggacaggcgucc

SEQ ID NO: 3418216 - RNA, 17 nt, Pseudomonas aeruginosa PA01
cugggacgccuuguuca

SEQ ID NO: 3418217 - RNA, 21 nt, Pseudomonas aeruginosa PA01
cugggacggaacgucggccug

SEQ ID NO: 3418218 - RNA, 23 nt, Pseudomonas aeruginosa PA01
cugggacggcagccugggggucu

SEQ ID NO: 3418219 - RNA, 14 nt, Pseudomonas aeruginosa PA01
cugggacggcggcu

SEQ ID NO: 3418220 - RNA, 23 nt, Pseudomonas aeruginosa PA01
cugggacggcugcccaacuggcg

SEQ ID NO: 3418221 - RNA, 16 nt, Pseudomonas aeruginosa PA01
cugggacucccgcaga

SEQ ID NO: 3418222 - RNA, 17 nt, Pseudomonas aeruginosa PA01
cugggaguuccgcgcaa

SEQ ID NO: 3418223 - RNA, 16 nt, Pseudomonas aeruginosa PA01
cugggcaagcugcacg

SEQ ID NO: 3418224 - RNA, 21 nt, Pseudomonas aeruginosa PA01
cugggcagcacgcuggcgucg

SEQ ID NO: 3418225 - RNA, 15 nt, Pseudomonas aeruginosa PA01
cugggcagcgccgcc

SEQ ID NO: 3418226 - RNA, 17 nt, Pseudomonas aeruginosa PA01
cugggcagcgccgccgg

SEQ ID NO: 3418227 - RNA, 19 nt, Pseudomonas aeruginosa PA01
cugggcagcgccgccgggc

SEQ ID NO: 3418228 - RNA, 16 nt, Pseudomonas aeruginosa PA01
cugggcauggcuggcg

SEQ ID NO: 3418229 - RNA, 18 nt, Pseudomonas aeruginosa PA01
cugggcauggcuggcgcu

SEQ ID NO: 3418230 - RNA, 15 nt, Pseudomonas aeruginosa PA01
cugggccaccuggcu

SEQ ID NO: 3418231 - RNA, 23 nt, Pseudomonas aeruginosa PA01
cugggccaccuggcucuguuccu

SEQ ID NO: 3418232 - RNA, 20 nt, Pseudomonas aeruginosa PA01
cugggccacguucugcagga

SEQ ID NO: 3418233 - RNA, 14 nt, Pseudomonas aeruginosa PA01
cugggccagcgccg

SEQ ID NO: 3418234 - RNA, 14 nt, Pseudomonas aeruginosa PA01
cugggccaucgccg

SEQ ID NO: 3418235 - RNA, 16 nt, Pseudomonas aeruginosa PA01
cugggccaucgccggc

SEQ ID NO: 3418236 - RNA, 19 nt, Pseudomonas aeruginosa PA01
cugggccaucgccggcccg

SEQ ID NO: 3418237 - RNA, 21 nt, Pseudomonas aeruginosa PA01
cugggccaucgccggcccgcg

SEQ ID NO: 3418238 - RNA, 16 nt, Pseudomonas aeruginosa PA01
cugggccaugaccucg

SEQ ID NO: 3418239 - RNA, 22 nt, Pseudomonas aeruginosa PA01
cugggccaugaccucggccagc

SEQ ID NO: 3418240 - RNA, 11 nt, Pseudomonas aeruginosa PA01
cugggccaugu

SEQ ID NO: 3418241 - RNA, 14 nt, Pseudomonas aeruginosa PA01
cugggccccggcca

SEQ ID NO: 3418242 - RNA, 16 nt, Pseudomonas aeruginosa PA01
cugggccccggccagg

SEQ ID NO: 3418243 - RNA, 16 nt, Pseudomonas aeruginosa PA01
cugggccccggccggc

SEQ ID NO: 3418244 - RNA, 17 nt, Pseudomonas aeruginosa PA01
cugggccccggccggca

SEQ ID NO: 3418245 - RNA, 19 nt, Pseudomonas aeruginosa PA01
cugggccccggccggcagg

SEQ ID NO: 3418246 - RNA, 20 nt, Pseudomonas aeruginosa PA01
cugggccccggccggcagga

SEQ ID NO: 3418247 - RNA, 22 nt, Pseudomonas aeruginosa PA01
cugggccccggccggcaggagg

SEQ ID NO: 3418248 - RNA, 19 nt, Pseudomonas aeruginosa PA01
cugggccccggcgccgacc

SEQ ID NO: 3418249 - RNA, 14 nt, Pseudomonas aeruginosa PA01
cugggccgaaggcc

SEQ ID NO: 3418250 - RNA, 19 nt, Pseudomonas aeruginosa PA01
cugggccgaaggccaggcc

SEQ ID NO: 3418251 - RNA, 14 nt, Pseudomonas aeruginosa PA01
cugggccggcgcca

SEQ ID NO: 3418252 - RNA, 16 nt, Pseudomonas aeruginosa PA01
cugggccggcgccagc

SEQ ID NO: 3418253 - RNA, 19 nt, Pseudomonas aeruginosa PA01
cugggccggcgccagcagg

SEQ ID NO: 3418254 - RNA, 18 nt, Pseudomonas aeruginosa PA01
cugggccgguugcggcgc

SEQ ID NO: 3418255 - RNA, 19 nt, Pseudomonas aeruginosa PA01
cugggccgguugcggcgcc

SEQ ID NO: 3418256 - RNA, 20 nt, Pseudomonas aeruginosa PA01
cugggccgguugcggcgccg

SEQ ID NO: 3418257 - RNA, 23 nt, Pseudomonas aeruginosa PA01
cugggccugucgggggcugcgca

SEQ ID NO: 3418258 - RNA, 13 nt, Pseudomonas aeruginosa PA01
cugggccuugagc

SEQ ID NO: 3418259 - RNA, 15 nt, Pseudomonas aeruginosa PA01
cugggccuugagcag

SEQ ID NO: 3418260 - RNA, 17 nt, Pseudomonas aeruginosa PA01
cugggccuugagcaggc

SEQ ID NO: 3418261 - RNA, 18 nt, Pseudomonas aeruginosa PA01
cugggccuugagcaggcg

SEQ ID NO: 3418262 - RNA, 20 nt, Pseudomonas aeruginosa PA01
cugggccuugagcaggcguu

SEQ ID NO: 3418263 - RNA, 23 nt, Pseudomonas aeruginosa PA01
cugggccuugaucaccaccacgc

SEQ ID NO: 3418264 - RNA, 19 nt, Pseudomonas aeruginosa PA01
cugggccuuguucagggug

SEQ ID NO: 3418265 - RNA, 21 nt, Pseudomonas aeruginosa PA01
cugggccuuguucaggguggc

SEQ ID NO: 3418266 - RNA, 17 nt, Pseudomonas aeruginosa PA01
cugggcgaccuucagcg

SEQ ID NO: 3418267 - RNA, 18 nt, Pseudomonas aeruginosa PA01
cugggcgaccuucagcgg

SEQ ID NO: 3418268 - RNA, 19 nt, Pseudomonas aeruginosa PA01
cugggcgacgcggacagcc

SEQ ID NO: 3418269 - RNA, 19 nt, Pseudomonas aeruginosa PA01
cugggcgaucacgccgcgc

SEQ ID NO: 3418270 - RNA, 16 nt, Pseudomonas aeruginosa PA01
cugggcgaugcggcgg

SEQ ID NO: 3418271 - RNA, 13 nt, Pseudomonas aeruginosa PA01
cugggcgcagccc

SEQ ID NO: 3418272 - RNA, 15 nt, Pseudomonas aeruginosa PA01
cugggcgcaggccga

SEQ ID NO: 3418273 - RNA, 16 nt, Pseudomonas aeruginosa PA01
cugggcgcaggccgag

SEQ ID NO: 3418274 - RNA, 13 nt, Pseudomonas aeruginosa PA01
cugggcgcagggg

SEQ ID NO: 3418275 - RNA, 18 nt, Pseudomonas aeruginosa PA01
cugggcgcaggggcgcgc

SEQ ID NO: 3418276 - RNA, 20 nt, Pseudomonas aeruginosa PA01
cugggcgcaggggcgcgccg

SEQ ID NO: 3418277 - RNA, 12 nt, Pseudomonas aeruginosa PA01
cugggcgccagc

SEQ ID NO: 3418278 - RNA, 17 nt, Pseudomonas aeruginosa PA01
cugggcgccagccgcca

SEQ ID NO: 3418279 - RNA, 14 nt, Pseudomonas aeruginosa PA01
cugggcgcccuuca

SEQ ID NO: 3418280 - RNA, 18 nt, Pseudomonas aeruginosa PA01
cugggcgcccuucagcgc

SEQ ID NO: 3418281 - RNA, 13 nt, Pseudomonas aeruginosa PA01
cugggcgccgcca

SEQ ID NO: 3418282 - RNA, 19 nt, Pseudomonas aeruginosa PA01
cugggcgccgccagccaga

SEQ ID NO: 3418283 - RNA, 16 nt, Pseudomonas aeruginosa PA01
cugggcgccgccggug

SEQ ID NO: 3418284 - RNA, 17 nt, Pseudomonas aeruginosa PA01
cugggcgccgccggugc

SEQ ID NO: 3418285 - RNA, 18 nt, Pseudomonas aeruginosa PA01
cugggcgccgccggugca

SEQ ID NO: 3418286 - RNA, 15 nt, Pseudomonas aeruginosa PA01
cugggcgccggcagg

SEQ ID NO: 3418287 - RNA, 17 nt, Pseudomonas aeruginosa PA01
cugggcgccggcaggcc

SEQ ID NO: 3418288 - RNA, 19 nt, Pseudomonas aeruginosa PA01
cugggcgccucgucgacgc

SEQ ID NO: 3418289 - RNA, 16 nt, Pseudomonas aeruginosa PA01
cugggcgcgaauggca

SEQ ID NO: 3418290 - RNA, 22 nt, Pseudomonas aeruginosa PA01
cugggcgcgaauggcauucagc

SEQ ID NO: 3418291 - RNA, 10 nt, Pseudomonas aeruginosa PA01
cugggcggcc

SEQ ID NO: 3418292 - RNA, 13 nt, Pseudomonas aeruginosa PA01
cugggcggccagg

SEQ ID NO: 3418293 - RNA, 14 nt, Pseudomonas aeruginosa PA01
cugggcggccaggu

SEQ ID NO: 3418294 - RNA, 22 nt, Pseudomonas aeruginosa PA01
cugggcggccagguugaccagu

SEQ ID NO: 3418295 - RNA, 20 nt, Pseudomonas aeruginosa PA01
cugggcggcgaccugcggca

SEQ ID NO: 3418296 - RNA, 16 nt, Pseudomonas aeruginosa PA01
cugggcggcgaggccg

SEQ ID NO: 3418297 - RNA, 11 nt, Pseudomonas aeruginosa PA01
cugggcggcgg

SEQ ID NO: 3418298 - RNA, 12 nt, Pseudomonas aeruginosa PA01
cugggcggcggg

SEQ ID NO: 3418299 - RNA, 15 nt, Pseudomonas aeruginosa PA01
cugggcggcgggccc

SEQ ID NO: 3418300 - RNA, 15 nt, Pseudomonas aeruginosa PA01
cugggcggucggcuc

SEQ ID NO: 3418301 - RNA, 14 nt, Pseudomonas aeruginosa PA01
cugggcggucucgg

SEQ ID NO: 3418302 - RNA, 15 nt, Pseudomonas aeruginosa PA01
cugggcggucucggc

SEQ ID NO: 3418303 - RNA, 23 nt, Pseudomonas aeruginosa PA01
cugggcguacaggccccaggcga

SEQ ID NO: 3418304 - RNA, 24 nt, Pseudomonas aeruginosa PA01
cugggcgucgaacaccggcgccgc

SEQ ID NO: 3418305 - RNA, 21 nt, Pseudomonas aeruginosa PA01
cugggcgucgacgaacggauc

SEQ ID NO: 3418306 - RNA, 17 nt, Pseudomonas aeruginosa PA01
cugggcgugcuuggcga

SEQ ID NO: 3418307 - RNA, 20 nt, Pseudomonas aeruginosa PA01
cugggcgugcuuggcgaggc

SEQ ID NO: 3418308 - RNA, 22 nt, Pseudomonas aeruginosa PA01
cugggcguggcaaaaaugcccu

SEQ ID NO: 3418309 - RNA, 18 nt, Pseudomonas aeruginosa PA01
cugggcguggcggccgcc

SEQ ID NO: 3418310 - RNA, 16 nt, Pseudomonas aeruginosa PA01
cugggcguuggccagc

SEQ ID NO: 3418311 - RNA, 23 nt, Pseudomonas aeruginosa PA01
cugggcguuggccagcgccacca

SEQ ID NO: 3418312 - RNA, 23 nt, Pseudomonas aeruginosa PA01
cugggcuacaucgucugcgcggc

SEQ ID NO: 3418313 - RNA, 18 nt, Pseudomonas aeruginosa PA01
cugggcuucgcugaugcc

SEQ ID NO: 3418314 - RNA, 22 nt, Pseudomonas aeruginosa PA01
cugggcuucgcugaugccggcg

SEQ ID NO: 3418315 - RNA, 18 nt, Pseudomonas aeruginosa PA01
cugggcuucguccgccug

SEQ ID NO: 3418316 - RNA, 20 nt, Pseudomonas aeruginosa PA01
cugggcuucguccgccuggg

SEQ ID NO: 3418317 - RNA, 15 nt, Pseudomonas aeruginosa PA01
cuggggaacugggcg

SEQ ID NO: 3418318 - RNA, 19 nt, Pseudomonas aeruginosa PA01
cuggggaaucugcgccagg

SEQ ID NO: 3418319 - RNA, 20 nt, Pseudomonas aeruginosa PA01
cuggggaaucugcgccaggu

SEQ ID NO: 3418320 - RNA, 18 nt, Pseudomonas aeruginosa PA01
cuggggauggccggcgcg

SEQ ID NO: 3418321 - RNA, 22 nt, Pseudomonas aeruginosa PA01
cuggggauggccggcgcggcgu

SEQ ID NO: 3418322 - RNA, 18 nt, Pseudomonas aeruginosa PA01
cuggggcaucucggccac

SEQ ID NO: 3418323 - RNA, 17 nt, Pseudomonas aeruginosa PA01
cuggggcaugggcgcgg

SEQ ID NO: 3418324 - RNA, 18 nt, Pseudomonas aeruginosa PA01
cuggggcaugggcgcggg

SEQ ID NO: 3418325 - RNA, 18 nt, Pseudomonas aeruginosa PA01
cuggggcggccucaggcc

SEQ ID NO: 3418326 - RNA, 16 nt, Pseudomonas aeruginosa PA01
cuggggugaggccgag

SEQ ID NO: 3418327 - RNA, 13 nt, Pseudomonas aeruginosa PA01
cuggggugcagca

SEQ ID NO: 3418328 - RNA, 21 nt, Pseudomonas aeruginosa PA01
cugggguugcggcgcccgcca

SEQ ID NO: 3418329 - RNA, 13 nt, Pseudomonas aeruginosa PA01
cuggguacaguga

SEQ ID NO: 3418330 - RNA, 20 nt, Pseudomonas aeruginosa PA01
cuggguaccgacggucggca

SEQ ID NO: 3418331 - RNA, 21 nt, Pseudomonas aeruginosa PA01
cuggguagauuuacaagccca

SEQ ID NO: 3418332 - RNA, 18 nt, Pseudomonas aeruginosa PA01
cuggguauagaccagcac

SEQ ID NO: 3418333 - RNA, 15 nt, Pseudomonas aeruginosa PA01
cuggguaugcgcggu

SEQ ID NO: 3418334 - RNA, 23 nt, Pseudomonas aeruginosa PA01
cuggguaugcgcggucaccaggg

SEQ ID NO: 3418335 - RNA, 17 nt, Pseudomonas aeruginosa PA01
cugggucaucgaggcca

SEQ ID NO: 3418336 - RNA, 19 nt, Pseudomonas aeruginosa PA01
cugggucaucgaggccauc

SEQ ID NO: 3418337 - RNA, 17 nt, Pseudomonas aeruginosa PA01
cugggucgacugcuggg

SEQ ID NO: 3418338 - RNA, 22 nt, Pseudomonas aeruginosa PA01
cugggucgauuccugucuccgc

SEQ ID NO: 3418339 - RNA, 17 nt, Pseudomonas aeruginosa PA01
cugggucgcgcagggca

SEQ ID NO: 3418340 - RNA, 13 nt, Pseudomonas aeruginosa PA01
cugggucggcugg

SEQ ID NO: 3418341 - RNA, 16 nt, Pseudomonas aeruginosa PA01
cugggucggcuggcag

SEQ ID NO: 3418342 - RNA, 23 nt, Pseudomonas aeruginosa PA01
cugggucggcuggcagggcgcgu

SEQ ID NO: 3418343 - RNA, 17 nt, Pseudomonas aeruginosa PA01
cugggugaacagcggcc

SEQ ID NO: 3418344 - RNA, 13 nt, Pseudomonas aeruginosa PA01
cugggugaccagc

SEQ ID NO: 3418345 - RNA, 16 nt, Pseudomonas aeruginosa PA01
cugggugaccagcagg

SEQ ID NO: 3418346 - RNA, 23 nt, Pseudomonas aeruginosa PA01
cugggugauuucuucagccuggg

SEQ ID NO: 3418347 - RNA, 14 nt, Pseudomonas aeruginosa PA01
cugggugccgcgaa

SEQ ID NO: 3418348 - RNA, 15 nt, Pseudomonas aeruginosa PA01
cugggugccgcgaau

SEQ ID NO: 3418349 - RNA, 15 nt, Pseudomonas aeruginosa PA01
cugggugcggugggc

SEQ ID NO: 3418350 - RNA, 13 nt, Pseudomonas aeruginosa PA01
cugggugcuuucc

SEQ ID NO: 3418351 - RNA, 17 nt, Pseudomonas aeruginosa PA01
cuggguggaggcccaga

SEQ ID NO: 3418352 - RNA, 14 nt, Pseudomonas aeruginosa PA01
cuggguggcgacga

SEQ ID NO: 3418353 - RNA, 15 nt, Pseudomonas aeruginosa PA01
cuggguggcgacgaa

SEQ ID NO: 3418354 - RNA, 18 nt, Pseudomonas aeruginosa PA01
cuggguggcgacgaagac

SEQ ID NO: 3418355 - RNA, 19 nt, Pseudomonas aeruginosa PA01
cuggguggucugcacggca

SEQ ID NO: 3418356 - RNA, 22 nt, Pseudomonas aeruginosa PA01
cuggguguccuucaugaacaca

SEQ ID NO: 3418357 - RNA, 17 nt, Pseudomonas aeruginosa PA01
cugggugucgaccuccg

SEQ ID NO: 3418358 - RNA, 23 nt, Pseudomonas aeruginosa PA01
cggccugcacguggaguucaccg

SEQ ID NO: 3418359 - RNA, 17 nt, Pseudomonas aeruginosa PA01
cggccugccccgccggc

SEQ ID NO: 3418360 - RNA, 16 nt, Pseudomonas aeruginosa PA01
cggccugccguugcac

SEQ ID NO: 3418361 - RNA, 14 nt, Pseudomonas aeruginosa PA01
cggccugcgccgga

SEQ ID NO: 3418362 - RNA, 15 nt, Pseudomonas aeruginosa PA01
cggccugcgccggac

SEQ ID NO: 3418363 - RNA, 16 nt, Pseudomonas aeruginosa PA01
cggccugcgccggacc

SEQ ID NO: 3418364 - RNA, 14 nt, Pseudomonas aeruginosa PA01
cggccugcgcgcac

SEQ ID NO: 3418365 - RNA, 18 nt, Pseudomonas aeruginosa PA01
cggccugcgcgcaccagg

SEQ ID NO: 3418366 - RNA, 19 nt, Pseudomonas aeruginosa PA01
cggccugcgcgcaccaggc

SEQ ID NO: 3418367 - RNA, 22 nt, Pseudomonas aeruginosa PA01
cggccugcgcgcaccaggccuc

SEQ ID NO: 3418368 - RNA, 23 nt, Pseudomonas aeruginosa PA01
cggccugcgcgcaccaggccucc

SEQ ID NO: 3418369 - RNA, 20 nt, Pseudomonas aeruginosa PA01
cggccugcggguucggcgag

SEQ ID NO: 3418370 - RNA, 21 nt, Pseudomonas aeruginosa PA01
cggccugcucgcgcagccagg

SEQ ID NO: 3418371 - RNA, 22 nt, Pseudomonas aeruginosa PA01
cggccugcucgcgcagccaggc

SEQ ID NO: 3418372 - RNA, 17 nt, Pseudomonas aeruginosa PA01
cggccugcucggcucgc

SEQ ID NO: 3418373 - RNA, 16 nt, Pseudomonas aeruginosa PA01
cggccugcugcgccgg

SEQ ID NO: 3418374 - RNA, 19 nt, Pseudomonas aeruginosa PA01
cggccugcugcgccggcac

SEQ ID NO: 3418375 - RNA, 22 nt, Pseudomonas aeruginosa PA01
cggccugcugcgccggcacggc

SEQ ID NO: 3418376 - RNA, 13 nt, Pseudomonas aeruginosa PA01
cggccugcugcuc

SEQ ID NO: 3418377 - RNA, 15 nt, Pseudomonas aeruginosa PA01
cggccugcugcucga

SEQ ID NO: 3418378 - RNA, 21 nt, Pseudomonas aeruginosa PA01
cggccugcugcucgaccgccu

SEQ ID NO: 3418379 - RNA, 17 nt, Pseudomonas aeruginosa PA01
cggccuggaucgccuug

SEQ ID NO: 3418380 - RNA, 20 nt, Pseudomonas aeruginosa PA01
cggccuggaucgccuugcgc

SEQ ID NO: 3418381 - RNA, 21 nt, Pseudomonas aeruginosa PA01
cggccuggaucgccuugcgcg

SEQ ID NO: 3418382 - RNA, 20 nt, Pseudomonas aeruginosa PA01
cggccuggaucucggcggcc

SEQ ID NO: 3418383 - RNA, 21 nt, Pseudomonas aeruginosa PA01
cggccuggaucucggcggcca

SEQ ID NO: 3418384 - RNA, 23 nt, Pseudomonas aeruginosa PA01
cggccuggaucucggcggccagg

SEQ ID NO: 3418385 - RNA, 18 nt, Pseudomonas aeruginosa PA01
cggccuggaucucugcga

SEQ ID NO: 3418386 - RNA, 20 nt, Pseudomonas aeruginosa PA01
cggccuggaucucugcgaga

SEQ ID NO: 3418387 - RNA, 12 nt, Pseudomonas aeruginosa PA01
cggccuggcgca

SEQ ID NO: 3418388 - RNA, 17 nt, Pseudomonas aeruginosa PA01
cggccuggcgcagcggc

SEQ ID NO: 3418389 - RNA, 18 nt, Pseudomonas aeruginosa PA01
cggccuggcgcagcggca

SEQ ID NO: 3418390 - RNA, 20 nt, Pseudomonas aeruginosa PA01
cggccuggcgcagcggcagc

SEQ ID NO: 3418391 - RNA, 14 nt, Pseudomonas aeruginosa PA01
cggccuggcgccgg

SEQ ID NO: 3418392 - RNA, 15 nt, Pseudomonas aeruginosa PA01
cggccuggcgccggg

SEQ ID NO: 3418393 - RNA, 16 nt, Pseudomonas aeruginosa PA01
cggccuggcgccgggg

SEQ ID NO: 3418394 - RNA, 12 nt, Pseudomonas aeruginosa PA01
cggccuggcgcg

SEQ ID NO: 3418395 - RNA, 15 nt, Pseudomonas aeruginosa PA01
cggccuggcgcgcgc

SEQ ID NO: 3418396 - RNA, 21 nt, Pseudomonas aeruginosa PA01
cggccuggcgcgcgcgccagg

SEQ ID NO: 3418397 - RNA, 20 nt, Pseudomonas aeruginosa PA01
cggccuggcgguugaugccg

SEQ ID NO: 3418398 - RNA, 22 nt, Pseudomonas aeruginosa PA01
cggccuggcgguugaugccgac

SEQ ID NO: 3418399 - RNA, 11 nt, Pseudomonas aeruginosa PA01
cggccugggcc

SEQ ID NO: 3418400 - RNA, 18 nt, Pseudomonas aeruginosa PA01
cggccugggccgaaggcc

SEQ ID NO: 3418401 - RNA, 22 nt, Pseudomonas aeruginosa PA01
cggccugggccgaaggccaggc

SEQ ID NO: 3418402 - RNA, 23 nt, Pseudomonas aeruginosa PA01
cggccugggccgaaggccaggcc

SEQ ID NO: 3418403 - RNA, 15 nt, Pseudomonas aeruginosa PA01
cggccugggcgcagg

SEQ ID NO: 3418404 - RNA, 16 nt, Pseudomonas aeruginosa PA01
cggccugggcgcaggc

SEQ ID NO: 3418405 - RNA, 14 nt, Pseudomonas aeruginosa PA01
cggccuggggcucg

SEQ ID NO: 3418406 - RNA, 22 nt, Pseudomonas aeruginosa PA01
cggccuggggcucggcuuccau

SEQ ID NO: 3418407 - RNA, 16 nt, Pseudomonas aeruginosa PA01
cggccuggguacgcac

SEQ ID NO: 3418408 - RNA, 20 nt, Pseudomonas aeruginosa PA01
cggccuggguacgcaccggc

SEQ ID NO: 3418409 - RNA, 21 nt, Pseudomonas aeruginosa PA01
cggccuggguacgcaccggcu

SEQ ID NO: 3418410 - RNA, 21 nt, Pseudomonas aeruginosa PA01
cggccugggugaacagcggcc

SEQ ID NO: 3418411 - RNA, 22 nt, Pseudomonas aeruginosa PA01
cggccugggugaacagcggccc

SEQ ID NO: 3418412 - RNA, 15 nt, Pseudomonas aeruginosa PA01
cggccugguaggccu

SEQ ID NO: 3418413 - RNA, 16 nt, Pseudomonas aeruginosa PA01
cggccugguagucgcc

SEQ ID NO: 3418414 - RNA, 22 nt, Pseudomonas aeruginosa PA01
cggccugguagucgccggucag

SEQ ID NO: 3418415 - RNA, 14 nt, Pseudomonas aeruginosa PA01
cggccugguccggc

SEQ ID NO: 3418416 - RNA, 16 nt, Pseudomonas aeruginosa PA01
cggccugguccggcac

SEQ ID NO: 3418417 - RNA, 17 nt, Pseudomonas aeruginosa PA01
cggccuggugacccgga

SEQ ID NO: 3418418 - RNA, 21 nt, Pseudomonas aeruginosa PA01
cggccuggugacccggacagc

SEQ ID NO: 3418419 - RNA, 16 nt, Pseudomonas aeruginosa PA01
cggccuggugcaccug

SEQ ID NO: 3418420 - RNA, 19 nt, Pseudomonas aeruginosa PA01
cggccuggugcaccuggcg

SEQ ID NO: 3418421 - RNA, 20 nt, Pseudomonas aeruginosa PA01
cggccuggugcaccuggcga

SEQ ID NO: 3418422 - RNA, 17 nt, Pseudomonas aeruginosa PA01
cggccuggugccgggcu

SEQ ID NO: 3418423 - RNA, 18 nt, Pseudomonas aeruginosa PA01
cggccuguaccgcuuccu

SEQ ID NO: 3418424 - RNA, 15 nt, Pseudomonas aeruginosa PA01
cggccugucacgccg

SEQ ID NO: 3418425 - RNA, 17 nt, Pseudomonas aeruginosa PA01
cggccugucacgccggg

SEQ ID NO: 3418426 - RNA, 18 nt, Pseudomonas aeruginosa PA01
cggccugucacgccgggg

SEQ ID NO: 3418427 - RNA, 15 nt, Pseudomonas aeruginosa PA01
cggccuucaccgcgc

SEQ ID NO: 3418428 - RNA, 18 nt, Pseudomonas aeruginosa PA01
cggccuucaccgcgccgc

SEQ ID NO: 3418429 - RNA, 17 nt, Pseudomonas aeruginosa PA01
cggccuucacgcagcuc

SEQ ID NO: 3418430 - RNA, 22 nt, Pseudomonas aeruginosa PA01
cggccuucacgcagcucugcga

SEQ ID NO: 3418431 - RNA, 18 nt, Pseudomonas aeruginosa PA01
cggccuucagcgguggcg

SEQ ID NO: 3418432 - RNA, 15 nt, Pseudomonas aeruginosa PA01
cggccuucgacgaug

SEQ ID NO: 3418433 - RNA, 15 nt, Pseudomonas aeruginosa PA01
cggccuucggcagga

SEQ ID NO: 3418434 - RNA, 18 nt, Pseudomonas aeruginosa PA01
cggccuucggcaggaagg

SEQ ID NO: 3418435 - RNA, 14 nt, Pseudomonas aeruginosa PA01
cggccuucggcguc

SEQ ID NO: 3418436 - RNA, 16 nt, Pseudomonas aeruginosa PA01
cggccuucucgucgcc

SEQ ID NO: 3418437 - RNA, 20 nt, Pseudomonas aeruginosa PA01
cggccuucucgucgccgccc

SEQ ID NO: 3418438 - RNA, 19 nt, Pseudomonas aeruginosa PA01
cggccuucuugcugccggc

SEQ ID NO: 3418439 - RNA, 21 nt, Pseudomonas aeruginosa PA01
cggccuucuugcugccggcgu

SEQ ID NO: 3418440 - RNA, 14 nt, Pseudomonas aeruginosa PA01
cggccuugagcgcc

SEQ ID NO: 3418441 - RNA, 13 nt, Pseudomonas aeruginosa PA01
cggccuugcuggc

SEQ ID NO: 3418442 - RNA, 15 nt, Pseudomonas aeruginosa PA01
cggccuugcuggcga

SEQ ID NO: 3418443 - RNA, 19 nt, Pseudomonas aeruginosa PA01
cggccuuggucaucagcac

SEQ ID NO: 3418444 - RNA, 17 nt, Pseudomonas aeruginosa PA01
cggccuuggucucgauc

SEQ ID NO: 3418445 - RNA, 19 nt, Pseudomonas aeruginosa PA01
cggccuuggucucgaucag

SEQ ID NO: 3418446 - RNA, 20 nt, Pseudomonas aeruginosa PA01
cggccuuggucucgaucagc

SEQ ID NO: 3418447 - RNA, 16 nt, Pseudomonas aeruginosa PA01
cggccuuguccgcgcg

SEQ ID NO: 3418448 - RNA, 18 nt, Pseudomonas aeruginosa PA01
cggccuuguccgcgcgcu

SEQ ID NO: 3418449 - RNA, 22 nt, Pseudomonas aeruginosa PA01
cggccuuguccgcgcgcuucca

SEQ ID NO: 3418450 - RNA, 16 nt, Pseudomonas aeruginosa PA01
cggccuuguccggcac

SEQ ID NO: 3418451 - RNA, 18 nt, Pseudomonas aeruginosa PA01
cggccuuuucucugcauc

SEQ ID NO: 3418452 - RNA, 21 nt, Pseudomonas aeruginosa PA01
cggccuuuuucucguucgggc

SEQ ID NO: 3418453 - RNA, 15 nt, Pseudomonas aeruginosa PA01
cggcgaaaccggcca

SEQ ID NO: 3418454 - RNA, 17 nt, Pseudomonas aeruginosa PA01
cggcgaaaccggccagc

SEQ ID NO: 3418455 - RNA, 20 nt, Pseudomonas aeruginosa PA01
cggcgaaagccggaccucuc

SEQ ID NO: 3418456 - RNA, 14 nt, Pseudomonas aeruginosa PA01
cggcgaaauccucg

SEQ ID NO: 3418457 - RNA, 23 nt, Pseudomonas aeruginosa PA01
cggcgaaauccucgcgcaccgcc

SEQ ID NO: 3418458 - RNA, 19 nt, Pseudomonas aeruginosa PA01
cggcgaaaugcaggccggu

SEQ ID NO: 3418459 - RNA, 22 nt, Pseudomonas aeruginosa PA01
cggcgaaaugcaggccgguggu

SEQ ID NO: 3418460 - RNA, 23 nt, Pseudomonas aeruginosa PA01
cggcgaaauggguucccagcagc

SEQ ID NO: 3418461 - RNA, 15 nt, Pseudomonas aeruginosa PA01
cggcgaacaccgggc

SEQ ID NO: 3418462 - RNA, 19 nt, Pseudomonas aeruginosa PA01
cggcgaacaccgggccgcc

SEQ ID NO: 3418463 - RNA, 23 nt, Pseudomonas aeruginosa PA01
cggcgaacaccgggccgccggcg

SEQ ID NO: 3418464 - RNA, 15 nt, Pseudomonas aeruginosa PA01
cggcgaacagccagc

SEQ ID NO: 3418465 - RNA, 18 nt, Pseudomonas aeruginosa PA01
cggcgaacagguagcccc

SEQ ID NO: 3418466 - RNA, 16 nt, Pseudomonas aeruginosa PA01
cggcgaacaucaucca

SEQ ID NO: 3418467 - RNA, 15 nt, Pseudomonas aeruginosa PA01
cggcgaaccagugca

SEQ ID NO: 3418468 - RNA, 20 nt, Pseudomonas aeruginosa PA01
cggcgaaccagugcaccgcc

SEQ ID NO: 3418469 - RNA, 16 nt, Pseudomonas aeruginosa PA01
cggcgaacccggcgcg

SEQ ID NO: 3418470 - RNA, 21 nt, Pseudomonas aeruginosa PA01
cggcgaacccggcgcggcgca

SEQ ID NO: 3418471 - RNA, 23 nt, Pseudomonas aeruginosa PA01
cggcgaacccggcgcggcgcagc

SEQ ID NO: 3418472 - RNA, 15 nt, Pseudomonas aeruginosa PA01
cggcgaacgacagca

SEQ ID NO: 3418473 - RNA, 23 nt, Pseudomonas aeruginosa PA01
cggcgaacgacagcaccaugccc

SEQ ID NO: 3418474 - RNA, 15 nt, Pseudomonas aeruginosa PA01
cggcgaacgcuugag

SEQ ID NO: 3418475 - RNA, 19 nt, Pseudomonas aeruginosa PA01
cggcgaacgcuugagcccc

SEQ ID NO: 3418476 - RNA, 21 nt, Pseudomonas aeruginosa PA01
cggcgaacgcuugagccccgg

SEQ ID NO: 3418477 - RNA, 22 nt, Pseudomonas aeruginosa PA01
cggcgaacgcuugagccccggc

SEQ ID NO: 3418478 - RNA, 14 nt, Pseudomonas aeruginosa PA01
cggcgaacggaccg

SEQ ID NO: 3418479 - RNA, 16 nt, Pseudomonas aeruginosa PA01
cggcgaacggaccgac

SEQ ID NO: 3418480 - RNA, 20 nt, Pseudomonas aeruginosa PA01
cggcgaacggaccgacguug

SEQ ID NO: 3418481 - RNA, 16 nt, Pseudomonas aeruginosa PA01
cggcgaacggcaugcg

SEQ ID NO: 3418482 - RNA, 17 nt, Pseudomonas aeruginosa PA01
cggcgaacuccgccagc

SEQ ID NO: 3418483 - RNA, 18 nt, Pseudomonas aeruginosa PA01
cggcgaacuccgccagcu

SEQ ID NO: 3418484 - RNA, 19 nt, Pseudomonas aeruginosa PA01
cggcgaacucguagacgaa

SEQ ID NO: 3418485 - RNA, 14 nt, Pseudomonas aeruginosa PA01
cggcgaacuggcca

SEQ ID NO: 3418486 - RNA, 14 nt, Pseudomonas aeruginosa PA01
cggcgaagaacagc

SEQ ID NO: 3418487 - RNA, 14 nt, Pseudomonas aeruginosa PA01
cggcgaagccgcgc

SEQ ID NO: 3418488 - RNA, 17 nt, Pseudomonas aeruginosa PA01
cggcgaagccgcgcccg

SEQ ID NO: 3418489 - RNA, 12 nt, Pseudomonas aeruginosa PA01
cggcgaagcgcu

SEQ ID NO: 3418490 - RNA, 16 nt, Pseudomonas aeruginosa PA01
cggcgaagcggaagcg

SEQ ID NO: 3418491 - RNA, 20 nt, Pseudomonas aeruginosa PA01
cggcgaagcggcccuugucg

SEQ ID NO: 3418492 - RNA, 22 nt, Pseudomonas aeruginosa PA01
cggcgaagcggcccuugucgcc

SEQ ID NO: 3418493 - RNA, 12 nt, Pseudomonas aeruginosa PA01
cggcgaagcguu

SEQ ID NO: 3418494 - RNA, 20 nt, Pseudomonas aeruginosa PA01
cggcgaagcguugcagcguc

SEQ ID NO: 3418495 - RNA, 23 nt, Pseudomonas aeruginosa PA01
cggcgaagcuccucgauaaacgg

SEQ ID NO: 3418496 - RNA, 18 nt, Pseudomonas aeruginosa PA01
cggcgaaggccgcuuggc

SEQ ID NO: 3418497 - RNA, 16 nt, Pseudomonas aeruginosa PA01
cggcgaagggcaggcc

SEQ ID NO: 3418498 - RNA, 19 nt, Pseudomonas aeruginosa PA01
cggcgaagggcaggccgau

SEQ ID NO: 3418499 - RNA, 14 nt, Pseudomonas aeruginosa PA01
cggcgaagggcgcu

SEQ ID NO: 3418500 - RNA, 20 nt, Pseudomonas aeruginosa PA01
cggcgaagggcgcuucggcg

SEQ ID NO: 3418501 - RNA, 15 nt, Pseudomonas aeruginosa PA01
cggcgaagguggcga

SEQ ID NO: 3418502 - RNA, 22 nt, Pseudomonas aeruginosa PA01
cggcgaaguaggaguaggucac

SEQ ID NO: 3418503 - RNA, 18 nt, Pseudomonas aeruginosa PA01
cggcgaaguccaccaggc

SEQ ID NO: 3418504 - RNA, 21 nt, Pseudomonas aeruginosa PA01
cggcgaaguccaccaggcgcc

SEQ ID NO: 3418505 - RNA, 21 nt, Pseudomonas aeruginosa PA01
cggcgaaguccggguugagca

SEQ ID NO: 3418506 - RNA, 23 nt, Pseudomonas aeruginosa PA01
cggcgaaguccggguugagcacc

SEQ ID NO: 3418507 - RNA, 15 nt, Pseudomonas aeruginosa PA01
cggcgaagucgccgu

SEQ ID NO: 3418508 - RNA, 16 nt, Pseudomonas aeruginosa PA01
cggcgaauucgucgcc

SEQ ID NO: 3418509 - RNA, 17 nt, Pseudomonas aeruginosa PA01
cggcgaauucgucgccg

SEQ ID NO: 3418510 - RNA, 23 nt, Pseudomonas aeruginosa PA01
cggcgaauucgucgccgccgagg

SEQ ID NO: 3418511 - RNA, 13 nt, Pseudomonas aeruginosa PA01
cggcgacaccccg

SEQ ID NO: 3418512 - RNA, 13 nt, Pseudomonas aeruginosa PA01
cggcgacaccgcc

SEQ ID NO: 3418513 - RNA, 14 nt, Pseudomonas aeruginosa PA01
cggcgacaccgcca

SEQ ID NO: 3418514 - RNA, 16 nt, Pseudomonas aeruginosa PA01
cggcgacaccgccagc

SEQ ID NO: 3418515 - RNA, 18 nt, Pseudomonas aeruginosa PA01
cggcgacaccgccagcac

SEQ ID NO: 3418516 - RNA, 16 nt, Pseudomonas aeruginosa PA01
cggcgacagcaccacg

SEQ ID NO: 3418517 - RNA, 19 nt, Pseudomonas aeruginosa PA01
cggcgacagcaccacgccg

SEQ ID NO: 3418518 - RNA, 16 nt, Pseudomonas aeruginosa PA01
cggcgacagccgggca

SEQ ID NO: 3418519 - RNA, 17 nt, Pseudomonas aeruginosa PA01
cggcgacagccgggcag

SEQ ID NO: 3418520 - RNA, 18 nt, Pseudomonas aeruginosa PA01
cggcgacagccgggcagc

SEQ ID NO: 3418521 - RNA, 16 nt, Pseudomonas aeruginosa PA01
cggcgaccaacagggc

SEQ ID NO: 3418522 - RNA, 17 nt, Pseudomonas aeruginosa PA01
cggcgaccaacagggcg

SEQ ID NO: 3418523 - RNA, 12 nt, Pseudomonas aeruginosa PA01
cggcgaccacca

SEQ ID NO: 3418524 - RNA, 20 nt, Pseudomonas aeruginosa PA01
cggcgaccaccacgucgaug

SEQ ID NO: 3418525 - RNA, 13 nt, Pseudomonas aeruginosa PA01
cggcgaccaccgc

SEQ ID NO: 3418526 - RNA, 14 nt, Pseudomonas aeruginosa PA01
cggcgaccaccgcc

SEQ ID NO: 3418527 - RNA, 18 nt, Pseudomonas aeruginosa PA01
cggcgaccaccgccggga

SEQ ID NO: 3418528 - RNA, 20 nt, Pseudomonas aeruginosa PA01
cggcgaccaccgcgaauccg

SEQ ID NO: 3418529 - RNA, 15 nt, Pseudomonas aeruginosa PA01
cggcgaccagcccgc

SEQ ID NO: 3418530 - RNA, 13 nt, Pseudomonas aeruginosa PA01
cggcgaccagcgc

SEQ ID NO: 3418531 - RNA, 13 nt, Pseudomonas aeruginosa PA01
cggcgaccagcgu

SEQ ID NO: 3418532 - RNA, 21 nt, Pseudomonas aeruginosa PA01
cggcgaccagcgucgcgcgug

SEQ ID NO: 3418533 - RNA, 22 nt, Pseudomonas aeruginosa PA01
cggcgaccagcgucgcgcgugc

SEQ ID NO: 3418534 - RNA, 21 nt, Pseudomonas aeruginosa PA01
cggcgaccagcucgaagccgc

SEQ ID NO: 3418535 - RNA, 13 nt, Pseudomonas aeruginosa PA01
cggcgaccaucca

SEQ ID NO: 3418536 - RNA, 19 nt, Pseudomonas aeruginosa PA01
cggcgaccauccagccugc

SEQ ID NO: 3418537 - RNA, 21 nt, Pseudomonas aeruginosa PA01
cggcgaccauguucaccagcg

SEQ ID NO: 3418538 - RNA, 13 nt, Pseudomonas aeruginosa PA01
cggcgaccauuca

SEQ ID NO: 3418539 - RNA, 19 nt, Pseudomonas aeruginosa PA01
cggcgacccagaccugccg

SEQ ID NO: 3418540 - RNA, 22 nt, Pseudomonas aeruginosa PA01
cggcgacccagaccugccgccc

SEQ ID NO: 3418541 - RNA, 17 nt, Pseudomonas aeruginosa PA01
cggcgaccccgaucacc

SEQ ID NO: 3418542 - RNA, 18 nt, Pseudomonas aeruginosa PA01
cggcgaccccgaucaccg

SEQ ID NO: 3418543 - RNA, 20 nt, Pseudomonas aeruginosa PA01
cggcgaccccgaucaccgga

SEQ ID NO: 3418544 - RNA, 18 nt, Pseudomonas aeruginosa PA01
cggcgacccgaaggucgc

SEQ ID NO: 3418545 - RNA, 15 nt, Pseudomonas aeruginosa PA01
cggcgacccuggggu

SEQ ID NO: 3418546 - RNA, 17 nt, Pseudomonas aeruginosa PA01
cggcgaccgaacagcgc

SEQ ID NO: 3418547 - RNA, 18 nt, Pseudomonas aeruginosa PA01
cggcgaccgaacagcgcg

SEQ ID NO: 3418548 - RNA, 20 nt, Pseudomonas aeruginosa PA01
cggcgaccgaacagcgcgcc

SEQ ID NO: 3418549 - RNA, 20 nt, Pseudomonas aeruginosa PA01
cggcgaccgcaucguuggcg

SEQ ID NO: 3418550 - RNA, 15 nt, Pseudomonas aeruginosa PA01
cggcgaccgcuggac

SEQ ID NO: 3418551 - RNA, 23 nt, Pseudomonas aeruginosa PA01
cggcgaccggccucacggguguu

SEQ ID NO: 3418552 - RNA, 22 nt, Pseudomonas aeruginosa PA01
cggcgaccucagucgugcaggu

SEQ ID NO: 3418553 - RNA, 16 nt, Pseudomonas aeruginosa PA01
cggcgaccucuucgga

SEQ ID NO: 3418554 - RNA, 12 nt, Pseudomonas aeruginosa PA01
cggcgaccugcg

SEQ ID NO: 3418555 - RNA, 14 nt, Pseudomonas aeruginosa PA01
cggcgaccugggcg

SEQ ID NO: 3418556 - RNA, 11 nt, Pseudomonas aeruginosa PA01
cggcgaccugu

SEQ ID NO: 3418557 - RNA, 18 nt, Pseudomonas aeruginosa PA01
cggcgaccuugcgcacca

SEQ ID NO: 3418558 - RNA, 19 nt, Pseudomonas aeruginosa PA01
cggcgaccuugcgcaccag

SEQ ID NO: 3418559 - RNA, 18 nt, Pseudomonas aeruginosa PA01
cggcgaccuuguccaggc

SEQ ID NO: 3418560 - RNA, 21 nt, Pseudomonas aeruginosa PA01
cggcgaccuuguccugcggcc

SEQ ID NO: 3418561 - RNA, 23 nt, Pseudomonas aeruginosa PA01
cggcgaccuuguccugcggccgg

SEQ ID NO: 3418562 - RNA, 19 nt, Pseudomonas aeruginosa PA01
cggcgacgaaagacgcugc

SEQ ID NO: 3418563 - RNA, 18 nt, Pseudomonas aeruginosa PA01
cggcgacgaagcccaggc

SEQ ID NO: 3418564 - RNA, 20 nt, Pseudomonas aeruginosa PA01
cggcgacgaagcccaggcug

SEQ ID NO: 3418565 - RNA, 14 nt, Pseudomonas aeruginosa PA01
cggcgacgaaggcc

SEQ ID NO: 3418566 - RNA, 18 nt, Pseudomonas aeruginosa PA01
cggcgacgaaggccuggu

SEQ ID NO: 3418567 - RNA, 20 nt, Pseudomonas aeruginosa PA01
cggcgacgaaggccuggucg

SEQ ID NO: 3418568 - RNA, 21 nt, Pseudomonas aeruginosa PA01
cggcgacgaaggccuggucga

SEQ ID NO: 3418569 - RNA, 17 nt, Pseudomonas aeruginosa PA01
cggcgacgaagguaucg

SEQ ID NO: 3418570 - RNA, 22 nt, Pseudomonas aeruginosa PA01
cggcgacgaagguaucgaaguc

SEQ ID NO: 3418571 - RNA, 23 nt, Pseudomonas aeruginosa PA01
cggcgacgaagguaucgaagucg

SEQ ID NO: 3418572 - RNA, 16 nt, Pseudomonas aeruginosa PA01
cggcgacgaaggucgg

SEQ ID NO: 3418573 - RNA, 17 nt, Pseudomonas aeruginosa PA01
cggcgacgaaggucggc

SEQ ID NO: 3418574 - RNA, 19 nt, Pseudomonas aeruginosa PA01
cggcgacgaaggucggcgg

SEQ ID NO: 3418575 - RNA, 14 nt, Pseudomonas aeruginosa PA01
cggcgacgacgaag

SEQ ID NO: 3418576 - RNA, 20 nt, Pseudomonas aeruginosa PA01
cggcgacgacgaucccggcg

SEQ ID NO: 3418577 - RNA, 22 nt, Pseudomonas aeruginosa PA01
cggcgacgacgaucccggcggu

SEQ ID NO: 3418578 - RNA, 13 nt, Pseudomonas aeruginosa PA01
cggcgacgaucac

SEQ ID NO: 3418579 - RNA, 19 nt, Pseudomonas aeruginosa PA01
cggcgacgaucacccccag

SEQ ID NO: 3418580 - RNA, 20 nt, Pseudomonas aeruginosa PA01
cggcgacgaucacccccagc

SEQ ID NO: 3418581 - RNA, 21 nt, Pseudomonas aeruginosa PA01
cggcgacgaucacccccagcg

SEQ ID NO: 3418582 - RNA, 14 nt, Pseudomonas aeruginosa PA01
cggcgacgaugccg

SEQ ID NO: 3418583 - RNA, 17 nt, Pseudomonas aeruginosa PA01
cggcgacgaugccgccg

SEQ ID NO: 3418584 - RNA, 15 nt, Pseudomonas aeruginosa PA01
cggcgacgcaggacg

SEQ ID NO: 3418585 - RNA, 18 nt, Pseudomonas aeruginosa PA01
cggcgacgcggauaccga

SEQ ID NO: 3418586 - RNA, 14 nt, Pseudomonas aeruginosa PA01
cggcgacgcuggcg

SEQ ID NO: 3418587 - RNA, 15 nt, Pseudomonas aeruginosa PA01
cggcgacgcuggcgg

SEQ ID NO: 3418588 - RNA, 20 nt, Pseudomonas aeruginosa PA01
cggcgacgggaagcgaacca

SEQ ID NO: 3418589 - RNA, 17 nt, Pseudomonas aeruginosa PA01
cggcgacgggcuucgcg

SEQ ID NO: 3418590 - RNA, 20 nt, Pseudomonas aeruginosa PA01
cggcgacgggcuucgcgacc

SEQ ID NO: 3418591 - RNA, 17 nt, Pseudomonas aeruginosa PA01
cggcgacgucgccguga

SEQ ID NO: 3418592 - RNA, 18 nt, Pseudomonas aeruginosa PA01
cggcgagaaaggcugcuu

SEQ ID NO: 3418593 - RNA, 20 nt, Pseudomonas aeruginosa PA01
cggcgagaaagucgaucagc

SEQ ID NO: 3418594 - RNA, 23 nt, Pseudomonas aeruginosa PA01
cggcgagaaagucgaucagcgcg

SEQ ID NO: 3418595 - RNA, 20 nt, Pseudomonas aeruginosa PA01
cggcgagacuaccgaucggc

SEQ ID NO: 3418596 - RNA, 15 nt, Pseudomonas aeruginosa PA01
cggcgagagcgccga

SEQ ID NO: 3418597 - RNA, 21 nt, Pseudomonas aeruginosa PA01
cggcgagagcguccggcaggg

SEQ ID NO: 3418598 - RNA, 14 nt, Pseudomonas aeruginosa PA01
cggcgagaggucgg

SEQ ID NO: 3418599 - RNA, 17 nt, Pseudomonas aeruginosa PA01
cggcgagaggucggcgc

SEQ ID NO: 3418600 - RNA, 18 nt, Pseudomonas aeruginosa PA01
cggcgagaggucggcgcg

SEQ ID NO: 3418601 - RNA, 19 nt, Pseudomonas aeruginosa PA01
cggcgagaggucggcgcgc

SEQ ID NO: 3418602 - RNA, 21 nt, Pseudomonas aeruginosa PA01
cggcgagaggucggcgcgccc

SEQ ID NO: 3418603 - RNA, 22 nt, Pseudomonas aeruginosa PA01
cggcgagaggucggcgcgcccg

SEQ ID NO: 3418604 - RNA, 15 nt, Pseudomonas aeruginosa PA01
cggcgagaucuucag

SEQ ID NO: 3418605 - RNA, 21 nt, Pseudomonas aeruginosa PA01
cggcgagaucuucaggccgaa

SEQ ID NO: 3418606 - RNA, 22 nt, Pseudomonas aeruginosa PA01
cggcgagaucuucaggccgaag

SEQ ID NO: 3418607 - RNA, 16 nt, Pseudomonas aeruginosa PA01
cggcgagauugcgcug

SEQ ID NO: 3418608 - RNA, 13 nt, Pseudomonas aeruginosa PA01
cggcgagcacggc

SEQ ID NO: 3418609 - RNA, 15 nt, Pseudomonas aeruginosa PA01
cggcgagcacggcga

SEQ ID NO: 3418610 - RNA, 16 nt, Pseudomonas aeruginosa PA01
cggcgagcacggcgaa

SEQ ID NO: 3418611 - RNA, 21 nt, Pseudomonas aeruginosa PA01
cggcgagcacggcgaacaccg

SEQ ID NO: 3418612 - RNA, 13 nt, Pseudomonas aeruginosa PA01
cggcgagcagcgg

SEQ ID NO: 3418613 - RNA, 17 nt, Pseudomonas aeruginosa PA01
cggcgagcagcggcgcu

SEQ ID NO: 3418614 - RNA, 17 nt, Pseudomonas aeruginosa PA01
cggcgagcaggcgaaca

SEQ ID NO: 3418615 - RNA, 15 nt, Pseudomonas aeruginosa PA01
cggcgagcagguaga

SEQ ID NO: 3418616 - RNA, 17 nt, Pseudomonas aeruginosa PA01
cggcgagcaucucggcc

SEQ ID NO: 3418617 - RNA, 20 nt, Pseudomonas aeruginosa PA01
cggcgagcaucucggccagg

SEQ ID NO: 3418618 - RNA, 21 nt, Pseudomonas aeruginosa PA01
cggcgagcaucucggccaggc

SEQ ID NO: 3418619 - RNA, 23 nt, Pseudomonas aeruginosa PA01
cggcgagcaucucggccaggccc

SEQ ID NO: 3418620 - RNA, 20 nt, Pseudomonas aeruginosa PA01
cggcgagcauuccucagcgc

SEQ ID NO: 3418621 - RNA, 13 nt, Pseudomonas aeruginosa PA01
cggcgagccaggu

SEQ ID NO: 3418622 - RNA, 18 nt, Pseudomonas aeruginosa PA01
cggcgagccgcagcggcu

SEQ ID NO: 3418623 - RNA, 15 nt, Pseudomonas aeruginosa PA01
cggcgagccgccggg

SEQ ID NO: 3418624 - RNA, 19 nt, Pseudomonas aeruginosa PA01
cggcgagccgcgacggcug

SEQ ID NO: 3418625 - RNA, 13 nt, Pseudomonas aeruginosa PA01
cggcgagccggcg

SEQ ID NO: 3418626 - RNA, 18 nt, Pseudomonas aeruginosa PA01
cggcgagcgagcggcaga

SEQ ID NO: 3418627 - RNA, 13 nt, Pseudomonas aeruginosa PA01
cggcgagcgccgc

SEQ ID NO: 3418628 - RNA, 14 nt, Pseudomonas aeruginosa PA01
cggcgagcgccgcg

SEQ ID NO: 3418629 - RNA, 18 nt, Pseudomonas aeruginosa PA01
cggcgagcgccgcggcga

SEQ ID NO: 3418630 - RNA, 19 nt, Pseudomonas aeruginosa PA01
cggcgagcgccgcggcgaa

SEQ ID NO: 3418631 - RNA, 20 nt, Pseudomonas aeruginosa PA01
cggcgagcgggucgauggcu

SEQ ID NO: 3418632 - RNA, 19 nt, Pseudomonas aeruginosa PA01
cggcgagcuggaucggcag

SEQ ID NO: 3418633 - RNA, 20 nt, Pseudomonas aeruginosa PA01
cggcgaggaacagcaccagc

SEQ ID NO: 3418634 - RNA, 21 nt, Pseudomonas aeruginosa PA01
cggcgaggaacagcaccagca

SEQ ID NO: 3418635 - RNA, 13 nt, Pseudomonas aeruginosa PA01
cggcgaggaucag

SEQ ID NO: 3418636 - RNA, 15 nt, Pseudomonas aeruginosa PA01
cggcgaggaucgcgc

SEQ ID NO: 3418637 - RNA, 17 nt, Pseudomonas aeruginosa PA01
cggcgaggaucgcgcug

SEQ ID NO: 3418638 - RNA, 22 nt, Pseudomonas aeruginosa PA01
cggcgaggaucgcgcuggccag

SEQ ID NO: 3418639 - RNA, 14 nt, Pseudomonas aeruginosa PA01
cggcgaggccgacc

SEQ ID NO: 3418640 - RNA, 15 nt, Pseudomonas aeruginosa PA01
cggcgaggccgaccu

SEQ ID NO: 3418641 - RNA, 17 nt, Pseudomonas aeruginosa PA01
cggcgaggccgaccuug

SEQ ID NO: 3418642 - RNA, 14 nt, Pseudomonas aeruginosa PA01
cggcgaggccggcg

SEQ ID NO: 3418643 - RNA, 15 nt, Pseudomonas aeruginosa PA01
cggcgaggccggcga

SEQ ID NO: 3418644 - RNA, 17 nt, Pseudomonas aeruginosa PA01
cggcgaggccggcgauc

SEQ ID NO: 3418645 - RNA, 19 nt, Pseudomonas aeruginosa PA01
cggcgaggccggcgaucag

SEQ ID NO: 3418646 - RNA, 20 nt, Pseudomonas aeruginosa PA01
cggcgaggccggcgaucagc

SEQ ID NO: 3418647 - RNA, 17 nt, Pseudomonas aeruginosa PA01
cggcgagggcaccacgu

SEQ ID NO: 3418648 - RNA, 13 nt, Pseudomonas aeruginosa PA01
cggcgagggcgcc

SEQ ID NO: 3418649 - RNA, 17 nt, Pseudomonas aeruginosa PA01
cggcgagggcggcgacc

SEQ ID NO: 3418650 - RNA, 14 nt, Pseudomonas aeruginosa PA01
cggcgaggucgggg

SEQ ID NO: 3418651 - RNA, 16 nt, Pseudomonas aeruginosa PA01
cggcgaggugaucgag

SEQ ID NO: 3418652 - RNA, 19 nt, Pseudomonas aeruginosa PA01
cggcgaggugaucgagggc

SEQ ID NO: 3418653 - RNA, 20 nt, Pseudomonas aeruginosa PA01
cggcgagguugcccacggcc

SEQ ID NO: 3418654 - RNA, 17 nt, Pseudomonas aeruginosa PA01
cggcgaguaaccaccgc

SEQ ID NO: 3418655 - RNA, 20 nt, Pseudomonas aeruginosa PA01
cggcgaguaaccaccgcucu

SEQ ID NO: 3418656 - RNA, 16 nt, Pseudomonas aeruginosa PA01
cggcgaguucgcgcag

SEQ ID NO: 3418657 - RNA, 19 nt, Pseudomonas aeruginosa PA01
cggcgaguucgcgcaggcg

SEQ ID NO: 3418658 - RNA, 23 nt, Pseudomonas aeruginosa PA01
cggcgaguucggcguuguccagg

SEQ ID NO: 3418659 - RNA, 18 nt, Pseudomonas aeruginosa PA01
cggcgaguugcgcgaggc

SEQ ID NO: 3418660 - RNA, 15 nt, Pseudomonas aeruginosa PA01
cggcgauacccaggc

SEQ ID NO: 3418661 - RNA, 17 nt, Pseudomonas aeruginosa PA01
cggcgauacccaggccg

SEQ ID NO: 3418662 - RNA, 23 nt, Pseudomonas aeruginosa PA01
cggcgauacccaggccgucgagg

SEQ ID NO: 3418663 - RNA, 19 nt, Pseudomonas aeruginosa PA01
cggcgaucacccggcgaag

SEQ ID NO: 3418664 - RNA, 16 nt, Pseudomonas aeruginosa PA01
cggcgaucacguccuu

SEQ ID NO: 3418665 - RNA, 15 nt, Pseudomonas aeruginosa PA01
cggcgaucagaacga

SEQ ID NO: 3418666 - RNA, 19 nt, Pseudomonas aeruginosa PA01
cggcgaucagaacgaugcc

SEQ ID NO: 3418667 - RNA, 13 nt, Pseudomonas aeruginosa PA01
cggcgaucagcgc

SEQ ID NO: 3418668 - RNA, 14 nt, Pseudomonas aeruginosa PA01
cggcgaucagcgcu

SEQ ID NO: 3418669 - RNA, 15 nt, Pseudomonas aeruginosa PA01
cggcgaucagcgggc

SEQ ID NO: 3418670 - RNA, 16 nt, Pseudomonas aeruginosa PA01
cggcgaucaggccgau

SEQ ID NO: 3418671 - RNA, 23 nt, Pseudomonas aeruginosa PA01
cggcgaucaggccgaugcgcaac

SEQ ID NO: 3418672 - RNA, 16 nt, Pseudomonas aeruginosa PA01
cggcgaucauccagcc

SEQ ID NO: 3418673 - RNA, 13 nt, Pseudomonas aeruginosa PA01
cggcgaucgccag

SEQ ID NO: 3418674 - RNA, 12 nt, Pseudomonas aeruginosa PA01
cggcgaucgccg

SEQ ID NO: 3418675 - RNA, 14 nt, Pseudomonas aeruginosa PA01
cggcgaucgccggc

SEQ ID NO: 3418676 - RNA, 18 nt, Pseudomonas aeruginosa PA01
cggcgaucuccgccaggc

SEQ ID NO: 3418677 - RNA, 23 nt, Pseudomonas aeruginosa PA01
cggcgaucuccgccaggcggccg

SEQ ID NO: 3418678 - RNA, 21 nt, Pseudomonas aeruginosa PA01
cggcgaucucgcccagggcgu

SEQ ID NO: 3418679 - RNA, 20 nt, Pseudomonas aeruginosa PA01
cggcgaucuucagguaggcg

SEQ ID NO: 3418680 - RNA, 14 nt, Pseudomonas aeruginosa PA01
cggcgaucuucucc

SEQ ID NO: 3418681 - RNA, 18 nt, Pseudomonas aeruginosa PA01
cggcgaucuucuccgccg

SEQ ID NO: 3418682 - RNA, 20 nt, Pseudomonas aeruginosa PA01
cggcgaucuucuccgccgcg

SEQ ID NO: 3418683 - RNA, 21 nt, Pseudomonas aeruginosa PA01
cggcgaucuucuccgccgcgu

SEQ ID NO: 3418684 - RNA, 19 nt, Pseudomonas aeruginosa PA01
cggcgaugaagcugaugcc

SEQ ID NO: 3418685 - RNA, 18 nt, Pseudomonas aeruginosa PA01
cggcgaugaccagcucgg

SEQ ID NO: 3418686 - RNA, 21 nt, Pseudomonas aeruginosa PA01
cggcgaugaccagcucggcgg

SEQ ID NO: 3418687 - RNA, 23 nt, Pseudomonas aeruginosa PA01
cggcgaugaccagcucggcggga

SEQ ID NO: 3418688 - RNA, 14 nt, Pseudomonas aeruginosa PA01
cggcgaugaucggc

SEQ ID NO: 3418689 - RNA, 20 nt, Pseudomonas aeruginosa PA01
cggcgaugaucggcagccgu

SEQ ID NO: 3418690 - RNA, 22 nt, Pseudomonas aeruginosa PA01
cggcgaugauggucaacaccag

SEQ ID NO: 3418691 - RNA, 23 nt, Pseudomonas aeruginosa PA01
cggcgaugauggucaacaccagc

SEQ ID NO: 3418692 - RNA, 17 nt, Pseudomonas aeruginosa PA01
cggcgaugcccaggccg

SEQ ID NO: 3418693 - RNA, 20 nt, Pseudomonas aeruginosa PA01
cggcgaugcccaggccgccg

SEQ ID NO: 3418694 - RNA, 22 nt, Pseudomonas aeruginosa PA01
cggcgaugcccaggccgccgau

SEQ ID NO: 3418695 - RNA, 23 nt, Pseudomonas aeruginosa PA01
cggcgaugcccaggccgccgauc

SEQ ID NO: 3418696 - RNA, 14 nt, Pseudomonas aeruginosa PA01
cggcgaugccgccc

SEQ ID NO: 3418697 - RNA, 15 nt, Pseudomonas aeruginosa PA01
cggcgaugccgccca

SEQ ID NO: 3418698 - RNA, 19 nt, Pseudomonas aeruginosa PA01
cggcgaugccgcccagcac

SEQ ID NO: 3418699 - RNA, 21 nt, Pseudomonas aeruginosa PA01
cggcgaugccgcccagcaccg

SEQ ID NO: 3418700 - RNA, 16 nt, Pseudomonas aeruginosa PA01
cggcgaugccgccggg

SEQ ID NO: 3418701 - RNA, 15 nt, Pseudomonas aeruginosa PA01
cggcgaugccgcgcc

SEQ ID NO: 3418702 - RNA, 18 nt, Pseudomonas aeruginosa PA01
cggcgaugccgcgccagg

SEQ ID NO: 3418703 - RNA, 12 nt, Pseudomonas aeruginosa PA01
cggcgaugccgg

SEQ ID NO: 3418704 - RNA, 23 nt, Pseudomonas aeruginosa PA01
cggcgaugccggagagcagcacg

SEQ ID NO: 3418705 - RNA, 17 nt, Pseudomonas aeruginosa PA01
cggcgaugcgcaugcgc

SEQ ID NO: 3418706 - RNA, 23 nt, Pseudomonas aeruginosa PA01
cggcgaugcgcaugcgcagcgcg

SEQ ID NO: 3418707 - RNA, 17 nt, Pseudomonas aeruginosa PA01
cggcgaugcucagcgcc

SEQ ID NO: 3418708 - RNA, 19 nt, Pseudomonas aeruginosa PA01
cggcgaugcucagcgccgg

SEQ ID NO: 3418709 - RNA, 20 nt, Pseudomonas aeruginosa PA01
cggcgaugcucagcgccggc

SEQ ID NO: 3418710 - RNA, 21 nt, Pseudomonas aeruginosa PA01
cggcgaugcucagcgccggcc

SEQ ID NO: 3418711 - RNA, 14 nt, Pseudomonas aeruginosa PA01
cggcgauggcccag

SEQ ID NO: 3418712 - RNA, 14 nt, Pseudomonas aeruginosa PA01
cggcgauggccgcc

SEQ ID NO: 3418713 - RNA, 17 nt, Pseudomonas aeruginosa PA01
cggcgauggccgccagc

SEQ ID NO: 3418714 - RNA, 21 nt, Pseudomonas aeruginosa PA01
cggcgauggccgccagcaggc

SEQ ID NO: 3418715 - RNA, 16 nt, Pseudomonas aeruginosa PA01
cggcgauggccgccug

SEQ ID NO: 3418716 - RNA, 17 nt, Pseudomonas aeruginosa PA01
cggcgauggccgccugc

SEQ ID NO: 3418717 - RNA, 18 nt, Pseudomonas aeruginosa PA01
cggcgauggccggcacca

SEQ ID NO: 3418718 - RNA, 22 nt, Pseudomonas aeruginosa PA01
cggcgauggccggcaccagcag

SEQ ID NO: 3418719 - RNA, 16 nt, Pseudomonas aeruginosa PA01
cggcgauggcgcgcgg

SEQ ID NO: 3418720 - RNA, 14 nt, Pseudomonas aeruginosa PA01
cggcgauggcgucc

SEQ ID NO: 3418721 - RNA, 19 nt, Pseudomonas aeruginosa PA01
cggcgauggcguccaccgc

SEQ ID NO: 3418722 - RNA, 17 nt, Pseudomonas aeruginosa PA01
cggcgaugggucgcgug

SEQ ID NO: 3418723 - RNA, 18 nt, Pseudomonas aeruginosa PA01
cggcgaugggucgcgugg

SEQ ID NO: 3418724 - RNA, 17 nt, Pseudomonas aeruginosa PA01
cggcgauggucaggacg

SEQ ID NO: 3418725 - RNA, 18 nt, Pseudomonas aeruginosa PA01
cggcgauggucaggacgc

SEQ ID NO: 3418726 - RNA, 16 nt, Pseudomonas aeruginosa PA01
cggcgaugucgcgggc

SEQ ID NO: 3418727 - RNA, 13 nt, Pseudomonas aeruginosa PA01
cggcgaugucggc

SEQ ID NO: 3418728 - RNA, 14 nt, Pseudomonas aeruginosa PA01
cggcgaugucggcc

SEQ ID NO: 3418729 - RNA, 15 nt, Pseudomonas aeruginosa PA01
cggcgaugucggccu

SEQ ID NO: 3418730 - RNA, 16 nt, Pseudomonas aeruginosa PA01
cggcgaugucggccug

SEQ ID NO: 3418731 - RNA, 17 nt, Pseudomonas aeruginosa PA01
cggcgaugucggccugc

SEQ ID NO: 3418732 - RNA, 14 nt, Pseudomonas aeruginosa PA01
cggcgaugugcggc

SEQ ID NO: 3418733 - RNA, 15 nt, Pseudomonas aeruginosa PA01
cggcgaugugcggcg

SEQ ID NO: 3418734 - RNA, 21 nt, Pseudomonas aeruginosa PA01
cggcgaugugcggcguggcga

SEQ ID NO: 3418735 - RNA, 16 nt, Pseudomonas aeruginosa PA01
cggcgauguucgcccc

SEQ ID NO: 3418736 - RNA, 19 nt, Pseudomonas aeruginosa PA01
cggcgauuccacgggccug

SEQ ID NO: 3418737 - RNA, 20 nt, Pseudomonas aeruginosa PA01
cggcgauuccacgggccugu

SEQ ID NO: 3418738 - RNA, 15 nt, Pseudomonas aeruginosa PA01
cggcgauucgcggcg

SEQ ID NO: 3418739 - RNA, 16 nt, Pseudomonas aeruginosa PA01
cggcgauucgcggcga

SEQ ID NO: 3418740 - RNA, 17 nt, Pseudomonas aeruginosa PA01
cggcgauucgcggcgac

SEQ ID NO: 3418741 - RNA, 19 nt, Pseudomonas aeruginosa PA01
cggcgauucguucgagcag

SEQ ID NO: 3418742 - RNA, 21 nt, Pseudomonas aeruginosa PA01
cggcgauucguucgagcagcu

SEQ ID NO: 3418743 - RNA, 22 nt, Pseudomonas aeruginosa PA01
cggcgauucguucgagcagcuc

SEQ ID NO: 3418744 - RNA, 14 nt, Pseudomonas aeruginosa PA01
cggcgcaaccccuu

SEQ ID NO: 3418745 - RNA, 14 nt, Pseudomonas aeruginosa PA01
cggcgcaagcgguu

SEQ ID NO: 3418746 - RNA, 15 nt, Pseudomonas aeruginosa PA01
cggcgcaagcgguug

SEQ ID NO: 3418747 - RNA, 23 nt, Pseudomonas aeruginosa PA01
cggcgcaagggcgccgccgacgc

SEQ ID NO: 3418748 - RNA, 21 nt, Pseudomonas aeruginosa PA01
cggcgcaaucagggcugggcg

SEQ ID NO: 3418749 - RNA, 22 nt, Pseudomonas aeruginosa PA01
cggcgcaaucagggcugggcgc

SEQ ID NO: 3418750 - RNA, 23 nt, Pseudomonas aeruginosa PA01
cggcgcacauuacccccuugccc

SEQ ID NO: 3418751 - RNA, 16 nt, Pseudomonas aeruginosa PA01
cggcgcaccgacgccg

SEQ ID NO: 3418752 - RNA, 17 nt, Pseudomonas aeruginosa PA01
cggcgcaccgacgccgc

SEQ ID NO: 3418753 - RNA, 16 nt, Pseudomonas aeruginosa PA01
cggcgcacgccggccu

SEQ ID NO: 3418754 - RNA, 17 nt, Pseudomonas aeruginosa PA01
cggcgcacgccggccuc

SEQ ID NO: 3418755 - RNA, 19 nt, Pseudomonas aeruginosa PA01
cggcgcacgccggccucgc

SEQ ID NO: 3418756 - RNA, 21 nt, Pseudomonas aeruginosa PA01
cggcgcacugagggucagccg

SEQ ID NO: 3418757 - RNA, 20 nt, Pseudomonas aeruginosa PA01
cggcgcagaacugccgggcc

SEQ ID NO: 3418758 - RNA, 21 nt, Pseudomonas aeruginosa PA01
cggcgcagaacugccgggcca

SEQ ID NO: 3418759 - RNA, 19 nt, Pseudomonas aeruginosa PA01
cggcgcagacgucuuccgg

SEQ ID NO: 3418760 - RNA, 18 nt, Pseudomonas aeruginosa PA01
cggcgcagaucgcggcgc

SEQ ID NO: 3418761 - RNA, 21 nt, Pseudomonas aeruginosa PA01
cggcgcagaucgcggcgcagg

SEQ ID NO: 3418762 - RNA, 16 nt, Pseudomonas aeruginosa PA01
cggcgcagcagggcgu

SEQ ID NO: 3418763 - RNA, 17 nt, Pseudomonas aeruginosa PA01
cggcgcagcagggcguc

SEQ ID NO: 3418764 - RNA, 17 nt, Pseudomonas aeruginosa PA01
cggcgcagcccagccgc

SEQ ID NO: 3418765 - RNA, 22 nt, Pseudomonas aeruginosa PA01
cggcgcagcccagccgcucgcg

SEQ ID NO: 3418766 - RNA, 16 nt, Pseudomonas aeruginosa PA01
cggcgcagccgcaagg

SEQ ID NO: 3418767 - RNA, 21 nt, Pseudomonas aeruginosa PA01
cggcgcagcuucuccaccgga

SEQ ID NO: 3418768 - RNA, 11 nt, Pseudomonas aeruginosa PA01
cggcgcaggca

SEQ ID NO: 3418769 - RNA, 13 nt, Pseudomonas aeruginosa PA01
cggcgcaggcgau

SEQ ID NO: 3418770 - RNA, 14 nt, Pseudomonas aeruginosa PA01
cggcgcaggcggau

SEQ ID NO: 3418771 - RNA, 18 nt, Pseudomonas aeruginosa PA01
cggcgcaggcggaucgcc

SEQ ID NO: 3418772 - RNA, 21 nt, Pseudomonas aeruginosa PA01
cggcgcaggcggaucgcccgg

SEQ ID NO: 3418773 - RNA, 22 nt, Pseudomonas aeruginosa PA01
cggcgcaggcggaucgcccggc

SEQ ID NO: 3418774 - RNA, 12 nt, Pseudomonas aeruginosa PA01
cggcgcaggcug

SEQ ID NO: 3418775 - RNA, 18 nt, Pseudomonas aeruginosa PA01
cggcgcaggcugucggcc

SEQ ID NO: 3418776 - RNA, 19 nt, Pseudomonas aeruginosa PA01
cggcgcaggcugucggcca

SEQ ID NO: 3418777 - RNA, 20 nt, Pseudomonas aeruginosa PA01
cggcgcaggcugucggccag

SEQ ID NO: 3418778 - RNA, 21 nt, Pseudomonas aeruginosa PA01
cggcgcaggcugucggccagc

SEQ ID NO: 3418779 - RNA, 13 nt, Pseudomonas aeruginosa PA01
cggcgcaggcuug

SEQ ID NO: 3418780 - RNA, 15 nt, Pseudomonas aeruginosa PA01
cggcgcagggcaucg

SEQ ID NO: 3418781 - RNA, 14 nt, Pseudomonas aeruginosa PA01
cggcgcaguagucg

SEQ ID NO: 3418782 - RNA, 18 nt, Pseudomonas aeruginosa PA01
cggcgcauagccaccgcc

SEQ ID NO: 3418783 - RNA, 20 nt, Pseudomonas aeruginosa PA01
cggcgcauagccaccgccga

SEQ ID NO: 3418784 - RNA, 17 nt, Pseudomonas aeruginosa PA01
cggcgcaucagcgccgg

SEQ ID NO: 3418785 - RNA, 15 nt, Pseudomonas aeruginosa PA01
cggcgcaucggcgga

SEQ ID NO: 3418786 - RNA, 17 nt, Pseudomonas aeruginosa PA01
cggcgcaucggcggaua

SEQ ID NO: 3418787 - RNA, 14 nt, Pseudomonas aeruginosa PA01
cggcgcaugccgca

SEQ ID NO: 3418788 - RNA, 16 nt, Pseudomonas aeruginosa PA01
cggcgcaugcgccggc

SEQ ID NO: 3418789 - RNA, 18 nt, Pseudomonas aeruginosa PA01
cggcgcaugcgccggcuu

SEQ ID NO: 3418790 - RNA, 17 nt, Pseudomonas aeruginosa PA01
cggcgccaacucggccu

SEQ ID NO: 3418791 - RNA, 19 nt, Pseudomonas aeruginosa PA01
cggcgccaacugcuugccg

SEQ ID NO: 3418792 - RNA, 12 nt, Pseudomonas aeruginosa PA01
cggcgccacccc

SEQ ID NO: 3418793 - RNA, 12 nt, Pseudomonas aeruginosa PA01
cggcgccacccu

SEQ ID NO: 3418794 - RNA, 18 nt, Pseudomonas aeruginosa PA01
cggcgccaccgauucgcc

SEQ ID NO: 3418795 - RNA, 19 nt, Pseudomonas aeruginosa PA01
cggcgccaccgauucgccg

SEQ ID NO: 3418796 - RNA, 23 nt, Pseudomonas aeruginosa PA01
cggcgccaccgauucgccggcca

SEQ ID NO: 3418797 - RNA, 13 nt, Pseudomonas aeruginosa PA01
cggcgccaccgcg

SEQ ID NO: 3418798 - RNA, 14 nt, Pseudomonas aeruginosa PA01
cggcgccaccgcga

SEQ ID NO: 3418799 - RNA, 17 nt, Pseudomonas aeruginosa PA01
cggcgccaccgcgacgc

SEQ ID NO: 3418800 - RNA, 21 nt, Pseudomonas aeruginosa PA01
cggcgccaccgcgacgcgcug

SEQ ID NO: 3418801 - RNA, 14 nt, Pseudomonas aeruginosa PA01
cggcgccaccgcgu

SEQ ID NO: 3418802 - RNA, 14 nt, Pseudomonas aeruginosa PA01
cggcgccagcgccc

SEQ ID NO: 3418803 - RNA, 21 nt, Pseudomonas aeruginosa PA01
cggcgccagcgccccaccagg

SEQ ID NO: 3418804 - RNA, 17 nt, Pseudomonas aeruginosa PA01
cggcgccagcuccagcg

SEQ ID NO: 3418805 - RNA, 19 nt, Pseudomonas aeruginosa PA01
cggcgccagcuccagcgcc

SEQ ID NO: 3418806 - RNA, 12 nt, Pseudomonas aeruginosa PA01
cggcgccaggcc

SEQ ID NO: 3418807 - RNA, 19 nt, Pseudomonas aeruginosa PA01
cggcgccaggcccucggcg

SEQ ID NO: 3418808 - RNA, 21 nt, Pseudomonas aeruginosa PA01
cggcgccaggcccucggcgac

SEQ ID NO: 3418809 - RNA, 23 nt, Pseudomonas aeruginosa PA01
cggcgccaggcccucggcgacca

SEQ ID NO: 3418810 - RNA, 14 nt, Pseudomonas aeruginosa PA01
cggcgccaggccgg

SEQ ID NO: 3418811 - RNA, 15 nt, Pseudomonas aeruginosa PA01
cggcgccaggccggc

SEQ ID NO: 3418812 - RNA, 17 nt, Pseudomonas aeruginosa PA01
cggcgccaggccggcga

SEQ ID NO: 3418813 - RNA, 19 nt, Pseudomonas aeruginosa PA01
cggcgccaggccggcgagg

SEQ ID NO: 3418814 - RNA, 20 nt, Pseudomonas aeruginosa PA01
cggcgccaggcguuccagcu

SEQ ID NO: 3418815 - RNA, 21 nt, Pseudomonas aeruginosa PA01
cggcgccaggcguuccagcuc

SEQ ID NO: 3418816 - RNA, 19 nt, Pseudomonas aeruginosa PA01
cggcgccaggcugaccgcg

SEQ ID NO: 3418817 - RNA, 22 nt, Pseudomonas aeruginosa PA01
cggcgccaggcugaccgcgugg

SEQ ID NO: 3418818 - RNA, 16 nt, Pseudomonas aeruginosa PA01
cggcgccaguucgccg

SEQ ID NO: 3418819 - RNA, 17 nt, Pseudomonas aeruginosa PA01
cggcgccaguucgccgg

SEQ ID NO: 3418820 - RNA, 19 nt, Pseudomonas aeruginosa PA01
cggcgccaguucgccggug

SEQ ID NO: 3418821 - RNA, 22 nt, Pseudomonas aeruginosa PA01
cggcgccauaccggcaaggcgg

SEQ ID NO: 3418822 - RNA, 20 nt, Pseudomonas aeruginosa PA01
cggcgccauaggccagcacc

SEQ ID NO: 3418823 - RNA, 19 nt, Pseudomonas aeruginosa PA01
cggcgcccaaugcaucggc

SEQ ID NO: 3418824 - RNA, 20 nt, Pseudomonas aeruginosa PA01
cggcgcccacaaccugccga

SEQ ID NO: 3418825 - RNA, 24 nt, Pseudomonas aeruginosa PA01
cggcgcccacaaccugccgaucgc

SEQ ID NO: 3418826 - RNA, 18 nt, Pseudomonas aeruginosa PA01
cggcgcccacuccaacca

SEQ ID NO: 3418827 - RNA, 13 nt, Pseudomonas aeruginosa PA01
cggcgcccagcac

SEQ ID NO: 3418828 - RNA, 21 nt, Pseudomonas aeruginosa PA01
cggcgcccagcaccacagcac

SEQ ID NO: 3418829 - RNA, 13 nt, Pseudomonas aeruginosa PA01
cggcgccccaggc

SEQ ID NO: 3418830 - RNA, 14 nt, Pseudomonas aeruginosa PA01
cggcgccccaggcg

SEQ ID NO: 3418831 - RNA, 16 nt, Pseudomonas aeruginosa PA01
cggcgccccaggcgcc

SEQ ID NO: 3418832 - RNA, 17 nt, Pseudomonas aeruginosa PA01
cggcgccccaggcgccc

SEQ ID NO: 3418833 - RNA, 21 nt, Pseudomonas aeruginosa PA01
cggcgccccaggcgcccaggc

SEQ ID NO: 3418834 - RNA, 15 nt, Pseudomonas aeruginosa PA01
cggcgccccggccca

SEQ ID NO: 3418835 - RNA, 17 nt, Pseudomonas aeruginosa PA01
cggcgccccggcccagc

SEQ ID NO: 3418836 - RNA, 23 nt, Pseudomonas aeruginosa PA01
cggcgccccggcccagccgcggc

SEQ ID NO: 3418837 - RNA, 24 nt, Pseudomonas aeruginosa PA01
cggcgccccggcccagccgcggcg

SEQ ID NO: 3418838 - RNA, 12 nt, Pseudomonas aeruginosa PA01
cggcgccccggg

SEQ ID NO: 3418839 - RNA, 22 nt, Pseudomonas aeruginosa PA01
cggcgccccgggucggcacggc

SEQ ID NO: 3418840 - RNA, 20 nt, Pseudomonas aeruginosa PA01
cggcgccccugcggcgccgg

SEQ ID NO: 3418841 - RNA, 15 nt, Pseudomonas aeruginosa PA01
cggcgcccgccaagg

SEQ ID NO: 3418842 - RNA, 12 nt, Pseudomonas aeruginosa PA01
cggcgcccgccu

SEQ ID NO: 3418843 - RNA, 14 nt, Pseudomonas aeruginosa PA01
cggcgcccgccugc

SEQ ID NO: 3418844 - RNA, 14 nt, Pseudomonas aeruginosa PA01
cggcgcccggcgca

SEQ ID NO: 3418845 - RNA, 18 nt, Pseudomonas aeruginosa PA01
cggcgcccucugccgguc

SEQ ID NO: 3418846 - RNA, 21 nt, Pseudomonas aeruginosa PA01
cggcgcccucugccggucgga

SEQ ID NO: 3418847 - RNA, 14 nt, Pseudomonas aeruginosa PA01
cggcgcccuggccg

SEQ ID NO: 3418848 - RNA, 17 nt, Pseudomonas aeruginosa PA01
cggcgcccuggccgcca

SEQ ID NO: 3418849 - RNA, 15 nt, Pseudomonas aeruginosa PA01
cggcgcccugggcgc

SEQ ID NO: 3418850 - RNA, 16 nt, Pseudomonas aeruginosa PA01
cggcgcccuugacccg

SEQ ID NO: 3418851 - RNA, 18 nt, Pseudomonas aeruginosa PA01
cggcgcccuugacccggu

SEQ ID NO: 3418852 - RNA, 13 nt, Pseudomonas aeruginosa PA01
cggcgccgagcau

SEQ ID NO: 3418853 - RNA, 13 nt, Pseudomonas aeruginosa PA01
cggcgccgaggcc

SEQ ID NO: 3418854 - RNA, 14 nt, Pseudomonas aeruginosa PA01
cggcgccgaggccc

SEQ ID NO: 3418855 - RNA, 16 nt, Pseudomonas aeruginosa PA01
cggcgccgagguagua

SEQ ID NO: 3418856 - RNA, 16 nt, Pseudomonas aeruginosa PA01
cggcgccgaucuccgc

SEQ ID NO: 3418857 - RNA, 13 nt, Pseudomonas aeruginosa PA01
cggcgccgaugcc

SEQ ID NO: 3418858 - RNA, 19 nt, Pseudomonas aeruginosa PA01
cggcgccgauuccugggcg

SEQ ID NO: 3418859 - RNA, 22 nt, Pseudomonas aeruginosa PA01
cggcgccgccccguuggcgcgg

SEQ ID NO: 3418860 - RNA, 14 nt, Pseudomonas aeruginosa PA01
cggcgccgccgaac

SEQ ID NO: 3418861 - RNA, 15 nt, Pseudomonas aeruginosa PA01
cggcgccgccgaaca

SEQ ID NO: 3418862 - RNA, 15 nt, Pseudomonas aeruginosa PA01
cggcgccgccgggga

SEQ ID NO: 3418863 - RNA, 12 nt, Pseudomonas aeruginosa PA01
cggcgccgccuc

SEQ ID NO: 3418864 - RNA, 16 nt, Pseudomonas aeruginosa PA01
cggcgccgccuggccg

SEQ ID NO: 3418865 - RNA, 17 nt, Pseudomonas aeruginosa PA01
cggcgccgccuggccgg

SEQ ID NO: 3418866 - RNA, 15 nt, Pseudomonas aeruginosa PA01
cggcgccgcgcaccu

SEQ ID NO: 3418867 - RNA, 20 nt, Pseudomonas aeruginosa PA01
cggcgccgcgcaccugggcg

SEQ ID NO: 3418868 - RNA, 19 nt, Pseudomonas aeruginosa PA01
cggcgccgcuagggcgccc

SEQ ID NO: 3418869 - RNA, 15 nt, Pseudomonas aeruginosa PA01
cggcgccgcugccca

SEQ ID NO: 3418870 - RNA, 16 nt, Pseudomonas aeruginosa PA01
cggcgccggagcuggu

SEQ ID NO: 3418871 - RNA, 12 nt, Pseudomonas aeruginosa PA01
cggcgccggcag

SEQ ID NO: 3418872 - RNA, 14 nt, Pseudomonas aeruginosa PA01
cggcgccggcagga

SEQ ID NO: 3418873 - RNA, 21 nt, Pseudomonas aeruginosa PA01
cggcgccggcagguagaccuc

SEQ ID NO: 3418874 - RNA, 21 nt, Pseudomonas aeruginosa PA01
cggcagaucggugcgggcaga

SEQ ID NO: 3418875 - RNA, 20 nt, Pseudomonas aeruginosa PA01
cggcagaucucccuguccua

SEQ ID NO: 3418876 - RNA, 17 nt, Pseudomonas aeruginosa PA01
cggcagaugccgggcgu

SEQ ID NO: 3418877 - RNA, 14 nt, Pseudomonas aeruginosa PA01
cggcagcaccaggc

SEQ ID NO: 3418878 - RNA, 20 nt, Pseudomonas aeruginosa PA01
cggcagcacccgcaccagcc

SEQ ID NO: 3418879 - RNA, 22 nt, Pseudomonas aeruginosa PA01
cggcagcacccgcaccagccgg

SEQ ID NO: 3418880 - RNA, 18 nt, Pseudomonas aeruginosa PA01
cggcagcacgcugacgcc

SEQ ID NO: 3418881 - RNA, 13 nt, Pseudomonas aeruginosa PA01
cggcagcacggcg

SEQ ID NO: 3418882 - RNA, 14 nt, Pseudomonas aeruginosa PA01
cggcagcacggcga

SEQ ID NO: 3418883 - RNA, 23 nt, Pseudomonas aeruginosa PA01
cggcagcacgucuugcaggcuca

SEQ ID NO: 3418884 - RNA, 14 nt, Pseudomonas aeruginosa PA01
cggcagcagccaac

SEQ ID NO: 3418885 - RNA, 21 nt, Pseudomonas aeruginosa PA01
cggcagcagccaaccgucgcc

SEQ ID NO: 3418886 - RNA, 15 nt, Pseudomonas aeruginosa PA01
cggcagcagcgccag

SEQ ID NO: 3418887 - RNA, 13 nt, Pseudomonas aeruginosa PA01
cggcagcagcgga

SEQ ID NO: 3418888 - RNA, 15 nt, Pseudomonas aeruginosa PA01
cggcagcagcuugcc

SEQ ID NO: 3418889 - RNA, 19 nt, Pseudomonas aeruginosa PA01
cggcagcagcuugccggca

SEQ ID NO: 3418890 - RNA, 23 nt, Pseudomonas aeruginosa PA01
cggcagcagcuugccggcauagc

SEQ ID NO: 3418891 - RNA, 18 nt, Pseudomonas aeruginosa PA01
cggcagcaggccgccgcg

SEQ ID NO: 3418892 - RNA, 13 nt, Pseudomonas aeruginosa PA01
cggcagcaggcgg

SEQ ID NO: 3418893 - RNA, 16 nt, Pseudomonas aeruginosa PA01
cggcagcaggcgggcg

SEQ ID NO: 3418894 - RNA, 13 nt, Pseudomonas aeruginosa PA01
cggcagcaggcug

SEQ ID NO: 3418895 - RNA, 15 nt, Pseudomonas aeruginosa PA01
cggcagcaggcugua

SEQ ID NO: 3418896 - RNA, 20 nt, Pseudomonas aeruginosa PA01
cggcagcagggucagcagcg

SEQ ID NO: 3418897 - RNA, 14 nt, Pseudomonas aeruginosa PA01
cggcagcaucagcc

SEQ ID NO: 3418898 - RNA, 16 nt, Pseudomonas aeruginosa PA01
cggcagcaucagccgc

SEQ ID NO: 3418899 - RNA, 18 nt, Pseudomonas aeruginosa PA01
cggcagcaucagccgcga

SEQ ID NO: 3418900 - RNA, 20 nt, Pseudomonas aeruginosa PA01
cggcagcaucagccgcgacg

SEQ ID NO: 3418901 - RNA, 22 nt, Pseudomonas aeruginosa PA01
cggcagcaucagccgcgacgac

SEQ ID NO: 3418902 - RNA, 23 nt, Pseudomonas aeruginosa PA01
cggcagcaucucggugcgcccca

SEQ ID NO: 3418903 - RNA, 14 nt, Pseudomonas aeruginosa PA01
cggcagccaccagg

SEQ ID NO: 3418904 - RNA, 17 nt, Pseudomonas aeruginosa PA01
cggcagccacucggcca

SEQ ID NO: 3418905 - RNA, 21 nt, Pseudomonas aeruginosa PA01
cggcagccaucgcauagccgg

SEQ ID NO: 3418906 - RNA, 22 nt, Pseudomonas aeruginosa PA01
cggcagccaucgcauagccggc

SEQ ID NO: 3418907 - RNA, 12 nt, Pseudomonas aeruginosa PA01
cggcagccgcgg

SEQ ID NO: 3418908 - RNA, 15 nt, Pseudomonas aeruginosa PA01
cggcagccgcggcug

SEQ ID NO: 3418909 - RNA, 12 nt, Pseudomonas aeruginosa PA01
cggcagccgggu

SEQ ID NO: 3418910 - RNA, 15 nt, Pseudomonas aeruginosa PA01
cggcagccguccgcc

SEQ ID NO: 3418911 - RNA, 18 nt, Pseudomonas aeruginosa PA01
cggcagccguccgcccag

SEQ ID NO: 3418912 - RNA, 15 nt, Pseudomonas aeruginosa PA01
cggcagcgaccacca

SEQ ID NO: 3418913 - RNA, 16 nt, Pseudomonas aeruginosa PA01
cggcagcgaccaccac

SEQ ID NO: 3418914 - RNA, 23 nt, Pseudomonas aeruginosa PA01
cggcagcgaccaccaccaggucg

SEQ ID NO: 3418915 - RNA, 14 nt, Pseudomonas aeruginosa PA01
cggcagcgacugga

SEQ ID NO: 3418916 - RNA, 20 nt, Pseudomonas aeruginosa PA01
cggcagcgacuggaaacgca

SEQ ID NO: 3418917 - RNA, 16 nt, Pseudomonas aeruginosa PA01
cggcagcgagcggguc

SEQ ID NO: 3418918 - RNA, 18 nt, Pseudomonas aeruginosa PA01
cggcagcgagcgggucag

SEQ ID NO: 3418919 - RNA, 13 nt, Pseudomonas aeruginosa PA01
cggcagcgccagg

SEQ ID NO: 3418920 - RNA, 16 nt, Pseudomonas aeruginosa PA01
cggcagcgccagguag

SEQ ID NO: 3418921 - RNA, 13 nt, Pseudomonas aeruginosa PA01
cggcagcgccgag

SEQ ID NO: 3418922 - RNA, 14 nt, Pseudomonas aeruginosa PA01
cggcagcgccgagg

SEQ ID NO: 3418923 - RNA, 12 nt, Pseudomonas aeruginosa PA01
cggcagcgccgc

SEQ ID NO: 3418924 - RNA, 14 nt, Pseudomonas aeruginosa PA01
cggcagcgccgcca

SEQ ID NO: 3418925 - RNA, 16 nt, Pseudomonas aeruginosa PA01
cggcagcgccgccagc

SEQ ID NO: 3418926 - RNA, 20 nt, Pseudomonas aeruginosa PA01
cggcagcgccgccagcagga

SEQ ID NO: 3418927 - RNA, 14 nt, Pseudomonas aeruginosa PA01
cggcagcgccgcgc

SEQ ID NO: 3418928 - RNA, 15 nt, Pseudomonas aeruginosa PA01
cggcagcgccgcgcg

SEQ ID NO: 3418929 - RNA, 13 nt, Pseudomonas aeruginosa PA01
cggcagcgccggg

SEQ ID NO: 3418930 - RNA, 15 nt, Pseudomonas aeruginosa PA01
cggcagcgccgggca

SEQ ID NO: 3418931 - RNA, 15 nt, Pseudomonas aeruginosa PA01
cggcagcgccucggc

SEQ ID NO: 3418932 - RNA, 18 nt, Pseudomonas aeruginosa PA01
cggcagcgccucggcggc

SEQ ID NO: 3418933 - RNA, 19 nt, Pseudomonas aeruginosa PA01
cggcagcgccucggcggcg

SEQ ID NO: 3418934 - RNA, 20 nt, Pseudomonas aeruginosa PA01
cggcagcgccuuuucggcac

SEQ ID NO: 3418935 - RNA, 21 nt, Pseudomonas aeruginosa PA01
cggcagcgcuacgcaggcccu

SEQ ID NO: 3418936 - RNA, 20 nt, Pseudomonas aeruginosa PA01
cggcagcgcuggcgaucacc

SEQ ID NO: 3418937 - RNA, 23 nt, Pseudomonas aeruginosa PA01
cggcagcgcuggcgaucaccagg

SEQ ID NO: 3418938 - RNA, 12 nt, Pseudomonas aeruginosa PA01
cggcagcggcuc

SEQ ID NO: 3418939 - RNA, 15 nt, Pseudomonas aeruginosa PA01
cggcagcggcuggcc

SEQ ID NO: 3418940 - RNA, 23 nt, Pseudomonas aeruginosa PA01
cggcagcggugaagguccgcgcc

SEQ ID NO: 3418941 - RNA, 17 nt, Pseudomonas aeruginosa PA01
cggcagcgguucgcccg

SEQ ID NO: 3418942 - RNA, 19 nt, Pseudomonas aeruginosa PA01
cggcagcgguucgcccgcg

SEQ ID NO: 3418943 - RNA, 14 nt, Pseudomonas aeruginosa PA01
cggcagcgucgagc

SEQ ID NO: 3418944 - RNA, 19 nt, Pseudomonas aeruginosa PA01
cggcagcgucgagcuggcg

SEQ ID NO: 3418945 - RNA, 19 nt, Pseudomonas aeruginosa PA01
cggcagcgucggaaaaccc

SEQ ID NO: 3418946 - RNA, 21 nt, Pseudomonas aeruginosa PA01
cggcagcgucucagcccucgg

SEQ ID NO: 3418947 - RNA, 22 nt, Pseudomonas aeruginosa PA01
cggcagcgucucagcccucggc

SEQ ID NO: 3418948 - RNA, 23 nt, Pseudomonas aeruginosa PA01
cggcagcgucucagcccucggcc

SEQ ID NO: 3418949 - RNA, 22 nt, Pseudomonas aeruginosa PA01
cggcagcgucucggcugccgcc

SEQ ID NO: 3418950 - RNA, 23 nt, Pseudomonas aeruginosa PA01
cggcagcucauaggucagguaca

SEQ ID NO: 3418951 - RNA, 14 nt, Pseudomonas aeruginosa PA01
cggcagcuccggcg

SEQ ID NO: 3418952 - RNA, 22 nt, Pseudomonas aeruginosa PA01
cggcagcucgcuaugcagcagg

SEQ ID NO: 3418953 - RNA, 22 nt, Pseudomonas aeruginosa PA01
cggcagcugcggcggcaccacg

SEQ ID NO: 3418954 - RNA, 23 nt, Pseudomonas aeruginosa PA01
cggcagcugcggcggcaccacgu

SEQ ID NO: 3418955 - RNA, 16 nt, Pseudomonas aeruginosa PA01
cggcagcuuggcgacg

SEQ ID NO: 3418956 - RNA, 16 nt, Pseudomonas aeruginosa PA01
cggcaggaacgcccgc

SEQ ID NO: 3418957 - RNA, 17 nt, Pseudomonas aeruginosa PA01
cggcaggaacgcccgcg

SEQ ID NO: 3418958 - RNA, 20 nt, Pseudomonas aeruginosa PA01
cggcaggaacgcccgcggca

SEQ ID NO: 3418959 - RNA, 18 nt, Pseudomonas aeruginosa PA01
cggcaggaaggccuggaa

SEQ ID NO: 3418960 - RNA, 20 nt, Pseudomonas aeruginosa PA01
cggcaggaaggccuggaaca

SEQ ID NO: 3418961 - RNA, 21 nt, Pseudomonas aeruginosa PA01
cggcaggaaggccuggaacac

SEQ ID NO: 3418962 - RNA, 13 nt, Pseudomonas aeruginosa PA01
cggcaggaccucg

SEQ ID NO: 3418963 - RNA, 17 nt, Pseudomonas aeruginosa PA01
cggcaggaccucgggcg

SEQ ID NO: 3418964 - RNA, 20 nt, Pseudomonas aeruginosa PA01
cggcaggaccucgggcgaga

SEQ ID NO: 3418965 - RNA, 18 nt, Pseudomonas aeruginosa PA01
cggcaggacgaugaucac

SEQ ID NO: 3418966 - RNA, 19 nt, Pseudomonas aeruginosa PA01
cggcaggacgaugaucacc

SEQ ID NO: 3418967 - RNA, 14 nt, Pseudomonas aeruginosa PA01
cggcaggagcauga

SEQ ID NO: 3418968 - RNA, 23 nt, Pseudomonas aeruginosa PA01
cggcaggagcguugcgggcaggu

SEQ ID NO: 3418969 - RNA, 20 nt, Pseudomonas aeruginosa PA01
cggcaggaggaucgcggccu

SEQ ID NO: 3418970 - RNA, 15 nt, Pseudomonas aeruginosa PA01
cggcaggaucaggcu

SEQ ID NO: 3418971 - RNA, 16 nt, Pseudomonas aeruginosa PA01
cggcaggaucggcgcg

SEQ ID NO: 3418972 - RNA, 10 nt, Pseudomonas aeruginosa PA01
cggcaggcaa

SEQ ID NO: 3418973 - RNA, 15 nt, Pseudomonas aeruginosa PA01
cggcaggcacgcugc

SEQ ID NO: 3418974 - RNA, 19 nt, Pseudomonas aeruginosa PA01
cggcaggcacgcugccagc

SEQ ID NO: 3418975 - RNA, 22 nt, Pseudomonas aeruginosa PA01
cggcaggcacgcugccagcagg

SEQ ID NO: 3418976 - RNA, 12 nt, Pseudomonas aeruginosa PA01
cggcaggccacg

SEQ ID NO: 3418977 - RNA, 15 nt, Pseudomonas aeruginosa PA01
cggcaggccacggcc

SEQ ID NO: 3418978 - RNA, 17 nt, Pseudomonas aeruginosa PA01
cggcaggccacggccgc

SEQ ID NO: 3418979 - RNA, 23 nt, Pseudomonas aeruginosa PA01
cggcaggccacggccgcugcgca

SEQ ID NO: 3418980 - RNA, 15 nt, Pseudomonas aeruginosa PA01
cggcaggccagcagg

SEQ ID NO: 3418981 - RNA, 17 nt, Pseudomonas aeruginosa PA01
cggcaggccagcaggua

SEQ ID NO: 3418982 - RNA, 18 nt, Pseudomonas aeruginosa PA01
cggcaggccagcagguag

SEQ ID NO: 3418983 - RNA, 22 nt, Pseudomonas aeruginosa PA01
cggcaggccagcuuccaggcgc

SEQ ID NO: 3418984 - RNA, 13 nt, Pseudomonas aeruginosa PA01
cggcaggccgaug

SEQ ID NO: 3418985 - RNA, 14 nt, Pseudomonas aeruginosa PA01
cggcaggccgaugg

SEQ ID NO: 3418986 - RNA, 15 nt, Pseudomonas aeruginosa PA01
cggcaggccgauggc

SEQ ID NO: 3418987 - RNA, 16 nt, Pseudomonas aeruginosa PA01
cggcaggccgauggcc

SEQ ID NO: 3418988 - RNA, 13 nt, Pseudomonas aeruginosa PA01
cggcaggccgccg

SEQ ID NO: 3418989 - RNA, 17 nt, Pseudomonas aeruginosa PA01
cggcaggccgccgaucc

SEQ ID NO: 3418990 - RNA, 12 nt, Pseudomonas aeruginosa PA01
cggcaggccguc

SEQ ID NO: 3418991 - RNA, 13 nt, Pseudomonas aeruginosa PA01
cggcaggccuucc

SEQ ID NO: 3418992 - RNA, 17 nt, Pseudomonas aeruginosa PA01
cggcaggccuuccacgc

SEQ ID NO: 3418993 - RNA, 19 nt, Pseudomonas aeruginosa PA01
cggcaggccuuccacgccu

SEQ ID NO: 3418994 - RNA, 13 nt, Pseudomonas aeruginosa PA01
cggcaggccuucg

SEQ ID NO: 3418995 - RNA, 16 nt, Pseudomonas aeruginosa PA01
cggcaggccuucgacg

SEQ ID NO: 3418996 - RNA, 18 nt, Pseudomonas aeruginosa PA01
cggcaggccuucggcgcc

SEQ ID NO: 3418997 - RNA, 13 nt, Pseudomonas aeruginosa PA01
cggcaggcgcacg

SEQ ID NO: 3418998 - RNA, 23 nt, Pseudomonas aeruginosa PA01
cggcaggcgccaaccgggcagca

SEQ ID NO: 3418999 - RNA, 17 nt, Pseudomonas aeruginosa PA01
cggcaggcgccggccgg

SEQ ID NO: 3419000 - RNA, 13 nt, Pseudomonas aeruginosa PA01
cggcaggcggcgg

SEQ ID NO: 3419001 - RNA, 15 nt, Pseudomonas aeruginosa PA01
cggcaggcggcggcg

SEQ ID NO: 3419002 - RNA, 16 nt, Pseudomonas aeruginosa PA01
cggcaggcggcggcgu

SEQ ID NO: 3419003 - RNA, 17 nt, Pseudomonas aeruginosa PA01
cggcaggcggcggcguu

SEQ ID NO: 3419004 - RNA, 15 nt, Pseudomonas aeruginosa PA01
cggcaggcucagcgc

SEQ ID NO: 3419005 - RNA, 18 nt, Pseudomonas aeruginosa PA01
cggcaggcugcaucggcu

SEQ ID NO: 3419006 - RNA, 20 nt, Pseudomonas aeruginosa PA01
cggcaggcugcaucggcucg

SEQ ID NO: 3419007 - RNA, 14 nt, Pseudomonas aeruginosa PA01
cggcaggcugcgcc

SEQ ID NO: 3419008 - RNA, 15 nt, Pseudomonas aeruginosa PA01
cggcaggcugcgccg

SEQ ID NO: 3419009 - RNA, 16 nt, Pseudomonas aeruginosa PA01
cggcaggcugcgccgc

SEQ ID NO: 3419010 - RNA, 20 nt, Pseudomonas aeruginosa PA01
cggcaggcugcgccgcugcg

SEQ ID NO: 3419011 - RNA, 14 nt, Pseudomonas aeruginosa PA01
cggcaggcugugcc

SEQ ID NO: 3419012 - RNA, 13 nt, Pseudomonas aeruginosa PA01
cggcagggaucac

SEQ ID NO: 3419013 - RNA, 17 nt, Pseudomonas aeruginosa PA01
cggcagggccucgggcg

SEQ ID NO: 3419014 - RNA, 18 nt, Pseudomonas aeruginosa PA01
cggcagggcgauccgccc

SEQ ID NO: 3419015 - RNA, 12 nt, Pseudomonas aeruginosa PA01
cggcagggcgcc

SEQ ID NO: 3419016 - RNA, 15 nt, Pseudomonas aeruginosa PA01
cggcagggcgcccgc

SEQ ID NO: 3419017 - RNA, 18 nt, Pseudomonas aeruginosa PA01
cggcagggcgcccgcccg

SEQ ID NO: 3419018 - RNA, 22 nt, Pseudomonas aeruginosa PA01
cggcagggcgcccgcccggcac

SEQ ID NO: 3419019 - RNA, 14 nt, Pseudomonas aeruginosa PA01
cggcagggcgccga

SEQ ID NO: 3419020 - RNA, 16 nt, Pseudomonas aeruginosa PA01
cggcagggcgccgacc

SEQ ID NO: 3419021 - RNA, 19 nt, Pseudomonas aeruginosa PA01
cggcagggcgccgaccagc

SEQ ID NO: 3419022 - RNA, 20 nt, Pseudomonas aeruginosa PA01
cggcagggcgccgaccagcu

SEQ ID NO: 3419023 - RNA, 22 nt, Pseudomonas aeruginosa PA01
cggcaggggcuuucuucgccug

SEQ ID NO: 3419024 - RNA, 17 nt, Pseudomonas aeruginosa PA01
cggcaggguagccacgc

SEQ ID NO: 3419025 - RNA, 16 nt, Pseudomonas aeruginosa PA01
cggcagggucagccga

SEQ ID NO: 3419026 - RNA, 16 nt, Pseudomonas aeruginosa PA01
cggcagguaguggccc

SEQ ID NO: 3419027 - RNA, 13 nt, Pseudomonas aeruginosa PA01
cggcaggucgagg

SEQ ID NO: 3419028 - RNA, 22 nt, Pseudomonas aeruginosa PA01
cggcaggucgaggacgaucagc

SEQ ID NO: 3419029 - RNA, 15 nt, Pseudomonas aeruginosa PA01
cggcaggucggacag

SEQ ID NO: 3419030 - RNA, 15 nt, Pseudomonas aeruginosa PA01
cggcagguggcuggc

SEQ ID NO: 3419031 - RNA, 21 nt, Pseudomonas aeruginosa PA01
cggcaggugguaagcgagcag

SEQ ID NO: 3419032 - RNA, 22 nt, Pseudomonas aeruginosa PA01
cggcagguggucguugcgcgcc

SEQ ID NO: 3419033 - RNA, 23 nt, Pseudomonas aeruginosa PA01
cggcagguggucguugcgcgcca

SEQ ID NO: 3419034 - RNA, 19 nt, Pseudomonas aeruginosa PA01
cggcagguucagcaggucg

SEQ ID NO: 3419035 - RNA, 23 nt, Pseudomonas aeruginosa PA01
cggcagguugaugugcaguucga

SEQ ID NO: 3419036 - RNA, 15 nt, Pseudomonas aeruginosa PA01
cggcagguugcucgc

SEQ ID NO: 3419037 - RNA, 19 nt, Pseudomonas aeruginosa PA01
cggcagguugugguugggc

SEQ ID NO: 3419038 - RNA, 21 nt, Pseudomonas aeruginosa PA01
cggcagguugugguugggcag

SEQ ID NO: 3419039 - RNA, 19 nt, Pseudomonas aeruginosa PA01
cggcagguuguucgccgca

SEQ ID NO: 3419040 - RNA, 17 nt, Pseudomonas aeruginosa PA01
cggcagucccugccagg

SEQ ID NO: 3419041 - RNA, 18 nt, Pseudomonas aeruginosa PA01
cggcagucccugccaggg

SEQ ID NO: 3419042 - RNA, 20 nt, Pseudomonas aeruginosa PA01
cggcagucccugccaggggc

SEQ ID NO: 3419043 - RNA, 21 nt, Pseudomonas aeruginosa PA01
cggcaguccucgccguuggcg

SEQ ID NO: 3419044 - RNA, 13 nt, Pseudomonas aeruginosa PA01
cggcagucgccgc

SEQ ID NO: 3419045 - RNA, 20 nt, Pseudomonas aeruginosa PA01
cggcagucgccgcaccggcg

SEQ ID NO: 3419046 - RNA, 22 nt, Pseudomonas aeruginosa PA01
cggcagucgguagaaauccucc

SEQ ID NO: 3419047 - RNA, 15 nt, Pseudomonas aeruginosa PA01
cggcauaccgcccgu

SEQ ID NO: 3419048 - RNA, 18 nt, Pseudomonas aeruginosa PA01
cggcauagaugccggccu

SEQ ID NO: 3419049 - RNA, 19 nt, Pseudomonas aeruginosa PA01
cggcauagaugccggccuc

SEQ ID NO: 3419050 - RNA, 20 nt, Pseudomonas aeruginosa PA01
cggcauagaugccggccucg

SEQ ID NO: 3419051 - RNA, 20 nt, Pseudomonas aeruginosa PA01
cggcauagccgaacuccgcc

SEQ ID NO: 3419052 - RNA, 21 nt, Pseudomonas aeruginosa PA01
cggcauagccgaacuccgcca

SEQ ID NO: 3419053 - RNA, 22 nt, Pseudomonas aeruginosa PA01
cggcauagccgaacuccgccag

SEQ ID NO: 3419054 - RNA, 23 nt, Pseudomonas aeruginosa PA01
cggcauagccgaacuccgccagc

SEQ ID NO: 3419055 - RNA, 20 nt, Pseudomonas aeruginosa PA01
cggcauagcgcagccgcucg

SEQ ID NO: 3419056 - RNA, 13 nt, Pseudomonas aeruginosa PA01
cggcauaggcgcc

SEQ ID NO: 3419057 - RNA, 16 nt, Pseudomonas aeruginosa PA01
cggcauaggcgccagc

SEQ ID NO: 3419058 - RNA, 18 nt, Pseudomonas aeruginosa PA01
cggcauaggcgccagccu

SEQ ID NO: 3419059 - RNA, 19 nt, Pseudomonas aeruginosa PA01
cggcauaggcgccagccua

SEQ ID NO: 3419060 - RNA, 18 nt, Pseudomonas aeruginosa PA01
cggcaucaaucgcuggcg

SEQ ID NO: 3419061 - RNA, 14 nt, Pseudomonas aeruginosa PA01
cggcaucaccggcg

SEQ ID NO: 3419062 - RNA, 16 nt, Pseudomonas aeruginosa PA01
cggcaucaccggcggg

SEQ ID NO: 3419063 - RNA, 24 nt, Pseudomonas aeruginosa PA01
cggcaucaccggcgggauguacgc

SEQ ID NO: 3419064 - RNA, 17 nt, Pseudomonas aeruginosa PA01
cggcaucaguagcgggc

SEQ ID NO: 3419065 - RNA, 15 nt, Pseudomonas aeruginosa PA01
cggcauccagcaucc

SEQ ID NO: 3419066 - RNA, 21 nt, Pseudomonas aeruginosa PA01
cggcauccaguuccugcacca

SEQ ID NO: 3419067 - RNA, 17 nt, Pseudomonas aeruginosa PA01
cggcaucccgcccgguc

SEQ ID NO: 3419068 - RNA, 20 nt, Pseudomonas aeruginosa PA01
cggcaucccgcccggucuca

SEQ ID NO: 3419069 - RNA, 15 nt, Pseudomonas aeruginosa PA01
cggcauccgccgcug

SEQ ID NO: 3419070 - RNA, 17 nt, Pseudomonas aeruginosa PA01
cggcauccgccgcuggg

SEQ ID NO: 3419071 - RNA, 15 nt, Pseudomonas aeruginosa PA01
cggcauccggcaggc

SEQ ID NO: 3419072 - RNA, 12 nt, Pseudomonas aeruginosa PA01
cggcauccucgc

SEQ ID NO: 3419073 - RNA, 16 nt, Pseudomonas aeruginosa PA01
cggcauccucgccccg

SEQ ID NO: 3419074 - RNA, 17 nt, Pseudomonas aeruginosa PA01
cggcauccucgccccgc

SEQ ID NO: 3419075 - RNA, 14 nt, Pseudomonas aeruginosa PA01
cggcauccuggcgg

SEQ ID NO: 3419076 - RNA, 16 nt, Pseudomonas aeruginosa PA01
cggcauccuguggcug

SEQ ID NO: 3419077 - RNA, 16 nt, Pseudomonas aeruginosa PA01
cggcaucgaacucaca

SEQ ID NO: 3419078 - RNA, 22 nt, Pseudomonas aeruginosa PA01
cggcaucgaccagcagcggcuc

SEQ ID NO: 3419079 - RNA, 14 nt, Pseudomonas aeruginosa PA01
cggcaucgaccagg

SEQ ID NO: 3419080 - RNA, 15 nt, Pseudomonas aeruginosa PA01
cggcaucgaccaggg

SEQ ID NO: 3419081 - RNA, 21 nt, Pseudomonas aeruginosa PA01
cggcaucgaccagggccgggu

SEQ ID NO: 3419082 - RNA, 22 nt, Pseudomonas aeruginosa PA01
cggcaucgaccagggccggguc

SEQ ID NO: 3419083 - RNA, 13 nt, Pseudomonas aeruginosa PA01
cggcaucgccggg

SEQ ID NO: 3419084 - RNA, 19 nt, Pseudomonas aeruginosa PA01
cggcaucgcguagggcgac

SEQ ID NO: 3419085 - RNA, 20 nt, Pseudomonas aeruginosa PA01
cggcaucgcguagggcgcau

SEQ ID NO: 3419086 - RNA, 14 nt, Pseudomonas aeruginosa PA01
cggcaucggagacc

SEQ ID NO: 3419087 - RNA, 13 nt, Pseudomonas aeruginosa PA01
cggcaucggcgcc

SEQ ID NO: 3419088 - RNA, 17 nt, Pseudomonas aeruginosa PA01
cggcaucgucgaagcug

SEQ ID NO: 3419089 - RNA, 15 nt, Pseudomonas aeruginosa PA01
cggcaucgugccgcg

SEQ ID NO: 3419090 - RNA, 17 nt, Pseudomonas aeruginosa PA01
cggcaucgugccgcgga

SEQ ID NO: 3419091 - RNA, 14 nt, Pseudomonas aeruginosa PA01
cggcaucguggcca

SEQ ID NO: 3419092 - RNA, 16 nt, Pseudomonas aeruginosa PA01
cggcaucguggccaug

SEQ ID NO: 3419093 - RNA, 16 nt, Pseudomonas aeruginosa PA01
cggcaucucgauggug

SEQ ID NO: 3419094 - RNA, 17 nt, Pseudomonas aeruginosa PA01
cggcaucugccgggcgu

SEQ ID NO: 3419095 - RNA, 23 nt, Pseudomonas aeruginosa PA01
cggcaugaagcuuuuccagcgca

SEQ ID NO: 3419096 - RNA, 18 nt, Pseudomonas aeruginosa PA01
cggcaugcacgcccugga

SEQ ID NO: 3419097 - RNA, 21 nt, Pseudomonas aeruginosa PA01
cggcaugcacgcccuggagcg

SEQ ID NO: 3419098 - RNA, 14 nt, Pseudomonas aeruginosa PA01
cggcaugcaggugg

SEQ ID NO: 3419099 - RNA, 17 nt, Pseudomonas aeruginosa PA01
cggcaugcagguggcgc

SEQ ID NO: 3419100 - RNA, 14 nt, Pseudomonas aeruginosa PA01
cggcaugcccugcc

SEQ ID NO: 3419101 - RNA, 15 nt, Pseudomonas aeruginosa PA01
cggcaugcccugccg

SEQ ID NO: 3419102 - RNA, 18 nt, Pseudomonas aeruginosa PA01
cggcaugcccugccggcg

SEQ ID NO: 3419103 - RNA, 22 nt, Pseudomonas aeruginosa PA01
cggcaugcccugccggcgcaga

SEQ ID NO: 3419104 - RNA, 22 nt, Pseudomonas aeruginosa PA01
cggcaugccguagacguagucg

SEQ ID NO: 3419105 - RNA, 16 nt, Pseudomonas aeruginosa PA01
cggcaugccguugggc

SEQ ID NO: 3419106 - RNA, 18 nt, Pseudomonas aeruginosa PA01
cggcaugcguucggcauu

SEQ ID NO: 3419107 - RNA, 14 nt, Pseudomonas aeruginosa PA01
cggcaugcucagcc

SEQ ID NO: 3419108 - RNA, 15 nt, Pseudomonas aeruginosa PA01
cggcaugcucagccg

SEQ ID NO: 3419109 - RNA, 13 nt, Pseudomonas aeruginosa PA01
cggcauggccacg

SEQ ID NO: 3419110 - RNA, 15 nt, Pseudomonas aeruginosa PA01
cggcauggccgaccg

SEQ ID NO: 3419111 - RNA, 17 nt, Pseudomonas aeruginosa PA01
cggcauggccgaccgcc

SEQ ID NO: 3419112 - RNA, 23 nt, Pseudomonas aeruginosa PA01
cggcauggcuguagggacaggcu

SEQ ID NO: 3419113 - RNA, 19 nt, Pseudomonas aeruginosa PA01
cggcaugggcauccugccg

SEQ ID NO: 3419114 - RNA, 16 nt, Pseudomonas aeruginosa PA01
cggcauggucagccca

SEQ ID NO: 3419115 - RNA, 22 nt, Pseudomonas aeruginosa PA01
cggcaugguccguucggcgccc

SEQ ID NO: 3419116 - RNA, 23 nt, Pseudomonas aeruginosa PA01
cggcaugguccguucggcgccca

SEQ ID NO: 3419117 - RNA, 16 nt, Pseudomonas aeruginosa PA01
cggcauguagcgcgcc

SEQ ID NO: 3419118 - RNA, 20 nt, Pseudomonas aeruginosa PA01
cggcauguugugcuugacga

SEQ ID NO: 3419119 - RNA, 16 nt, Pseudomonas aeruginosa PA01
cggcauuacuugccca

SEQ ID NO: 3419120 - RNA, 20 nt, Pseudomonas aeruginosa PA01
cggcauuacuugcccacgca

SEQ ID NO: 3419121 - RNA, 14 nt, Pseudomonas aeruginosa PA01
cggcauuagucuuu

SEQ ID NO: 3419122 - RNA, 14 nt, Pseudomonas aeruginosa PA01
cggcauuccgggcg

SEQ ID NO: 3419123 - RNA, 12 nt, Pseudomonas aeruginosa PA01
cggcauuccugg

SEQ ID NO: 3419124 - RNA, 17 nt, Pseudomonas aeruginosa PA01
cggcauuccugguccag

SEQ ID NO: 3419125 - RNA, 21 nt, Pseudomonas aeruginosa PA01
cggcauuccugguccagccag

SEQ ID NO: 3419126 - RNA, 22 nt, Pseudomonas aeruginosa PA01
cggcauuccugguccagccagc

SEQ ID NO: 3419127 - RNA, 14 nt, Pseudomonas aeruginosa PA01
cggcauucgacccg

SEQ ID NO: 3419128 - RNA, 17 nt, Pseudomonas aeruginosa PA01
cggcauucgacccgccg

SEQ ID NO: 3419129 - RNA, 13 nt, Pseudomonas aeruginosa PA01
cggcauucgccgg

SEQ ID NO: 3419130 - RNA, 15 nt, Pseudomonas aeruginosa PA01
cggcauucgccgggc

SEQ ID NO: 3419131 - RNA, 16 nt, Pseudomonas aeruginosa PA01
cggcauucgccgggcu

SEQ ID NO: 3419132 - RNA, 16 nt, Pseudomonas aeruginosa PA01
cggcauucgcgcuggu

SEQ ID NO: 3419133 - RNA, 22 nt, Pseudomonas aeruginosa PA01
cggcauucucucuucagcaggg

SEQ ID NO: 3419134 - RNA, 18 nt, Pseudomonas aeruginosa PA01
cggcauuggcacccugga

SEQ ID NO: 3419135 - RNA, 22 nt, Pseudomonas aeruginosa PA01
cggcauuggcacccuggacccg

SEQ ID NO: 3419136 - RNA, 14 nt, Pseudomonas aeruginosa PA01
cggccaaccaccgg

SEQ ID NO: 3419137 - RNA, 15 nt, Pseudomonas aeruginosa PA01
cggccaaccaccggc

SEQ ID NO: 3419138 - RNA, 18 nt, Pseudomonas aeruginosa PA01
cggccaaccaccggcgca

SEQ ID NO: 3419139 - RNA, 18 nt, Pseudomonas aeruginosa PA01
cggccaaccucuccccag

SEQ ID NO: 3419140 - RNA, 14 nt, Pseudomonas aeruginosa PA01
cggccaacggccgc

SEQ ID NO: 3419141 - RNA, 15 nt, Pseudomonas aeruginosa PA01
cggccaacggccgcu

SEQ ID NO: 3419142 - RNA, 21 nt, Pseudomonas aeruginosa PA01
cggccaacggccgcuugaucu

SEQ ID NO: 3419143 - RNA, 17 nt, Pseudomonas aeruginosa PA01
cggccaacugagcggcg

SEQ ID NO: 3419144 - RNA, 18 nt, Pseudomonas aeruginosa PA01
cggccaacugagcggcgg

SEQ ID NO: 3419145 - RNA, 19 nt, Pseudomonas aeruginosa PA01
cggccaacugagcggcggc

SEQ ID NO: 3419146 - RNA, 20 nt, Pseudomonas aeruginosa PA01
cggccaaugcccggaccugg

SEQ ID NO: 3419147 - RNA, 23 nt, Pseudomonas aeruginosa PA01
cggccaaugcccggaccugggca

SEQ ID NO: 3419148 - RNA, 12 nt, Pseudomonas aeruginosa PA01
cggccaccacca

SEQ ID NO: 3419149 - RNA, 14 nt, Pseudomonas aeruginosa PA01
cggccaccaccacg

SEQ ID NO: 3419150 - RNA, 17 nt, Pseudomonas aeruginosa PA01
cggccaccaccacgauc

SEQ ID NO: 3419151 - RNA, 15 nt, Pseudomonas aeruginosa PA01
cggccaccagcagca

SEQ ID NO: 3419152 - RNA, 13 nt, Pseudomonas aeruginosa PA01
cggccaccagcga

SEQ ID NO: 3419153 - RNA, 23 nt, Pseudomonas aeruginosa PA01
cggccaccagcgaaagcgucagc

SEQ ID NO: 3419154 - RNA, 14 nt, Pseudomonas aeruginosa PA01
cggccaccaggcuu

SEQ ID NO: 3419155 - RNA, 23 nt, Pseudomonas aeruginosa PA01
cggccaccaucacgucgcgcacc

SEQ ID NO: 3419156 - RNA, 16 nt, Pseudomonas aeruginosa PA01
cggccacccgaaggug

SEQ ID NO: 3419157 - RNA, 19 nt, Pseudomonas aeruginosa PA01
cggccaccgacgcgcgcgc

SEQ ID NO: 3419158 - RNA, 16 nt, Pseudomonas aeruginosa PA01
cggccaccuucgcccg

SEQ ID NO: 3419159 - RNA, 18 nt, Pseudomonas aeruginosa PA01
cggccaccuucgcccgcu

SEQ ID NO: 3419160 - RNA, 19 nt, Pseudomonas aeruginosa PA01
cggccaccuucgcccgcug

SEQ ID NO: 3419161 - RNA, 20 nt, Pseudomonas aeruginosa PA01
cggccaccuucgcccgcugc

SEQ ID NO: 3419162 - RNA, 21 nt, Pseudomonas aeruginosa PA01
cggccaccuucgcccgcugcg

SEQ ID NO: 3419163 - RNA, 18 nt, Pseudomonas aeruginosa PA01
cggccacgcgaccagcgc

SEQ ID NO: 3419164 - RNA, 20 nt, Pseudomonas aeruginosa PA01
cggccacgcgaccagcgcca

SEQ ID NO: 3419165 - RNA, 23 nt, Pseudomonas aeruginosa PA01
cggccacgcgaccagcgccaggc

SEQ ID NO: 3419166 - RNA, 13 nt, Pseudomonas aeruginosa PA01
cggccacggcgga

SEQ ID NO: 3419167 - RNA, 16 nt, Pseudomonas aeruginosa PA01
cggccacuaucgccaa

SEQ ID NO: 3419168 - RNA, 19 nt, Pseudomonas aeruginosa PA01
cggccacuaucgccaacgc

SEQ ID NO: 3419169 - RNA, 13 nt, Pseudomonas aeruginosa PA01
cggccacuccagc

SEQ ID NO: 3419170 - RNA, 17 nt, Pseudomonas aeruginosa PA01
cggccacuccagccccg

SEQ ID NO: 3419171 - RNA, 18 nt, Pseudomonas aeruginosa PA01
cggccacuccagccccgc

SEQ ID NO: 3419172 - RNA, 14 nt, Pseudomonas aeruginosa PA01
cggccacucgcagc

SEQ ID NO: 3419173 - RNA, 16 nt, Pseudomonas aeruginosa PA01
cggccacucgcagccg

SEQ ID NO: 3419174 - RNA, 18 nt, Pseudomonas aeruginosa PA01
cggccacucgcagccgcg

SEQ ID NO: 3419175 - RNA, 20 nt, Pseudomonas aeruginosa PA01
cggccacuucguccggccgc

SEQ ID NO: 3419176 - RNA, 22 nt, Pseudomonas aeruginosa PA01
cggccacuucguccggccgccc

SEQ ID NO: 3419177 - RNA, 13 nt, Pseudomonas aeruginosa PA01
cggccagagcuuc

SEQ ID NO: 3419178 - RNA, 20 nt, Pseudomonas aeruginosa PA01
cggccagagcuucugcugga

SEQ ID NO: 3419179 - RNA, 21 nt, Pseudomonas aeruginosa PA01
cggccagcaaugcccgcgccu

SEQ ID NO: 3419180 - RNA, 12 nt, Pseudomonas aeruginosa PA01
cggccagcagca

SEQ ID NO: 3419181 - RNA, 14 nt, Pseudomonas aeruginosa PA01
cggccagcagcacg

SEQ ID NO: 3419182 - RNA, 15 nt, Pseudomonas aeruginosa PA01
cggccagcagcacgc

SEQ ID NO: 3419183 - RNA, 16 nt, Pseudomonas aeruginosa PA01
cggccagcagcacgcc

SEQ ID NO: 3419184 - RNA, 17 nt, Pseudomonas aeruginosa PA01
cggccagcagcacgccc

SEQ ID NO: 3419185 - RNA, 19 nt, Pseudomonas aeruginosa PA01
cggccagcagcacgcccug

SEQ ID NO: 3419186 - RNA, 17 nt, Pseudomonas aeruginosa PA01
cggccagcagcacggcg

SEQ ID NO: 3419187 - RNA, 20 nt, Pseudomonas aeruginosa PA01
cggccagcagcacggcgacg

SEQ ID NO: 3419188 - RNA, 13 nt, Pseudomonas aeruginosa PA01
cggccagcagcgc

SEQ ID NO: 3419189 - RNA, 15 nt, Pseudomonas aeruginosa PA01
cggccagcagcgccu

SEQ ID NO: 3419190 - RNA, 18 nt, Pseudomonas aeruginosa PA01
cggccagccagggcagca

SEQ ID NO: 3419191 - RNA, 12 nt, Pseudomonas aeruginosa PA01
cggccagccccc

SEQ ID NO: 3419192 - RNA, 13 nt, Pseudomonas aeruginosa PA01
cggccagcccccu

SEQ ID NO: 3419193 - RNA, 14 nt, Pseudomonas aeruginosa PA01
cggccagcccccuc

SEQ ID NO: 3419194 - RNA, 20 nt, Pseudomonas aeruginosa PA01
cggccagcccccucgcccuc

SEQ ID NO: 3419195 - RNA, 14 nt, Pseudomonas aeruginosa PA01
cggccagccccugc

SEQ ID NO: 3419196 - RNA, 16 nt, Pseudomonas aeruginosa PA01
cggccagccccugcgg

SEQ ID NO: 3419197 - RNA, 13 nt, Pseudomonas aeruginosa PA01
cggccagcccggc

SEQ ID NO: 3419198 - RNA, 20 nt, Pseudomonas aeruginosa PA01
cggccagcccggccucgccg

SEQ ID NO: 3419199 - RNA, 14 nt, Pseudomonas aeruginosa PA01
cggccagccgcgcc

SEQ ID NO: 3419200 - RNA, 15 nt, Pseudomonas aeruginosa PA01
cggccagccgcgcca

SEQ ID NO: 3419201 - RNA, 16 nt, Pseudomonas aeruginosa PA01
cggccagccgcgccag

SEQ ID NO: 3419202 - RNA, 13 nt, Pseudomonas aeruginosa PA01
cggccagccgcua

SEQ ID NO: 3419203 - RNA, 23 nt, Pseudomonas aeruginosa PA01
cggccagccgcuagcgguagccg

SEQ ID NO: 3419204 - RNA, 15 nt, Pseudomonas aeruginosa PA01
cggccagccggcgcc

SEQ ID NO: 3419205 - RNA, 17 nt, Pseudomonas aeruginosa PA01
cggccagccuggccagc

SEQ ID NO: 3419206 - RNA, 19 nt, Pseudomonas aeruginosa PA01
cggccagccuggccagcgc

SEQ ID NO: 3419207 - RNA, 17 nt, Pseudomonas aeruginosa PA01
cggccagccuuccucgg

SEQ ID NO: 3419208 - RNA, 12 nt, Pseudomonas aeruginosa PA01
cggccagcgcau

SEQ ID NO: 3419209 - RNA, 13 nt, Pseudomonas aeruginosa PA01
cggccagcgcauc

SEQ ID NO: 3419210 - RNA, 14 nt, Pseudomonas aeruginosa PA01
cggccagcgcaucg

SEQ ID NO: 3419211 - RNA, 21 nt, Pseudomonas aeruginosa PA01
cggccagcgcaucgaggccgg

SEQ ID NO: 3419212 - RNA, 23 nt, Pseudomonas aeruginosa PA01
cggccagcgcaucgaggccggca

SEQ ID NO: 3419213 - RNA, 12 nt, Pseudomonas aeruginosa PA01
cggccagcgcca

SEQ ID NO: 3419214 - RNA, 18 nt, Pseudomonas aeruginosa PA01
cggccagcgccacggcgc

SEQ ID NO: 3419215 - RNA, 19 nt, Pseudomonas aeruginosa PA01
cggccagcgccacggcgcg

SEQ ID NO: 3419216 - RNA, 13 nt, Pseudomonas aeruginosa PA01
cggccagcgccag

SEQ ID NO: 3419217 - RNA, 14 nt, Pseudomonas aeruginosa PA01
cggccagcgccagg

SEQ ID NO: 3419218 - RNA, 15 nt, Pseudomonas aeruginosa PA01
cggccagcgccagga

SEQ ID NO: 3419219 - RNA, 18 nt, Pseudomonas aeruginosa PA01
cggccagcgccaggagca

SEQ ID NO: 3419220 - RNA, 19 nt, Pseudomonas aeruginosa PA01
cggccagcgccaggagcag

SEQ ID NO: 3419221 - RNA, 12 nt, Pseudomonas aeruginosa PA01
cggccagcgccg

SEQ ID NO: 3419222 - RNA, 13 nt, Pseudomonas aeruginosa PA01
cggccagcgccgc

SEQ ID NO: 3419223 - RNA, 13 nt, Pseudomonas aeruginosa PA01
cggccagcgcggc

SEQ ID NO: 3419224 - RNA, 16 nt, Pseudomonas aeruginosa PA01
cggccagcgcggccgc

SEQ ID NO: 3419225 - RNA, 18 nt, Pseudomonas aeruginosa PA01
cggccagcgcggccgccg

SEQ ID NO: 3419226 - RNA, 20 nt, Pseudomonas aeruginosa PA01
cggccagcgcggccgccgcc

SEQ ID NO: 3419227 - RNA, 22 nt, Pseudomonas aeruginosa PA01
cggccagcgcggccgccgccga

SEQ ID NO: 3419228 - RNA, 14 nt, Pseudomonas aeruginosa PA01
cggccagcgcggcg

SEQ ID NO: 3419229 - RNA, 15 nt, Pseudomonas aeruginosa PA01
cggccagcgcggcgc

SEQ ID NO: 3419230 - RNA, 18 nt, Pseudomonas aeruginosa PA01
cggccagcgcggcgcgcu

SEQ ID NO: 3419231 - RNA, 19 nt, Pseudomonas aeruginosa PA01
cggccagcgcggcggacag

SEQ ID NO: 3419232 - RNA, 16 nt, Pseudomonas aeruginosa PA01
cggccagcggaugcug

SEQ ID NO: 3419233 - RNA, 18 nt, Pseudomonas aeruginosa PA01
cggccagcggaugcuggc

SEQ ID NO: 3419234 - RNA, 14 nt, Pseudomonas aeruginosa PA01
cggccagcggcaga

SEQ ID NO: 3419235 - RNA, 20 nt, Pseudomonas aeruginosa PA01
cggccagcguccuucggcgc

SEQ ID NO: 3419236 - RNA, 12 nt, Pseudomonas aeruginosa PA01
cggccagcguga

SEQ ID NO: 3419237 - RNA, 15 nt, Pseudomonas aeruginosa PA01
cggccagcucgccga

SEQ ID NO: 3419238 - RNA, 15 nt, Pseudomonas aeruginosa PA01
cggccagcucgccgg

SEQ ID NO: 3419239 - RNA, 18 nt, Pseudomonas aeruginosa PA01
cggccagcucgccgguca

SEQ ID NO: 3419240 - RNA, 17 nt, Pseudomonas aeruginosa PA01
cggccagcuucuccagc

SEQ ID NO: 3419241 - RNA, 19 nt, Pseudomonas aeruginosa PA01
cggccaggaaggccgcuuc

SEQ ID NO: 3419242 - RNA, 17 nt, Pseudomonas aeruginosa PA01
cggccaggaccagggcg

SEQ ID NO: 3419243 - RNA, 18 nt, Pseudomonas aeruginosa PA01
cggccaggaccagggcgg

SEQ ID NO: 3419244 - RNA, 13 nt, Pseudomonas aeruginosa PA01
cggccaggacgcc

SEQ ID NO: 3419245 - RNA, 18 nt, Pseudomonas aeruginosa PA01
cggccaggacgccaccag

SEQ ID NO: 3419246 - RNA, 13 nt, Pseudomonas aeruginosa PA01
cggccaggcacag

SEQ ID NO: 3419247 - RNA, 14 nt, Pseudomonas aeruginosa PA01
cggccaggcacagg

SEQ ID NO: 3419248 - RNA, 13 nt, Pseudomonas aeruginosa PA01
cggccaggccacg

SEQ ID NO: 3419249 - RNA, 16 nt, Pseudomonas aeruginosa PA01
cggccaggccacggcc

SEQ ID NO: 3419250 - RNA, 22 nt, Pseudomonas aeruginosa PA01
cggccaggccacggccggcgag

SEQ ID NO: 3419251 - RNA, 19 nt, Pseudomonas aeruginosa PA01
cggccaggccacggcggaa

SEQ ID NO: 3419252 - RNA, 14 nt, Pseudomonas aeruginosa PA01
cggccaggcccacg

SEQ ID NO: 3419253 - RNA, 15 nt, Pseudomonas aeruginosa PA01
cggccaggcccacgc

SEQ ID NO: 3419254 - RNA, 20 nt, Pseudomonas aeruginosa PA01
cggccaggcccucagcggcg

SEQ ID NO: 3419255 - RNA, 15 nt, Pseudomonas aeruginosa PA01
cggccaggccgccca

SEQ ID NO: 3419256 - RNA, 12 nt, Pseudomonas aeruginosa PA01
cggccaggcgau

SEQ ID NO: 3419257 - RNA, 12 nt, Pseudomonas aeruginosa PA01
cggccaggcgcc

SEQ ID NO: 3419258 - RNA, 18 nt, Pseudomonas aeruginosa PA01
cggccaggcgccagggcc

SEQ ID NO: 3419259 - RNA, 19 nt, Pseudomonas aeruginosa PA01
cggccaggcgccagggccg

SEQ ID NO: 3419260 - RNA, 18 nt, Pseudomonas aeruginosa PA01
cggccaggcgccagguag

SEQ ID NO: 3419261 - RNA, 12 nt, Pseudomonas aeruginosa PA01
cggccaggcgcg

SEQ ID NO: 3419262 - RNA, 14 nt, Pseudomonas aeruginosa PA01
cggccaggcgcggc

SEQ ID NO: 3419263 - RNA, 15 nt, Pseudomonas aeruginosa PA01
cggccaggcgcggcg

SEQ ID NO: 3419264 - RNA, 15 nt, Pseudomonas aeruginosa PA01
cggccaggcgcgggu

SEQ ID NO: 3419265 - RNA, 16 nt, Pseudomonas aeruginosa PA01
cggccaggcgcggguc

SEQ ID NO: 3419266 - RNA, 18 nt, Pseudomonas aeruginosa PA01
cggccaggcgcgggucuu

SEQ ID NO: 3419267 - RNA, 22 nt, Pseudomonas aeruginosa PA01
cggccaggcgcugguccagcac

SEQ ID NO: 3419268 - RNA, 20 nt, Pseudomonas aeruginosa PA01
cggccaggcgguccagccag

SEQ ID NO: 3419269 - RNA, 14 nt, Pseudomonas aeruginosa PA01
cggccagggagcgc

SEQ ID NO: 3419270 - RNA, 21 nt, Pseudomonas aeruginosa PA01
cggccagggagucgcuggcca

SEQ ID NO: 3419271 - RNA, 22 nt, Pseudomonas aeruginosa PA01
cggccagggcaugggucagcgc

SEQ ID NO: 3419272 - RNA, 15 nt, Pseudomonas aeruginosa PA01
cggccagggccgcuc

SEQ ID NO: 3419273 - RNA, 15 nt, Pseudomonas aeruginosa PA01
cggccagggcgaaca

SEQ ID NO: 3419274 - RNA, 20 nt, Pseudomonas aeruginosa PA01
cggccagggcgaacagcgcc

SEQ ID NO: 3419275 - RNA, 21 nt, Pseudomonas aeruginosa PA01
cggccagggcgaacagcgccg

SEQ ID NO: 3419276 - RNA, 22 nt, Pseudomonas aeruginosa PA01
cggccagggcgaacagcgccgc

SEQ ID NO: 3419277 - RNA, 24 nt, Pseudomonas aeruginosa PA01
cggccagggcgaacagcgccgcgg

SEQ ID NO: 3419278 - RNA, 16 nt, Pseudomonas aeruginosa PA01
cggccagggcgaggcc

SEQ ID NO: 3419279 - RNA, 15 nt, Pseudomonas aeruginosa PA01
cggccagggcgcggu

SEQ ID NO: 3419280 - RNA, 15 nt, Pseudomonas aeruginosa PA01
cggccaggggagcgc

SEQ ID NO: 3419281 - RNA, 16 nt, Pseudomonas aeruginosa PA01
cggccaggggagcgcc

SEQ ID NO: 3419282 - RNA, 20 nt, Pseudomonas aeruginosa PA01
cggccaggggagcgccggcg

SEQ ID NO: 3419283 - RNA, 21 nt, Pseudomonas aeruginosa PA01
cggccaggggagcgccggcgc

SEQ ID NO: 3419284 - RNA, 22 nt, Pseudomonas aeruginosa PA01
cggccaggggagcgccggcgcg

SEQ ID NO: 3419285 - RNA, 23 nt, Pseudomonas aeruginosa PA01
cggccaggggagcgccggcgcgg

SEQ ID NO: 3419286 - RNA, 13 nt, Pseudomonas aeruginosa PA01
cggccaggggcug

SEQ ID NO: 3419287 - RNA, 18 nt, Pseudomonas aeruginosa PA01
cggccaggggcugaacag

SEQ ID NO: 3419288 - RNA, 21 nt, Pseudomonas aeruginosa PA01
cggccaggggcugaacagcgc

SEQ ID NO: 3419289 - RNA, 23 nt, Pseudomonas aeruginosa PA01
cggccaggggcugaacagcgcca

SEQ ID NO: 3419290 - RNA, 12 nt, Pseudomonas aeruginosa PA01
cggccagggucg

SEQ ID NO: 3419291 - RNA, 14 nt, Pseudomonas aeruginosa PA01
cggccagggucgcc

SEQ ID NO: 3419292 - RNA, 20 nt, Pseudomonas aeruginosa PA01
cggccagggucgccagcagg

SEQ ID NO: 3419293 - RNA, 17 nt, Pseudomonas aeruginosa PA01
cggccagguacuggcga

SEQ ID NO: 3419294 - RNA, 16 nt, Pseudomonas aeruginosa PA01
cggccagguacuuggc

SEQ ID NO: 3419295 - RNA, 13 nt, Pseudomonas aeruginosa PA01
cggccagguagcg

SEQ ID NO: 3419296 - RNA, 14 nt, Pseudomonas aeruginosa PA01
cggccagguaggcg

SEQ ID NO: 3419297 - RNA, 16 nt, Pseudomonas aeruginosa PA01
cggccagguaggcgac

SEQ ID NO: 3419298 - RNA, 18 nt, Pseudomonas aeruginosa PA01
cggccagguaggcgacga

SEQ ID NO: 3419299 - RNA, 19 nt, Pseudomonas aeruginosa PA01
cggccagguaggcgacgaa

SEQ ID NO: 3419300 - RNA, 20 nt, Pseudomonas aeruginosa PA01
cggccagguaggcgacgaag

SEQ ID NO: 3419301 - RNA, 20 nt, Pseudomonas aeruginosa PA01
cggccagguauucgcgcucg

SEQ ID NO: 3419302 - RNA, 13 nt, Pseudomonas aeruginosa PA01
cggccaggucgcg

SEQ ID NO: 3419303 - RNA, 14 nt, Pseudomonas aeruginosa PA01
cggccaggucgcga

SEQ ID NO: 3419304 - RNA, 14 nt, Pseudomonas aeruginosa PA01
cggccaggucgcgg

SEQ ID NO: 3419305 - RNA, 16 nt, Pseudomonas aeruginosa PA01
cggccaggucgcgggu

SEQ ID NO: 3419306 - RNA, 18 nt, Pseudomonas aeruginosa PA01
cggccaggucgcggguga

SEQ ID NO: 3419307 - RNA, 22 nt, Pseudomonas aeruginosa PA01
cggccaggucgcgggugaagcg

SEQ ID NO: 3419308 - RNA, 20 nt, Pseudomonas aeruginosa PA01
cggccaggucguugcgccgg

SEQ ID NO: 3419309 - RNA, 14 nt, Pseudomonas aeruginosa PA01
cggccagguggucg

SEQ ID NO: 3419310 - RNA, 15 nt, Pseudomonas aeruginosa PA01
cggccagguugacca

SEQ ID NO: 3419311 - RNA, 13 nt, Pseudomonas aeruginosa PA01
cggccaguuccuu

SEQ ID NO: 3419312 - RNA, 17 nt, Pseudomonas aeruginosa PA01
cggccaguuccuucacg

SEQ ID NO: 3419313 - RNA, 22 nt, Pseudomonas aeruginosa PA01
cggccaguuccuucacggcauc

SEQ ID NO: 3419314 - RNA, 17 nt, Pseudomonas aeruginosa PA01
cggccaguucgcggcgc

SEQ ID NO: 3419315 - RNA, 14 nt, Pseudomonas aeruginosa PA01
cggccaguucgggg

SEQ ID NO: 3419316 - RNA, 22 nt, Pseudomonas aeruginosa PA01
cggccaguucggggucggccug

SEQ ID NO: 3419317 - RNA, 20 nt, Pseudomonas aeruginosa PA01
cggccaguuggugcacgcgc

SEQ ID NO: 3419318 - RNA, 24 nt, Pseudomonas aeruginosa PA01
cggccaguuggugcacgcgccggg

SEQ ID NO: 3419319 - RNA, 17 nt, Pseudomonas aeruginosa PA01
cggccaguuguuccggc

SEQ ID NO: 3419320 - RNA, 20 nt, Pseudomonas aeruginosa PA01
cggccaguuguuccggcugg

SEQ ID NO: 3419321 - RNA, 16 nt, Pseudomonas aeruginosa PA01
cggccauaccuccagc

SEQ ID NO: 3419322 - RNA, 20 nt, Pseudomonas aeruginosa PA01
cggccauaccuccagccagc

SEQ ID NO: 3419323 - RNA, 22 nt, Pseudomonas aeruginosa PA01
cggccauaccuccagccagcag

SEQ ID NO: 3419324 - RNA, 13 nt, Pseudomonas aeruginosa PA01
cggccaucagcac

SEQ ID NO: 3419325 - RNA, 16 nt, Pseudomonas aeruginosa PA01
cggccaucagcaccag

SEQ ID NO: 3419326 - RNA, 15 nt, Pseudomonas aeruginosa PA01
cggccaucagcgcca

SEQ ID NO: 3419327 - RNA, 17 nt, Pseudomonas aeruginosa PA01
cggccauccagccaggc

SEQ ID NO: 3419328 - RNA, 20 nt, Pseudomonas aeruginosa PA01
cggccauccagccaggcgcu

SEQ ID NO: 3419329 - RNA, 15 nt, Pseudomonas aeruginosa PA01
cggccauccuggccg

SEQ ID NO: 3419330 - RNA, 16 nt, Pseudomonas aeruginosa PA01
cggccauccuggccgg

SEQ ID NO: 3419331 - RNA, 20 nt, Pseudomonas aeruginosa PA01
cggccauccuggccggucgu

SEQ ID NO: 3419332 - RNA, 14 nt, Pseudomonas aeruginosa PA01
cggccaucgagcgc

SEQ ID NO: 3419333 - RNA, 19 nt, Pseudomonas aeruginosa PA01
cggccaucgagcgcuccac

SEQ ID NO: 3419334 - RNA, 22 nt, Pseudomonas aeruginosa PA01
cggccaucgagcgcuccaccgc

SEQ ID NO: 3419335 - RNA, 23 nt, Pseudomonas aeruginosa PA01
cggccaucgagcgcuccaccgcg

SEQ ID NO: 3419336 - RNA, 16 nt, Pseudomonas aeruginosa PA01
cggccaucgccgucuc

SEQ ID NO: 3419337 - RNA, 15 nt, Pseudomonas aeruginosa PA01
cggccaucggcgaag

SEQ ID NO: 3419338 - RNA, 16 nt, Pseudomonas aeruginosa PA01
cggccaucggcgaagc

SEQ ID NO: 3419339 - RNA, 20 nt, Pseudomonas aeruginosa PA01
cggccaugcaggccagggcg

SEQ ID NO: 3419340 - RNA, 14 nt, Pseudomonas aeruginosa PA01
cggccaugccgccg

SEQ ID NO: 3419341 - RNA, 16 nt, Pseudomonas aeruginosa PA01
cggccaugccgccgac

SEQ ID NO: 3419342 - RNA, 17 nt, Pseudomonas aeruginosa PA01
cggccaugccgccgacg

SEQ ID NO: 3419343 - RNA, 19 nt, Pseudomonas aeruginosa PA01
cggccaugccgccgacgcc

SEQ ID NO: 3419344 - RNA, 20 nt, Pseudomonas aeruginosa PA01
cggccaugccgccgacgccg

SEQ ID NO: 3419345 - RNA, 18 nt, Pseudomonas aeruginosa PA01
cggccaugccggccagga

SEQ ID NO: 3419346 - RNA, 14 nt, Pseudomonas aeruginosa PA01
cggccauggccgag

SEQ ID NO: 3419347 - RNA, 15 nt, Pseudomonas aeruginosa PA01
cggccauggccgagc

SEQ ID NO: 3419348 - RNA, 16 nt, Pseudomonas aeruginosa PA01
cggccauggccgagcc

SEQ ID NO: 3419349 - RNA, 13 nt, Pseudomonas aeruginosa PA01
cggccaugucccg

SEQ ID NO: 3419350 - RNA, 17 nt, Pseudomonas aeruginosa PA01
cggccauuacgccgagc

SEQ ID NO: 3419351 - RNA, 19 nt, Pseudomonas aeruginosa PA01
cggccauucgcugucgagc

SEQ ID NO: 3419352 - RNA, 14 nt, Pseudomonas aeruginosa PA01
cggccauucggccu

SEQ ID NO: 3419353 - RNA, 18 nt, Pseudomonas aeruginosa PA01
cggccauucggccuggca

SEQ ID NO: 3419354 - RNA, 21 nt, Pseudomonas aeruginosa PA01
cggccauugcccgguggccuc

SEQ ID NO: 3419355 - RNA, 17 nt, Pseudomonas aeruginosa PA01
cggccauugccgccaga

SEQ ID NO: 3419356 - RNA, 15 nt, Pseudomonas aeruginosa PA01
cggccauugccgcgg

SEQ ID NO: 3419357 - RNA, 15 nt, Pseudomonas aeruginosa PA01
cggccauugucggcc

SEQ ID NO: 3419358 - RNA, 18 nt, Pseudomonas aeruginosa PA01
cggccauugucggccucg

SEQ ID NO: 3419359 - RNA, 21 nt, Pseudomonas aeruginosa PA01
cggccauugucggccucgaug

SEQ ID NO: 3419360 - RNA, 20 nt, Pseudomonas aeruginosa PA01
cggccauuuuucaugggcgg

SEQ ID NO: 3419361 - RNA, 21 nt, Pseudomonas aeruginosa PA01
cggccauuuuucaugggcggg

SEQ ID NO: 3419362 - RNA, 18 nt, Pseudomonas aeruginosa PA01
cggcccaccaccacgacg

SEQ ID NO: 3419363 - RNA, 12 nt, Pseudomonas aeruginosa PA01
cggcccaccaga

SEQ ID NO: 3419364 - RNA, 22 nt, Pseudomonas aeruginosa PA01
cggcccacgcucagugcgccgg

SEQ ID NO: 3419365 - RNA, 12 nt, Pseudomonas aeruginosa PA01
cggcccagcagc

SEQ ID NO: 3419366 - RNA, 13 nt, Pseudomonas aeruginosa PA01
cggcccagcagcg

SEQ ID NO: 3419367 - RNA, 15 nt, Pseudomonas aeruginosa PA01
cggcccagcagcgcu

SEQ ID NO: 3419368 - RNA, 12 nt, Pseudomonas aeruginosa PA01
cggcccagcagg

SEQ ID NO: 3419369 - RNA, 13 nt, Pseudomonas aeruginosa PA01
cggcccagcaggc

SEQ ID NO: 3419370 - RNA, 16 nt, Pseudomonas aeruginosa PA01
cggcccagcaggccgg

SEQ ID NO: 3419371 - RNA, 18 nt, Pseudomonas aeruginosa PA01
cggcccagcaggccggcc

SEQ ID NO: 3419372 - RNA, 21 nt, Pseudomonas aeruginosa PA01
cggcccagcaggccggccagc

SEQ ID NO: 3419373 - RNA, 15 nt, Pseudomonas aeruginosa PA01
cggcccagccgcggc

SEQ ID NO: 3419374 - RNA, 16 nt, Pseudomonas aeruginosa PA01
cggcccagccgcggcg

SEQ ID NO: 3419375 - RNA, 12 nt, Pseudomonas aeruginosa PA01
cggcccagcgcc

SEQ ID NO: 3419376 - RNA, 13 nt, Pseudomonas aeruginosa PA01
cggcccagcgccc

SEQ ID NO: 3419377 - RNA, 13 nt, Pseudomonas aeruginosa PA01
cggcccagcggca

SEQ ID NO: 3419378 - RNA, 18 nt, Pseudomonas aeruginosa PA01
cggcccagcggcaggucg

SEQ ID NO: 3419379 - RNA, 18 nt, Pseudomonas aeruginosa PA01
cggcccagcguucggcgc

SEQ ID NO: 3419380 - RNA, 19 nt, Pseudomonas aeruginosa PA01
cggcccagcguucggcgcu

SEQ ID NO: 3419381 - RNA, 23 nt, Pseudomonas aeruginosa PA01
cggcccagcguucggcgcuggcg

SEQ ID NO: 3419382 - RNA, 15 nt, Pseudomonas aeruginosa PA01
cggcccauccgccgc

SEQ ID NO: 3419383 - RNA, 16 nt, Pseudomonas aeruginosa PA01
cggcccauccgccgca

SEQ ID NO: 3419384 - RNA, 18 nt, Pseudomonas aeruginosa PA01
cggcccauccgccgcagg

SEQ ID NO: 3419385 - RNA, 22 nt, Pseudomonas aeruginosa PA01
cggcccaugaaaaagcccggcc

SEQ ID NO: 3419386 - RNA, 14 nt, Pseudomonas aeruginosa PA01
cggcccaugccucc

SEQ ID NO: 3419387 - RNA, 17 nt, Pseudomonas aeruginosa PA01
cggcccaugcggaucgc

SEQ ID NO: 3419388 - RNA, 21 nt, Pseudomonas aeruginosa PA01
cggcccaugcggaucgccucc

SEQ ID NO: 3419389 - RNA, 14 nt, Pseudomonas aeruginosa PA01
cggccccaccagca

SEQ ID NO: 3419390 - RNA, 15 nt, Pseudomonas aeruginosa PA01
cggccccaccagcaa

SEQ ID NO: 3419391 - RNA, 12 nt, Pseudomonas aeruginosa PA01
cggccccaccgc

SEQ ID NO: 3419392 - RNA, 14 nt, Pseudomonas aeruginosa PA01
cggccccaccgcac

SEQ ID NO: 3419393 - RNA, 14 nt, Pseudomonas aeruginosa PA01
cggccccaccuggc

SEQ ID NO: 3419394 - RNA, 17 nt, Pseudomonas aeruginosa PA01
cggccccaccuggcgac

SEQ ID NO: 3419395 - RNA, 22 nt, Pseudomonas aeruginosa PA01
cggccccaccuggcgacaggcg

SEQ ID NO: 3419396 - RNA, 11 nt, Pseudomonas aeruginosa PA01
cggccccaggc

SEQ ID NO: 3419397 - RNA, 20 nt, Pseudomonas aeruginosa PA01
cggccccgcgguacccggca

SEQ ID NO: 3419398 - RNA, 15 nt, Pseudomonas aeruginosa PA01
cggccccggcgcucg

SEQ ID NO: 3419399 - RNA, 16 nt, Pseudomonas aeruginosa PA01
cggccccugggccggc

SEQ ID NO: 3419400 - RNA, 17 nt, Pseudomonas aeruginosa PA01
cggccccugggccggcu

SEQ ID NO: 3419401 - RNA, 18 nt, Pseudomonas aeruginosa PA01
cggccccugggccggcuu

SEQ ID NO: 3419402 - RNA, 17 nt, Pseudomonas aeruginosa PA01
cggccccuucagcucca

SEQ ID NO: 3419403 - RNA, 18 nt, Pseudomonas aeruginosa PA01
cggccccuucagcuccag

SEQ ID NO: 3419404 - RNA, 19 nt, Pseudomonas aeruginosa PA01
cggccccuucagcuccagc

SEQ ID NO: 3419405 - RNA, 12 nt, Pseudomonas aeruginosa PA01
cggcccgaccca

SEQ ID NO: 3419406 - RNA, 13 nt, Pseudomonas aeruginosa PA01
cggcccgacccac

SEQ ID NO: 3419407 - RNA, 19 nt, Pseudomonas aeruginosa PA01
cggcccgacgccgcccggc

SEQ ID NO: 3419408 - RNA, 20 nt, Pseudomonas aeruginosa PA01
cggcccgagcaggcugccga

SEQ ID NO: 3419409 - RNA, 16 nt, Pseudomonas aeruginosa PA01
cggcccgagggcggca

SEQ ID NO: 3419410 - RNA, 18 nt, Pseudomonas aeruginosa PA01
cggcccgagggcggcagg

SEQ ID NO: 3419411 - RNA, 21 nt, Pseudomonas aeruginosa PA01
cggcccgccacagaucgccag

SEQ ID NO: 3419412 - RNA, 22 nt, Pseudomonas aeruginosa PA01
cggcccgccacagaucgccagc

SEQ ID NO: 3419413 - RNA, 12 nt, Pseudomonas aeruginosa PA01
cggcccgccccg

SEQ ID NO: 3419414 - RNA, 17 nt, Pseudomonas aeruginosa PA01
cggcccgccgccggggc

SEQ ID NO: 3419415 - RNA, 12 nt, Pseudomonas aeruginosa PA01
cggcccgccggc

SEQ ID NO: 3419416 - RNA, 13 nt, Pseudomonas aeruginosa PA01
cggcccgccggcg

SEQ ID NO: 3419417 - RNA, 14 nt, Pseudomonas aeruginosa PA01
cggcccgccucggc

SEQ ID NO: 3419418 - RNA, 18 nt, Pseudomonas aeruginosa PA01
cggcccgccucggcggcu

SEQ ID NO: 3419419 - RNA, 13 nt, Pseudomonas aeruginosa PA01
cggcccgcgccgc

SEQ ID NO: 3419420 - RNA, 15 nt, Pseudomonas aeruginosa PA01
cggcccgcgccgccu

SEQ ID NO: 3419421 - RNA, 17 nt, Pseudomonas aeruginosa PA01
cggcccgcgcggcaacg

SEQ ID NO: 3419422 - RNA, 20 nt, Pseudomonas aeruginosa PA01
cggcccgcggaucgcgccgu

SEQ ID NO: 3419423 - RNA, 22 nt, Pseudomonas aeruginosa PA01
cggcccgcggaucgcgccgucg

SEQ ID NO: 3419424 - RNA, 23 nt, Pseudomonas aeruginosa PA01
cggcccgcggucacucggccucg

SEQ ID NO: 3419425 - RNA, 22 nt, Pseudomonas aeruginosa PA01
cggcccgcucuugauacccacc

SEQ ID NO: 3419426 - RNA, 14 nt, Pseudomonas aeruginosa PA01
cggcccggaagcuc

SEQ ID NO: 3419427 - RNA, 13 nt, Pseudomonas aeruginosa PA01
cggcccggagacc

SEQ ID NO: 3419428 - RNA, 19 nt, Pseudomonas aeruginosa PA01
cggcccggagaccgugccg

SEQ ID NO: 3419429 - RNA, 22 nt, Pseudomonas aeruginosa PA01
cggcccggagaccgugccgccg

SEQ ID NO: 3419430 - RNA, 23 nt, Pseudomonas aeruginosa PA01
cggcccggagaccgugccgccgg

SEQ ID NO: 3419431 - RNA, 12 nt, Pseudomonas aeruginosa PA01
cggcccggagcc

SEQ ID NO: 3419432 - RNA, 14 nt, Pseudomonas aeruginosa PA01
cggcccggagccaa

SEQ ID NO: 3419433 - RNA, 17 nt, Pseudomonas aeruginosa PA01
cggcccggagccaacgc

SEQ ID NO: 3419434 - RNA, 22 nt, Pseudomonas aeruginosa PA01
cggcccggagccaacgcccggg

SEQ ID NO: 3419435 - RNA, 14 nt, Pseudomonas aeruginosa PA01
cggcccggagcgcg

SEQ ID NO: 3419436 - RNA, 15 nt, Pseudomonas aeruginosa PA01
cggcccggagcgcga

SEQ ID NO: 3419437 - RNA, 17 nt, Pseudomonas aeruginosa PA01
cggcccggagcgcgagg

SEQ ID NO: 3419438 - RNA, 18 nt, Pseudomonas aeruginosa PA01
cggcccggagcgcgaggc

SEQ ID NO: 3419439 - RNA, 19 nt, Pseudomonas aeruginosa PA01
cggcccggagcgcgaggcg

SEQ ID NO: 3419440 - RNA, 15 nt, Pseudomonas aeruginosa PA01
cggcccggcaggcgc

SEQ ID NO: 3419441 - RNA, 20 nt, Pseudomonas aeruginosa PA01
cggcccggcaggcgcacgcg

SEQ ID NO: 3419442 - RNA, 13 nt, Pseudomonas aeruginosa PA01
cggcccggccagg

SEQ ID NO: 3419443 - RNA, 14 nt, Pseudomonas aeruginosa PA01
cggcccggccaggc

SEQ ID NO: 3419444 - RNA, 15 nt, Pseudomonas aeruginosa PA01
cggcccggccaggcg

SEQ ID NO: 3419445 - RNA, 14 nt, Pseudomonas aeruginosa PA01
cggcccggccaucc

SEQ ID NO: 3419446 - RNA, 18 nt, Pseudomonas aeruginosa PA01
cggcccggcgugagcagg

SEQ ID NO: 3419447 - RNA, 19 nt, Pseudomonas aeruginosa PA01
cggcccggcgugagcaggg

SEQ ID NO: 3419448 - RNA, 22 nt, Pseudomonas aeruginosa PA01
cggcccgggccuggugcacgcc

SEQ ID NO: 3419449 - RNA, 11 nt, Pseudomonas aeruginosa PA01
cggcccgggcg

SEQ ID NO: 3419450 - RNA, 15 nt, Pseudomonas aeruginosa PA01
cggcccgggcgccac

SEQ ID NO: 3419451 - RNA, 19 nt, Pseudomonas aeruginosa PA01
cggcccgggcgccaccgcg

SEQ ID NO: 3419452 - RNA, 17 nt, Pseudomonas aeruginosa PA01
cggcccggggcucugcc

SEQ ID NO: 3419453 - RNA, 22 nt, Pseudomonas aeruginosa PA01
cggcccggggcucugccggugu

SEQ ID NO: 3419454 - RNA, 19 nt, Pseudomonas aeruginosa PA01
cggcccgggucacggucag

SEQ ID NO: 3419455 - RNA, 23 nt, Pseudomonas aeruginosa PA01
cggcccgggucacggucagcucg

SEQ ID NO: 3419456 - RNA, 12 nt, Pseudomonas aeruginosa PA01
cggcccggucag

SEQ ID NO: 3419457 - RNA, 23 nt, Pseudomonas aeruginosa PA01
cggcccggucagcuucgccgccc

SEQ ID NO: 3419458 - RNA, 21 nt, Pseudomonas aeruginosa PA01
cggcccgguuuuccgcuucca

SEQ ID NO: 3419459 - RNA, 16 nt, Pseudomonas aeruginosa PA01
cggcccguccgcgcca

SEQ ID NO: 3419460 - RNA, 18 nt, Pseudomonas aeruginosa PA01
cggcccguccgcgccacg

SEQ ID NO: 3419461 - RNA, 16 nt, Pseudomonas aeruginosa PA01
cggcccucacgggccg

SEQ ID NO: 3419462 - RNA, 13 nt, Pseudomonas aeruginosa PA01
cggcccuccggcg

SEQ ID NO: 3419463 - RNA, 12 nt, Pseudomonas aeruginosa PA01
cggcccugcgcc

SEQ ID NO: 3419464 - RNA, 17 nt, Pseudomonas aeruginosa PA01
cggcccugcgccgcagc

SEQ ID NO: 3419465 - RNA, 22 nt, Pseudomonas aeruginosa PA01
cggcccugcgccgcagcggcca

SEQ ID NO: 3419466 - RNA, 13 nt, Pseudomonas aeruginosa PA01
cggcccugcucgc

SEQ ID NO: 3419467 - RNA, 16 nt, Pseudomonas aeruginosa PA01
cggcccugcucgccgg

SEQ ID NO: 3419468 - RNA, 17 nt, Pseudomonas aeruginosa PA01
cggcccugcucgccggc

SEQ ID NO: 3419469 - RNA, 23 nt, Pseudomonas aeruginosa PA01
cggcccugggcguggcaaaaaug

SEQ ID NO: 3419470 - RNA, 22 nt, Pseudomonas aeruginosa PA01
cggcccugguugcggaacggcu

SEQ ID NO: 3419471 - RNA, 16 nt, Pseudomonas aeruginosa PA01
cggcccuucgacaugg

SEQ ID NO: 3419472 - RNA, 21 nt, Pseudomonas aeruginosa PA01
cggcccuucgacaugggccgc

SEQ ID NO: 3419473 - RNA, 20 nt, Pseudomonas aeruginosa PA01
cggcccuucgacgacaccug

SEQ ID NO: 3419474 - RNA, 18 nt, Pseudomonas aeruginosa PA01
cggcccuugagcauggcg

SEQ ID NO: 3419475 - RNA, 16 nt, Pseudomonas aeruginosa PA01
cggcccuugcccggau

SEQ ID NO: 3419476 - RNA, 12 nt, Pseudomonas aeruginosa PA01
cggcccuugucg

SEQ ID NO: 3419477 - RNA, 17 nt, Pseudomonas aeruginosa PA01
cggcccuugucgccgcu

SEQ ID NO: 3419478 - RNA, 18 nt, Pseudomonas aeruginosa PA01
cggcccuugucgccgcug

SEQ ID NO: 3419479 - RNA, 19 nt, Pseudomonas aeruginosa PA01
cggcccuugucgccgcugg

SEQ ID NO: 3419480 - RNA, 23 nt, Pseudomonas aeruginosa PA01
cggcccuuguucgcggcgaugcg

SEQ ID NO: 3419481 - RNA, 18 nt, Pseudomonas aeruginosa PA01
cggccgaaaucgaugucg

SEQ ID NO: 3419482 - RNA, 22 nt, Pseudomonas aeruginosa PA01
cggccgaaaucgaugucgcggc

SEQ ID NO: 3419483 - RNA, 15 nt, Pseudomonas aeruginosa PA01
cggccgaacagacgc

SEQ ID NO: 3419484 - RNA, 16 nt, Pseudomonas aeruginosa PA01
cggccgaacucuggcg

SEQ ID NO: 3419485 - RNA, 21 nt, Pseudomonas aeruginosa PA01
cggccgaacucuggcggcgua

SEQ ID NO: 3419486 - RNA, 24 nt, Pseudomonas aeruginosa PA01
cggccgaacucuggcggcguaucc

SEQ ID NO: 3419487 - RNA, 13 nt, Pseudomonas aeruginosa PA01
cggccgaacugga

SEQ ID NO: 3419488 - RNA, 19 nt, Pseudomonas aeruginosa PA01
cggccgaagaacaccacgc

SEQ ID NO: 3419489 - RNA, 20 nt, Pseudomonas aeruginosa PA01
cggccgaauccuccagccgg

SEQ ID NO: 3419490 - RNA, 22 nt, Pseudomonas aeruginosa PA01
cggccgaauuccagcuugucca

SEQ ID NO: 3419491 - RNA, 21 nt, Pseudomonas aeruginosa PA01
cggccgacagagcggccggcg

SEQ ID NO: 3419492 - RNA, 22 nt, Pseudomonas aeruginosa PA01
cggccgacagagcggccggcgc

SEQ ID NO: 3419493 - RNA, 23 nt, Pseudomonas aeruginosa PA01
cggccgacagagcggccggcgcg

SEQ ID NO: 3419494 - RNA, 16 nt, Pseudomonas aeruginosa PA01
cggccgaccaggccgu

SEQ ID NO: 3419495 - RNA, 21 nt, Pseudomonas aeruginosa PA01
cggccgaccaggugcuggucg

SEQ ID NO: 3419496 - RNA, 21 nt, Pseudomonas aeruginosa PA01
cggccgacgauguucgaggcg

SEQ ID NO: 3419497 - RNA, 17 nt, Pseudomonas aeruginosa PA01
cggccgacgugcacccg

SEQ ID NO: 3419498 - RNA, 15 nt, Pseudomonas aeruginosa PA01
cggccgagcaccacg

SEQ ID NO: 3419499 - RNA, 16 nt, Pseudomonas aeruginosa PA01
cggccgagcaccacgc

SEQ ID NO: 3419500 - RNA, 18 nt, Pseudomonas aeruginosa PA01
cggccgagcaccacgcgc

SEQ ID NO: 3419501 - RNA, 16 nt, Pseudomonas aeruginosa PA01
cggccgagcaggcgcg

SEQ ID NO: 3419502 - RNA, 22 nt, Pseudomonas aeruginosa PA01
cggccgagcaggcgcgccaggc

SEQ ID NO: 3419503 - RNA, 24 nt, Pseudomonas aeruginosa PA01
cggccgagcaggcgcgccaggccc

SEQ ID NO: 3419504 - RNA, 21 nt, Pseudomonas aeruginosa PA01
cggccgaggaacuccuccucg

SEQ ID NO: 3419505 - RNA, 15 nt, Pseudomonas aeruginosa PA01
cggccgaggaaggcg

SEQ ID NO: 3419506 - RNA, 21 nt, Pseudomonas aeruginosa PA01
cggccgaggaaggcgcuggcg

SEQ ID NO: 3419507 - RNA, 23 nt, Pseudomonas aeruginosa PA01
cggccgaggaaggcgcuggcgcu

SEQ ID NO: 3419508 - RNA, 15 nt, Pseudomonas aeruginosa PA01
cggccgagggcgagu

SEQ ID NO: 3419509 - RNA, 22 nt, Pseudomonas aeruginosa PA01
cggccgagggcgaguucggcga

SEQ ID NO: 3419510 - RNA, 23 nt, Pseudomonas aeruginosa PA01
cggccgagggcgaguucggcgag

SEQ ID NO: 3419511 - RNA, 17 nt, Pseudomonas aeruginosa PA01
cggccgaguucgcgcag

SEQ ID NO: 3419512 - RNA, 20 nt, Pseudomonas aeruginosa PA01
cggccgaguucgcgcaggcg

SEQ ID NO: 3419513 - RNA, 15 nt, Pseudomonas aeruginosa PA01
cggccgaucaucggc

SEQ ID NO: 3419514 - RNA, 16 nt, Pseudomonas aeruginosa PA01
cggccgaucaucggcu

SEQ ID NO: 3419515 - RNA, 19 nt, Pseudomonas aeruginosa PA01
cggccgaucaucggcuggu

SEQ ID NO: 3419516 - RNA, 16 nt, Pseudomonas aeruginosa PA01
cggccgaucuccuggc

SEQ ID NO: 3419517 - RNA, 17 nt, Pseudomonas aeruginosa PA01
cggccgaucuccuggcg

SEQ ID NO: 3419518 - RNA, 15 nt, Pseudomonas aeruginosa PA01
cggccgaucuucagc

SEQ ID NO: 3419519 - RNA, 17 nt, Pseudomonas aeruginosa PA01
cggccgaucuucagcag

SEQ ID NO: 3419520 - RNA, 19 nt, Pseudomonas aeruginosa PA01
cggccgaucuucagcagca

SEQ ID NO: 3419521 - RNA, 23 nt, Pseudomonas aeruginosa PA01
cggccgaucuucagcagcaggcg

SEQ ID NO: 3419522 - RNA, 12 nt, Pseudomonas aeruginosa PA01
cggccgaugauc

SEQ ID NO: 3419523 - RNA, 15 nt, Pseudomonas aeruginosa PA01
cggccgaugaucucc

SEQ ID NO: 3419524 - RNA, 21 nt, Pseudomonas aeruginosa PA01
cggccgaugaucuccgcgccg

SEQ ID NO: 3419525 - RNA, 22 nt, Pseudomonas aeruginosa PA01
cggccgaugaucuccgcgccgg

SEQ ID NO: 3419526 - RNA, 22 nt, Pseudomonas aeruginosa PA01
cggccgauggaaaucggccacu

SEQ ID NO: 3419527 - RNA, 24 nt, Pseudomonas aeruginosa PA01
cggccgauggaaaucggccacucc

SEQ ID NO: 3419528 - RNA, 22 nt, Pseudomonas aeruginosa PA01
cggccgaugugaaaacggcgca

SEQ ID NO: 3419529 - RNA, 17 nt, Pseudomonas aeruginosa PA01
cggccgcaaccagcccu

SEQ ID NO: 3419530 - RNA, 15 nt, Pseudomonas aeruginosa PA01
cggccgcaugccggg

SEQ ID NO: 3419531 - RNA, 12 nt, Pseudomonas aeruginosa PA01
cggccgccaggc

SEQ ID NO: 3419532 - RNA, 14 nt, Pseudomonas aeruginosa PA01
cggccgccaggcgc

SEQ ID NO: 3419533 - RNA, 16 nt, Pseudomonas aeruginosa PA01
cggccgccaggcgcgu

SEQ ID NO: 3419534 - RNA, 14 nt, Pseudomonas aeruginosa PA01
cggccgccaggcug

SEQ ID NO: 3419535 - RNA, 16 nt, Pseudomonas aeruginosa PA01
cggccgccaggcuggg

SEQ ID NO: 3419536 - RNA, 14 nt, Pseudomonas aeruginosa PA01
cggccgccauuccg

SEQ ID NO: 3419537 - RNA, 12 nt, Pseudomonas aeruginosa PA01
cggccgcccagc

SEQ ID NO: 3419538 - RNA, 14 nt, Pseudomonas aeruginosa PA01
cggccgcccagcgg

SEQ ID NO: 3419539 - RNA, 17 nt, Pseudomonas aeruginosa PA01
cggccgcccgagccgcu

SEQ ID NO: 3419540 - RNA, 22 nt, Pseudomonas aeruginosa PA01
cggccgccgaaaugcugcaggc

SEQ ID NO: 3419541 - RNA, 23 nt, Pseudomonas aeruginosa PA01
cggccgccgaaaugcugcaggcc

SEQ ID NO: 3419542 - RNA, 17 nt, Pseudomonas aeruginosa PA01
cggccgccgagcaacug

SEQ ID NO: 3419543 - RNA, 14 nt, Pseudomonas aeruginosa PA01
cggccgccgccgac

SEQ ID NO: 3419544 - RNA, 12 nt, Pseudomonas aeruginosa PA01
cggccgccggcg

SEQ ID NO: 3419545 - RNA, 15 nt, Pseudomonas aeruginosa PA01
cggccgccggcgccc

SEQ ID NO: 3419546 - RNA, 17 nt, Pseudomonas aeruginosa PA01
cggccgccggcgcccug

SEQ ID NO: 3419547 - RNA, 18 nt, Pseudomonas aeruginosa PA01
cggccgccggcgcccugc

SEQ ID NO: 3419548 - RNA, 12 nt, Pseudomonas aeruginosa PA01
cggccgccuggc

SEQ ID NO: 3419549 - RNA, 13 nt, Pseudomonas aeruginosa PA01
cggccgccuggcg

SEQ ID NO: 3419550 - RNA, 15 nt, Pseudomonas aeruginosa PA01
cggccgccuggcgug

SEQ ID NO: 3419551 - RNA, 21 nt, Pseudomonas aeruginosa PA01
cggccgccuggcgugccgcca

SEQ ID NO: 3419552 - RNA, 14 nt, Pseudomonas aeruginosa PA01
cggccgcgagcgcg

SEQ ID NO: 3419553 - RNA, 15 nt, Pseudomonas aeruginosa PA01
cggccgcgagcgcgg

SEQ ID NO: 3419554 - RNA, 18 nt, Pseudomonas aeruginosa PA01
cggccgcgagcgcggccg

SEQ ID NO: 3419555 - RNA, 20 nt, Pseudomonas aeruginosa PA01
cggccgcgagcgcggccggc

SEQ ID NO: 3419556 - RNA, 21 nt, Pseudomonas aeruginosa PA01
cggccgcgagcgcggccggcc

SEQ ID NO: 3419557 - RNA, 23 nt, Pseudomonas aeruginosa PA01
cggccgcgagcgcggccggccac

SEQ ID NO: 3419558 - RNA, 16 nt, Pseudomonas aeruginosa PA01
cggccgcgccagccac

SEQ ID NO: 3419559 - RNA, 12 nt, Pseudomonas aeruginosa PA01
cggccgcgccgg

SEQ ID NO: 3419560 - RNA, 19 nt, Pseudomonas aeruginosa PA01
cggccgcgccuucagcgcc

SEQ ID NO: 3419561 - RNA, 12 nt, Pseudomonas aeruginosa PA01
cggccgcggcug

SEQ ID NO: 3419562 - RNA, 15 nt, Pseudomonas aeruginosa PA01
cggccgcggcuggca

SEQ ID NO: 3419563 - RNA, 21 nt, Pseudomonas aeruginosa PA01
cggccgcggcuggcaggugcc

SEQ ID NO: 3419564 - RNA, 13 nt, Pseudomonas aeruginosa PA01
cggccgcguccga

SEQ ID NO: 3419565 - RNA, 21 nt, Pseudomonas aeruginosa PA01
cggccgcguccgagagcaggg

SEQ ID NO: 3419566 - RNA, 16 nt, Pseudomonas aeruginosa PA01
cggccgcgucgcccag

SEQ ID NO: 3419567 - RNA, 18 nt, Pseudomonas aeruginosa PA01
cggccgcgucgcccaggc

SEQ ID NO: 3419568 - RNA, 19 nt, Pseudomonas aeruginosa PA01
cggccgcgucgcccaggcc

SEQ ID NO: 3419569 - RNA, 16 nt, Pseudomonas aeruginosa PA01
cggccgcugccgggcu

SEQ ID NO: 3419570 - RNA, 13 nt, Pseudomonas aeruginosa PA01
cggccgcugccgu

SEQ ID NO: 3419571 - RNA, 22 nt, Pseudomonas aeruginosa PA01
cggccgcugccguugcaggccc

SEQ ID NO: 3419572 - RNA, 15 nt, Pseudomonas aeruginosa PA01
cggccgcugcgcagg

SEQ ID NO: 3419573 - RNA, 20 nt, Pseudomonas aeruginosa PA01
cggccgcugcgcaggccgag

SEQ ID NO: 3419574 - RNA, 21 nt, Pseudomonas aeruginosa PA01
cggccgcuggaugccgaccac

SEQ ID NO: 3419575 - RNA, 18 nt, Pseudomonas aeruginosa PA01
cggccgcuggcgaucucg

SEQ ID NO: 3419576 - RNA, 21 nt, Pseudomonas aeruginosa PA01
cggccgcuggcgaucucggcg

SEQ ID NO: 3419577 - RNA, 22 nt, Pseudomonas aeruginosa PA01
cggccgcuggcgaucucggcgc

SEQ ID NO: 3419578 - RNA, 23 nt, Pseudomonas aeruginosa PA01
cggccgcugucgucuucggccag

SEQ ID NO: 3419579 - RNA, 23 nt, Pseudomonas aeruginosa PA01
cggccggaggggaugugcucagc

SEQ ID NO: 3419580 - RNA, 13 nt, Pseudomonas aeruginosa PA01
cggccggauggcc

SEQ ID NO: 3419581 - RNA, 14 nt, Pseudomonas aeruginosa PA01
cggccggauggccg

SEQ ID NO: 3419582 - RNA, 18 nt, Pseudomonas aeruginosa PA01
cggccggauggccgccgu

SEQ ID NO: 3419583 - RNA, 15 nt, Pseudomonas aeruginosa PA01
cggccggauuggccg

SEQ ID NO: 3419584 - RNA, 17 nt, Pseudomonas aeruginosa PA01
cggccggauuggccgag

SEQ ID NO: 3419585 - RNA, 13 nt, Pseudomonas aeruginosa PA01
cggccggcagcga

SEQ ID NO: 3419586 - RNA, 19 nt, Pseudomonas aeruginosa PA01
cggccggcagcuccggcgg

SEQ ID NO: 3419587 - RNA, 22 nt, Pseudomonas aeruginosa PA01
cggccggcagcuccggcgggcg

SEQ ID NO: 3419588 - RNA, 13 nt, Pseudomonas aeruginosa PA01
cggccggcaggag

SEQ ID NO: 3419589 - RNA, 13 nt, Pseudomonas aeruginosa PA01
cggccggcaggcc

SEQ ID NO: 3419590 - RNA, 20 nt, Pseudomonas aeruginosa PA01
cggccggcaggccgauggcc

SEQ ID NO: 3419591 - RNA, 13 nt, Pseudomonas aeruginosa PA01
cggccggcaggcu

SEQ ID NO: 3419592 - RNA, 14 nt, Pseudomonas aeruginosa PA01
cggccggccacgcg

SEQ ID NO: 3419593 - RNA, 19 nt, Pseudomonas aeruginosa PA01
cggccggccacgcgaccag

SEQ ID NO: 3419594 - RNA, 23 nt, Pseudomonas aeruginosa PA01
cggccggccacgcgaccagcgcc

SEQ ID NO: 3419595 - RNA, 13 nt, Pseudomonas aeruginosa PA01
cggccggccaggu

SEQ ID NO: 3419596 - RNA, 15 nt, Pseudomonas aeruginosa PA01
cggccggccaggucg

SEQ ID NO: 3419597 - RNA, 15 nt, Pseudomonas aeruginosa PA01
cggccggcgaccuug

SEQ ID NO: 3419598 - RNA, 18 nt, Pseudomonas aeruginosa PA01
cggccggcgaccuugucc

SEQ ID NO: 3419599 - RNA, 21 nt, Pseudomonas aeruginosa PA01
cggccggcgaccuuguccugc

SEQ ID NO: 3419600 - RNA, 20 nt, Pseudomonas aeruginosa PA01
cggccggcgcggacggccug

SEQ ID NO: 3419601 - RNA, 14 nt, Pseudomonas aeruginosa PA01
cggccggcgcggcg

SEQ ID NO: 3419602 - RNA, 13 nt, Pseudomonas aeruginosa PA01
cggccggcggccu

SEQ ID NO: 3419603 - RNA, 17 nt, Pseudomonas aeruginosa PA01
cggccggcucagcgcuu

SEQ ID NO: 3419604 - RNA, 18 nt, Pseudomonas aeruginosa PA01
cggccggcuucagcaacu

SEQ ID NO: 3419605 - RNA, 18 nt, Pseudomonas aeruginosa PA01
cggccgggauacagcagc

SEQ ID NO: 3419606 - RNA, 23 nt, Pseudomonas aeruginosa PA01
cggccgggauaugggugaugacc

SEQ ID NO: 3419607 - RNA, 17 nt, Pseudomonas aeruginosa PA01
cggccggggccggcacc

SEQ ID NO: 3419608 - RNA, 16 nt, Pseudomonas aeruginosa PA01
cggccggggcgcgccc

SEQ ID NO: 3419609 - RNA, 20 nt, Pseudomonas aeruginosa PA01
cggccggggcgcgcccgcca

SEQ ID NO: 3419610 - RNA, 13 nt, Pseudomonas aeruginosa PA01
cggccggggcgga

SEQ ID NO: 3419611 - RNA, 21 nt, Pseudomonas aeruginosa PA01
cggccggggcggauucaggcg

SEQ ID NO: 3419612 - RNA, 23 nt, Pseudomonas aeruginosa PA01
cggccggggcggauucaggcgcg

SEQ ID NO: 3419613 - RNA, 17 nt, Pseudomonas aeruginosa PA01
cggccggggucaggccg

SEQ ID NO: 3419614 - RNA, 19 nt, Pseudomonas aeruginosa PA01
cggccggggucaggccgag

SEQ ID NO: 3419615 - RNA, 23 nt, Pseudomonas aeruginosa PA01
cggccggggucaggccgaggcgc

SEQ ID NO: 3419616 - RNA, 13 nt, Pseudomonas aeruginosa PA01
cggccgguagucg

SEQ ID NO: 3419617 - RNA, 20 nt, Pseudomonas aeruginosa PA01
cggccggugccuucggcggc

SEQ ID NO: 3419618 - RNA, 22 nt, Pseudomonas aeruginosa PA01
cggccggugccuucggcggcgc

SEQ ID NO: 3419619 - RNA, 17 nt, Pseudomonas aeruginosa PA01
cggccguagcagauauc

SEQ ID NO: 3419620 - RNA, 21 nt, Pseudomonas aeruginosa PA01
cggccguagccgucgaacagc

SEQ ID NO: 3419621 - RNA, 13 nt, Pseudomonas aeruginosa PA01
cggccgucccagu

SEQ ID NO: 3419622 - RNA, 19 nt, Pseudomonas aeruginosa PA01
cggccgucccagucggcgu

SEQ ID NO: 3419623 - RNA, 20 nt, Pseudomonas aeruginosa PA01
cggccgucccagucggcguc

SEQ ID NO: 3419624 - RNA, 23 nt, Pseudomonas aeruginosa PA01
cggccgucccagucggcguccgc

SEQ ID NO: 3419625 - RNA, 16 nt, Pseudomonas aeruginosa PA01
cggccguccugcggcc

SEQ ID NO: 3419626 - RNA, 14 nt, Pseudomonas aeruginosa PA01
cggccgucgcgcac

SEQ ID NO: 3419627 - RNA, 15 nt, Pseudomonas aeruginosa PA01
cggccgucgcgcacc

SEQ ID NO: 3419628 - RNA, 21 nt, Pseudomonas aeruginosa PA01
cggccgucgcgcaccacccau

SEQ ID NO: 3419629 - RNA, 15 nt, Pseudomonas aeruginosa PA01
cggccgucggccugg

SEQ ID NO: 3419630 - RNA, 15 nt, Pseudomonas aeruginosa PA01
cggccgugcaugccg

SEQ ID NO: 3419631 - RNA, 16 nt, Pseudomonas aeruginosa PA01
cggccgugcaugccga

SEQ ID NO: 3419632 - RNA, 17 nt, Pseudomonas aeruginosa PA01
cggccgugcaugccgac

SEQ ID NO: 3419633 - RNA, 24 nt, Pseudomonas aeruginosa PA01
cggccgugccucagagucgcaccg

SEQ ID NO: 3419634 - RNA, 13 nt, Pseudomonas aeruginosa PA01
cggccguucgccc

SEQ ID NO: 3419635 - RNA, 15 nt, Pseudomonas aeruginosa PA01
cggccguucuccggg

SEQ ID NO: 3419636 - RNA, 17 nt, Pseudomonas aeruginosa PA01
cggccguugcgggcgau

SEQ ID NO: 3419637 - RNA, 16 nt, Pseudomonas aeruginosa PA01
cggccguuguccaggg

SEQ ID NO: 3419638 - RNA, 18 nt, Pseudomonas aeruginosa PA01
cggccguuucguuuccgu

SEQ ID NO: 3419639 - RNA, 18 nt, Pseudomonas aeruginosa PA01
cggccuacuugaucagcc

SEQ ID NO: 3419640 - RNA, 24 nt, Pseudomonas aeruginosa PA01
cggccuacuugaucagccgcaggc

SEQ ID NO: 3419641 - RNA, 23 nt, Pseudomonas aeruginosa PA01
cggccucacggguguuucggccg

SEQ ID NO: 3419642 - RNA, 16 nt, Pseudomonas aeruginosa PA01
cggccucaggccuggc

SEQ ID NO: 3419643 - RNA, 22 nt, Pseudomonas aeruginosa PA01
cggccucaguuuucuaaccggc

SEQ ID NO: 3419644 - RNA, 12 nt, Pseudomonas aeruginosa PA01
cggccuccagca

SEQ ID NO: 3419645 - RNA, 14 nt, Pseudomonas aeruginosa PA01
cggccuccagcacu

SEQ ID NO: 3419646 - RNA, 15 nt, Pseudomonas aeruginosa PA01
cggccuccagcacuc

SEQ ID NO: 3419647 - RNA, 17 nt, Pseudomonas aeruginosa PA01
cggccuccagcgccucg

SEQ ID NO: 3419648 - RNA, 23 nt, Pseudomonas aeruginosa PA01
cggccuccagcgccucgccgagc

SEQ ID NO: 3419649 - RNA, 18 nt, Pseudomonas aeruginosa PA01
cggccuccagcgccuggc

SEQ ID NO: 3419650 - RNA, 19 nt, Pseudomonas aeruginosa PA01
cggccuccagcgccuggcg

SEQ ID NO: 3419651 - RNA, 14 nt, Pseudomonas aeruginosa PA01
cggccuccaggcug

SEQ ID NO: 3419652 - RNA, 19 nt, Pseudomonas aeruginosa PA01
cggccuccaggcuggccuu

SEQ ID NO: 3419653 - RNA, 19 nt, Pseudomonas aeruginosa PA01
cggccuccccggcccgcgc

SEQ ID NO: 3419654 - RNA, 15 nt, Pseudomonas aeruginosa PA01
cggccuccgguggcg

SEQ ID NO: 3419655 - RNA, 22 nt, Pseudomonas aeruginosa PA01
cggccucgacaucgucucgcga

SEQ ID NO: 3419656 - RNA, 21 nt, Pseudomonas aeruginosa PA01
cggccucgacgagguugcucu

SEQ ID NO: 3419657 - RNA, 17 nt, Pseudomonas aeruginosa PA01
cggccucgacgcagagc

SEQ ID NO: 3419658 - RNA, 20 nt, Pseudomonas aeruginosa PA01
cggccucgacgcagagcgcc

SEQ ID NO: 3419659 - RNA, 21 nt, Pseudomonas aeruginosa PA01
cggccucgacgcagagcgcca

SEQ ID NO: 3419660 - RNA, 23 nt, Pseudomonas aeruginosa PA01
cggccucgacgcagagcgccaug

SEQ ID NO: 3419661 - RNA, 20 nt, Pseudomonas aeruginosa PA01
cggccucgagcaucuccggc

SEQ ID NO: 3419662 - RNA, 20 nt, Pseudomonas aeruginosa PA01
cggccucgaggaacaggucg

SEQ ID NO: 3419663 - RNA, 22 nt, Pseudomonas aeruginosa PA01
cggccucgaggucggccuggcu

SEQ ID NO: 3419664 - RNA, 14 nt, Pseudomonas aeruginosa PA01
cggccucgauggcg

SEQ ID NO: 3419665 - RNA, 16 nt, Pseudomonas aeruginosa PA01
cggccucgauggcggc

SEQ ID NO: 3419666 - RNA, 17 nt, Pseudomonas aeruginosa PA01
cggccucgauggcggca

SEQ ID NO: 3419667 - RNA, 20 nt, Pseudomonas aeruginosa PA01
cggccucgcaauugaucauc

SEQ ID NO: 3419668 - RNA, 13 nt, Pseudomonas aeruginosa PA01
cggccucgccgau

SEQ ID NO: 3419669 - RNA, 17 nt, Pseudomonas aeruginosa PA01
cggccucgccgaugucg

SEQ ID NO: 3419670 - RNA, 12 nt, Pseudomonas aeruginosa PA01
cggccucgccgg

SEQ ID NO: 3419671 - RNA, 16 nt, Pseudomonas aeruginosa PA01
cggccucgccggucgc

SEQ ID NO: 3419672 - RNA, 20 nt, Pseudomonas aeruginosa PA01
cggccucgccggucgcgcuc

SEQ ID NO: 3419673 - RNA, 23 nt, Pseudomonas aeruginosa PA01
cggccucgccggucgcgcucagg

SEQ ID NO: 3419674 - RNA, 14 nt, Pseudomonas aeruginosa PA01
cggccucgcgcaac

SEQ ID NO: 3419675 - RNA, 20 nt, Pseudomonas aeruginosa PA01
cggccucgcgcaacugcggg

SEQ ID NO: 3419676 - RNA, 14 nt, Pseudomonas aeruginosa PA01
cggccucgcggcgc

SEQ ID NO: 3419677 - RNA, 15 nt, Pseudomonas aeruginosa PA01
cggccucgcggcgcu

SEQ ID NO: 3419678 - RNA, 17 nt, Pseudomonas aeruginosa PA01
cggccucgcggcgcucg

SEQ ID NO: 3419679 - RNA, 17 nt, Pseudomonas aeruginosa PA01
cggccucgcggguaucg

SEQ ID NO: 3419680 - RNA, 15 nt, Pseudomonas aeruginosa PA01
cggccucgcgugcgc

SEQ ID NO: 3419681 - RNA, 18 nt, Pseudomonas aeruginosa PA01
cggccucgcugccgccgc

SEQ ID NO: 3419682 - RNA, 20 nt, Pseudomonas aeruginosa PA01
cggccucgcugccgccgcag

SEQ ID NO: 3419683 - RNA, 13 nt, Pseudomonas aeruginosa PA01
cggccucggcgag

SEQ ID NO: 3419684 - RNA, 13 nt, Pseudomonas aeruginosa PA01
cggccucggcggc

SEQ ID NO: 3419685 - RNA, 17 nt, Pseudomonas aeruginosa PA01
cggccucggcggcgcga

SEQ ID NO: 3419686 - RNA, 13 nt, Pseudomonas aeruginosa PA01
cggccucggcguc

SEQ ID NO: 3419687 - RNA, 20 nt, Pseudomonas aeruginosa PA01
cggccucggcgucgcgcagg

SEQ ID NO: 3419688 - RNA, 19 nt, Pseudomonas aeruginosa PA01
cggccucguaggcggcgcg

SEQ ID NO: 3419689 - RNA, 17 nt, Pseudomonas aeruginosa PA01
cggccucgucgagcauc

SEQ ID NO: 3419690 - RNA, 20 nt, Pseudomonas aeruginosa PA01
cggccucuccgagacgcugc

SEQ ID NO: 3419691 - RNA, 21 nt, Pseudomonas aeruginosa PA01
cggccucuucgucggcgaacg

SEQ ID NO: 3419692 - RNA, 19 nt, Pseudomonas aeruginosa PA01
cggccugagcugccgcuuc

SEQ ID NO: 3419693 - RNA, 14 nt, Pseudomonas aeruginosa PA01
cggccugaucaucu

SEQ ID NO: 3419694 - RNA, 17 nt, Pseudomonas aeruginosa PA01
cggccugaucaucuggg

SEQ ID NO: 3419695 - RNA, 20 nt, Pseudomonas aeruginosa PA01
cggccugaucaucugggcca

SEQ ID NO: 3419696 - RNA, 22 nt, Pseudomonas aeruginosa PA01
cggccugaucaucugggccauc

SEQ ID NO: 3419697 - RNA, 17 nt, Pseudomonas aeruginosa PA01
cggccugcaacacccag

SEQ ID NO: 3419698 - RNA, 18 nt, Pseudomonas aeruginosa PA01
cggccugcaacacccagg

SEQ ID NO: 3419699 - RNA, 19 nt, Pseudomonas aeruginosa PA01
cggccugcaacacccaggc

SEQ ID NO: 3419700 - RNA, 22 nt, Pseudomonas aeruginosa PA01
cggccugcaacacccaggccug

SEQ ID NO: 3419701 - RNA, 15 nt, Pseudomonas aeruginosa PA01
cggccugcaacgccg

SEQ ID NO: 3419702 - RNA, 18 nt, Pseudomonas aeruginosa PA01
cggccugcaacgccgcca

SEQ ID NO: 3419703 - RNA, 14 nt, Pseudomonas aeruginosa PA01
cggccugcaccagc

SEQ ID NO: 3419704 - RNA, 21 nt, Pseudomonas aeruginosa PA01
cggccugcaccugcucggggc

SEQ ID NO: 3419705 - RNA, 14 nt, Pseudomonas aeruginosa PA01
cggagcaugguguc

SEQ ID NO: 3419706 - RNA, 17 nt, Pseudomonas aeruginosa PA01
cggagccaacgcccggg

SEQ ID NO: 3419707 - RNA, 12 nt, Pseudomonas aeruginosa PA01
cggagccaccgg

SEQ ID NO: 3419708 - RNA, 14 nt, Pseudomonas aeruginosa PA01
cggagccaccggga

SEQ ID NO: 3419709 - RNA, 15 nt, Pseudomonas aeruginosa PA01
cggagccgucggcuc

SEQ ID NO: 3419710 - RNA, 16 nt, Pseudomonas aeruginosa PA01
cggagccgucggcucc

SEQ ID NO: 3419711 - RNA, 12 nt, Pseudomonas aeruginosa PA01
cggagcgaacga

SEQ ID NO: 3419712 - RNA, 23 nt, Pseudomonas aeruginosa PA01
cggagcgccacgcgagaagccgc

SEQ ID NO: 3419713 - RNA, 22 nt, Pseudomonas aeruginosa PA01
cggagcgcgaaagcgccccggg

SEQ ID NO: 3419714 - RNA, 22 nt, Pseudomonas aeruginosa PA01
cggagcgcgaggcgaguaccac

SEQ ID NO: 3419715 - RNA, 14 nt, Pseudomonas aeruginosa PA01
cggagcggcugccg

SEQ ID NO: 3419716 - RNA, 15 nt, Pseudomonas aeruginosa PA01
cggagcggcugccga

SEQ ID NO: 3419717 - RNA, 14 nt, Pseudomonas aeruginosa PA01
cggagcguccacca

SEQ ID NO: 3419718 - RNA, 16 nt, Pseudomonas aeruginosa PA01
cggagcguccaccagc

SEQ ID NO: 3419719 - RNA, 17 nt, Pseudomonas aeruginosa PA01
cggagcguccaccagcg

SEQ ID NO: 3419720 - RNA, 18 nt, Pseudomonas aeruginosa PA01
cggagcguccaccagcgc

SEQ ID NO: 3419721 - RNA, 19 nt, Pseudomonas aeruginosa PA01
cggagcguccaccagcgcc

SEQ ID NO: 3419722 - RNA, 20 nt, Pseudomonas aeruginosa PA01
cggagcguccaccagcgccc

SEQ ID NO: 3419723 - RNA, 23 nt, Pseudomonas aeruginosa PA01
cggagcgucgggcgggaucaggu

SEQ ID NO: 3419724 - RNA, 23 nt, Pseudomonas aeruginosa PA01
cggagcugcaugagugucgccau

SEQ ID NO: 3419725 - RNA, 19 nt, Pseudomonas aeruginosa PA01
cggagcugguacgcccccu

SEQ ID NO: 3419726 - RNA, 20 nt, Pseudomonas aeruginosa PA01
cggagcugguacgcccccuc

SEQ ID NO: 3419727 - RNA, 17 nt, Pseudomonas aeruginosa PA01
cggagcuuugcagggcg

SEQ ID NO: 3419728 - RNA, 15 nt, Pseudomonas aeruginosa PA01
cggaggaaacccaug

SEQ ID NO: 3419729 - RNA, 18 nt, Pseudomonas aeruginosa PA01
cggaggaaacccaugccc

SEQ ID NO: 3419730 - RNA, 18 nt, Pseudomonas aeruginosa PA01
cggaggccuucgccgacc

SEQ ID NO: 3419731 - RNA, 22 nt, Pseudomonas aeruginosa PA01
cggaggccuucgccgaccaggu

SEQ ID NO: 3419732 - RNA, 20 nt, Pseudomonas aeruginosa PA01
cggaggcgaggucgccgggg

SEQ ID NO: 3419733 - RNA, 14 nt, Pseudomonas aeruginosa PA01
cggaggcggcgagc

SEQ ID NO: 3419734 - RNA, 20 nt, Pseudomonas aeruginosa PA01
cggaggggcggccgccgagc

SEQ ID NO: 3419735 - RNA, 17 nt, Pseudomonas aeruginosa PA01
cggagggucaggccgag

SEQ ID NO: 3419736 - RNA, 14 nt, Pseudomonas aeruginosa PA01
cggaggucgagcag

SEQ ID NO: 3419737 - RNA, 18 nt, Pseudomonas aeruginosa PA01
cggagguucgaauccucc

SEQ ID NO: 3419738 - RNA, 17 nt, Pseudomonas aeruginosa PA01
cggaguagccggcggcg

SEQ ID NO: 3419739 - RNA, 13 nt, Pseudomonas aeruginosa PA01
cggagucaggcuc

SEQ ID NO: 3419740 - RNA, 12 nt, Pseudomonas aeruginosa PA01
cggagucgccgg

SEQ ID NO: 3419741 - RNA, 18 nt, Pseudomonas aeruginosa PA01
cggagucguagcgcaugc

SEQ ID NO: 3419742 - RNA, 19 nt, Pseudomonas aeruginosa PA01
cggagucguagcgcaugcc

SEQ ID NO: 3419743 - RNA, 15 nt, Pseudomonas aeruginosa PA01
cggagucguagcgcg

SEQ ID NO: 3419744 - RNA, 17 nt, Pseudomonas aeruginosa PA01
cggagucguagcgcgcg

SEQ ID NO: 3419745 - RNA, 10 nt, Pseudomonas aeruginosa PA01
cggagugaac

SEQ ID NO: 3419746 - RNA, 16 nt, Pseudomonas aeruginosa PA01
cggagugaggccgagc

SEQ ID NO: 3419747 - RNA, 14 nt, Pseudomonas aeruginosa PA01
cggagugccgcgga

SEQ ID NO: 3419748 - RNA, 18 nt, Pseudomonas aeruginosa PA01
cggagugugucggggccg

SEQ ID NO: 3419749 - RNA, 15 nt, Pseudomonas aeruginosa PA01
cggaguuccagcggg

SEQ ID NO: 3419750 - RNA, 13 nt, Pseudomonas aeruginosa PA01
cggaguucgcccg

SEQ ID NO: 3419751 - RNA, 16 nt, Pseudomonas aeruginosa PA01
cggaguucgcccgccc

SEQ ID NO: 3419752 - RNA, 17 nt, Pseudomonas aeruginosa PA01
cggaguucgcccgcccc

SEQ ID NO: 3419753 - RNA, 21 nt, Pseudomonas aeruginosa PA01
cggaguucgucaaccagcacc

SEQ ID NO: 3419754 - RNA, 22 nt, Pseudomonas aeruginosa PA01
cggaguucgucaaccagcaccg

SEQ ID NO: 3419755 - RNA, 18 nt, Pseudomonas aeruginosa PA01
cggauaacaccguuggcg

SEQ ID NO: 3419756 - RNA, 16 nt, Pseudomonas aeruginosa PA01
cggauaaccgcaagcg

SEQ ID NO: 3419757 - RNA, 21 nt, Pseudomonas aeruginosa PA01
cggauaaccgcguugcgguua

SEQ ID NO: 3419758 - RNA, 13 nt, Pseudomonas aeruginosa PA01
cggauaacgccag

SEQ ID NO: 3419759 - RNA, 18 nt, Pseudomonas aeruginosa PA01
cggauaacgcccgcggcg

SEQ ID NO: 3419760 - RNA, 19 nt, Pseudomonas aeruginosa PA01
cggauaacgcccgcggcgu

SEQ ID NO: 3419761 - RNA, 13 nt, Pseudomonas aeruginosa PA01
cggauaacgccga

SEQ ID NO: 3419762 - RNA, 13 nt, Pseudomonas aeruginosa PA01
cggauaacgccgg

SEQ ID NO: 3419763 - RNA, 18 nt, Pseudomonas aeruginosa PA01
cggauaacgccguuggcg

SEQ ID NO: 3419764 - RNA, 20 nt, Pseudomonas aeruginosa PA01
cggauaacgccuauggcguu

SEQ ID NO: 3419765 - RNA, 14 nt, Pseudomonas aeruginosa PA01
cggauaacgccugu

SEQ ID NO: 3419766 - RNA, 20 nt, Pseudomonas aeruginosa PA01
cggauaacgcuucgcagcau

SEQ ID NO: 3419767 - RNA, 16 nt, Pseudomonas aeruginosa PA01
cggauaacggcagccg

SEQ ID NO: 3419768 - RNA, 18 nt, Pseudomonas aeruginosa PA01
cggauaacggcagccgcg

SEQ ID NO: 3419769 - RNA, 19 nt, Pseudomonas aeruginosa PA01
cggauaagcaagcgcaacg

SEQ ID NO: 3419770 - RNA, 16 nt, Pseudomonas aeruginosa PA01
cggauacaggcgcagc

SEQ ID NO: 3419771 - RNA, 20 nt, Pseudomonas aeruginosa PA01
cggauacaggcgcagcagca

SEQ ID NO: 3419772 - RNA, 13 nt, Pseudomonas aeruginosa PA01
cggauacgccagg

SEQ ID NO: 3419773 - RNA, 17 nt, Pseudomonas aeruginosa PA01
cggauacggcaggguag

SEQ ID NO: 3419774 - RNA, 13 nt, Pseudomonas aeruginosa PA01
cggauacuccuuc

SEQ ID NO: 3419775 - RNA, 22 nt, Pseudomonas aeruginosa PA01
cggauagagcuucccgcauggc

SEQ ID NO: 3419776 - RNA, 13 nt, Pseudomonas aeruginosa PA01
cggauagcaccga

SEQ ID NO: 3419777 - RNA, 14 nt, Pseudomonas aeruginosa PA01
cggauagcaccgau

SEQ ID NO: 3419778 - RNA, 17 nt, Pseudomonas aeruginosa PA01
cggauagccaaccagau

SEQ ID NO: 3419779 - RNA, 18 nt, Pseudomonas aeruginosa PA01
cggauagccgugcagcag

SEQ ID NO: 3419780 - RNA, 21 nt, Pseudomonas aeruginosa PA01
cggauagccgugcagcagcga

SEQ ID NO: 3419781 - RNA, 21 nt, Pseudomonas aeruginosa PA01
cggauagucggaacgaccggu

SEQ ID NO: 3419782 - RNA, 17 nt, Pseudomonas aeruginosa PA01
cggauauagcuggucaa

SEQ ID NO: 3419783 - RNA, 20 nt, Pseudomonas aeruginosa PA01
cggauauccgggcccaggcu

SEQ ID NO: 3419784 - RNA, 16 nt, Pseudomonas aeruginosa PA01
cggauaucgcgccgcg

SEQ ID NO: 3419785 - RNA, 20 nt, Pseudomonas aeruginosa PA01
cggauaucggccucggucag

SEQ ID NO: 3419786 - RNA, 16 nt, Pseudomonas aeruginosa PA01
cggauaugcgccgcca

SEQ ID NO: 3419787 - RNA, 22 nt, Pseudomonas aeruginosa PA01
cggauauucgacgcgcggcugc

SEQ ID NO: 3419788 - RNA, 13 nt, Pseudomonas aeruginosa PA01
cggaucaacgccg

SEQ ID NO: 3419789 - RNA, 15 nt, Pseudomonas aeruginosa PA01
cggaucaacgggccc

SEQ ID NO: 3419790 - RNA, 19 nt, Pseudomonas aeruginosa PA01
cggaucaacuccgccaggc

SEQ ID NO: 3419791 - RNA, 12 nt, Pseudomonas aeruginosa PA01
cggaucaccacg

SEQ ID NO: 3419792 - RNA, 22 nt, Pseudomonas aeruginosa PA01
cggaucaccacguaaucgccau

SEQ ID NO: 3419793 - RNA, 13 nt, Pseudomonas aeruginosa PA01
cggaucaccggcu

SEQ ID NO: 3419794 - RNA, 15 nt, Pseudomonas aeruginosa PA01
cggaucaccggcugg

SEQ ID NO: 3419795 - RNA, 17 nt, Pseudomonas aeruginosa PA01
cggaucaccggcuggcc

SEQ ID NO: 3419796 - RNA, 21 nt, Pseudomonas aeruginosa PA01
cggaucaccggcuggcccucc

SEQ ID NO: 3419797 - RNA, 13 nt, Pseudomonas aeruginosa PA01
cggaucaccuggc

SEQ ID NO: 3419798 - RNA, 18 nt, Pseudomonas aeruginosa PA01
cggaucaccuggccgugc

SEQ ID NO: 3419799 - RNA, 17 nt, Pseudomonas aeruginosa PA01
cggaucacggugccauc

SEQ ID NO: 3419800 - RNA, 19 nt, Pseudomonas aeruginosa PA01
cggaucacggugccauccg

SEQ ID NO: 3419801 - RNA, 15 nt, Pseudomonas aeruginosa PA01
cggaucagccggccc

SEQ ID NO: 3419802 - RNA, 14 nt, Pseudomonas aeruginosa PA01
cggaucaggcuggg

SEQ ID NO: 3419803 - RNA, 16 nt, Pseudomonas aeruginosa PA01
cggaucaggcuggggu

SEQ ID NO: 3419804 - RNA, 12 nt, Pseudomonas aeruginosa PA01
cggauccacgcc

SEQ ID NO: 3419805 - RNA, 18 nt, Pseudomonas aeruginosa PA01
cggauccccucccgcgcc

SEQ ID NO: 3419806 - RNA, 16 nt, Pseudomonas aeruginosa PA01
cggauccggguggaga

SEQ ID NO: 3419807 - RNA, 22 nt, Pseudomonas aeruginosa PA01
cggauccggguggagaggcgug

SEQ ID NO: 3419808 - RNA, 23 nt, Pseudomonas aeruginosa PA01
cggaucgaaguagucggcguagc

SEQ ID NO: 3419809 - RNA, 18 nt, Pseudomonas aeruginosa PA01
cggaucgagcagcggcgc

SEQ ID NO: 3419810 - RNA, 22 nt, Pseudomonas aeruginosa PA01
cggaucgaggaauuccggcagc

SEQ ID NO: 3419811 - RNA, 13 nt, Pseudomonas aeruginosa PA01
cggaucgaucagc

SEQ ID NO: 3419812 - RNA, 19 nt, Pseudomonas aeruginosa PA01
cggaucgaugcccggcugg

SEQ ID NO: 3419813 - RNA, 13 nt, Pseudomonas aeruginosa PA01
cggaucgccaacc

SEQ ID NO: 3419814 - RNA, 19 nt, Pseudomonas aeruginosa PA01
cggaucgccuccggcacgc

SEQ ID NO: 3419815 - RNA, 23 nt, Pseudomonas aeruginosa PA01
cggaucgcgcaaugccgcgucga

SEQ ID NO: 3419816 - RNA, 18 nt, Pseudomonas aeruginosa PA01
cggaucgcgccgucgcug

SEQ ID NO: 3419817 - RNA, 23 nt, Pseudomonas aeruginosa PA01
cggaucgcgccgucgcuggcgau

SEQ ID NO: 3419818 - RNA, 13 nt, Pseudomonas aeruginosa PA01
cggaucgcgcugg

SEQ ID NO: 3419819 - RNA, 16 nt, Pseudomonas aeruginosa PA01
cggaucgcucucgcgc

SEQ ID NO: 3419820 - RNA, 23 nt, Pseudomonas aeruginosa PA01
cggaucggauagccgugcagcag

SEQ ID NO: 3419821 - RNA, 15 nt, Pseudomonas aeruginosa PA01
cggaucggcccggcg

SEQ ID NO: 3419822 - RNA, 16 nt, Pseudomonas aeruginosa PA01
cggaucggccuuggcg

SEQ ID NO: 3419823 - RNA, 13 nt, Pseudomonas aeruginosa PA01
cggaucggcgugu

SEQ ID NO: 3419824 - RNA, 14 nt, Pseudomonas aeruginosa PA01
cggaucggcugacc

SEQ ID NO: 3419825 - RNA, 23 nt, Pseudomonas aeruginosa PA01
cggaucgguaggcucugcuccag

SEQ ID NO: 3419826 - RNA, 12 nt, Pseudomonas aeruginosa PA01
cggaucggucag

SEQ ID NO: 3419827 - RNA, 15 nt, Pseudomonas aeruginosa PA01
cggaucgguccccuc

SEQ ID NO: 3419828 - RNA, 22 nt, Pseudomonas aeruginosa PA01
cggaucgguccccuccagguag

SEQ ID NO: 3419829 - RNA, 12 nt, Pseudomonas aeruginosa PA01
cggaucgucgcg

SEQ ID NO: 3419830 - RNA, 14 nt, Pseudomonas aeruginosa PA01
cggaucgucgcggc

SEQ ID NO: 3419831 - RNA, 16 nt, Pseudomonas aeruginosa PA01
cggaucgucgcggcgc

SEQ ID NO: 3419832 - RNA, 17 nt, Pseudomonas aeruginosa PA01
cggaucgucgcggcgcg

SEQ ID NO: 3419833 - RNA, 22 nt, Pseudomonas aeruginosa PA01
cggaucuaaggggcggcucggc

SEQ ID NO: 3419834 - RNA, 20 nt, Pseudomonas aeruginosa PA01
cggaucucaggaccuuccgc

SEQ ID NO: 3419835 - RNA, 16 nt, Pseudomonas aeruginosa PA01
cggaucucgucgccga

SEQ ID NO: 3419836 - RNA, 18 nt, Pseudomonas aeruginosa PA01
cggaucucgucgccgacc

SEQ ID NO: 3419837 - RNA, 21 nt, Pseudomonas aeruginosa PA01
cggaugaccuucggaucgguc

SEQ ID NO: 3419838 - RNA, 18 nt, Pseudomonas aeruginosa PA01
cggaugacgggcgaagac

SEQ ID NO: 3419839 - RNA, 19 nt, Pseudomonas aeruginosa PA01
cggaugacgggcgaagacg

SEQ ID NO: 3419840 - RNA, 22 nt, Pseudomonas aeruginosa PA01
cggaugacguucccguccgggc

SEQ ID NO: 3419841 - RNA, 15 nt, Pseudomonas aeruginosa PA01
cggaugcacgugcag

SEQ ID NO: 3419842 - RNA, 18 nt, Pseudomonas aeruginosa PA01
cggaugcacgugcagcuc

SEQ ID NO: 3419843 - RNA, 20 nt, Pseudomonas aeruginosa PA01
cggaugcacgugcagcucgg

SEQ ID NO: 3419844 - RNA, 19 nt, Pseudomonas aeruginosa PA01
cggaugcagucccgccagg

SEQ ID NO: 3419845 - RNA, 20 nt, Pseudomonas aeruginosa PA01
cggaugcagucccgccaggc

SEQ ID NO: 3419846 - RNA, 21 nt, Pseudomonas aeruginosa PA01
cggaugcagucccgccaggcg

SEQ ID NO: 3419847 - RNA, 22 nt, Pseudomonas aeruginosa PA01
cggaugcaguugagucgcgcgc

SEQ ID NO: 3419848 - RNA, 11 nt, Pseudomonas aeruginosa PA01
cggaugccacc

SEQ ID NO: 3419849 - RNA, 15 nt, Pseudomonas aeruginosa PA01
cggaugccaccgcuc

SEQ ID NO: 3419850 - RNA, 18 nt, Pseudomonas aeruginosa PA01
cggaugcccuggucggcg

SEQ ID NO: 3419851 - RNA, 14 nt, Pseudomonas aeruginosa PA01
cggaugccgcacag

SEQ ID NO: 3419852 - RNA, 12 nt, Pseudomonas aeruginosa PA01
cggaugccggcg

SEQ ID NO: 3419853 - RNA, 13 nt, Pseudomonas aeruginosa PA01
cggaugccggcgc

SEQ ID NO: 3419854 - RNA, 18 nt, Pseudomonas aeruginosa PA01
cggaugccggcgcugucu

SEQ ID NO: 3419855 - RNA, 20 nt, Pseudomonas aeruginosa PA01
cggaugcguugcucgcacca

SEQ ID NO: 3419856 - RNA, 21 nt, Pseudomonas aeruginosa PA01
cggaugcuccagguucggcgc

SEQ ID NO: 3419857 - RNA, 23 nt, Pseudomonas aeruginosa PA01
cggaugcuccagguucggcgcca

SEQ ID NO: 3419858 - RNA, 19 nt, Pseudomonas aeruginosa PA01
cggauggccguccaggcug

SEQ ID NO: 3419859 - RNA, 13 nt, Pseudomonas aeruginosa PA01
cggaugggcgacg

SEQ ID NO: 3419860 - RNA, 15 nt, Pseudomonas aeruginosa PA01
cggaugggcgacgac

SEQ ID NO: 3419861 - RNA, 22 nt, Pseudomonas aeruginosa PA01
cggaugggcgacgacgaacgcc

SEQ ID NO: 3419862 - RNA, 22 nt, Pseudomonas aeruginosa PA01
cggauguaguccagcgccgcgc

SEQ ID NO: 3419863 - RNA, 23 nt, Pseudomonas aeruginosa PA01
cggauguaguccagcgccgcgcu

SEQ ID NO: 3419864 - RNA, 14 nt, Pseudomonas aeruginosa PA01
cggauguaguucuu

SEQ ID NO: 3419865 - RNA, 16 nt, Pseudomonas aeruginosa PA01
cggaugugcaggguca

SEQ ID NO: 3419866 - RNA, 16 nt, Pseudomonas aeruginosa PA01
cggauguucaccaggu

SEQ ID NO: 3419867 - RNA, 18 nt, Pseudomonas aeruginosa PA01
cggauguucgaaggccag

SEQ ID NO: 3419868 - RNA, 17 nt, Pseudomonas aeruginosa PA01
cggauguucgccacgcu

SEQ ID NO: 3419869 - RNA, 17 nt, Pseudomonas aeruginosa PA01
cggauguucuucaccuu

SEQ ID NO: 3419870 - RNA, 19 nt, Pseudomonas aeruginosa PA01
cggauuacuccgccggcgu

SEQ ID NO: 3419871 - RNA, 16 nt, Pseudomonas aeruginosa PA01
cggauucaggcgcgcu

SEQ ID NO: 3419872 - RNA, 18 nt, Pseudomonas aeruginosa PA01
cggauucaggcgcgcucg

SEQ ID NO: 3419873 - RNA, 20 nt, Pseudomonas aeruginosa PA01
cggauucaggcgcgcucggg

SEQ ID NO: 3419874 - RNA, 14 nt, Pseudomonas aeruginosa PA01
cggauuccagcgcg

SEQ ID NO: 3419875 - RNA, 15 nt, Pseudomonas aeruginosa PA01
cggauucgcgcagca

SEQ ID NO: 3419876 - RNA, 18 nt, Pseudomonas aeruginosa PA01
cggauucgcgcagcaggc

SEQ ID NO: 3419877 - RNA, 16 nt, Pseudomonas aeruginosa PA01
cggauucucucccagg

SEQ ID NO: 3419878 - RNA, 23 nt, Pseudomonas aeruginosa PA01
cggauugacgauggccagcccgg

SEQ ID NO: 3419879 - RNA, 12 nt, Pseudomonas aeruginosa PA01
cggauugccgcg

SEQ ID NO: 3419880 - RNA, 16 nt, Pseudomonas aeruginosa PA01
cggauugccgcggguc

SEQ ID NO: 3419881 - RNA, 13 nt, Pseudomonas aeruginosa PA01
cggauuggccgag

SEQ ID NO: 3419882 - RNA, 19 nt, Pseudomonas aeruginosa PA01
cggauuggccgagguggag

SEQ ID NO: 3419883 - RNA, 13 nt, Pseudomonas aeruginosa PA01
cggauuggccggg

SEQ ID NO: 3419884 - RNA, 14 nt, Pseudomonas aeruginosa PA01
cggauuggccgggc

SEQ ID NO: 3419885 - RNA, 19 nt, Pseudomonas aeruginosa PA01
cggauuggccgggccgaug

SEQ ID NO: 3419886 - RNA, 13 nt, Pseudomonas aeruginosa PA01
cggauuugccgcc

SEQ ID NO: 3419887 - RNA, 15 nt, Pseudomonas aeruginosa PA01
cggcaaacgccgcca

SEQ ID NO: 3419888 - RNA, 16 nt, Pseudomonas aeruginosa PA01
cggcaaaggcccggcg

SEQ ID NO: 3419889 - RNA, 17 nt, Pseudomonas aeruginosa PA01
cggcaacaggucgaggg

SEQ ID NO: 3419890 - RNA, 20 nt, Pseudomonas aeruginosa PA01
cggcaacgaacuucagggcu

SEQ ID NO: 3419891 - RNA, 19 nt, Pseudomonas aeruginosa PA01
cggcaacgauaccgccgcc

SEQ ID NO: 3419892 - RNA, 22 nt, Pseudomonas aeruginosa PA01
cggcaacgauaccgccgccggc

SEQ ID NO: 3419893 - RNA, 16 nt, Pseudomonas aeruginosa PA01
cggcaacgucaggcug

SEQ ID NO: 3419894 - RNA, 20 nt, Pseudomonas aeruginosa PA01
cggcaacgucaggcuguagc

SEQ ID NO: 3419895 - RNA, 14 nt, Pseudomonas aeruginosa PA01
cggcaacgucgcgg

SEQ ID NO: 3419896 - RNA, 19 nt, Pseudomonas aeruginosa PA01
cggcaacugagcgcaacuc

SEQ ID NO: 3419897 - RNA, 16 nt, Pseudomonas aeruginosa PA01
cggcaacugauagucg

SEQ ID NO: 3419898 - RNA, 12 nt, Pseudomonas aeruginosa PA01
cggcaagcaggc

SEQ ID NO: 3419899 - RNA, 19 nt, Pseudomonas aeruginosa PA01
cggcaagcaggccgcggua

SEQ ID NO: 3419900 - RNA, 23 nt, Pseudomonas aeruginosa PA01
cggcaagcaggccgcgguaacgg

SEQ ID NO: 3419901 - RNA, 23 nt, Pseudomonas aeruginosa PA01
cggcaagcgccggcaacagcagc

SEQ ID NO: 3419902 - RNA, 16 nt, Pseudomonas aeruginosa PA01
cggcaagcgugccccg

SEQ ID NO: 3419903 - RNA, 23 nt, Pseudomonas aeruginosa PA01
cggcaagcgugccccgacugucg

SEQ ID NO: 3419904 - RNA, 13 nt, Pseudomonas aeruginosa PA01
cggcaagcuccgc

SEQ ID NO: 3419905 - RNA, 18 nt, Pseudomonas aeruginosa PA01
cggcaagcuccgcgaugu

SEQ ID NO: 3419906 - RNA, 18 nt, Pseudomonas aeruginosa PA01
cggcaaggcacacgcccg

SEQ ID NO: 3419907 - RNA, 19 nt, Pseudomonas aeruginosa PA01
cggcaaggccaagucggcc

SEQ ID NO: 3419908 - RNA, 21 nt, Pseudomonas aeruginosa PA01
cggcaaggccaagucggccgc

SEQ ID NO: 3419909 - RNA, 22 nt, Pseudomonas aeruginosa PA01
cggcaaggccaagucggccgcc

SEQ ID NO: 3419910 - RNA, 15 nt, Pseudomonas aeruginosa PA01
cggcaaggcgauccc

SEQ ID NO: 3419911 - RNA, 16 nt, Pseudomonas aeruginosa PA01
cggcaaggcgaucccg

SEQ ID NO: 3419912 - RNA, 18 nt, Pseudomonas aeruginosa PA01
cggcaaggcgaucccggc

SEQ ID NO: 3419913 - RNA, 11 nt, Pseudomonas aeruginosa PA01
cggcaaggcgc

SEQ ID NO: 3419914 - RNA, 22 nt, Pseudomonas aeruginosa PA01
cggcaagggcacgugcagcggc

SEQ ID NO: 3419915 - RNA, 14 nt, Pseudomonas aeruginosa PA01
cggcaagggccugc

SEQ ID NO: 3419916 - RNA, 19 nt, Pseudomonas aeruginosa PA01
cggcaagggccugcucagc

SEQ ID NO: 3419917 - RNA, 17 nt, Pseudomonas aeruginosa PA01
cggcaagggcgucuggg

SEQ ID NO: 3419918 - RNA, 18 nt, Pseudomonas aeruginosa PA01
cggcaaguucgcauaggc

SEQ ID NO: 3419919 - RNA, 15 nt, Pseudomonas aeruginosa PA01
cggcaaucaggcgcg

SEQ ID NO: 3419920 - RNA, 16 nt, Pseudomonas aeruginosa PA01
cggcaaugcggcgaug

SEQ ID NO: 3419921 - RNA, 22 nt, Pseudomonas aeruginosa PA01
cggcaaugcggcgauggcgucc

SEQ ID NO: 3419922 - RNA, 19 nt, Pseudomonas aeruginosa PA01
cggcaauguccgagcaggu

SEQ ID NO: 3419923 - RNA, 18 nt, Pseudomonas aeruginosa PA01
cggcaauucuucaagguc

SEQ ID NO: 3419924 - RNA, 20 nt, Pseudomonas aeruginosa PA01
cggcacagcguggccagcgc

SEQ ID NO: 3419925 - RNA, 14 nt, Pseudomonas aeruginosa PA01
cggcaccaccaccg

SEQ ID NO: 3419926 - RNA, 16 nt, Pseudomonas aeruginosa PA01
cggcaccaccaccgac

SEQ ID NO: 3419927 - RNA, 21 nt, Pseudomonas aeruginosa PA01
cggcaccaccaccgacaggcc

SEQ ID NO: 3419928 - RNA, 17 nt, Pseudomonas aeruginosa PA01
cggcaccaccagcgcgc

SEQ ID NO: 3419929 - RNA, 20 nt, Pseudomonas aeruginosa PA01
cggcaccaccagcgcgcgcu

SEQ ID NO: 3419930 - RNA, 16 nt, Pseudomonas aeruginosa PA01
cggcaccaccggucaa

SEQ ID NO: 3419931 - RNA, 17 nt, Pseudomonas aeruginosa PA01
cggcaccacgugcagca

SEQ ID NO: 3419932 - RNA, 13 nt, Pseudomonas aeruginosa PA01
cggcaccagcacg

SEQ ID NO: 3419933 - RNA, 14 nt, Pseudomonas aeruginosa PA01
cggcaccagcacgu

SEQ ID NO: 3419934 - RNA, 19 nt, Pseudomonas aeruginosa PA01
cggcaccagcacguugcca

SEQ ID NO: 3419935 - RNA, 12 nt, Pseudomonas aeruginosa PA01
cggcaccagcca

SEQ ID NO: 3419936 - RNA, 15 nt, Pseudomonas aeruginosa PA01
cggcaccagccaggu

SEQ ID NO: 3419937 - RNA, 18 nt, Pseudomonas aeruginosa PA01
cggcaccagccagguguu

SEQ ID NO: 3419938 - RNA, 13 nt, Pseudomonas aeruginosa PA01
cggcaccagcgcg

SEQ ID NO: 3419939 - RNA, 19 nt, Pseudomonas aeruginosa PA01
cggcaccagcgcgucgaag

SEQ ID NO: 3419940 - RNA, 22 nt, Pseudomonas aeruginosa PA01
cggcaccagggcuucgcgcaga

SEQ ID NO: 3419941 - RNA, 17 nt, Pseudomonas aeruginosa PA01
cggcaccaucaccgaca

SEQ ID NO: 3419942 - RNA, 20 nt, Pseudomonas aeruginosa PA01
cggcaccccuugcagccagc

SEQ ID NO: 3419943 - RNA, 14 nt, Pseudomonas aeruginosa PA01
cggcacccggcugg

SEQ ID NO: 3419944 - RNA, 16 nt, Pseudomonas aeruginosa PA01
cggcacccggcugggu

SEQ ID NO: 3419945 - RNA, 19 nt, Pseudomonas aeruginosa PA01
cggcacccucuuccgcgcu

SEQ ID NO: 3419946 - RNA, 22 nt, Pseudomonas aeruginosa PA01
cggcacccucuuccgcgcugac

SEQ ID NO: 3419947 - RNA, 17 nt, Pseudomonas aeruginosa PA01
cggcacccugaccgcga

SEQ ID NO: 3419948 - RNA, 19 nt, Pseudomonas aeruginosa PA01
cggcacccugaccgcgagc

SEQ ID NO: 3419949 - RNA, 21 nt, Pseudomonas aeruginosa PA01
cggcacccugaccgcgagcgc

SEQ ID NO: 3419950 - RNA, 22 nt, Pseudomonas aeruginosa PA01
cggcacccugaccgcgagcgcc

SEQ ID NO: 3419951 - RNA, 13 nt, Pseudomonas aeruginosa PA01
cggcaccgacgcc

SEQ ID NO: 3419952 - RNA, 13 nt, Pseudomonas aeruginosa PA01
cggcaccgaucgc

SEQ ID NO: 3419953 - RNA, 19 nt, Pseudomonas aeruginosa PA01
cggcaccgaucgcccgcgc

SEQ ID NO: 3419954 - RNA, 15 nt, Pseudomonas aeruginosa PA01
cggcaccgcucugca

SEQ ID NO: 3419955 - RNA, 15 nt, Pseudomonas aeruginosa PA01
cggcaccgcuuucgu

SEQ ID NO: 3419956 - RNA, 23 nt, Pseudomonas aeruginosa PA01
cggcaccgcuuucguagggcgaa

SEQ ID NO: 3419957 - RNA, 14 nt, Pseudomonas aeruginosa PA01
cggcaccggcgacg

SEQ ID NO: 3419958 - RNA, 14 nt, Pseudomonas aeruginosa PA01
cggcaccgggguga

SEQ ID NO: 3419959 - RNA, 15 nt, Pseudomonas aeruginosa PA01
cggcaccgucgagca

SEQ ID NO: 3419960 - RNA, 22 nt, Pseudomonas aeruginosa PA01
cggcaccgucgagcaccaggcg

SEQ ID NO: 3419961 - RNA, 17 nt, Pseudomonas aeruginosa PA01
cggcaccucgauggcgg

SEQ ID NO: 3419962 - RNA, 19 nt, Pseudomonas aeruginosa PA01
cggcaccucgauggcggcg

SEQ ID NO: 3419963 - RNA, 21 nt, Pseudomonas aeruginosa PA01
cggcaccucgauggcggcggc

SEQ ID NO: 3419964 - RNA, 14 nt, Pseudomonas aeruginosa PA01
cggcaccugcagac

SEQ ID NO: 3419965 - RNA, 15 nt, Pseudomonas aeruginosa PA01
cggcaccugcagacg

SEQ ID NO: 3419966 - RNA, 18 nt, Pseudomonas aeruginosa PA01
cggcaccugcagacgguu

SEQ ID NO: 3419967 - RNA, 20 nt, Pseudomonas aeruginosa PA01
cggcaccuugcgaaaagccc

SEQ ID NO: 3419968 - RNA, 22 nt, Pseudomonas aeruginosa PA01
cggcacgaccuucuccgaccag

SEQ ID NO: 3419969 - RNA, 13 nt, Pseudomonas aeruginosa PA01
cggcacgaugucg

SEQ ID NO: 3419970 - RNA, 18 nt, Pseudomonas aeruginosa PA01
cggcacgaugucgaccug

SEQ ID NO: 3419971 - RNA, 19 nt, Pseudomonas aeruginosa PA01
cggcacgaugucgaccugg

SEQ ID NO: 3419972 - RNA, 20 nt, Pseudomonas aeruginosa PA01
cggcacgaugucgaccuggg

SEQ ID NO: 3419973 - RNA, 14 nt, Pseudomonas aeruginosa PA01
cggcacgcagcagc

SEQ ID NO: 3419974 - RNA, 14 nt, Pseudomonas aeruginosa PA01
cggcacgccauccu

SEQ ID NO: 3419975 - RNA, 17 nt, Pseudomonas aeruginosa PA01
cggcacgccauccuccg

SEQ ID NO: 3419976 - RNA, 11 nt, Pseudomonas aeruginosa PA01
cggcacgcccu

SEQ ID NO: 3419977 - RNA, 13 nt, Pseudomonas aeruginosa PA01
cggcacgccgaag

SEQ ID NO: 3419978 - RNA, 16 nt, Pseudomonas aeruginosa PA01
cggcacgccgaagucc

SEQ ID NO: 3419979 - RNA, 22 nt, Pseudomonas aeruginosa PA01
cggcacgccgaaguccugcaac

SEQ ID NO: 3419980 - RNA, 23 nt, Pseudomonas aeruginosa PA01
cggcacgccgaaguccugcaaca

SEQ ID NO: 3419981 - RNA, 14 nt, Pseudomonas aeruginosa PA01
cggcacgcguggcg

SEQ ID NO: 3419982 - RNA, 15 nt, Pseudomonas aeruginosa PA01
cggcacgcucaggcg

SEQ ID NO: 3419983 - RNA, 11 nt, Pseudomonas aeruginosa PA01
cggcacgcucc

SEQ ID NO: 3419984 - RNA, 16 nt, Pseudomonas aeruginosa PA01
cggcacgcuccagauc

SEQ ID NO: 3419985 - RNA, 17 nt, Pseudomonas aeruginosa PA01
cggcacgcuccagggcg

SEQ ID NO: 3419986 - RNA, 11 nt, Pseudomonas aeruginosa PA01
cggcacgcucu

SEQ ID NO: 3419987 - RNA, 14 nt, Pseudomonas aeruginosa PA01
cggcacgcucuggc

SEQ ID NO: 3419988 - RNA, 13 nt, Pseudomonas aeruginosa PA01
cggcacgcugccg

SEQ ID NO: 3419989 - RNA, 15 nt, Pseudomonas aeruginosa PA01
cggcacgcugccgcc

SEQ ID NO: 3419990 - RNA, 17 nt, Pseudomonas aeruginosa PA01
cggcacgcugccgccga

SEQ ID NO: 3419991 - RNA, 19 nt, Pseudomonas aeruginosa PA01
cggcacgcugccgccgaug

SEQ ID NO: 3419992 - RNA, 21 nt, Pseudomonas aeruginosa PA01
cggcacgcugcuugcgcaccu

SEQ ID NO: 3419993 - RNA, 19 nt, Pseudomonas aeruginosa PA01
cggcacggucauggccagc

SEQ ID NO: 3419994 - RNA, 21 nt, Pseudomonas aeruginosa PA01
cggcacggucauggccagcuc

SEQ ID NO: 3419995 - RNA, 22 nt, Pseudomonas aeruginosa PA01
cggcacggucauggccagcucg

SEQ ID NO: 3419996 - RNA, 15 nt, Pseudomonas aeruginosa PA01
cggcacucagccagc

SEQ ID NO: 3419997 - RNA, 13 nt, Pseudomonas aeruginosa PA01
cggcacuccagga

SEQ ID NO: 3419998 - RNA, 14 nt, Pseudomonas aeruginosa PA01
cggcacuccggcau

SEQ ID NO: 3419999 - RNA, 19 nt, Pseudomonas aeruginosa PA01
cggcacuccggcauaccgc

SEQ ID NO: 3420000 - RNA, 21 nt, Pseudomonas aeruginosa PA01
cggcacuccggcauaccgccc

SEQ ID NO: 3420001 - RNA, 23 nt, Pseudomonas aeruginosa PA01
cggcacuccggcauaccgcccgu

SEQ ID NO: 3420002 - RNA, 17 nt, Pseudomonas aeruginosa PA01
cggcacucgccgggcgu

SEQ ID NO: 3420003 - RNA, 15 nt, Pseudomonas aeruginosa PA01
cggcacucggcgacc

SEQ ID NO: 3420004 - RNA, 20 nt, Pseudomonas aeruginosa PA01
cggcacucggcgaccacccg

SEQ ID NO: 3420005 - RNA, 20 nt, Pseudomonas aeruginosa PA01
cggcacuguuccucagcccc

SEQ ID NO: 3420006 - RNA, 17 nt, Pseudomonas aeruginosa PA01
cggcacuucccgccccc

SEQ ID NO: 3420007 - RNA, 13 nt, Pseudomonas aeruginosa PA01
cggcacuuccuug

SEQ ID NO: 3420008 - RNA, 16 nt, Pseudomonas aeruginosa PA01
cggcacuuccuuggug

SEQ ID NO: 3420009 - RNA, 21 nt, Pseudomonas aeruginosa PA01
cggcacuuccuuggugaucac

SEQ ID NO: 3420010 - RNA, 16 nt, Pseudomonas aeruginosa PA01
cggcagaagcuuuccc

SEQ ID NO: 3420011 - RNA, 14 nt, Pseudomonas aeruginosa PA01
cggcagacgugcug

SEQ ID NO: 3420012 - RNA, 23 nt, Pseudomonas aeruginosa PA01
cggcagaguuucucggucgccgc

SEQ ID NO: 3420013 - RNA, 16 nt, Pseudomonas aeruginosa PA01
cggcagaucccaucgc

SEQ ID NO: 3420014 - RNA, 15 nt, Pseudomonas aeruginosa PA01
cggcagauccgccgu

SEQ ID NO: 3420015 - RNA, 23 nt, Pseudomonas aeruginosa PA01
cggcagauccgccgugaggcgcg

SEQ ID NO: 3420016 - RNA, 14 nt, Pseudomonas aeruginosa PA01
cgcucagcgccgcu

SEQ ID NO: 3420017 - RNA, 24 nt, Pseudomonas aeruginosa PA01
cgcucagcgcgagggggccucggc

SEQ ID NO: 3420018 - RNA, 20 nt, Pseudomonas aeruginosa PA01
cgcucagcgcuucucggcag

SEQ ID NO: 3420019 - RNA, 16 nt, Pseudomonas aeruginosa PA01
cgcucagcgggccgau

SEQ ID NO: 3420020 - RNA, 20 nt, Pseudomonas aeruginosa PA01
cgcucagcgggccgauccgc

SEQ ID NO: 3420021 - RNA, 13 nt, Pseudomonas aeruginosa PA01
cgcucaggaugcg

SEQ ID NO: 3420022 - RNA, 15 nt, Pseudomonas aeruginosa PA01
cgcucaggaugcgau

SEQ ID NO: 3420023 - RNA, 14 nt, Pseudomonas aeruginosa PA01
cgcucaggcagcga

SEQ ID NO: 3420024 - RNA, 20 nt, Pseudomonas aeruginosa PA01
cgcucaggcagcgaucgccg

SEQ ID NO: 3420025 - RNA, 22 nt, Pseudomonas aeruginosa PA01
cgcucaggcagcgaucgccgcc

SEQ ID NO: 3420026 - RNA, 14 nt, Pseudomonas aeruginosa PA01
cgcucaggccucga

SEQ ID NO: 3420027 - RNA, 12 nt, Pseudomonas aeruginosa PA01
cgcucaggcgca

SEQ ID NO: 3420028 - RNA, 14 nt, Pseudomonas aeruginosa PA01
cgcucaggcgcagc

SEQ ID NO: 3420029 - RNA, 16 nt, Pseudomonas aeruginosa PA01
cgcucaggcgcagcgu

SEQ ID NO: 3420030 - RNA, 19 nt, Pseudomonas aeruginosa PA01
cgcucaggcgucccgcucc

SEQ ID NO: 3420031 - RNA, 14 nt, Pseudomonas aeruginosa PA01
cgcucagggaaugg

SEQ ID NO: 3420032 - RNA, 23 nt, Pseudomonas aeruginosa PA01
cgcucagggacaccccgucucgc

SEQ ID NO: 3420033 - RNA, 19 nt, Pseudomonas aeruginosa PA01
cgcucagucgaccgucgcc

SEQ ID NO: 3420034 - RNA, 21 nt, Pseudomonas aeruginosa PA01
cgcucagucgaccgucgccac

SEQ ID NO: 3420035 - RNA, 21 nt, Pseudomonas aeruginosa PA01
cgcucagucgagcaugucgcu

SEQ ID NO: 3420036 - RNA, 15 nt, Pseudomonas aeruginosa PA01
cgcucagugcgccgg

SEQ ID NO: 3420037 - RNA, 18 nt, Pseudomonas aeruginosa PA01
cgcucauccgcgaggcau

SEQ ID NO: 3420038 - RNA, 18 nt, Pseudomonas aeruginosa PA01
cgcucaugagauccgcca

SEQ ID NO: 3420039 - RNA, 20 nt, Pseudomonas aeruginosa PA01
cgcucaugagauccgccagc

SEQ ID NO: 3420040 - RNA, 15 nt, Pseudomonas aeruginosa PA01
cgcucaugcgcgugu

SEQ ID NO: 3420041 - RNA, 16 nt, Pseudomonas aeruginosa PA01
cgcucauggcgccgcc

SEQ ID NO: 3420042 - RNA, 17 nt, Pseudomonas aeruginosa PA01
cgcucauggcgccgcca

SEQ ID NO: 3420043 - RNA, 14 nt, Pseudomonas aeruginosa PA01
cgcuccaacgcagg

SEQ ID NO: 3420044 - RNA, 22 nt, Pseudomonas aeruginosa PA01
cgcuccaacgcaggcgcauggc

SEQ ID NO: 3420045 - RNA, 20 nt, Pseudomonas aeruginosa PA01
cgcuccacagcugccagccc

SEQ ID NO: 3420046 - RNA, 14 nt, Pseudomonas aeruginosa PA01
cgcuccaccgcccc

SEQ ID NO: 3420047 - RNA, 16 nt, Pseudomonas aeruginosa PA01
cgcuccaccgcccccg

SEQ ID NO: 3420048 - RNA, 17 nt, Pseudomonas aeruginosa PA01
cgcuccaccgcccccgg

SEQ ID NO: 3420049 - RNA, 19 nt, Pseudomonas aeruginosa PA01
cgcuccaccgcccccggcg

SEQ ID NO: 3420050 - RNA, 22 nt, Pseudomonas aeruginosa PA01
cgcuccaccgcccccggcgcca

SEQ ID NO: 3420051 - RNA, 16 nt, Pseudomonas aeruginosa PA01
cgcuccagaccuccag

SEQ ID NO: 3420052 - RNA, 18 nt, Pseudomonas aeruginosa PA01
cgcuccagaccuccaggu

SEQ ID NO: 3420053 - RNA, 22 nt, Pseudomonas aeruginosa PA01
cgcuccagacucuccaggucgg

SEQ ID NO: 3420054 - RNA, 13 nt, Pseudomonas aeruginosa PA01
cgcuccagcccca

SEQ ID NO: 3420055 - RNA, 13 nt, Pseudomonas aeruginosa PA01
cgcuccagccggc

SEQ ID NO: 3420056 - RNA, 17 nt, Pseudomonas aeruginosa PA01
cgcuccagccggcaagc

SEQ ID NO: 3420057 - RNA, 21 nt, Pseudomonas aeruginosa PA01
cgcuccagccggcaagcgugc

SEQ ID NO: 3420058 - RNA, 13 nt, Pseudomonas aeruginosa PA01
cgcuccagcgccu

SEQ ID NO: 3420059 - RNA, 15 nt, Pseudomonas aeruginosa PA01
cgcuccagcgccucg

SEQ ID NO: 3420060 - RNA, 20 nt, Pseudomonas aeruginosa PA01
cgcuccagcgccucgaccag

SEQ ID NO: 3420061 - RNA, 15 nt, Pseudomonas aeruginosa PA01
cgcuccagcggcagc

SEQ ID NO: 3420062 - RNA, 21 nt, Pseudomonas aeruginosa PA01
cgcuccagcggcagcucggcg

SEQ ID NO: 3420063 - RNA, 17 nt, Pseudomonas aeruginosa PA01
cgcuccagcuccuccag

SEQ ID NO: 3420064 - RNA, 16 nt, Pseudomonas aeruginosa PA01
cgcuccaggaucgccu

SEQ ID NO: 3420065 - RNA, 23 nt, Pseudomonas aeruginosa PA01
cgcuccaggaucgccuccaccag

SEQ ID NO: 3420066 - RNA, 14 nt, Pseudomonas aeruginosa PA01
cgcuccaggcccgg

SEQ ID NO: 3420067 - RNA, 16 nt, Pseudomonas aeruginosa PA01
cgcuccaggcccggca

SEQ ID NO: 3420068 - RNA, 17 nt, Pseudomonas aeruginosa PA01
cgcuccaggcccggcag

SEQ ID NO: 3420069 - RNA, 13 nt, Pseudomonas aeruginosa PA01
cgcuccaggcugu

SEQ ID NO: 3420070 - RNA, 23 nt, Pseudomonas aeruginosa PA01
cgcuccaggcugugggcgacuuc

SEQ ID NO: 3420071 - RNA, 19 nt, Pseudomonas aeruginosa PA01
cgcuccagggcauccucgc

SEQ ID NO: 3420072 - RNA, 12 nt, Pseudomonas aeruginosa PA01
cgcuccagggcg

SEQ ID NO: 3420073 - RNA, 16 nt, Pseudomonas aeruginosa PA01
cgcuccagggcgcuga

SEQ ID NO: 3420074 - RNA, 18 nt, Pseudomonas aeruginosa PA01
cgcuccaggugcacggcc

SEQ ID NO: 3420075 - RNA, 21 nt, Pseudomonas aeruginosa PA01
cgcuccaggugcacggccagg

SEQ ID NO: 3420076 - RNA, 23 nt, Pseudomonas aeruginosa PA01
cgcuccaggugcacggccaggcc

SEQ ID NO: 3420077 - RNA, 19 nt, Pseudomonas aeruginosa PA01
cgcuccagucggggcaggc

SEQ ID NO: 3420078 - RNA, 22 nt, Pseudomonas aeruginosa PA01
cgcuccagucggggcaggcgca

SEQ ID NO: 3420079 - RNA, 19 nt, Pseudomonas aeruginosa PA01
cgcuccauccagucggcgc

SEQ ID NO: 3420080 - RNA, 22 nt, Pseudomonas aeruginosa PA01
cgcuccauccagucggcgcugg

SEQ ID NO: 3420081 - RNA, 23 nt, Pseudomonas aeruginosa PA01
cgcucccaacagucgucgcgcag

SEQ ID NO: 3420082 - RNA, 13 nt, Pseudomonas aeruginosa PA01
cgcucccaccgcu

SEQ ID NO: 3420083 - RNA, 14 nt, Pseudomonas aeruginosa PA01
cgcucccagccgac

SEQ ID NO: 3420084 - RNA, 18 nt, Pseudomonas aeruginosa PA01
cgcucccagccgacguag

SEQ ID NO: 3420085 - RNA, 19 nt, Pseudomonas aeruginosa PA01
cgcuccccacucggccagc

SEQ ID NO: 3420086 - RNA, 20 nt, Pseudomonas aeruginosa PA01
cgcuccccacucggccagca

SEQ ID NO: 3420087 - RNA, 23 nt, Pseudomonas aeruginosa PA01
cgcuccccacucggccagcaaug

SEQ ID NO: 3420088 - RNA, 22 nt, Pseudomonas aeruginosa PA01
cgcuccccugccgaaccgccuc

SEQ ID NO: 3420089 - RNA, 21 nt, Pseudomonas aeruginosa PA01
cgcuccgacuccugcaacagu

SEQ ID NO: 3420090 - RNA, 14 nt, Pseudomonas aeruginosa PA01
cgcuccgcaucuuc

SEQ ID NO: 3420091 - RNA, 13 nt, Pseudomonas aeruginosa PA01
cgcuccgcggccg

SEQ ID NO: 3420092 - RNA, 16 nt, Pseudomonas aeruginosa PA01
cgcuccgcggccggcu

SEQ ID NO: 3420093 - RNA, 19 nt, Pseudomonas aeruginosa PA01
cgcuccgcggccggcuuca

SEQ ID NO: 3420094 - RNA, 12 nt, Pseudomonas aeruginosa PA01
cgcuccggcagc

SEQ ID NO: 3420095 - RNA, 14 nt, Pseudomonas aeruginosa PA01
cgcuccggcgccga

SEQ ID NO: 3420096 - RNA, 15 nt, Pseudomonas aeruginosa PA01
cgcuccggcgccgag

SEQ ID NO: 3420097 - RNA, 13 nt, Pseudomonas aeruginosa PA01
cgcuccggcgcgc

SEQ ID NO: 3420098 - RNA, 15 nt, Pseudomonas aeruginosa PA01
cgcuccggcgcgcca

SEQ ID NO: 3420099 - RNA, 19 nt, Pseudomonas aeruginosa PA01
cgcuccggcgcgccauggc

SEQ ID NO: 3420100 - RNA, 20 nt, Pseudomonas aeruginosa PA01
cgcuccggcgcgccauggcg

SEQ ID NO: 3420101 - RNA, 16 nt, Pseudomonas aeruginosa PA01
cgcuccggcucucccc

SEQ ID NO: 3420102 - RNA, 17 nt, Pseudomonas aeruginosa PA01
cgcuccggcucuccccg

SEQ ID NO: 3420103 - RNA, 16 nt, Pseudomonas aeruginosa PA01
cgcuccggcugcgcgg

SEQ ID NO: 3420104 - RNA, 18 nt, Pseudomonas aeruginosa PA01
cgcuccggugccagggcg

SEQ ID NO: 3420105 - RNA, 15 nt, Pseudomonas aeruginosa PA01
cgcuccgguggcgga

SEQ ID NO: 3420106 - RNA, 13 nt, Pseudomonas aeruginosa PA01
cgcuccguagggc

SEQ ID NO: 3420107 - RNA, 16 nt, Pseudomonas aeruginosa PA01
cgcuccguagggcgac

SEQ ID NO: 3420108 - RNA, 22 nt, Pseudomonas aeruginosa PA01
cgcuccguagggcgacgcccga

SEQ ID NO: 3420109 - RNA, 23 nt, Pseudomonas aeruginosa PA01
cgcuccguagggcgacgcccgag

SEQ ID NO: 3420110 - RNA, 22 nt, Pseudomonas aeruginosa PA01
cgcuccgucgcuucgcccgccg

SEQ ID NO: 3420111 - RNA, 16 nt, Pseudomonas aeruginosa PA01
cgcuccuccagcgccg

SEQ ID NO: 3420112 - RNA, 18 nt, Pseudomonas aeruginosa PA01
cgcuccuccagcgccgcc

SEQ ID NO: 3420113 - RNA, 19 nt, Pseudomonas aeruginosa PA01
cgcuccuccagcgccgcca

SEQ ID NO: 3420114 - RNA, 15 nt, Pseudomonas aeruginosa PA01
cgcuccuccgggaag

SEQ ID NO: 3420115 - RNA, 19 nt, Pseudomonas aeruginosa PA01
cgcuccuccucgcucugcg

SEQ ID NO: 3420116 - RNA, 20 nt, Pseudomonas aeruginosa PA01
cgcuccuccucgcucugcgc

SEQ ID NO: 3420117 - RNA, 14 nt, Pseudomonas aeruginosa PA01
cgcuccucgauccg

SEQ ID NO: 3420118 - RNA, 18 nt, Pseudomonas aeruginosa PA01
cgcuccucgcgcugcccg

SEQ ID NO: 3420119 - RNA, 20 nt, Pseudomonas aeruginosa PA01
cgcuccucgcgcugcccggc

SEQ ID NO: 3420120 - RNA, 23 nt, Pseudomonas aeruginosa PA01
cgcuccucgcgcugcccggcgcg

SEQ ID NO: 3420121 - RNA, 14 nt, Pseudomonas aeruginosa PA01
cgcuccucgucgag

SEQ ID NO: 3420122 - RNA, 12 nt, Pseudomonas aeruginosa PA01
cgcuccugcgcc

SEQ ID NO: 3420123 - RNA, 15 nt, Pseudomonas aeruginosa PA01
cgcuccugcgccggc

SEQ ID NO: 3420124 - RNA, 19 nt, Pseudomonas aeruginosa PA01
cgcuccugcgccggcucgu

SEQ ID NO: 3420125 - RNA, 18 nt, Pseudomonas aeruginosa PA01
cgcuccuggaagaacagg

SEQ ID NO: 3420126 - RNA, 20 nt, Pseudomonas aeruginosa PA01
cgcuccuggaagaacaggcg

SEQ ID NO: 3420127 - RNA, 13 nt, Pseudomonas aeruginosa PA01
cgcuccuggaggu

SEQ ID NO: 3420128 - RNA, 14 nt, Pseudomonas aeruginosa PA01
cgcuccuggagguu

SEQ ID NO: 3420129 - RNA, 17 nt, Pseudomonas aeruginosa PA01
cgcuccuggugcggcac

SEQ ID NO: 3420130 - RNA, 18 nt, Pseudomonas aeruginosa PA01
cgcuccuggugcggcacc

SEQ ID NO: 3420131 - RNA, 19 nt, Pseudomonas aeruginosa PA01
cgcuccuguugcuggccgg

SEQ ID NO: 3420132 - RNA, 22 nt, Pseudomonas aeruginosa PA01
cgcuccuucuccggggcccggc

SEQ ID NO: 3420133 - RNA, 14 nt, Pseudomonas aeruginosa PA01
cgcuccuugagcag

SEQ ID NO: 3420134 - RNA, 18 nt, Pseudomonas aeruginosa PA01
cgcuccuugagcagcucg

SEQ ID NO: 3420135 - RNA, 16 nt, Pseudomonas aeruginosa PA01
cgcuccuugcgccagg

SEQ ID NO: 3420136 - RNA, 18 nt, Pseudomonas aeruginosa PA01
cgcuccuugcgccaggcc

SEQ ID NO: 3420137 - RNA, 19 nt, Pseudomonas aeruginosa PA01
cgcuccuugcgccaggccc

SEQ ID NO: 3420138 - RNA, 20 nt, Pseudomonas aeruginosa PA01
cgcuccuugcgccaggcccg

SEQ ID NO: 3420139 - RNA, 19 nt, Pseudomonas aeruginosa PA01
cgcuccuuguagaacggcg

SEQ ID NO: 3420140 - RNA, 22 nt, Pseudomonas aeruginosa PA01
cgcuccuuguagaacggcggca

SEQ ID NO: 3420141 - RNA, 13 nt, Pseudomonas aeruginosa PA01
cgcuccuuuccca

SEQ ID NO: 3420142 - RNA, 15 nt, Pseudomonas aeruginosa PA01
cgcuccuuucccagc

SEQ ID NO: 3420143 - RNA, 17 nt, Pseudomonas aeruginosa PA01
cgcuccuuucccagcgu

SEQ ID NO: 3420144 - RNA, 23 nt, Pseudomonas aeruginosa PA01
cgcuccuuucccagcguuguccu

SEQ ID NO: 3420145 - RNA, 13 nt, Pseudomonas aeruginosa PA01
cgcucgaacgccg

SEQ ID NO: 3420146 - RNA, 16 nt, Pseudomonas aeruginosa PA01
cgcucgaacgccgccc

SEQ ID NO: 3420147 - RNA, 20 nt, Pseudomonas aeruginosa PA01
cgcucgaacgccgcccgucg

SEQ ID NO: 3420148 - RNA, 15 nt, Pseudomonas aeruginosa PA01
cgcucgaccuugccg

SEQ ID NO: 3420149 - RNA, 17 nt, Pseudomonas aeruginosa PA01
cgcucgacgaucaggug

SEQ ID NO: 3420150 - RNA, 20 nt, Pseudomonas aeruginosa PA01
cgcucgagccggcugaugcc

SEQ ID NO: 3420151 - RNA, 14 nt, Pseudomonas aeruginosa PA01
cgcucgagcuugag

SEQ ID NO: 3420152 - RNA, 14 nt, Pseudomonas aeruginosa PA01
cgcucgagggcgac

SEQ ID NO: 3420153 - RNA, 16 nt, Pseudomonas aeruginosa PA01
cgcucgagggcgaccg

SEQ ID NO: 3420154 - RNA, 20 nt, Pseudomonas aeruginosa PA01
cgcucgagggcgaccgccag

SEQ ID NO: 3420155 - RNA, 23 nt, Pseudomonas aeruginosa PA01
cgcucgagggcgaccgccaggcg

SEQ ID NO: 3420156 - RNA, 15 nt, Pseudomonas aeruginosa PA01
cgcucgaggggcgac

SEQ ID NO: 3420157 - RNA, 18 nt, Pseudomonas aeruginosa PA01
cgcucgaguucgcgcggg

SEQ ID NO: 3420158 - RNA, 19 nt, Pseudomonas aeruginosa PA01
cgcucgaguucgcgcgggu

SEQ ID NO: 3420159 - RNA, 19 nt, Pseudomonas aeruginosa PA01
cgcucgauagcguccaggu

SEQ ID NO: 3420160 - RNA, 20 nt, Pseudomonas aeruginosa PA01
cgcucgauagcguccaggug

SEQ ID NO: 3420161 - RNA, 16 nt, Pseudomonas aeruginosa PA01
cgcucgaucagguagu

SEQ ID NO: 3420162 - RNA, 18 nt, Pseudomonas aeruginosa PA01
cgcucgaucccggcgcgg

SEQ ID NO: 3420163 - RNA, 16 nt, Pseudomonas aeruginosa PA01
cgcucgaugcccgcca

SEQ ID NO: 3420164 - RNA, 19 nt, Pseudomonas aeruginosa PA01
cgcucgaugcccgccagca

SEQ ID NO: 3420165 - RNA, 17 nt, Pseudomonas aeruginosa PA01
cgcucgcaacgcugucc

SEQ ID NO: 3420166 - RNA, 15 nt, Pseudomonas aeruginosa PA01
cgcucgcccuugcgc

SEQ ID NO: 3420167 - RNA, 20 nt, Pseudomonas aeruginosa PA01
cgcucgcccuugcgccgcgg

SEQ ID NO: 3420168 - RNA, 21 nt, Pseudomonas aeruginosa PA01
cgcucgccgggaaucgccagc

SEQ ID NO: 3420169 - RNA, 22 nt, Pseudomonas aeruginosa PA01
cgcucgccgggaaucgccagca

SEQ ID NO: 3420170 - RNA, 20 nt, Pseudomonas aeruginosa PA01
cgcucgccgggucgccgcag

SEQ ID NO: 3420171 - RNA, 21 nt, Pseudomonas aeruginosa PA01
cgcucgccgggucgccgcagc

SEQ ID NO: 3420172 - RNA, 16 nt, Pseudomonas aeruginosa PA01
cgcucgccgucaucga

SEQ ID NO: 3420173 - RNA, 20 nt, Pseudomonas aeruginosa PA01
cgcucgccgucaucgagcag

SEQ ID NO: 3420174 - RNA, 23 nt, Pseudomonas aeruginosa PA01
cgcucgccuaccggcgccgcccc

SEQ ID NO: 3420175 - RNA, 12 nt, Pseudomonas aeruginosa PA01
cgcucgcgcagg

SEQ ID NO: 3420176 - RNA, 16 nt, Pseudomonas aeruginosa PA01
cgcucgcggaccucug

SEQ ID NO: 3420177 - RNA, 21 nt, Pseudomonas aeruginosa PA01
cgcucgcggaccucugcguuc

SEQ ID NO: 3420178 - RNA, 12 nt, Pseudomonas aeruginosa PA01
cgcucgcggcau

SEQ ID NO: 3420179 - RNA, 14 nt, Pseudomonas aeruginosa PA01
cgcucgcggcaucc

SEQ ID NO: 3420180 - RNA, 19 nt, Pseudomonas aeruginosa PA01
cgcucgcggcaucccgccc

SEQ ID NO: 3420181 - RNA, 21 nt, Pseudomonas aeruginosa PA01
cgcucgcggcaucccgcccgg

SEQ ID NO: 3420182 - RNA, 18 nt, Pseudomonas aeruginosa PA01
cgcucgcgggccgccugg

SEQ ID NO: 3420183 - RNA, 19 nt, Pseudomonas aeruginosa PA01
cgcucgcgguuauccgccg

SEQ ID NO: 3420184 - RNA, 20 nt, Pseudomonas aeruginosa PA01
cgcucgcgguuauccgccgc

SEQ ID NO: 3420185 - RNA, 22 nt, Pseudomonas aeruginosa PA01
cgcucgcgguuauccgccgccu

SEQ ID NO: 3420186 - RNA, 23 nt, Pseudomonas aeruginosa PA01
cgcucgcgguuauccgccgccua

SEQ ID NO: 3420187 - RNA, 12 nt, Pseudomonas aeruginosa PA01
cgcucgcguccg

SEQ ID NO: 3420188 - RNA, 21 nt, Pseudomonas aeruginosa PA01
cgcucgcugcgugcguugcgc

SEQ ID NO: 3420189 - RNA, 22 nt, Pseudomonas aeruginosa PA01
cgcucgcugucgcucagcgggc

SEQ ID NO: 3420190 - RNA, 17 nt, Pseudomonas aeruginosa PA01
cgcucgcuucagcgagc

SEQ ID NO: 3420191 - RNA, 16 nt, Pseudomonas aeruginosa PA01
cgcucggacagcuucu

SEQ ID NO: 3420192 - RNA, 15 nt, Pseudomonas aeruginosa PA01
cgcucggaucaggcg

SEQ ID NO: 3420193 - RNA, 16 nt, Pseudomonas aeruginosa PA01
cgcucggaucaggcgg

SEQ ID NO: 3420194 - RNA, 18 nt, Pseudomonas aeruginosa PA01
cgcucggaucaggcgggc

SEQ ID NO: 3420195 - RNA, 19 nt, Pseudomonas aeruginosa PA01
cgcucggaucaggcgggcu

SEQ ID NO: 3420196 - RNA, 11 nt, Pseudomonas aeruginosa PA01
cgcucggccaa

SEQ ID NO: 3420197 - RNA, 15 nt, Pseudomonas aeruginosa PA01
cgcucggccagcguc

SEQ ID NO: 3420198 - RNA, 23 nt, Pseudomonas aeruginosa PA01
cgcucggccaguucgucgagcau

SEQ ID NO: 3420199 - RNA, 13 nt, Pseudomonas aeruginosa PA01
cgcucggccgcca

SEQ ID NO: 3420200 - RNA, 15 nt, Pseudomonas aeruginosa PA01
cgcucggccgccagc

SEQ ID NO: 3420201 - RNA, 18 nt, Pseudomonas aeruginosa PA01
cgcucggccgccuggcgu

SEQ ID NO: 3420202 - RNA, 13 nt, Pseudomonas aeruginosa PA01
cgcucggccugcg

SEQ ID NO: 3420203 - RNA, 14 nt, Pseudomonas aeruginosa PA01
cgcucggccuggug

SEQ ID NO: 3420204 - RNA, 15 nt, Pseudomonas aeruginosa PA01
cgcucggccuuagcg

SEQ ID NO: 3420205 - RNA, 17 nt, Pseudomonas aeruginosa PA01
cgcucggcgaccuugcg

SEQ ID NO: 3420206 - RNA, 14 nt, Pseudomonas aeruginosa PA01
cgcucggcgagccg

SEQ ID NO: 3420207 - RNA, 18 nt, Pseudomonas aeruginosa PA01
cgcucggcgagccgccgg

SEQ ID NO: 3420208 - RNA, 19 nt, Pseudomonas aeruginosa PA01
cgcucggcgagccgccggg

SEQ ID NO: 3420209 - RNA, 19 nt, Pseudomonas aeruginosa PA01
cgcucggcgaggccggcga

SEQ ID NO: 3420210 - RNA, 20 nt, Pseudomonas aeruginosa PA01
cgcucggcgaggccggcgau

SEQ ID NO: 3420211 - RNA, 23 nt, Pseudomonas aeruginosa PA01
cgcucggcgaggccggcgaucag

SEQ ID NO: 3420212 - RNA, 18 nt, Pseudomonas aeruginosa PA01
cgcucggcggccucgcgg

SEQ ID NO: 3420213 - RNA, 19 nt, Pseudomonas aeruginosa PA01
cgcucggcggccucgcggg

SEQ ID NO: 3420214 - RNA, 20 nt, Pseudomonas aeruginosa PA01
cgcucggcggccucgcgggu

SEQ ID NO: 3420215 - RNA, 12 nt, Pseudomonas aeruginosa PA01
cgcucggcggcg

SEQ ID NO: 3420216 - RNA, 19 nt, Pseudomonas aeruginosa PA01
cgcucggcggcgcgcagcg

SEQ ID NO: 3420217 - RNA, 15 nt, Pseudomonas aeruginosa PA01
cgcucggcggguauc

SEQ ID NO: 3420218 - RNA, 20 nt, Pseudomonas aeruginosa PA01
cgcucggcggguauccgccg

SEQ ID NO: 3420219 - RNA, 22 nt, Pseudomonas aeruginosa PA01
cgcucggcggguauccgccggg

SEQ ID NO: 3420220 - RNA, 14 nt, Pseudomonas aeruginosa PA01
cgcucggcggucag

SEQ ID NO: 3420221 - RNA, 15 nt, Pseudomonas aeruginosa PA01
cgcucggcguagccg

SEQ ID NO: 3420222 - RNA, 19 nt, Pseudomonas aeruginosa PA01
cgcucggcguagccggcga

SEQ ID NO: 3420223 - RNA, 21 nt, Pseudomonas aeruginosa PA01
cgcucggcguagccggcgauc

SEQ ID NO: 3420224 - RNA, 19 nt, Pseudomonas aeruginosa PA01
cgcucggcgucguaacgga

SEQ ID NO: 3420225 - RNA, 18 nt, Pseudomonas aeruginosa PA01
cgcucggcuccagccagg

SEQ ID NO: 3420226 - RNA, 20 nt, Pseudomonas aeruginosa PA01
cgcucggcuccagccaggcc

SEQ ID NO: 3420227 - RNA, 21 nt, Pseudomonas aeruginosa PA01
cgcucggcuccagccaggccc

SEQ ID NO: 3420228 - RNA, 14 nt, Pseudomonas aeruginosa PA01
cgcucggcuucgcg

SEQ ID NO: 3420229 - RNA, 20 nt, Pseudomonas aeruginosa PA01
cgcucggggauguccgccgc

SEQ ID NO: 3420230 - RNA, 21 nt, Pseudomonas aeruginosa PA01
cgcucggggauguccgccgcc

SEQ ID NO: 3420231 - RNA, 23 nt, Pseudomonas aeruginosa PA01
cgcucggggauguccgccgccca

SEQ ID NO: 3420232 - RNA, 16 nt, Pseudomonas aeruginosa PA01
cgcucggggugcgcgg

SEQ ID NO: 3420233 - RNA, 18 nt, Pseudomonas aeruginosa PA01
cgcucggggugcgcggcg

SEQ ID NO: 3420234 - RNA, 19 nt, Pseudomonas aeruginosa PA01
cgcucggggugcgcggcga

SEQ ID NO: 3420235 - RNA, 15 nt, Pseudomonas aeruginosa PA01
cgcucggucagcucc

SEQ ID NO: 3420236 - RNA, 16 nt, Pseudomonas aeruginosa PA01
cgcucggucagcuccc

SEQ ID NO: 3420237 - RNA, 24 nt, Pseudomonas aeruginosa PA01
cgcucggugccuucccagccgagg

SEQ ID NO: 3420238 - RNA, 17 nt, Pseudomonas aeruginosa PA01
cgcucguagagcuugcu

SEQ ID NO: 3420239 - RNA, 21 nt, Pseudomonas aeruginosa PA01
cgcucguagagcuugcugaag

SEQ ID NO: 3420240 - RNA, 14 nt, Pseudomonas aeruginosa PA01
cgcucguagccggc

SEQ ID NO: 3420241 - RNA, 15 nt, Pseudomonas aeruginosa PA01
cgcucguagccggcg

SEQ ID NO: 3420242 - RNA, 16 nt, Pseudomonas aeruginosa PA01
cgcucguagccggcgc

SEQ ID NO: 3420243 - RNA, 18 nt, Pseudomonas aeruginosa PA01
cgcucguagccggcgcgg

SEQ ID NO: 3420244 - RNA, 21 nt, Pseudomonas aeruginosa PA01
cgcucguagccggcgcggcgc

SEQ ID NO: 3420245 - RNA, 22 nt, Pseudomonas aeruginosa PA01
cgcucguagccggcgcggcgca

SEQ ID NO: 3420246 - RNA, 14 nt, Pseudomonas aeruginosa PA01
cgcucgucaggcgc

SEQ ID NO: 3420247 - RNA, 13 nt, Pseudomonas aeruginosa PA01
cgcucgucauggc

SEQ ID NO: 3420248 - RNA, 21 nt, Pseudomonas aeruginosa PA01
cgcucgucauggcgcacgccg

SEQ ID NO: 3420249 - RNA, 16 nt, Pseudomonas aeruginosa PA01
cgcucguccaguucca

SEQ ID NO: 3420250 - RNA, 13 nt, Pseudomonas aeruginosa PA01
cgcucgucgagga

SEQ ID NO: 3420251 - RNA, 12 nt, Pseudomonas aeruginosa PA01
cgcucguugcgc

SEQ ID NO: 3420252 - RNA, 16 nt, Pseudomonas aeruginosa PA01
cgcucguugcgccgcu

SEQ ID NO: 3420253 - RNA, 13 nt, Pseudomonas aeruginosa PA01
cgcucucgaacac

SEQ ID NO: 3420254 - RNA, 19 nt, Pseudomonas aeruginosa PA01
cgcucucgaacaccaggcg

SEQ ID NO: 3420255 - RNA, 22 nt, Pseudomonas aeruginosa PA01
cgcucucgaacaccaggcgcca

SEQ ID NO: 3420256 - RNA, 19 nt, Pseudomonas aeruginosa PA01
cgcucucgaacaccggcga

SEQ ID NO: 3420257 - RNA, 21 nt, Pseudomonas aeruginosa PA01
cgcucucgaacaccggcgagc

SEQ ID NO: 3420258 - RNA, 14 nt, Pseudomonas aeruginosa PA01
cgcucucgaacagc

SEQ ID NO: 3420259 - RNA, 16 nt, Pseudomonas aeruginosa PA01
cgcucucgaacagcag

SEQ ID NO: 3420260 - RNA, 18 nt, Pseudomonas aeruginosa PA01
cgcucucgaacagcagca

SEQ ID NO: 3420261 - RNA, 21 nt, Pseudomonas aeruginosa PA01
cgcucucgagcaugccugcuu

SEQ ID NO: 3420262 - RNA, 14 nt, Pseudomonas aeruginosa PA01
cgcucucgaggacg

SEQ ID NO: 3420263 - RNA, 12 nt, Pseudomonas aeruginosa PA01
cgcucucgccgc

SEQ ID NO: 3420264 - RNA, 14 nt, Pseudomonas aeruginosa PA01
cgcucucgccgccu

SEQ ID NO: 3420265 - RNA, 20 nt, Pseudomonas aeruginosa PA01
cgcucucggugaccaccagg

SEQ ID NO: 3420266 - RNA, 22 nt, Pseudomonas aeruginosa PA01
cgcucucggugaccaccaggcg

SEQ ID NO: 3420267 - RNA, 13 nt, Pseudomonas aeruginosa PA01
cgcucugcagugc

SEQ ID NO: 3420268 - RNA, 16 nt, Pseudomonas aeruginosa PA01
cgcucugcgccaggcg

SEQ ID NO: 3420269 - RNA, 14 nt, Pseudomonas aeruginosa PA01
cgcucugcgccgcg

SEQ ID NO: 3420270 - RNA, 17 nt, Pseudomonas aeruginosa PA01
cgcucugcgccgcggcg

SEQ ID NO: 3420271 - RNA, 18 nt, Pseudomonas aeruginosa PA01
cgcucugcgccgcggcgu

SEQ ID NO: 3420272 - RNA, 23 nt, Pseudomonas aeruginosa PA01
cgcucugcgccgcggcguugcgc

SEQ ID NO: 3420273 - RNA, 15 nt, Pseudomonas aeruginosa PA01
cgcucugcuggccac

SEQ ID NO: 3420274 - RNA, 16 nt, Pseudomonas aeruginosa PA01
cgcucugcuggccacc

SEQ ID NO: 3420275 - RNA, 18 nt, Pseudomonas aeruginosa PA01
cgcucugcuggccgcccu

SEQ ID NO: 3420276 - RNA, 14 nt, Pseudomonas aeruginosa PA01
cgcucuggcgcaua

SEQ ID NO: 3420277 - RNA, 13 nt, Pseudomonas aeruginosa PA01
cgcucuggcugcu

SEQ ID NO: 3420278 - RNA, 18 nt, Pseudomonas aeruginosa PA01
cgcucuucaccucgauga

SEQ ID NO: 3420279 - RNA, 14 nt, Pseudomonas aeruginosa PA01
cgcucuucacuucc

SEQ ID NO: 3420280 - RNA, 18 nt, Pseudomonas aeruginosa PA01
cgcucuucagcacgccca

SEQ ID NO: 3420281 - RNA, 14 nt, Pseudomonas aeruginosa PA01
cgcucuuccuuguc

SEQ ID NO: 3420282 - RNA, 13 nt, Pseudomonas aeruginosa PA01
cgcucuucgccgc

SEQ ID NO: 3420283 - RNA, 18 nt, Pseudomonas aeruginosa PA01
cgcucuucgccgcggcgu

SEQ ID NO: 3420284 - RNA, 15 nt, Pseudomonas aeruginosa PA01
cgcugaaacgcgcgu

SEQ ID NO: 3420285 - RNA, 17 nt, Pseudomonas aeruginosa PA01
cgcugaaauagcgcguc

SEQ ID NO: 3420286 - RNA, 22 nt, Pseudomonas aeruginosa PA01
cgcugaaauggaaacgccagcc

SEQ ID NO: 3420287 - RNA, 15 nt, Pseudomonas aeruginosa PA01
cgcugaacagcuggc

SEQ ID NO: 3420288 - RNA, 16 nt, Pseudomonas aeruginosa PA01
cgcugaacagcuggcg

SEQ ID NO: 3420289 - RNA, 20 nt, Pseudomonas aeruginosa PA01
cgcugaagcggccgagaucc

SEQ ID NO: 3420290 - RNA, 21 nt, Pseudomonas aeruginosa PA01
cgcugaaggacugugccugga

SEQ ID NO: 3420291 - RNA, 14 nt, Pseudomonas aeruginosa PA01
cgcugaaggcggug

SEQ ID NO: 3420292 - RNA, 15 nt, Pseudomonas aeruginosa PA01
cgcugaaggucgccg

SEQ ID NO: 3420293 - RNA, 21 nt, Pseudomonas aeruginosa PA01
cgcugaaggucgccgcgcuga

SEQ ID NO: 3420294 - RNA, 16 nt, Pseudomonas aeruginosa PA01
cgcugaaguccuggcc

SEQ ID NO: 3420295 - RNA, 21 nt, Pseudomonas aeruginosa PA01
cgcugaauaccaccgggccgu

SEQ ID NO: 3420296 - RNA, 17 nt, Pseudomonas aeruginosa PA01
cgcugaccagcccggcg

SEQ ID NO: 3420297 - RNA, 20 nt, Pseudomonas aeruginosa PA01
cgcugaccagcccggcggcg

SEQ ID NO: 3420298 - RNA, 21 nt, Pseudomonas aeruginosa PA01
cgcugaccagcccggcggcgg

SEQ ID NO: 3420299 - RNA, 15 nt, Pseudomonas aeruginosa PA01
cgcugacccagcgca

SEQ ID NO: 3420300 - RNA, 17 nt, Pseudomonas aeruginosa PA01
cgcugacccagcgcacg

SEQ ID NO: 3420301 - RNA, 21 nt, Pseudomonas aeruginosa PA01
cgcugacccaggcuucggcgc

SEQ ID NO: 3420302 - RNA, 22 nt, Pseudomonas aeruginosa PA01
cgcugacccaggcuucggcgcg

SEQ ID NO: 3420303 - RNA, 23 nt, Pseudomonas aeruginosa PA01
cgcugacccaggcuucggcgcgc

SEQ ID NO: 3420304 - RNA, 13 nt, Pseudomonas aeruginosa PA01
cgcugaccgcucc

SEQ ID NO: 3420305 - RNA, 16 nt, Pseudomonas aeruginosa PA01
cgcugaccgcucccag

SEQ ID NO: 3420306 - RNA, 19 nt, Pseudomonas aeruginosa PA01
cgcugaccgcucccaggca

SEQ ID NO: 3420307 - RNA, 22 nt, Pseudomonas aeruginosa PA01
cgcugaccgcucccaggcaacg

SEQ ID NO: 3420308 - RNA, 14 nt, Pseudomonas aeruginosa PA01
cgcugaccggccgc

SEQ ID NO: 3420309 - RNA, 20 nt, Pseudomonas aeruginosa PA01
cgcugaccggccgcagcagg

SEQ ID NO: 3420310 - RNA, 14 nt, Pseudomonas aeruginosa PA01
cgcugaccgggcgg

SEQ ID NO: 3420311 - RNA, 20 nt, Pseudomonas aeruginosa PA01
cgcugaccucgagcuggacg

SEQ ID NO: 3420312 - RNA, 16 nt, Pseudomonas aeruginosa PA01
cgcugaccucgauggc

SEQ ID NO: 3420313 - RNA, 17 nt, Pseudomonas aeruginosa PA01
cgcugaccucgauggcg

SEQ ID NO: 3420314 - RNA, 18 nt, Pseudomonas aeruginosa PA01
cgcugaccucggugagga

SEQ ID NO: 3420315 - RNA, 16 nt, Pseudomonas aeruginosa PA01
cgcugacgaaacggug

SEQ ID NO: 3420316 - RNA, 19 nt, Pseudomonas aeruginosa PA01
cgcugacgaggacgccgcc

SEQ ID NO: 3420317 - RNA, 21 nt, Pseudomonas aeruginosa PA01
cgcugacgaggacgccgccgg

SEQ ID NO: 3420318 - RNA, 14 nt, Pseudomonas aeruginosa PA01
cgcugacgccggca

SEQ ID NO: 3420319 - RNA, 20 nt, Pseudomonas aeruginosa PA01
cgcugacggcaaggaccugc

SEQ ID NO: 3420320 - RNA, 17 nt, Pseudomonas aeruginosa PA01
cgcugacuuccaucagc

SEQ ID NO: 3420321 - RNA, 21 nt, Pseudomonas aeruginosa PA01
cgcugacuuccaucagcucca

SEQ ID NO: 3420322 - RNA, 19 nt, Pseudomonas aeruginosa PA01
cgcugagaccgauccagca

SEQ ID NO: 3420323 - RNA, 23 nt, Pseudomonas aeruginosa PA01
cgcugagaccgauccagcagucg

SEQ ID NO: 3420324 - RNA, 17 nt, Pseudomonas aeruginosa PA01
cgcugagcaccgggacg

SEQ ID NO: 3420325 - RNA, 14 nt, Pseudomonas aeruginosa PA01
cgcugagcagcagg

SEQ ID NO: 3420326 - RNA, 21 nt, Pseudomonas aeruginosa PA01
cgcugagcaguugcgggcgca

SEQ ID NO: 3420327 - RNA, 22 nt, Pseudomonas aeruginosa PA01
cgcugagcaguugcgggcgcag

SEQ ID NO: 3420328 - RNA, 14 nt, Pseudomonas aeruginosa PA01
cgcugagcaucugg

SEQ ID NO: 3420329 - RNA, 13 nt, Pseudomonas aeruginosa PA01
cgcugagcgccuc

SEQ ID NO: 3420330 - RNA, 15 nt, Pseudomonas aeruginosa PA01
cgcugagcgccucga

SEQ ID NO: 3420331 - RNA, 20 nt, Pseudomonas aeruginosa PA01
cgcugagcggaaacaagcuc

SEQ ID NO: 3420332 - RNA, 20 nt, Pseudomonas aeruginosa PA01
cgcugagcggcugguggccg

SEQ ID NO: 3420333 - RNA, 15 nt, Pseudomonas aeruginosa PA01
cgcugaggaagagca

SEQ ID NO: 3420334 - RNA, 18 nt, Pseudomonas aeruginosa PA01
cgcugaggaagagcagcg

SEQ ID NO: 3420335 - RNA, 22 nt, Pseudomonas aeruginosa PA01
cgcugaggaagagcagcgcggc

SEQ ID NO: 3420336 - RNA, 17 nt, Pseudomonas aeruginosa PA01
cgcugaggacugccagg

SEQ ID NO: 3420337 - RNA, 14 nt, Pseudomonas aeruginosa PA01
cgcugaggaucacg

SEQ ID NO: 3420338 - RNA, 19 nt, Pseudomonas aeruginosa PA01
cgcugaggaucacgauggc

SEQ ID NO: 3420339 - RNA, 20 nt, Pseudomonas aeruginosa PA01
cgcugaggaucacgauggcc

SEQ ID NO: 3420340 - RNA, 21 nt, Pseudomonas aeruginosa PA01
cgcugaggaucacgauggccg

SEQ ID NO: 3420341 - RNA, 23 nt, Pseudomonas aeruginosa PA01
cgcugaggaucacgauggccggc

SEQ ID NO: 3420342 - RNA, 16 nt, Pseudomonas aeruginosa PA01
cgcugaggaucagcca

SEQ ID NO: 3420343 - RNA, 23 nt, Pseudomonas aeruginosa PA01
cgcugaggccgcccuggccgagc

SEQ ID NO: 3420344 - RNA, 16 nt, Pseudomonas aeruginosa PA01
cgcugaggcucagcgc

SEQ ID NO: 3420345 - RNA, 12 nt, Pseudomonas aeruginosa PA01
cgcugaggcucg

SEQ ID NO: 3420346 - RNA, 23 nt, Pseudomonas aeruginosa PA01
cgcugaguuugcccagcgccgcc

SEQ ID NO: 3420347 - RNA, 18 nt, Pseudomonas aeruginosa PA01
cgcugaucacgaucggca

SEQ ID NO: 3420348 - RNA, 23 nt, Pseudomonas aeruginosa PA01
cgcugaucaguaccggcagcgcc

SEQ ID NO: 3420349 - RNA, 15 nt, Pseudomonas aeruginosa PA01
cgcugaucaucagca

SEQ ID NO: 3420350 - RNA, 20 nt, Pseudomonas aeruginosa PA01
cgcugaucaucagcaggguc

SEQ ID NO: 3420351 - RNA, 16 nt, Pseudomonas aeruginosa PA01
cgcugaucucgguauc

SEQ ID NO: 3420352 - RNA, 18 nt, Pseudomonas aeruginosa PA01
cgcugaugaucgcgucgu

SEQ ID NO: 3420353 - RNA, 20 nt, Pseudomonas aeruginosa PA01
cgcugaugaugccgcggcga

SEQ ID NO: 3420354 - RNA, 21 nt, Pseudomonas aeruginosa PA01
cgcugaugccggcgucggcga

SEQ ID NO: 3420355 - RNA, 15 nt, Pseudomonas aeruginosa PA01
cgcugauugcgggcc

SEQ ID NO: 3420356 - RNA, 21 nt, Pseudomonas aeruginosa PA01
cgcugauugcgggccuuggcg

SEQ ID NO: 3420357 - RNA, 17 nt, Pseudomonas aeruginosa PA01
cgcugcaaucgcugccg

SEQ ID NO: 3420358 - RNA, 16 nt, Pseudomonas aeruginosa PA01
cgcugcaauucgucgg

SEQ ID NO: 3420359 - RNA, 17 nt, Pseudomonas aeruginosa PA01
cgcugcaauucgucggc

SEQ ID NO: 3420360 - RNA, 18 nt, Pseudomonas aeruginosa PA01
cgcugcaauucgucggcc

SEQ ID NO: 3420361 - RNA, 20 nt, Pseudomonas aeruginosa PA01
cgcugcaauucgucggccug

SEQ ID NO: 3420362 - RNA, 21 nt, Pseudomonas aeruginosa PA01
cgcugcaauucgucggccugc

SEQ ID NO: 3420363 - RNA, 13 nt, Pseudomonas aeruginosa PA01
cgcugcaccagcu

SEQ ID NO: 3420364 - RNA, 17 nt, Pseudomonas aeruginosa PA01
cgcugcaccgaacggug

SEQ ID NO: 3420365 - RNA, 16 nt, Pseudomonas aeruginosa PA01
cgcugcaccgcggcgc

SEQ ID NO: 3420366 - RNA, 17 nt, Pseudomonas aeruginosa PA01
cgcugcacgcacgcgcc

SEQ ID NO: 3420367 - RNA, 18 nt, Pseudomonas aeruginosa PA01
cgcugcacgcacgcgccu

SEQ ID NO: 3420368 - RNA, 19 nt, Pseudomonas aeruginosa PA01
cgcugcaggcgguagcgcc

SEQ ID NO: 3420369 - RNA, 17 nt, Pseudomonas aeruginosa PA01
cgcugcagggcggcgcu

SEQ ID NO: 3420370 - RNA, 15 nt, Pseudomonas aeruginosa PA01
cgcugcaucggcgcg

SEQ ID NO: 3420371 - RNA, 17 nt, Pseudomonas aeruginosa PA01
cgcugcaucggcgcgcc

SEQ ID NO: 3420372 - RNA, 18 nt, Pseudomonas aeruginosa PA01
cgcugcaucggcgcgccg

SEQ ID NO: 3420373 - RNA, 19 nt, Pseudomonas aeruginosa PA01
cgcugcaucggcgcgccga

SEQ ID NO: 3420374 - RNA, 20 nt, Pseudomonas aeruginosa PA01
cgcugcaucggcgcgccgaa

SEQ ID NO: 3420375 - RNA, 12 nt, Pseudomonas aeruginosa PA01
cgcugcaugcgg

SEQ ID NO: 3420376 - RNA, 13 nt, Pseudomonas aeruginosa PA01
cgcugcaugcgga

SEQ ID NO: 3420377 - RNA, 15 nt, Pseudomonas aeruginosa PA01
cgcugcaugggcucg

SEQ ID NO: 3420378 - RNA, 21 nt, Pseudomonas aeruginosa PA01
cgcugcaugggcucgcgcggg

SEQ ID NO: 3420379 - RNA, 21 nt, Pseudomonas aeruginosa PA01
cgcugcauggggauggucgag

SEQ ID NO: 3420380 - RNA, 18 nt, Pseudomonas aeruginosa PA01
cgcugcaugugccaggcc

SEQ ID NO: 3420381 - RNA, 22 nt, Pseudomonas aeruginosa PA01
cgcugcaugugccaggccuggg

SEQ ID NO: 3420382 - RNA, 18 nt, Pseudomonas aeruginosa PA01
cgcugccaaacgccgucu

SEQ ID NO: 3420383 - RNA, 23 nt, Pseudomonas aeruginosa PA01
cgcugccacaguuucauggugcc

SEQ ID NO: 3420384 - RNA, 14 nt, Pseudomonas aeruginosa PA01
cgcugccagcaggc

SEQ ID NO: 3420385 - RNA, 17 nt, Pseudomonas aeruginosa PA01
cgcugccagcaggccga

SEQ ID NO: 3420386 - RNA, 13 nt, Pseudomonas aeruginosa PA01
cgcugccagcgcc

SEQ ID NO: 3420387 - RNA, 16 nt, Pseudomonas aeruginosa PA01
cgcugccagcgccgcc

SEQ ID NO: 3420388 - RNA, 17 nt, Pseudomonas aeruginosa PA01
cgcugccagcgccgccg

SEQ ID NO: 3420389 - RNA, 23 nt, Pseudomonas aeruginosa PA01
cgcugccagcgccgccgcguggg

SEQ ID NO: 3420390 - RNA, 22 nt, Pseudomonas aeruginosa PA01
cgcugccagguuggcaacugcg

SEQ ID NO: 3420391 - RNA, 16 nt, Pseudomonas aeruginosa PA01
cgcugccaguggcggc

SEQ ID NO: 3420392 - RNA, 22 nt, Pseudomonas aeruginosa PA01
cgcugcccagauccccugcagg

SEQ ID NO: 3420393 - RNA, 15 nt, Pseudomonas aeruginosa PA01
cgcugcccagcccgc

SEQ ID NO: 3420394 - RNA, 14 nt, Pseudomonas aeruginosa PA01
cgcugcccaucgcc

SEQ ID NO: 3420395 - RNA, 24 nt, Pseudomonas aeruginosa PA01
cgcugcccaucgccuccacggcgg

SEQ ID NO: 3420396 - RNA, 15 nt, Pseudomonas aeruginosa PA01
cgcugccccguagcc

SEQ ID NO: 3420397 - RNA, 13 nt, Pseudomonas aeruginosa PA01
cgcugcccggcgc

SEQ ID NO: 3420398 - RNA, 17 nt, Pseudomonas aeruginosa PA01
cgcugcccggcgcgacg

SEQ ID NO: 3420399 - RNA, 22 nt, Pseudomonas aeruginosa PA01
cgcugcccggcgcgacgcucca

SEQ ID NO: 3420400 - RNA, 13 nt, Pseudomonas aeruginosa PA01
cgcugccgaacag

SEQ ID NO: 3420401 - RNA, 17 nt, Pseudomonas aeruginosa PA01
cgcugccgaacagcagg

SEQ ID NO: 3420402 - RNA, 21 nt, Pseudomonas aeruginosa PA01
cgcugccgaacagcagggagg

SEQ ID NO: 3420403 - RNA, 17 nt, Pseudomonas aeruginosa PA01
cgcugccgaggaacucg

SEQ ID NO: 3420404 - RNA, 12 nt, Pseudomonas aeruginosa PA01
cgcugccgccgc

SEQ ID NO: 3420405 - RNA, 14 nt, Pseudomonas aeruginosa PA01
cgcugccgccgcgc

SEQ ID NO: 3420406 - RNA, 15 nt, Pseudomonas aeruginosa PA01
cgcugccgccgcgca

SEQ ID NO: 3420407 - RNA, 17 nt, Pseudomonas aeruginosa PA01
cgcugccgccgcgcagg

SEQ ID NO: 3420408 - RNA, 16 nt, Pseudomonas aeruginosa PA01
cgcugccgccgcgccc

SEQ ID NO: 3420409 - RNA, 22 nt, Pseudomonas aeruginosa PA01
cgcugccgccgcgcccggcgcc

SEQ ID NO: 3420410 - RNA, 23 nt, Pseudomonas aeruginosa PA01
cgcugccgccgcgcccggcgcca

SEQ ID NO: 3420411 - RNA, 20 nt, Pseudomonas aeruginosa PA01
cgcugccgccgucuccgccg

SEQ ID NO: 3420412 - RNA, 22 nt, Pseudomonas aeruginosa PA01
cgcugccgccgucuccgccgcu

SEQ ID NO: 3420413 - RNA, 23 nt, Pseudomonas aeruginosa PA01
cgcugccgcucuggcugcuggcg

SEQ ID NO: 3420414 - RNA, 14 nt, Pseudomonas aeruginosa PA01
cgcugccggccagg

SEQ ID NO: 3420415 - RNA, 16 nt, Pseudomonas aeruginosa PA01
cgcugccggccagggu

SEQ ID NO: 3420416 - RNA, 16 nt, Pseudomonas aeruginosa PA01
cgcugccggcgcgcac

SEQ ID NO: 3420417 - RNA, 16 nt, Pseudomonas aeruginosa PA01
cgcugccggucaggcu

SEQ ID NO: 3420418 - RNA, 19 nt, Pseudomonas aeruginosa PA01
cgcugccguagaggucgcc

SEQ ID NO: 3420419 - RNA, 13 nt, Pseudomonas aeruginosa PA01
cgcugccguucgc

SEQ ID NO: 3420420 - RNA, 18 nt, Pseudomonas aeruginosa PA01
cgcugccguucgcccgcg

SEQ ID NO: 3420421 - RNA, 19 nt, Pseudomonas aeruginosa PA01
cgcugccguucgcccgcgg

SEQ ID NO: 3420422 - RNA, 20 nt, Pseudomonas aeruginosa PA01
cgcugccguugcaggcccag

SEQ ID NO: 3420423 - RNA, 14 nt, Pseudomonas aeruginosa PA01
cgcugccugcaccg

SEQ ID NO: 3420424 - RNA, 18 nt, Pseudomonas aeruginosa PA01
cgcugccugcaccgggcc

SEQ ID NO: 3420425 - RNA, 20 nt, Pseudomonas aeruginosa PA01
cgcugccugcaccgggccga

SEQ ID NO: 3420426 - RNA, 16 nt, Pseudomonas aeruginosa PA01
cgcugccugcgaugga

SEQ ID NO: 3420427 - RNA, 17 nt, Pseudomonas aeruginosa PA01
cgcugccugcgauggaa

SEQ ID NO: 3420428 - RNA, 16 nt, Pseudomonas aeruginosa PA01
cgcugccuggggacgg

SEQ ID NO: 3420429 - RNA, 18 nt, Pseudomonas aeruginosa PA01
cgcugccuggggacggca

SEQ ID NO: 3420430 - RNA, 16 nt, Pseudomonas aeruginosa PA01
cgcugccugucgcagc

SEQ ID NO: 3420431 - RNA, 15 nt, Pseudomonas aeruginosa PA01
cgcugccuuccuuuu

SEQ ID NO: 3420432 - RNA, 17 nt, Pseudomonas aeruginosa PA01
cgcugcgaaucgucgcc

SEQ ID NO: 3420433 - RNA, 19 nt, Pseudomonas aeruginosa PA01
cgcugcgaaucgucgccgg

SEQ ID NO: 3420434 - RNA, 20 nt, Pseudomonas aeruginosa PA01
cgcugcgaaucgucgccgga

SEQ ID NO: 3420435 - RNA, 19 nt, Pseudomonas aeruginosa PA01
cgcugcgaccuggcgccga

SEQ ID NO: 3420436 - RNA, 14 nt, Pseudomonas aeruginosa PA01
cgcugcgagcaggu

SEQ ID NO: 3420437 - RNA, 15 nt, Pseudomonas aeruginosa PA01
cgcugcgagcagguc

SEQ ID NO: 3420438 - RNA, 20 nt, Pseudomonas aeruginosa PA01
cgcugcgagcagguccuguc

SEQ ID NO: 3420439 - RNA, 12 nt, Pseudomonas aeruginosa PA01
cgcugcgcaggc

SEQ ID NO: 3420440 - RNA, 13 nt, Pseudomonas aeruginosa PA01
cgcugcgcaggcc

SEQ ID NO: 3420441 - RNA, 15 nt, Pseudomonas aeruginosa PA01
cgcugcgcaggccga

SEQ ID NO: 3420442 - RNA, 17 nt, Pseudomonas aeruginosa PA01
cgcugcgcaggccgaga

SEQ ID NO: 3420443 - RNA, 19 nt, Pseudomonas aeruginosa PA01
cgcugcgcaggccgagaag

SEQ ID NO: 3420444 - RNA, 18 nt, Pseudomonas aeruginosa PA01
cgcugcgccaggccguuc

SEQ ID NO: 3420445 - RNA, 14 nt, Pseudomonas aeruginosa PA01
cgcugcgccaggcu

SEQ ID NO: 3420446 - RNA, 15 nt, Pseudomonas aeruginosa PA01
cgcugcgcccgcucg

SEQ ID NO: 3420447 - RNA, 18 nt, Pseudomonas aeruginosa PA01
cgcugcgcccgcucgacc

SEQ ID NO: 3420448 - RNA, 14 nt, Pseudomonas aeruginosa PA01
cgcugcgccgccgu

SEQ ID NO: 3420449 - RNA, 13 nt, Pseudomonas aeruginosa PA01
cgcugcgccggcg

SEQ ID NO: 3420450 - RNA, 15 nt, Pseudomonas aeruginosa PA01
cgcugcgccggcgcu

SEQ ID NO: 3420451 - RNA, 22 nt, Pseudomonas aeruginosa PA01
cgcugcgcgcaguucagggcgu

SEQ ID NO: 3420452 - RNA, 24 nt, Pseudomonas aeruginosa PA01
cgcugcgcgcaguucagggcguag

SEQ ID NO: 3420453 - RNA, 14 nt, Pseudomonas aeruginosa PA01
cgcugcgcggccug

SEQ ID NO: 3420454 - RNA, 12 nt, Pseudomonas aeruginosa PA01
cgcugcgcggcg

SEQ ID NO: 3420455 - RNA, 13 nt, Pseudomonas aeruginosa PA01
cgcugcgcggcgu

SEQ ID NO: 3420456 - RNA, 13 nt, Pseudomonas aeruginosa PA01
cgcugcgcugcca

SEQ ID NO: 3420457 - RNA, 15 nt, Pseudomonas aeruginosa PA01
cgcugcgcugccagc

SEQ ID NO: 3420458 - RNA, 22 nt, Pseudomonas aeruginosa PA01
cgcugcgcugccagcgccgccg

SEQ ID NO: 3420459 - RNA, 17 nt, Pseudomonas aeruginosa PA01
cgcugcggaagaaacug

SEQ ID NO: 3420460 - RNA, 23 nt, Pseudomonas aeruginosa PA01
cgcugcggaagagguacggccuu

SEQ ID NO: 3420461 - RNA, 21 nt, Pseudomonas aeruginosa PA01
cgcugcggaucaacuccgcca

SEQ ID NO: 3420462 - RNA, 22 nt, Pseudomonas aeruginosa PA01
cgcugcggaucaacuccgccag

SEQ ID NO: 3420463 - RNA, 13 nt, Pseudomonas aeruginosa PA01
cgcugcggccggc

SEQ ID NO: 3420464 - RNA, 16 nt, Pseudomonas aeruginosa PA01
cgcugcggccggcgcg

SEQ ID NO: 3420465 - RNA, 13 nt, Pseudomonas aeruginosa PA01
cgcugcggcucgc

SEQ ID NO: 3420466 - RNA, 16 nt, Pseudomonas aeruginosa PA01
cgcugcggcucgccga

SEQ ID NO: 3420467 - RNA, 17 nt, Pseudomonas aeruginosa PA01
cgcugcggcucgccgau

SEQ ID NO: 3420468 - RNA, 18 nt, Pseudomonas aeruginosa PA01
cgcugcggcucgccgauu

SEQ ID NO: 3420469 - RNA, 13 nt, Pseudomonas aeruginosa PA01
cgcugcggcugca

SEQ ID NO: 3420470 - RNA, 18 nt, Pseudomonas aeruginosa PA01
cgcugcggcugcagggcc

SEQ ID NO: 3420471 - RNA, 17 nt, Pseudomonas aeruginosa PA01
cgcugcgggcguagcgc

SEQ ID NO: 3420472 - RNA, 18 nt, Pseudomonas aeruginosa PA01
cgcugcggguucagucgg

SEQ ID NO: 3420473 - RNA, 22 nt, Pseudomonas aeruginosa PA01
cgcugcggguucagucggccag

SEQ ID NO: 3420474 - RNA, 21 nt, Pseudomonas aeruginosa PA01
cgcugcguaguugagccccag

SEQ ID NO: 3420475 - RNA, 13 nt, Pseudomonas aeruginosa PA01
cgcugcgugcgcc

SEQ ID NO: 3420476 - RNA, 22 nt, Pseudomonas aeruginosa PA01
cgcugcgugcgccgcucgcgca

SEQ ID NO: 3420477 - RNA, 21 nt, Pseudomonas aeruginosa PA01
cgcugcguggguagccgccca

SEQ ID NO: 3420478 - RNA, 23 nt, Pseudomonas aeruginosa PA01
cgcugcguggguagccgcccacc

SEQ ID NO: 3420479 - RNA, 18 nt, Pseudomonas aeruginosa PA01
cgcugcuaggcuggaagc

SEQ ID NO: 3420480 - RNA, 19 nt, Pseudomonas aeruginosa PA01
cgcugcuaggcuggaagcc

SEQ ID NO: 3420481 - RNA, 21 nt, Pseudomonas aeruginosa PA01
cgcugcucagggccgcgccga

SEQ ID NO: 3420482 - RNA, 22 nt, Pseudomonas aeruginosa PA01
cgcugcucagggccgcgccgag

SEQ ID NO: 3420483 - RNA, 23 nt, Pseudomonas aeruginosa PA01
cgcugcucagggccgcgccgagc

SEQ ID NO: 3420484 - RNA, 19 nt, Pseudomonas aeruginosa PA01
cgcugcucagggcuccaau

SEQ ID NO: 3420485 - RNA, 15 nt, Pseudomonas aeruginosa PA01
cgcugcucgaccacc

SEQ ID NO: 3420486 - RNA, 15 nt, Pseudomonas aeruginosa PA01
cgcugcucgacggca

SEQ ID NO: 3420487 - RNA, 21 nt, Pseudomonas aeruginosa PA01
cgcugcucgacggcaccagcg

SEQ ID NO: 3420488 - RNA, 22 nt, Pseudomonas aeruginosa PA01
cgcugcucgacggcaccagcgc

SEQ ID NO: 3420489 - RNA, 15 nt, Pseudomonas aeruginosa PA01
cgcugcucgauggcc

SEQ ID NO: 3420490 - RNA, 21 nt, Pseudomonas aeruginosa PA01
cgcugcucgauggccuugagg

SEQ ID NO: 3420491 - RNA, 15 nt, Pseudomonas aeruginosa PA01
cgcugcucgcagccg

SEQ ID NO: 3420492 - RNA, 14 nt, Pseudomonas aeruginosa PA01
cgcugcucggccuu

SEQ ID NO: 3420493 - RNA, 21 nt, Pseudomonas aeruginosa PA01
cgcugcugccauccgcgccga

SEQ ID NO: 3420494 - RNA, 22 nt, Pseudomonas aeruginosa PA01
cgcugcugccauccgcgccgac

SEQ ID NO: 3420495 - RNA, 23 nt, Pseudomonas aeruginosa PA01
cgcugcugccauccgcgccgacc

SEQ ID NO: 3420496 - RNA, 18 nt, Pseudomonas aeruginosa PA01
cgcugcuggauggggcug

SEQ ID NO: 3420497 - RNA, 16 nt, Pseudomonas aeruginosa PA01
cgcugcuggcgccgcu

SEQ ID NO: 3420498 - RNA, 18 nt, Pseudomonas aeruginosa PA01
cgcugcuggcgccgcugg

SEQ ID NO: 3420499 - RNA, 14 nt, Pseudomonas aeruginosa PA01
cgcugcugggcggc

SEQ ID NO: 3420500 - RNA, 15 nt, Pseudomonas aeruginosa PA01
cgcugcugggcggcg

SEQ ID NO: 3420501 - RNA, 16 nt, Pseudomonas aeruginosa PA01
cgcugcugggcggcga

SEQ ID NO: 3420502 - RNA, 18 nt, Pseudomonas aeruginosa PA01
cgcugcugggcggcgacc

SEQ ID NO: 3420503 - RNA, 13 nt, Pseudomonas aeruginosa PA01
cgcugcugguagu

SEQ ID NO: 3420504 - RNA, 21 nt, Pseudomonas aeruginosa PA01
cgcugcuucuugucgagguag

SEQ ID NO: 3420505 - RNA, 15 nt, Pseudomonas aeruginosa PA01
cgcugcuugaacacc

SEQ ID NO: 3420506 - RNA, 16 nt, Pseudomonas aeruginosa PA01
cgcugcuugaccacca

SEQ ID NO: 3420507 - RNA, 12 nt, Pseudomonas aeruginosa PA01
cgcugcuugcgc

SEQ ID NO: 3420508 - RNA, 16 nt, Pseudomonas aeruginosa PA01
cgcuggaaccggccgg

SEQ ID NO: 3420509 - RNA, 16 nt, Pseudomonas aeruginosa PA01
cgcuggaacggccagg

SEQ ID NO: 3420510 - RNA, 17 nt, Pseudomonas aeruginosa PA01
cgcuggaacggccaggu

SEQ ID NO: 3420511 - RNA, 20 nt, Pseudomonas aeruginosa PA01
cgcuggaaguuguacagcga

SEQ ID NO: 3420512 - RNA, 21 nt, Pseudomonas aeruginosa PA01
cgcuggaaguuguacagcgag

SEQ ID NO: 3420513 - RNA, 19 nt, Pseudomonas aeruginosa PA01
cgcuggaccaggcggccgg

SEQ ID NO: 3420514 - RNA, 21 nt, Pseudomonas aeruginosa PA01
cgcuggaccaguucagcgcgc

SEQ ID NO: 3420515 - RNA, 14 nt, Pseudomonas aeruginosa PA01
cgcuggacccgcac

SEQ ID NO: 3420516 - RNA, 21 nt, Pseudomonas aeruginosa PA01
cgcuggacccgcaccuggacc

SEQ ID NO: 3420517 - RNA, 13 nt, Pseudomonas aeruginosa PA01
cgcuggagcugcg

SEQ ID NO: 3420518 - RNA, 17 nt, Pseudomonas aeruginosa PA01
cgcuggaguaucgcccu

SEQ ID NO: 3420519 - RNA, 19 nt, Pseudomonas aeruginosa PA01
cgcuggaguaucgcccugg

SEQ ID NO: 3420520 - RNA, 16 nt, Pseudomonas aeruginosa PA01
cgcuggaugccgacca

SEQ ID NO: 3420521 - RNA, 13 nt, Pseudomonas aeruginosa PA01
cgcuggcaccggc

SEQ ID NO: 3420522 - RNA, 19 nt, Pseudomonas aeruginosa PA01
cgcuggcaccggccaggcg

SEQ ID NO: 3420523 - RNA, 21 nt, Pseudomonas aeruginosa PA01
cgcuggcagaacgcgucgacc

SEQ ID NO: 3420524 - RNA, 20 nt, Pseudomonas aeruginosa PA01
cgcuggcagguugcacggcc

SEQ ID NO: 3420525 - RNA, 23 nt, Pseudomonas aeruginosa PA01
cgcuggcagguugcacggccggu

SEQ ID NO: 3420526 - RNA, 22 nt, Pseudomonas aeruginosa PA01
cgcuggcauacacaugcaggcu

SEQ ID NO: 3420527 - RNA, 14 nt, Pseudomonas aeruginosa PA01
cgcuggccagcgcu

SEQ ID NO: 3420528 - RNA, 17 nt, Pseudomonas aeruginosa PA01
cgcuggccagcgcuucc

SEQ ID NO: 3420529 - RNA, 22 nt, Pseudomonas aeruginosa PA01
cgcuggccagcgcuuccaccgc

SEQ ID NO: 3420530 - RNA, 23 nt, Pseudomonas aeruginosa PA01
cgcuggccagcgcuuccaccgcc

SEQ ID NO: 3420531 - RNA, 12 nt, Pseudomonas aeruginosa PA01
cgcuggccagcu

SEQ ID NO: 3420532 - RNA, 21 nt, Pseudomonas aeruginosa PA01
cgcuggccaguuccaugucgc

SEQ ID NO: 3420533 - RNA, 12 nt, Pseudomonas aeruginosa PA01
cgcuggccaucu

SEQ ID NO: 3420534 - RNA, 23 nt, Pseudomonas aeruginosa PA01
cgcuggccaucuucucgaagcgc

SEQ ID NO: 3420535 - RNA, 23 nt, Pseudomonas aeruginosa PA01
cgcuggcccaacagcggugugcu

SEQ ID NO: 3420536 - RNA, 12 nt, Pseudomonas aeruginosa PA01
cgcuggccgaau

SEQ ID NO: 3420537 - RNA, 13 nt, Pseudomonas aeruginosa PA01
cgcuggccgacca

SEQ ID NO: 3420538 - RNA, 24 nt, Pseudomonas aeruginosa PA01
cgcuggccgagcugccgcaccgcc

SEQ ID NO: 3420539 - RNA, 14 nt, Pseudomonas aeruginosa PA01
cgcuggccgcgcga

SEQ ID NO: 3420540 - RNA, 15 nt, Pseudomonas aeruginosa PA01
cgcuggccugcagca

SEQ ID NO: 3420541 - RNA, 15 nt, Pseudomonas aeruginosa PA01
cgcuggccugcaggu

SEQ ID NO: 3420542 - RNA, 17 nt, Pseudomonas aeruginosa PA01
cgcuggccugccgaugg

SEQ ID NO: 3420543 - RNA, 12 nt, Pseudomonas aeruginosa PA01
cgcuggccuggg

SEQ ID NO: 3420544 - RNA, 22 nt, Pseudomonas aeruginosa PA01
cgcuggccugggguagccggcc

SEQ ID NO: 3420545 - RNA, 24 nt, Pseudomonas aeruginosa PA01
cgcuggccugggguagccggccga

SEQ ID NO: 3420546 - RNA, 14 nt, Pseudomonas aeruginosa PA01
cgcuggcgacgcuu

SEQ ID NO: 3420547 - RNA, 21 nt, Pseudomonas aeruginosa PA01
cgcuggcgaggacgccgggcu

SEQ ID NO: 3420548 - RNA, 22 nt, Pseudomonas aeruginosa PA01
cgcuggcgaggauuuccucgcg

SEQ ID NO: 3420549 - RNA, 23 nt, Pseudomonas aeruginosa PA01
cgcuggcgaggauuuccucgcgc

SEQ ID NO: 3420550 - RNA, 16 nt, Pseudomonas aeruginosa PA01
cgcuggcgaucaccag

SEQ ID NO: 3420551 - RNA, 21 nt, Pseudomonas aeruginosa PA01
cgcuggcgaucaccagggugc

SEQ ID NO: 3420552 - RNA, 16 nt, Pseudomonas aeruginosa PA01
cgcuggcgaucaugcc

SEQ ID NO: 3420553 - RNA, 15 nt, Pseudomonas aeruginosa PA01
cgcuggcgaucucgg

SEQ ID NO: 3420554 - RNA, 16 nt, Pseudomonas aeruginosa PA01
cgcuggcgaucucggc

SEQ ID NO: 3420555 - RNA, 19 nt, Pseudomonas aeruginosa PA01
cgcuggcgaucucggcgcg

SEQ ID NO: 3420556 - RNA, 20 nt, Pseudomonas aeruginosa PA01
cgcuggcgaucucggcgcgg

SEQ ID NO: 3420557 - RNA, 22 nt, Pseudomonas aeruginosa PA01
cgcuggcgaucucggcgcgggc

SEQ ID NO: 3420558 - RNA, 23 nt, Pseudomonas aeruginosa PA01
cgcuggcgaucucggcgcgggca

SEQ ID NO: 3420559 - RNA, 19 nt, Pseudomonas aeruginosa PA01
cgcuggcgauguagcugcc

SEQ ID NO: 3420560 - RNA, 22 nt, Pseudomonas aeruginosa PA01
cgcuggcgauguagcugccggc

SEQ ID NO: 3420561 - RNA, 16 nt, Pseudomonas aeruginosa PA01
cgcuggcgcagcagca

SEQ ID NO: 3420562 - RNA, 18 nt, Pseudomonas aeruginosa PA01
cgcuggcgcagcagcagg

SEQ ID NO: 3420563 - RNA, 16 nt, Pseudomonas aeruginosa PA01
cgcuggcgcagccgcu

SEQ ID NO: 3420564 - RNA, 17 nt, Pseudomonas aeruginosa PA01
cgcuggcgcagccgcug

SEQ ID NO: 3420565 - RNA, 14 nt, Pseudomonas aeruginosa PA01
cgcuggcgcagcgg

SEQ ID NO: 3420566 - RNA, 15 nt, Pseudomonas aeruginosa PA01
cgcuggcgcccaacg

SEQ ID NO: 3420567 - RNA, 18 nt, Pseudomonas aeruginosa PA01
cgcuggcgcccaacgucu

SEQ ID NO: 3420568 - RNA, 23 nt, Pseudomonas aeruginosa PA01
cgcuggcgcccaacgucuucagg

SEQ ID NO: 3420569 - RNA, 16 nt, Pseudomonas aeruginosa PA01
cgcuggcgccgaugcu

SEQ ID NO: 3420570 - RNA, 22 nt, Pseudomonas aeruginosa PA01
cgcuggcgcugaccgcucccag

SEQ ID NO: 3420571 - RNA, 15 nt, Pseudomonas aeruginosa PA01
cgcuggcgcuguagg

SEQ ID NO: 3420572 - RNA, 17 nt, Pseudomonas aeruginosa PA01
cgcuggcgcuguaggcg

SEQ ID NO: 3420573 - RNA, 20 nt, Pseudomonas aeruginosa PA01
cgcuggcgcuguaggcgagc

SEQ ID NO: 3420574 - RNA, 17 nt, Pseudomonas aeruginosa PA01
cgcuggcggcaugccgu

SEQ ID NO: 3420575 - RNA, 13 nt, Pseudomonas aeruginosa PA01
cgcuggcggccga

SEQ ID NO: 3420576 - RNA, 23 nt, Pseudomonas aeruginosa PA01
cgcuggcggccgaguucgcgcag

SEQ ID NO: 3420577 - RNA, 18 nt, Pseudomonas aeruginosa PA01
cgcuggcggccuucggcg

SEQ ID NO: 3420578 - RNA, 13 nt, Pseudomonas aeruginosa PA01
cgcuggcggcgac

SEQ ID NO: 3420579 - RNA, 13 nt, Pseudomonas aeruginosa PA01
cgcuggcggcgcu

SEQ ID NO: 3420580 - RNA, 16 nt, Pseudomonas aeruginosa PA01
cgcuggcgucgaccgc

SEQ ID NO: 3420581 - RNA, 17 nt, Pseudomonas aeruginosa PA01
cgcuggcgucgaccgcc

SEQ ID NO: 3420582 - RNA, 17 nt, Pseudomonas aeruginosa PA01
cgcuggcguuguugccg

SEQ ID NO: 3420583 - RNA, 16 nt, Pseudomonas aeruginosa PA01
cgcugggacggcggcu

SEQ ID NO: 3420584 - RNA, 13 nt, Pseudomonas aeruginosa PA01
cgcugggcagcac

SEQ ID NO: 3420585 - RNA, 15 nt, Pseudomonas aeruginosa PA01
cgcugggcagguggu

SEQ ID NO: 3420586 - RNA, 20 nt, Pseudomonas aeruginosa PA01
cgcugggcagguggugguag

SEQ ID NO: 3420587 - RNA, 14 nt, Pseudomonas aeruginosa PA01
cgcugggcgaggug

SEQ ID NO: 3420588 - RNA, 15 nt, Pseudomonas aeruginosa PA01
cgcugggcgcagccc

SEQ ID NO: 3420589 - RNA, 15 nt, Pseudomonas aeruginosa PA01
cgcugggcgccgauu

SEQ ID NO: 3420590 - RNA, 19 nt, Pseudomonas aeruginosa PA01
cgcugggcgccggcaggcc

SEQ ID NO: 3420591 - RNA, 20 nt, Pseudomonas aeruginosa PA01
cgcugggcgccggcaggccu

SEQ ID NO: 3420592 - RNA, 12 nt, Pseudomonas aeruginosa PA01
cgcugggcgccu

SEQ ID NO: 3420593 - RNA, 14 nt, Pseudomonas aeruginosa PA01
cgcugggcgccucg

SEQ ID NO: 3420594 - RNA, 19 nt, Pseudomonas aeruginosa PA01
cgcugggcgccucgucgac

SEQ ID NO: 3420595 - RNA, 21 nt, Pseudomonas aeruginosa PA01
cgcugggcggcuggccgagga

SEQ ID NO: 3420596 - RNA, 20 nt, Pseudomonas aeruginosa PA01
cgcugggcugggucggcugg

SEQ ID NO: 3420597 - RNA, 19 nt, Pseudomonas aeruginosa PA01
cgcuggggaccgcaccugg

SEQ ID NO: 3420598 - RNA, 15 nt, Pseudomonas aeruginosa PA01
cgcugguaauccagg

SEQ ID NO: 3420599 - RNA, 15 nt, Pseudomonas aeruginosa PA01
cgcugguaccugccg

SEQ ID NO: 3420600 - RNA, 17 nt, Pseudomonas aeruginosa PA01
cgcugguaccugccggc

SEQ ID NO: 3420601 - RNA, 19 nt, Pseudomonas aeruginosa PA01
cgcugguaccugccggcac

SEQ ID NO: 3420602 - RNA, 14 nt, Pseudomonas aeruginosa PA01
cgcugguagcccag

SEQ ID NO: 3420603 - RNA, 15 nt, Pseudomonas aeruginosa PA01
cgcugguagcccagg

SEQ ID NO: 3420604 - RNA, 16 nt, Pseudomonas aeruginosa PA01
cgcugguagcccaggc

SEQ ID NO: 3420605 - RNA, 17 nt, Pseudomonas aeruginosa PA01
cgcugguagcccaggcc

SEQ ID NO: 3420606 - RNA, 18 nt, Pseudomonas aeruginosa PA01
cgcugguagcccaggccg

SEQ ID NO: 3420607 - RNA, 19 nt, Pseudomonas aeruginosa PA01
cgcugguagcgcuccagcu

SEQ ID NO: 3420608 - RNA, 22 nt, Pseudomonas aeruginosa PA01
cgcugguagcgcuccagcuccu

SEQ ID NO: 3420609 - RNA, 20 nt, Pseudomonas aeruginosa PA01
cgcugguccagcuggcgcag

SEQ ID NO: 3420610 - RNA, 21 nt, Pseudomonas aeruginosa PA01
cgcugguccagcuggcgcagc

SEQ ID NO: 3420611 - RNA, 18 nt, Pseudomonas aeruginosa PA01
cgcuggucguaggcgcgg

SEQ ID NO: 3420612 - RNA, 19 nt, Pseudomonas aeruginosa PA01
cgcuggucguucucgcgca

SEQ ID NO: 3420613 - RNA, 20 nt, Pseudomonas aeruginosa PA01
cgcuggucguucucgcgcau

SEQ ID NO: 3420614 - RNA, 21 nt, Pseudomonas aeruginosa PA01
cgcuggucguucucgcgcauc

SEQ ID NO: 3420615 - RNA, 22 nt, Pseudomonas aeruginosa PA01
cgcuggugaucgagggaggucg

SEQ ID NO: 3420616 - RNA, 13 nt, Pseudomonas aeruginosa PA01
cgcuggugcugcu

SEQ ID NO: 3420617 - RNA, 17 nt, Pseudomonas aeruginosa PA01
cgcugguugaggucgac

SEQ ID NO: 3420618 - RNA, 18 nt, Pseudomonas aeruginosa PA01
cgcugguugaggucgacg

SEQ ID NO: 3420619 - RNA, 19 nt, Pseudomonas aeruginosa PA01
cgcugguugaggucgacga

SEQ ID NO: 3420620 - RNA, 15 nt, Pseudomonas aeruginosa PA01
cgcugguugcccagg

SEQ ID NO: 3420621 - RNA, 19 nt, Pseudomonas aeruginosa PA01
cgcugguuuagcucggcga

SEQ ID NO: 3420622 - RNA, 18 nt, Pseudomonas aeruginosa PA01
cgcuguaaagcgaguccg

SEQ ID NO: 3420623 - RNA, 17 nt, Pseudomonas aeruginosa PA01
cgcuguacaagcgcaac

SEQ ID NO: 3420624 - RNA, 22 nt, Pseudomonas aeruginosa PA01
cgcuguacaagcgcaacgcgcg

SEQ ID NO: 3420625 - RNA, 18 nt, Pseudomonas aeruginosa PA01
cgcuguagaccagauaga

SEQ ID NO: 3420626 - RNA, 13 nt, Pseudomonas aeruginosa PA01
cgcuguagccggc

SEQ ID NO: 3420627 - RNA, 19 nt, Pseudomonas aeruginosa PA01
cgcuguaggacagguucag

SEQ ID NO: 3420628 - RNA, 16 nt, Pseudomonas aeruginosa PA01
cgcuguaggcgagcag

SEQ ID NO: 3420629 - RNA, 17 nt, Pseudomonas aeruginosa PA01
cgcuguaggcgagcagc

SEQ ID NO: 3420630 - RNA, 20 nt, Pseudomonas aeruginosa PA01
cgcuguaggcgagcagcggc

SEQ ID NO: 3420631 - RNA, 21 nt, Pseudomonas aeruginosa PA01
cgcuguaggcgagcagcggca

SEQ ID NO: 3420632 - RNA, 21 nt, Pseudomonas aeruginosa PA01
cgcuguaguuguucggcuggg

SEQ ID NO: 3420633 - RNA, 19 nt, Pseudomonas aeruginosa PA01
cgcugucaaucgcgcaacg

SEQ ID NO: 3420634 - RNA, 21 nt, Pseudomonas aeruginosa PA01
cgcugucaaucgcgcaacggc

SEQ ID NO: 3420635 - RNA, 10 nt, Pseudomonas aeruginosa PA01
cgcugucagg

SEQ ID NO: 3420636 - RNA, 18 nt, Pseudomonas aeruginosa PA01
cgcugucagggcuugcgc

SEQ ID NO: 3420637 - RNA, 21 nt, Pseudomonas aeruginosa PA01
cgcugucagggcuugcgcgcc

SEQ ID NO: 3420638 - RNA, 13 nt, Pseudomonas aeruginosa PA01
cgcugucccggcc

SEQ ID NO: 3420639 - RNA, 14 nt, Pseudomonas aeruginosa PA01
cgcugucccggcca

SEQ ID NO: 3420640 - RNA, 14 nt, Pseudomonas aeruginosa PA01
cgcuguccgccgcc

SEQ ID NO: 3420641 - RNA, 15 nt, Pseudomonas aeruginosa PA01
cgcuguccgccgccg

SEQ ID NO: 3420642 - RNA, 16 nt, Pseudomonas aeruginosa PA01
cgcuguccgccgccgc

SEQ ID NO: 3420643 - RNA, 20 nt, Pseudomonas aeruginosa PA01
cgcuguccgccgccgcggcg

SEQ ID NO: 3420644 - RNA, 21 nt, Pseudomonas aeruginosa PA01
cgcuguccgccgccgcggcgc

SEQ ID NO: 3420645 - RNA, 15 nt, Pseudomonas aeruginosa PA01
cgcuguccgccggcc

SEQ ID NO: 3420646 - RNA, 16 nt, Pseudomonas aeruginosa PA01
cgcuguccgccggccu

SEQ ID NO: 3420647 - RNA, 16 nt, Pseudomonas aeruginosa PA01
cgcuguccuccagcgg

SEQ ID NO: 3420648 - RNA, 18 nt, Pseudomonas aeruginosa PA01
cgcuguccuccagcggcg

SEQ ID NO: 3420649 - RNA, 19 nt, Pseudomonas aeruginosa PA01
cgcuguccuccagcggcgg

SEQ ID NO: 3420650 - RNA, 21 nt, Pseudomonas aeruginosa PA01
cgcuguccuccagcggcggga

SEQ ID NO: 3420651 - RNA, 15 nt, Pseudomonas aeruginosa PA01
cgcugucgagcaggg

SEQ ID NO: 3420652 - RNA, 23 nt, Pseudomonas aeruginosa PA01
cgcugucgagcagggagaaccag

SEQ ID NO: 3420653 - RNA, 16 nt, Pseudomonas aeruginosa PA01
cgcugucgccggucag

SEQ ID NO: 3420654 - RNA, 13 nt, Pseudomonas aeruginosa PA01
cgcugucgccguu

SEQ ID NO: 3420655 - RNA, 22 nt, Pseudomonas aeruginosa PA01
cgcugucgccguuggccuucac

SEQ ID NO: 3420656 - RNA, 23 nt, Pseudomonas aeruginosa PA01
cgcugucgcguucccacucgcga

SEQ ID NO: 3420657 - RNA, 18 nt, Pseudomonas aeruginosa PA01
cgcugucggccucgacga

SEQ ID NO: 3420658 - RNA, 13 nt, Pseudomonas aeruginosa PA01
cgcugucgucggc

SEQ ID NO: 3420659 - RNA, 16 nt, Pseudomonas aeruginosa PA01
cgcugucgucggcgcg

SEQ ID NO: 3420660 - RNA, 20 nt, Pseudomonas aeruginosa PA01
cgcugucgucggcgcggccg

SEQ ID NO: 3420661 - RNA, 20 nt, Pseudomonas aeruginosa PA01
cgcugucuaucugcgccgaa

SEQ ID NO: 3420662 - RNA, 16 nt, Pseudomonas aeruginosa PA01
cgcugucucgccagcc

SEQ ID NO: 3420663 - RNA, 20 nt, Pseudomonas aeruginosa PA01
cgcugugaggugggcgcgcc

SEQ ID NO: 3420664 - RNA, 23 nt, Pseudomonas aeruginosa PA01
cgcugugaggugggcgcgccgca

SEQ ID NO: 3420665 - RNA, 15 nt, Pseudomonas aeruginosa PA01
cgcugugcggcagca

SEQ ID NO: 3420666 - RNA, 17 nt, Pseudomonas aeruginosa PA01
cgcugugcggcagcagg

SEQ ID NO: 3420667 - RNA, 19 nt, Pseudomonas aeruginosa PA01
cgcuguggaaguacggcgc

SEQ ID NO: 3420668 - RNA, 22 nt, Pseudomonas aeruginosa PA01
cgcuguggaaguacggcgcggu

SEQ ID NO: 3420669 - RNA, 18 nt, Pseudomonas aeruginosa PA01
cgcugugggugaggcguu

SEQ ID NO: 3420670 - RNA, 22 nt, Pseudomonas aeruginosa PA01
cgcugugugccucugaccgcgc

SEQ ID NO: 3420671 - RNA, 18 nt, Pseudomonas aeruginosa PA01
cgcuguuccgccguggga

SEQ ID NO: 3420672 - RNA, 14 nt, Pseudomonas aeruginosa PA01
cgcuguuccucguc

SEQ ID NO: 3420673 - RNA, 21 nt, Pseudomonas aeruginosa PA01
cgcuguuccucguccaguuca

SEQ ID NO: 3420674 - RNA, 17 nt, Pseudomonas aeruginosa PA01
cgcuguuggccugggcg

SEQ ID NO: 3420675 - RNA, 23 nt, Pseudomonas aeruginosa PA01
cgcuguugguguugauggucacc

SEQ ID NO: 3420676 - RNA, 22 nt, Pseudomonas aeruginosa PA01
cgcuguuucuccaguucggcga

SEQ ID NO: 3420677 - RNA, 23 nt, Pseudomonas aeruginosa PA01
cgcuguuucuccaguucggcgau

SEQ ID NO: 3420678 - RNA, 18 nt, Pseudomonas aeruginosa PA01
cgcuguuugcggcgcagg

SEQ ID NO: 3420679 - RNA, 17 nt, Pseudomonas aeruginosa PA01
cgcuuagcgccagaacg

SEQ ID NO: 3420680 - RNA, 20 nt, Pseudomonas aeruginosa PA01
cgcuucacucauccucgccg

SEQ ID NO: 3420681 - RNA, 23 nt, Pseudomonas aeruginosa PA01
cgcuucacucauccucgccgcug

SEQ ID NO: 3420682 - RNA, 19 nt, Pseudomonas aeruginosa PA01
cgcuucagcgccucgaccu

SEQ ID NO: 3420683 - RNA, 13 nt, Pseudomonas aeruginosa PA01
cgcuucagcgcgc

SEQ ID NO: 3420684 - RNA, 15 nt, Pseudomonas aeruginosa PA01
cgcuucagcgcgccg

SEQ ID NO: 3420685 - RNA, 19 nt, Pseudomonas aeruginosa PA01
cgcuucaucaggcugcugu

SEQ ID NO: 3420686 - RNA, 21 nt, Pseudomonas aeruginosa PA01
cgcuucaucaggcugcugucg

SEQ ID NO: 3420687 - RNA, 15 nt, Pseudomonas aeruginosa PA01
cgcuucauccugcgc

SEQ ID NO: 3420688 - RNA, 19 nt, Pseudomonas aeruginosa PA01
cgcuucauccugcgcgccu

SEQ ID NO: 3420689 - RNA, 21 nt, Pseudomonas aeruginosa PA01
cgcuucauccugcgcgccucu

SEQ ID NO: 3420690 - RNA, 16 nt, Pseudomonas aeruginosa PA01
cgcuuccaccgccugc

SEQ ID NO: 3420691 - RNA, 14 nt, Pseudomonas aeruginosa PA01
cgcuuccagcaccu

SEQ ID NO: 3420692 - RNA, 14 nt, Pseudomonas aeruginosa PA01
cgcuuccaggcacg

SEQ ID NO: 3420693 - RNA, 22 nt, Pseudomonas aeruginosa PA01
cgcuuccaggguagcgccgcgg

SEQ ID NO: 3420694 - RNA, 23 nt, Pseudomonas aeruginosa PA01
cgcuuccaggguagcgccgcggg

SEQ ID NO: 3420695 - RNA, 23 nt, Pseudomonas aeruginosa PA01
cgcuuccgccaggcgcagccagc

SEQ ID NO: 3420696 - RNA, 14 nt, Pseudomonas aeruginosa PA01
cgcuuccgcccagu

SEQ ID NO: 3420697 - RNA, 15 nt, Pseudomonas aeruginosa PA01
cgcuuccgccggcgc

SEQ ID NO: 3420698 - RNA, 16 nt, Pseudomonas aeruginosa PA01
cgcuuccgccggcgcc

SEQ ID NO: 3420699 - RNA, 17 nt, Pseudomonas aeruginosa PA01
cgcuuccgccggcgccg

SEQ ID NO: 3420700 - RNA, 18 nt, Pseudomonas aeruginosa PA01
cgcuuccgccggcgccgc

SEQ ID NO: 3420701 - RNA, 21 nt, Pseudomonas aeruginosa PA01
cgcuuccgccggcgccgccuc

SEQ ID NO: 3420702 - RNA, 23 nt, Pseudomonas aeruginosa PA01
cgcuuccgccggcgccgccucgg

SEQ ID NO: 3420703 - RNA, 20 nt, Pseudomonas aeruginosa PA01
cgcuuccgcgcggcgcccug

SEQ ID NO: 3420704 - RNA, 23 nt, Pseudomonas aeruginosa PA01
cgcuuccgcgcggcgcccugccg

SEQ ID NO: 3420705 - RNA, 17 nt, Pseudomonas aeruginosa PA01
cgcuuccggcagccagc

SEQ ID NO: 3420706 - RNA, 20 nt, Pseudomonas aeruginosa PA01
cgcuuccggcagccagccgc

SEQ ID NO: 3420707 - RNA, 23 nt, Pseudomonas aeruginosa PA01
cgcuuccggcagccagccgccga

SEQ ID NO: 3420708 - RNA, 16 nt, Pseudomonas aeruginosa PA01
cgcuuccggcccggcc

SEQ ID NO: 3420709 - RNA, 17 nt, Pseudomonas aeruginosa PA01
cgcuuccggcccggcca

SEQ ID NO: 3420710 - RNA, 17 nt, Pseudomonas aeruginosa PA01
cgcuuccggcuugguuc

SEQ ID NO: 3420711 - RNA, 13 nt, Pseudomonas aeruginosa PA01
cgcuuccucggca

SEQ ID NO: 3420712 - RNA, 22 nt, Pseudomonas aeruginosa PA01
cgcuuccucggcacucagccag

SEQ ID NO: 3420713 - RNA, 12 nt, Pseudomonas aeruginosa PA01
cgcuuccucggg

SEQ ID NO: 3420714 - RNA, 15 nt, Pseudomonas aeruginosa PA01
cgcuuccucgggcag

SEQ ID NO: 3420715 - RNA, 21 nt, Pseudomonas aeruginosa PA01
cgcuuccugggaauugcgcac

SEQ ID NO: 3420716 - RNA, 15 nt, Pseudomonas aeruginosa PA01
cgcuucgaagcucuc

SEQ ID NO: 3420717 - RNA, 17 nt, Pseudomonas aeruginosa PA01
cgcuucgaagcucucgc

SEQ ID NO: 3420718 - RNA, 19 nt, Pseudomonas aeruginosa PA01
cgcuucgaagcucucgccg

SEQ ID NO: 3420719 - RNA, 21 nt, Pseudomonas aeruginosa PA01
cgcuucgaagcucucgccgcg

SEQ ID NO: 3420720 - RNA, 13 nt, Pseudomonas aeruginosa PA01
cgcuucgagcacc

SEQ ID NO: 3420721 - RNA, 22 nt, Pseudomonas aeruginosa PA01
cgcuucgagcaccccgagcccg

SEQ ID NO: 3420722 - RNA, 13 nt, Pseudomonas aeruginosa PA01
cgcuucgcccgcc

SEQ ID NO: 3420723 - RNA, 14 nt, Pseudomonas aeruginosa PA01
cgcuucgcccgccg

SEQ ID NO: 3420724 - RNA, 16 nt, Pseudomonas aeruginosa PA01
cgcuucgcgaucggcg

SEQ ID NO: 3420725 - RNA, 18 nt, Pseudomonas aeruginosa PA01
cgcuucgcgaucggcguc

SEQ ID NO: 3420726 - RNA, 18 nt, Pseudomonas aeruginosa PA01
cgcuucgcgcagcucggc

SEQ ID NO: 3420727 - RNA, 15 nt, Pseudomonas aeruginosa PA01
cgcuucgcggaucaa

SEQ ID NO: 3420728 - RNA, 15 nt, Pseudomonas aeruginosa PA01
cgcuucggcccgcug

SEQ ID NO: 3420729 - RNA, 11 nt, Pseudomonas aeruginosa PA01
cgcuucggcgg

SEQ ID NO: 3420730 - RNA, 17 nt, Pseudomonas aeruginosa PA01
cgcuucggcggcuucgc

SEQ ID NO: 3420731 - RNA, 19 nt, Pseudomonas aeruginosa PA01
cgcuucggcuccagcacca

SEQ ID NO: 3420732 - RNA, 21 nt, Pseudomonas aeruginosa PA01
cgcuucggcuccagcaccagc

SEQ ID NO: 3420733 - RNA, 17 nt, Pseudomonas aeruginosa PA01
cgcuucguuggcgacga

SEQ ID NO: 3420734 - RNA, 16 nt, Pseudomonas aeruginosa PA01
cgcuucuccucggccg

SEQ ID NO: 3420735 - RNA, 13 nt, Pseudomonas aeruginosa PA01
cgcuucucgacgu

SEQ ID NO: 3420736 - RNA, 22 nt, Pseudomonas aeruginosa PA01
cgcuucucgacguaggcggcga

SEQ ID NO: 3420737 - RNA, 14 nt, Pseudomonas aeruginosa PA01
cgcuucucggcagc

SEQ ID NO: 3420738 - RNA, 17 nt, Pseudomonas aeruginosa PA01
cgcuucucggcagcgcu

SEQ ID NO: 3420739 - RNA, 15 nt, Pseudomonas aeruginosa PA01
cgcuucugcgagccg

SEQ ID NO: 3420740 - RNA, 17 nt, Pseudomonas aeruginosa PA01
cgcuucugcgagccgcg

SEQ ID NO: 3420741 - RNA, 21 nt, Pseudomonas aeruginosa PA01
cgcuucugcgccuccucggcg

SEQ ID NO: 3420742 - RNA, 16 nt, Pseudomonas aeruginosa PA01
cgcuucugcucggccu

SEQ ID NO: 3420743 - RNA, 17 nt, Pseudomonas aeruginosa PA01
cgcuucugcucggccug

SEQ ID NO: 3420744 - RNA, 12 nt, Pseudomonas aeruginosa PA01
cgcuucugcugg

SEQ ID NO: 3420745 - RNA, 19 nt, Pseudomonas aeruginosa PA01
cgcuucugcuggccgcgca

SEQ ID NO: 3420746 - RNA, 23 nt, Pseudomonas aeruginosa PA01
cgcuucugcuggccgcgcaggaa

SEQ ID NO: 3420747 - RNA, 16 nt, Pseudomonas aeruginosa PA01
cgcuucuuguuccucg

SEQ ID NO: 3420748 - RNA, 22 nt, Pseudomonas aeruginosa PA01
cgcuugacgaaaaagccggaag

SEQ ID NO: 3420749 - RNA, 17 nt, Pseudomonas aeruginosa PA01
cgcuugagaccuucgcg

SEQ ID NO: 3420750 - RNA, 13 nt, Pseudomonas aeruginosa PA01
cgcuugagcagcc

SEQ ID NO: 3420751 - RNA, 16 nt, Pseudomonas aeruginosa PA01
cgcuugagcagccagg

SEQ ID NO: 3420752 - RNA, 18 nt, Pseudomonas aeruginosa PA01
cgcuugagcagccaggcg

SEQ ID NO: 3420753 - RNA, 14 nt, Pseudomonas aeruginosa PA01
cgcuugagccauuc

SEQ ID NO: 3420754 - RNA, 20 nt, Pseudomonas aeruginosa PA01
cgcuugagccauucggcuuc

SEQ ID NO: 3420755 - RNA, 22 nt, Pseudomonas aeruginosa PA01
cgcuugagccauucggcuuccu

SEQ ID NO: 3420756 - RNA, 19 nt, Pseudomonas aeruginosa PA01
cgcuugagccccggcaggc

SEQ ID NO: 3420757 - RNA, 20 nt, Pseudomonas aeruginosa PA01
cgcuugagccccggcaggca

SEQ ID NO: 3420758 - RNA, 22 nt, Pseudomonas aeruginosa PA01
cgcuugagccccggcaggcagg

SEQ ID NO: 3420759 - RNA, 19 nt, Pseudomonas aeruginosa PA01
cgcuugaguugccagacga

SEQ ID NO: 3420760 - RNA, 16 nt, Pseudomonas aeruginosa PA01
cgcuugcccagguagu

SEQ ID NO: 3420761 - RNA, 23 nt, Pseudomonas aeruginosa PA01
cgcuugcccagguagucgcccag

SEQ ID NO: 3420762 - RNA, 13 nt, Pseudomonas aeruginosa PA01
cgcuugccgcgcc

SEQ ID NO: 3420763 - RNA, 16 nt, Pseudomonas aeruginosa PA01
cgcuugccgcgcccgg

SEQ ID NO: 3420764 - RNA, 18 nt, Pseudomonas aeruginosa PA01
cgcuugccgcgcccggcc

SEQ ID NO: 3420765 - RNA, 14 nt, Pseudomonas aeruginosa PA01
cgcuugccgcuguu

SEQ ID NO: 3420766 - RNA, 15 nt, Pseudomonas aeruginosa PA01
cgcuugccggccgcc

SEQ ID NO: 3420767 - RNA, 23 nt, Pseudomonas aeruginosa PA01
cgcuugccggccgccagcaggua

SEQ ID NO: 3420768 - RNA, 14 nt, Pseudomonas aeruginosa PA01
cgcuugccgucgac

SEQ ID NO: 3420769 - RNA, 17 nt, Pseudomonas aeruginosa PA01
cgcuugccgucgaccug

SEQ ID NO: 3420770 - RNA, 15 nt, Pseudomonas aeruginosa PA01
cgcuugccgucgcgg

SEQ ID NO: 3420771 - RNA, 21 nt, Pseudomonas aeruginosa PA01
cgcuugccgucgcggaagccg

SEQ ID NO: 3420772 - RNA, 18 nt, Pseudomonas aeruginosa PA01
cgcuugccuuccugggcg

SEQ ID NO: 3420773 - RNA, 12 nt, Pseudomonas aeruginosa PA01
cgcuugcgaucg

SEQ ID NO: 3420774 - RNA, 13 nt, Pseudomonas aeruginosa PA01
cgcuugcgguagu

SEQ ID NO: 3420775 - RNA, 20 nt, Pseudomonas aeruginosa PA01
cgcuugcggucauccgccgg

SEQ ID NO: 3420776 - RNA, 21 nt, Pseudomonas aeruginosa PA01
cgcuugcggucauccgccggc

SEQ ID NO: 3420777 - RNA, 22 nt, Pseudomonas aeruginosa PA01
cgcuugcggucauccgccggcg

SEQ ID NO: 3420778 - RNA, 18 nt, Pseudomonas aeruginosa PA01
cgcuugcgguuauccgcc

SEQ ID NO: 3420779 - RNA, 22 nt, Pseudomonas aeruginosa PA01
cgcuugcgguuauccgccgccg

SEQ ID NO: 3420780 - RNA, 21 nt, Pseudomonas aeruginosa PA01
cgcuugcgguuauccgccgug

SEQ ID NO: 3420781 - RNA, 21 nt, Pseudomonas aeruginosa PA01
cgcuugcucuccacuaccgcc

SEQ ID NO: 3420782 - RNA, 13 nt, Pseudomonas aeruginosa PA01
cgcuuggagcggg

SEQ ID NO: 3420783 - RNA, 15 nt, Pseudomonas aeruginosa PA01
cgcuuggagcgggcg

SEQ ID NO: 3420784 - RNA, 16 nt, Pseudomonas aeruginosa PA01
cgcuuggccaggucgu

SEQ ID NO: 3420785 - RNA, 20 nt, Pseudomonas aeruginosa PA01
cgcuuggccaggucgucgcg

SEQ ID NO: 3420786 - RNA, 21 nt, Pseudomonas aeruginosa PA01
cgcuuggccaggucgucgcgc

SEQ ID NO: 3420787 - RNA, 17 nt, Pseudomonas aeruginosa PA01
cgcuuggccauggcgcu

SEQ ID NO: 3420788 - RNA, 15 nt, Pseudomonas aeruginosa PA01
cgcuuggccuugccg

SEQ ID NO: 3420789 - RNA, 19 nt, Pseudomonas aeruginosa PA01
cgcuuggcgaaaucgagcu

SEQ ID NO: 3420790 - RNA, 16 nt, Pseudomonas aeruginosa PA01
cgcuuggcgaucacgg

SEQ ID NO: 3420791 - RNA, 20 nt, Pseudomonas aeruginosa PA01
cgcuuggcgaucacggcgcc

SEQ ID NO: 3420792 - RNA, 17 nt, Pseudomonas aeruginosa PA01
cgcuuguagcagccgca

SEQ ID NO: 3420793 - RNA, 22 nt, Pseudomonas aeruginosa PA01
cgcuuguagcagccgcaggaug

SEQ ID NO: 3420794 - RNA, 16 nt, Pseudomonas aeruginosa PA01
cgcuuguagcccaggg

SEQ ID NO: 3420795 - RNA, 19 nt, Pseudomonas aeruginosa PA01
cgcuuguagcccaggggca

SEQ ID NO: 3420796 - RNA, 21 nt, Pseudomonas aeruginosa PA01
cgcuuguccgagaccggcagc

SEQ ID NO: 3420797 - RNA, 21 nt, Pseudomonas aeruginosa PA01
cgcuuguugaucaccaccggc

SEQ ID NO: 3420798 - RNA, 23 nt, Pseudomonas aeruginosa PA01
cgcuuucaccagggucgccaggg

SEQ ID NO: 3420799 - RNA, 18 nt, Pseudomonas aeruginosa PA01
cgcuuucagcgccgcucg

SEQ ID NO: 3420800 - RNA, 17 nt, Pseudomonas aeruginosa PA01
cgcuuuccccggcggca

SEQ ID NO: 3420801 - RNA, 15 nt, Pseudomonas aeruginosa PA01
cgcuuucccgcuucg

SEQ ID NO: 3420802 - RNA, 14 nt, Pseudomonas aeruginosa PA01
cgcuuuccggcgcg

SEQ ID NO: 3420803 - RNA, 15 nt, Pseudomonas aeruginosa PA01
cgcuuuccggcgcgg

SEQ ID NO: 3420804 - RNA, 23 nt, Pseudomonas aeruginosa PA01
cgcuuuccggcuugaccgccgcc

SEQ ID NO: 3420805 - RNA, 16 nt, Pseudomonas aeruginosa PA01
cgcuuuccuggccgac

SEQ ID NO: 3420806 - RNA, 17 nt, Pseudomonas aeruginosa PA01
cgcuuuccuggccgacc

SEQ ID NO: 3420807 - RNA, 12 nt, Pseudomonas aeruginosa PA01
cgcuuucgagaa

SEQ ID NO: 3420808 - RNA, 20 nt, Pseudomonas aeruginosa PA01
cgcuuugcagggucacgcgu

SEQ ID NO: 3420809 - RNA, 17 nt, Pseudomonas aeruginosa PA01
cgcuuuuccggcgccgg

SEQ ID NO: 3420810 - RNA, 15 nt, Pseudomonas aeruginosa PA01
cgcuuuuccucgacc

SEQ ID NO: 3420811 - RNA, 17 nt, Pseudomonas aeruginosa PA01
cgcuuuuccucgaccca

SEQ ID NO: 3420812 - RNA, 21 nt, Pseudomonas aeruginosa PA01
cgcuuuuuucuugccgccaga

SEQ ID NO: 3420813 - RNA, 17 nt, Pseudomonas aeruginosa PA01
cggaaaaaggcgccuuc

SEQ ID NO: 3420814 - RNA, 22 nt, Pseudomonas aeruginosa PA01
cggaaaacgccgcgaagcccag

SEQ ID NO: 3420815 - RNA, 18 nt, Pseudomonas aeruginosa PA01
cggaaaagaagccgcgca

SEQ ID NO: 3420816 - RNA, 19 nt, Pseudomonas aeruginosa PA01
cggaaaagaagccgcgcaa

SEQ ID NO: 3420817 - RNA, 21 nt, Pseudomonas aeruginosa PA01
cggaaaaucaaaaccagccuu

SEQ ID NO: 3420818 - RNA, 16 nt, Pseudomonas aeruginosa PA01
cggaaacacagcacga

SEQ ID NO: 3420819 - RNA, 19 nt, Pseudomonas aeruginosa PA01
cggaaaccgcauugacccg

SEQ ID NO: 3420820 - RNA, 15 nt, Pseudomonas aeruginosa PA01
cggaaaccgcggccg

SEQ ID NO: 3420821 - RNA, 20 nt, Pseudomonas aeruginosa PA01
cggaaaccugcaacucggcg

SEQ ID NO: 3420822 - RNA, 15 nt, Pseudomonas aeruginosa PA01
cggaaacgcgcgcuc

SEQ ID NO: 3420823 - RNA, 16 nt, Pseudomonas aeruginosa PA01
cggaaacgcgcgcucu

SEQ ID NO: 3420824 - RNA, 14 nt, Pseudomonas aeruginosa PA01
cggaaagcagggcg

SEQ ID NO: 3420825 - RNA, 20 nt, Pseudomonas aeruginosa PA01
cggaaagcagggcgauggcc

SEQ ID NO: 3420826 - RNA, 18 nt, Pseudomonas aeruginosa PA01
cggaaagccuggccggcg

SEQ ID NO: 3420827 - RNA, 21 nt, Pseudomonas aeruginosa PA01
cggaaagccuggccggcgaac

SEQ ID NO: 3420828 - RNA, 16 nt, Pseudomonas aeruginosa PA01
cggaacaagccgccuu

SEQ ID NO: 3420829 - RNA, 20 nt, Pseudomonas aeruginosa PA01
cggaacaagccgccuucggg

SEQ ID NO: 3420830 - RNA, 13 nt, Pseudomonas aeruginosa PA01
cggaacaccgccu

SEQ ID NO: 3420831 - RNA, 16 nt, Pseudomonas aeruginosa PA01
cggaacaggagccauc

SEQ ID NO: 3420832 - RNA, 20 nt, Pseudomonas aeruginosa PA01
cggaacaggagccaucgcuc

SEQ ID NO: 3420833 - RNA, 13 nt, Pseudomonas aeruginosa PA01
cggaacauggugu

SEQ ID NO: 3420834 - RNA, 19 nt, Pseudomonas aeruginosa PA01
cggaaccagugcgcggucc

SEQ ID NO: 3420835 - RNA, 21 nt, Pseudomonas aeruginosa PA01
cggaacccgcgcaguuccuuc

SEQ ID NO: 3420836 - RNA, 21 nt, Pseudomonas aeruginosa PA01
cggaaccucuccccucgcccu

SEQ ID NO: 3420837 - RNA, 23 nt, Pseudomonas aeruginosa PA01
cggaacgaaagaaggggagccga

SEQ ID NO: 3420838 - RNA, 22 nt, Pseudomonas aeruginosa PA01
cggaacgaaggacaggucgcgg

SEQ ID NO: 3420839 - RNA, 17 nt, Pseudomonas aeruginosa PA01
cggaacgggacgccugg

SEQ ID NO: 3420840 - RNA, 15 nt, Pseudomonas aeruginosa PA01
cggaacgucggccug

SEQ ID NO: 3420841 - RNA, 18 nt, Pseudomonas aeruginosa PA01
cggaacgucggccugggu

SEQ ID NO: 3420842 - RNA, 19 nt, Pseudomonas aeruginosa PA01
cggaacgucggccugggug

SEQ ID NO: 3420843 - RNA, 20 nt, Pseudomonas aeruginosa PA01
cggaacgucggccuggguga

SEQ ID NO: 3420844 - RNA, 15 nt, Pseudomonas aeruginosa PA01
cggaacuccggggug

SEQ ID NO: 3420845 - RNA, 17 nt, Pseudomonas aeruginosa PA01
cggaacuugcgccgacc

SEQ ID NO: 3420846 - RNA, 16 nt, Pseudomonas aeruginosa PA01
cggaacuugucgccgc

SEQ ID NO: 3420847 - RNA, 19 nt, Pseudomonas aeruginosa PA01
cggaagaaaagaaggcgga

SEQ ID NO: 3420848 - RNA, 18 nt, Pseudomonas aeruginosa PA01
cggaagaauaccgccagc

SEQ ID NO: 3420849 - RNA, 20 nt, Pseudomonas aeruginosa PA01
cggaagacgaucucccgcga

SEQ ID NO: 3420850 - RNA, 16 nt, Pseudomonas aeruginosa PA01
cggaagagguacggcc

SEQ ID NO: 3420851 - RNA, 18 nt, Pseudomonas aeruginosa PA01
cggaagagguacggccuu

SEQ ID NO: 3420852 - RNA, 13 nt, Pseudomonas aeruginosa PA01
cggaagaugguuu

SEQ ID NO: 3420853 - RNA, 17 nt, Pseudomonas aeruginosa PA01
cggaagcauggccggcu

SEQ ID NO: 3420854 - RNA, 17 nt, Pseudomonas aeruginosa PA01
cggaagcccugcuggcg

SEQ ID NO: 3420855 - RNA, 12 nt, Pseudomonas aeruginosa PA01
cggaagccggga

SEQ ID NO: 3420856 - RNA, 13 nt, Pseudomonas aeruginosa PA01
cggaagccgucgg

SEQ ID NO: 3420857 - RNA, 14 nt, Pseudomonas aeruginosa PA01
cggaagccgucggc

SEQ ID NO: 3420858 - RNA, 15 nt, Pseudomonas aeruginosa PA01
cggaagccgucggcg

SEQ ID NO: 3420859 - RNA, 22 nt, Pseudomonas aeruginosa PA01
cggaagccgucggcgaucgcca

SEQ ID NO: 3420860 - RNA, 14 nt, Pseudomonas aeruginosa PA01
cggaagcgccugcg

SEQ ID NO: 3420861 - RNA, 15 nt, Pseudomonas aeruginosa PA01
cggaagcgccugcgg

SEQ ID NO: 3420862 - RNA, 11 nt, Pseudomonas aeruginosa PA01
cggaagcgcuc

SEQ ID NO: 3420863 - RNA, 18 nt, Pseudomonas aeruginosa PA01
cggaagcgcugcucgacc

SEQ ID NO: 3420864 - RNA, 13 nt, Pseudomonas aeruginosa PA01
cggaagcggccga

SEQ ID NO: 3420865 - RNA, 16 nt, Pseudomonas aeruginosa PA01
cggaagcggccgagca

SEQ ID NO: 3420866 - RNA, 16 nt, Pseudomonas aeruginosa PA01
cggaagcgucagccgc

SEQ ID NO: 3420867 - RNA, 21 nt, Pseudomonas aeruginosa PA01
cggaagcgucagccgcggccg

SEQ ID NO: 3420868 - RNA, 23 nt, Pseudomonas aeruginosa PA01
cggaagcgucagccgcggccggg

SEQ ID NO: 3420869 - RNA, 18 nt, Pseudomonas aeruginosa PA01
cggaagcguugcucgagc

SEQ ID NO: 3420870 - RNA, 21 nt, Pseudomonas aeruginosa PA01
cggaagcuucaggcucggccu

SEQ ID NO: 3420871 - RNA, 23 nt, Pseudomonas aeruginosa PA01
cggaagcuucaggcucggccugu

SEQ ID NO: 3420872 - RNA, 16 nt, Pseudomonas aeruginosa PA01
cggaaggccacgccgc

SEQ ID NO: 3420873 - RNA, 17 nt, Pseudomonas aeruginosa PA01
cggaaggccacgccgcc

SEQ ID NO: 3420874 - RNA, 16 nt, Pseudomonas aeruginosa PA01
cggaaggcccgcgagc

SEQ ID NO: 3420875 - RNA, 18 nt, Pseudomonas aeruginosa PA01
cggaaggcccgcgagccg

SEQ ID NO: 3420876 - RNA, 15 nt, Pseudomonas aeruginosa PA01
cggaaggccucggug

SEQ ID NO: 3420877 - RNA, 14 nt, Pseudomonas aeruginosa PA01
cggaaggcggcgaa

SEQ ID NO: 3420878 - RNA, 16 nt, Pseudomonas aeruginosa PA01
cggaaggcggcgaagu

SEQ ID NO: 3420879 - RNA, 15 nt, Pseudomonas aeruginosa PA01
cggaaggcuuccugg

SEQ ID NO: 3420880 - RNA, 13 nt, Pseudomonas aeruginosa PA01
cggaagggccgag

SEQ ID NO: 3420881 - RNA, 16 nt, Pseudomonas aeruginosa PA01
cggaagucgaagcagc

SEQ ID NO: 3420882 - RNA, 13 nt, Pseudomonas aeruginosa PA01
cggaagucggcgg

SEQ ID NO: 3420883 - RNA, 15 nt, Pseudomonas aeruginosa PA01
cggaagugcgccggu

SEQ ID NO: 3420884 - RNA, 16 nt, Pseudomonas aeruginosa PA01
cggaagugcgggguga

SEQ ID NO: 3420885 - RNA, 15 nt, Pseudomonas aeruginosa PA01
cggaaguucaccucg

SEQ ID NO: 3420886 - RNA, 19 nt, Pseudomonas aeruginosa PA01
cggaaguucaccucgguga

SEQ ID NO: 3420887 - RNA, 16 nt, Pseudomonas aeruginosa PA01
cggaaucacgucgauc

SEQ ID NO: 3420888 - RNA, 14 nt, Pseudomonas aeruginosa PA01
cggaauccuucgcg

SEQ ID NO: 3420889 - RNA, 23 nt, Pseudomonas aeruginosa PA01
cggaaucgacggauacgccaggu

SEQ ID NO: 3420890 - RNA, 14 nt, Pseudomonas aeruginosa PA01
cggaaucgcgcccu

SEQ ID NO: 3420891 - RNA, 20 nt, Pseudomonas aeruginosa PA01
cggaaucgcguagcgccccu

SEQ ID NO: 3420892 - RNA, 18 nt, Pseudomonas aeruginosa PA01
cggaaucggacgaucgac

SEQ ID NO: 3420893 - RNA, 13 nt, Pseudomonas aeruginosa PA01
cggaaucggcgau

SEQ ID NO: 3420894 - RNA, 13 nt, Pseudomonas aeruginosa PA01
cggaaugacgagc

SEQ ID NO: 3420895 - RNA, 16 nt, Pseudomonas aeruginosa PA01
cggaaugacgagccgc

SEQ ID NO: 3420896 - RNA, 21 nt, Pseudomonas aeruginosa PA01
cggaaugcuuccguaggugga

SEQ ID NO: 3420897 - RNA, 15 nt, Pseudomonas aeruginosa PA01
cggaauuccugcucg

SEQ ID NO: 3420898 - RNA, 17 nt, Pseudomonas aeruginosa PA01
cggacaacaggccgggc

SEQ ID NO: 3420899 - RNA, 19 nt, Pseudomonas aeruginosa PA01
cggacaacaggccgggcgg

SEQ ID NO: 3420900 - RNA, 16 nt, Pseudomonas aeruginosa PA01
cggacaacccggcgcu

SEQ ID NO: 3420901 - RNA, 16 nt, Pseudomonas aeruginosa PA01
cggacaaccgccguag

SEQ ID NO: 3420902 - RNA, 18 nt, Pseudomonas aeruginosa PA01
cggacaagggccagagca

SEQ ID NO: 3420903 - RNA, 14 nt, Pseudomonas aeruginosa PA01
cggacacgcaggcg

SEQ ID NO: 3420904 - RNA, 15 nt, Pseudomonas aeruginosa PA01
cggacacgcaggcgc

SEQ ID NO: 3420905 - RNA, 20 nt, Pseudomonas aeruginosa PA01
cggacagcccgcgcucggcc

SEQ ID NO: 3420906 - RNA, 21 nt, Pseudomonas aeruginosa PA01
cggacagcccgcgcucggccg

SEQ ID NO: 3420907 - RNA, 14 nt, Pseudomonas aeruginosa PA01
cggacaggcagccg

SEQ ID NO: 3420908 - RNA, 14 nt, Pseudomonas aeruginosa PA01
cggacaggccaccc

SEQ ID NO: 3420909 - RNA, 16 nt, Pseudomonas aeruginosa PA01
cggacaggccacccgc

SEQ ID NO: 3420910 - RNA, 15 nt, Pseudomonas aeruginosa PA01
cggacagguuggcgc

SEQ ID NO: 3420911 - RNA, 18 nt, Pseudomonas aeruginosa PA01
cggacagguuggcgccgg

SEQ ID NO: 3420912 - RNA, 21 nt, Pseudomonas aeruginosa PA01
cggacagguuggcgccgggcg

SEQ ID NO: 3420913 - RNA, 23 nt, Pseudomonas aeruginosa PA01
cggacaugaaaaagccggaggca

SEQ ID NO: 3420914 - RNA, 12 nt, Pseudomonas aeruginosa PA01
cggacauggcgc

SEQ ID NO: 3420915 - RNA, 17 nt, Pseudomonas aeruginosa PA01
cggaccagaucggcgcg

SEQ ID NO: 3420916 - RNA, 19 nt, Pseudomonas aeruginosa PA01
cggaccagaucggcgcgca

SEQ ID NO: 3420917 - RNA, 20 nt, Pseudomonas aeruginosa PA01
cggaccagaucggcgcgcag

SEQ ID NO: 3420918 - RNA, 12 nt, Pseudomonas aeruginosa PA01
cggaccagccgg

SEQ ID NO: 3420919 - RNA, 13 nt, Pseudomonas aeruginosa PA01
cggaccagccggu

SEQ ID NO: 3420920 - RNA, 20 nt, Pseudomonas aeruginosa PA01
cggaccagccggucccgggc

SEQ ID NO: 3420921 - RNA, 16 nt, Pseudomonas aeruginosa PA01
cggaccagccguccgc

SEQ ID NO: 3420922 - RNA, 16 nt, Pseudomonas aeruginosa PA01
cggaccagcuccgaag

SEQ ID NO: 3420923 - RNA, 18 nt, Pseudomonas aeruginosa PA01
cggaccagcuccgaaggg

SEQ ID NO: 3420924 - RNA, 17 nt, Pseudomonas aeruginosa PA01
cggaccagggcgccggg

SEQ ID NO: 3420925 - RNA, 22 nt, Pseudomonas aeruginosa PA01
cggacccaguugggccaggagg

SEQ ID NO: 3420926 - RNA, 18 nt, Pseudomonas aeruginosa PA01
cggaccccauguaccucu

SEQ ID NO: 3420927 - RNA, 21 nt, Pseudomonas aeruginosa PA01
cggaccccauguaccucuggc

SEQ ID NO: 3420928 - RNA, 15 nt, Pseudomonas aeruginosa PA01
cggacccgcgccggc

SEQ ID NO: 3420929 - RNA, 16 nt, Pseudomonas aeruginosa PA01
cggacccgcgccggca

SEQ ID NO: 3420930 - RNA, 17 nt, Pseudomonas aeruginosa PA01
cggacccgcucggccuu

SEQ ID NO: 3420931 - RNA, 21 nt, Pseudomonas aeruginosa PA01
cggaccgacguugagaaggcg

SEQ ID NO: 3420932 - RNA, 23 nt, Pseudomonas aeruginosa PA01
cggaccgaucucguucggguagu

SEQ ID NO: 3420933 - RNA, 13 nt, Pseudomonas aeruginosa PA01
cggaccgcaaccg

SEQ ID NO: 3420934 - RNA, 13 nt, Pseudomonas aeruginosa PA01
cggaccgcagaac

SEQ ID NO: 3420935 - RNA, 20 nt, Pseudomonas aeruginosa PA01
cggaccgcagaaccagacgc

SEQ ID NO: 3420936 - RNA, 21 nt, Pseudomonas aeruginosa PA01
cggaccggcucucuucggccg

SEQ ID NO: 3420937 - RNA, 20 nt, Pseudomonas aeruginosa PA01
cggaccgggcggcaggcgcc

SEQ ID NO: 3420938 - RNA, 21 nt, Pseudomonas aeruginosa PA01
cggaccguggugacgguccgc

SEQ ID NO: 3420939 - RNA, 13 nt, Pseudomonas aeruginosa PA01
cggaccuccagcc

SEQ ID NO: 3420940 - RNA, 15 nt, Pseudomonas aeruginosa PA01
cggaccuccagccgg

SEQ ID NO: 3420941 - RNA, 16 nt, Pseudomonas aeruginosa PA01
cggaccuccagccggc

SEQ ID NO: 3420942 - RNA, 14 nt, Pseudomonas aeruginosa PA01
cggaccuccgccag

SEQ ID NO: 3420943 - RNA, 15 nt, Pseudomonas aeruginosa PA01
cggaccuccgccagg

SEQ ID NO: 3420944 - RNA, 14 nt, Pseudomonas aeruginosa PA01
cggaccucucucgc

SEQ ID NO: 3420945 - RNA, 19 nt, Pseudomonas aeruginosa PA01
cggaccucucucgcugcgc

SEQ ID NO: 3420946 - RNA, 20 nt, Pseudomonas aeruginosa PA01
cggaccucucucgcugcgcg

SEQ ID NO: 3420947 - RNA, 21 nt, Pseudomonas aeruginosa PA01
cggaccucugcguucugcugc

SEQ ID NO: 3420948 - RNA, 19 nt, Pseudomonas aeruginosa PA01
cggaccugagaucagcgcc

SEQ ID NO: 3420949 - RNA, 23 nt, Pseudomonas aeruginosa PA01
cggaccugagaucagcgcccggc

SEQ ID NO: 3420950 - RNA, 14 nt, Pseudomonas aeruginosa PA01
cggaccuucgacgg

SEQ ID NO: 3420951 - RNA, 21 nt, Pseudomonas aeruginosa PA01
cggaccuucgacggcaggugg

SEQ ID NO: 3420952 - RNA, 13 nt, Pseudomonas aeruginosa PA01
cggaccuugucca

SEQ ID NO: 3420953 - RNA, 16 nt, Pseudomonas aeruginosa PA01
cggaccuuguccaggg

SEQ ID NO: 3420954 - RNA, 18 nt, Pseudomonas aeruginosa PA01
cggaccuugucgccggug

SEQ ID NO: 3420955 - RNA, 20 nt, Pseudomonas aeruginosa PA01
cggacgacaucucguccucg

SEQ ID NO: 3420956 - RNA, 15 nt, Pseudomonas aeruginosa PA01
cggacgagcuuuccu

SEQ ID NO: 3420957 - RNA, 14 nt, Pseudomonas aeruginosa PA01
cggacgaucgacga

SEQ ID NO: 3420958 - RNA, 17 nt, Pseudomonas aeruginosa PA01
cggacgauggucgccgc

SEQ ID NO: 3420959 - RNA, 18 nt, Pseudomonas aeruginosa PA01
cggacgauggucgccgcg

SEQ ID NO: 3420960 - RNA, 21 nt, Pseudomonas aeruginosa PA01
cggacgauggucgccgcgacc

SEQ ID NO: 3420961 - RNA, 22 nt, Pseudomonas aeruginosa PA01
cggacgauggucgccgcgaccu

SEQ ID NO: 3420962 - RNA, 14 nt, Pseudomonas aeruginosa PA01
cggacgcaccagca

SEQ ID NO: 3420963 - RNA, 15 nt, Pseudomonas aeruginosa PA01
cggacgcaccagcag

SEQ ID NO: 3420964 - RNA, 19 nt, Pseudomonas aeruginosa PA01
cggacgcaccagcaggccg

SEQ ID NO: 3420965 - RNA, 23 nt, Pseudomonas aeruginosa PA01
cggacgcaccagcaggccgauca

SEQ ID NO: 3420966 - RNA, 18 nt, Pseudomonas aeruginosa PA01
cggacgcagcgggucgau

SEQ ID NO: 3420967 - RNA, 14 nt, Pseudomonas aeruginosa PA01
cggacgccgaacgc

SEQ ID NO: 3420968 - RNA, 12 nt, Pseudomonas aeruginosa PA01
cggacgccgaag

SEQ ID NO: 3420969 - RNA, 19 nt, Pseudomonas aeruginosa PA01
cggacgccguagcggccuc

SEQ ID NO: 3420970 - RNA, 16 nt, Pseudomonas aeruginosa PA01
cggacgcgacugcugc

SEQ ID NO: 3420971 - RNA, 16 nt, Pseudomonas aeruginosa PA01
cggacgcgaucccgcu

SEQ ID NO: 3420972 - RNA, 12 nt, Pseudomonas aeruginosa PA01
cggacgcgcagg

SEQ ID NO: 3420973 - RNA, 23 nt, Pseudomonas aeruginosa PA01
cggacgcggcuggcgcaggaccg

SEQ ID NO: 3420974 - RNA, 22 nt, Pseudomonas aeruginosa PA01
cggacgcugcaugcggaacacc

SEQ ID NO: 3420975 - RNA, 17 nt, Pseudomonas aeruginosa PA01
cggacgcugggcugggu

SEQ ID NO: 3420976 - RNA, 14 nt, Pseudomonas aeruginosa PA01
cggacgcuuguccu

SEQ ID NO: 3420977 - RNA, 23 nt, Pseudomonas aeruginosa PA01
cggacgcuuguccuucggccagu

SEQ ID NO: 3420978 - RNA, 13 nt, Pseudomonas aeruginosa PA01
cggacggcacggg

SEQ ID NO: 3420979 - RNA, 17 nt, Pseudomonas aeruginosa PA01
cggacggccgcgccggc

SEQ ID NO: 3420980 - RNA, 17 nt, Pseudomonas aeruginosa PA01
cggacggcucgcgcagc

SEQ ID NO: 3420981 - RNA, 22 nt, Pseudomonas aeruginosa PA01
cggacggcucgcgcagcggcgc

SEQ ID NO: 3420982 - RNA, 15 nt, Pseudomonas aeruginosa PA01
cggacggcugaggcu

SEQ ID NO: 3420983 - RNA, 19 nt, Pseudomonas aeruginosa PA01
cggacggcugaggcuggcg

SEQ ID NO: 3420984 - RNA, 14 nt, Pseudomonas aeruginosa PA01
cggacgggccgcgc

SEQ ID NO: 3420985 - RNA, 16 nt, Pseudomonas aeruginosa PA01
cggacgggugcgcgcc

SEQ ID NO: 3420986 - RNA, 23 nt, Pseudomonas aeruginosa PA01
cggacgggugcgcgccaccuggu

SEQ ID NO: 3420987 - RNA, 21 nt, Pseudomonas aeruginosa PA01
cggacguaggacgaacaaccg

SEQ ID NO: 3420988 - RNA, 17 nt, Pseudomonas aeruginosa PA01
cggacguuccaccuggc

SEQ ID NO: 3420989 - RNA, 22 nt, Pseudomonas aeruginosa PA01
cggacguuccaccuggcgcagg

SEQ ID NO: 3420990 - RNA, 18 nt, Pseudomonas aeruginosa PA01
cggacuaccuucgaucac

SEQ ID NO: 3420991 - RNA, 17 nt, Pseudomonas aeruginosa PA01
cggacuccggaggcgca

SEQ ID NO: 3420992 - RNA, 16 nt, Pseudomonas aeruginosa PA01
cggacugcccagcgcc

SEQ ID NO: 3420993 - RNA, 20 nt, Pseudomonas aeruginosa PA01
cggacugcccagcgccgcca

SEQ ID NO: 3420994 - RNA, 23 nt, Pseudomonas aeruginosa PA01
cggacugcccgacgaagacgcuc

SEQ ID NO: 3420995 - RNA, 14 nt, Pseudomonas aeruginosa PA01
cggacugcucgccg

SEQ ID NO: 3420996 - RNA, 17 nt, Pseudomonas aeruginosa PA01
cggacugcucgccgccg

SEQ ID NO: 3420997 - RNA, 19 nt, Pseudomonas aeruginosa PA01
cggacugcucgccgccggc

SEQ ID NO: 3420998 - RNA, 20 nt, Pseudomonas aeruginosa PA01
cggacugcucgccgccggcg

SEQ ID NO: 3420999 - RNA, 21 nt, Pseudomonas aeruginosa PA01
cggacugcucgccgccggcga

SEQ ID NO: 3421000 - RNA, 21 nt, Pseudomonas aeruginosa PA01
cggacuggauucggccugccg

SEQ ID NO: 3421001 - RNA, 17 nt, Pseudomonas aeruginosa PA01
cggacugguaggacagg

SEQ ID NO: 3421002 - RNA, 20 nt, Pseudomonas aeruginosa PA01
cggacugguaggacagggcc

SEQ ID NO: 3421003 - RNA, 18 nt, Pseudomonas aeruginosa PA01
cggacuugaugaccgucc

SEQ ID NO: 3421004 - RNA, 13 nt, Pseudomonas aeruginosa PA01
cggacuugcggcc

SEQ ID NO: 3421005 - RNA, 19 nt, Pseudomonas aeruginosa PA01
cggacuugcggcccaccac

SEQ ID NO: 3421006 - RNA, 20 nt, Pseudomonas aeruginosa PA01
cggagaaacuuucuucgcca

SEQ ID NO: 3421007 - RNA, 15 nt, Pseudomonas aeruginosa PA01
cggagaacagcagcg

SEQ ID NO: 3421008 - RNA, 18 nt, Pseudomonas aeruginosa PA01
cggagaacagcagcggca

SEQ ID NO: 3421009 - RNA, 21 nt, Pseudomonas aeruginosa PA01
cggagaacagcagcggcacca

SEQ ID NO: 3421010 - RNA, 16 nt, Pseudomonas aeruginosa PA01
cggagaacagcgagac

SEQ ID NO: 3421011 - RNA, 17 nt, Pseudomonas aeruginosa PA01
cggagaacagcgagacc

SEQ ID NO: 3421012 - RNA, 20 nt, Pseudomonas aeruginosa PA01
cggagaacaguugcagggug

SEQ ID NO: 3421013 - RNA, 15 nt, Pseudomonas aeruginosa PA01
cggagaaccggcgga

SEQ ID NO: 3421014 - RNA, 23 nt, Pseudomonas aeruginosa PA01
cggagaagcguccgagguggcug

SEQ ID NO: 3421015 - RNA, 20 nt, Pseudomonas aeruginosa PA01
cggagaaggagaacgacaug

SEQ ID NO: 3421016 - RNA, 20 nt, Pseudomonas aeruginosa PA01
cggagaagggcgcgccccgu

SEQ ID NO: 3421017 - RNA, 13 nt, Pseudomonas aeruginosa PA01
cggagaauccgcu

SEQ ID NO: 3421018 - RNA, 21 nt, Pseudomonas aeruginosa PA01
cggagacaggaaucgacccag

SEQ ID NO: 3421019 - RNA, 13 nt, Pseudomonas aeruginosa PA01
cggagaccacggu

SEQ ID NO: 3421020 - RNA, 21 nt, Pseudomonas aeruginosa PA01
cggagaccacggugaucaggc

SEQ ID NO: 3421021 - RNA, 13 nt, Pseudomonas aeruginosa PA01
cggagaccgugcc

SEQ ID NO: 3421022 - RNA, 16 nt, Pseudomonas aeruginosa PA01
cggagaccgugccgcc

SEQ ID NO: 3421023 - RNA, 14 nt, Pseudomonas aeruginosa PA01
cggagacgauggcg

SEQ ID NO: 3421024 - RNA, 18 nt, Pseudomonas aeruginosa PA01
cggagagacccgccagcg

SEQ ID NO: 3421025 - RNA, 20 nt, Pseudomonas aeruginosa PA01
cggagagacccgccagcggc

SEQ ID NO: 3421026 - RNA, 22 nt, Pseudomonas aeruginosa PA01
cggagagacccgccagcggcau

SEQ ID NO: 3421027 - RNA, 18 nt, Pseudomonas aeruginosa PA01
cggagagauagucgccgu

SEQ ID NO: 3421028 - RNA, 20 nt, Pseudomonas aeruginosa PA01
cggagagauucggguagucu

SEQ ID NO: 3421029 - RNA, 15 nt, Pseudomonas aeruginosa PA01
cggagagcagcacgg

SEQ ID NO: 3421030 - RNA, 16 nt, Pseudomonas aeruginosa PA01
cggagagcagcacggc

SEQ ID NO: 3421031 - RNA, 14 nt, Pseudomonas aeruginosa PA01
cggagagcagccaa

SEQ ID NO: 3421032 - RNA, 21 nt, Pseudomonas aeruginosa PA01
cggagagcgaauacaccgagc

SEQ ID NO: 3421033 - RNA, 22 nt, Pseudomonas aeruginosa PA01
cggagagggagcgccuggcguc

SEQ ID NO: 3421034 - RNA, 13 nt, Pseudomonas aeruginosa PA01
cggagauagccuc

SEQ ID NO: 3421035 - RNA, 14 nt, Pseudomonas aeruginosa PA01
cggagauccccucc

SEQ ID NO: 3421036 - RNA, 21 nt, Pseudomonas aeruginosa PA01
cggagauccccuccuccagca

SEQ ID NO: 3421037 - RNA, 22 nt, Pseudomonas aeruginosa PA01
cggagauccccuccuccagcag

SEQ ID NO: 3421038 - RNA, 16 nt, Pseudomonas aeruginosa PA01
cggagaucgccgcgcc

SEQ ID NO: 3421039 - RNA, 22 nt, Pseudomonas aeruginosa PA01
cggagaucggcugcaacgccgg

SEQ ID NO: 3421040 - RNA, 22 nt, Pseudomonas aeruginosa PA01
cggagaugugcgcggugacgac

SEQ ID NO: 3421041 - RNA, 16 nt, Pseudomonas aeruginosa PA01
cggagauugcggcgaa

SEQ ID NO: 3421042 - RNA, 16 nt, Pseudomonas aeruginosa PA01
cggagcaccgcgccuu

SEQ ID NO: 3421043 - RNA, 17 nt, Pseudomonas aeruginosa PA01
cggagcaccgcgccuuc

SEQ ID NO: 3421044 - RNA, 21 nt, Pseudomonas aeruginosa PA01
cggagcaccgcgccuuccagc

SEQ ID NO: 3421045 - RNA, 22 nt, Pseudomonas aeruginosa PA01
cggagcaccgcgccuuccagcc

SEQ ID NO: 3421046 - RNA, 13 nt, Pseudomonas aeruginosa PA01
cggagcaggccau

SEQ ID NO: 3421047 - RNA, 21 nt, Pseudomonas aeruginosa PA01
cggagcaggccaugggugucg

SEQ ID NO: 3421048 - RNA, 15 nt, Pseudomonas aeruginosa PA01
cgcgacugccgucgg

SEQ ID NO: 3421049 - RNA, 21 nt, Pseudomonas aeruginosa PA01
cgcgacugccgucggcgcccu

SEQ ID NO: 3421050 - RNA, 13 nt, Pseudomonas aeruginosa PA01
cgcgacugcugcu

SEQ ID NO: 3421051 - RNA, 14 nt, Pseudomonas aeruginosa PA01
cgcgacugcugcug

SEQ ID NO: 3421052 - RNA, 21 nt, Pseudomonas aeruginosa PA01
cgcgacugucgagcagggucg

SEQ ID NO: 3421053 - RNA, 16 nt, Pseudomonas aeruginosa PA01
cgcgagaagccgccca

SEQ ID NO: 3421054 - RNA, 16 nt, Pseudomonas aeruginosa PA01
cgcgagaccccggcgg

SEQ ID NO: 3421055 - RNA, 16 nt, Pseudomonas aeruginosa PA01
cgcgagaugaagcgcc

SEQ ID NO: 3421056 - RNA, 18 nt, Pseudomonas aeruginosa PA01
cgcgagaugaagcgccgc

SEQ ID NO: 3421057 - RNA, 16 nt, Pseudomonas aeruginosa PA01
cgcgagauggcgucga

SEQ ID NO: 3421058 - RNA, 21 nt, Pseudomonas aeruginosa PA01
cgcgagcaccaugcagcggca

SEQ ID NO: 3421059 - RNA, 15 nt, Pseudomonas aeruginosa PA01
cgcgagcaccgcgca

SEQ ID NO: 3421060 - RNA, 16 nt, Pseudomonas aeruginosa PA01
cgcgagcaccgcgcag

SEQ ID NO: 3421061 - RNA, 19 nt, Pseudomonas aeruginosa PA01
cgcgagcaccgcgcagacc

SEQ ID NO: 3421062 - RNA, 20 nt, Pseudomonas aeruginosa PA01
cgcgagcaccgcgcagacca

SEQ ID NO: 3421063 - RNA, 23 nt, Pseudomonas aeruginosa PA01
cgcgagcaccgcgcagaccauca

SEQ ID NO: 3421064 - RNA, 21 nt, Pseudomonas aeruginosa PA01
cgcgagcaugcucacugcgag

SEQ ID NO: 3421065 - RNA, 22 nt, Pseudomonas aeruginosa PA01
cgcgagcaugcucacugcgagc

SEQ ID NO: 3421066 - RNA, 24 nt, Pseudomonas aeruginosa PA01
cgcgagcaugcucacugcgagcac

SEQ ID NO: 3421067 - RNA, 14 nt, Pseudomonas aeruginosa PA01
cgcgagccagccgu

SEQ ID NO: 3421068 - RNA, 13 nt, Pseudomonas aeruginosa PA01
cgcgagccgcgca

SEQ ID NO: 3421069 - RNA, 15 nt, Pseudomonas aeruginosa PA01
cgcgagccgcgcagc

SEQ ID NO: 3421070 - RNA, 14 nt, Pseudomonas aeruginosa PA01
cgcgagccguccug

SEQ ID NO: 3421071 - RNA, 16 nt, Pseudomonas aeruginosa PA01
cgcgagccguccugcg

SEQ ID NO: 3421072 - RNA, 17 nt, Pseudomonas aeruginosa PA01
cgcgagccguccugcgg

SEQ ID NO: 3421073 - RNA, 19 nt, Pseudomonas aeruginosa PA01
cgcgagccguccugcggcc

SEQ ID NO: 3421074 - RNA, 20 nt, Pseudomonas aeruginosa PA01
cgcgagccguccugcggccg

SEQ ID NO: 3421075 - RNA, 22 nt, Pseudomonas aeruginosa PA01
cgcgagccguccugcggccgca

SEQ ID NO: 3421076 - RNA, 17 nt, Pseudomonas aeruginosa PA01
cgcgagccuucagcacg

SEQ ID NO: 3421077 - RNA, 23 nt, Pseudomonas aeruginosa PA01
cgcgagccuucagcacggcgcgg

SEQ ID NO: 3421078 - RNA, 13 nt, Pseudomonas aeruginosa PA01
cgcgagcgccgcc

SEQ ID NO: 3421079 - RNA, 15 nt, Pseudomonas aeruginosa PA01
cgcgagcgccgccgg

SEQ ID NO: 3421080 - RNA, 13 nt, Pseudomonas aeruginosa PA01
cgcgagcgcggcc

SEQ ID NO: 3421081 - RNA, 14 nt, Pseudomonas aeruginosa PA01
cgcgagcgcggccg

SEQ ID NO: 3421082 - RNA, 20 nt, Pseudomonas aeruginosa PA01
cgcgagcgcggccggccacg

SEQ ID NO: 3421083 - RNA, 12 nt, Pseudomonas aeruginosa PA01
cgcgagcggcag

SEQ ID NO: 3421084 - RNA, 18 nt, Pseudomonas aeruginosa PA01
cgcgagcggcagauccgc

SEQ ID NO: 3421085 - RNA, 20 nt, Pseudomonas aeruginosa PA01
cgcgagcgguuauucgcccu

SEQ ID NO: 3421086 - RNA, 14 nt, Pseudomonas aeruginosa PA01
cgcgagcuggcgcc

SEQ ID NO: 3421087 - RNA, 15 nt, Pseudomonas aeruginosa PA01
cgcgagcuggcgccg

SEQ ID NO: 3421088 - RNA, 22 nt, Pseudomonas aeruginosa PA01
cgcgagcuggcgccgucaucgc

SEQ ID NO: 3421089 - RNA, 15 nt, Pseudomonas aeruginosa PA01
cgcgagcuuggcccu

SEQ ID NO: 3421090 - RNA, 15 nt, Pseudomonas aeruginosa PA01
cgcgaggagaucggc

SEQ ID NO: 3421091 - RNA, 18 nt, Pseudomonas aeruginosa PA01
cgcgaggagaucggcguu

SEQ ID NO: 3421092 - RNA, 22 nt, Pseudomonas aeruginosa PA01
cgcgaggaucagccacgggcgc

SEQ ID NO: 3421093 - RNA, 20 nt, Pseudomonas aeruginosa PA01
cgcgaggcauucucgcgacc

SEQ ID NO: 3421094 - RNA, 18 nt, Pseudomonas aeruginosa PA01
cgcgaggccggccccacc

SEQ ID NO: 3421095 - RNA, 12 nt, Pseudomonas aeruginosa PA01
cgcgaggcgagu

SEQ ID NO: 3421096 - RNA, 19 nt, Pseudomonas aeruginosa PA01
cgcgaggcgaguaccaccg

SEQ ID NO: 3421097 - RNA, 18 nt, Pseudomonas aeruginosa PA01
cgcgaggcgcccgccggc

SEQ ID NO: 3421098 - RNA, 19 nt, Pseudomonas aeruginosa PA01
cgcgaggcgcccgccggcc

SEQ ID NO: 3421099 - RNA, 20 nt, Pseudomonas aeruginosa PA01
cgcgaggcgcccgccggccg

SEQ ID NO: 3421100 - RNA, 15 nt, Pseudomonas aeruginosa PA01
cgcgaggcgcucuuc

SEQ ID NO: 3421101 - RNA, 23 nt, Pseudomonas aeruginosa PA01
cgcgaggcgcucuucacuuccag

SEQ ID NO: 3421102 - RNA, 21 nt, Pseudomonas aeruginosa PA01
cgcgaggcggucaugcgcccu

SEQ ID NO: 3421103 - RNA, 22 nt, Pseudomonas aeruginosa PA01
cgcgaggggaacauugccacca

SEQ ID NO: 3421104 - RNA, 20 nt, Pseudomonas aeruginosa PA01
cgcgagggggccucggccag

SEQ ID NO: 3421105 - RNA, 14 nt, Pseudomonas aeruginosa PA01
cgcgaggucucgau

SEQ ID NO: 3421106 - RNA, 21 nt, Pseudomonas aeruginosa PA01
cgcgaggucugugccgugauc

SEQ ID NO: 3421107 - RNA, 17 nt, Pseudomonas aeruginosa PA01
cgcgagguggaugaaca

SEQ ID NO: 3421108 - RNA, 18 nt, Pseudomonas aeruginosa PA01
cgcgagguggaugaacag

SEQ ID NO: 3421109 - RNA, 19 nt, Pseudomonas aeruginosa PA01
cgcgagguuccgcggcgac

SEQ ID NO: 3421110 - RNA, 20 nt, Pseudomonas aeruginosa PA01
cgcgagguuccgcggcgacg

SEQ ID NO: 3421111 - RNA, 24 nt, Pseudomonas aeruginosa PA01
cgcgagguuucgcuuuccucgguc

SEQ ID NO: 3421112 - RNA, 22 nt, Pseudomonas aeruginosa PA01
cgcgaguccuucggcgcauagc

SEQ ID NO: 3421113 - RNA, 14 nt, Pseudomonas aeruginosa PA01
cgcgagugcagcga

SEQ ID NO: 3421114 - RNA, 20 nt, Pseudomonas aeruginosa PA01
cgcgagugcagcgagucgcc

SEQ ID NO: 3421115 - RNA, 15 nt, Pseudomonas aeruginosa PA01
cgcgaguucgccggc

SEQ ID NO: 3421116 - RNA, 16 nt, Pseudomonas aeruginosa PA01
cgcgaguucgccggcc

SEQ ID NO: 3421117 - RNA, 18 nt, Pseudomonas aeruginosa PA01
cgcgaguucgccggccag

SEQ ID NO: 3421118 - RNA, 19 nt, Pseudomonas aeruginosa PA01
cgcgaguucgccggccagg

SEQ ID NO: 3421119 - RNA, 18 nt, Pseudomonas aeruginosa PA01
cgcgauaaaaagccccgc

SEQ ID NO: 3421120 - RNA, 22 nt, Pseudomonas aeruginosa PA01
cgcgauaaaaagccccgcuucg

SEQ ID NO: 3421121 - RNA, 18 nt, Pseudomonas aeruginosa PA01
cgcgauacccuggccggc

SEQ ID NO: 3421122 - RNA, 20 nt, Pseudomonas aeruginosa PA01
cgcgauacccuggccggccu

SEQ ID NO: 3421123 - RNA, 22 nt, Pseudomonas aeruginosa PA01
cgcgauacccuggccggccucg

SEQ ID NO: 3421124 - RNA, 20 nt, Pseudomonas aeruginosa PA01
cgcgauacucgugggccggu

SEQ ID NO: 3421125 - RNA, 15 nt, Pseudomonas aeruginosa PA01
cgcgauagacgccgg

SEQ ID NO: 3421126 - RNA, 16 nt, Pseudomonas aeruginosa PA01
cgcgauagacgccggc

SEQ ID NO: 3421127 - RNA, 17 nt, Pseudomonas aeruginosa PA01
cgcgauagacgccggcg

SEQ ID NO: 3421128 - RNA, 18 nt, Pseudomonas aeruginosa PA01
cgcgauagacgccggcga

SEQ ID NO: 3421129 - RNA, 20 nt, Pseudomonas aeruginosa PA01
cgcgauagacgccggcgacg

SEQ ID NO: 3421130 - RNA, 14 nt, Pseudomonas aeruginosa PA01
cgcgauauccgcca

SEQ ID NO: 3421131 - RNA, 16 nt, Pseudomonas aeruginosa PA01
cgcgauauccgccagg

SEQ ID NO: 3421132 - RNA, 23 nt, Pseudomonas aeruginosa PA01
cgcgauauccgccaggcggagca

SEQ ID NO: 3421133 - RNA, 21 nt, Pseudomonas aeruginosa PA01
cgcgauauccgccagggagca

SEQ ID NO: 3421134 - RNA, 14 nt, Pseudomonas aeruginosa PA01
cgcgauaucgcagg

SEQ ID NO: 3421135 - RNA, 22 nt, Pseudomonas aeruginosa PA01
cgcgauaucgcaggccaggccc

SEQ ID NO: 3421136 - RNA, 12 nt, Pseudomonas aeruginosa PA01
cgcgaucaccgc

SEQ ID NO: 3421137 - RNA, 14 nt, Pseudomonas aeruginosa PA01
cgcgaucaccgcgu

SEQ ID NO: 3421138 - RNA, 13 nt, Pseudomonas aeruginosa PA01
cgcgaucagccgc

SEQ ID NO: 3421139 - RNA, 15 nt, Pseudomonas aeruginosa PA01
cgcgauccaccgcca

SEQ ID NO: 3421140 - RNA, 17 nt, Pseudomonas aeruginosa PA01
cgcgauccaccgccagg

SEQ ID NO: 3421141 - RNA, 18 nt, Pseudomonas aeruginosa PA01
cgcgauccaccgccaggg

SEQ ID NO: 3421142 - RNA, 22 nt, Pseudomonas aeruginosa PA01
cgcgauccaccgccagggcgcu

SEQ ID NO: 3421143 - RNA, 13 nt, Pseudomonas aeruginosa PA01
cgcgauccgcgcg

SEQ ID NO: 3421144 - RNA, 15 nt, Pseudomonas aeruginosa PA01
cgcgauccgcgcggc

SEQ ID NO: 3421145 - RNA, 18 nt, Pseudomonas aeruginosa PA01
cgcgauccgcgcggcaac

SEQ ID NO: 3421146 - RNA, 17 nt, Pseudomonas aeruginosa PA01
cgcgauccuccgccagc

SEQ ID NO: 3421147 - RNA, 19 nt, Pseudomonas aeruginosa PA01
cgcgauccuccgccagccc

SEQ ID NO: 3421148 - RNA, 21 nt, Pseudomonas aeruginosa PA01
cgcgauccuccgccagcccca

SEQ ID NO: 3421149 - RNA, 22 nt, Pseudomonas aeruginosa PA01
cgcgauccuccgccagccccag

SEQ ID NO: 3421150 - RNA, 14 nt, Pseudomonas aeruginosa PA01
cgcgauccuggcgg

SEQ ID NO: 3421151 - RNA, 16 nt, Pseudomonas aeruginosa PA01
cgcgauccuggcggca

SEQ ID NO: 3421152 - RNA, 22 nt, Pseudomonas aeruginosa PA01
cgcgauccuucggaggucgagc

SEQ ID NO: 3421153 - RNA, 23 nt, Pseudomonas aeruginosa PA01
cgcgaucgaggccuacccgcgcu

SEQ ID NO: 3421154 - RNA, 16 nt, Pseudomonas aeruginosa PA01
cgcgaucgaucggcug

SEQ ID NO: 3421155 - RNA, 17 nt, Pseudomonas aeruginosa PA01
cgcgaucgaucggcugg

SEQ ID NO: 3421156 - RNA, 18 nt, Pseudomonas aeruginosa PA01
cgcgaucgaucggcuggu

SEQ ID NO: 3421157 - RNA, 17 nt, Pseudomonas aeruginosa PA01
cgcgaucggcguccgcg

SEQ ID NO: 3421158 - RNA, 23 nt, Pseudomonas aeruginosa PA01
cgcgaucucuacuaccgccagcg

SEQ ID NO: 3421159 - RNA, 17 nt, Pseudomonas aeruginosa PA01
cgcgaucugcugguuga

SEQ ID NO: 3421160 - RNA, 13 nt, Pseudomonas aeruginosa PA01
cgcgaugaugccg

SEQ ID NO: 3421161 - RNA, 17 nt, Pseudomonas aeruginosa PA01
cgcgaugcguuccaggg

SEQ ID NO: 3421162 - RNA, 23 nt, Pseudomonas aeruginosa PA01
cgcgaugcguuccagggcgaagu

SEQ ID NO: 3421163 - RNA, 16 nt, Pseudomonas aeruginosa PA01
cgcgaugcucccgagc

SEQ ID NO: 3421164 - RNA, 17 nt, Pseudomonas aeruginosa PA01
cgcgaugcucccgagca

SEQ ID NO: 3421165 - RNA, 18 nt, Pseudomonas aeruginosa PA01
cgcgauggaguaggcguc

SEQ ID NO: 3421166 - RNA, 13 nt, Pseudomonas aeruginosa PA01
cgcgauggccggc

SEQ ID NO: 3421167 - RNA, 16 nt, Pseudomonas aeruginosa PA01
cgcgauggccggcgga

SEQ ID NO: 3421168 - RNA, 18 nt, Pseudomonas aeruginosa PA01
cgcgauggccggcggaga

SEQ ID NO: 3421169 - RNA, 21 nt, Pseudomonas aeruginosa PA01
cgcgauggcucgcggcgcucg

SEQ ID NO: 3421170 - RNA, 24 nt, Pseudomonas aeruginosa PA01
cgcgaugguaguccgcugcgagca

SEQ ID NO: 3421171 - RNA, 13 nt, Pseudomonas aeruginosa PA01
cgcgaugguaugg

SEQ ID NO: 3421172 - RNA, 23 nt, Pseudomonas aeruginosa PA01
cgcgaugguauggcggucggcca

SEQ ID NO: 3421173 - RNA, 22 nt, Pseudomonas aeruginosa PA01
cgcgauguccccggccagcagc

SEQ ID NO: 3421174 - RNA, 19 nt, Pseudomonas aeruginosa PA01
cgcgauguuggcgucgaac

SEQ ID NO: 3421175 - RNA, 16 nt, Pseudomonas aeruginosa PA01
cgcgauucgccgggcu

SEQ ID NO: 3421176 - RNA, 23 nt, Pseudomonas aeruginosa PA01
cgcgauucgccgggcuccagcau

SEQ ID NO: 3421177 - RNA, 14 nt, Pseudomonas aeruginosa PA01
cgcgauugcagcuc

SEQ ID NO: 3421178 - RNA, 19 nt, Pseudomonas aeruginosa PA01
cgcgauugcagcuccuggu

SEQ ID NO: 3421179 - RNA, 19 nt, Pseudomonas aeruginosa PA01
cgcgcaaaccggcagcauc

SEQ ID NO: 3421180 - RNA, 15 nt, Pseudomonas aeruginosa PA01
cgcgcaaccagccgg

SEQ ID NO: 3421181 - RNA, 19 nt, Pseudomonas aeruginosa PA01
cgcgcaaccguuccagcgc

SEQ ID NO: 3421182 - RNA, 12 nt, Pseudomonas aeruginosa PA01
cgcgcaacgccg

SEQ ID NO: 3421183 - RNA, 16 nt, Pseudomonas aeruginosa PA01
cgcgcaacgccgacgg

SEQ ID NO: 3421184 - RNA, 19 nt, Pseudomonas aeruginosa PA01
cgcgcaacgccgacggcgu

SEQ ID NO: 3421185 - RNA, 19 nt, Pseudomonas aeruginosa PA01
cgcgcaacgcuuccagcac

SEQ ID NO: 3421186 - RNA, 23 nt, Pseudomonas aeruginosa PA01
cgcgcaacgcuuccagcaccucc

SEQ ID NO: 3421187 - RNA, 14 nt, Pseudomonas aeruginosa PA01
cgcgcaacggcagc

SEQ ID NO: 3421188 - RNA, 19 nt, Pseudomonas aeruginosa PA01
cgcgcaacgguuccaugcg

SEQ ID NO: 3421189 - RNA, 19 nt, Pseudomonas aeruginosa PA01
cgcgcaacugcggggcgcu

SEQ ID NO: 3421190 - RNA, 16 nt, Pseudomonas aeruginosa PA01
cgcgcaacuggucgcg

SEQ ID NO: 3421191 - RNA, 20 nt, Pseudomonas aeruginosa PA01
cgcgcaacuggucgcggcug

SEQ ID NO: 3421192 - RNA, 21 nt, Pseudomonas aeruginosa PA01
cgcgcaacuggucgcggcugc

SEQ ID NO: 3421193 - RNA, 13 nt, Pseudomonas aeruginosa PA01
cgcgcaagcgccc

SEQ ID NO: 3421194 - RNA, 14 nt, Pseudomonas aeruginosa PA01
cgcgcaagcgcccg

SEQ ID NO: 3421195 - RNA, 16 nt, Pseudomonas aeruginosa PA01
cgcgcaagcgcccggc

SEQ ID NO: 3421196 - RNA, 23 nt, Pseudomonas aeruginosa PA01
cgcgcaagcucgucacccgcgcc

SEQ ID NO: 3421197 - RNA, 16 nt, Pseudomonas aeruginosa PA01
cgcgcaaggcagcguc

SEQ ID NO: 3421198 - RNA, 18 nt, Pseudomonas aeruginosa PA01
cgcgcaaggcagcguccg

SEQ ID NO: 3421199 - RNA, 12 nt, Pseudomonas aeruginosa PA01
cgcgcaaggccg

SEQ ID NO: 3421200 - RNA, 13 nt, Pseudomonas aeruginosa PA01
cgcgcaaggccga

SEQ ID NO: 3421201 - RNA, 18 nt, Pseudomonas aeruginosa PA01
cgcgcaaugccgcgucga

SEQ ID NO: 3421202 - RNA, 20 nt, Pseudomonas aeruginosa PA01
cgcgcacaaaaaagcccgcc

SEQ ID NO: 3421203 - RNA, 19 nt, Pseudomonas aeruginosa PA01
cgcgcacaugccgagcgaa

SEQ ID NO: 3421204 - RNA, 12 nt, Pseudomonas aeruginosa PA01
cgcgcaccaccg

SEQ ID NO: 3421205 - RNA, 20 nt, Pseudomonas aeruginosa PA01
cgcgcaccaccgagagcggc

SEQ ID NO: 3421206 - RNA, 12 nt, Pseudomonas aeruginosa PA01
cgcgcaccaccu

SEQ ID NO: 3421207 - RNA, 23 nt, Pseudomonas aeruginosa PA01
cgcgcaccaccuggcagguaucg

SEQ ID NO: 3421208 - RNA, 13 nt, Pseudomonas aeruginosa PA01
cgcgcaccagcac

SEQ ID NO: 3421209 - RNA, 21 nt, Pseudomonas aeruginosa PA01
cgcgcaccagcacuuccggcg

SEQ ID NO: 3421210 - RNA, 23 nt, Pseudomonas aeruginosa PA01
cgcgcaccagcacuuccggcgcg

SEQ ID NO: 3421211 - RNA, 12 nt, Pseudomonas aeruginosa PA01
cgcgcaccagcg

SEQ ID NO: 3421212 - RNA, 15 nt, Pseudomonas aeruginosa PA01
cgcgcaccagcgggu

SEQ ID NO: 3421213 - RNA, 18 nt, Pseudomonas aeruginosa PA01
cgcgcaccaggccuccca

SEQ ID NO: 3421214 - RNA, 22 nt, Pseudomonas aeruginosa PA01
cgcgcaccaggccucccagccg

SEQ ID NO: 3421215 - RNA, 23 nt, Pseudomonas aeruginosa PA01
cgcgcaccaggccucccagccgu

SEQ ID NO: 3421216 - RNA, 17 nt, Pseudomonas aeruginosa PA01
cgcgcaccgcggccagu

SEQ ID NO: 3421217 - RNA, 15 nt, Pseudomonas aeruginosa PA01
cgcgcaccgcggcga

SEQ ID NO: 3421218 - RNA, 16 nt, Pseudomonas aeruginosa PA01
cgcgcaccgcggcgag

SEQ ID NO: 3421219 - RNA, 17 nt, Pseudomonas aeruginosa PA01
cgcgcaccgcggcgagc

SEQ ID NO: 3421220 - RNA, 17 nt, Pseudomonas aeruginosa PA01
cgcgcaccucgaccgcg

SEQ ID NO: 3421221 - RNA, 14 nt, Pseudomonas aeruginosa PA01
cgcgcaccuggcgg

SEQ ID NO: 3421222 - RNA, 22 nt, Pseudomonas aeruginosa PA01
cgcgcaccuggcggucgccgcc

SEQ ID NO: 3421223 - RNA, 14 nt, Pseudomonas aeruginosa PA01
cgcgcaccugggcg

SEQ ID NO: 3421224 - RNA, 19 nt, Pseudomonas aeruginosa PA01
cgcgcaccugggcguuggc

SEQ ID NO: 3421225 - RNA, 23 nt, Pseudomonas aeruginosa PA01
cgcgcacgaggauuuccgcgccc

SEQ ID NO: 3421226 - RNA, 16 nt, Pseudomonas aeruginosa PA01
cgcgcacgcuguagac

SEQ ID NO: 3421227 - RNA, 14 nt, Pseudomonas aeruginosa PA01
cgcgcacggaggcg

SEQ ID NO: 3421228 - RNA, 22 nt, Pseudomonas aeruginosa PA01
cgcgcacggaucgcgcugggcg

SEQ ID NO: 3421229 - RNA, 17 nt, Pseudomonas aeruginosa PA01
cgcgcacggucuuggcg

SEQ ID NO: 3421230 - RNA, 18 nt, Pseudomonas aeruginosa PA01
cgcgcacgucaccguccu

SEQ ID NO: 3421231 - RNA, 19 nt, Pseudomonas aeruginosa PA01
cgcgcacgucaccguccuu

SEQ ID NO: 3421232 - RNA, 15 nt, Pseudomonas aeruginosa PA01
cgcgcacgucgaggu

SEQ ID NO: 3421233 - RNA, 14 nt, Pseudomonas aeruginosa PA01
cgcgcacuuccgga

SEQ ID NO: 3421234 - RNA, 21 nt, Pseudomonas aeruginosa PA01
cgcgcacuuccggacugccca

SEQ ID NO: 3421235 - RNA, 16 nt, Pseudomonas aeruginosa PA01
cgcgcacuuccucggc

SEQ ID NO: 3421236 - RNA, 17 nt, Pseudomonas aeruginosa PA01
cgcgcacuuccucggcg

SEQ ID NO: 3421237 - RNA, 20 nt, Pseudomonas aeruginosa PA01
cgcgcacuuccucggcgacc

SEQ ID NO: 3421238 - RNA, 22 nt, Pseudomonas aeruginosa PA01
cgcgcacuuccucggcgaccac

SEQ ID NO: 3421239 - RNA, 22 nt, Pseudomonas aeruginosa PA01
cgcgcagaccaucagcuggauc

SEQ ID NO: 3421240 - RNA, 18 nt, Pseudomonas aeruginosa PA01
cgcgcagacgauugaccu

SEQ ID NO: 3421241 - RNA, 22 nt, Pseudomonas aeruginosa PA01
cgcgcagacgauugaccucccg

SEQ ID NO: 3421242 - RNA, 19 nt, Pseudomonas aeruginosa PA01
cgcgcagaggcgcuccacc

SEQ ID NO: 3421243 - RNA, 15 nt, Pseudomonas aeruginosa PA01
cgcgcagauagucga

SEQ ID NO: 3421244 - RNA, 16 nt, Pseudomonas aeruginosa PA01
cgcgcagaucgccgcg

SEQ ID NO: 3421245 - RNA, 19 nt, Pseudomonas aeruginosa PA01
cgcgcagaugaucgccacc

SEQ ID NO: 3421246 - RNA, 20 nt, Pseudomonas aeruginosa PA01
cgcgcagaugaucgccaccg

SEQ ID NO: 3421247 - RNA, 16 nt, Pseudomonas aeruginosa PA01
cgcgcagcaacggcgc

SEQ ID NO: 3421248 - RNA, 20 nt, Pseudomonas aeruginosa PA01
cgcgcagcaggauccaggug

SEQ ID NO: 3421249 - RNA, 22 nt, Pseudomonas aeruginosa PA01
cgcgcagcaggcggcccaugcg

SEQ ID NO: 3421250 - RNA, 16 nt, Pseudomonas aeruginosa PA01
cgcgcagcagguagug

SEQ ID NO: 3421251 - RNA, 20 nt, Pseudomonas aeruginosa PA01
cgcgcagcagguagugcggc

SEQ ID NO: 3421252 - RNA, 23 nt, Pseudomonas aeruginosa PA01
cgcgcagcagguagugcggcggg

SEQ ID NO: 3421253 - RNA, 15 nt, Pseudomonas aeruginosa PA01
cgcgcagcaguaccu

SEQ ID NO: 3421254 - RNA, 14 nt, Pseudomonas aeruginosa PA01
cgcgcagccacugg

SEQ ID NO: 3421255 - RNA, 23 nt, Pseudomonas aeruginosa PA01
cgcgcagccacuggcggaccgcc

SEQ ID NO: 3421256 - RNA, 12 nt, Pseudomonas aeruginosa PA01
cgcgcagccagg

SEQ ID NO: 3421257 - RNA, 15 nt, Pseudomonas aeruginosa PA01
cgcgcagccaggcga

SEQ ID NO: 3421258 - RNA, 23 nt, Pseudomonas aeruginosa PA01
cgcgcagccaggcgaggaacagc

SEQ ID NO: 3421259 - RNA, 12 nt, Pseudomonas aeruginosa PA01
cgcgcagccagu

SEQ ID NO: 3421260 - RNA, 22 nt, Pseudomonas aeruginosa PA01
cgcgcagcgaacgggcguugcc

SEQ ID NO: 3421261 - RNA, 14 nt, Pseudomonas aeruginosa PA01
cgcgcagcgccgcc

SEQ ID NO: 3421262 - RNA, 15 nt, Pseudomonas aeruginosa PA01
cgcgcagcgccgccg

SEQ ID NO: 3421263 - RNA, 13 nt, Pseudomonas aeruginosa PA01
cgcgcagcgccuc

SEQ ID NO: 3421264 - RNA, 15 nt, Pseudomonas aeruginosa PA01
cgcgcagcgcggcgc

SEQ ID NO: 3421265 - RNA, 14 nt, Pseudomonas aeruginosa PA01
cgcgcagcggcgcc

SEQ ID NO: 3421266 - RNA, 15 nt, Pseudomonas aeruginosa PA01
cgcgcagcggcgccg

SEQ ID NO: 3421267 - RNA, 15 nt, Pseudomonas aeruginosa PA01
cgcgcagcggcgcgu

SEQ ID NO: 3421268 - RNA, 13 nt, Pseudomonas aeruginosa PA01
cgcgcagcggcuc

SEQ ID NO: 3421269 - RNA, 14 nt, Pseudomonas aeruginosa PA01
cgcgcagcucggcc

SEQ ID NO: 3421270 - RNA, 20 nt, Pseudomonas aeruginosa PA01
cgcgcagcugguaggagccg

SEQ ID NO: 3421271 - RNA, 21 nt, Pseudomonas aeruginosa PA01
cgcgcagcuugccuuccaggc

SEQ ID NO: 3421272 - RNA, 20 nt, Pseudomonas aeruginosa PA01
cgcgcaggaagaaggcgucc

SEQ ID NO: 3421273 - RNA, 22 nt, Pseudomonas aeruginosa PA01
cgcgcaggaccacgcuggucac

SEQ ID NO: 3421274 - RNA, 23 nt, Pseudomonas aeruginosa PA01
cgcgcaggaccacgcuggucacc

SEQ ID NO: 3421275 - RNA, 13 nt, Pseudomonas aeruginosa PA01
cgcgcaggaccug

SEQ ID NO: 3421276 - RNA, 16 nt, Pseudomonas aeruginosa PA01
cgcgcaggaccuggcu

SEQ ID NO: 3421277 - RNA, 18 nt, Pseudomonas aeruginosa PA01
cgcgcaggaccuggcuga

SEQ ID NO: 3421278 - RNA, 19 nt, Pseudomonas aeruginosa PA01
cgcgcaggaccuggcugag

SEQ ID NO: 3421279 - RNA, 22 nt, Pseudomonas aeruginosa PA01
cgcgcaggacgaggaaggcgcg

SEQ ID NO: 3421280 - RNA, 18 nt, Pseudomonas aeruginosa PA01
cgcgcaggacggauaacg

SEQ ID NO: 3421281 - RNA, 12 nt, Pseudomonas aeruginosa PA01
cgcgcaggagug

SEQ ID NO: 3421282 - RNA, 13 nt, Pseudomonas aeruginosa PA01
cgcgcaggccggu

SEQ ID NO: 3421283 - RNA, 15 nt, Pseudomonas aeruginosa PA01
cgcgcaggccgguga

SEQ ID NO: 3421284 - RNA, 13 nt, Pseudomonas aeruginosa PA01
cgcgcaggcgcua

SEQ ID NO: 3421285 - RNA, 17 nt, Pseudomonas aeruginosa PA01
cgcgcaggcgcuggcgg

SEQ ID NO: 3421286 - RNA, 12 nt, Pseudomonas aeruginosa PA01
cgcgcaggcggg

SEQ ID NO: 3421287 - RNA, 18 nt, Pseudomonas aeruginosa PA01
cgcgcaggcgggcggcgu

SEQ ID NO: 3421288 - RNA, 20 nt, Pseudomonas aeruginosa PA01
cgcgcaggcgggcggcgucg

SEQ ID NO: 3421289 - RNA, 18 nt, Pseudomonas aeruginosa PA01
cgcgcaggcggucgccga

SEQ ID NO: 3421290 - RNA, 22 nt, Pseudomonas aeruginosa PA01
cgcgcaggcuuucguaggcagg

SEQ ID NO: 3421291 - RNA, 13 nt, Pseudomonas aeruginosa PA01
cgcgcagggcagc

SEQ ID NO: 3421292 - RNA, 14 nt, Pseudomonas aeruginosa PA01
cgcgcagggccagc

SEQ ID NO: 3421293 - RNA, 19 nt, Pseudomonas aeruginosa PA01
cgcgcagggccagcaacag

SEQ ID NO: 3421294 - RNA, 20 nt, Pseudomonas aeruginosa PA01
cgcgcagggccagcaacagg

SEQ ID NO: 3421295 - RNA, 22 nt, Pseudomonas aeruginosa PA01
cgcgcagggccagcaacaggca

SEQ ID NO: 3421296 - RNA, 18 nt, Pseudomonas aeruginosa PA01
cgcgcagggccagggcgg

SEQ ID NO: 3421297 - RNA, 22 nt, Pseudomonas aeruginosa PA01
cgcgcagggccagggcggcggc

SEQ ID NO: 3421298 - RNA, 23 nt, Pseudomonas aeruginosa PA01
cgcgcagggccagggcggcggcg

SEQ ID NO: 3421299 - RNA, 13 nt, Pseudomonas aeruginosa PA01
cgcgcagggucga

SEQ ID NO: 3421300 - RNA, 18 nt, Pseudomonas aeruginosa PA01
cgcgcagggucgaggcaa

SEQ ID NO: 3421301 - RNA, 21 nt, Pseudomonas aeruginosa PA01
cgcgcaggugcuuggcaccgc

SEQ ID NO: 3421302 - RNA, 16 nt, Pseudomonas aeruginosa PA01
cgcgcagguucaucgc

SEQ ID NO: 3421303 - RNA, 17 nt, Pseudomonas aeruginosa PA01
cgcgcagguucaucgcc

SEQ ID NO: 3421304 - RNA, 20 nt, Pseudomonas aeruginosa PA01
cgcgcagguucaucgccgcc

SEQ ID NO: 3421305 - RNA, 21 nt, Pseudomonas aeruginosa PA01
cgcgcagguucaucgccgcca

SEQ ID NO: 3421306 - RNA, 23 nt, Pseudomonas aeruginosa PA01
cgcgcagguucaucgccgccagg

SEQ ID NO: 3421307 - RNA, 19 nt, Pseudomonas aeruginosa PA01
cgcgcaguacgaucagcca

SEQ ID NO: 3421308 - RNA, 21 nt, Pseudomonas aeruginosa PA01
cgcgcaguacgaucagccagg

SEQ ID NO: 3421309 - RNA, 17 nt, Pseudomonas aeruginosa PA01
cgcgcaguaggcgcugc

SEQ ID NO: 3421310 - RNA, 19 nt, Pseudomonas aeruginosa PA01
cgcgcaguaggcgcugccg

SEQ ID NO: 3421311 - RNA, 20 nt, Pseudomonas aeruginosa PA01
cgcgcaguaggcgcugccgu

SEQ ID NO: 3421312 - RNA, 16 nt, Pseudomonas aeruginosa PA01
cgcgcagucccgcgcg

SEQ ID NO: 3421313 - RNA, 20 nt, Pseudomonas aeruginosa PA01
cgcgcagucccgcgcggccc

SEQ ID NO: 3421314 - RNA, 16 nt, Pseudomonas aeruginosa PA01
cgcgcaguuccuucac

SEQ ID NO: 3421315 - RNA, 21 nt, Pseudomonas aeruginosa PA01
cgcgcaucaccccgcaaccgc

SEQ ID NO: 3421316 - RNA, 18 nt, Pseudomonas aeruginosa PA01
cgcgcaucgaugccuugc

SEQ ID NO: 3421317 - RNA, 18 nt, Pseudomonas aeruginosa PA01
cgcgcaucgcggacaccg

SEQ ID NO: 3421318 - RNA, 19 nt, Pseudomonas aeruginosa PA01
cgcgcaucgcggacaccgc

SEQ ID NO: 3421319 - RNA, 15 nt, Pseudomonas aeruginosa PA01
cgcgcaucggugccg

SEQ ID NO: 3421320 - RNA, 14 nt, Pseudomonas aeruginosa PA01
cgcgcaucgugcag

SEQ ID NO: 3421321 - RNA, 16 nt, Pseudomonas aeruginosa PA01
cgcgcaucuggcugcg

SEQ ID NO: 3421322 - RNA, 21 nt, Pseudomonas aeruginosa PA01
cgcgcaucuggcugcgcgcca

SEQ ID NO: 3421323 - RNA, 21 nt, Pseudomonas aeruginosa PA01
cgcgcaugaaaaagcccggca

SEQ ID NO: 3421324 - RNA, 21 nt, Pseudomonas aeruginosa PA01
cgcgcaugaaaaagccgccca

SEQ ID NO: 3421325 - RNA, 15 nt, Pseudomonas aeruginosa PA01
cgcgcaugaccuuca

SEQ ID NO: 3421326 - RNA, 22 nt, Pseudomonas aeruginosa PA01
cgcgcaugaccuucagcaccug

SEQ ID NO: 3421327 - RNA, 19 nt, Pseudomonas aeruginosa PA01
cgcgcaugaucgccucggc

SEQ ID NO: 3421328 - RNA, 20 nt, Pseudomonas aeruginosa PA01
cgcgcaugaucgccucggcg

SEQ ID NO: 3421329 - RNA, 21 nt, Pseudomonas aeruginosa PA01
cgcgcaugaucgccucggcgc

SEQ ID NO: 3421330 - RNA, 23 nt, Pseudomonas aeruginosa PA01
cgcgcaugaucgccucggcgcgc

SEQ ID NO: 3421331 - RNA, 14 nt, Pseudomonas aeruginosa PA01
cgcgcaugcagggc

SEQ ID NO: 3421332 - RNA, 17 nt, Pseudomonas aeruginosa PA01
cgcgcaugcagggcguc

SEQ ID NO: 3421333 - RNA, 20 nt, Pseudomonas aeruginosa PA01
cgcgcauggagacggcccgc

SEQ ID NO: 3421334 - RNA, 21 nt, Pseudomonas aeruginosa PA01
cgcgcauggagacggcccgcc

SEQ ID NO: 3421335 - RNA, 22 nt, Pseudomonas aeruginosa PA01
cgcgcauggagacggcccgccc

SEQ ID NO: 3421336 - RNA, 15 nt, Pseudomonas aeruginosa PA01
cgcgcauggcggcga

SEQ ID NO: 3421337 - RNA, 16 nt, Pseudomonas aeruginosa PA01
cgcgcauggcggcgac

SEQ ID NO: 3421338 - RNA, 18 nt, Pseudomonas aeruginosa PA01
cgcgcauggcggcgaccg

SEQ ID NO: 3421339 - RNA, 19 nt, Pseudomonas aeruginosa PA01
cgcgcauggcggcgaccgc

SEQ ID NO: 3421340 - RNA, 23 nt, Pseudomonas aeruginosa PA01
cgcgccaaaaagcaggacggcga

SEQ ID NO: 3421341 - RNA, 14 nt, Pseudomonas aeruginosa PA01
cgcgccaaggccgc

SEQ ID NO: 3421342 - RNA, 18 nt, Pseudomonas aeruginosa PA01
cgcgccaaggccgccagg

SEQ ID NO: 3421343 - RNA, 21 nt, Pseudomonas aeruginosa PA01
cgcgccaaggccgccaggccu

SEQ ID NO: 3421344 - RNA, 20 nt, Pseudomonas aeruginosa PA01
cgcgccaagguuccagcccc

SEQ ID NO: 3421345 - RNA, 12 nt, Pseudomonas aeruginosa PA01
cgcgccaccagc

SEQ ID NO: 3421346 - RNA, 13 nt, Pseudomonas aeruginosa PA01
cgcgccaccagcg

SEQ ID NO: 3421347 - RNA, 15 nt, Pseudomonas aeruginosa PA01
cgcgccaccgccugg

SEQ ID NO: 3421348 - RNA, 16 nt, Pseudomonas aeruginosa PA01
cgcgccaccgccuggu

SEQ ID NO: 3421349 - RNA, 14 nt, Pseudomonas aeruginosa PA01
cgcgccacgcagga

SEQ ID NO: 3421350 - RNA, 15 nt, Pseudomonas aeruginosa PA01
cgcgccacgcaggaa

SEQ ID NO: 3421351 - RNA, 17 nt, Pseudomonas aeruginosa PA01
cgcgccacgcaggaaca

SEQ ID NO: 3421352 - RNA, 15 nt, Pseudomonas aeruginosa PA01
cgcgccacgcucucc

SEQ ID NO: 3421353 - RNA, 22 nt, Pseudomonas aeruginosa PA01
cgcgccacggaaggccacgccg

SEQ ID NO: 3421354 - RNA, 21 nt, Pseudomonas aeruginosa PA01
cgcgccacgggcagaccuucg

SEQ ID NO: 3421355 - RNA, 18 nt, Pseudomonas aeruginosa PA01
cgcgccagaagcggccga

SEQ ID NO: 3421356 - RNA, 23 nt, Pseudomonas aeruginosa PA01
cgcgccagaagcggccgaccagg

SEQ ID NO: 3421357 - RNA, 22 nt, Pseudomonas aeruginosa PA01
cgcgccagagaucgcccagcgg

SEQ ID NO: 3421358 - RNA, 17 nt, Pseudomonas aeruginosa PA01
cgcgccagcacggcgca

SEQ ID NO: 3421359 - RNA, 19 nt, Pseudomonas aeruginosa PA01
cgcgccagcacggcgcagg

SEQ ID NO: 3421360 - RNA, 22 nt, Pseudomonas aeruginosa PA01
cgcgccagcacggcgcagggca

SEQ ID NO: 3421361 - RNA, 18 nt, Pseudomonas aeruginosa PA01
cgcgccagcaggcgcagc

SEQ ID NO: 3421362 - RNA, 22 nt, Pseudomonas aeruginosa PA01
cgcgccagcaggcgcagcagcg

SEQ ID NO: 3421363 - RNA, 12 nt, Pseudomonas aeruginosa PA01
cgcgccagccac

SEQ ID NO: 3421364 - RNA, 23 nt, Pseudomonas aeruginosa PA01
cgcgccagccaggaagagcccgc

SEQ ID NO: 3421365 - RNA, 15 nt, Pseudomonas aeruginosa PA01
cgcgccagccccagg

SEQ ID NO: 3421366 - RNA, 17 nt, Pseudomonas aeruginosa PA01
cgcgccagccccaggcg

SEQ ID NO: 3421367 - RNA, 20 nt, Pseudomonas aeruginosa PA01
cgcgccagccccaggcgcgg

SEQ ID NO: 3421368 - RNA, 12 nt, Pseudomonas aeruginosa PA01
cgcgccagcgcc

SEQ ID NO: 3421369 - RNA, 17 nt, Pseudomonas aeruginosa PA01
cgcgccagcgccacggc

SEQ ID NO: 3421370 - RNA, 13 nt, Pseudomonas aeruginosa PA01
cgcgccagcgccg

SEQ ID NO: 3421371 - RNA, 15 nt, Pseudomonas aeruginosa PA01
cgcgccagcgccgcc

SEQ ID NO: 3421372 - RNA, 17 nt, Pseudomonas aeruginosa PA01
cgcgccagcgccgccag

SEQ ID NO: 3421373 - RNA, 18 nt, Pseudomonas aeruginosa PA01
cgcgccaggcccacgccc

SEQ ID NO: 3421374 - RNA, 13 nt, Pseudomonas aeruginosa PA01
cgcgccaggccgc

SEQ ID NO: 3421375 - RNA, 14 nt, Pseudomonas aeruginosa PA01
cgcgccaggcgcag

SEQ ID NO: 3421376 - RNA, 13 nt, Pseudomonas aeruginosa PA01
cgcgccagggcgg

SEQ ID NO: 3421377 - RNA, 15 nt, Pseudomonas aeruginosa PA01
cgcgccaggucgaga

SEQ ID NO: 3421378 - RNA, 21 nt, Pseudomonas aeruginosa PA01
cgcgccagucccgcaaagccc

SEQ ID NO: 3421379 - RNA, 17 nt, Pseudomonas aeruginosa PA01
cgcgccagugccugcac

SEQ ID NO: 3421380 - RNA, 15 nt, Pseudomonas aeruginosa PA01
cgcgccaucggcggu

SEQ ID NO: 3421381 - RNA, 19 nt, Pseudomonas aeruginosa PA01
cgcgccaucggucgcgccc

SEQ ID NO: 3421382 - RNA, 23 nt, Pseudomonas aeruginosa PA01
cgcgccaugcaagaacgccgacc

SEQ ID NO: 3421383 - RNA, 14 nt, Pseudomonas aeruginosa PA01
cgcgccaugccggc

SEQ ID NO: 3421384 - RNA, 17 nt, Pseudomonas aeruginosa PA01
cgcgccauggccgcuga

SEQ ID NO: 3421385 - RNA, 17 nt, Pseudomonas aeruginosa PA01
cgcgccauuccgcggca

SEQ ID NO: 3421386 - RNA, 18 nt, Pseudomonas aeruginosa PA01
cgcgccauuccgcggcac

SEQ ID NO: 3421387 - RNA, 20 nt, Pseudomonas aeruginosa PA01
cgcgccauuccgcggcacuc

SEQ ID NO: 3421388 - RNA, 19 nt, Pseudomonas aeruginosa PA01
cgcgcccacuccuccgccu

SEQ ID NO: 3421389 - RNA, 13 nt, Pseudomonas aeruginosa PA01
cgcgcccaggcag

SEQ ID NO: 3421390 - RNA, 12 nt, Pseudomonas aeruginosa PA01
cgcgcccaggcc

SEQ ID NO: 3421391 - RNA, 13 nt, Pseudomonas aeruginosa PA01
cgcgcccaggccc

SEQ ID NO: 3421392 - RNA, 17 nt, Pseudomonas aeruginosa PA01
cgcgcccaggcccagcg

SEQ ID NO: 3421393 - RNA, 21 nt, Pseudomonas aeruginosa PA01
cgcgcccaggcccagcgcggc

SEQ ID NO: 3421394 - RNA, 22 nt, Pseudomonas aeruginosa PA01
cgcgcccaggcccagcgcggcg

SEQ ID NO: 3421395 - RNA, 14 nt, Pseudomonas aeruginosa PA01
cgcgcccaggcugc

SEQ ID NO: 3421396 - RNA, 22 nt, Pseudomonas aeruginosa PA01
cgcgcccaggcugccggccagg

SEQ ID NO: 3421397 - RNA, 17 nt, Pseudomonas aeruginosa PA01
cgcgccccacggcgcgg

SEQ ID NO: 3421398 - RNA, 13 nt, Pseudomonas aeruginosa PA01
cgcgccccagcgg

SEQ ID NO: 3421399 - RNA, 21 nt, Pseudomonas aeruginosa PA01
cgcgccccagcggcaggcacg

SEQ ID NO: 3421400 - RNA, 15 nt, Pseudomonas aeruginosa PA01
cgcgcccccuggccg

SEQ ID NO: 3421401 - RNA, 16 nt, Pseudomonas aeruginosa PA01
cgcgcccccuggccgu

SEQ ID NO: 3421402 - RNA, 20 nt, Pseudomonas aeruginosa PA01
cgcgccccgcuugccgucga

SEQ ID NO: 3421403 - RNA, 15 nt, Pseudomonas aeruginosa PA01
cgcgccccggcgagc

SEQ ID NO: 3421404 - RNA, 11 nt, Pseudomonas aeruginosa PA01
cgcgccccguc

SEQ ID NO: 3421405 - RNA, 13 nt, Pseudomonas aeruginosa PA01
cgcgccccguccc

SEQ ID NO: 3421406 - RNA, 21 nt, Pseudomonas aeruginosa PA01
cgcgccccgucccuaccagcg

SEQ ID NO: 3421407 - RNA, 13 nt, Pseudomonas aeruginosa PA01
cgcgccccugcgc

SEQ ID NO: 3421408 - RNA, 14 nt, Pseudomonas aeruginosa PA01
cgcgcccgccaggu

SEQ ID NO: 3421409 - RNA, 11 nt, Pseudomonas aeruginosa PA01
cgcgcccggcc

SEQ ID NO: 3421410 - RNA, 12 nt, Pseudomonas aeruginosa PA01
cgcgcccggcca

SEQ ID NO: 3421411 - RNA, 14 nt, Pseudomonas aeruginosa PA01
cgcgcccggccagg

SEQ ID NO: 3421412 - RNA, 15 nt, Pseudomonas aeruginosa PA01
cgcgcccggccaggc

SEQ ID NO: 3421413 - RNA, 19 nt, Pseudomonas aeruginosa PA01
cgcgcccggccaggccgcc

SEQ ID NO: 3421414 - RNA, 21 nt, Pseudomonas aeruginosa PA01
cgcgcccggccaggccgccca

SEQ ID NO: 3421415 - RNA, 14 nt, Pseudomonas aeruginosa PA01
cgcgcccggccucc

SEQ ID NO: 3421416 - RNA, 20 nt, Pseudomonas aeruginosa PA01
cgcgcccggccuucaccgcg

SEQ ID NO: 3421417 - RNA, 13 nt, Pseudomonas aeruginosa PA01
cgcgcccggcgca

SEQ ID NO: 3421418 - RNA, 16 nt, Pseudomonas aeruginosa PA01
cgcgcccggcgccacc

SEQ ID NO: 3421419 - RNA, 20 nt, Pseudomonas aeruginosa PA01
cgcgcccgguguucaccgga

SEQ ID NO: 3421420 - RNA, 21 nt, Pseudomonas aeruginosa PA01
cgcgcccguaccaagcgagac

SEQ ID NO: 3421421 - RNA, 22 nt, Pseudomonas aeruginosa PA01
cgcgcccucgcucguuccgcgg

SEQ ID NO: 3421422 - RNA, 18 nt, Pseudomonas aeruginosa PA01
cgcgcccucggugauacc

SEQ ID NO: 3421423 - RNA, 23 nt, Pseudomonas aeruginosa PA01
cgcgcccucggugauaccgccgg

SEQ ID NO: 3421424 - RNA, 17 nt, Pseudomonas aeruginosa PA01
cgcgcccugcaggccga

SEQ ID NO: 3421425 - RNA, 18 nt, Pseudomonas aeruginosa PA01
cgcgccgaacucgaacgc

SEQ ID NO: 3421426 - RNA, 13 nt, Pseudomonas aeruginosa PA01
cgcgccgaaggcg

SEQ ID NO: 3421427 - RNA, 23 nt, Pseudomonas aeruginosa PA01
cgcgccgaaggcgauauggccga

SEQ ID NO: 3421428 - RNA, 17 nt, Pseudomonas aeruginosa PA01
cgcgccgacagcacgau

SEQ ID NO: 3421429 - RNA, 17 nt, Pseudomonas aeruginosa PA01
cgcgccgacaggcaucg

SEQ ID NO: 3421430 - RNA, 14 nt, Pseudomonas aeruginosa PA01
cgcgccgaccagcc

SEQ ID NO: 3421431 - RNA, 19 nt, Pseudomonas aeruginosa PA01
cgcgccgaccagccgcagg

SEQ ID NO: 3421432 - RNA, 15 nt, Pseudomonas aeruginosa PA01
cgcgccgacccagag

SEQ ID NO: 3421433 - RNA, 17 nt, Pseudomonas aeruginosa PA01
cgcgccgacgacccgga

SEQ ID NO: 3421434 - RNA, 20 nt, Pseudomonas aeruginosa PA01
cgcgccgagauagcggcaac

SEQ ID NO: 3421435 - RNA, 14 nt, Pseudomonas aeruginosa PA01
cgcgccgagccagg

SEQ ID NO: 3421436 - RNA, 17 nt, Pseudomonas aeruginosa PA01
cgcgccgagccagguac

SEQ ID NO: 3421437 - RNA, 22 nt, Pseudomonas aeruginosa PA01
cgcgccgagcccccggcgccca

SEQ ID NO: 3421438 - RNA, 15 nt, Pseudomonas aeruginosa PA01
cgcgccgagccggcu

SEQ ID NO: 3421439 - RNA, 17 nt, Pseudomonas aeruginosa PA01
cgcgccgagcuggcgcg

SEQ ID NO: 3421440 - RNA, 19 nt, Pseudomonas aeruginosa PA01
cgcgccgagcuggcgcgcg

SEQ ID NO: 3421441 - RNA, 21 nt, Pseudomonas aeruginosa PA01
cgcgccgaguucgccgcgagc

SEQ ID NO: 3421442 - RNA, 14 nt, Pseudomonas aeruginosa PA01
cgcgccgaguuggc

SEQ ID NO: 3421443 - RNA, 21 nt, Pseudomonas aeruginosa PA01
cgcgccgcaguacgaggggcc

SEQ ID NO: 3421444 - RNA, 20 nt, Pseudomonas aeruginosa PA01
cgcgccgcccggcucgccgc

SEQ ID NO: 3421445 - RNA, 22 nt, Pseudomonas aeruginosa PA01
cgcgccgcccggcucgccgccg

SEQ ID NO: 3421446 - RNA, 15 nt, Pseudomonas aeruginosa PA01
cgcgccgccgccgcg

SEQ ID NO: 3421447 - RNA, 17 nt, Pseudomonas aeruginosa PA01
cgcgccgccgccgcggu

SEQ ID NO: 3421448 - RNA, 14 nt, Pseudomonas aeruginosa PA01
cgcgccgccgcggc

SEQ ID NO: 3421449 - RNA, 12 nt, Pseudomonas aeruginosa PA01
cgcgccgccgga

SEQ ID NO: 3421450 - RNA, 13 nt, Pseudomonas aeruginosa PA01
cgcgccgccggau

SEQ ID NO: 3421451 - RNA, 15 nt, Pseudomonas aeruginosa PA01
cgcgccgccgguagc

SEQ ID NO: 3421452 - RNA, 16 nt, Pseudomonas aeruginosa PA01
cgcgccgcgccagcag

SEQ ID NO: 3421453 - RNA, 17 nt, Pseudomonas aeruginosa PA01
cgcgccgcgccagcagg

SEQ ID NO: 3421454 - RNA, 12 nt, Pseudomonas aeruginosa PA01
cgcgccgcgcuu

SEQ ID NO: 3421455 - RNA, 15 nt, Pseudomonas aeruginosa PA01
cgcgccgcgcuuggc

SEQ ID NO: 3421456 - RNA, 22 nt, Pseudomonas aeruginosa PA01
cgcgccgcgcuuggccuugccg

SEQ ID NO: 3421457 - RNA, 23 nt, Pseudomonas aeruginosa PA01
cgcgccgcgcuuggccuugccgu

SEQ ID NO: 3421458 - RNA, 12 nt, Pseudomonas aeruginosa PA01
cgcgccgcggaa

SEQ ID NO: 3421459 - RNA, 21 nt, Pseudomonas aeruginosa PA01
cgcgccgcggaaucgcguagc

SEQ ID NO: 3421460 - RNA, 14 nt, Pseudomonas aeruginosa PA01
cgcgccgcggcggc

SEQ ID NO: 3421461 - RNA, 15 nt, Pseudomonas aeruginosa PA01
cgcgccgcgucgccg

SEQ ID NO: 3421462 - RNA, 17 nt, Pseudomonas aeruginosa PA01
cgcgccgcgucgccgcc

SEQ ID NO: 3421463 - RNA, 23 nt, Pseudomonas aeruginosa PA01
cgcgccgcgucgccgccagcgcc

SEQ ID NO: 3421464 - RNA, 14 nt, Pseudomonas aeruginosa PA01
cgcgccgcucaggc

SEQ ID NO: 3421465 - RNA, 20 nt, Pseudomonas aeruginosa PA01
cgcgccggaaguggcagcgc

SEQ ID NO: 3421466 - RNA, 22 nt, Pseudomonas aeruginosa PA01
cgcgccggaaguggcagcgccg

SEQ ID NO: 3421467 - RNA, 21 nt, Pseudomonas aeruginosa PA01
cgcgccggacaggccacccgc

SEQ ID NO: 3421468 - RNA, 23 nt, Pseudomonas aeruginosa PA01
cgcgccggacaggccacccgccu

SEQ ID NO: 3421469 - RNA, 18 nt, Pseudomonas aeruginosa PA01
cgcgccggaugggcgagc

SEQ ID NO: 3421470 - RNA, 20 nt, Pseudomonas aeruginosa PA01
cgcgccggaugggcgagcug

SEQ ID NO: 3421471 - RNA, 22 nt, Pseudomonas aeruginosa PA01
cgcgccggaugggcgagcugcc

SEQ ID NO: 3421472 - RNA, 13 nt, Pseudomonas aeruginosa PA01
cgcgccggcagcu

SEQ ID NO: 3421473 - RNA, 14 nt, Pseudomonas aeruginosa PA01
cgcgccggcagcuc

SEQ ID NO: 3421474 - RNA, 17 nt, Pseudomonas aeruginosa PA01
cgcgccggcagcucggc

SEQ ID NO: 3421475 - RNA, 22 nt, Pseudomonas aeruginosa PA01
cgcgccggcagcucggccgagg

SEQ ID NO: 3421476 - RNA, 21 nt, Pseudomonas aeruginosa PA01
cgcgccggccauucgcugucg

SEQ ID NO: 3421477 - RNA, 13 nt, Pseudomonas aeruginosa PA01
cgcgccggcccgg

SEQ ID NO: 3421478 - RNA, 16 nt, Pseudomonas aeruginosa PA01
cgcgccggccguccca

SEQ ID NO: 3421479 - RNA, 13 nt, Pseudomonas aeruginosa PA01
cgcgccggcgaua

SEQ ID NO: 3421480 - RNA, 22 nt, Pseudomonas aeruginosa PA01
cgcgccggcgaucgccaggcga

SEQ ID NO: 3421481 - RNA, 23 nt, Pseudomonas aeruginosa PA01
cgcgccggcgaucgccaggcgau

SEQ ID NO: 3421482 - RNA, 16 nt, Pseudomonas aeruginosa PA01
cgcgccggcggggaag

SEQ ID NO: 3421483 - RNA, 22 nt, Pseudomonas aeruginosa PA01
cgcgccggcggggaagccuucg

SEQ ID NO: 3421484 - RNA, 16 nt, Pseudomonas aeruginosa PA01
cgcgccgggcucagcg

SEQ ID NO: 3421485 - RNA, 19 nt, Pseudomonas aeruginosa PA01
cgcgccgggcucagcgcgc

SEQ ID NO: 3421486 - RNA, 15 nt, Pseudomonas aeruginosa PA01
cgcgccgggcuggcc

SEQ ID NO: 3421487 - RNA, 17 nt, Pseudomonas aeruginosa PA01
cgcgccgggcuggccgu

SEQ ID NO: 3421488 - RNA, 20 nt, Pseudomonas aeruginosa PA01
cgcgccgggcuggccgucga

SEQ ID NO: 3421489 - RNA, 16 nt, Pseudomonas aeruginosa PA01
cgcgccggggcagcag

SEQ ID NO: 3421490 - RNA, 15 nt, Pseudomonas aeruginosa PA01
cgcgccgggucgaca

SEQ ID NO: 3421491 - RNA, 17 nt, Pseudomonas aeruginosa PA01
cgcgccgggucgacaug

SEQ ID NO: 3421492 - RNA, 22 nt, Pseudomonas aeruginosa PA01
cgcgccgggucgacaugcaggc

SEQ ID NO: 3421493 - RNA, 15 nt, Pseudomonas aeruginosa PA01
cgcgccgggucggau

SEQ ID NO: 3421494 - RNA, 19 nt, Pseudomonas aeruginosa PA01
cgcgccgguaaugacgauc

SEQ ID NO: 3421495 - RNA, 23 nt, Pseudomonas aeruginosa PA01
cgcgccgguaaugacgaucucga

SEQ ID NO: 3421496 - RNA, 18 nt, Pseudomonas aeruginosa PA01
cgcgccgguggccaggac

SEQ ID NO: 3421497 - RNA, 21 nt, Pseudomonas aeruginosa PA01
cgcgccgguggccaggacgcu

SEQ ID NO: 3421498 - RNA, 13 nt, Pseudomonas aeruginosa PA01
cgcgccgguggcg

SEQ ID NO: 3421499 - RNA, 22 nt, Pseudomonas aeruginosa PA01
cgcgccgguggcguacccgccc

SEQ ID NO: 3421500 - RNA, 20 nt, Pseudomonas aeruginosa PA01
cgcgccgguuucgaccggcg

SEQ ID NO: 3421501 - RNA, 14 nt, Pseudomonas aeruginosa PA01
cgcgccgugcggcg

SEQ ID NO: 3421502 - RNA, 20 nt, Pseudomonas aeruginosa PA01
cgcgccucagcggcuggcga

SEQ ID NO: 3421503 - RNA, 13 nt, Pseudomonas aeruginosa PA01
cgcgccuccaggc

SEQ ID NO: 3421504 - RNA, 16 nt, Pseudomonas aeruginosa PA01
cgcgccuccaggcgcg

SEQ ID NO: 3421505 - RNA, 17 nt, Pseudomonas aeruginosa PA01
cgcgccuccaggcgcgc

SEQ ID NO: 3421506 - RNA, 18 nt, Pseudomonas aeruginosa PA01
cgcgccuccaggcgcgcc

SEQ ID NO: 3421507 - RNA, 21 nt, Pseudomonas aeruginosa PA01
cgcgccuccaggcgcgccugg

SEQ ID NO: 3421508 - RNA, 22 nt, Pseudomonas aeruginosa PA01
cgcgccuccaggcgcgccugga

SEQ ID NO: 3421509 - RNA, 14 nt, Pseudomonas aeruginosa PA01
cgcgccuccggcag

SEQ ID NO: 3421510 - RNA, 15 nt, Pseudomonas aeruginosa PA01
cgcgccuccggcagc

SEQ ID NO: 3421511 - RNA, 16 nt, Pseudomonas aeruginosa PA01
cgcgccuccggcagcg

SEQ ID NO: 3421512 - RNA, 18 nt, Pseudomonas aeruginosa PA01
cgcgccuccggcagcguc

SEQ ID NO: 3421513 - RNA, 15 nt, Pseudomonas aeruginosa PA01
cgcgccucgccccag

SEQ ID NO: 3421514 - RNA, 17 nt, Pseudomonas aeruginosa PA01
cgcgccucgcgcaacgc

SEQ ID NO: 3421515 - RNA, 13 nt, Pseudomonas aeruginosa PA01
cgcgccucgucgc

SEQ ID NO: 3421516 - RNA, 22 nt, Pseudomonas aeruginosa PA01
cgcgccucuuccuggaccuccg

SEQ ID NO: 3421517 - RNA, 17 nt, Pseudomonas aeruginosa PA01
cgcgccucuucgcagga

SEQ ID NO: 3421518 - RNA, 21 nt, Pseudomonas aeruginosa PA01
cgcgccugaaacugcggaugu

SEQ ID NO: 3421519 - RNA, 13 nt, Pseudomonas aeruginosa PA01
cgcgccugagcug

SEQ ID NO: 3421520 - RNA, 14 nt, Pseudomonas aeruginosa PA01
cgcgccugagcugg

SEQ ID NO: 3421521 - RNA, 17 nt, Pseudomonas aeruginosa PA01
cgcgccugagcuggccc

SEQ ID NO: 3421522 - RNA, 16 nt, Pseudomonas aeruginosa PA01
cgcgccugcaacgcca

SEQ ID NO: 3421523 - RNA, 18 nt, Pseudomonas aeruginosa PA01
cgcgccugcaacgccagc

SEQ ID NO: 3421524 - RNA, 20 nt, Pseudomonas aeruginosa PA01
cgcgccugcaacguccucgc

SEQ ID NO: 3421525 - RNA, 21 nt, Pseudomonas aeruginosa PA01
cgcgccugcaggucgaggcgc

SEQ ID NO: 3421526 - RNA, 22 nt, Pseudomonas aeruginosa PA01
cgcgccugcaggucgaggcgcu

SEQ ID NO: 3421527 - RNA, 17 nt, Pseudomonas aeruginosa PA01
cgcgccugcucuucggc

SEQ ID NO: 3421528 - RNA, 20 nt, Pseudomonas aeruginosa PA01
cgcgccugcuucagguagug

SEQ ID NO: 3421529 - RNA, 18 nt, Pseudomonas aeruginosa PA01
cgcgccuggaucagcgcc

SEQ ID NO: 3421530 - RNA, 19 nt, Pseudomonas aeruginosa PA01
cgcgccuggaucagcgccu

SEQ ID NO: 3421531 - RNA, 21 nt, Pseudomonas aeruginosa PA01
cgcgccuggaucagcgccucg

SEQ ID NO: 3421532 - RNA, 23 nt, Pseudomonas aeruginosa PA01
cgcgccuggaucagcgccucgac

SEQ ID NO: 3421533 - RNA, 16 nt, Pseudomonas aeruginosa PA01
cgcgccuggcccuggc

SEQ ID NO: 3421534 - RNA, 17 nt, Pseudomonas aeruginosa PA01
cgcgccuggcccuggcg

SEQ ID NO: 3421535 - RNA, 12 nt, Pseudomonas aeruginosa PA01
cgcgccuggccg

SEQ ID NO: 3421536 - RNA, 17 nt, Pseudomonas aeruginosa PA01
cgcgccuggcuggccag

SEQ ID NO: 3421537 - RNA, 19 nt, Pseudomonas aeruginosa PA01
cgcgccuggcuggccagca

SEQ ID NO: 3421538 - RNA, 18 nt, Pseudomonas aeruginosa PA01
cgcgccugggccgcgagg

SEQ ID NO: 3421539 - RNA, 20 nt, Pseudomonas aeruginosa PA01
cgcgccugguauugcgccca

SEQ ID NO: 3421540 - RNA, 15 nt, Pseudomonas aeruginosa PA01
cgcgccuucagcccc

SEQ ID NO: 3421541 - RNA, 18 nt, Pseudomonas aeruginosa PA01
cgcgccuucagccccagc

SEQ ID NO: 3421542 - RNA, 14 nt, Pseudomonas aeruginosa PA01
cgcgccuucagcgc

SEQ ID NO: 3421543 - RNA, 18 nt, Pseudomonas aeruginosa PA01
cgcgccuucagcgccagc

SEQ ID NO: 3421544 - RNA, 20 nt, Pseudomonas aeruginosa PA01
cgcgccuucagcgccuccag

SEQ ID NO: 3421545 - RNA, 15 nt, Pseudomonas aeruginosa PA01
cgcgccuuccagccc

SEQ ID NO: 3421546 - RNA, 19 nt, Pseudomonas aeruginosa PA01
cgcgccuuccagcccuucg

SEQ ID NO: 3421547 - RNA, 13 nt, Pseudomonas aeruginosa PA01
cgcgccuucgacg

SEQ ID NO: 3421548 - RNA, 16 nt, Pseudomonas aeruginosa PA01
cgcgccuuucgcucag

SEQ ID NO: 3421549 - RNA, 18 nt, Pseudomonas aeruginosa PA01
cgcgccuuucgcucaggc

SEQ ID NO: 3421550 - RNA, 22 nt, Pseudomonas aeruginosa PA01
cgcgccuuuuucauuucgcgcg

SEQ ID NO: 3421551 - RNA, 22 nt, Pseudomonas aeruginosa PA01
cgcgccuuuuuuuauacgcucg

SEQ ID NO: 3421552 - RNA, 16 nt, Pseudomonas aeruginosa PA01
cgcgcgaaagggucag

SEQ ID NO: 3421553 - RNA, 23 nt, Pseudomonas aeruginosa PA01
cgcgcgaaagggucaggccuuga

SEQ ID NO: 3421554 - RNA, 14 nt, Pseudomonas aeruginosa PA01
cgcgcgaagcacgc

SEQ ID NO: 3421555 - RNA, 12 nt, Pseudomonas aeruginosa PA01
cgcgcgaccgcg

SEQ ID NO: 3421556 - RNA, 17 nt, Pseudomonas aeruginosa PA01
cgcgcgaccgcggcgcu

SEQ ID NO: 3421557 - RNA, 21 nt, Pseudomonas aeruginosa PA01
cgcgcgauaaaaagccccgcu

SEQ ID NO: 3421558 - RNA, 22 nt, Pseudomonas aeruginosa PA01
cgcgcgauaaaaagccccgcuu

SEQ ID NO: 3421559 - RNA, 18 nt, Pseudomonas aeruginosa PA01
cgcgcgauaccgacaagc

SEQ ID NO: 3421560 - RNA, 18 nt, Pseudomonas aeruginosa PA01
cgcgcgauggccggcgga

SEQ ID NO: 3421561 - RNA, 16 nt, Pseudomonas aeruginosa PA01
cgcgcgcaaggccgaa

SEQ ID NO: 3421562 - RNA, 18 nt, Pseudomonas aeruginosa PA01
cgcgcgcaaggccgaaga

SEQ ID NO: 3421563 - RNA, 11 nt, Pseudomonas aeruginosa PA01
cgcgcgcagga

SEQ ID NO: 3421564 - RNA, 13 nt, Pseudomonas aeruginosa PA01
cgcgcgccagguc

SEQ ID NO: 3421565 - RNA, 14 nt, Pseudomonas aeruginosa PA01
cgcgcgccaguccc

SEQ ID NO: 3421566 - RNA, 18 nt, Pseudomonas aeruginosa PA01
cgcgcgccagucccgcaa

SEQ ID NO: 3421567 - RNA, 21 nt, Pseudomonas aeruginosa PA01
cgcgcgccaucaguuccucgc

SEQ ID NO: 3421568 - RNA, 17 nt, Pseudomonas aeruginosa PA01
cgcgcgcccccuggccg

SEQ ID NO: 3421569 - RNA, 10 nt, Pseudomonas aeruginosa PA01
cgcgcgccga

SEQ ID NO: 3421570 - RNA, 19 nt, Pseudomonas aeruginosa PA01
cgcgcgccgagcccccggc

SEQ ID NO: 3421571 - RNA, 21 nt, Pseudomonas aeruginosa PA01
cgcgcgccugcaacgccagca

SEQ ID NO: 3421572 - RNA, 22 nt, Pseudomonas aeruginosa PA01
cgcgcgccugcaacgccagcag

SEQ ID NO: 3421573 - RNA, 21 nt, Pseudomonas aeruginosa PA01
cgcgcgccuggcuggccagca

SEQ ID NO: 3421574 - RNA, 22 nt, Pseudomonas aeruginosa PA01
cgcgcgccuggcuggccagcag

SEQ ID NO: 3421575 - RNA, 13 nt, Pseudomonas aeruginosa PA01
cgcgcgcgcaagg

SEQ ID NO: 3421576 - RNA, 13 nt, Pseudomonas aeruginosa PA01
cgcgcgcgcgcuc

SEQ ID NO: 3421577 - RNA, 14 nt, Pseudomonas aeruginosa PA01
cgcgcgcgcggucg

SEQ ID NO: 3421578 - RNA, 16 nt, Pseudomonas aeruginosa PA01
cgcgcgcgcuccucga

SEQ ID NO: 3421579 - RNA, 13 nt, Pseudomonas aeruginosa PA01
cgcgcgcgcugcc

SEQ ID NO: 3421580 - RNA, 11 nt, Pseudomonas aeruginosa PA01
cgcgcgcggcc

SEQ ID NO: 3421581 - RNA, 14 nt, Pseudomonas aeruginosa PA01
cgcgcgcggccagc

SEQ ID NO: 3421582 - RNA, 14 nt, Pseudomonas aeruginosa PA01
cgcgcgcggucgag

SEQ ID NO: 3421583 - RNA, 15 nt, Pseudomonas aeruginosa PA01
cgcgcgcggucgagc

SEQ ID NO: 3421584 - RNA, 14 nt, Pseudomonas aeruginosa PA01
cgcgcgcgucgagc

SEQ ID NO: 3421585 - RNA, 16 nt, Pseudomonas aeruginosa PA01
cgcgcgcuccucgauc

SEQ ID NO: 3421586 - RNA, 15 nt, Pseudomonas aeruginosa PA01
cgcgcgcucucgccg

SEQ ID NO: 3421587 - RNA, 18 nt, Pseudomonas aeruginosa PA01
cgcgcgcucucgccggcc

SEQ ID NO: 3421588 - RNA, 21 nt, Pseudomonas aeruginosa PA01
cgcgcgcucucgccggccugg

SEQ ID NO: 3421589 - RNA, 21 nt, Pseudomonas aeruginosa PA01
cgcgcgcuggauuucgccgag

SEQ ID NO: 3421590 - RNA, 16 nt, Pseudomonas aeruginosa PA01
cgcgcgcuuccaggca

SEQ ID NO: 3421591 - RNA, 16 nt, Pseudomonas aeruginosa PA01
cgcgcgcuuguggcga

SEQ ID NO: 3421592 - RNA, 17 nt, Pseudomonas aeruginosa PA01
cgcgcgcuuuuccggcg

SEQ ID NO: 3421593 - RNA, 20 nt, Pseudomonas aeruginosa PA01
cgcgcgcuuuuccggcgccg

SEQ ID NO: 3421594 - RNA, 22 nt, Pseudomonas aeruginosa PA01
cgcgcgcuuuuccggcgccggc

SEQ ID NO: 3421595 - RNA, 19 nt, Pseudomonas aeruginosa PA01
cgcgcggaccuucgacggc

SEQ ID NO: 3421596 - RNA, 22 nt, Pseudomonas aeruginosa PA01
cgcgcggaccuucgacggcagg

SEQ ID NO: 3421597 - RNA, 21 nt, Pseudomonas aeruginosa PA01
cgcgcggauauagcuggucaa

SEQ ID NO: 3421598 - RNA, 18 nt, Pseudomonas aeruginosa PA01
cgcgcggauccccucccg

SEQ ID NO: 3421599 - RNA, 23 nt, Pseudomonas aeruginosa PA01
cgcgcggauccccucccgcgcca

SEQ ID NO: 3421600 - RNA, 14 nt, Pseudomonas aeruginosa PA01
cgcgcggcaccccu

SEQ ID NO: 3421601 - RNA, 22 nt, Pseudomonas aeruginosa PA01
cgcgcggcauagcgcagccgcu

SEQ ID NO: 3421602 - RNA, 12 nt, Pseudomonas aeruginosa PA01
cgcgcggccagc

SEQ ID NO: 3421603 - RNA, 15 nt, Pseudomonas aeruginosa PA01
cgcgcggccagcgcg

SEQ ID NO: 3421604 - RNA, 17 nt, Pseudomonas aeruginosa PA01
cgcgcggccagcgcggc

SEQ ID NO: 3421605 - RNA, 22 nt, Pseudomonas aeruginosa PA01
cgcgcggccagcgcggccgccg

SEQ ID NO: 3421606 - RNA, 16 nt, Pseudomonas aeruginosa PA01
cgcgcggccaguucgg

SEQ ID NO: 3421607 - RNA, 14 nt, Pseudomonas aeruginosa PA01
cgcgcggcccacca

SEQ ID NO: 3421608 - RNA, 15 nt, Pseudomonas aeruginosa PA01
cgcgcggcccuucga

SEQ ID NO: 3421609 - RNA, 17 nt, Pseudomonas aeruginosa PA01
cgcgcggcccuucgacg

SEQ ID NO: 3421610 - RNA, 17 nt, Pseudomonas aeruginosa PA01
cgcgcggcgagccgcga

SEQ ID NO: 3421611 - RNA, 20 nt, Pseudomonas aeruginosa PA01
cgcgcggcgagggcgccggg

SEQ ID NO: 3421612 - RNA, 12 nt, Pseudomonas aeruginosa PA01
cgcgcggcgccc

SEQ ID NO: 3421613 - RNA, 15 nt, Pseudomonas aeruginosa PA01
cgcgcggcgucgacc

SEQ ID NO: 3421614 - RNA, 21 nt, Pseudomonas aeruginosa PA01
cgcgcggcugcuugccgcuca

SEQ ID NO: 3421615 - RNA, 12 nt, Pseudomonas aeruginosa PA01
cgcgcggcuggc

SEQ ID NO: 3421616 - RNA, 18 nt, Pseudomonas aeruginosa PA01
cgcgcggcuugccggcgc

SEQ ID NO: 3421617 - RNA, 19 nt, Pseudomonas aeruginosa PA01
cgcgcggcuugccggcgcg

SEQ ID NO: 3421618 - RNA, 14 nt, Pseudomonas aeruginosa PA01
cgcgcgggccgagg

SEQ ID NO: 3421619 - RNA, 15 nt, Pseudomonas aeruginosa PA01
cgcgcgggccgaggu

SEQ ID NO: 3421620 - RNA, 17 nt, Pseudomonas aeruginosa PA01
cgcgcgggccggcgaug

SEQ ID NO: 3421621 - RNA, 19 nt, Pseudomonas aeruginosa PA01
cgcgcgggccggcgauggc

SEQ ID NO: 3421622 - RNA, 20 nt, Pseudomonas aeruginosa PA01
cgcgcgggccggcgauggcc

SEQ ID NO: 3421623 - RNA, 14 nt, Pseudomonas aeruginosa PA01
cgcgcggggcgcgc

SEQ ID NO: 3421624 - RNA, 15 nt, Pseudomonas aeruginosa PA01
cgcgcggggcgcgcu

SEQ ID NO: 3421625 - RNA, 18 nt, Pseudomonas aeruginosa PA01
cgcgcggggcgcgcugcg

SEQ ID NO: 3421626 - RNA, 17 nt, Pseudomonas aeruginosa PA01
cgcgcggggucuggccg

SEQ ID NO: 3421627 - RNA, 20 nt, Pseudomonas aeruginosa PA01
cgcgcggggucuggccggcg

SEQ ID NO: 3421628 - RNA, 15 nt, Pseudomonas aeruginosa PA01
cgcgcgggguggccg

SEQ ID NO: 3421629 - RNA, 14 nt, Pseudomonas aeruginosa PA01
cgcgcgggucgucg

SEQ ID NO: 3421630 - RNA, 15 nt, Pseudomonas aeruginosa PA01
cgcgcgggucgucga

SEQ ID NO: 3421631 - RNA, 17 nt, Pseudomonas aeruginosa PA01
cgcgcggguuuccgugc

SEQ ID NO: 3421632 - RNA, 19 nt, Pseudomonas aeruginosa PA01
cgcgcggguuuccgugcgc

SEQ ID NO: 3421633 - RNA, 20 nt, Pseudomonas aeruginosa PA01
cgcgcggguuuccgugcgcu

SEQ ID NO: 3421634 - RNA, 23 nt, Pseudomonas aeruginosa PA01
cgcgcggguuuccgugcgcugcg

SEQ ID NO: 3421635 - RNA, 13 nt, Pseudomonas aeruginosa PA01
cgcgcggucgagc

SEQ ID NO: 3421636 - RNA, 15 nt, Pseudomonas aeruginosa PA01
cgcgcggucgagcag

SEQ ID NO: 3421637 - RNA, 16 nt, Pseudomonas aeruginosa PA01
cgcgcggucgagcagc

SEQ ID NO: 3421638 - RNA, 19 nt, Pseudomonas aeruginosa PA01
cgcgcggucgagcagcgcc

SEQ ID NO: 3421639 - RNA, 15 nt, Pseudomonas aeruginosa PA01
cgcgcguaggcuugg

SEQ ID NO: 3421640 - RNA, 15 nt, Pseudomonas aeruginosa PA01
cgcgcguccagccgg

SEQ ID NO: 3421641 - RNA, 14 nt, Pseudomonas aeruginosa PA01
cgcgcgucggcggc

SEQ ID NO: 3421642 - RNA, 15 nt, Pseudomonas aeruginosa PA01
cgcgcgucggucagg

SEQ ID NO: 3421643 - RNA, 19 nt, Pseudomonas aeruginosa PA01
cgcgcgucguccagggcgc

SEQ ID NO: 3421644 - RNA, 17 nt, Pseudomonas aeruginosa PA01
cgcgcgugccccguggc

SEQ ID NO: 3421645 - RNA, 17 nt, Pseudomonas aeruginosa PA01
cgcgcguggccgccagg

SEQ ID NO: 3421646 - RNA, 22 nt, Pseudomonas aeruginosa PA01
cgcgcguggcuucguccagcga

SEQ ID NO: 3421647 - RNA, 15 nt, Pseudomonas aeruginosa PA01
cgcgcguuccagguc

SEQ ID NO: 3421648 - RNA, 16 nt, Pseudomonas aeruginosa PA01
cgcgcguuccaggucg

SEQ ID NO: 3421649 - RNA, 22 nt, Pseudomonas aeruginosa PA01
cgcgcguuccaggucgcugcug

SEQ ID NO: 3421650 - RNA, 21 nt, Pseudomonas aeruginosa PA01
cgcgcguucgcgcgaggcgcu

SEQ ID NO: 3421651 - RNA, 16 nt, Pseudomonas aeruginosa PA01
cgcgcguuucagcgcu

SEQ ID NO: 3421652 - RNA, 17 nt, Pseudomonas aeruginosa PA01
cgcgcguuucagcgcuu

SEQ ID NO: 3421653 - RNA, 18 nt, Pseudomonas aeruginosa PA01
cgcgcguuucagcgcuug

SEQ ID NO: 3421654 - RNA, 14 nt, Pseudomonas aeruginosa PA01
cgcgcucagcgcga

SEQ ID NO: 3421655 - RNA, 21 nt, Pseudomonas aeruginosa PA01
cgcgcucagcgcgagggggcc

SEQ ID NO: 3421656 - RNA, 16 nt, Pseudomonas aeruginosa PA01
cgcgcucagcgcuucu

SEQ ID NO: 3421657 - RNA, 20 nt, Pseudomonas aeruginosa PA01
cgcgcucaggcgcagcgucc

SEQ ID NO: 3421658 - RNA, 23 nt, Pseudomonas aeruginosa PA01
cgcgcucaggcgcagcguccugc

SEQ ID NO: 3421659 - RNA, 20 nt, Pseudomonas aeruginosa PA01
cgcgcuccaggcccggcagg

SEQ ID NO: 3421660 - RNA, 19 nt, Pseudomonas aeruginosa PA01
cgcgcuccaguucguugac

SEQ ID NO: 3421661 - RNA, 13 nt, Pseudomonas aeruginosa PA01
cgcgcuccggcgc

SEQ ID NO: 3421662 - RNA, 12 nt, Pseudomonas aeruginosa PA01
cgcgcuccucga

SEQ ID NO: 3421663 - RNA, 20 nt, Pseudomonas aeruginosa PA01
cgcgcucgaucagguagucg

SEQ ID NO: 3421664 - RNA, 15 nt, Pseudomonas aeruginosa PA01
cgcgcucgcgcauga

SEQ ID NO: 3421665 - RNA, 17 nt, Pseudomonas aeruginosa PA01
cgcgcucgcugucgcuc

SEQ ID NO: 3421666 - RNA, 20 nt, Pseudomonas aeruginosa PA01
cgcgcucgcugucgcucagc

SEQ ID NO: 3421667 - RNA, 12 nt, Pseudomonas aeruginosa PA01
cgcgcucggccg

SEQ ID NO: 3421668 - RNA, 13 nt, Pseudomonas aeruginosa PA01
cgcgcucggccgc

SEQ ID NO: 3421669 - RNA, 19 nt, Pseudomonas aeruginosa PA01
cgcgcucggccgccuggcg

SEQ ID NO: 3421670 - RNA, 12 nt, Pseudomonas aeruginosa PA01
cgcgcucggccu

SEQ ID NO: 3421671 - RNA, 14 nt, Pseudomonas aeruginosa PA01
cgcgcucggccugg

SEQ ID NO: 3421672 - RNA, 13 nt, Pseudomonas aeruginosa PA01
cgcgcucggcggc

SEQ ID NO: 3421673 - RNA, 16 nt, Pseudomonas aeruginosa PA01
cgcgcucggcggccuc

SEQ ID NO: 3421674 - RNA, 13 nt, Pseudomonas aeruginosa PA01
cgcgcucggcggu

SEQ ID NO: 3421675 - RNA, 23 nt, Pseudomonas aeruginosa PA01
cgcgcucggcggucaggccaagc

SEQ ID NO: 3421676 - RNA, 16 nt, Pseudomonas aeruginosa PA01
cgcgcucgggaucgcc

SEQ ID NO: 3421677 - RNA, 12 nt, Pseudomonas aeruginosa PA01
cgcgcucucgcc

SEQ ID NO: 3421678 - RNA, 15 nt, Pseudomonas aeruginosa PA01
cgcgcucucgccggc

SEQ ID NO: 3421679 - RNA, 16 nt, Pseudomonas aeruginosa PA01
cgcgcucucgccggcc

SEQ ID NO: 3421680 - RNA, 13 nt, Pseudomonas aeruginosa PA01
cgcgcucuggccc

SEQ ID NO: 3421681 - RNA, 22 nt, Pseudomonas aeruginosa PA01
cgcgcugaccuggucguugcgc

SEQ ID NO: 3421682 - RNA, 13 nt, Pseudomonas aeruginosa PA01
cgcgcugacggca

SEQ ID NO: 3421683 - RNA, 16 nt, Pseudomonas aeruginosa PA01
cgcgcugacggcaagg

SEQ ID NO: 3421684 - RNA, 14 nt, Pseudomonas aeruginosa PA01
cgcgcugcaggcgg

SEQ ID NO: 3421685 - RNA, 16 nt, Pseudomonas aeruginosa PA01
cgcgcugccccuggcu

SEQ ID NO: 3421686 - RNA, 16 nt, Pseudomonas aeruginosa PA01
cgcgcugcccggcgcg

SEQ ID NO: 3421687 - RNA, 17 nt, Pseudomonas aeruginosa PA01
cgcgcugcccggcgcga

SEQ ID NO: 3421688 - RNA, 19 nt, Pseudomonas aeruginosa PA01
cgcgcugcccggcgcgacg

SEQ ID NO: 3421689 - RNA, 20 nt, Pseudomonas aeruginosa PA01
cgcgcugcccggcgcgacgc

SEQ ID NO: 3421690 - RNA, 15 nt, Pseudomonas aeruginosa PA01
cgcgcugcgccaggc

SEQ ID NO: 3421691 - RNA, 14 nt, Pseudomonas aeruginosa PA01
cgcgcugcgugcgc

SEQ ID NO: 3421692 - RNA, 18 nt, Pseudomonas aeruginosa PA01
cgcgcugcgugcgccgcu

SEQ ID NO: 3421693 - RNA, 19 nt, Pseudomonas aeruginosa PA01
cgcgcugcgugcgccgcuc

SEQ ID NO: 3421694 - RNA, 22 nt, Pseudomonas aeruginosa PA01
cgcgcugcguggguagccgccc

SEQ ID NO: 3421695 - RNA, 17 nt, Pseudomonas aeruginosa PA01
cgcgcugcugccauccg

SEQ ID NO: 3421696 - RNA, 21 nt, Pseudomonas aeruginosa PA01
cgcgcugcugguagugcuggc

SEQ ID NO: 3421697 - RNA, 19 nt, Pseudomonas aeruginosa PA01
cgcgcuggaccauggccgg

SEQ ID NO: 3421698 - RNA, 13 nt, Pseudomonas aeruginosa PA01
cgcgcuggaccug

SEQ ID NO: 3421699 - RNA, 14 nt, Pseudomonas aeruginosa PA01
cgcgcuggaccugg

SEQ ID NO: 3421700 - RNA, 15 nt, Pseudomonas aeruginosa PA01
cgcgcuggaccuggc

SEQ ID NO: 3421701 - RNA, 19 nt, Pseudomonas aeruginosa PA01
cgcgcuggaguaucgcccu

SEQ ID NO: 3421702 - RNA, 21 nt, Pseudomonas aeruginosa PA01
cgcgcuggaguaucgcccugg

SEQ ID NO: 3421703 - RNA, 23 nt, Pseudomonas aeruginosa PA01
cgcgcuggaguaucgcccuggcc

SEQ ID NO: 3421704 - RNA, 19 nt, Pseudomonas aeruginosa PA01
cgcgcuggaugaaacgggc

SEQ ID NO: 3421705 - RNA, 17 nt, Pseudomonas aeruginosa PA01
cgcgcuggaugcccucc

SEQ ID NO: 3421706 - RNA, 17 nt, Pseudomonas aeruginosa PA01
cgcgcuggauuucgccg

SEQ ID NO: 3421707 - RNA, 18 nt, Pseudomonas aeruginosa PA01
cgcgcuggauuucgccga

SEQ ID NO: 3421708 - RNA, 12 nt, Pseudomonas aeruginosa PA01
cgcgcuggcgca

SEQ ID NO: 3421709 - RNA, 17 nt, Pseudomonas aeruginosa PA01
cgcgcuggcgcagcggg

SEQ ID NO: 3421710 - RNA, 15 nt, Pseudomonas aeruginosa PA01
cgcgcuggucguagg

SEQ ID NO: 3421711 - RNA, 18 nt, Pseudomonas aeruginosa PA01
cgcgcuggucguaggcgc

SEQ ID NO: 3421712 - RNA, 21 nt, Pseudomonas aeruginosa PA01
cgcgcuggucguaggcgcggg

SEQ ID NO: 3421713 - RNA, 22 nt, Pseudomonas aeruginosa PA01
cgcgcuggucguaggcgcgggc

SEQ ID NO: 3421714 - RNA, 20 nt, Pseudomonas aeruginosa PA01
cgcgcuggucguucucgcgc

SEQ ID NO: 3421715 - RNA, 23 nt, Pseudomonas aeruginosa PA01
cgcgcuggucguucucgcgcauc

SEQ ID NO: 3421716 - RNA, 20 nt, Pseudomonas aeruginosa PA01
cgcgcugguuuagcucggcg

SEQ ID NO: 3421717 - RNA, 21 nt, Pseudomonas aeruginosa PA01
cgcgcugguuuagcucggcga

SEQ ID NO: 3421718 - RNA, 19 nt, Pseudomonas aeruginosa PA01
cgcgcuguagccggcgccg

SEQ ID NO: 3421719 - RNA, 17 nt, Pseudomonas aeruginosa PA01
cgcgcugucggccucga

SEQ ID NO: 3421720 - RNA, 14 nt, Pseudomonas aeruginosa PA01
cgcgcuucaggcag

SEQ ID NO: 3421721 - RNA, 13 nt, Pseudomonas aeruginosa PA01
cgcgcuuccaggc

SEQ ID NO: 3421722 - RNA, 23 nt, Pseudomonas aeruginosa PA01
cgcgcuuccaggguagcgccgcg

SEQ ID NO: 3421723 - RNA, 24 nt, Pseudomonas aeruginosa PA01
cgcgcuuccaggguagcgccgcgg

SEQ ID NO: 3421724 - RNA, 19 nt, Pseudomonas aeruginosa PA01
cgcgcuuccgcaucggccg

SEQ ID NO: 3421725 - RNA, 21 nt, Pseudomonas aeruginosa PA01
cgcgcuucuucgacuaccugg

SEQ ID NO: 3421726 - RNA, 11 nt, Pseudomonas aeruginosa PA01
cgcgcuugagc

SEQ ID NO: 3421727 - RNA, 21 nt, Pseudomonas aeruginosa PA01
cgcgcuugaguugccagacga

SEQ ID NO: 3421728 - RNA, 18 nt, Pseudomonas aeruginosa PA01
cgcgcuugccgucgcgga

SEQ ID NO: 3421729 - RNA, 23 nt, Pseudomonas aeruginosa PA01
cgcgcuuggacagcucgcgggac

SEQ ID NO: 3421730 - RNA, 23 nt, Pseudomonas aeruginosa PA01
cgcgcuuggccuugccguccagc

SEQ ID NO: 3421731 - RNA, 15 nt, Pseudomonas aeruginosa PA01
cgcgcuuguccucca

SEQ ID NO: 3421732 - RNA, 19 nt, Pseudomonas aeruginosa PA01
cgcgcuuguccuccagcug

SEQ ID NO: 3421733 - RNA, 20 nt, Pseudomonas aeruginosa PA01
cgcgcuuguccuccagcugc

SEQ ID NO: 3421734 - RNA, 15 nt, Pseudomonas aeruginosa PA01
cgcgcuuuccggcgc

SEQ ID NO: 3421735 - RNA, 18 nt, Pseudomonas aeruginosa PA01
cgcgcuuuccggcgcggc

SEQ ID NO: 3421736 - RNA, 16 nt, Pseudomonas aeruginosa PA01
cgcgcuuuuccggcgc

SEQ ID NO: 3421737 - RNA, 18 nt, Pseudomonas aeruginosa PA01
cgcgcuuuuccggcgccg

SEQ ID NO: 3421738 - RNA, 22 nt, Pseudomonas aeruginosa PA01
cgcgcuuuuccggcgccggcag

SEQ ID NO: 3421739 - RNA, 16 nt, Pseudomonas aeruginosa PA01
cgcggaaaacgccgcg

SEQ ID NO: 3421740 - RNA, 17 nt, Pseudomonas aeruginosa PA01
cgcggaaaacgccgcga

SEQ ID NO: 3421741 - RNA, 20 nt, Pseudomonas aeruginosa PA01
cgcggaaacccuuccagccg

SEQ ID NO: 3421742 - RNA, 18 nt, Pseudomonas aeruginosa PA01
cgcggaacaucgcccggc

SEQ ID NO: 3421743 - RNA, 18 nt, Pseudomonas aeruginosa PA01
cgcggaaccagugcgcgg

SEQ ID NO: 3421744 - RNA, 13 nt, Pseudomonas aeruginosa PA01
cgcggaacuucgc

SEQ ID NO: 3421745 - RNA, 15 nt, Pseudomonas aeruginosa PA01
cgcggaacuucgcau

SEQ ID NO: 3421746 - RNA, 16 nt, Pseudomonas aeruginosa PA01
cgcggaagccgugcaa

SEQ ID NO: 3421747 - RNA, 15 nt, Pseudomonas aeruginosa PA01
cgcggaaggcgucga

SEQ ID NO: 3421748 - RNA, 11 nt, Pseudomonas aeruginosa PA01
cgcggaagucg

SEQ ID NO: 3421749 - RNA, 15 nt, Pseudomonas aeruginosa PA01
cgcggaagucggcgg

SEQ ID NO: 3421750 - RNA, 16 nt, Pseudomonas aeruginosa PA01
cgcggaagucggcggg

SEQ ID NO: 3421751 - RNA, 12 nt, Pseudomonas aeruginosa PA01
cgcggaaucgcg

SEQ ID NO: 3421752 - RNA, 20 nt, Pseudomonas aeruginosa PA01
cgcggaaucgcguagcgccc

SEQ ID NO: 3421753 - RNA, 13 nt, Pseudomonas aeruginosa PA01
cgcggaauggcgc

SEQ ID NO: 3421754 - RNA, 16 nt, Pseudomonas aeruginosa PA01
cgcggaauggcgcgca

SEQ ID NO: 3421755 - RNA, 22 nt, Pseudomonas aeruginosa PA01
cgcggaauggcgcgcaaaaaaa

SEQ ID NO: 3421756 - RNA, 13 nt, Pseudomonas aeruginosa PA01
cgcggacaccgcg

SEQ ID NO: 3421757 - RNA, 14 nt, Pseudomonas aeruginosa PA01
cgcggacaccgcgg

SEQ ID NO: 3421758 - RNA, 19 nt, Pseudomonas aeruginosa PA01
cgcggacaccgcggugucg

SEQ ID NO: 3421759 - RNA, 18 nt, Pseudomonas aeruginosa PA01
cgcggacagccugggcgg

SEQ ID NO: 3421760 - RNA, 20 nt, Pseudomonas aeruginosa PA01
cgcggacauggcgcucgagc

SEQ ID NO: 3421761 - RNA, 12 nt, Pseudomonas aeruginosa PA01
cgcggaccagcu

SEQ ID NO: 3421762 - RNA, 15 nt, Pseudomonas aeruginosa PA01
cgcggacccgcgccg

SEQ ID NO: 3421763 - RNA, 17 nt, Pseudomonas aeruginosa PA01
cgcggacccgcgccggc

SEQ ID NO: 3421764 - RNA, 20 nt, Pseudomonas aeruginosa PA01
cgcggacccgcgccggcagc

SEQ ID NO: 3421765 - RNA, 21 nt, Pseudomonas aeruginosa PA01
cgcggacccgcgccggcagcu

SEQ ID NO: 3421766 - RNA, 23 nt, Pseudomonas aeruginosa PA01
cgcggaccgaaggcaacagcccg

SEQ ID NO: 3421767 - RNA, 16 nt, Pseudomonas aeruginosa PA01
cgcggaccgggcggcg

SEQ ID NO: 3421768 - RNA, 18 nt, Pseudomonas aeruginosa PA01
cgcggaccgggcggcgcg

SEQ ID NO: 3421769 - RNA, 22 nt, Pseudomonas aeruginosa PA01
cgcggaccgggcggcgcggcgc

SEQ ID NO: 3421770 - RNA, 17 nt, Pseudomonas aeruginosa PA01
cgcggaccuccagccgg

SEQ ID NO: 3421771 - RNA, 19 nt, Pseudomonas aeruginosa PA01
cgcggaccuccagccggcc

SEQ ID NO: 3421772 - RNA, 23 nt, Pseudomonas aeruginosa PA01
cgcggaccuccagccggccaucc

SEQ ID NO: 3421773 - RNA, 21 nt, Pseudomonas aeruginosa PA01
cgcggaccucugcguucugcu

SEQ ID NO: 3421774 - RNA, 18 nt, Pseudomonas aeruginosa PA01
cgcggaccuucgacggca

SEQ ID NO: 3421775 - RNA, 19 nt, Pseudomonas aeruginosa PA01
cgcggaccuucgacggcag

SEQ ID NO: 3421776 - RNA, 20 nt, Pseudomonas aeruginosa PA01
cgcggaccuucgacggcagg

SEQ ID NO: 3421777 - RNA, 22 nt, Pseudomonas aeruginosa PA01
cgcggaccuucgacggcaggug

SEQ ID NO: 3421778 - RNA, 22 nt, Pseudomonas aeruginosa PA01
cgcggaccuugucgccggugag

SEQ ID NO: 3421779 - RNA, 15 nt, Pseudomonas aeruginosa PA01
cgcggacgauggucg

SEQ ID NO: 3421780 - RNA, 15 nt, Pseudomonas aeruginosa PA01
cgcggacgcuggcga

SEQ ID NO: 3421781 - RNA, 22 nt, Pseudomonas aeruginosa PA01
cgcggacgcuggcgaucaugcc

SEQ ID NO: 3421782 - RNA, 15 nt, Pseudomonas aeruginosa PA01
cgcggacggcacggg

SEQ ID NO: 3421783 - RNA, 19 nt, Pseudomonas aeruginosa PA01
cgcggacggcacggggcgc

SEQ ID NO: 3421784 - RNA, 13 nt, Pseudomonas aeruginosa PA01
cgcggacggccgg

SEQ ID NO: 3421785 - RNA, 14 nt, Pseudomonas aeruginosa PA01
cgcggacggccggc

SEQ ID NO: 3421786 - RNA, 14 nt, Pseudomonas aeruginosa PA01
cgcggacggccugc

SEQ ID NO: 3421787 - RNA, 18 nt, Pseudomonas aeruginosa PA01
cgcggacgggccgcgccg

SEQ ID NO: 3421788 - RNA, 21 nt, Pseudomonas aeruginosa PA01
cgcggacguaacggcuugagg

SEQ ID NO: 3421789 - RNA, 16 nt, Pseudomonas aeruginosa PA01
cgcggagaggaucagc

SEQ ID NO: 3421790 - RNA, 16 nt, Pseudomonas aeruginosa PA01
cgcggagauccccucc

SEQ ID NO: 3421791 - RNA, 22 nt, Pseudomonas aeruginosa PA01
cgcggagauccccuccuccagc

SEQ ID NO: 3421792 - RNA, 23 nt, Pseudomonas aeruginosa PA01
cgcggagcguccaccagcgcccg

SEQ ID NO: 3421793 - RNA, 12 nt, Pseudomonas aeruginosa PA01
cgcggagcugga

SEQ ID NO: 3421794 - RNA, 12 nt, Pseudomonas aeruginosa PA01
cgcggagggcgg

SEQ ID NO: 3421795 - RNA, 13 nt, Pseudomonas aeruginosa PA01
cgcggagucgccg

SEQ ID NO: 3421796 - RNA, 16 nt, Pseudomonas aeruginosa PA01
cgcggauacggcaggg

SEQ ID NO: 3421797 - RNA, 18 nt, Pseudomonas aeruginosa PA01
cgcggauacggcaggggc

SEQ ID NO: 3421798 - RNA, 20 nt, Pseudomonas aeruginosa PA01
cgcggauaucgcuggcgccc

SEQ ID NO: 3421799 - RNA, 21 nt, Pseudomonas aeruginosa PA01
cgcggauaucgcuggcgccca

SEQ ID NO: 3421800 - RNA, 14 nt, Pseudomonas aeruginosa PA01
cgcggaucaacgcc

SEQ ID NO: 3421801 - RNA, 18 nt, Pseudomonas aeruginosa PA01
cgcggaucaacgccgguc

SEQ ID NO: 3421802 - RNA, 13 nt, Pseudomonas aeruginosa PA01
cgcggaucaccug

SEQ ID NO: 3421803 - RNA, 18 nt, Pseudomonas aeruginosa PA01
cgcggaucaccuggccgu

SEQ ID NO: 3421804 - RNA, 13 nt, Pseudomonas aeruginosa PA01
cgcggauccacgc

SEQ ID NO: 3421805 - RNA, 15 nt, Pseudomonas aeruginosa PA01
cgcggauccacgccu

SEQ ID NO: 3421806 - RNA, 16 nt, Pseudomonas aeruginosa PA01
cgcggauccacgccug

SEQ ID NO: 3421807 - RNA, 19 nt, Pseudomonas aeruginosa PA01
cgcggauccccucccgcgc

SEQ ID NO: 3421808 - RNA, 21 nt, Pseudomonas aeruginosa PA01
cgcggauccccucccgcgcca

SEQ ID NO: 3421809 - RNA, 14 nt, Pseudomonas aeruginosa PA01
cgcggaucgcgccg

SEQ ID NO: 3421810 - RNA, 13 nt, Pseudomonas aeruginosa PA01
cgcggaucugcuc

SEQ ID NO: 3421811 - RNA, 17 nt, Pseudomonas aeruginosa PA01
cgcggaucuggcccuuu

SEQ ID NO: 3421812 - RNA, 23 nt, Pseudomonas aeruginosa PA01
cgcggaucuggcccuuuuccucg

SEQ ID NO: 3421813 - RNA, 18 nt, Pseudomonas aeruginosa PA01
cgcggauguucaccaggu

SEQ ID NO: 3421814 - RNA, 16 nt, Pseudomonas aeruginosa PA01
cgcggauguucgccac

SEQ ID NO: 3421815 - RNA, 19 nt, Pseudomonas aeruginosa PA01
cgcggauguucgccacgcu

SEQ ID NO: 3421816 - RNA, 14 nt, Pseudomonas aeruginosa PA01
cgcggauuggccgg

SEQ ID NO: 3421817 - RNA, 15 nt, Pseudomonas aeruginosa PA01
cgcggauuggccggg

SEQ ID NO: 3421818 - RNA, 16 nt, Pseudomonas aeruginosa PA01
cgcggauuggccgggc

SEQ ID NO: 3421819 - RNA, 20 nt, Pseudomonas aeruginosa PA01
cgcggauuggccgggccgau

SEQ ID NO: 3421820 - RNA, 16 nt, Pseudomonas aeruginosa PA01
cgcggcaaagugcggu

SEQ ID NO: 3421821 - RNA, 17 nt, Pseudomonas aeruginosa PA01
cgcggcaaccuguggaa

SEQ ID NO: 3421822 - RNA, 21 nt, Pseudomonas aeruginosa PA01
cgcggcaacgaaaacgcccgg

SEQ ID NO: 3421823 - RNA, 14 nt, Pseudomonas aeruginosa PA01
cgcggcaacgucag

SEQ ID NO: 3421824 - RNA, 18 nt, Pseudomonas aeruginosa PA01
cgcggcaacgucaggcug

SEQ ID NO: 3421825 - RNA, 17 nt, Pseudomonas aeruginosa PA01
cgcggcaaugcggcgau

SEQ ID NO: 3421826 - RNA, 12 nt, Pseudomonas aeruginosa PA01
cgcggcacagcg

SEQ ID NO: 3421827 - RNA, 21 nt, Pseudomonas aeruginosa PA01
cgcggcacagcguggccagcg

SEQ ID NO: 3421828 - RNA, 23 nt, Pseudomonas aeruginosa PA01
cgcggcacagcguggccagcgcc

SEQ ID NO: 3421829 - RNA, 14 nt, Pseudomonas aeruginosa PA01
cgcggcacaggcgg

SEQ ID NO: 3421830 - RNA, 15 nt, Pseudomonas aeruginosa PA01
cgcggcacaggcggc

SEQ ID NO: 3421831 - RNA, 16 nt, Pseudomonas aeruginosa PA01
cgcggcaccggcgacg

SEQ ID NO: 3421832 - RNA, 16 nt, Pseudomonas aeruginosa PA01
cgcggcagcaccaggc

SEQ ID NO: 3421833 - RNA, 17 nt, Pseudomonas aeruginosa PA01
cgcggcagcaccaggcc

SEQ ID NO: 3421834 - RNA, 13 nt, Pseudomonas aeruginosa PA01
cgcggcagcagcc

SEQ ID NO: 3421835 - RNA, 19 nt, Pseudomonas aeruginosa PA01
cgcggcagcagccaaccgu

SEQ ID NO: 3421836 - RNA, 21 nt, Pseudomonas aeruginosa PA01
cgcggcagcagccaaccgucg

SEQ ID NO: 3421837 - RNA, 14 nt, Pseudomonas aeruginosa PA01
cgcggcagcaggcg

SEQ ID NO: 3421838 - RNA, 17 nt, Pseudomonas aeruginosa PA01
cgcggcagcaggcgggc

SEQ ID NO: 3421839 - RNA, 13 nt, Pseudomonas aeruginosa PA01
cgcggcagcgcca

SEQ ID NO: 3421840 - RNA, 14 nt, Pseudomonas aeruginosa PA01
cgcggcagcgccau

SEQ ID NO: 3421841 - RNA, 15 nt, Pseudomonas aeruginosa PA01
cgcggcagcgccauc

SEQ ID NO: 3421842 - RNA, 16 nt, Pseudomonas aeruginosa PA01
cgcggcagcgccauca

SEQ ID NO: 3421843 - RNA, 21 nt, Pseudomonas aeruginosa PA01
cgcggcaggaaauccgccgcg

SEQ ID NO: 3421844 - RNA, 15 nt, Pseudomonas aeruginosa PA01
cgcggcaggaucagg

SEQ ID NO: 3421845 - RNA, 19 nt, Pseudomonas aeruginosa PA01
cgcggcaggaucaggcucg

SEQ ID NO: 3421846 - RNA, 13 nt, Pseudomonas aeruginosa PA01
cgcggcaggcggc

SEQ ID NO: 3421847 - RNA, 15 nt, Pseudomonas aeruginosa PA01
cgcggcaggcggcgg

SEQ ID NO: 3421848 - RNA, 21 nt, Pseudomonas aeruginosa PA01
cgcggcagguagccgccuugu

SEQ ID NO: 3421849 - RNA, 18 nt, Pseudomonas aeruginosa PA01
cgcggcagguggcuggcc

SEQ ID NO: 3421850 - RNA, 19 nt, Pseudomonas aeruginosa PA01
cgcggcagguggcuggcca

SEQ ID NO: 3421851 - RNA, 17 nt, Pseudomonas aeruginosa PA01
cgcggcagugcucgauc

SEQ ID NO: 3421852 - RNA, 23 nt, Pseudomonas aeruginosa PA01
cgcggcauagaugccggccucga

SEQ ID NO: 3421853 - RNA, 16 nt, Pseudomonas aeruginosa PA01
cgcggcauagcgcagc

SEQ ID NO: 3421854 - RNA, 19 nt, Pseudomonas aeruginosa PA01
cgcggcauagcgcagccgc

SEQ ID NO: 3421855 - RNA, 20 nt, Pseudomonas aeruginosa PA01
cgcggcauagcgcagccgcu

SEQ ID NO: 3421856 - RNA, 23 nt, Pseudomonas aeruginosa PA01
cgcggcauagcgcagccgcucgg

SEQ ID NO: 3421857 - RNA, 14 nt, Pseudomonas aeruginosa PA01
cgcggcaucccgcc

SEQ ID NO: 3421858 - RNA, 15 nt, Pseudomonas aeruginosa PA01
cgcggcaucccgccc

SEQ ID NO: 3421859 - RNA, 18 nt, Pseudomonas aeruginosa PA01
cgcggccacuucguccgg

SEQ ID NO: 3421860 - RNA, 23 nt, Pseudomonas aeruginosa PA01
cgcggccacuucguccggccgcc

SEQ ID NO: 3421861 - RNA, 13 nt, Pseudomonas aeruginosa PA01
cgcggccagcagc

SEQ ID NO: 3421862 - RNA, 22 nt, Pseudomonas aeruginosa PA01
cgcggccagcccccucgcccuc

SEQ ID NO: 3421863 - RNA, 17 nt, Pseudomonas aeruginosa PA01
cgcggccagccgcuagc

SEQ ID NO: 3421864 - RNA, 13 nt, Pseudomonas aeruginosa PA01
cgcggccagcgcg

SEQ ID NO: 3421865 - RNA, 16 nt, Pseudomonas aeruginosa PA01
cgcggccagcgcggcc

SEQ ID NO: 3421866 - RNA, 18 nt, Pseudomonas aeruginosa PA01
cgcggccagcgcggccgc

SEQ ID NO: 3421867 - RNA, 19 nt, Pseudomonas aeruginosa PA01
cgcggccagcgcggccgcc

SEQ ID NO: 3421868 - RNA, 22 nt, Pseudomonas aeruginosa PA01
cgcggccaguucggggucggcc

SEQ ID NO: 3421869 - RNA, 12 nt, Pseudomonas aeruginosa PA01
cgcggccaucgg

SEQ ID NO: 3421870 - RNA, 14 nt, Pseudomonas aeruginosa PA01
cgcggccaucggcg

SEQ ID NO: 3421871 - RNA, 19 nt, Pseudomonas aeruginosa PA01
cgcggcccaccagaggcug

SEQ ID NO: 3421872 - RNA, 14 nt, Pseudomonas aeruginosa PA01
cgcggccccagcac

SEQ ID NO: 3421873 - RNA, 13 nt, Pseudomonas aeruginosa PA01
cgcggcccguccg

SEQ ID NO: 3421874 - RNA, 16 nt, Pseudomonas aeruginosa PA01
cgcggcccguccgcgc

SEQ ID NO: 3421875 - RNA, 21 nt, Pseudomonas aeruginosa PA01
cgcggcccugcgccgcagcgg

SEQ ID NO: 3421876 - RNA, 22 nt, Pseudomonas aeruginosa PA01
cgcggcccugcgccgcagcggc

SEQ ID NO: 3421877 - RNA, 14 nt, Pseudomonas aeruginosa PA01
cgcggcccugcucg

SEQ ID NO: 3421878 - RNA, 19 nt, Pseudomonas aeruginosa PA01
cgcggcccugcucgccggc

SEQ ID NO: 3421879 - RNA, 20 nt, Pseudomonas aeruginosa PA01
cgcggcccugcucgccggcg

SEQ ID NO: 3421880 - RNA, 17 nt, Pseudomonas aeruginosa PA01
cgcggcccuucgacgac

SEQ ID NO: 3421881 - RNA, 20 nt, Pseudomonas aeruginosa PA01
cgcggccgaacucuggcggc

SEQ ID NO: 3421882 - RNA, 21 nt, Pseudomonas aeruginosa PA01
cgcggccgaacucuggcggcg

SEQ ID NO: 3421883 - RNA, 23 nt, Pseudomonas aeruginosa PA01
cgcggccgaggaaggcgcuggcg

SEQ ID NO: 3421884 - RNA, 13 nt, Pseudomonas aeruginosa PA01
cgcggccgccgcc

SEQ ID NO: 3421885 - RNA, 17 nt, Pseudomonas aeruginosa PA01
cgcggccgccgccgaca

SEQ ID NO: 3421886 - RNA, 20 nt, Pseudomonas aeruginosa PA01
cgcggccgccgccgacaggu

SEQ ID NO: 3421887 - RNA, 11 nt, Pseudomonas aeruginosa PA01
cgcggccggca

SEQ ID NO: 3421888 - RNA, 13 nt, Pseudomonas aeruginosa PA01
cgcggccggcagg

SEQ ID NO: 3421889 - RNA, 17 nt, Pseudomonas aeruginosa PA01
cgcggccggcaggccga

SEQ ID NO: 3421890 - RNA, 11 nt, Pseudomonas aeruginosa PA01
cgcggccggcg

SEQ ID NO: 3421891 - RNA, 18 nt, Pseudomonas aeruginosa PA01
cgcggccggcuucagcaa

SEQ ID NO: 3421892 - RNA, 22 nt, Pseudomonas aeruginosa PA01
cgcggccggcuucagcaacucu

SEQ ID NO: 3421893 - RNA, 14 nt, Pseudomonas aeruginosa PA01
cgcggccggcuucu

SEQ ID NO: 3421894 - RNA, 13 nt, Pseudomonas aeruginosa PA01
cgcggccggggaa

SEQ ID NO: 3421895 - RNA, 20 nt, Pseudomonas aeruginosa PA01
cgcggccguuguccagggug

SEQ ID NO: 3421896 - RNA, 14 nt, Pseudomonas aeruginosa PA01
cgcggccucgcugg

SEQ ID NO: 3421897 - RNA, 14 nt, Pseudomonas aeruginosa PA01
cgcggccugcagcg

SEQ ID NO: 3421898 - RNA, 21 nt, Pseudomonas aeruginosa PA01
cgcggccugcagcgacuccag

SEQ ID NO: 3421899 - RNA, 14 nt, Pseudomonas aeruginosa PA01
cgcggccugcgccg

SEQ ID NO: 3421900 - RNA, 15 nt, Pseudomonas aeruginosa PA01
cgcggccugcgccgg

SEQ ID NO: 3421901 - RNA, 17 nt, Pseudomonas aeruginosa PA01
cgcggccugcgccggac

SEQ ID NO: 3421902 - RNA, 18 nt, Pseudomonas aeruginosa PA01
cgcggccugcgccggacc

SEQ ID NO: 3421903 - RNA, 14 nt, Pseudomonas aeruginosa PA01
cgcggccugcucgg

SEQ ID NO: 3421904 - RNA, 16 nt, Pseudomonas aeruginosa PA01
cgcggccugcucggcu

SEQ ID NO: 3421905 - RNA, 14 nt, Pseudomonas aeruginosa PA01
cgcggccugggccg

SEQ ID NO: 3421906 - RNA, 12 nt, Pseudomonas aeruginosa PA01
cgcggccuucuc

SEQ ID NO: 3421907 - RNA, 19 nt, Pseudomonas aeruginosa PA01
cgcggccuucucgucgccg

SEQ ID NO: 3421908 - RNA, 20 nt, Pseudomonas aeruginosa PA01
cgcggccuucucgucgccgc

SEQ ID NO: 3421909 - RNA, 22 nt, Pseudomonas aeruginosa PA01
cgcggccuucucgucgccgccc

SEQ ID NO: 3421910 - RNA, 15 nt, Pseudomonas aeruginosa PA01
cgcggcgaagcgcuc

SEQ ID NO: 3421911 - RNA, 20 nt, Pseudomonas aeruginosa PA01
cgcggcgaagcgcucgacau

SEQ ID NO: 3421912 - RNA, 19 nt, Pseudomonas aeruginosa PA01
cgcggcgaagcguugcagc

SEQ ID NO: 3421913 - RNA, 15 nt, Pseudomonas aeruginosa PA01
cgcggcgaagggcgc

SEQ ID NO: 3421914 - RNA, 22 nt, Pseudomonas aeruginosa PA01
cgcggcgaagggcgcuucggcg

SEQ ID NO: 3421915 - RNA, 16 nt, Pseudomonas aeruginosa PA01
cgcggcgaagguggcg

SEQ ID NO: 3421916 - RNA, 21 nt, Pseudomonas aeruginosa PA01
cgcggcgacagcaccacgccg

SEQ ID NO: 3421917 - RNA, 14 nt, Pseudomonas aeruginosa PA01
cgcggcgaccagcg

SEQ ID NO: 3421918 - RNA, 17 nt, Pseudomonas aeruginosa PA01
cgcggcgaccagcgcgg

SEQ ID NO: 3421919 - RNA, 13 nt, Pseudomonas aeruginosa PA01
cgcggcgacgauc

SEQ ID NO: 3421920 - RNA, 22 nt, Pseudomonas aeruginosa PA01
cgcggcgacgaucacccccagc

SEQ ID NO: 3421921 - RNA, 15 nt, Pseudomonas aeruginosa PA01
cgcggcgacggcucu

SEQ ID NO: 3421922 - RNA, 21 nt, Pseudomonas aeruginosa PA01
cgcggcgagaucuucaggccg

SEQ ID NO: 3421923 - RNA, 22 nt, Pseudomonas aeruginosa PA01
cgcggcgagaucuucaggccga

SEQ ID NO: 3421924 - RNA, 18 nt, Pseudomonas aeruginosa PA01
cgcggcgagcagcggcgc

SEQ ID NO: 3421925 - RNA, 20 nt, Pseudomonas aeruginosa PA01
cgcggcgagcaucucggcca

SEQ ID NO: 3421926 - RNA, 22 nt, Pseudomonas aeruginosa PA01
cgcggcgagcaucucggccagg

SEQ ID NO: 3421927 - RNA, 23 nt, Pseudomonas aeruginosa PA01
cgcggcgagcaucucggccaggc

SEQ ID NO: 3421928 - RNA, 23 nt, Pseudomonas aeruginosa PA01
cgcggcgagccgcgacggcugcu

SEQ ID NO: 3421929 - RNA, 20 nt, Pseudomonas aeruginosa PA01
cgcggcgaguugcgcgaggc

SEQ ID NO: 3421930 - RNA, 14 nt, Pseudomonas aeruginosa PA01
cgcggcgaugcgca

SEQ ID NO: 3421931 - RNA, 23 nt, Pseudomonas aeruginosa PA01
cgcggcgaugcgcaugcgcagcg

SEQ ID NO: 3421932 - RNA, 18 nt, Pseudomonas aeruginosa PA01
cgcggcgauggccgccag

SEQ ID NO: 3421933 - RNA, 19 nt, Pseudomonas aeruginosa PA01
cgcggcgauggccgccagc

SEQ ID NO: 3421934 - RNA, 21 nt, Pseudomonas aeruginosa PA01
cgcggcgauggccgccagcag

SEQ ID NO: 3421935 - RNA, 22 nt, Pseudomonas aeruginosa PA01
cgcggcgauggccgccagcagg

SEQ ID NO: 3421936 - RNA, 13 nt, Pseudomonas aeruginosa PA01
cgcggcgcagcgg

SEQ ID NO: 3421937 - RNA, 16 nt, Pseudomonas aeruginosa PA01
cgcggcgcagcggcga

SEQ ID NO: 3421938 - RNA, 18 nt, Pseudomonas aeruginosa PA01
cgcggcgcagcggcgaac

SEQ ID NO: 3421939 - RNA, 14 nt, Pseudomonas aeruginosa PA01
cgcggcgcagcuuc

SEQ ID NO: 3421940 - RNA, 13 nt, Pseudomonas aeruginosa PA01
cgcggcgcaggcg

SEQ ID NO: 3421941 - RNA, 15 nt, Pseudomonas aeruginosa PA01
cgcggcgcaggcgau

SEQ ID NO: 3421942 - RNA, 14 nt, Pseudomonas aeruginosa PA01
cgcggcgcaggcug

SEQ ID NO: 3421943 - RNA, 20 nt, Pseudomonas aeruginosa PA01
cgcggcgcaggcugucggcc

SEQ ID NO: 3421944 - RNA, 21 nt, Pseudomonas aeruginosa PA01
cgcggcgcaggcugucggcca

SEQ ID NO: 3421945 - RNA, 15 nt, Pseudomonas aeruginosa PA01
cgcggcgcaguucgu

SEQ ID NO: 3421946 - RNA, 18 nt, Pseudomonas aeruginosa PA01
cgcggcgcaguucgucga

SEQ ID NO: 3421947 - RNA, 18 nt, Pseudomonas aeruginosa PA01
cgcggcgccacgcucacc

SEQ ID NO: 3421948 - RNA, 19 nt, Pseudomonas aeruginosa PA01
cgcggcgccacgcucaccg

SEQ ID NO: 3421949 - RNA, 14 nt, Pseudomonas aeruginosa PA01
cgcggcgccagcgc

SEQ ID NO: 3421950 - RNA, 15 nt, Pseudomonas aeruginosa PA01
cgcggcgccagcgcc

SEQ ID NO: 3421951 - RNA, 16 nt, Pseudomonas aeruginosa PA01
cgcggcgccagcgccc

SEQ ID NO: 3421952 - RNA, 18 nt, Pseudomonas aeruginosa PA01
cgcggcgccccaggcgcc

SEQ ID NO: 3421953 - RNA, 20 nt, Pseudomonas aeruginosa PA01
cgcggcgccccaggcgccca

SEQ ID NO: 3421954 - RNA, 12 nt, Pseudomonas aeruginosa PA01
cgcggcgccccg

SEQ ID NO: 3421955 - RNA, 15 nt, Pseudomonas aeruginosa PA01
cgcggcgccccgucc

SEQ ID NO: 3421956 - RNA, 13 nt, Pseudomonas aeruginosa PA01
cgcggcgcccugc

SEQ ID NO: 3421957 - RNA, 15 nt, Pseudomonas aeruginosa PA01
cgcggcgcccugccg

SEQ ID NO: 3421958 - RNA, 17 nt, Pseudomonas aeruginosa PA01
cgcggcgcccugccggg

SEQ ID NO: 3421959 - RNA, 13 nt, Pseudomonas aeruginosa PA01
cgcggcgcgagau

SEQ ID NO: 3421960 - RNA, 18 nt, Pseudomonas aeruginosa PA01
cgcggcgcgauauccgcc

SEQ ID NO: 3421961 - RNA, 21 nt, Pseudomonas aeruginosa PA01
cgcggcgcgauauccgccagg

SEQ ID NO: 3421962 - RNA, 20 nt, Pseudomonas aeruginosa PA01
cgcggcgcggacauggcgcu

SEQ ID NO: 3421963 - RNA, 12 nt, Pseudomonas aeruginosa PA01
cgcggcgcggcg

SEQ ID NO: 3421964 - RNA, 14 nt, Pseudomonas aeruginosa PA01
cgcggcgcggcggg

SEQ ID NO: 3421965 - RNA, 16 nt, Pseudomonas aeruginosa PA01
cgcggcgcguaggcga

SEQ ID NO: 3421966 - RNA, 15 nt, Pseudomonas aeruginosa PA01
cgcggcgcguuccgg

SEQ ID NO: 3421967 - RNA, 20 nt, Pseudomonas aeruginosa PA01
cgcggcgcguuccgggucgc

SEQ ID NO: 3421968 - RNA, 22 nt, Pseudomonas aeruginosa PA01
cgcggcgcguuccgggucgcug

SEQ ID NO: 3421969 - RNA, 16 nt, Pseudomonas aeruginosa PA01
cgcggcgcuccaggcg

SEQ ID NO: 3421970 - RNA, 14 nt, Pseudomonas aeruginosa PA01
cgcggcgcucgagg

SEQ ID NO: 3421971 - RNA, 15 nt, Pseudomonas aeruginosa PA01
cgcggcgcucggcau

SEQ ID NO: 3421972 - RNA, 19 nt, Pseudomonas aeruginosa PA01
cgcggcgcucggcaucgac

SEQ ID NO: 3421973 - RNA, 15 nt, Pseudomonas aeruginosa PA01
cgcggcgcucgucgg

SEQ ID NO: 3421974 - RNA, 16 nt, Pseudomonas aeruginosa PA01
cgcggcgcuuggcgaa

SEQ ID NO: 3421975 - RNA, 22 nt, Pseudomonas aeruginosa PA01
cgcggcggaagaauaccgccag

SEQ ID NO: 3421976 - RNA, 20 nt, Pseudomonas aeruginosa PA01
cgcggcggacaggcagccgg

SEQ ID NO: 3421977 - RNA, 22 nt, Pseudomonas aeruginosa PA01
cgcggcggacaggcagccggcc

SEQ ID NO: 3421978 - RNA, 18 nt, Pseudomonas aeruginosa PA01
cgcggcggaugccggcgc

SEQ ID NO: 3421979 - RNA, 15 nt, Pseudomonas aeruginosa PA01
cgcggcggccgccuc

SEQ ID NO: 3421980 - RNA, 13 nt, Pseudomonas aeruginosa PA01
cgcggcggcgcgg

SEQ ID NO: 3421981 - RNA, 16 nt, Pseudomonas aeruginosa PA01
cgcggcggcgcggaga

SEQ ID NO: 3421982 - RNA, 17 nt, Pseudomonas aeruginosa PA01
cgcggcggcgcggagau

SEQ ID NO: 3421983 - RNA, 15 nt, Pseudomonas aeruginosa PA01
cgcggcggcgcgucg

SEQ ID NO: 3421984 - RNA, 16 nt, Pseudomonas aeruginosa PA01
cgcggcggcggacagc

SEQ ID NO: 3421985 - RNA, 12 nt, Pseudomonas aeruginosa PA01
cgcggcggcggc

SEQ ID NO: 3421986 - RNA, 13 nt, Pseudomonas aeruginosa PA01
cgcggcggcggcc

SEQ ID NO: 3421987 - RNA, 14 nt, Pseudomonas aeruginosa PA01
cgcggcggcggcca

SEQ ID NO: 3421988 - RNA, 15 nt, Pseudomonas aeruginosa PA01
cgcggcggcggccag

SEQ ID NO: 3421989 - RNA, 17 nt, Pseudomonas aeruginosa PA01
cgcggcggcggccagca

SEQ ID NO: 3421990 - RNA, 21 nt, Pseudomonas aeruginosa PA01
cgcggcggcggccgcaugccg

SEQ ID NO: 3421991 - RNA, 20 nt, Pseudomonas aeruginosa PA01
cgcggcggcgugcaggccga

SEQ ID NO: 3421992 - RNA, 23 nt, Pseudomonas aeruginosa PA01
cgcggcggguaguguuugcgcag

SEQ ID NO: 3421993 - RNA, 13 nt, Pseudomonas aeruginosa PA01
cgcggcggugcag

SEQ ID NO: 3421994 - RNA, 17 nt, Pseudomonas aeruginosa PA01
cgcggcguaaucgcgcc

SEQ ID NO: 3421995 - RNA, 19 nt, Pseudomonas aeruginosa PA01
cgcggcguaaucgcgccag

SEQ ID NO: 3421996 - RNA, 21 nt, Pseudomonas aeruginosa PA01
cgcggcguaaucgcgccaggc

SEQ ID NO: 3421997 - RNA, 17 nt, Pseudomonas aeruginosa PA01
cgcggcguaccagccgc

SEQ ID NO: 3421998 - RNA, 19 nt, Pseudomonas aeruginosa PA01
cgcggcguaccagccgcgg

SEQ ID NO: 3421999 - RNA, 17 nt, Pseudomonas aeruginosa PA01
cgcggcguaccuucgag

SEQ ID NO: 3422000 - RNA, 15 nt, Pseudomonas aeruginosa PA01
cgcggcguaggcgcg

SEQ ID NO: 3422001 - RNA, 17 nt, Pseudomonas aeruginosa PA01
cgcggcguaggcgcgcc

SEQ ID NO: 3422002 - RNA, 14 nt, Pseudomonas aeruginosa PA01
cgcggcguaggcgg

SEQ ID NO: 3422003 - RNA, 16 nt, Pseudomonas aeruginosa PA01
cgcggcguaggcggug

SEQ ID NO: 3422004 - RNA, 12 nt, Pseudomonas aeruginosa PA01
cgcggcgucgac

SEQ ID NO: 3422005 - RNA, 17 nt, Pseudomonas aeruginosa PA01
cgcggcgucggcgaagc

SEQ ID NO: 3422006 - RNA, 19 nt, Pseudomonas aeruginosa PA01
cgcggcguggccggcgacc

SEQ ID NO: 3422007 - RNA, 15 nt, Pseudomonas aeruginosa PA01
cgcggcguggcggaa

SEQ ID NO: 3422008 - RNA, 19 nt, Pseudomonas aeruginosa PA01
cgcggcguuagccgccugc

SEQ ID NO: 3422009 - RNA, 23 nt, Pseudomonas aeruginosa PA01
cgcggcguuagccgccugcggcg

SEQ ID NO: 3422010 - RNA, 21 nt, Pseudomonas aeruginosa PA01
cgcggcguucaucgcucaugu

SEQ ID NO: 3422011 - RNA, 17 nt, Pseudomonas aeruginosa PA01
cgcggcguucgcccugc

SEQ ID NO: 3422012 - RNA, 16 nt, Pseudomonas aeruginosa PA01
cgcggcguuguaggaa

SEQ ID NO: 3422013 - RNA, 18 nt, Pseudomonas aeruginosa PA01
cgcggcguugucggccag

SEQ ID NO: 3422014 - RNA, 20 nt, Pseudomonas aeruginosa PA01
cgcggcguugucggccagca

SEQ ID NO: 3422015 - RNA, 21 nt, Pseudomonas aeruginosa PA01
cgcggcguugucggccagcag

SEQ ID NO: 3422016 - RNA, 22 nt, Pseudomonas aeruginosa PA01
cgcggcuacccucuccccaacc

SEQ ID NO: 3422017 - RNA, 20 nt, Pseudomonas aeruginosa PA01
cgcggcuaucgaucacugcc

SEQ ID NO: 3422018 - RNA, 23 nt, Pseudomonas aeruginosa PA01
cgcggcucaccgagaaccaguac

SEQ ID NO: 3422019 - RNA, 13 nt, Pseudomonas aeruginosa PA01
cgcggcuccagcc

SEQ ID NO: 3422020 - RNA, 16 nt, Pseudomonas aeruginosa PA01
cgcggcuccagccgcu

SEQ ID NO: 3422021 - RNA, 12 nt, Pseudomonas aeruginosa PA01
cgcggcucggcg

SEQ ID NO: 3422022 - RNA, 15 nt, Pseudomonas aeruginosa PA01
cgcggcucggcgggc

SEQ ID NO: 3422023 - RNA, 16 nt, Pseudomonas aeruginosa PA01
cgcggcucgggcggca

SEQ ID NO: 3422024 - RNA, 17 nt, Pseudomonas aeruginosa PA01
cgcggcucgggcggcaa

SEQ ID NO: 3422025 - RNA, 13 nt, Pseudomonas aeruginosa PA01
cgcggcucgggga

SEQ ID NO: 3422026 - RNA, 17 nt, Pseudomonas aeruginosa PA01
cgcggcucuggcgcagg

SEQ ID NO: 3422027 - RNA, 20 nt, Pseudomonas aeruginosa PA01
cgcggcugaagaagcugccc

SEQ ID NO: 3422028 - RNA, 15 nt, Pseudomonas aeruginosa PA01
cgcggcugaaggccg

SEQ ID NO: 3422029 - RNA, 21 nt, Pseudomonas aeruginosa PA01
cgcggcugacgaaguccuugu

SEQ ID NO: 3422030 - RNA, 21 nt, Pseudomonas aeruginosa PA01
cgcggcugacgaagugaugga

SEQ ID NO: 3422031 - RNA, 21 nt, Pseudomonas aeruginosa PA01
cgcggcugaucggccgccagu

SEQ ID NO: 3422032 - RNA, 17 nt, Pseudomonas aeruginosa PA01
cgcggcugaugccgcgg

SEQ ID NO: 3422033 - RNA, 21 nt, Pseudomonas aeruginosa PA01
cgcggcugaugccgcgguagg

SEQ ID NO: 3422034 - RNA, 16 nt, Pseudomonas aeruginosa PA01
cgcggcugcgcgccgg

SEQ ID NO: 3422035 - RNA, 22 nt, Pseudomonas aeruginosa PA01
cgcggcugcuugccgcucaggc

SEQ ID NO: 3422036 - RNA, 15 nt, Pseudomonas aeruginosa PA01
cgcggcuggaagucg

SEQ ID NO: 3422037 - RNA, 17 nt, Pseudomonas aeruginosa PA01
cgcggcuggaagucgcc

SEQ ID NO: 3422038 - RNA, 18 nt, Pseudomonas aeruginosa PA01
cgcggcuggcaggugccg

SEQ ID NO: 3422039 - RNA, 15 nt, Pseudomonas aeruginosa PA01
cgcggcuggccaucc

SEQ ID NO: 3422040 - RNA, 20 nt, Pseudomonas aeruginosa PA01
cgcggcuggccauccgcccu

SEQ ID NO: 3422041 - RNA, 22 nt, Pseudomonas aeruginosa PA01
cgcggcuggccgccucgcgccg

SEQ ID NO: 3422042 - RNA, 21 nt, Pseudomonas aeruginosa PA01
cgcggcuggccgccuggccgg

SEQ ID NO: 3422043 - RNA, 16 nt, Pseudomonas aeruginosa PA01
cgcggcuggcugcccu

SEQ ID NO: 3422044 - RNA, 15 nt, Pseudomonas aeruginosa PA01
cgcggcuucggucag

SEQ ID NO: 3422045 - RNA, 19 nt, Pseudomonas aeruginosa PA01
cgcggcuucggucaggugg

SEQ ID NO: 3422046 - RNA, 17 nt, Pseudomonas aeruginosa PA01
cgcggcuugccggcgcg

SEQ ID NO: 3422047 - RNA, 18 nt, Pseudomonas aeruginosa PA01
cgcggcuugccggcgcgc

SEQ ID NO: 3422048 - RNA, 21 nt, Pseudomonas aeruginosa PA01
cgcggcuugccggcgcgcggu

SEQ ID NO: 3422049 - RNA, 19 nt, Pseudomonas aeruginosa PA01
cgcggcuuucuuccagcac

SEQ ID NO: 3422050 - RNA, 22 nt, Pseudomonas aeruginosa PA01
cgcggcuuucuuccagcacgcg

SEQ ID NO: 3422051 - RNA, 15 nt, Pseudomonas aeruginosa PA01
cgcgggacgccgcag

SEQ ID NO: 3422052 - RNA, 14 nt, Pseudomonas aeruginosa PA01
cgcgggacgcggcg

SEQ ID NO: 3422053 - RNA, 17 nt, Pseudomonas aeruginosa PA01
cgcgggacgcguucccc

SEQ ID NO: 3422054 - RNA, 20 nt, Pseudomonas aeruginosa PA01
cgcgggacuuguacucgccg

SEQ ID NO: 3422055 - RNA, 17 nt, Pseudomonas aeruginosa PA01
cgcgggaggccgccucg

SEQ ID NO: 3422056 - RNA, 18 nt, Pseudomonas aeruginosa PA01
cgcgggaggccgccucga

SEQ ID NO: 3422057 - RNA, 20 nt, Pseudomonas aeruginosa PA01
cgcgggaggccgccucgacc

SEQ ID NO: 3422058 - RNA, 19 nt, Pseudomonas aeruginosa PA01
cgcgggauaaacggcggau

SEQ ID NO: 3422059 - RNA, 18 nt, Pseudomonas aeruginosa PA01
cgcgggauagacggcgga

SEQ ID NO: 3422060 - RNA, 17 nt, Pseudomonas aeruginosa PA01
cgcgggcaaccgcggcg

SEQ ID NO: 3422061 - RNA, 18 nt, Pseudomonas aeruginosa PA01
cgcgggcaaccgcggcgg

SEQ ID NO: 3422062 - RNA, 20 nt, Pseudomonas aeruginosa PA01
cgcgggcaaccgcggcggcc

SEQ ID NO: 3422063 - RNA, 17 nt, Pseudomonas aeruginosa PA01
cgcgggcagcagucgca

SEQ ID NO: 3422064 - RNA, 18 nt, Pseudomonas aeruginosa PA01
cgcgggcagcagucgcag

SEQ ID NO: 3422065 - RNA, 18 nt, Pseudomonas aeruginosa PA01
cgcgggcaugcaccuacc

SEQ ID NO: 3422066 - RNA, 18 nt, Pseudomonas aeruginosa PA01
cgcgggcaugcugcucgg

SEQ ID NO: 3422067 - RNA, 14 nt, Pseudomonas aeruginosa PA01
cgcgggccaggccc

SEQ ID NO: 3422068 - RNA, 15 nt, Pseudomonas aeruginosa PA01
cgcgggccaggcccu

SEQ ID NO: 3422069 - RNA, 15 nt, Pseudomonas aeruginosa PA01
cgcgggccaggccga

SEQ ID NO: 3422070 - RNA, 13 nt, Pseudomonas aeruginosa PA01
cgcgggccgacgg

SEQ ID NO: 3422071 - RNA, 17 nt, Pseudomonas aeruginosa PA01
cgcgggccgacggcccu

SEQ ID NO: 3422072 - RNA, 19 nt, Pseudomonas aeruginosa PA01
cgcgggccgccuggucggg

SEQ ID NO: 3422073 - RNA, 18 nt, Pseudomonas aeruginosa PA01
cgcgggccgcggcgacca

SEQ ID NO: 3422074 - RNA, 18 nt, Pseudomonas aeruginosa PA01
cgcgggcgaacggcagcg

SEQ ID NO: 3422075 - RNA, 20 nt, Pseudomonas aeruginosa PA01
cgcgggcgaacggcagcguc

SEQ ID NO: 3422076 - RNA, 21 nt, Pseudomonas aeruginosa PA01
cgcgggcgaacggcagcgucu

SEQ ID NO: 3422077 - RNA, 22 nt, Pseudomonas aeruginosa PA01
cgcgggcgaagcgcagcuccgg

SEQ ID NO: 3422078 - RNA, 21 nt, Pseudomonas aeruginosa PA01
cgcgggcgaaggccucgucga

SEQ ID NO: 3422079 - RNA, 12 nt, Pseudomonas aeruginosa PA01
cgcgggcgaggu

SEQ ID NO: 3422080 - RNA, 21 nt, Pseudomonas aeruginosa PA01
cgcgggcgaggucgccacgca

SEQ ID NO: 3422081 - RNA, 22 nt, Pseudomonas aeruginosa PA01
cgcgggcgauggcccguuccac

SEQ ID NO: 3422082 - RNA, 15 nt, Pseudomonas aeruginosa PA01
cgcgggcgccgaugc

SEQ ID NO: 3422083 - RNA, 12 nt, Pseudomonas aeruginosa PA01
cgcgggcgcgca

SEQ ID NO: 3422084 - RNA, 13 nt, Pseudomonas aeruginosa PA01
cgcgggcgcgcag

SEQ ID NO: 3422085 - RNA, 14 nt, Pseudomonas aeruginosa PA01
cgcgggcgcgcagc

SEQ ID NO: 3422086 - RNA, 17 nt, Pseudomonas aeruginosa PA01
cgcgggcgcgcagcagg

SEQ ID NO: 3422087 - RNA, 18 nt, Pseudomonas aeruginosa PA01
cgcgggcgcgcagcaggu

SEQ ID NO: 3422088 - RNA, 17 nt, Pseudomonas aeruginosa PA01
cgcgggcgcuaugcgcc

SEQ ID NO: 3422089 - RNA, 22 nt, Pseudomonas aeruginosa PA01
cgcgggcggccucgauggcggc

SEQ ID NO: 3422090 - RNA, 19 nt, Pseudomonas aeruginosa PA01
cgcgggcgugcuccagcac

SEQ ID NO: 3422091 - RNA, 21 nt, Pseudomonas aeruginosa PA01
cgcgggcgugcuccagcaccg

SEQ ID NO: 3422092 - RNA, 18 nt, Pseudomonas aeruginosa PA01
cgcgggcguugcgcgccu

SEQ ID NO: 3422093 - RNA, 23 nt, Pseudomonas aeruginosa PA01
cgcgggcguugcgcgccucgccc

SEQ ID NO: 3422094 - RNA, 14 nt, Pseudomonas aeruginosa PA01
cgcgggcuauuccc

SEQ ID NO: 3422095 - RNA, 18 nt, Pseudomonas aeruginosa PA01
cgcgggcuauucccgccg

SEQ ID NO: 3422096 - RNA, 20 nt, Pseudomonas aeruginosa PA01
cgcgggcuauucccgccgcu

SEQ ID NO: 3422097 - RNA, 16 nt, Pseudomonas aeruginosa PA01
cgcgggcucaggcucu

SEQ ID NO: 3422098 - RNA, 12 nt, Pseudomonas aeruginosa PA01
cgcgggcugccc

SEQ ID NO: 3422099 - RNA, 21 nt, Pseudomonas aeruginosa PA01
cgcggggcgaggucggccugc

SEQ ID NO: 3422100 - RNA, 17 nt, Pseudomonas aeruginosa PA01
cgcgggggcucggucga

SEQ ID NO: 3422101 - RNA, 19 nt, Pseudomonas aeruginosa PA01
cgcgggggcucggucgagc

SEQ ID NO: 3422102 - RNA, 22 nt, Pseudomonas aeruginosa PA01
cgcgggggucggaugcagcgcu

SEQ ID NO: 3422103 - RNA, 17 nt, Pseudomonas aeruginosa PA01
cgcgggguagggguggc

SEQ ID NO: 3422104 - RNA, 19 nt, Pseudomonas aeruginosa PA01
cgcgggguagggguggcca

SEQ ID NO: 3422105 - RNA, 16 nt, Pseudomonas aeruginosa PA01
cgcggggucuggccgg

SEQ ID NO: 3422106 - RNA, 19 nt, Pseudomonas aeruginosa PA01
cgcggggucuggccggcga

SEQ ID NO: 3422107 - RNA, 19 nt, Pseudomonas aeruginosa PA01
cgcggguaucgauccagcc

SEQ ID NO: 3422108 - RNA, 15 nt, Pseudomonas aeruginosa PA01
cgcgggucaccagcg

SEQ ID NO: 3422109 - RNA, 16 nt, Pseudomonas aeruginosa PA01
cgcgggucaccagcgc

SEQ ID NO: 3422110 - RNA, 17 nt, Pseudomonas aeruginosa PA01
cgcgggucaccagcggg

SEQ ID NO: 3422111 - RNA, 18 nt, Pseudomonas aeruginosa PA01
cgcgggucguacaccgcg

SEQ ID NO: 3422112 - RNA, 19 nt, Pseudomonas aeruginosa PA01
cgcgggucguacaccgcgc

SEQ ID NO: 3422113 - RNA, 16 nt, Pseudomonas aeruginosa PA01
cgcgggucguccucca

SEQ ID NO: 3422114 - RNA, 14 nt, Pseudomonas aeruginosa PA01
cgcgggucgucgau

SEQ ID NO: 3422115 - RNA, 20 nt, Pseudomonas aeruginosa PA01
cgcgggucucgaucagcgcc

SEQ ID NO: 3422116 - RNA, 13 nt, Pseudomonas aeruginosa PA01
cgcgggucugcuc

SEQ ID NO: 3422117 - RNA, 15 nt, Pseudomonas aeruginosa PA01
cgcgggucugcucgc

SEQ ID NO: 3422118 - RNA, 16 nt, Pseudomonas aeruginosa PA01
cgcgggucugcucggc

SEQ ID NO: 3422119 - RNA, 20 nt, Pseudomonas aeruginosa PA01
cgcgggucugcucggcgccc

SEQ ID NO: 3422120 - RNA, 19 nt, Pseudomonas aeruginosa PA01
cgcgggucuucaggccgca

SEQ ID NO: 3422121 - RNA, 22 nt, Pseudomonas aeruginosa PA01
cgcgggucuugccggucugcug

SEQ ID NO: 3422122 - RNA, 21 nt, Pseudomonas aeruginosa PA01
cgcgggucuugcgcagggcgg

SEQ ID NO: 3422123 - RNA, 20 nt, Pseudomonas aeruginosa PA01
cgcgggugcggcuggcgcgc

SEQ ID NO: 3422124 - RNA, 19 nt, Pseudomonas aeruginosa PA01
cgcggguuacuucgccgau

SEQ ID NO: 3422125 - RNA, 20 nt, Pseudomonas aeruginosa PA01
cgcggguuacuucgccgauc

SEQ ID NO: 3422126 - RNA, 18 nt, Pseudomonas aeruginosa PA01
cgcggguuccucacggcg

SEQ ID NO: 3422127 - RNA, 20 nt, Pseudomonas aeruginosa PA01
cgcggguuccucacggcgca

SEQ ID NO: 3422128 - RNA, 22 nt, Pseudomonas aeruginosa PA01
cgcggguuccucacggcgcagc

SEQ ID NO: 3422129 - RNA, 21 nt, Pseudomonas aeruginosa PA01
cgcggguucgagucccguccg

SEQ ID NO: 3422130 - RNA, 18 nt, Pseudomonas aeruginosa PA01
cgcggguugcccggcucc

SEQ ID NO: 3422131 - RNA, 17 nt, Pseudomonas aeruginosa PA01
cgcggguuucgcugccc

SEQ ID NO: 3422132 - RNA, 14 nt, Pseudomonas aeruginosa PA01
cgcgguacagccgg

SEQ ID NO: 3422133 - RNA, 16 nt, Pseudomonas aeruginosa PA01
cgcgguagacgcaggg

SEQ ID NO: 3422134 - RNA, 21 nt, Pseudomonas aeruginosa PA01
cgcgguagcugcgcagggcgc

SEQ ID NO: 3422135 - RNA, 17 nt, Pseudomonas aeruginosa PA01
cgcgguaggccagcucc

SEQ ID NO: 3422136 - RNA, 21 nt, Pseudomonas aeruginosa PA01
cgcgguaucccuggaacuagc

SEQ ID NO: 3422137 - RNA, 22 nt, Pseudomonas aeruginosa PA01
cgcgguaucccuggaacuagcc

SEQ ID NO: 3422138 - RNA, 20 nt, Pseudomonas aeruginosa PA01
cgcgguauucuccagcaggc

SEQ ID NO: 3422139 - RNA, 14 nt, Pseudomonas aeruginosa PA01
cgcggucaccaggg

SEQ ID NO: 3422140 - RNA, 22 nt, Pseudomonas aeruginosa PA01
cgcggucaccagggucacgccg

SEQ ID NO: 3422141 - RNA, 23 nt, Pseudomonas aeruginosa PA01
cgcggucacccauucgaugccgc

SEQ ID NO: 3422142 - RNA, 21 nt, Pseudomonas aeruginosa PA01
cgcggucacucggccucggcg

SEQ ID NO: 3422143 - RNA, 18 nt, Pseudomonas aeruginosa PA01
cgcggucauccgcccugc

SEQ ID NO: 3422144 - RNA, 16 nt, Pseudomonas aeruginosa PA01
cgcggucaucgccggc

SEQ ID NO: 3422145 - RNA, 18 nt, Pseudomonas aeruginosa PA01
cgcggucaucgccggcgc

SEQ ID NO: 3422146 - RNA, 20 nt, Pseudomonas aeruginosa PA01
cgcggucaucgccggcgccg

SEQ ID NO: 3422147 - RNA, 13 nt, Pseudomonas aeruginosa PA01
cgcggucgagcag

SEQ ID NO: 3422148 - RNA, 16 nt, Pseudomonas aeruginosa PA01
cgcggucgagcagcgc

SEQ ID NO: 3422149 - RNA, 17 nt, Pseudomonas aeruginosa PA01
cgcggucgagcagcgcc

SEQ ID NO: 3422150 - RNA, 17 nt, Pseudomonas aeruginosa PA01
cgcggucgagcucggcc

SEQ ID NO: 3422151 - RNA, 18 nt, Pseudomonas aeruginosa PA01
cgcggucgagcucggcca

SEQ ID NO: 3422152 - RNA, 19 nt, Pseudomonas aeruginosa PA01
cgcggucgaugucgcggcc

SEQ ID NO: 3422153 - RNA, 20 nt, Pseudomonas aeruginosa PA01
cgcggucgaugucgcggccc

SEQ ID NO: 3422154 - RNA, 15 nt, Pseudomonas aeruginosa PA01
cgcggucgggcagau

SEQ ID NO: 3422155 - RNA, 14 nt, Pseudomonas aeruginosa PA01
cgcggucggugagc

SEQ ID NO: 3422156 - RNA, 21 nt, Pseudomonas aeruginosa PA01
cgcggucggugagcacgccgc

SEQ ID NO: 3422157 - RNA, 16 nt, Pseudomonas aeruginosa PA01
cgcggucuucaucacc

SEQ ID NO: 3422158 - RNA, 13 nt, Pseudomonas aeruginosa PA01
cgcggucuucccg

SEQ ID NO: 3422159 - RNA, 15 nt, Pseudomonas aeruginosa PA01
cgcggucuuccgccg

SEQ ID NO: 3422160 - RNA, 19 nt, Pseudomonas aeruginosa PA01
cgcggugacgacgugccca

SEQ ID NO: 3422161 - RNA, 14 nt, Pseudomonas aeruginosa PA01
cgcggugagcaggg

SEQ ID NO: 3422162 - RNA, 15 nt, Pseudomonas aeruginosa PA01
cgcggugagggcgac

SEQ ID NO: 3422163 - RNA, 22 nt, Pseudomonas aeruginosa PA01
cgcggugagggcgacguugcgc

SEQ ID NO: 3422164 - RNA, 19 nt, Pseudomonas aeruginosa PA01
cgcggugcaguucgccguu

SEQ ID NO: 3422165 - RNA, 19 nt, Pseudomonas aeruginosa PA01
cgcggugccauucggugcg

SEQ ID NO: 3422166 - RNA, 20 nt, Pseudomonas aeruginosa PA01
cgcggugccauucggugcgc

SEQ ID NO: 3422167 - RNA, 17 nt, Pseudomonas aeruginosa PA01
cgcggugccgccauaga

SEQ ID NO: 3422168 - RNA, 13 nt, Pseudomonas aeruginosa PA01
cgcggugccgugg

SEQ ID NO: 3422169 - RNA, 20 nt, Pseudomonas aeruginosa PA01
cgcggugccgugggucgccu

SEQ ID NO: 3422170 - RNA, 23 nt, Pseudomonas aeruginosa PA01
cgcggugccgugggucgccucga

SEQ ID NO: 3422171 - RNA, 14 nt, Pseudomonas aeruginosa PA01
cgcggugcgcgcca

SEQ ID NO: 3422172 - RNA, 14 nt, Pseudomonas aeruginosa PA01
cgcggugcgggccu

SEQ ID NO: 3422173 - RNA, 17 nt, Pseudomonas aeruginosa PA01
cgcggugggcuccagcg

SEQ ID NO: 3422174 - RNA, 14 nt, Pseudomonas aeruginosa PA01
cgcggugucggcga

SEQ ID NO: 3422175 - RNA, 14 nt, Pseudomonas aeruginosa PA01
cgcggugucggugc

SEQ ID NO: 3422176 - RNA, 16 nt, Pseudomonas aeruginosa PA01
cgcgguuauccgccgc

SEQ ID NO: 3422177 - RNA, 18 nt, Pseudomonas aeruginosa PA01
cgcgguuauccgccgccg

SEQ ID NO: 3422178 - RNA, 23 nt, Pseudomonas aeruginosa PA01
cgcgguuauccgccgccgggcuu

SEQ ID NO: 3422179 - RNA, 18 nt, Pseudomonas aeruginosa PA01
cgcgguuauccgccgcug

SEQ ID NO: 3422180 - RNA, 17 nt, Pseudomonas aeruginosa PA01
cgcgguuauccgccggc

SEQ ID NO: 3422181 - RNA, 18 nt, Pseudomonas aeruginosa PA01
cgcgguuauccgccggcu

SEQ ID NO: 3422182 - RNA, 20 nt, Pseudomonas aeruginosa PA01
cgcgguuccacucccaugcc

SEQ ID NO: 3422183 - RNA, 21 nt, Pseudomonas aeruginosa PA01
cgcgguuccacucccaugcca

SEQ ID NO: 3422184 - RNA, 14 nt, Pseudomonas aeruginosa PA01
cgcgguuccagcuc

SEQ ID NO: 3422185 - RNA, 19 nt, Pseudomonas aeruginosa PA01
cgcgguucgaggacuucau

SEQ ID NO: 3422186 - RNA, 13 nt, Pseudomonas aeruginosa PA01
cgcgguucugcuc

SEQ ID NO: 3422187 - RNA, 22 nt, Pseudomonas aeruginosa PA01
cgcgguucugcuccuggguccg

SEQ ID NO: 3422188 - RNA, 20 nt, Pseudomonas aeruginosa PA01
cgcgguugccgaagcgcucg

SEQ ID NO: 3422189 - RNA, 20 nt, Pseudomonas aeruginosa PA01
cgcgguugccgcugcggcgg

SEQ ID NO: 3422190 - RNA, 14 nt, Pseudomonas aeruginosa PA01
cgcgguugcgcugc

SEQ ID NO: 3422191 - RNA, 16 nt, Pseudomonas aeruginosa PA01
cgcgguuggcgccucg

SEQ ID NO: 3422192 - RNA, 17 nt, Pseudomonas aeruginosa PA01
cgcgguuuccgugcgga

SEQ ID NO: 3422193 - RNA, 17 nt, Pseudomonas aeruginosa PA01
cgcgguuucgcagcgcu

SEQ ID NO: 3422194 - RNA, 19 nt, Pseudomonas aeruginosa PA01
cgcgguuucuucgccuugc

SEQ ID NO: 3422195 - RNA, 21 nt, Pseudomonas aeruginosa PA01
cgcgguuucuucgccuugccc

SEQ ID NO: 3422196 - RNA, 22 nt, Pseudomonas aeruginosa PA01
cgcguaagcggccuuuucucug

SEQ ID NO: 3422197 - RNA, 18 nt, Pseudomonas aeruginosa PA01
cgcguacagcgggccggg

SEQ ID NO: 3422198 - RNA, 16 nt, Pseudomonas aeruginosa PA01
cgcguacaucccgccg

SEQ ID NO: 3422199 - RNA, 19 nt, Pseudomonas aeruginosa PA01
cgcguaccaguagcgacag

SEQ ID NO: 3422200 - RNA, 21 nt, Pseudomonas aeruginosa PA01
cgcguaccaguagcgacagca

SEQ ID NO: 3422201 - RNA, 17 nt, Pseudomonas aeruginosa PA01
cgcguacgacuucggcg

SEQ ID NO: 3422202 - RNA, 22 nt, Pseudomonas aeruginosa PA01
cgcguacgacuucggcgacagc

SEQ ID NO: 3422203 - RNA, 16 nt, Pseudomonas aeruginosa PA01
cgcguacgcccgcagc

SEQ ID NO: 3422204 - RNA, 19 nt, Pseudomonas aeruginosa PA01
cgcguacgcccgcagccac

SEQ ID NO: 3422205 - RNA, 20 nt, Pseudomonas aeruginosa PA01
cgcguacucaggccgggcgg

SEQ ID NO: 3422206 - RNA, 16 nt, Pseudomonas aeruginosa PA01
cgcguacuugccaggg

SEQ ID NO: 3422207 - RNA, 23 nt, Pseudomonas aeruginosa PA01
cgcguagaccaccucgacggcga

SEQ ID NO: 3422208 - RNA, 14 nt, Pseudomonas aeruginosa PA01
cgcguagaccaucg

SEQ ID NO: 3422209 - RNA, 17 nt, Pseudomonas aeruginosa PA01
cgcguagaccaucgccg

SEQ ID NO: 3422210 - RNA, 19 nt, Pseudomonas aeruginosa PA01
cgcguagaccaucgccggc

SEQ ID NO: 3422211 - RNA, 20 nt, Pseudomonas aeruginosa PA01
cgcguagaccaucgccggcg

SEQ ID NO: 3422212 - RNA, 21 nt, Pseudomonas aeruginosa PA01
cgcguagaccaucgccggcga

SEQ ID NO: 3422213 - RNA, 15 nt, Pseudomonas aeruginosa PA01
cgcguagccccucgc

SEQ ID NO: 3422214 - RNA, 16 nt, Pseudomonas aeruginosa PA01
cgcguagcgccaggcc

SEQ ID NO: 3422215 - RNA, 21 nt, Pseudomonas aeruginosa PA01
cgcguagcgccccuuggccag

SEQ ID NO: 3422216 - RNA, 16 nt, Pseudomonas aeruginosa PA01
cgcguagcgcuucccg

SEQ ID NO: 3422217 - RNA, 14 nt, Pseudomonas aeruginosa PA01
cgcguagcugggcg

SEQ ID NO: 3422218 - RNA, 17 nt, Pseudomonas aeruginosa PA01
cgcguaggcgaacacgu

SEQ ID NO: 3422219 - RNA, 18 nt, Pseudomonas aeruginosa PA01
cgcguaggcuuggucggg

SEQ ID NO: 3422220 - RNA, 19 nt, Pseudomonas aeruginosa PA01
cgcguagguggcgccgccg

SEQ ID NO: 3422221 - RNA, 22 nt, Pseudomonas aeruginosa PA01
cgcguagguggcgccgccggcg

SEQ ID NO: 3422222 - RNA, 19 nt, Pseudomonas aeruginosa PA01
cgcgucacucgacaggcca

SEQ ID NO: 3422223 - RNA, 22 nt, Pseudomonas aeruginosa PA01
cgcgucaucaggcucaggccgg

SEQ ID NO: 3422224 - RNA, 15 nt, Pseudomonas aeruginosa PA01
cgcgucaugccgccg

SEQ ID NO: 3422225 - RNA, 14 nt, Pseudomonas aeruginosa PA01
cgcguccaccuggc

SEQ ID NO: 3422226 - RNA, 20 nt, Pseudomonas aeruginosa PA01
cgcguccaccuggcggcuga

SEQ ID NO: 3422227 - RNA, 21 nt, Pseudomonas aeruginosa PA01
cgcguccagccgguaggggcc

SEQ ID NO: 3422228 - RNA, 12 nt, Pseudomonas aeruginosa PA01
cgcguccagcuc

SEQ ID NO: 3422229 - RNA, 14 nt, Pseudomonas aeruginosa PA01
cgcguccagcucca

SEQ ID NO: 3422230 - RNA, 15 nt, Pseudomonas aeruginosa PA01
cgcguccagcuccac

SEQ ID NO: 3422231 - RNA, 18 nt, Pseudomonas aeruginosa PA01
cgcguccagcuccaccag

SEQ ID NO: 3422232 - RNA, 20 nt, Pseudomonas aeruginosa PA01
cgcguccagcuccaccaggc

SEQ ID NO: 3422233 - RNA, 17 nt, Pseudomonas aeruginosa PA01
cgcguccauccccgccu

SEQ ID NO: 3422234 - RNA, 19 nt, Pseudomonas aeruginosa PA01
cgcguccauccccgccucg

SEQ ID NO: 3422235 - RNA, 20 nt, Pseudomonas aeruginosa PA01
cgcguccauccccgccucga

SEQ ID NO: 3422236 - RNA, 13 nt, Pseudomonas aeruginosa PA01
cgcgucccaucgg

SEQ ID NO: 3422237 - RNA, 13 nt, Pseudomonas aeruginosa PA01
cgcgucccugcac

SEQ ID NO: 3422238 - RNA, 18 nt, Pseudomonas aeruginosa PA01
cgcgucccugggcgcagg

SEQ ID NO: 3422239 - RNA, 19 nt, Pseudomonas aeruginosa PA01
cgcgucccugggcgcaggg

SEQ ID NO: 3422240 - RNA, 23 nt, Pseudomonas aeruginosa PA01
cgcgucccuuguuuuccuggccc

SEQ ID NO: 3422241 - RNA, 22 nt, Pseudomonas aeruginosa PA01
cgcguccggccagccuggccag

SEQ ID NO: 3422242 - RNA, 16 nt, Pseudomonas aeruginosa PA01
cgcguccuccuggagg

SEQ ID NO: 3422243 - RNA, 17 nt, Pseudomonas aeruginosa PA01
cgcguccuccuggagga

SEQ ID NO: 3422244 - RNA, 23 nt, Pseudomonas aeruginosa PA01
cgcguccuucuuguauaccagcg

SEQ ID NO: 3422245 - RNA, 15 nt, Pseudomonas aeruginosa PA01
cgcgucgaagccgga

SEQ ID NO: 3422246 - RNA, 16 nt, Pseudomonas aeruginosa PA01
cgcgucgaagucgauc

SEQ ID NO: 3422247 - RNA, 14 nt, Pseudomonas aeruginosa PA01
cgcgucgaccaccg

SEQ ID NO: 3422248 - RNA, 15 nt, Pseudomonas aeruginosa PA01
cgcgucgaccaccgc

SEQ ID NO: 3422249 - RNA, 14 nt, Pseudomonas aeruginosa PA01
cgcgucgcacccgg

SEQ ID NO: 3422250 - RNA, 16 nt, Pseudomonas aeruginosa PA01
cgcgucgcacccggcc

SEQ ID NO: 3422251 - RNA, 22 nt, Pseudomonas aeruginosa PA01
cgcgucgcacccggcccauggc

SEQ ID NO: 3422252 - RNA, 14 nt, Pseudomonas aeruginosa PA01
cgcgucgcaggcga

SEQ ID NO: 3422253 - RNA, 12 nt, Pseudomonas aeruginosa PA01
cgcgucgccgaa

SEQ ID NO: 3422254 - RNA, 12 nt, Pseudomonas aeruginosa PA01
cgcgucgccgcc

SEQ ID NO: 3422255 - RNA, 13 nt, Pseudomonas aeruginosa PA01
cgcgucgccgcca

SEQ ID NO: 3422256 - RNA, 13 nt, Pseudomonas aeruginosa PA01
cgcgucgccuucg

SEQ ID NO: 3422257 - RNA, 21 nt, Pseudomonas aeruginosa PA01
cgcgucgcggccucuucgucg

SEQ ID NO: 3422258 - RNA, 21 nt, Pseudomonas aeruginosa PA01
cgcgucgcucauccgcgaggc

SEQ ID NO: 3422259 - RNA, 13 nt, Pseudomonas aeruginosa PA01
cgcgucgcugcgc

SEQ ID NO: 3422260 - RNA, 16 nt, Pseudomonas aeruginosa PA01
cgcgucggcacgccga

SEQ ID NO: 3422261 - RNA, 19 nt, Pseudomonas aeruginosa PA01
cgcgucgggaaaggccgcc

SEQ ID NO: 3422262 - RNA, 15 nt, Pseudomonas aeruginosa PA01
cgcgucggugccgcc

SEQ ID NO: 3422263 - RNA, 17 nt, Pseudomonas aeruginosa PA01
cgcgucggugccgcccg

SEQ ID NO: 3422264 - RNA, 21 nt, Pseudomonas aeruginosa PA01
cgcgucggugccgcccggcgc

SEQ ID NO: 3422265 - RNA, 19 nt, Pseudomonas aeruginosa PA01
cgcgucguauaggcgcugg

SEQ ID NO: 3422266 - RNA, 22 nt, Pseudomonas aeruginosa PA01
cgcgucguauaggcgcuggugc

SEQ ID NO: 3422267 - RNA, 17 nt, Pseudomonas aeruginosa PA01
cgcgucguccagggcgc

SEQ ID NO: 3422268 - RNA, 16 nt, Pseudomonas aeruginosa PA01
cgcgucguccgaggcg

SEQ ID NO: 3422269 - RNA, 14 nt, Pseudomonas aeruginosa PA01
cgcgucgucggcga

SEQ ID NO: 3422270 - RNA, 15 nt, Pseudomonas aeruginosa PA01
cgcgucgucggcgac

SEQ ID NO: 3422271 - RNA, 20 nt, Pseudomonas aeruginosa PA01
cgcgucgucggcgacgcuga

SEQ ID NO: 3422272 - RNA, 18 nt, Pseudomonas aeruginosa PA01
cgcgucuccagcucggcg

SEQ ID NO: 3422273 - RNA, 14 nt, Pseudomonas aeruginosa PA01
cgcgucuccaugcg

SEQ ID NO: 3422274 - RNA, 19 nt, Pseudomonas aeruginosa PA01
cgcgucugaacgaagaagc

SEQ ID NO: 3422275 - RNA, 23 nt, Pseudomonas aeruginosa PA01
cgcgucugaacgaagaagccggc

SEQ ID NO: 3422276 - RNA, 21 nt, Pseudomonas aeruginosa PA01
cgcgugaagcuggagcagcag

SEQ ID NO: 3422277 - RNA, 19 nt, Pseudomonas aeruginosa PA01
cgcgugcaggcgcccuggc

SEQ ID NO: 3422278 - RNA, 13 nt, Pseudomonas aeruginosa PA01
cgcgugcgcgccg

SEQ ID NO: 3422279 - RNA, 15 nt, Pseudomonas aeruginosa PA01
cgcgugcgcgccgcc

SEQ ID NO: 3422280 - RNA, 19 nt, Pseudomonas aeruginosa PA01
cgcgugcgcugguaccugc

SEQ ID NO: 3422281 - RNA, 18 nt, Pseudomonas aeruginosa PA01
cgcgugcuccgugucggc

SEQ ID NO: 3422282 - RNA, 20 nt, Pseudomonas aeruginosa PA01
cgcgugcuccgugucggcgg

SEQ ID NO: 3422283 - RNA, 21 nt, Pseudomonas aeruginosa PA01
cgcgugcuccgugucggcggc

SEQ ID NO: 3422284 - RNA, 15 nt, Pseudomonas aeruginosa PA01
cgcgugcuggugccg

SEQ ID NO: 3422285 - RNA, 16 nt, Pseudomonas aeruginosa PA01
cgcguggcccggcgcg

SEQ ID NO: 3422286 - RNA, 17 nt, Pseudomonas aeruginosa PA01
cgcguggcccggcgcgg

SEQ ID NO: 3422287 - RNA, 14 nt, Pseudomonas aeruginosa PA01
cgcguggccgccag

SEQ ID NO: 3422288 - RNA, 16 nt, Pseudomonas aeruginosa PA01
cgcguggcgucggcgc

SEQ ID NO: 3422289 - RNA, 17 nt, Pseudomonas aeruginosa PA01
cgcguggcgugcucggc

SEQ ID NO: 3422290 - RNA, 19 nt, Pseudomonas aeruginosa PA01
cgcguggcgugcucggcga

SEQ ID NO: 3422291 - RNA, 21 nt, Pseudomonas aeruginosa PA01
cgcguggcgugcucggcgauc

SEQ ID NO: 3422292 - RNA, 22 nt, Pseudomonas aeruginosa PA01
cgcguggcuucguccagcgagg

SEQ ID NO: 3422293 - RNA, 22 nt, Pseudomonas aeruginosa PA01
cgcgugggauucagugggucga

SEQ ID NO: 3422294 - RNA, 12 nt, Pseudomonas aeruginosa PA01
cgcgugggccac

SEQ ID NO: 3422295 - RNA, 13 nt, Pseudomonas aeruginosa PA01
cgcgugggccagg

SEQ ID NO: 3422296 - RNA, 17 nt, Pseudomonas aeruginosa PA01
cgcgugggcuucgccgc

SEQ ID NO: 3422297 - RNA, 19 nt, Pseudomonas aeruginosa PA01
cgcgugggcuucgccgccg

SEQ ID NO: 3422298 - RNA, 22 nt, Pseudomonas aeruginosa PA01
cgcgugggcuucgccgccgcgc

SEQ ID NO: 3422299 - RNA, 23 nt, Pseudomonas aeruginosa PA01
cgcgugggcuucgccgccgcgcg

SEQ ID NO: 3422300 - RNA, 17 nt, Pseudomonas aeruginosa PA01
cgcgugguaucggcgcu

SEQ ID NO: 3422301 - RNA, 23 nt, Pseudomonas aeruginosa PA01
cgcgugguaucggcgcucaccgc

SEQ ID NO: 3422302 - RNA, 20 nt, Pseudomonas aeruginosa PA01
cgcguucaccguggcgcugg

SEQ ID NO: 3422303 - RNA, 14 nt, Pseudomonas aeruginosa PA01
cgcguucagccacg

SEQ ID NO: 3422304 - RNA, 18 nt, Pseudomonas aeruginosa PA01
cgcguucaucgucggcag

SEQ ID NO: 3422305 - RNA, 20 nt, Pseudomonas aeruginosa PA01
cgcguucaucgucggcagcc

SEQ ID NO: 3422306 - RNA, 19 nt, Pseudomonas aeruginosa PA01
cgcguuccagcaccucgcg

SEQ ID NO: 3422307 - RNA, 12 nt, Pseudomonas aeruginosa PA01
cgcguucgccga

SEQ ID NO: 3422308 - RNA, 14 nt, Pseudomonas aeruginosa PA01
cgcguucgcggggc

SEQ ID NO: 3422309 - RNA, 14 nt, Pseudomonas aeruginosa PA01
cgcguucgcuccgg

SEQ ID NO: 3422310 - RNA, 21 nt, Pseudomonas aeruginosa PA01
cgcguucggcgaugccgcgcc

SEQ ID NO: 3422311 - RNA, 13 nt, Pseudomonas aeruginosa PA01
cgcguucgucggc

SEQ ID NO: 3422312 - RNA, 16 nt, Pseudomonas aeruginosa PA01
cgcguucgucggccac

SEQ ID NO: 3422313 - RNA, 14 nt, Pseudomonas aeruginosa PA01
cgcguucucccuga

SEQ ID NO: 3422314 - RNA, 16 nt, Pseudomonas aeruginosa PA01
cgcguucucccugagc

SEQ ID NO: 3422315 - RNA, 18 nt, Pseudomonas aeruginosa PA01
cgcguucucccugagccu

SEQ ID NO: 3422316 - RNA, 22 nt, Pseudomonas aeruginosa PA01
cgcguucucccugagccugucg

SEQ ID NO: 3422317 - RNA, 23 nt, Pseudomonas aeruginosa PA01
cgcguugaccgugaugcccagcg

SEQ ID NO: 3422318 - RNA, 23 nt, Pseudomonas aeruginosa PA01
cgcguugacgcggaugcccuggu

SEQ ID NO: 3422319 - RNA, 14 nt, Pseudomonas aeruginosa PA01
cgcguugcagcgcc

SEQ ID NO: 3422320 - RNA, 15 nt, Pseudomonas aeruginosa PA01
cgcguugcaggcgac

SEQ ID NO: 3422321 - RNA, 16 nt, Pseudomonas aeruginosa PA01
cgcguugcaggcgacg

SEQ ID NO: 3422322 - RNA, 23 nt, Pseudomonas aeruginosa PA01
cgcguugcauguccucggcgccg

SEQ ID NO: 3422323 - RNA, 14 nt, Pseudomonas aeruginosa PA01
cgcguugcgaccaa

SEQ ID NO: 3422324 - RNA, 19 nt, Pseudomonas aeruginosa PA01
cgcguugcgagggcucggg

SEQ ID NO: 3422325 - RNA, 22 nt, Pseudomonas aeruginosa PA01
cgcguugcgagggcucgggcgc

SEQ ID NO: 3422326 - RNA, 20 nt, Pseudomonas aeruginosa PA01
cgcguugcgguuauucgccc

SEQ ID NO: 3422327 - RNA, 21 nt, Pseudomonas aeruginosa PA01
cgcguugcgguuauucgcccu

SEQ ID NO: 3422328 - RNA, 21 nt, Pseudomonas aeruginosa PA01
cgcguugcuuguguccgccga

SEQ ID NO: 3422329 - RNA, 22 nt, Pseudomonas aeruginosa PA01
cgcguugcuuguguccgccgag

SEQ ID NO: 3422330 - RNA, 13 nt, Pseudomonas aeruginosa PA01
cgcguuggcggug

SEQ ID NO: 3422331 - RNA, 19 nt, Pseudomonas aeruginosa PA01
cgcguuggcggugccgcag

SEQ ID NO: 3422332 - RNA, 18 nt, Pseudomonas aeruginosa PA01
cgcguuggcgugcucgcg

SEQ ID NO: 3422333 - RNA, 21 nt, Pseudomonas aeruginosa PA01
cgcguugucccugucccgccg

SEQ ID NO: 3422334 - RNA, 16 nt, Pseudomonas aeruginosa PA01
cgcguugugccgccac

SEQ ID NO: 3422335 - RNA, 17 nt, Pseudomonas aeruginosa PA01
cgcguuucucagcgccg

SEQ ID NO: 3422336 - RNA, 18 nt, Pseudomonas aeruginosa PA01
cgcguuucucagcgccgu

SEQ ID NO: 3422337 - RNA, 15 nt, Pseudomonas aeruginosa PA01
cgcguuuuuccgcga

SEQ ID NO: 3422338 - RNA, 14 nt, Pseudomonas aeruginosa PA01
cgcuacagccggga

SEQ ID NO: 3422339 - RNA, 17 nt, Pseudomonas aeruginosa PA01
cgcuacccagguggucg

SEQ ID NO: 3422340 - RNA, 17 nt, Pseudomonas aeruginosa PA01
cgcuaccgacaggacca

SEQ ID NO: 3422341 - RNA, 21 nt, Pseudomonas aeruginosa PA01
cgcuaccgcgcauggcggcga

SEQ ID NO: 3422342 - RNA, 20 nt, Pseudomonas aeruginosa PA01
cgcuacgaaggcgugccgcu

SEQ ID NO: 3422343 - RNA, 15 nt, Pseudomonas aeruginosa PA01
cgcuacgcggcggga

SEQ ID NO: 3422344 - RNA, 15 nt, Pseudomonas aeruginosa PA01
cgcuacgcucgccga

SEQ ID NO: 3422345 - RNA, 16 nt, Pseudomonas aeruginosa PA01
cgcuacgcucgccgac

SEQ ID NO: 3422346 - RNA, 17 nt, Pseudomonas aeruginosa PA01
cgcuacgcucgccgacg

SEQ ID NO: 3422347 - RNA, 22 nt, Pseudomonas aeruginosa PA01
cgcuacggaaggucgccgggcu

SEQ ID NO: 3422348 - RNA, 22 nt, Pseudomonas aeruginosa PA01
cgcuacggcaucaccggcggga

SEQ ID NO: 3422349 - RNA, 17 nt, Pseudomonas aeruginosa PA01
cgcuacguuccagggcc

SEQ ID NO: 3422350 - RNA, 19 nt, Pseudomonas aeruginosa PA01
cgcuacguuccagggccug

SEQ ID NO: 3422351 - RNA, 23 nt, Pseudomonas aeruginosa PA01
cgcuacguuccagggccugguag

SEQ ID NO: 3422352 - RNA, 14 nt, Pseudomonas aeruginosa PA01
cgcuacugcgcggg

SEQ ID NO: 3422353 - RNA, 21 nt, Pseudomonas aeruginosa PA01
cgcuagcgcauggcgaccugg

SEQ ID NO: 3422354 - RNA, 13 nt, Pseudomonas aeruginosa PA01
cgcuauccaccgu

SEQ ID NO: 3422355 - RNA, 16 nt, Pseudomonas aeruginosa PA01
cgcuauccaccgucgc

SEQ ID NO: 3422356 - RNA, 15 nt, Pseudomonas aeruginosa PA01
cgcuaucgccgccgc

SEQ ID NO: 3422357 - RNA, 17 nt, Pseudomonas aeruginosa PA01
cgcuaucgccgccgcag

SEQ ID NO: 3422358 - RNA, 20 nt, Pseudomonas aeruginosa PA01
cgcuaucgccgccgcagccg

SEQ ID NO: 3422359 - RNA, 21 nt, Pseudomonas aeruginosa PA01
cgcuaucgccgccgcagccgu

SEQ ID NO: 3422360 - RNA, 15 nt, Pseudomonas aeruginosa PA01
cgcuaucgcuggcgc

SEQ ID NO: 3422361 - RNA, 20 nt, Pseudomonas aeruginosa PA01
cgcuaucgcuggcgcagccg

SEQ ID NO: 3422362 - RNA, 15 nt, Pseudomonas aeruginosa PA01
cgcuaucggcccggg

SEQ ID NO: 3422363 - RNA, 22 nt, Pseudomonas aeruginosa PA01
cgcuaucgggcagggcagccgc

SEQ ID NO: 3422364 - RNA, 13 nt, Pseudomonas aeruginosa PA01
cgcuaugcagcag

SEQ ID NO: 3422365 - RNA, 17 nt, Pseudomonas aeruginosa PA01
cgcuaugcagcagguag

SEQ ID NO: 3422366 - RNA, 14 nt, Pseudomonas aeruginosa PA01
cgcuaugggcaccg

SEQ ID NO: 3422367 - RNA, 17 nt, Pseudomonas aeruginosa PA01
cgcuaugggcaccgcgc

SEQ ID NO: 3422368 - RNA, 21 nt, Pseudomonas aeruginosa PA01
cgcuauucugauugcguaacg

SEQ ID NO: 3422369 - RNA, 21 nt, Pseudomonas aeruginosa PA01
cgcucaaccgaacaggcgacg

SEQ ID NO: 3422370 - RNA, 13 nt, Pseudomonas aeruginosa PA01
cgcucaacgccuc

SEQ ID NO: 3422371 - RNA, 15 nt, Pseudomonas aeruginosa PA01
cgcucaacggcgugc

SEQ ID NO: 3422372 - RNA, 19 nt, Pseudomonas aeruginosa PA01
cgcucaacggcgugccggg

SEQ ID NO: 3422373 - RNA, 20 nt, Pseudomonas aeruginosa PA01
cgcucaagacggcccgcaga

SEQ ID NO: 3422374 - RNA, 15 nt, Pseudomonas aeruginosa PA01
cgcucaagggcuggc

SEQ ID NO: 3422375 - RNA, 15 nt, Pseudomonas aeruginosa PA01
cgcucaccaccaccg

SEQ ID NO: 3422376 - RNA, 21 nt, Pseudomonas aeruginosa PA01
cgcucaccaccaccgcgccga

SEQ ID NO: 3422377 - RNA, 23 nt, Pseudomonas aeruginosa PA01
cgcucaccaggcccgccggucaa

SEQ ID NO: 3422378 - RNA, 16 nt, Pseudomonas aeruginosa PA01
cgcucacccacauggc

SEQ ID NO: 3422379 - RNA, 22 nt, Pseudomonas aeruginosa PA01
cgcucacccugucccaucacgg

SEQ ID NO: 3422380 - RNA, 21 nt, Pseudomonas aeruginosa PA01
cgcucaccgaggcgaacggca

SEQ ID NO: 3422381 - RNA, 20 nt, Pseudomonas aeruginosa PA01
cgcucaccgcauagucgcga

SEQ ID NO: 3422382 - RNA, 18 nt, Pseudomonas aeruginosa PA01
cgcucaccggaccguggu

SEQ ID NO: 3422383 - RNA, 21 nt, Pseudomonas aeruginosa PA01
cgcucaccggucgagagggau

SEQ ID NO: 3422384 - RNA, 23 nt, Pseudomonas aeruginosa PA01
cgcucacgcaccucgucgagcag

SEQ ID NO: 3422385 - RNA, 22 nt, Pseudomonas aeruginosa PA01
cgcucacguagcccccgccgcu

SEQ ID NO: 3422386 - RNA, 17 nt, Pseudomonas aeruginosa PA01
cgcucagcaucagcgac

SEQ ID NO: 3422387 - RNA, 18 nt, Pseudomonas aeruginosa PA01
cgcucagcaucagcgaca

SEQ ID NO: 3422388 - RNA, 20 nt, Pseudomonas aeruginosa PA01
cgcucagccgaggucgccgc

SEQ ID NO: 3422389 - RNA, 22 nt, Pseudomonas aeruginosa PA01
cgcucagccgaggucgccgcca

SEQ ID NO: 3422390 - RNA, 23 nt, Pseudomonas aeruginosa PA01
cgcucagccgaggucgccgccag

SEQ ID NO: 3422391 - RNA, 17 nt, Pseudomonas aeruginosa PA01
cgcucagccguggcacc

SEQ ID NO: 3422392 - RNA, 22 nt, Pseudomonas aeruginosa PA01
augccgaaggcgucauccgcca

SEQ ID NO: 3422393 - RNA, 23 nt, Pseudomonas aeruginosa PA01
augccgacgagcagcucgccggc

SEQ ID NO: 3422394 - RNA, 19 nt, Pseudomonas aeruginosa PA01
augccgacgucgaugacga

SEQ ID NO: 3422395 - RNA, 11 nt, Pseudomonas aeruginosa PA01
augccgagcau

SEQ ID NO: 3422396 - RNA, 17 nt, Pseudomonas aeruginosa PA01
augccgagcaucagcga

SEQ ID NO: 3422397 - RNA, 13 nt, Pseudomonas aeruginosa PA01
augccgaggcggc

SEQ ID NO: 3422398 - RNA, 16 nt, Pseudomonas aeruginosa PA01
augccgaucaccgcca

SEQ ID NO: 3422399 - RNA, 14 nt, Pseudomonas aeruginosa PA01
augccgaugccgcc

SEQ ID NO: 3422400 - RNA, 15 nt, Pseudomonas aeruginosa PA01
augccgaugccgccg

SEQ ID NO: 3422401 - RNA, 17 nt, Pseudomonas aeruginosa PA01
augccgaugccgccgac

SEQ ID NO: 3422402 - RNA, 17 nt, Pseudomonas aeruginosa PA01
augccgauggcgccgcc

SEQ ID NO: 3422403 - RNA, 18 nt, Pseudomonas aeruginosa PA01
augccgauggcgccgccg

SEQ ID NO: 3422404 - RNA, 23 nt, Pseudomonas aeruginosa PA01
augccgcaagcuccccgccgcca

SEQ ID NO: 3422405 - RNA, 14 nt, Pseudomonas aeruginosa PA01
augccgcacaggcu

SEQ ID NO: 3422406 - RNA, 15 nt, Pseudomonas aeruginosa PA01
augccgcacaggcug

SEQ ID NO: 3422407 - RNA, 18 nt, Pseudomonas aeruginosa PA01
augccgcacaggcuggcc

SEQ ID NO: 3422408 - RNA, 20 nt, Pseudomonas aeruginosa PA01
augccgcacaggcuggccag

SEQ ID NO: 3422409 - RNA, 15 nt, Pseudomonas aeruginosa PA01
augccgcaccccauc

SEQ ID NO: 3422410 - RNA, 23 nt, Pseudomonas aeruginosa PA01
augccgcaccccauccucgccgg

SEQ ID NO: 3422411 - RNA, 13 nt, Pseudomonas aeruginosa PA01
augccgcaggcag

SEQ ID NO: 3422412 - RNA, 14 nt, Pseudomonas aeruginosa PA01
augccgcccagcac

SEQ ID NO: 3422413 - RNA, 22 nt, Pseudomonas aeruginosa PA01
augccgcccuccaucagcgccu

SEQ ID NO: 3422414 - RNA, 20 nt, Pseudomonas aeruginosa PA01
augccgccgaccucggccgc

SEQ ID NO: 3422415 - RNA, 12 nt, Pseudomonas aeruginosa PA01
augccgccggca

SEQ ID NO: 3422416 - RNA, 13 nt, Pseudomonas aeruginosa PA01
augccgccggcau

SEQ ID NO: 3422417 - RNA, 14 nt, Pseudomonas aeruginosa PA01
augccgccgucgcg

SEQ ID NO: 3422418 - RNA, 16 nt, Pseudomonas aeruginosa PA01
augccgccgucgcggc

SEQ ID NO: 3422419 - RNA, 17 nt, Pseudomonas aeruginosa PA01
augccgccgucgcggcc

SEQ ID NO: 3422420 - RNA, 16 nt, Pseudomonas aeruginosa PA01
augccgcgagccagcc

SEQ ID NO: 3422421 - RNA, 14 nt, Pseudomonas aeruginosa PA01
augccgcgccaggc

SEQ ID NO: 3422422 - RNA, 15 nt, Pseudomonas aeruginosa PA01
augccgcgccaggcg

SEQ ID NO: 3422423 - RNA, 16 nt, Pseudomonas aeruginosa PA01
augccgcgccaggcgc

SEQ ID NO: 3422424 - RNA, 14 nt, Pseudomonas aeruginosa PA01
augccgcgccggaa

SEQ ID NO: 3422425 - RNA, 19 nt, Pseudomonas aeruginosa PA01
augccgcgccggaaguggc

SEQ ID NO: 3422426 - RNA, 22 nt, Pseudomonas aeruginosa PA01
augccgcgccggaaguggcagc

SEQ ID NO: 3422427 - RNA, 19 nt, Pseudomonas aeruginosa PA01
augccgcgcgccuggcugg

SEQ ID NO: 3422428 - RNA, 22 nt, Pseudomonas aeruginosa PA01
augccgcgcgccuggcuggcca

SEQ ID NO: 3422429 - RNA, 23 nt, Pseudomonas aeruginosa PA01
augccgcgcgccuggcuggccag

SEQ ID NO: 3422430 - RNA, 15 nt, Pseudomonas aeruginosa PA01
augccgcuagcccug

SEQ ID NO: 3422431 - RNA, 13 nt, Pseudomonas aeruginosa PA01
augccggccagga

SEQ ID NO: 3422432 - RNA, 13 nt, Pseudomonas aeruginosa PA01
augccggccggca

SEQ ID NO: 3422433 - RNA, 14 nt, Pseudomonas aeruginosa PA01
augccggccggggc

SEQ ID NO: 3422434 - RNA, 18 nt, Pseudomonas aeruginosa PA01
augccggccggggccggc

SEQ ID NO: 3422435 - RNA, 21 nt, Pseudomonas aeruginosa PA01
augccggccgucgcgcaccac

SEQ ID NO: 3422436 - RNA, 12 nt, Pseudomonas aeruginosa PA01
augccggccucg

SEQ ID NO: 3422437 - RNA, 15 nt, Pseudomonas aeruginosa PA01
ccagggccuggcgca

SEQ ID NO: 3422438 - RNA, 22 nt, Pseudomonas aeruginosa PA01
ccagggcgaacagcgccgcggc

SEQ ID NO: 3422439 - RNA, 20 nt, Pseudomonas aeruginosa PA01
ccagggcgaagucggcgcgc

SEQ ID NO: 3422440 - RNA, 22 nt, Pseudomonas aeruginosa PA01
ccagggcgaggaucacgcagca

SEQ ID NO: 3422441 - RNA, 23 nt, Pseudomonas aeruginosa PA01
ccagggcgaggccgcucuucugg

SEQ ID NO: 3422442 - RNA, 14 nt, Pseudomonas aeruginosa PA01
ccagggcgauggcg

SEQ ID NO: 3422443 - RNA, 20 nt, Pseudomonas aeruginosa PA01
ccagggcgcgguagggaucg

SEQ ID NO: 3422444 - RNA, 12 nt, Pseudomonas aeruginosa PA01
ccagggcgcugc

SEQ ID NO: 3422445 - RNA, 12 nt, Pseudomonas aeruginosa PA01
ccagggcggcgc

SEQ ID NO: 3422446 - RNA, 15 nt, Pseudomonas aeruginosa PA01
ccagggcggcgcgga

SEQ ID NO: 3422447 - RNA, 13 nt, Pseudomonas aeruginosa PA01
ccagggcgggccg

SEQ ID NO: 3422448 - RNA, 15 nt, Pseudomonas aeruginosa PA01
ccagggcgggccgcu

SEQ ID NO: 3422449 - RNA, 21 nt, Pseudomonas aeruginosa PA01
ccagggcgggccgcucgcgcg

SEQ ID NO: 3422450 - RNA, 22 nt, Pseudomonas aeruginosa PA01
ccagggcggugagguugccgcc

SEQ ID NO: 3422451 - RNA, 23 nt, Pseudomonas aeruginosa PA01
ccagggcggugagguugccgccg

SEQ ID NO: 3422452 - RNA, 23 nt, Pseudomonas aeruginosa PA01
ccagggcguggucggcggccucg

SEQ ID NO: 3422453 - RNA, 16 nt, Pseudomonas aeruginosa PA01
ccagggcucggacgac

SEQ ID NO: 3422454 - RNA, 18 nt, Pseudomonas aeruginosa PA01
ccagggcuucccaggcca

SEQ ID NO: 3422455 - RNA, 22 nt, Pseudomonas aeruginosa PA01
ccagggcuucccaggccagcgg

SEQ ID NO: 3422456 - RNA, 16 nt, Pseudomonas aeruginosa PA01
ccagggcuucgcggug

SEQ ID NO: 3422457 - RNA, 23 nt, Pseudomonas aeruginosa PA01
ccagggcuucgcgguggaugccg

SEQ ID NO: 3422458 - RNA, 14 nt, Pseudomonas aeruginosa PA01
ccaggggauggucg

SEQ ID NO: 3422459 - RNA, 20 nt, Pseudomonas aeruginosa PA01
ccaggggcacgcuggcgaga

SEQ ID NO: 3422460 - RNA, 19 nt, Pseudomonas aeruginosa PA01
ccaggggcauguccaccgc

SEQ ID NO: 3422461 - RNA, 22 nt, Pseudomonas aeruginosa PA01
ccaggggcauguccaccgccgc

SEQ ID NO: 3422462 - RNA, 20 nt, Pseudomonas aeruginosa PA01
ccaggggcuagucgcgcagc

SEQ ID NO: 3422463 - RNA, 21 nt, Pseudomonas aeruginosa PA01
ccaggggcuagucgcgcagcg

SEQ ID NO: 3422464 - RNA, 21 nt, Pseudomonas aeruginosa PA01
ccaggggcugaacagcgccac

SEQ ID NO: 3422465 - RNA, 15 nt, Pseudomonas aeruginosa PA01
ccagggggccgggcc

SEQ ID NO: 3422466 - RNA, 15 nt, Pseudomonas aeruginosa PA01
ccaggggucaggccg

SEQ ID NO: 3422467 - RNA, 16 nt, Pseudomonas aeruginosa PA01
ccaggggucgacgcag

SEQ ID NO: 3422468 - RNA, 17 nt, Pseudomonas aeruginosa PA01
ccaggggucgacgcagg

SEQ ID NO: 3422469 - RNA, 13 nt, Pseudomonas aeruginosa PA01
ccaggggucggca

SEQ ID NO: 3422470 - RNA, 16 nt, Pseudomonas aeruginosa PA01
ccaggggucggcaucg

SEQ ID NO: 3422471 - RNA, 16 nt, Pseudomonas aeruginosa PA01
ccaggggugccuugcc

SEQ ID NO: 3422472 - RNA, 18 nt, Pseudomonas aeruginosa PA01
ccaggguaccgaaacagg

SEQ ID NO: 3422473 - RNA, 22 nt, Pseudomonas aeruginosa PA01
ccaggguaccgaaacagggcga

SEQ ID NO: 3422474 - RNA, 22 nt, Pseudomonas aeruginosa PA01
ccaggguaccguugcgcaggcg

SEQ ID NO: 3422475 - RNA, 23 nt, Pseudomonas aeruginosa PA01
ccaggguaccguugcgcaggcgu

SEQ ID NO: 3422476 - RNA, 19 nt, Pseudomonas aeruginosa PA01
ccaggguaucgcugucgcc

SEQ ID NO: 3422477 - RNA, 15 nt, Pseudomonas aeruginosa PA01
ccagggucacgccgc

SEQ ID NO: 3422478 - RNA, 19 nt, Pseudomonas aeruginosa PA01
ccagggucacgccgcggcu

SEQ ID NO: 3422479 - RNA, 15 nt, Pseudomonas aeruginosa PA01
ccagggucagcuggc

SEQ ID NO: 3422480 - RNA, 17 nt, Pseudomonas aeruginosa PA01
ccagggucagcuggcgc

SEQ ID NO: 3422481 - RNA, 17 nt, Pseudomonas aeruginosa PA01
ccagggucgccagcagg

SEQ ID NO: 3422482 - RNA, 18 nt, Pseudomonas aeruginosa PA01
ccagggucgccagcaggu

SEQ ID NO: 3422483 - RNA, 19 nt, Pseudomonas aeruginosa PA01
ccagggucgccagcaggua

SEQ ID NO: 3422484 - RNA, 16 nt, Pseudomonas aeruginosa PA01
ccagggucgcccgugc

SEQ ID NO: 3422485 - RNA, 20 nt, Pseudomonas aeruginosa PA01
ccagggucggcaccgagccg

SEQ ID NO: 3422486 - RNA, 18 nt, Pseudomonas aeruginosa PA01
ccagggucgggccgcgcu

SEQ ID NO: 3422487 - RNA, 19 nt, Pseudomonas aeruginosa PA01
ccagggucgguucgcggcg

SEQ ID NO: 3422488 - RNA, 20 nt, Pseudomonas aeruginosa PA01
ccagggucgguucgcggcgc

SEQ ID NO: 3422489 - RNA, 21 nt, Pseudomonas aeruginosa PA01
ccagggucgguucgcggcgca

SEQ ID NO: 3422490 - RNA, 14 nt, Pseudomonas aeruginosa PA01
ccagggucuccagg

SEQ ID NO: 3422491 - RNA, 22 nt, Pseudomonas aeruginosa PA01
ccagggugacgcucuucaccuc

SEQ ID NO: 3422492 - RNA, 18 nt, Pseudomonas aeruginosa PA01
ccagggugaucacaccga

SEQ ID NO: 3422493 - RNA, 23 nt, Pseudomonas aeruginosa PA01
ccagggugaucgacucgauggcg

SEQ ID NO: 3422494 - RNA, 14 nt, Pseudomonas aeruginosa PA01
ccaggguggcgcgc

SEQ ID NO: 3422495 - RNA, 22 nt, Pseudomonas aeruginosa PA01
ccagggugggcggugcggcauu

SEQ ID NO: 3422496 - RNA, 23 nt, Pseudomonas aeruginosa PA01
ccaggguguacuugacggcgccg

SEQ ID NO: 3422497 - RNA, 20 nt, Pseudomonas aeruginosa PA01
ccaggguguuguucgccagc

SEQ ID NO: 3422498 - RNA, 21 nt, Pseudomonas aeruginosa PA01
ccaggguuggcggcaucgcgu

SEQ ID NO: 3422499 - RNA, 17 nt, Pseudomonas aeruginosa PA01
ccaggguuuccagcagc

SEQ ID NO: 3422500 - RNA, 15 nt, Pseudomonas aeruginosa PA01
ccaggguuuccuggu

SEQ ID NO: 3422501 - RNA, 16 nt, Pseudomonas aeruginosa PA01
ccagguaaaggccacc

SEQ ID NO: 3422502 - RNA, 19 nt, Pseudomonas aeruginosa PA01
ccagguaaaggccaccaga

SEQ ID NO: 3422503 - RNA, 23 nt, Pseudomonas aeruginosa PA01
ccagguaaaggccaccagagcca

SEQ ID NO: 3422504 - RNA, 14 nt, Pseudomonas aeruginosa PA01
ccagguaagcggcg

SEQ ID NO: 3422505 - RNA, 14 nt, Pseudomonas aeruginosa PA01
ccagguaccggcca

SEQ ID NO: 3422506 - RNA, 16 nt, Pseudomonas aeruginosa PA01
ccagguaccggccagg

SEQ ID NO: 3422507 - RNA, 19 nt, Pseudomonas aeruginosa PA01
ccagguaccggccaggcgg

SEQ ID NO: 3422508 - RNA, 18 nt, Pseudomonas aeruginosa PA01
ccagguacggcccgcgga

SEQ ID NO: 3422509 - RNA, 23 nt, Pseudomonas aeruginosa PA01
ccagguacggcccgcggaucgcg

SEQ ID NO: 3422510 - RNA, 22 nt, Pseudomonas aeruginosa PA01
ccagguacuggcgauggaugac

SEQ ID NO: 3422511 - RNA, 19 nt, Pseudomonas aeruginosa PA01
ccagguacuuggccacgcc

SEQ ID NO: 3422512 - RNA, 20 nt, Pseudomonas aeruginosa PA01
ccagguacuuggccacgccu

SEQ ID NO: 3422513 - RNA, 18 nt, Pseudomonas aeruginosa PA01
ccagguagagcagcccgg

SEQ ID NO: 3422514 - RNA, 20 nt, Pseudomonas aeruginosa PA01
ccagguagagcagcccgggc

SEQ ID NO: 3422515 - RNA, 21 nt, Pseudomonas aeruginosa PA01
ccagguagagcagcccgggca

SEQ ID NO: 3422516 - RNA, 23 nt, Pseudomonas aeruginosa PA01
ccagguagccuggauacgggcgc

SEQ ID NO: 3422517 - RNA, 16 nt, Pseudomonas aeruginosa PA01
ccagguagcgcugcgc

SEQ ID NO: 3422518 - RNA, 22 nt, Pseudomonas aeruginosa PA01
ccagguagcggcguucgccgag

SEQ ID NO: 3422519 - RNA, 21 nt, Pseudomonas aeruginosa PA01
ccagguaggcgaaggcgaugu

SEQ ID NO: 3422520 - RNA, 16 nt, Pseudomonas aeruginosa PA01
ccagguagucgcccag

SEQ ID NO: 3422521 - RNA, 18 nt, Pseudomonas aeruginosa PA01
ccagguagucgcccagcg

SEQ ID NO: 3422522 - RNA, 22 nt, Pseudomonas aeruginosa PA01
ccagguagucgcccagcgccug

SEQ ID NO: 3422523 - RNA, 19 nt, Pseudomonas aeruginosa PA01
ccagguagugccgcccuug

SEQ ID NO: 3422524 - RNA, 22 nt, Pseudomonas aeruginosa PA01
ccaggucagccaccugcucgcu

SEQ ID NO: 3422525 - RNA, 18 nt, Pseudomonas aeruginosa PA01
ccaggucaugcccuggcc

SEQ ID NO: 3422526 - RNA, 24 nt, Pseudomonas aeruginosa PA01
ccaggucaugcccuggccgacgcu

SEQ ID NO: 3422527 - RNA, 20 nt, Pseudomonas aeruginosa PA01
ccagguccgccacuucaagc

SEQ ID NO: 3422528 - RNA, 14 nt, Pseudomonas aeruginosa PA01
ccagguccgccugg

SEQ ID NO: 3422529 - RNA, 19 nt, Pseudomonas aeruginosa PA01
ccagguccgccugguccag

SEQ ID NO: 3422530 - RNA, 13 nt, Pseudomonas aeruginosa PA01
ccagguccggcag

SEQ ID NO: 3422531 - RNA, 14 nt, Pseudomonas aeruginosa PA01
ccagguccggcagc

SEQ ID NO: 3422532 - RNA, 15 nt, Pseudomonas aeruginosa PA01
ccagguccggcagcg

SEQ ID NO: 3422533 - RNA, 19 nt, Pseudomonas aeruginosa PA01
ccagguccggcagcgccuu

SEQ ID NO: 3422534 - RNA, 16 nt, Pseudomonas aeruginosa PA01
ccaggucgaacagcgg

SEQ ID NO: 3422535 - RNA, 18 nt, Pseudomonas aeruginosa PA01
ccaggucgaacagcggcu

SEQ ID NO: 3422536 - RNA, 20 nt, Pseudomonas aeruginosa PA01
ccaggucgaacagcggcugg

SEQ ID NO: 3422537 - RNA, 23 nt, Pseudomonas aeruginosa PA01
ccaggucgaacagcggcuggccc

SEQ ID NO: 3422538 - RNA, 22 nt, Pseudomonas aeruginosa PA01
ccagucgagacgccagccgccc

SEQ ID NO: 3422539 - RNA, 18 nt, Pseudomonas aeruginosa PA01
ccagucggccguugcggg

SEQ ID NO: 3422540 - RNA, 19 nt, Pseudomonas aeruginosa PA01
ccagucggccguugcgggc

SEQ ID NO: 3422541 - RNA, 22 nt, Pseudomonas aeruginosa PA01
ccagucggcggucuugaucacg

SEQ ID NO: 3422542 - RNA, 20 nt, Pseudomonas aeruginosa PA01
ccagucggggcaggcgcagg

SEQ ID NO: 3422543 - RNA, 14 nt, Pseudomonas aeruginosa PA01
ccagucuucgccgg

SEQ ID NO: 3422544 - RNA, 17 nt, Pseudomonas aeruginosa PA01
ccagucuucgccggccu

SEQ ID NO: 3422545 - RNA, 19 nt, Pseudomonas aeruginosa PA01
ccagucuucgccggccugc

SEQ ID NO: 3422546 - RNA, 16 nt, Pseudomonas aeruginosa PA01
ccagugcaccgccggg

SEQ ID NO: 3422547 - RNA, 21 nt, Pseudomonas aeruginosa PA01
ccagugcaugcguucgccgaa

SEQ ID NO: 3422548 - RNA, 13 nt, Pseudomonas aeruginosa PA01
ccagugccucccg

SEQ ID NO: 3422549 - RNA, 16 nt, Pseudomonas aeruginosa PA01
ccagugccucgcgcgu

SEQ ID NO: 3422550 - RNA, 17 nt, Pseudomonas aeruginosa PA01
ccagugccucgcgcgug

SEQ ID NO: 3422551 - RNA, 18 nt, Pseudomonas aeruginosa PA01
ccagugccucgcgcgugg

SEQ ID NO: 3422552 - RNA, 23 nt, Pseudomonas aeruginosa PA01
ccagugccugcaccacgcaggcg

SEQ ID NO: 3422553 - RNA, 17 nt, Pseudomonas aeruginosa PA01
ccagugcgagucggcga

SEQ ID NO: 3422554 - RNA, 19 nt, Pseudomonas aeruginosa PA01
ccagugcgagucggcgacg

SEQ ID NO: 3422555 - RNA, 20 nt, Pseudomonas aeruginosa PA01
ccagugcgcgguccgcgugg

SEQ ID NO: 3422556 - RNA, 14 nt, Pseudomonas aeruginosa PA01
ccaguggcgccgcc

SEQ ID NO: 3422557 - RNA, 16 nt, Pseudomonas aeruginosa PA01
ccaguggcgccgccau

SEQ ID NO: 3422558 - RNA, 13 nt, Pseudomonas aeruginosa PA01
ccagugggccacc

SEQ ID NO: 3422559 - RNA, 16 nt, Pseudomonas aeruginosa PA01
ccagugggccaccggc

SEQ ID NO: 3422560 - RNA, 14 nt, Pseudomonas aeruginosa PA01
ccaguguggcggcg

SEQ ID NO: 3422561 - RNA, 13 nt, Pseudomonas aeruginosa PA01
ccaguucagcgcg

SEQ ID NO: 3422562 - RNA, 16 nt, Pseudomonas aeruginosa PA01
ccaguucagcgcgcuc

SEQ ID NO: 3422563 - RNA, 22 nt, Pseudomonas aeruginosa PA01
ccaguucagggcgagcagggca

SEQ ID NO: 3422564 - RNA, 18 nt, Pseudomonas aeruginosa PA01
ccaguucaucgagcaggu

SEQ ID NO: 3422565 - RNA, 15 nt, Pseudomonas aeruginosa PA01
ccaguuccucgcgag

SEQ ID NO: 3422566 - RNA, 17 nt, Pseudomonas aeruginosa PA01
ccaguuccucgcgaggg

SEQ ID NO: 3422567 - RNA, 12 nt, Pseudomonas aeruginosa PA01
ccaguuccugcu

SEQ ID NO: 3422568 - RNA, 18 nt, Pseudomonas aeruginosa PA01
ccaguuccugcuccuccg

SEQ ID NO: 3422569 - RNA, 17 nt, Pseudomonas aeruginosa PA01
ccaguuccuucgccgaa

SEQ ID NO: 3422570 - RNA, 15 nt, Pseudomonas aeruginosa PA01
ccaguuccuucuuga

SEQ ID NO: 3422571 - RNA, 17 nt, Pseudomonas aeruginosa PA01
ccaguuccuugaggucg

SEQ ID NO: 3422572 - RNA, 18 nt, Pseudomonas aeruginosa PA01
ccaguucgccgccgcgcu

SEQ ID NO: 3422573 - RNA, 14 nt, Pseudomonas aeruginosa PA01
ccaguucgccggcc

SEQ ID NO: 3422574 - RNA, 15 nt, Pseudomonas aeruginosa PA01
ccaguucgccgguga

SEQ ID NO: 3422575 - RNA, 17 nt, Pseudomonas aeruginosa PA01
ccaguucgcugccgccg

SEQ ID NO: 3422576 - RNA, 18 nt, Pseudomonas aeruginosa PA01
ccaguucgcugccgccgc

SEQ ID NO: 3422577 - RNA, 20 nt, Pseudomonas aeruginosa PA01
ccaguucgcugccgccgcgc

SEQ ID NO: 3422578 - RNA, 21 nt, Pseudomonas aeruginosa PA01
ccaguucgcugccgccgcgcu

SEQ ID NO: 3422579 - RNA, 20 nt, Pseudomonas aeruginosa PA01
ccaguucggccaucagcacg

SEQ ID NO: 3422580 - RNA, 18 nt, Pseudomonas aeruginosa PA01
ccaguucguucugggucg

SEQ ID NO: 3422581 - RNA, 22 nt, Pseudomonas aeruginosa PA01
ccaguucguugaccacgcucag

SEQ ID NO: 3422582 - RNA, 18 nt, Pseudomonas aeruginosa PA01
ccaguucuucgccgcccg

SEQ ID NO: 3422583 - RNA, 20 nt, Pseudomonas aeruginosa PA01
ccaguucuucgccgcccgcg

SEQ ID NO: 3422584 - RNA, 22 nt, Pseudomonas aeruginosa PA01
ccaguucuucgccgcccgcgcc

SEQ ID NO: 3422585 - RNA, 19 nt, Pseudomonas aeruginosa PA01
ccaguugcagcacccccag

SEQ ID NO: 3422586 - RNA, 17 nt, Pseudomonas aeruginosa PA01
ccaguugcccggccugg

SEQ ID NO: 3422587 - RNA, 13 nt, Pseudomonas aeruginosa PA01
ccaguugccgagc

SEQ ID NO: 3422588 - RNA, 14 nt, Pseudomonas aeruginosa PA01
ccaguugcgccgcc

SEQ ID NO: 3422589 - RNA, 14 nt, Pseudomonas aeruginosa PA01
ccaguugcgcggcg

SEQ ID NO: 3422590 - RNA, 15 nt, Pseudomonas aeruginosa PA01
ccaguugcgcggcga

SEQ ID NO: 3422591 - RNA, 20 nt, Pseudomonas aeruginosa PA01
ccaguugcgcuccgguggcg

SEQ ID NO: 3422592 - RNA, 21 nt, Pseudomonas aeruginosa PA01
ccaguuggaaguugccgccag

SEQ ID NO: 3422593 - RNA, 14 nt, Pseudomonas aeruginosa PA01
ccaguugggccagg

SEQ ID NO: 3422594 - RNA, 19 nt, Pseudomonas aeruginosa PA01
ccaguuggugcacgcgccg

SEQ ID NO: 3422595 - RNA, 20 nt, Pseudomonas aeruginosa PA01
ccaguuggugcacgcgccgg

SEQ ID NO: 3422596 - RNA, 21 nt, Pseudomonas aeruginosa PA01
ccaguuggugcacgcgccggg

SEQ ID NO: 3422597 - RNA, 17 nt, Pseudomonas aeruginosa PA01
ccaguuguuccggcugg

SEQ ID NO: 3422598 - RNA, 15 nt, Pseudomonas aeruginosa PA01
ccauacaccaggccg

SEQ ID NO: 3422599 - RNA, 23 nt, Pseudomonas aeruginosa PA01
ccauacaccaggccggcggccga

SEQ ID NO: 3422600 - RNA, 14 nt, Pseudomonas aeruginosa PA01
ccauacagcgccca

SEQ ID NO: 3422601 - RNA, 22 nt, Pseudomonas aeruginosa PA01
ccauaccgacaugccccgccga

SEQ ID NO: 3422602 - RNA, 15 nt, Pseudomonas aeruginosa PA01
ccauaccuccagcca

SEQ ID NO: 3422603 - RNA, 15 nt, Pseudomonas aeruginosa PA01
ccauagcgagccgcg

SEQ ID NO: 3422604 - RNA, 17 nt, Pseudomonas aeruginosa PA01
ccauagcgagccgcgcu

SEQ ID NO: 3422605 - RNA, 22 nt, Pseudomonas aeruginosa PA01
ccauagcgaguaggcgaagccc

SEQ ID NO: 3422606 - RNA, 23 nt, Pseudomonas aeruginosa PA01
ccauagcgcgccggguugcgccg

SEQ ID NO: 3422607 - RNA, 19 nt, Pseudomonas aeruginosa PA01
ccauaggccagcaccucga

SEQ ID NO: 3422608 - RNA, 16 nt, Pseudomonas aeruginosa PA01
ccaucaccagcgccgu

SEQ ID NO: 3422609 - RNA, 15 nt, Pseudomonas aeruginosa PA01
ccaucaccgacaguc

SEQ ID NO: 3422610 - RNA, 21 nt, Pseudomonas aeruginosa PA01
ccaucaccgacagucccaggc

SEQ ID NO: 3422611 - RNA, 18 nt, Pseudomonas aeruginosa PA01
ccaucaccgccaucagca

SEQ ID NO: 3422612 - RNA, 12 nt, Pseudomonas aeruginosa PA01
ccaucaccgcgg

SEQ ID NO: 3422613 - RNA, 15 nt, Pseudomonas aeruginosa PA01
ccaucacggccccga

SEQ ID NO: 3422614 - RNA, 14 nt, Pseudomonas aeruginosa PA01
ccaucagcaccagg

SEQ ID NO: 3422615 - RNA, 23 nt, Pseudomonas aeruginosa PA01
ccaucagcaccaggaagccccag

SEQ ID NO: 3422616 - RNA, 19 nt, Pseudomonas aeruginosa PA01
ccaucagcacgucguccag

SEQ ID NO: 3422617 - RNA, 14 nt, Pseudomonas aeruginosa PA01
ccaucagccagccc

SEQ ID NO: 3422618 - RNA, 15 nt, Pseudomonas aeruginosa PA01
ccaucagccagccca

SEQ ID NO: 3422619 - RNA, 17 nt, Pseudomonas aeruginosa PA01
ccaucagccagcccagu

SEQ ID NO: 3422620 - RNA, 14 nt, Pseudomonas aeruginosa PA01
ccaucagccgcgcg

SEQ ID NO: 3422621 - RNA, 14 nt, Pseudomonas aeruginosa PA01
ccaucagcgaccag

SEQ ID NO: 3422622 - RNA, 11 nt, Pseudomonas aeruginosa PA01
ccaucagcgcc

SEQ ID NO: 3422623 - RNA, 14 nt, Pseudomonas aeruginosa PA01
ccaucagcgccagg

SEQ ID NO: 3422624 - RNA, 16 nt, Pseudomonas aeruginosa PA01
ccaucagcgccagggc

SEQ ID NO: 3422625 - RNA, 17 nt, Pseudomonas aeruginosa PA01
ccaucagcgccagggca

SEQ ID NO: 3422626 - RNA, 20 nt, Pseudomonas aeruginosa PA01
ccaucagcgccgccucgcug

SEQ ID NO: 3422627 - RNA, 11 nt, Pseudomonas aeruginosa PA01
ccaucagcucc

SEQ ID NO: 3422628 - RNA, 22 nt, Pseudomonas aeruginosa PA01
ccaucagcuccacgucggcccg

SEQ ID NO: 3422629 - RNA, 12 nt, Pseudomonas aeruginosa PA01
ccaucaggaugc

SEQ ID NO: 3422630 - RNA, 12 nt, Pseudomonas aeruginosa PA01
ccaucaggccgc

SEQ ID NO: 3422631 - RNA, 12 nt, Pseudomonas aeruginosa PA01
ccaucaggcgcu

SEQ ID NO: 3422632 - RNA, 16 nt, Pseudomonas aeruginosa PA01
ccaucaggcucaggcg

SEQ ID NO: 3422633 - RNA, 17 nt, Pseudomonas aeruginosa PA01
ccaucaggcucaggcgu

SEQ ID NO: 3422634 - RNA, 15 nt, Pseudomonas aeruginosa PA01
ccaucagggcgaaag

SEQ ID NO: 3422635 - RNA, 12 nt, Pseudomonas aeruginosa PA01
ccauccagccag

SEQ ID NO: 3422636 - RNA, 16 nt, Pseudomonas aeruginosa PA01
ccauccagccaggcgc

SEQ ID NO: 3422637 - RNA, 20 nt, Pseudomonas aeruginosa PA01
ccauccaggcuuuccaccgc

SEQ ID NO: 3422638 - RNA, 22 nt, Pseudomonas aeruginosa PA01
ccauccagucuucgccggccug

SEQ ID NO: 3422639 - RNA, 12 nt, Pseudomonas aeruginosa PA01
ccauccccgagg

SEQ ID NO: 3422640 - RNA, 16 nt, Pseudomonas aeruginosa PA01
ccaucccucuaucaca

SEQ ID NO: 3422641 - RNA, 17 nt, Pseudomonas aeruginosa PA01
ccaugccgcccggccgc

SEQ ID NO: 3422642 - RNA, 15 nt, Pseudomonas aeruginosa PA01
ccaugccgccgacgc

SEQ ID NO: 3422643 - RNA, 20 nt, Pseudomonas aeruginosa PA01
ccaugccgccgacgccggac

SEQ ID NO: 3422644 - RNA, 21 nt, Pseudomonas aeruginosa PA01
ccaugccgcuagcccugcugc

SEQ ID NO: 3422645 - RNA, 13 nt, Pseudomonas aeruginosa PA01
ccaugccggcgcc

SEQ ID NO: 3422646 - RNA, 15 nt, Pseudomonas aeruginosa PA01
ccaugccggcgccga

SEQ ID NO: 3422647 - RNA, 19 nt, Pseudomonas aeruginosa PA01
ccaugccguagaucaggac

SEQ ID NO: 3422648 - RNA, 21 nt, Pseudomonas aeruginosa PA01
ccaugccguagaucaggacga

SEQ ID NO: 3422649 - RNA, 15 nt, Pseudomonas aeruginosa PA01
ccaugccguucagcg

SEQ ID NO: 3422650 - RNA, 17 nt, Pseudomonas aeruginosa PA01
ccaugccguucaggccg

SEQ ID NO: 3422651 - RNA, 21 nt, Pseudomonas aeruginosa PA01
ccaugccguucaggccggcgc

SEQ ID NO: 3422652 - RNA, 22 nt, Pseudomonas aeruginosa PA01
ccaugccguucaggccggcgcc

SEQ ID NO: 3422653 - RNA, 17 nt, Pseudomonas aeruginosa PA01
ccaugccuuccaccggc

SEQ ID NO: 3422654 - RNA, 18 nt, Pseudomonas aeruginosa PA01
ccaugccuuccaccggcg

SEQ ID NO: 3422655 - RNA, 16 nt, Pseudomonas aeruginosa PA01
ccaugccuugcagcgc

SEQ ID NO: 3422656 - RNA, 18 nt, Pseudomonas aeruginosa PA01
ccaugcgaaaacggcgac

SEQ ID NO: 3422657 - RNA, 21 nt, Pseudomonas aeruginosa PA01
ccaugcgaaaacggcgacccu

SEQ ID NO: 3422658 - RNA, 13 nt, Pseudomonas aeruginosa PA01
ccaugcggcaggc

SEQ ID NO: 3422659 - RNA, 17 nt, Pseudomonas aeruginosa PA01
ccaugcggcuacucgcc

SEQ ID NO: 3422660 - RNA, 19 nt, Pseudomonas aeruginosa PA01
ccaugcggcuacucgcccg

SEQ ID NO: 3422661 - RNA, 19 nt, Pseudomonas aeruginosa PA01
ccaugcgggagagcgccgu

SEQ ID NO: 3422662 - RNA, 15 nt, Pseudomonas aeruginosa PA01
ccaugcucaggucga

SEQ ID NO: 3422663 - RNA, 13 nt, Pseudomonas aeruginosa PA01
ccaugcuccgccu

SEQ ID NO: 3422664 - RNA, 15 nt, Pseudomonas aeruginosa PA01
ccaugcucggccagc

SEQ ID NO: 3422665 - RNA, 23 nt, Pseudomonas aeruginosa PA01
ccaugcucggccagcucgccgaa

SEQ ID NO: 3422666 - RNA, 19 nt, Pseudomonas aeruginosa PA01
ccaugcuggcgcucucgaa

SEQ ID NO: 3422667 - RNA, 11 nt, Pseudomonas aeruginosa PA01
ccauggcaucc

SEQ ID NO: 3422668 - RNA, 12 nt, Pseudomonas aeruginosa PA01
ccauggcauccc

SEQ ID NO: 3422669 - RNA, 15 nt, Pseudomonas aeruginosa PA01
ccauggccggcgugc

SEQ ID NO: 3422670 - RNA, 13 nt, Pseudomonas aeruginosa PA01
ccauggcggacau

SEQ ID NO: 3422671 - RNA, 22 nt, Pseudomonas aeruginosa PA01
ccauggcggugagcugaucgcg

SEQ ID NO: 3422672 - RNA, 23 nt, Pseudomonas aeruginosa PA01
ccaugggcacgccgguggccagg

SEQ ID NO: 3422673 - RNA, 17 nt, Pseudomonas aeruginosa PA01
ccaugggccggccgacg

SEQ ID NO: 3422674 - RNA, 20 nt, Pseudomonas aeruginosa PA01
ccaugguguuggcggccugg

SEQ ID NO: 3422675 - RNA, 16 nt, Pseudomonas aeruginosa PA01
ccaugguuuccgccgg

SEQ ID NO: 3422676 - RNA, 18 nt, Pseudomonas aeruginosa PA01
ccaugguuuccgccggac

SEQ ID NO: 3422677 - RNA, 14 nt, Pseudomonas aeruginosa PA01
ccauguaccucugg

SEQ ID NO: 3422678 - RNA, 14 nt, Pseudomonas aeruginosa PA01
ccauguagcguugc

SEQ ID NO: 3422679 - RNA, 15 nt, Pseudomonas aeruginosa PA01
ccaugugcuccuuga

SEQ ID NO: 3422680 - RNA, 18 nt, Pseudomonas aeruginosa PA01
ccaugugcuugaccgccg

SEQ ID NO: 3422681 - RNA, 18 nt, Pseudomonas aeruginosa PA01
ccauguggcgcagcauca

SEQ ID NO: 3422682 - RNA, 21 nt, Pseudomonas aeruginosa PA01
ccauguugcggcccagcggca

SEQ ID NO: 3422683 - RNA, 19 nt, Pseudomonas aeruginosa PA01
ccauguuggccuugagcag

SEQ ID NO: 3422684 - RNA, 14 nt, Pseudomonas aeruginosa PA01
ccauuccuuccagg

SEQ ID NO: 3422685 - RNA, 18 nt, Pseudomonas aeruginosa PA01
ccauucgaauggcgccgg

SEQ ID NO: 3422686 - RNA, 23 nt, Pseudomonas aeruginosa PA01
ccauucgaauggcgccggccaga

SEQ ID NO: 3422687 - RNA, 18 nt, Pseudomonas aeruginosa PA01
ccauucgaugccgcgcgc

SEQ ID NO: 3422688 - RNA, 15 nt, Pseudomonas aeruginosa PA01
ccauucgccgcgacg

SEQ ID NO: 3422689 - RNA, 18 nt, Pseudomonas aeruginosa PA01
ccauucgccgcgacgcuc

SEQ ID NO: 3422690 - RNA, 21 nt, Pseudomonas aeruginosa PA01
ccauucgcugucgagcaggga

SEQ ID NO: 3422691 - RNA, 20 nt, Pseudomonas aeruginosa PA01
ccauucgcugucgucggcgc

SEQ ID NO: 3422692 - RNA, 15 nt, Pseudomonas aeruginosa PA01
ccauucggccuggca

SEQ ID NO: 3422693 - RNA, 13 nt, Pseudomonas aeruginosa PA01
ccauucucgccau

SEQ ID NO: 3422694 - RNA, 14 nt, Pseudomonas aeruginosa PA01
ccauugcaucugcg

SEQ ID NO: 3422695 - RNA, 13 nt, Pseudomonas aeruginosa PA01
ccauugcccggcc

SEQ ID NO: 3422696 - RNA, 18 nt, Pseudomonas aeruginosa PA01
ccauugcccggccaggcg

SEQ ID NO: 3422697 - RNA, 22 nt, Pseudomonas aeruginosa PA01
ccauugcccgguggccuccugc

SEQ ID NO: 3422698 - RNA, 14 nt, Pseudomonas aeruginosa PA01
ccauugccgccagg

SEQ ID NO: 3422699 - RNA, 11 nt, Pseudomonas aeruginosa PA01
ccauugccgcg

SEQ ID NO: 3422700 - RNA, 18 nt, Pseudomonas aeruginosa PA01
ccauugcgccaggaccau

SEQ ID NO: 3422701 - RNA, 16 nt, Pseudomonas aeruginosa PA01
ccauugcguagggcgg

SEQ ID NO: 3422702 - RNA, 13 nt, Pseudomonas aeruginosa PA01
ccauuggccaggg

SEQ ID NO: 3422703 - RNA, 18 nt, Pseudomonas aeruginosa PA01
ccauuucguagcccaggc

SEQ ID NO: 3422704 - RNA, 19 nt, Pseudomonas aeruginosa PA01
cccaacagucgucgcgcag

SEQ ID NO: 3422705 - RNA, 20 nt, Pseudomonas aeruginosa PA01
cccaacagucgucgcgcagc

SEQ ID NO: 3422706 - RNA, 16 nt, Pseudomonas aeruginosa PA01
cccaacccggccagcc

SEQ ID NO: 3422707 - RNA, 15 nt, Pseudomonas aeruginosa PA01
cccaaccguucugcc

SEQ ID NO: 3422708 - RNA, 20 nt, Pseudomonas aeruginosa PA01
cccaaccguucugccgcagc

SEQ ID NO: 3422709 - RNA, 14 nt, Pseudomonas aeruginosa PA01
cccaaccuucuccc

SEQ ID NO: 3422710 - RNA, 22 nt, Pseudomonas aeruginosa PA01
cccaaccuucucccuucaggga

SEQ ID NO: 3422711 - RNA, 20 nt, Pseudomonas aeruginosa PA01
cccaacggaaaaaggcgccu

SEQ ID NO: 3422712 - RNA, 13 nt, Pseudomonas aeruginosa PA01
cccaacuccagcu

SEQ ID NO: 3422713 - RNA, 13 nt, Pseudomonas aeruginosa PA01
cccaaggggccgc

SEQ ID NO: 3422714 - RNA, 23 nt, Pseudomonas aeruginosa PA01
cccaauacggcggggucgggcag

SEQ ID NO: 3422715 - RNA, 14 nt, Pseudomonas aeruginosa PA01
cccaauccgcgccg

SEQ ID NO: 3422716 - RNA, 23 nt, Pseudomonas aeruginosa PA01
cccaauugcccguagggcgaaca

SEQ ID NO: 3422717 - RNA, 17 nt, Pseudomonas aeruginosa PA01
cccaauugccguagggc

SEQ ID NO: 3422718 - RNA, 20 nt, Pseudomonas aeruginosa PA01
cccaauugccguagggcgaa

SEQ ID NO: 3422719 - RNA, 14 nt, Pseudomonas aeruginosa PA01
cccacaggcccugc

SEQ ID NO: 3422720 - RNA, 17 nt, Pseudomonas aeruginosa PA01
cccacaggcccugcagc

SEQ ID NO: 3422721 - RNA, 20 nt, Pseudomonas aeruginosa PA01
cccacaggcccugcagcgcc

SEQ ID NO: 3422722 - RNA, 21 nt, Pseudomonas aeruginosa PA01
cccacaggcccugcagcgcca

SEQ ID NO: 3422723 - RNA, 18 nt, Pseudomonas aeruginosa PA01
cccacaggccggcuaacc

SEQ ID NO: 3422724 - RNA, 22 nt, Pseudomonas aeruginosa PA01
cccacaggguggcgggcggccc

SEQ ID NO: 3422725 - RNA, 15 nt, Pseudomonas aeruginosa PA01
cccacagugccaggc

SEQ ID NO: 3422726 - RNA, 19 nt, Pseudomonas aeruginosa PA01
cccaccagcgucgccaggc

SEQ ID NO: 3422727 - RNA, 21 nt, Pseudomonas aeruginosa PA01
cccaccagcgucgccaggccg

SEQ ID NO: 3422728 - RNA, 12 nt, Pseudomonas aeruginosa PA01
cccaccaggcuc

SEQ ID NO: 3422729 - RNA, 12 nt, Pseudomonas aeruginosa PA01
cccacccguccc

SEQ ID NO: 3422730 - RNA, 15 nt, Pseudomonas aeruginosa PA01
cccacccgucccgcg

SEQ ID NO: 3422731 - RNA, 19 nt, Pseudomonas aeruginosa PA01
cccaccgaauaccagggcu

SEQ ID NO: 3422732 - RNA, 14 nt, Pseudomonas aeruginosa PA01
cccaccgaccacca

SEQ ID NO: 3422733 - RNA, 20 nt, Pseudomonas aeruginosa PA01
cccaccgcccccgcauccuc

SEQ ID NO: 3422734 - RNA, 13 nt, Pseudomonas aeruginosa PA01
cccaccgcgcggc

SEQ ID NO: 3422735 - RNA, 21 nt, Pseudomonas aeruginosa PA01
cccaccgcgggggucggaugc

SEQ ID NO: 3422736 - RNA, 19 nt, Pseudomonas aeruginosa PA01
cccaccgcuuucagcgccg

SEQ ID NO: 3422737 - RNA, 18 nt, Pseudomonas aeruginosa PA01
cccaccggcucgcucucg

SEQ ID NO: 3422738 - RNA, 20 nt, Pseudomonas aeruginosa PA01
cccaccgggaucugccggua

SEQ ID NO: 3422739 - RNA, 21 nt, Pseudomonas aeruginosa PA01
cccaccgggccaucgcggaaa

SEQ ID NO: 3422740 - RNA, 16 nt, Pseudomonas aeruginosa PA01
cccaccggucuuggcg

SEQ ID NO: 3422741 - RNA, 17 nt, Pseudomonas aeruginosa PA01
cccaccugaacgcgccc

SEQ ID NO: 3422742 - RNA, 20 nt, Pseudomonas aeruginosa PA01
cccacgcauuggcuucgccc

SEQ ID NO: 3422743 - RNA, 13 nt, Pseudomonas aeruginosa PA01
cccacgcccaucg

SEQ ID NO: 3422744 - RNA, 18 nt, Pseudomonas aeruginosa PA01
cccagcgcccgcaccacc

SEQ ID NO: 3422745 - RNA, 13 nt, Pseudomonas aeruginosa PA01
cccagcgccgcca

SEQ ID NO: 3422746 - RNA, 18 nt, Pseudomonas aeruginosa PA01
cccagcgccgccagcagg

SEQ ID NO: 3422747 - RNA, 14 nt, Pseudomonas aeruginosa PA01
cccagcgccgccug

SEQ ID NO: 3422748 - RNA, 23 nt, Pseudomonas aeruginosa PA01
cccagcgccgccugcuggcugcc

SEQ ID NO: 3422749 - RNA, 14 nt, Pseudomonas aeruginosa PA01
cccagcgccugcaa

SEQ ID NO: 3422750 - RNA, 12 nt, Pseudomonas aeruginosa PA01
cccagcgccugg

SEQ ID NO: 3422751 - RNA, 15 nt, Pseudomonas aeruginosa PA01
cccagcgccugggcc

SEQ ID NO: 3422752 - RNA, 12 nt, Pseudomonas aeruginosa PA01
cccagcgcgccg

SEQ ID NO: 3422753 - RNA, 15 nt, Pseudomonas aeruginosa PA01
cccagcgcgccgccg

SEQ ID NO: 3422754 - RNA, 13 nt, Pseudomonas aeruginosa PA01
cccagcgcggcgc

SEQ ID NO: 3422755 - RNA, 18 nt, Pseudomonas aeruginosa PA01
cccagcgcgugcaggcgc

SEQ ID NO: 3422756 - RNA, 17 nt, Pseudomonas aeruginosa PA01
cccagcgcugguugacg

SEQ ID NO: 3422757 - RNA, 13 nt, Pseudomonas aeruginosa PA01
cccagcggcaggc

SEQ ID NO: 3422758 - RNA, 20 nt, Pseudomonas aeruginosa PA01
cccagcggcagggcggcgau

SEQ ID NO: 3422759 - RNA, 14 nt, Pseudomonas aeruginosa PA01
cccagcggcagguc

SEQ ID NO: 3422760 - RNA, 16 nt, Pseudomonas aeruginosa PA01
cccagcggcaggucgu

SEQ ID NO: 3422761 - RNA, 13 nt, Pseudomonas aeruginosa PA01
cccagcggcgcca

SEQ ID NO: 3422762 - RNA, 14 nt, Pseudomonas aeruginosa PA01
cccagcggcgccag

SEQ ID NO: 3422763 - RNA, 13 nt, Pseudomonas aeruginosa PA01
cccagcguucggc

SEQ ID NO: 3422764 - RNA, 20 nt, Pseudomonas aeruginosa PA01
cccagcguucggcgcuggcg

SEQ ID NO: 3422765 - RNA, 19 nt, Pseudomonas aeruginosa PA01
cccagcucgccgcuccaca

SEQ ID NO: 3422766 - RNA, 21 nt, Pseudomonas aeruginosa PA01
cccagcuugauguaggacagg

SEQ ID NO: 3422767 - RNA, 21 nt, Pseudomonas aeruginosa PA01
cccagcuugcuggcguagaag

SEQ ID NO: 3422768 - RNA, 12 nt, Pseudomonas aeruginosa PA01
cccagcuuggcc

SEQ ID NO: 3422769 - RNA, 17 nt, Pseudomonas aeruginosa PA01
cccaggaaaacaucacg

SEQ ID NO: 3422770 - RNA, 13 nt, Pseudomonas aeruginosa PA01
cccaggaaggagc

SEQ ID NO: 3422771 - RNA, 23 nt, Pseudomonas aeruginosa PA01
cccaggacaacgacagccccggc

SEQ ID NO: 3422772 - RNA, 18 nt, Pseudomonas aeruginosa PA01
cccaggauuuguccgcgc

SEQ ID NO: 3422773 - RNA, 12 nt, Pseudomonas aeruginosa PA01
cccaggcacggc

SEQ ID NO: 3422774 - RNA, 18 nt, Pseudomonas aeruginosa PA01
cccaggcacggcuucagc

SEQ ID NO: 3422775 - RNA, 22 nt, Pseudomonas aeruginosa PA01
cccaggcacggcuucagcgcca

SEQ ID NO: 3422776 - RNA, 18 nt, Pseudomonas aeruginosa PA01
cccaggcagaucgcgccg

SEQ ID NO: 3422777 - RNA, 22 nt, Pseudomonas aeruginosa PA01
cccaggcagaucgcgccgagcu

SEQ ID NO: 3422778 - RNA, 23 nt, Pseudomonas aeruginosa PA01
cccaggcagcagagcgccacggg

SEQ ID NO: 3422779 - RNA, 13 nt, Pseudomonas aeruginosa PA01
cccaggcaggcga

SEQ ID NO: 3422780 - RNA, 19 nt, Pseudomonas aeruginosa PA01
cccaggccaaccaccccga

SEQ ID NO: 3422781 - RNA, 18 nt, Pseudomonas aeruginosa PA01
cccaggccacgcccaugc

SEQ ID NO: 3422782 - RNA, 13 nt, Pseudomonas aeruginosa PA01
cccaggccagcgg

SEQ ID NO: 3422783 - RNA, 14 nt, Pseudomonas aeruginosa PA01
cccaggccagcggg

SEQ ID NO: 3422784 - RNA, 15 nt, Pseudomonas aeruginosa PA01
cccaggcccagccgg

SEQ ID NO: 3422785 - RNA, 16 nt, Pseudomonas aeruginosa PA01
cccaggcccagccggu

SEQ ID NO: 3422786 - RNA, 17 nt, Pseudomonas aeruginosa PA01
cccaggcccagcgcggc

SEQ ID NO: 3422787 - RNA, 18 nt, Pseudomonas aeruginosa PA01
cccaggccgacagcggcu

SEQ ID NO: 3422788 - RNA, 13 nt, Pseudomonas aeruginosa PA01
cccaggccgccga

SEQ ID NO: 3422789 - RNA, 14 nt, Pseudomonas aeruginosa PA01
cccaggccgcgcag

SEQ ID NO: 3422790 - RNA, 15 nt, Pseudomonas aeruginosa PA01
cccaggccgcgcagc

SEQ ID NO: 3422791 - RNA, 22 nt, Pseudomonas aeruginosa PA01
cccaggccgcgcagcaacggcg

SEQ ID NO: 3422792 - RNA, 13 nt, Pseudomonas aeruginosa PA01
cccaggccggguc

SEQ ID NO: 3422793 - RNA, 20 nt, Pseudomonas aeruginosa PA01
cccaggccgggucgcagccg

SEQ ID NO: 3422794 - RNA, 17 nt, Pseudomonas aeruginosa PA01
cccaggccgucgagggc

SEQ ID NO: 3422795 - RNA, 18 nt, Pseudomonas aeruginosa PA01
cccaggccgucgagggca

SEQ ID NO: 3422796 - RNA, 17 nt, Pseudomonas aeruginosa PA01
cccaggccuggguguug

SEQ ID NO: 3422797 - RNA, 14 nt, Pseudomonas aeruginosa PA01
cccaggcgauccac

SEQ ID NO: 3422798 - RNA, 18 nt, Pseudomonas aeruginosa PA01
cccaggcgauccacagca

SEQ ID NO: 3422799 - RNA, 22 nt, Pseudomonas aeruginosa PA01
cccaggcgauccacagcagguu

SEQ ID NO: 3422800 - RNA, 12 nt, Pseudomonas aeruginosa PA01
cccaggcgccca

SEQ ID NO: 3422801 - RNA, 13 nt, Pseudomonas aeruginosa PA01
cccaggcgccgau

SEQ ID NO: 3422802 - RNA, 15 nt, Pseudomonas aeruginosa PA01
cccaggcgccgaucc

SEQ ID NO: 3422803 - RNA, 13 nt, Pseudomonas aeruginosa PA01
cccaggcgccgcu

SEQ ID NO: 3422804 - RNA, 14 nt, Pseudomonas aeruginosa PA01
cccaggcgcggcgu

SEQ ID NO: 3422805 - RNA, 19 nt, Pseudomonas aeruginosa PA01
cccaggcgcggcgucgggc

SEQ ID NO: 3422806 - RNA, 15 nt, Pseudomonas aeruginosa PA01
cccaggcgcucggcg

SEQ ID NO: 3422807 - RNA, 19 nt, Pseudomonas aeruginosa PA01
cccaggcgcucggcggcgc

SEQ ID NO: 3422808 - RNA, 22 nt, Pseudomonas aeruginosa PA01
cccaggcgcucggcggcgcgca

SEQ ID NO: 3422809 - RNA, 12 nt, Pseudomonas aeruginosa PA01
cccaggcgcugc

SEQ ID NO: 3422810 - RNA, 16 nt, Pseudomonas aeruginosa PA01
cccaggcgucgcgcca

SEQ ID NO: 3422811 - RNA, 17 nt, Pseudomonas aeruginosa PA01
cccaggcgucgcgccag

SEQ ID NO: 3422812 - RNA, 18 nt, Pseudomonas aeruginosa PA01
cccaggcgucgcgccagc

SEQ ID NO: 3422813 - RNA, 19 nt, Pseudomonas aeruginosa PA01
cccaggcgucgcgccagca

SEQ ID NO: 3422814 - RNA, 20 nt, Pseudomonas aeruginosa PA01
cccaggcugccgccgccguc

SEQ ID NO: 3422815 - RNA, 19 nt, Pseudomonas aeruginosa PA01
cccaggcugccggccaggu

SEQ ID NO: 3422816 - RNA, 20 nt, Pseudomonas aeruginosa PA01
cccaggcugccggccaggua

SEQ ID NO: 3422817 - RNA, 15 nt, Pseudomonas aeruginosa PA01
cccaggcuggcggca

SEQ ID NO: 3422818 - RNA, 19 nt, Pseudomonas aeruginosa PA01
cccaggcuggcggccaggg

SEQ ID NO: 3422819 - RNA, 14 nt, Pseudomonas aeruginosa PA01
cccagggacgcgcc

SEQ ID NO: 3422820 - RNA, 20 nt, Pseudomonas aeruginosa PA01
cccagggcaguacguggcgc

SEQ ID NO: 3422821 - RNA, 14 nt, Pseudomonas aeruginosa PA01
cccagggccagcgg

SEQ ID NO: 3422822 - RNA, 19 nt, Pseudomonas aeruginosa PA01
cccagggccagcggguuga

SEQ ID NO: 3422823 - RNA, 23 nt, Pseudomonas aeruginosa PA01
cccagggcccagagcagcaccag

SEQ ID NO: 3422824 - RNA, 15 nt, Pseudomonas aeruginosa PA01
cccagggcgcugccg

SEQ ID NO: 3422825 - RNA, 13 nt, Pseudomonas aeruginosa PA01
cccagggcguggu

SEQ ID NO: 3422826 - RNA, 14 nt, Pseudomonas aeruginosa PA01
cccaggggcacguc

SEQ ID NO: 3422827 - RNA, 16 nt, Pseudomonas aeruginosa PA01
cccaggggucggcauc

SEQ ID NO: 3422828 - RNA, 19 nt, Pseudomonas aeruginosa PA01
cccaggggucggcaucgcg

SEQ ID NO: 3422829 - RNA, 19 nt, Pseudomonas aeruginosa PA01
cccagggugacgcucuuca

SEQ ID NO: 3422830 - RNA, 23 nt, Pseudomonas aeruginosa PA01
cccagggugcgccggggaucagg

SEQ ID NO: 3422831 - RNA, 19 nt, Pseudomonas aeruginosa PA01
cccaggguuggcggcaucg

SEQ ID NO: 3422832 - RNA, 21 nt, Pseudomonas aeruginosa PA01
cccaggguuggcggcaucgcg

SEQ ID NO: 3422833 - RNA, 22 nt, Pseudomonas aeruginosa PA01
cccagguacugggcgauguccu

SEQ ID NO: 3422834 - RNA, 16 nt, Pseudomonas aeruginosa PA01
cccagguagccggcga

SEQ ID NO: 3422835 - RNA, 15 nt, Pseudomonas aeruginosa PA01
cccagguagcgcugc

SEQ ID NO: 3422836 - RNA, 20 nt, Pseudomonas aeruginosa PA01
cccagguagcgcugcgccag

SEQ ID NO: 3422837 - RNA, 22 nt, Pseudomonas aeruginosa PA01
cccagguagcgcugcgccaggc

SEQ ID NO: 3422838 - RNA, 22 nt, Pseudomonas aeruginosa PA01
cccagguagucgcccagcgccu

SEQ ID NO: 3422839 - RNA, 13 nt, Pseudomonas aeruginosa PA01
cccaggucggcgg

SEQ ID NO: 3422840 - RNA, 15 nt, Pseudomonas aeruginosa PA01
cccaggucggcgggc

SEQ ID NO: 3422841 - RNA, 21 nt, Pseudomonas aeruginosa PA01
cccaggucggcgggcaccgcc

SEQ ID NO: 3422842 - RNA, 13 nt, Pseudomonas aeruginosa PA01
cccaggugcagcg

SEQ ID NO: 3422843 - RNA, 17 nt, Pseudomonas aeruginosa PA01
cccaggugcccuggaag

SEQ ID NO: 3422844 - RNA, 17 nt, Pseudomonas aeruginosa PA01
cccaggugcgcaggcgc

SEQ ID NO: 3422845 - RNA, 24 nt, Pseudomonas aeruginosa PA01
cccaggugcgccgagcgcucgccg

SEQ ID NO: 3422846 - RNA, 14 nt, Pseudomonas aeruginosa PA01
cccagguggcaggc

SEQ ID NO: 3422847 - RNA, 16 nt, Pseudomonas aeruginosa PA01
ccccagcaucgccggc

SEQ ID NO: 3422848 - RNA, 13 nt, Pseudomonas aeruginosa PA01
ccccagccuccac

SEQ ID NO: 3422849 - RNA, 12 nt, Pseudomonas aeruginosa PA01
ccccagcgcccg

SEQ ID NO: 3422850 - RNA, 11 nt, Pseudomonas aeruginosa PA01
ccccagcgccu

SEQ ID NO: 3422851 - RNA, 14 nt, Pseudomonas aeruginosa PA01
ccccagcgccuggg

SEQ ID NO: 3422852 - RNA, 16 nt, Pseudomonas aeruginosa PA01
ccccagcgccugggcc

SEQ ID NO: 3422853 - RNA, 15 nt, Pseudomonas aeruginosa PA01
ccccagcgcgagcgu

SEQ ID NO: 3422854 - RNA, 16 nt, Pseudomonas aeruginosa PA01
ccccagcucagcaggu

SEQ ID NO: 3422855 - RNA, 17 nt, Pseudomonas aeruginosa PA01
ccccagcucagcagguc

SEQ ID NO: 3422856 - RNA, 22 nt, Pseudomonas aeruginosa PA01
ccccaggcaccguaggccaggc

SEQ ID NO: 3422857 - RNA, 14 nt, Pseudomonas aeruginosa PA01
ccccaggccgccgc

SEQ ID NO: 3422858 - RNA, 22 nt, Pseudomonas aeruginosa PA01
ccccaggccgccgccugcucgc

SEQ ID NO: 3422859 - RNA, 22 nt, Pseudomonas aeruginosa PA01
ccccaggcgauccacagcaggu

SEQ ID NO: 3422860 - RNA, 12 nt, Pseudomonas aeruginosa PA01
ccccaggcgccc

SEQ ID NO: 3422861 - RNA, 13 nt, Pseudomonas aeruginosa PA01
ccccaggcgccca

SEQ ID NO: 3422862 - RNA, 16 nt, Pseudomonas aeruginosa PA01
ccccaggcugcccagg

SEQ ID NO: 3422863 - RNA, 14 nt, Pseudomonas aeruginosa PA01
ccccagggccggcg

SEQ ID NO: 3422864 - RNA, 14 nt, Pseudomonas aeruginosa PA01
ccccaggugcagcg

SEQ ID NO: 3422865 - RNA, 14 nt, Pseudomonas aeruginosa PA01
ccccauccgggcgg

SEQ ID NO: 3422866 - RNA, 20 nt, Pseudomonas aeruginosa PA01
ccccaugaaaaaggcgcccg

SEQ ID NO: 3422867 - RNA, 22 nt, Pseudomonas aeruginosa PA01
ccccaugcccggccuggcgucc

SEQ ID NO: 3422868 - RNA, 20 nt, Pseudomonas aeruginosa PA01
cccccaauugcccguagggc

SEQ ID NO: 3422869 - RNA, 19 nt, Pseudomonas aeruginosa PA01
cccccaauugccguagggc

SEQ ID NO: 3422870 - RNA, 15 nt, Pseudomonas aeruginosa PA01
cccccacccgucccg

SEQ ID NO: 3422871 - RNA, 12 nt, Pseudomonas aeruginosa PA01
cccccagcaccu

SEQ ID NO: 3422872 - RNA, 16 nt, Pseudomonas aeruginosa PA01
cccccagcaggccagc

SEQ ID NO: 3422873 - RNA, 13 nt, Pseudomonas aeruginosa PA01
cccccagcgcgcc

SEQ ID NO: 3422874 - RNA, 16 nt, Pseudomonas aeruginosa PA01
cccccauaccgccucg

SEQ ID NO: 3422875 - RNA, 17 nt, Pseudomonas aeruginosa PA01
cccccaucgcccgcagc

SEQ ID NO: 3422876 - RNA, 22 nt, Pseudomonas aeruginosa PA01
cccccaucgcccgcagccacag

SEQ ID NO: 3422877 - RNA, 20 nt, Pseudomonas aeruginosa PA01
cccccaugaaaaaggcgccc

SEQ ID NO: 3422878 - RNA, 12 nt, Pseudomonas aeruginosa PA01
ccccccacccgu

SEQ ID NO: 3422879 - RNA, 13 nt, Pseudomonas aeruginosa PA01
ccccccgcgaagc

SEQ ID NO: 3422880 - RNA, 13 nt, Pseudomonas aeruginosa PA01
ccccccuacgaaa

SEQ ID NO: 3422881 - RNA, 13 nt, Pseudomonas aeruginosa PA01
cccccgcaaccgc

SEQ ID NO: 3422882 - RNA, 19 nt, Pseudomonas aeruginosa PA01
cccccgcaaccgcugccgc

SEQ ID NO: 3422883 - RNA, 15 nt, Pseudomonas aeruginosa PA01
cccccggcccggcca

SEQ ID NO: 3422884 - RNA, 21 nt, Pseudomonas aeruginosa PA01
cccccggcccggccauccugg

SEQ ID NO: 3422885 - RNA, 12 nt, Pseudomonas aeruginosa PA01
cccccggcgccc

SEQ ID NO: 3422886 - RNA, 23 nt, Pseudomonas aeruginosa PA01
cccccguggcgacgcagcacggc

SEQ ID NO: 3422887 - RNA, 14 nt, Pseudomonas aeruginosa PA01
cccccuacgaaagc

SEQ ID NO: 3422888 - RNA, 24 nt, Pseudomonas aeruginosa PA01
cccccuguuucgaugagcuucgcc

SEQ ID NO: 3422889 - RNA, 14 nt, Pseudomonas aeruginosa PA01
ccccgaacuucccc

SEQ ID NO: 3422890 - RNA, 20 nt, Pseudomonas aeruginosa PA01
ccccgaccaggucgcuggca

SEQ ID NO: 3422891 - RNA, 19 nt, Pseudomonas aeruginosa PA01
ccccgaggccagcaggccg

SEQ ID NO: 3422892 - RNA, 13 nt, Pseudomonas aeruginosa PA01
ccccgaggcgacg

SEQ ID NO: 3422893 - RNA, 13 nt, Pseudomonas aeruginosa PA01
ccccgaucaccgg

SEQ ID NO: 3422894 - RNA, 13 nt, Pseudomonas aeruginosa PA01
ccccgcaaccgcu

SEQ ID NO: 3422895 - RNA, 15 nt, Pseudomonas aeruginosa PA01
ccccgcaaccgcugc

SEQ ID NO: 3422896 - RNA, 18 nt, Pseudomonas aeruginosa PA01
ccccgcaaggugcgggcc

SEQ ID NO: 3422897 - RNA, 19 nt, Pseudomonas aeruginosa PA01
ccccgcaaggugcgggccg

SEQ ID NO: 3422898 - RNA, 11 nt, Pseudomonas aeruginosa PA01
ccccgcagccg

SEQ ID NO: 3422899 - RNA, 17 nt, Pseudomonas aeruginosa PA01
ccccgccacuuccagca

SEQ ID NO: 3422900 - RNA, 23 nt, Pseudomonas aeruginosa PA01
ccccgccacuuccagcacgccga

SEQ ID NO: 3422901 - RNA, 13 nt, Pseudomonas aeruginosa PA01
ccccgcccuagcg

SEQ ID NO: 3422902 - RNA, 15 nt, Pseudomonas aeruginosa PA01
ccccgccgccaggcg

SEQ ID NO: 3422903 - RNA, 22 nt, Pseudomonas aeruginosa PA01
ccccgccgccaggcgcuggcga

SEQ ID NO: 3422904 - RNA, 13 nt, Pseudomonas aeruginosa PA01
ccccgccucgacc

SEQ ID NO: 3422905 - RNA, 20 nt, Pseudomonas aeruginosa PA01
ccccgcgaagcgacggcgca

SEQ ID NO: 3422906 - RNA, 14 nt, Pseudomonas aeruginosa PA01
ccccgcgccgccgg

SEQ ID NO: 3422907 - RNA, 19 nt, Pseudomonas aeruginosa PA01
ccccgcguguucgaccggg

SEQ ID NO: 3422908 - RNA, 13 nt, Pseudomonas aeruginosa PA01
ccccgcuauggcg

SEQ ID NO: 3422909 - RNA, 18 nt, Pseudomonas aeruginosa PA01
ccccgcuccgcucagucg

SEQ ID NO: 3422910 - RNA, 17 nt, Pseudomonas aeruginosa PA01
ccccgcuugccgucgac

SEQ ID NO: 3422911 - RNA, 16 nt, Pseudomonas aeruginosa PA01
ccccggaccagggcgc

SEQ ID NO: 3422912 - RNA, 21 nt, Pseudomonas aeruginosa PA01
ccccggcaagggccugcucag

SEQ ID NO: 3422913 - RNA, 16 nt, Pseudomonas aeruginosa PA01
ccccggcagccaccag

SEQ ID NO: 3422914 - RNA, 12 nt, Pseudomonas aeruginosa PA01
ccccggccagca

SEQ ID NO: 3422915 - RNA, 20 nt, Pseudomonas aeruginosa PA01
ccccggccagcagcgccucc

SEQ ID NO: 3422916 - RNA, 12 nt, Pseudomonas aeruginosa PA01
ccccggccaggu

SEQ ID NO: 3422917 - RNA, 23 nt, Pseudomonas aeruginosa PA01
ccccggccagguaccggccaggc

SEQ ID NO: 3422918 - RNA, 16 nt, Pseudomonas aeruginosa PA01
ccccggcccgcgccgc

SEQ ID NO: 3422919 - RNA, 14 nt, Pseudomonas aeruginosa PA01
ccccggcccggcca

SEQ ID NO: 3422920 - RNA, 13 nt, Pseudomonas aeruginosa PA01
ccccggcccggcg

SEQ ID NO: 3422921 - RNA, 15 nt, Pseudomonas aeruginosa PA01
ccccggcccgggcgu

SEQ ID NO: 3422922 - RNA, 13 nt, Pseudomonas aeruginosa PA01
ccccggccggcag

SEQ ID NO: 3422923 - RNA, 13 nt, Pseudomonas aeruginosa PA01
ccccggccuggcg

SEQ ID NO: 3422924 - RNA, 16 nt, Pseudomonas aeruginosa PA01
ccccggccuggcuggc

SEQ ID NO: 3422925 - RNA, 11 nt, Pseudomonas aeruginosa PA01
ccccggcgauc

SEQ ID NO: 3422926 - RNA, 14 nt, Pseudomonas aeruginosa PA01
ccccggcgcccaga

SEQ ID NO: 3422927 - RNA, 19 nt, Pseudomonas aeruginosa PA01
ccccggcgcccagaaaaaa

SEQ ID NO: 3422928 - RNA, 13 nt, Pseudomonas aeruginosa PA01
ccccggcggcgau

SEQ ID NO: 3422929 - RNA, 20 nt, Pseudomonas aeruginosa PA01
ccccggcggguucagcccgc

SEQ ID NO: 3422930 - RNA, 18 nt, Pseudomonas aeruginosa PA01
ccccggcucauggccggg

SEQ ID NO: 3422931 - RNA, 13 nt, Pseudomonas aeruginosa PA01
ccccggcuuggcg

SEQ ID NO: 3422932 - RNA, 19 nt, Pseudomonas aeruginosa PA01
ccccgggaugcccggccgc

SEQ ID NO: 3422933 - RNA, 16 nt, Pseudomonas aeruginosa PA01
ccccgggucgcgcagc

SEQ ID NO: 3422934 - RNA, 17 nt, Pseudomonas aeruginosa PA01
ccccgggucgcgcagcg

SEQ ID NO: 3422935 - RNA, 22 nt, Pseudomonas aeruginosa PA01
ccccgggucgcugcucagggcc

SEQ ID NO: 3422936 - RNA, 15 nt, Pseudomonas aeruginosa PA01
ccccggucaggccga

SEQ ID NO: 3422937 - RNA, 18 nt, Pseudomonas aeruginosa PA01
ccccggucucgcgcagcg

SEQ ID NO: 3422938 - RNA, 23 nt, Pseudomonas aeruginosa PA01
ccccguagccaugcccggcuggc

SEQ ID NO: 3422939 - RNA, 19 nt, Pseudomonas aeruginosa PA01
ccccgucaacccuugcucc

SEQ ID NO: 3422940 - RNA, 13 nt, Pseudomonas aeruginosa PA01
ccccguccuggcg

SEQ ID NO: 3422941 - RNA, 19 nt, Pseudomonas aeruginosa PA01
ccccgucgacgcaucgacg

SEQ ID NO: 3422942 - RNA, 14 nt, Pseudomonas aeruginosa PA01
ccccguggcgccgc

SEQ ID NO: 3422943 - RNA, 19 nt, Pseudomonas aeruginosa PA01
ccccguggcgccgcagggc

SEQ ID NO: 3422944 - RNA, 15 nt, Pseudomonas aeruginosa PA01
ccccguggcgggcca

SEQ ID NO: 3422945 - RNA, 18 nt, Pseudomonas aeruginosa PA01
ccccguggcgggccagca

SEQ ID NO: 3422946 - RNA, 19 nt, Pseudomonas aeruginosa PA01
ccccguuugccgucggcgc

SEQ ID NO: 3422947 - RNA, 19 nt, Pseudomonas aeruginosa PA01
ccccuagaccaacugcgcc

SEQ ID NO: 3422948 - RNA, 13 nt, Pseudomonas aeruginosa PA01
ccccucaggcgcc

SEQ ID NO: 3422949 - RNA, 18 nt, Pseudomonas aeruginosa PA01
ccccucccagccacagag

SEQ ID NO: 3422950 - RNA, 21 nt, Pseudomonas aeruginosa PA01
ccccucccgcgccagcgccgc

SEQ ID NO: 3422951 - RNA, 17 nt, Pseudomonas aeruginosa PA01
cccgcagcggcagcggc

SEQ ID NO: 3422952 - RNA, 21 nt, Pseudomonas aeruginosa PA01
cccgcagcggcagcggcucgu

SEQ ID NO: 3422953 - RNA, 12 nt, Pseudomonas aeruginosa PA01
cccgcagcggcg

SEQ ID NO: 3422954 - RNA, 20 nt, Pseudomonas aeruginosa PA01
cccgcagggcucgugccauc

SEQ ID NO: 3422955 - RNA, 19 nt, Pseudomonas aeruginosa PA01
cccgcaguuccucgccgcu

SEQ ID NO: 3422956 - RNA, 21 nt, Pseudomonas aeruginosa PA01
cccgcaguuccucgccgcugc

SEQ ID NO: 3422957 - RNA, 19 nt, Pseudomonas aeruginosa PA01
cccgcaucccaguagccgg

SEQ ID NO: 3422958 - RNA, 14 nt, Pseudomonas aeruginosa PA01
cccgcauccuccac

SEQ ID NO: 3422959 - RNA, 19 nt, Pseudomonas aeruginosa PA01
cccgcaucgaggccgccca

SEQ ID NO: 3422960 - RNA, 21 nt, Pseudomonas aeruginosa PA01
cccgcaucgaggccgcccagc

SEQ ID NO: 3422961 - RNA, 19 nt, Pseudomonas aeruginosa PA01
cccgccaaggcccugcugc

SEQ ID NO: 3422962 - RNA, 13 nt, Pseudomonas aeruginosa PA01
cccgccaaggcgg

SEQ ID NO: 3422963 - RNA, 14 nt, Pseudomonas aeruginosa PA01
cccgccaaggcggg

SEQ ID NO: 3422964 - RNA, 18 nt, Pseudomonas aeruginosa PA01
cccgccaagggcgccgcc

SEQ ID NO: 3422965 - RNA, 19 nt, Pseudomonas aeruginosa PA01
cccgccaagggcgccgccg

SEQ ID NO: 3422966 - RNA, 22 nt, Pseudomonas aeruginosa PA01
cccgccaagggcgccgccgagg

SEQ ID NO: 3422967 - RNA, 16 nt, Pseudomonas aeruginosa PA01
cccgccacagaucgcc

SEQ ID NO: 3422968 - RNA, 20 nt, Pseudomonas aeruginosa PA01
cccgccacagaucgccagcu

SEQ ID NO: 3422969 - RNA, 15 nt, Pseudomonas aeruginosa PA01
cccgccaccgacccu

SEQ ID NO: 3422970 - RNA, 23 nt, Pseudomonas aeruginosa PA01
cccgccaccgacccucggcgagg

SEQ ID NO: 3422971 - RNA, 14 nt, Pseudomonas aeruginosa PA01
cccgccaccuggcg

SEQ ID NO: 3422972 - RNA, 21 nt, Pseudomonas aeruginosa PA01
cccgccacggcgcgcuccggc

SEQ ID NO: 3422973 - RNA, 17 nt, Pseudomonas aeruginosa PA01
cccgccacuuccagcac

SEQ ID NO: 3422974 - RNA, 20 nt, Pseudomonas aeruginosa PA01
cccgccacuuccagcacgcc

SEQ ID NO: 3422975 - RNA, 22 nt, Pseudomonas aeruginosa PA01
cccgccaggagccuacggagga

SEQ ID NO: 3422976 - RNA, 15 nt, Pseudomonas aeruginosa PA01
cccgccaggcgccga

SEQ ID NO: 3422977 - RNA, 16 nt, Pseudomonas aeruginosa PA01
cccgccaggucgaggg

SEQ ID NO: 3422978 - RNA, 14 nt, Pseudomonas aeruginosa PA01
cccgccagguggcg

SEQ ID NO: 3422979 - RNA, 22 nt, Pseudomonas aeruginosa PA01
cccgccauguuggccuugagca

SEQ ID NO: 3422980 - RNA, 14 nt, Pseudomonas aeruginosa PA01
cccgcccaguucgu

SEQ ID NO: 3422981 - RNA, 15 nt, Pseudomonas aeruginosa PA01
cccgcccaguucgua

SEQ ID NO: 3422982 - RNA, 13 nt, Pseudomonas aeruginosa PA01
cccgccccgcaag

SEQ ID NO: 3422983 - RNA, 14 nt, Pseudomonas aeruginosa PA01
cccgccccgcacca

SEQ ID NO: 3422984 - RNA, 17 nt, Pseudomonas aeruginosa PA01
cccgccccgcaccagcc

SEQ ID NO: 3422985 - RNA, 13 nt, Pseudomonas aeruginosa PA01
cccgccccugcuc

SEQ ID NO: 3422986 - RNA, 14 nt, Pseudomonas aeruginosa PA01
cccgccccugcucc

SEQ ID NO: 3422987 - RNA, 14 nt, Pseudomonas aeruginosa PA01
cccgccccuuuccg

SEQ ID NO: 3422988 - RNA, 14 nt, Pseudomonas aeruginosa PA01
cccgcccgccgucc

SEQ ID NO: 3422989 - RNA, 19 nt, Pseudomonas aeruginosa PA01
cccgcccggucucagccgg

SEQ ID NO: 3422990 - RNA, 20 nt, Pseudomonas aeruginosa PA01
cccgcccggucucagccggc

SEQ ID NO: 3422991 - RNA, 17 nt, Pseudomonas aeruginosa PA01
cccgcccuuggcggcgc

SEQ ID NO: 3422992 - RNA, 19 nt, Pseudomonas aeruginosa PA01
cccgcccuuggcggcgcca

SEQ ID NO: 3422993 - RNA, 14 nt, Pseudomonas aeruginosa PA01
cccgccgaacagca

SEQ ID NO: 3422994 - RNA, 12 nt, Pseudomonas aeruginosa PA01
cccgccgaagcg

SEQ ID NO: 3422995 - RNA, 19 nt, Pseudomonas aeruginosa PA01
cccgccgaggaagccgacc

SEQ ID NO: 3422996 - RNA, 18 nt, Pseudomonas aeruginosa PA01
cccgccgauauuggucac

SEQ ID NO: 3422997 - RNA, 22 nt, Pseudomonas aeruginosa PA01
cccgccgauauuggucaccacg

SEQ ID NO: 3422998 - RNA, 14 nt, Pseudomonas aeruginosa PA01
cccgccgccaggcg

SEQ ID NO: 3422999 - RNA, 16 nt, Pseudomonas aeruginosa PA01
cccgccgccaggcggc

SEQ ID NO: 3423000 - RNA, 20 nt, Pseudomonas aeruginosa PA01
cccgccgccaggcggcaagg

SEQ ID NO: 3423001 - RNA, 19 nt, Pseudomonas aeruginosa PA01
cccgccgcgagcgccgccg

SEQ ID NO: 3423002 - RNA, 14 nt, Pseudomonas aeruginosa PA01
cccgccgcgccgcu

SEQ ID NO: 3423003 - RNA, 15 nt, Pseudomonas aeruginosa PA01
cccgccgcgccgcuc

SEQ ID NO: 3423004 - RNA, 13 nt, Pseudomonas aeruginosa PA01
cccgccgcggcga

SEQ ID NO: 3423005 - RNA, 15 nt, Pseudomonas aeruginosa PA01
cccgccgcuccuccg

SEQ ID NO: 3423006 - RNA, 13 nt, Pseudomonas aeruginosa PA01
cccgccgcucugc

SEQ ID NO: 3423007 - RNA, 14 nt, Pseudomonas aeruginosa PA01
cccgccgcucugcu

SEQ ID NO: 3423008 - RNA, 14 nt, Pseudomonas aeruginosa PA01
cccgccgcugaggc

SEQ ID NO: 3423009 - RNA, 12 nt, Pseudomonas aeruginosa PA01
cccgccgcuggc

SEQ ID NO: 3423010 - RNA, 19 nt, Pseudomonas aeruginosa PA01
cccgccgcuggcggcaugc

SEQ ID NO: 3423011 - RNA, 21 nt, Pseudomonas aeruginosa PA01
cccgccggaagacggaaacgc

SEQ ID NO: 3423012 - RNA, 23 nt, Pseudomonas aeruginosa PA01
cccgccggaaugacgagccgcag

SEQ ID NO: 3423013 - RNA, 13 nt, Pseudomonas aeruginosa PA01
cccgccggcgccc

SEQ ID NO: 3423014 - RNA, 15 nt, Pseudomonas aeruginosa PA01
cccgccggcgcgccc

SEQ ID NO: 3423015 - RNA, 16 nt, Pseudomonas aeruginosa PA01
cccgccggcgcgccca

SEQ ID NO: 3423016 - RNA, 19 nt, Pseudomonas aeruginosa PA01
cccgccggcgcgcccaggc

SEQ ID NO: 3423017 - RNA, 12 nt, Pseudomonas aeruginosa PA01
cccgccggcgug

SEQ ID NO: 3423018 - RNA, 16 nt, Pseudomonas aeruginosa PA01
cccgccggcgugccga

SEQ ID NO: 3423019 - RNA, 17 nt, Pseudomonas aeruginosa PA01
cccgccgggagcggccg

SEQ ID NO: 3423020 - RNA, 18 nt, Pseudomonas aeruginosa PA01
cccgccgggagcggccgu

SEQ ID NO: 3423021 - RNA, 21 nt, Pseudomonas aeruginosa PA01
cccgccgggagcggccgugca

SEQ ID NO: 3423022 - RNA, 20 nt, Pseudomonas aeruginosa PA01
cccgccgugcgcuccgccag

SEQ ID NO: 3423023 - RNA, 21 nt, Pseudomonas aeruginosa PA01
cccgccgugcgcuccgccagg

SEQ ID NO: 3423024 - RNA, 15 nt, Pseudomonas aeruginosa PA01
cccgccguucgcccg

SEQ ID NO: 3423025 - RNA, 17 nt, Pseudomonas aeruginosa PA01
cccgccguucgcccgcc

SEQ ID NO: 3423026 - RNA, 15 nt, Pseudomonas aeruginosa PA01
cccgccucaggccgg

SEQ ID NO: 3423027 - RNA, 12 nt, Pseudomonas aeruginosa PA01
cccgccucgacc

SEQ ID NO: 3423028 - RNA, 14 nt, Pseudomonas aeruginosa PA01
cccgccucggcggc

SEQ ID NO: 3423029 - RNA, 13 nt, Pseudomonas aeruginosa PA01
cccgccucgucgc

SEQ ID NO: 3423030 - RNA, 14 nt, Pseudomonas aeruginosa PA01
cccgccucgucgcc

SEQ ID NO: 3423031 - RNA, 16 nt, Pseudomonas aeruginosa PA01
cccgccugaaggcggg

SEQ ID NO: 3423032 - RNA, 18 nt, Pseudomonas aeruginosa PA01
cccgccuggaaggcgcug

SEQ ID NO: 3423033 - RNA, 17 nt, Pseudomonas aeruginosa PA01
cccgcgacaacggccgu

SEQ ID NO: 3423034 - RNA, 15 nt, Pseudomonas aeruginosa PA01
cccgcgagcagccga

SEQ ID NO: 3423035 - RNA, 16 nt, Pseudomonas aeruginosa PA01
cccgcgagccgcgcag

SEQ ID NO: 3423036 - RNA, 23 nt, Pseudomonas aeruginosa PA01
cccgcgagccguccugcggccgc

SEQ ID NO: 3423037 - RNA, 19 nt, Pseudomonas aeruginosa PA01
cccgcgaggccggccccac

SEQ ID NO: 3423038 - RNA, 17 nt, Pseudomonas aeruginosa PA01
cccgcgauucgccgggc

SEQ ID NO: 3423039 - RNA, 15 nt, Pseudomonas aeruginosa PA01
cccgcgcauggagac

SEQ ID NO: 3423040 - RNA, 22 nt, Pseudomonas aeruginosa PA01
cccgcgcauggagacggcccgc

SEQ ID NO: 3423041 - RNA, 13 nt, Pseudomonas aeruginosa PA01
cccgcgccagcgc

SEQ ID NO: 3423042 - RNA, 17 nt, Pseudomonas aeruginosa PA01
cccgcgccagcgccgcc

SEQ ID NO: 3423043 - RNA, 18 nt, Pseudomonas aeruginosa PA01
cccgcgccagcgccgcca

SEQ ID NO: 3423044 - RNA, 19 nt, Pseudomonas aeruginosa PA01
cccgcgccagcgccgccag

SEQ ID NO: 3423045 - RNA, 12 nt, Pseudomonas aeruginosa PA01
cccgcgccgccg

SEQ ID NO: 3423046 - RNA, 13 nt, Pseudomonas aeruginosa PA01
cccgcgccgccgg

SEQ ID NO: 3423047 - RNA, 14 nt, Pseudomonas aeruginosa PA01
cccgcgccgccggu

SEQ ID NO: 3423048 - RNA, 13 nt, Pseudomonas aeruginosa PA01
cccgcgccgccuc

SEQ ID NO: 3423049 - RNA, 13 nt, Pseudomonas aeruginosa PA01
cccgcgccggcag

SEQ ID NO: 3423050 - RNA, 16 nt, Pseudomonas aeruginosa PA01
cccgcgccuccaggcg

SEQ ID NO: 3423051 - RNA, 17 nt, Pseudomonas aeruginosa PA01
cccgcgccuccaggcgc

SEQ ID NO: 3423052 - RNA, 19 nt, Pseudomonas aeruginosa PA01
cccgcgccuccaggcgcgc

SEQ ID NO: 3423053 - RNA, 13 nt, Pseudomonas aeruginosa PA01
cccgcgccugggc

SEQ ID NO: 3423054 - RNA, 21 nt, Pseudomonas aeruginosa PA01
cccgcgccugggccgcgaggu

SEQ ID NO: 3423055 - RNA, 18 nt, Pseudomonas aeruginosa PA01
cccggccagcagcgccuc

SEQ ID NO: 3423056 - RNA, 23 nt, Pseudomonas aeruginosa PA01
cccggccagcagcgccuccucua

SEQ ID NO: 3423057 - RNA, 14 nt, Pseudomonas aeruginosa PA01
cccggccagcccgg

SEQ ID NO: 3423058 - RNA, 15 nt, Pseudomonas aeruginosa PA01
cccggccagcccggc

SEQ ID NO: 3423059 - RNA, 21 nt, Pseudomonas aeruginosa PA01
cccggccagcccggccucgcc

SEQ ID NO: 3423060 - RNA, 22 nt, Pseudomonas aeruginosa PA01
cccggccagcccggccucgccg

SEQ ID NO: 3423061 - RNA, 19 nt, Pseudomonas aeruginosa PA01
cccggccagcgaccgucga

SEQ ID NO: 3423062 - RNA, 11 nt, Pseudomonas aeruginosa PA01
cccggccaggc

SEQ ID NO: 3423063 - RNA, 19 nt, Pseudomonas aeruginosa PA01
cccggccaggccacggcgg

SEQ ID NO: 3423064 - RNA, 14 nt, Pseudomonas aeruginosa PA01
cccggccaggccgc

SEQ ID NO: 3423065 - RNA, 15 nt, Pseudomonas aeruginosa PA01
cccggccaggccgcc

SEQ ID NO: 3423066 - RNA, 18 nt, Pseudomonas aeruginosa PA01
cccggccaggccgcccag

SEQ ID NO: 3423067 - RNA, 13 nt, Pseudomonas aeruginosa PA01
cccggccaggcga

SEQ ID NO: 3423068 - RNA, 17 nt, Pseudomonas aeruginosa PA01
cccggccaggcgcggcg

SEQ ID NO: 3423069 - RNA, 19 nt, Pseudomonas aeruginosa PA01
cccggccagguaccggcca

SEQ ID NO: 3423070 - RNA, 24 nt, Pseudomonas aeruginosa PA01
cccggccagguacuggcgauggau

SEQ ID NO: 3423071 - RNA, 17 nt, Pseudomonas aeruginosa PA01
cccggccagguaggcga

SEQ ID NO: 3423072 - RNA, 18 nt, Pseudomonas aeruginosa PA01
cccggccagguaggcgac

SEQ ID NO: 3423073 - RNA, 13 nt, Pseudomonas aeruginosa PA01
cccggccauccug

SEQ ID NO: 3423074 - RNA, 17 nt, Pseudomonas aeruginosa PA01
cccggccauccuggccg

SEQ ID NO: 3423075 - RNA, 21 nt, Pseudomonas aeruginosa PA01
cccggccauccuggccggucg

SEQ ID NO: 3423076 - RNA, 13 nt, Pseudomonas aeruginosa PA01
cccggccaugagc

SEQ ID NO: 3423077 - RNA, 20 nt, Pseudomonas aeruginosa PA01
cccggccaugagccgggguu

SEQ ID NO: 3423078 - RNA, 18 nt, Pseudomonas aeruginosa PA01
cccggccaugccgccgac

SEQ ID NO: 3423079 - RNA, 14 nt, Pseudomonas aeruginosa PA01
cccggccauggcgg

SEQ ID NO: 3423080 - RNA, 18 nt, Pseudomonas aeruginosa PA01
cccggccauggcggguca

SEQ ID NO: 3423081 - RNA, 18 nt, Pseudomonas aeruginosa PA01
cccggccauuccuuccag

SEQ ID NO: 3423082 - RNA, 17 nt, Pseudomonas aeruginosa PA01
cccggccauugaacgga

SEQ ID NO: 3423083 - RNA, 18 nt, Pseudomonas aeruginosa PA01
cccggcccagccgcggcg

SEQ ID NO: 3423084 - RNA, 22 nt, Pseudomonas aeruginosa PA01
cccggcccagccgcggcgccac

SEQ ID NO: 3423085 - RNA, 17 nt, Pseudomonas aeruginosa PA01
cccggcccagcguucgg

SEQ ID NO: 3423086 - RNA, 18 nt, Pseudomonas aeruginosa PA01
cccggcccaggccggguu

SEQ ID NO: 3423087 - RNA, 14 nt, Pseudomonas aeruginosa PA01
cccggcccauggcg

SEQ ID NO: 3423088 - RNA, 13 nt, Pseudomonas aeruginosa PA01
cccggcccggcca

SEQ ID NO: 3423089 - RNA, 14 nt, Pseudomonas aeruginosa PA01
cccggcccggucag

SEQ ID NO: 3423090 - RNA, 21 nt, Pseudomonas aeruginosa PA01
cccggcccggucagcuucgcc

SEQ ID NO: 3423091 - RNA, 15 nt, Pseudomonas aeruginosa PA01
cccggcccuugagca

SEQ ID NO: 3423092 - RNA, 14 nt, Pseudomonas aeruginosa PA01
cccggccgaccagg

SEQ ID NO: 3423093 - RNA, 13 nt, Pseudomonas aeruginosa PA01
cccggccgaugga

SEQ ID NO: 3423094 - RNA, 11 nt, Pseudomonas aeruginosa PA01
cccggccgccu

SEQ ID NO: 3423095 - RNA, 17 nt, Pseudomonas aeruginosa PA01
cccggccgccuuccucg

SEQ ID NO: 3423096 - RNA, 14 nt, Pseudomonas aeruginosa PA01
cccggccggcagga

SEQ ID NO: 3423097 - RNA, 24 nt, Pseudomonas aeruginosa PA01
cccggccucaacgaccgcccaggc

SEQ ID NO: 3423098 - RNA, 15 nt, Pseudomonas aeruginosa PA01
cccggccuccaggcu

SEQ ID NO: 3423099 - RNA, 14 nt, Pseudomonas aeruginosa PA01
cccggccuccccgg

SEQ ID NO: 3423100 - RNA, 13 nt, Pseudomonas aeruginosa PA01
cccggccucgccg

SEQ ID NO: 3423101 - RNA, 14 nt, Pseudomonas aeruginosa PA01
cccggccucgccgg

SEQ ID NO: 3423102 - RNA, 12 nt, Pseudomonas aeruginosa PA01
cccggccuggcg

SEQ ID NO: 3423103 - RNA, 13 nt, Pseudomonas aeruginosa PA01
cccggccuggcgc

SEQ ID NO: 3423104 - RNA, 15 nt, Pseudomonas aeruginosa PA01
cccggccuggcgccg

SEQ ID NO: 3423105 - RNA, 20 nt, Pseudomonas aeruginosa PA01
cccggccuggcgccgggguu

SEQ ID NO: 3423106 - RNA, 15 nt, Pseudomonas aeruginosa PA01
cccggccuggcgcgc

SEQ ID NO: 3423107 - RNA, 21 nt, Pseudomonas aeruginosa PA01
cccggccuggcgcgcgcgcca

SEQ ID NO: 3423108 - RNA, 17 nt, Pseudomonas aeruginosa PA01
cccggccuggcgucccg

SEQ ID NO: 3423109 - RNA, 15 nt, Pseudomonas aeruginosa PA01
cccggccuggcuggc

SEQ ID NO: 3423110 - RNA, 17 nt, Pseudomonas aeruginosa PA01
cccggccuggcuggccu

SEQ ID NO: 3423111 - RNA, 18 nt, Pseudomonas aeruginosa PA01
cccggccugguaggccuc

SEQ ID NO: 3423112 - RNA, 17 nt, Pseudomonas aeruginosa PA01
cccggccuggugccggg

SEQ ID NO: 3423113 - RNA, 17 nt, Pseudomonas aeruginosa PA01
cccggccuucaccgcgc

SEQ ID NO: 3423114 - RNA, 22 nt, Pseudomonas aeruginosa PA01
cccggccuucaccgcgccgcgc

SEQ ID NO: 3423115 - RNA, 16 nt, Pseudomonas aeruginosa PA01
cccggcgaacagcgcu

SEQ ID NO: 3423116 - RNA, 20 nt, Pseudomonas aeruginosa PA01
cccggcgaacagcgcuuccu

SEQ ID NO: 3423117 - RNA, 19 nt, Pseudomonas aeruginosa PA01
cccggcgagagcguccggc

SEQ ID NO: 3423118 - RNA, 16 nt, Pseudomonas aeruginosa PA01
cccggcgauccgcgca

SEQ ID NO: 3423119 - RNA, 22 nt, Pseudomonas aeruginosa PA01
cccggcgcacgccggccucgcg

SEQ ID NO: 3423120 - RNA, 19 nt, Pseudomonas aeruginosa PA01
cccggcgcaugccgcagga

SEQ ID NO: 3423121 - RNA, 14 nt, Pseudomonas aeruginosa PA01
cccggcgccacccc

SEQ ID NO: 3423122 - RNA, 13 nt, Pseudomonas aeruginosa PA01
cccggcgccaccg

SEQ ID NO: 3423123 - RNA, 16 nt, Pseudomonas aeruginosa PA01
cccggcgcccggcgca

SEQ ID NO: 3423124 - RNA, 13 nt, Pseudomonas aeruginosa PA01
cccggcgccgccc

SEQ ID NO: 3423125 - RNA, 18 nt, Pseudomonas aeruginosa PA01
cccggcgcgaccgucggc

SEQ ID NO: 3423126 - RNA, 13 nt, Pseudomonas aeruginosa PA01
cccggcgcggcgc

SEQ ID NO: 3423127 - RNA, 16 nt, Pseudomonas aeruginosa PA01
cccggcgcggcgcagc

SEQ ID NO: 3423128 - RNA, 18 nt, Pseudomonas aeruginosa PA01
cccggcgcggcgcagcca

SEQ ID NO: 3423129 - RNA, 19 nt, Pseudomonas aeruginosa PA01
cccggcgcggcgcagccag

SEQ ID NO: 3423130 - RNA, 20 nt, Pseudomonas aeruginosa PA01
cccggcgcggcggccgccuc

SEQ ID NO: 3423131 - RNA, 23 nt, Pseudomonas aeruginosa PA01
cccggcgcggcggccgccucggc

SEQ ID NO: 3423132 - RNA, 15 nt, Pseudomonas aeruginosa PA01
cccggcgcggcuacc

SEQ ID NO: 3423133 - RNA, 21 nt, Pseudomonas aeruginosa PA01
cccggcgcgguuucgcagcgc

SEQ ID NO: 3423134 - RNA, 14 nt, Pseudomonas aeruginosa PA01
cccggcgcguagag

SEQ ID NO: 3423135 - RNA, 14 nt, Pseudomonas aeruginosa PA01
cccggcgcuccaac

SEQ ID NO: 3423136 - RNA, 20 nt, Pseudomonas aeruginosa PA01
cccggcgcuccaacagcagg

SEQ ID NO: 3423137 - RNA, 13 nt, Pseudomonas aeruginosa PA01
cccggcgcugccc

SEQ ID NO: 3423138 - RNA, 21 nt, Pseudomonas aeruginosa PA01
cccggcgcugcuucuugucga

SEQ ID NO: 3423139 - RNA, 11 nt, Pseudomonas aeruginosa PA01
cccggcgcugg

SEQ ID NO: 3423140 - RNA, 16 nt, Pseudomonas aeruginosa PA01
cccggcgcuucgcgca

SEQ ID NO: 3423141 - RNA, 17 nt, Pseudomonas aeruginosa PA01
cccggcggaacaugguc

SEQ ID NO: 3423142 - RNA, 12 nt, Pseudomonas aeruginosa PA01
cccggcggacaa

SEQ ID NO: 3423143 - RNA, 13 nt, Pseudomonas aeruginosa PA01
cccggcggcgauc

SEQ ID NO: 3423144 - RNA, 12 nt, Pseudomonas aeruginosa PA01
cccggcggcgcg

SEQ ID NO: 3423145 - RNA, 19 nt, Pseudomonas aeruginosa PA01
cccggcggcggcaccgacg

SEQ ID NO: 3423146 - RNA, 12 nt, Pseudomonas aeruginosa PA01
cccggcgguccg

SEQ ID NO: 3423147 - RNA, 15 nt, Pseudomonas aeruginosa PA01
cccggcgguccgccg

SEQ ID NO: 3423148 - RNA, 19 nt, Pseudomonas aeruginosa PA01
cccggcgguuucgccgagg

SEQ ID NO: 3423149 - RNA, 14 nt, Pseudomonas aeruginosa PA01
cccggcguccucgc

SEQ ID NO: 3423150 - RNA, 15 nt, Pseudomonas aeruginosa PA01
cccggcguccucgcg

SEQ ID NO: 3423151 - RNA, 21 nt, Pseudomonas aeruginosa PA01
cccggcguccucgcgacaccg

SEQ ID NO: 3423152 - RNA, 16 nt, Pseudomonas aeruginosa PA01
cccggcgucggcgcgg

SEQ ID NO: 3423153 - RNA, 19 nt, Pseudomonas aeruginosa PA01
cccggcgucggcgcgggcg

SEQ ID NO: 3423154 - RNA, 21 nt, Pseudomonas aeruginosa PA01
cccggcgucggcgcgggcgcc

SEQ ID NO: 3423155 - RNA, 13 nt, Pseudomonas aeruginosa PA01
cccggcgugagca

SEQ ID NO: 3423156 - RNA, 14 nt, Pseudomonas aeruginosa PA01
cccggcgugagcag

SEQ ID NO: 3423157 - RNA, 15 nt, Pseudomonas aeruginosa PA01
cccggcgugagcagg

SEQ ID NO: 3423158 - RNA, 22 nt, Pseudomonas aeruginosa PA01
cccggcgugagcagggccgagc

SEQ ID NO: 3423159 - RNA, 19 nt, Pseudomonas aeruginosa PA01
cccgguugagauccuggcc

SEQ ID NO: 3423160 - RNA, 14 nt, Pseudomonas aeruginosa PA01
cccgguuggccagg

SEQ ID NO: 3423161 - RNA, 21 nt, Pseudomonas aeruginosa PA01
cccgguuggccaggaccaucg

SEQ ID NO: 3423162 - RNA, 19 nt, Pseudomonas aeruginosa PA01
cccgguuuccgcagcgcuu

SEQ ID NO: 3423163 - RNA, 14 nt, Pseudomonas aeruginosa PA01
cccguaaggccagg

SEQ ID NO: 3423164 - RNA, 20 nt, Pseudomonas aeruginosa PA01
cccguaccccgacgcuguug

SEQ ID NO: 3423165 - RNA, 23 nt, Pseudomonas aeruginosa PA01
cccguagcacauggucuucccag

SEQ ID NO: 3423166 - RNA, 16 nt, Pseudomonas aeruginosa PA01
cccguagcgcucggug

SEQ ID NO: 3423167 - RNA, 17 nt, Pseudomonas aeruginosa PA01
cccguauccuccgcgac

SEQ ID NO: 3423168 - RNA, 21 nt, Pseudomonas aeruginosa PA01
cccgucaugaccagagccgcc

SEQ ID NO: 3423169 - RNA, 22 nt, Pseudomonas aeruginosa PA01
cccgucaugaccagagccgccg

SEQ ID NO: 3423170 - RNA, 13 nt, Pseudomonas aeruginosa PA01
cccguccagcgcu

SEQ ID NO: 3423171 - RNA, 14 nt, Pseudomonas aeruginosa PA01
cccguccagcgcuu

SEQ ID NO: 3423172 - RNA, 15 nt, Pseudomonas aeruginosa PA01
cccguccagcgcuug

SEQ ID NO: 3423173 - RNA, 18 nt, Pseudomonas aeruginosa PA01
cccguccauuuucagcgg

SEQ ID NO: 3423174 - RNA, 20 nt, Pseudomonas aeruginosa PA01
cccguccauuuucagcggag

SEQ ID NO: 3423175 - RNA, 23 nt, Pseudomonas aeruginosa PA01
cccgucccuaccagcgcaaccgg

SEQ ID NO: 3423176 - RNA, 23 nt, Pseudomonas aeruginosa PA01
cccgucccucagguagucggcga

SEQ ID NO: 3423177 - RNA, 13 nt, Pseudomonas aeruginosa PA01
cccguccuggcgg

SEQ ID NO: 3423178 - RNA, 18 nt, Pseudomonas aeruginosa PA01
cccgucgacgcccugggc

SEQ ID NO: 3423179 - RNA, 18 nt, Pseudomonas aeruginosa PA01
cccgucgccauucggcga

SEQ ID NO: 3423180 - RNA, 14 nt, Pseudomonas aeruginosa PA01
cccgucgcgccggc

SEQ ID NO: 3423181 - RNA, 12 nt, Pseudomonas aeruginosa PA01
cccgucggccuc

SEQ ID NO: 3423182 - RNA, 14 nt, Pseudomonas aeruginosa PA01
cccgucuagcgcag

SEQ ID NO: 3423183 - RNA, 17 nt, Pseudomonas aeruginosa PA01
cccgucucgcugccgaa

SEQ ID NO: 3423184 - RNA, 17 nt, Pseudomonas aeruginosa PA01
cccgugcaccgaggcgc

SEQ ID NO: 3423185 - RNA, 23 nt, Pseudomonas aeruginosa PA01
cccgugccucggcggacagcccg

SEQ ID NO: 3423186 - RNA, 14 nt, Pseudomonas aeruginosa PA01
cccgugcgccgcgg

SEQ ID NO: 3423187 - RNA, 17 nt, Pseudomonas aeruginosa PA01
cccgugcgccgcggguc

SEQ ID NO: 3423188 - RNA, 14 nt, Pseudomonas aeruginosa PA01
cccgugcggcacgc

SEQ ID NO: 3423189 - RNA, 17 nt, Pseudomonas aeruginosa PA01
cccguggcgacgcagca

SEQ ID NO: 3423190 - RNA, 11 nt, Pseudomonas aeruginosa PA01
cccguggcgcc

SEQ ID NO: 3423191 - RNA, 14 nt, Pseudomonas aeruginosa PA01
cccguggcgccgca

SEQ ID NO: 3423192 - RNA, 11 nt, Pseudomonas aeruginosa PA01
cccguggcgcg

SEQ ID NO: 3423193 - RNA, 14 nt, Pseudomonas aeruginosa PA01
cccguggcgggcca

SEQ ID NO: 3423194 - RNA, 17 nt, Pseudomonas aeruginosa PA01
cccguggcgggccagca

SEQ ID NO: 3423195 - RNA, 21 nt, Pseudomonas aeruginosa PA01
cccguggcgggccagcaggcg

SEQ ID NO: 3423196 - RNA, 18 nt, Pseudomonas aeruginosa PA01
cccgugggguauuccagg

SEQ ID NO: 3423197 - RNA, 12 nt, Pseudomonas aeruginosa PA01
cccgugggucgu

SEQ ID NO: 3423198 - RNA, 19 nt, Pseudomonas aeruginosa PA01
cccguguaccacgcccgcg

SEQ ID NO: 3423199 - RNA, 21 nt, Pseudomonas aeruginosa PA01
cccgugucgccuuccggcagg

SEQ ID NO: 3423200 - RNA, 15 nt, Pseudomonas aeruginosa PA01
cccguguucggccag

SEQ ID NO: 3423201 - RNA, 19 nt, Pseudomonas aeruginosa PA01
cccguguucggccagccgg

SEQ ID NO: 3423202 - RNA, 22 nt, Pseudomonas aeruginosa PA01
cccguuccuugcgcggcaggcc

SEQ ID NO: 3423203 - RNA, 21 nt, Pseudomonas aeruginosa PA01
cccguucgaucaauugccggu

SEQ ID NO: 3423204 - RNA, 22 nt, Pseudomonas aeruginosa PA01
cccguucgaucaauugccggua

SEQ ID NO: 3423205 - RNA, 21 nt, Pseudomonas aeruginosa PA01
cccguucgccggccuccagca

SEQ ID NO: 3423206 - RNA, 20 nt, Pseudomonas aeruginosa PA01
cccguucugcacaugcacca

SEQ ID NO: 3423207 - RNA, 15 nt, Pseudomonas aeruginosa PA01
cccguugcgccucgc

SEQ ID NO: 3423208 - RNA, 17 nt, Pseudomonas aeruginosa PA01
cccguuugccgucggcg

SEQ ID NO: 3423209 - RNA, 20 nt, Pseudomonas aeruginosa PA01
cccuacagcccccccagcac

SEQ ID NO: 3423210 - RNA, 22 nt, Pseudomonas aeruginosa PA01
cccuaccagcgcaaccgguuuc

SEQ ID NO: 3423211 - RNA, 23 nt, Pseudomonas aeruginosa PA01
cccuacccgacaggcagcgccgc

SEQ ID NO: 3423212 - RNA, 18 nt, Pseudomonas aeruginosa PA01
cccuaccgcccacccugc

SEQ ID NO: 3423213 - RNA, 16 nt, Pseudomonas aeruginosa PA01
cccuaccguccgcagc

SEQ ID NO: 3423214 - RNA, 19 nt, Pseudomonas aeruginosa PA01
cccuaccguccgcagcaca

SEQ ID NO: 3423215 - RNA, 15 nt, Pseudomonas aeruginosa PA01
cccuaccugucccgg

SEQ ID NO: 3423216 - RNA, 21 nt, Pseudomonas aeruginosa PA01
cccuaccugucccggacgacg

SEQ ID NO: 3423217 - RNA, 17 nt, Pseudomonas aeruginosa PA01
cccuacgaaagcgccuu

SEQ ID NO: 3423218 - RNA, 20 nt, Pseudomonas aeruginosa PA01
cccuacgaaagcgccuucug

SEQ ID NO: 3423219 - RNA, 14 nt, Pseudomonas aeruginosa PA01
cccuacgaugcugg

SEQ ID NO: 3423220 - RNA, 14 nt, Pseudomonas aeruginosa PA01
cccuacggccccag

SEQ ID NO: 3423221 - RNA, 18 nt, Pseudomonas aeruginosa PA01
cccuacggccccaggcug

SEQ ID NO: 3423222 - RNA, 22 nt, Pseudomonas aeruginosa PA01
cccuacgggggcgugucgaggg

SEQ ID NO: 3423223 - RNA, 20 nt, Pseudomonas aeruginosa PA01
cccuacuccaggggucggca

SEQ ID NO: 3423224 - RNA, 15 nt, Pseudomonas aeruginosa PA01
cccuagaccaacugc

SEQ ID NO: 3423225 - RNA, 16 nt, Pseudomonas aeruginosa PA01
cccuagaccaacugcg

SEQ ID NO: 3423226 - RNA, 23 nt, Pseudomonas aeruginosa PA01
cccuaggguuccggucgggaugc

SEQ ID NO: 3423227 - RNA, 18 nt, Pseudomonas aeruginosa PA01
cccuauucgcugucaggg

SEQ ID NO: 3423228 - RNA, 13 nt, Pseudomonas aeruginosa PA01
cccucaaccggcg

SEQ ID NO: 3423229 - RNA, 16 nt, Pseudomonas aeruginosa PA01
cccucaaccggcgucc

SEQ ID NO: 3423230 - RNA, 16 nt, Pseudomonas aeruginosa PA01
cccucacaccaccagc

SEQ ID NO: 3423231 - RNA, 19 nt, Pseudomonas aeruginosa PA01
cccucacaccaccagcauc

SEQ ID NO: 3423232 - RNA, 18 nt, Pseudomonas aeruginosa PA01
cccucacggcgcgagaaa

SEQ ID NO: 3423233 - RNA, 23 nt, Pseudomonas aeruginosa PA01
cccucacuccgucuccagcaacc

SEQ ID NO: 3423234 - RNA, 19 nt, Pseudomonas aeruginosa PA01
cccucagagcaugucgaga

SEQ ID NO: 3423235 - RNA, 12 nt, Pseudomonas aeruginosa PA01
cccucagcggcg

SEQ ID NO: 3423236 - RNA, 21 nt, Pseudomonas aeruginosa PA01
cccucagcggcggugcgccgg

SEQ ID NO: 3423237 - RNA, 22 nt, Pseudomonas aeruginosa PA01
cccucagcggcggugcgccggc

SEQ ID NO: 3423238 - RNA, 22 nt, Pseudomonas aeruginosa PA01
cccucaggauagccggcgcguu

SEQ ID NO: 3423239 - RNA, 16 nt, Pseudomonas aeruginosa PA01
cccucaggcgccgcug

SEQ ID NO: 3423240 - RNA, 22 nt, Pseudomonas aeruginosa PA01
cccucagggaagaugcacacca

SEQ ID NO: 3423241 - RNA, 18 nt, Pseudomonas aeruginosa PA01
cccucagguagucggcga

SEQ ID NO: 3423242 - RNA, 14 nt, Pseudomonas aeruginosa PA01
cccucaggucggcg

SEQ ID NO: 3423243 - RNA, 21 nt, Pseudomonas aeruginosa PA01
cccucauggcuguagcucugc

SEQ ID NO: 3423244 - RNA, 23 nt, Pseudomonas aeruginosa PA01
cccuccaaagaaaagcccggcca

SEQ ID NO: 3423245 - RNA, 20 nt, Pseudomonas aeruginosa PA01
cccuccaccucgacccuggc

SEQ ID NO: 3423246 - RNA, 12 nt, Pseudomonas aeruginosa PA01
cccuccagcacc

SEQ ID NO: 3423247 - RNA, 22 nt, Pseudomonas aeruginosa PA01
cccuccagguaggggaaaccgu

SEQ ID NO: 3423248 - RNA, 20 nt, Pseudomonas aeruginosa PA01
cccuccauccagucuucgcc

SEQ ID NO: 3423249 - RNA, 22 nt, Pseudomonas aeruginosa PA01
cccuccauccagucuucgccgg

SEQ ID NO: 3423250 - RNA, 22 nt, Pseudomonas aeruginosa PA01
cccuccugcucgauccagccgg

SEQ ID NO: 3423251 - RNA, 23 nt, Pseudomonas aeruginosa PA01
cccuccuggaaagaccggcgccc

SEQ ID NO: 3423252 - RNA, 12 nt, Pseudomonas aeruginosa PA01
cccuccugggcc

SEQ ID NO: 3423253 - RNA, 17 nt, Pseudomonas aeruginosa PA01
cccuccugggccugucg

SEQ ID NO: 3423254 - RNA, 23 nt, Pseudomonas aeruginosa PA01
cccuccuucgagccuggccaggc

SEQ ID NO: 3423255 - RNA, 13 nt, Pseudomonas aeruginosa PA01
cccucgaacggcg

SEQ ID NO: 3423256 - RNA, 15 nt, Pseudomonas aeruginosa PA01
cccucgaccuggcuc

SEQ ID NO: 3423257 - RNA, 17 nt, Pseudomonas aeruginosa PA01
cccucgaccuggcucca

SEQ ID NO: 3423258 - RNA, 21 nt, Pseudomonas aeruginosa PA01
cccucgagcaccgcggucuuc

SEQ ID NO: 3423259 - RNA, 15 nt, Pseudomonas aeruginosa PA01
cccucgauguaggcc

SEQ ID NO: 3423260 - RNA, 17 nt, Pseudomonas aeruginosa PA01
cccucgauguaggccuc

SEQ ID NO: 3423261 - RNA, 18 nt, Pseudomonas aeruginosa PA01
cccuggauaucugggcca

SEQ ID NO: 3423262 - RNA, 16 nt, Pseudomonas aeruginosa PA01
cccuggaucaccgcgg

SEQ ID NO: 3423263 - RNA, 18 nt, Pseudomonas aeruginosa PA01
cccuggaucaccgcggcg

SEQ ID NO: 3423264 - RNA, 16 nt, Pseudomonas aeruginosa PA01
cccuggaucuccuggg

SEQ ID NO: 3423265 - RNA, 20 nt, Pseudomonas aeruginosa PA01
cccuggaucuccugggucga

SEQ ID NO: 3423266 - RNA, 17 nt, Pseudomonas aeruginosa PA01
cccuggcagacgcugcu

SEQ ID NO: 3423267 - RNA, 20 nt, Pseudomonas aeruginosa PA01
cccuggccacguccagcggc

SEQ ID NO: 3423268 - RNA, 19 nt, Pseudomonas aeruginosa PA01
cccuggccgacgcugagga

SEQ ID NO: 3423269 - RNA, 19 nt, Pseudomonas aeruginosa PA01
cccuggccgaucagcuugg

SEQ ID NO: 3423270 - RNA, 23 nt, Pseudomonas aeruginosa PA01
cccuggccgaucagcuuggccuu

SEQ ID NO: 3423271 - RNA, 15 nt, Pseudomonas aeruginosa PA01
cccuggccgcgcggc

SEQ ID NO: 3423272 - RNA, 17 nt, Pseudomonas aeruginosa PA01
cccuggccgcgcggcuu

SEQ ID NO: 3423273 - RNA, 22 nt, Pseudomonas aeruginosa PA01
cccuggccgcgcggcuugccgg

SEQ ID NO: 3423274 - RNA, 12 nt, Pseudomonas aeruginosa PA01
cccuggccggca

SEQ ID NO: 3423275 - RNA, 16 nt, Pseudomonas aeruginosa PA01
cccuggccggcacccu

SEQ ID NO: 3423276 - RNA, 12 nt, Pseudomonas aeruginosa PA01
cccuggccggcc

SEQ ID NO: 3423277 - RNA, 14 nt, Pseudomonas aeruginosa PA01
cccuggccggccuc

SEQ ID NO: 3423278 - RNA, 18 nt, Pseudomonas aeruginosa PA01
cccuggccggccucggcg

SEQ ID NO: 3423279 - RNA, 13 nt, Pseudomonas aeruginosa PA01
cccuggccggcga

SEQ ID NO: 3423280 - RNA, 16 nt, Pseudomonas aeruginosa PA01
cccuggccuuggccac

SEQ ID NO: 3423281 - RNA, 21 nt, Pseudomonas aeruginosa PA01
cccuggccuuggccacgaccc

SEQ ID NO: 3423282 - RNA, 19 nt, Pseudomonas aeruginosa PA01
cccuggcgcagacaggccu

SEQ ID NO: 3423283 - RNA, 15 nt, Pseudomonas aeruginosa PA01
cccuggcgcaggcgg

SEQ ID NO: 3423284 - RNA, 16 nt, Pseudomonas aeruginosa PA01
cccuggcgcaggcggc

SEQ ID NO: 3423285 - RNA, 21 nt, Pseudomonas aeruginosa PA01
cccuggcgcaggcggcgcugu

SEQ ID NO: 3423286 - RNA, 13 nt, Pseudomonas aeruginosa PA01
cccuggcgcggca

SEQ ID NO: 3423287 - RNA, 22 nt, Pseudomonas aeruginosa PA01
cccuggcggauaucgcgccgcg

SEQ ID NO: 3423288 - RNA, 23 nt, Pseudomonas aeruginosa PA01
cccuggcguggccggcgaggcgg

SEQ ID NO: 3423289 - RNA, 19 nt, Pseudomonas aeruginosa PA01
cccuggcucugggccauga

SEQ ID NO: 3423290 - RNA, 20 nt, Pseudomonas aeruginosa PA01
cccuggcucuugccgcgagc

SEQ ID NO: 3423291 - RNA, 14 nt, Pseudomonas aeruginosa PA01
cccuggcuuuccag

SEQ ID NO: 3423292 - RNA, 19 nt, Pseudomonas aeruginosa PA01
cccuggcuuuccagggccu

SEQ ID NO: 3423293 - RNA, 23 nt, Pseudomonas aeruginosa PA01
cccuggcuuuccagggccuggcg

SEQ ID NO: 3423294 - RNA, 12 nt, Pseudomonas aeruginosa PA01
cccugggaaugg

SEQ ID NO: 3423295 - RNA, 17 nt, Pseudomonas aeruginosa PA01
cccugggacaggcgucc

SEQ ID NO: 3423296 - RNA, 14 nt, Pseudomonas aeruginosa PA01
cccugggagccgcc

SEQ ID NO: 3423297 - RNA, 13 nt, Pseudomonas aeruginosa PA01
cccugggccaacg

SEQ ID NO: 3423298 - RNA, 15 nt, Pseudomonas aeruginosa PA01
cccugggccccggcc

SEQ ID NO: 3423299 - RNA, 17 nt, Pseudomonas aeruginosa PA01
cccugggccccggccgg

SEQ ID NO: 3423300 - RNA, 19 nt, Pseudomonas aeruginosa PA01
cccugggccccggccggca

SEQ ID NO: 3423301 - RNA, 20 nt, Pseudomonas aeruginosa PA01
cccugggccccggccggcag

SEQ ID NO: 3423302 - RNA, 14 nt, Pseudomonas aeruginosa PA01
cccugggccggcgc

SEQ ID NO: 3423303 - RNA, 16 nt, Pseudomonas aeruginosa PA01
cccugggccggcgcca

SEQ ID NO: 3423304 - RNA, 21 nt, Pseudomonas aeruginosa PA01
cccugggccggcgccagcagg

SEQ ID NO: 3423305 - RNA, 14 nt, Pseudomonas aeruginosa PA01
cccugggccugcag

SEQ ID NO: 3423306 - RNA, 16 nt, Pseudomonas aeruginosa PA01
cccugggcgaacagca

SEQ ID NO: 3423307 - RNA, 21 nt, Pseudomonas aeruginosa PA01
cccugggcgaacagcacccag

SEQ ID NO: 3423308 - RNA, 15 nt, Pseudomonas aeruginosa PA01
cccugggcgaugcgg

SEQ ID NO: 3423309 - RNA, 24 nt, Pseudomonas aeruginosa PA01
cccugggcgcgaauggcauucagc

SEQ ID NO: 3423310 - RNA, 19 nt, Pseudomonas aeruginosa PA01
cccugggcggcgaccugcg

SEQ ID NO: 3423311 - RNA, 19 nt, Pseudomonas aeruginosa PA01
cccugggcgucgacgaacg

SEQ ID NO: 3423312 - RNA, 18 nt, Pseudomonas aeruginosa PA01
cccugggguuucugcugg

SEQ ID NO: 3423313 - RNA, 21 nt, Pseudomonas aeruginosa PA01
cccugggguuucugcuggcca

SEQ ID NO: 3423314 - RNA, 22 nt, Pseudomonas aeruginosa PA01
cccugggguuucugcuggccac

SEQ ID NO: 3423315 - RNA, 22 nt, Pseudomonas aeruginosa PA01
cccugguacagcacccaggcga

SEQ ID NO: 3423316 - RNA, 16 nt, Pseudomonas aeruginosa PA01
cccugguacagcgccu

SEQ ID NO: 3423317 - RNA, 17 nt, Pseudomonas aeruginosa PA01
cccugguacagcgccug

SEQ ID NO: 3423318 - RNA, 23 nt, Pseudomonas aeruginosa PA01
cccugguccaaccgggcaucgcc

SEQ ID NO: 3423319 - RNA, 12 nt, Pseudomonas aeruginosa PA01
cccuggucggcg

SEQ ID NO: 3423320 - RNA, 13 nt, Pseudomonas aeruginosa PA01
cccuggucggcgg

SEQ ID NO: 3423321 - RNA, 16 nt, Pseudomonas aeruginosa PA01
cccuggucggcggucu

SEQ ID NO: 3423322 - RNA, 16 nt, Pseudomonas aeruginosa PA01
cccugguugcggaacg

SEQ ID NO: 3423323 - RNA, 16 nt, Pseudomonas aeruginosa PA01
cccuguagcguuccgg

SEQ ID NO: 3423324 - RNA, 17 nt, Pseudomonas aeruginosa PA01
cccuguccccucacggc

SEQ ID NO: 3423325 - RNA, 19 nt, Pseudomonas aeruginosa PA01
cccuguccccucacggcgc

SEQ ID NO: 3423326 - RNA, 16 nt, Pseudomonas aeruginosa PA01
cccugucccgccgcgc

SEQ ID NO: 3423327 - RNA, 14 nt, Pseudomonas aeruginosa PA01
cccuguucggcggg

SEQ ID NO: 3423328 - RNA, 21 nt, Pseudomonas aeruginosa PA01
cccuguucggcgggaucgacg

SEQ ID NO: 3423329 - RNA, 21 nt, Pseudomonas aeruginosa PA01
cccuguuucggguccaggcgc

SEQ ID NO: 3423330 - RNA, 18 nt, Pseudomonas aeruginosa PA01
cccuucacgagaccaccg

SEQ ID NO: 3423331 - RNA, 20 nt, Pseudomonas aeruginosa PA01
cccuucagcgcaccgcccug

SEQ ID NO: 3423332 - RNA, 13 nt, Pseudomonas aeruginosa PA01
cccuuccagccgc

SEQ ID NO: 3423333 - RNA, 18 nt, Pseudomonas aeruginosa PA01
cccuucgaacccgcccuc

SEQ ID NO: 3423334 - RNA, 21 nt, Pseudomonas aeruginosa PA01
cccuucgacgacaccugcaac

SEQ ID NO: 3423335 - RNA, 12 nt, Pseudomonas aeruginosa PA01
cccuucgagcaa

SEQ ID NO: 3423336 - RNA, 24 nt, Pseudomonas aeruginosa PA01
cccuucggcugcaacuuccacucg

SEQ ID NO: 3423337 - RNA, 18 nt, Pseudomonas aeruginosa PA01
cccuucggucgcgccccg

SEQ ID NO: 3423338 - RNA, 19 nt, Pseudomonas aeruginosa PA01
cccuucggucgcgccccgc

SEQ ID NO: 3423339 - RNA, 22 nt, Pseudomonas aeruginosa PA01
cccuucggucgcgccccgccag

SEQ ID NO: 3423340 - RNA, 22 nt, Pseudomonas aeruginosa PA01
cccuucguccucguggcgcgcc

SEQ ID NO: 3423341 - RNA, 15 nt, Pseudomonas aeruginosa PA01
cccuucgugggccug

SEQ ID NO: 3423342 - RNA, 16 nt, Pseudomonas aeruginosa PA01
cccuucuccgccagcc

SEQ ID NO: 3423343 - RNA, 14 nt, Pseudomonas aeruginosa PA01
cccuucugucuugu

SEQ ID NO: 3423344 - RNA, 23 nt, Pseudomonas aeruginosa PA01
cccuucuuuuauacccggcgccc

SEQ ID NO: 3423345 - RNA, 15 nt, Pseudomonas aeruginosa PA01
cccuugaagcgcuuc

SEQ ID NO: 3423346 - RNA, 22 nt, Pseudomonas aeruginosa PA01
cccuugaagcgcuucugcaggc

SEQ ID NO: 3423347 - RNA, 21 nt, Pseudomonas aeruginosa PA01
cccuugacguucaggcuguug

SEQ ID NO: 3423348 - RNA, 19 nt, Pseudomonas aeruginosa PA01
cccuugaggaaguugcgca

SEQ ID NO: 3423349 - RNA, 22 nt, Pseudomonas aeruginosa PA01
cccuugagggccucggcgaagu

SEQ ID NO: 3423350 - RNA, 17 nt, Pseudomonas aeruginosa PA01
cccuugaggguguucag

SEQ ID NO: 3423351 - RNA, 22 nt, Pseudomonas aeruginosa PA01
cccuugaggucguuggccaggc

SEQ ID NO: 3423352 - RNA, 16 nt, Pseudomonas aeruginosa PA01
cccuugaucagcgcgc

SEQ ID NO: 3423353 - RNA, 19 nt, Pseudomonas aeruginosa PA01
cccuugcaaccgccgccgc

SEQ ID NO: 3423354 - RNA, 16 nt, Pseudomonas aeruginosa PA01
cccuugcagccagccg

SEQ ID NO: 3423355 - RNA, 19 nt, Pseudomonas aeruginosa PA01
cccuugccggucaccgugg

SEQ ID NO: 3423356 - RNA, 13 nt, Pseudomonas aeruginosa PA01
cccuugcgcggcg

SEQ ID NO: 3423357 - RNA, 18 nt, Pseudomonas aeruginosa PA01
cccuugcgcucuggcgca

SEQ ID NO: 3423358 - RNA, 14 nt, Pseudomonas aeruginosa PA01
cccuugcggcccgc

SEQ ID NO: 3423359 - RNA, 19 nt, Pseudomonas aeruginosa PA01
cccuugcggcccgccucgg

SEQ ID NO: 3423360 - RNA, 21 nt, Pseudomonas aeruginosa PA01
cccuugcggcccgccucggcg

SEQ ID NO: 3423361 - RNA, 16 nt, Pseudomonas aeruginosa PA01
cccuugcggcgcggcc

SEQ ID NO: 3423362 - RNA, 16 nt, Pseudomonas aeruginosa PA01
cccuugcguccugccu

SEQ ID NO: 3423363 - RNA, 17 nt, Pseudomonas aeruginosa PA01
ccgaagucgcccgccgg

SEQ ID NO: 3423364 - RNA, 18 nt, Pseudomonas aeruginosa PA01
ccgaagucgcccgccggc

SEQ ID NO: 3423365 - RNA, 20 nt, Pseudomonas aeruginosa PA01
ccgaagucgcccgccggcgu

SEQ ID NO: 3423366 - RNA, 15 nt, Pseudomonas aeruginosa PA01
ccgaagugaucuggc

SEQ ID NO: 3423367 - RNA, 13 nt, Pseudomonas aeruginosa PA01
ccgaaguuguaga

SEQ ID NO: 3423368 - RNA, 13 nt, Pseudomonas aeruginosa PA01
ccgaauacccggu

SEQ ID NO: 3423369 - RNA, 21 nt, Pseudomonas aeruginosa PA01
ccgaauacugcacgcccaggc

SEQ ID NO: 3423370 - RNA, 21 nt, Pseudomonas aeruginosa PA01
ccgaauagaucugcaccaggc

SEQ ID NO: 3423371 - RNA, 19 nt, Pseudomonas aeruginosa PA01
ccgaaucccuuggcugcuc

SEQ ID NO: 3423372 - RNA, 20 nt, Pseudomonas aeruginosa PA01
ccgaaucccuuggcugcucg

SEQ ID NO: 3423373 - RNA, 13 nt, Pseudomonas aeruginosa PA01
ccgaauccgccgg

SEQ ID NO: 3423374 - RNA, 19 nt, Pseudomonas aeruginosa PA01
ccgaauccgccggcgaugc

SEQ ID NO: 3423375 - RNA, 15 nt, Pseudomonas aeruginosa PA01
ccgaauccuccagcc

SEQ ID NO: 3423376 - RNA, 16 nt, Pseudomonas aeruginosa PA01
ccgaauccuugaucac

SEQ ID NO: 3423377 - RNA, 12 nt, Pseudomonas aeruginosa PA01
ccgaaucgccua

SEQ ID NO: 3423378 - RNA, 21 nt, Pseudomonas aeruginosa PA01
ccgaaucgccuaccagaccgc

SEQ ID NO: 3423379 - RNA, 21 nt, Pseudomonas aeruginosa PA01
ccgacaacgaaaagagccgcg

SEQ ID NO: 3423380 - RNA, 20 nt, Pseudomonas aeruginosa PA01
ccgacaagcauucagcgcgc

SEQ ID NO: 3423381 - RNA, 21 nt, Pseudomonas aeruginosa PA01
ccgacaagcauucagcgcgcc

SEQ ID NO: 3423382 - RNA, 17 nt, Pseudomonas aeruginosa PA01
ccgacaagccuccagcg

SEQ ID NO: 3423383 - RNA, 20 nt, Pseudomonas aeruginosa PA01
ccgacaagccuccagcgccg

SEQ ID NO: 3423384 - RNA, 22 nt, Pseudomonas aeruginosa PA01
ccgacaaggagcgcgagcggca

SEQ ID NO: 3423385 - RNA, 14 nt, Pseudomonas aeruginosa PA01
ccgacacccgcgcc

SEQ ID NO: 3423386 - RNA, 15 nt, Pseudomonas aeruginosa PA01
ccgacacccgcgccg

SEQ ID NO: 3423387 - RNA, 22 nt, Pseudomonas aeruginosa PA01
ccgacacgggugccggagaacg

SEQ ID NO: 3423388 - RNA, 21 nt, Pseudomonas aeruginosa PA01
ccgacacgugugucgacaccu

SEQ ID NO: 3423389 - RNA, 14 nt, Pseudomonas aeruginosa PA01
ccgacagagcggcc

SEQ ID NO: 3423390 - RNA, 15 nt, Pseudomonas aeruginosa PA01
ccgacagagcggccg

SEQ ID NO: 3423391 - RNA, 18 nt, Pseudomonas aeruginosa PA01
ccgacagagcggccggcg

SEQ ID NO: 3423392 - RNA, 20 nt, Pseudomonas aeruginosa PA01
ccgacagagcggccggcgcg

SEQ ID NO: 3423393 - RNA, 19 nt, Pseudomonas aeruginosa PA01
ccgacagcacgauggcgag

SEQ ID NO: 3423394 - RNA, 14 nt, Pseudomonas aeruginosa PA01
ccgacagcggcugg

SEQ ID NO: 3423395 - RNA, 16 nt, Pseudomonas aeruginosa PA01
ccgacaggcagcgccg

SEQ ID NO: 3423396 - RNA, 19 nt, Pseudomonas aeruginosa PA01
ccgacaggcagcgccgccc

SEQ ID NO: 3423397 - RNA, 20 nt, Pseudomonas aeruginosa PA01
ccgacaggccgaccagcagg

SEQ ID NO: 3423398 - RNA, 12 nt, Pseudomonas aeruginosa PA01
ccgacaggccgg

SEQ ID NO: 3423399 - RNA, 23 nt, Pseudomonas aeruginosa PA01
ccgacaggccggugccgccggcc

SEQ ID NO: 3423400 - RNA, 15 nt, Pseudomonas aeruginosa PA01
ccgacaggcuggugc

SEQ ID NO: 3423401 - RNA, 22 nt, Pseudomonas aeruginosa PA01
ccgacaggucgcuuucgcgcag

SEQ ID NO: 3423402 - RNA, 14 nt, Pseudomonas aeruginosa PA01
ccgacaggucggcc

SEQ ID NO: 3423403 - RNA, 15 nt, Pseudomonas aeruginosa PA01
ccgacaggucggccg

SEQ ID NO: 3423404 - RNA, 16 nt, Pseudomonas aeruginosa PA01
ccgacaggucggccgg

SEQ ID NO: 3423405 - RNA, 19 nt, Pseudomonas aeruginosa PA01
ccgacaggucggccggcag

SEQ ID NO: 3423406 - RNA, 21 nt, Pseudomonas aeruginosa PA01
ccgacaggucggccggcagcu

SEQ ID NO: 3423407 - RNA, 12 nt, Pseudomonas aeruginosa PA01
ccgacaugcccc

SEQ ID NO: 3423408 - RNA, 15 nt, Pseudomonas aeruginosa PA01
ccgacaugccccgcc

SEQ ID NO: 3423409 - RNA, 17 nt, Pseudomonas aeruginosa PA01
ccgacaugccccgccga

SEQ ID NO: 3423410 - RNA, 13 nt, Pseudomonas aeruginosa PA01
ccgaccaccauca

SEQ ID NO: 3423411 - RNA, 18 nt, Pseudomonas aeruginosa PA01
ccgaccaccuucaggcug

SEQ ID NO: 3423412 - RNA, 14 nt, Pseudomonas aeruginosa PA01
ccgaccacuuccag

SEQ ID NO: 3423413 - RNA, 18 nt, Pseudomonas aeruginosa PA01
ccgaccagcagggccagc

SEQ ID NO: 3423414 - RNA, 22 nt, Pseudomonas aeruginosa PA01
ccgaccagcagggccagcagcg

SEQ ID NO: 3423415 - RNA, 12 nt, Pseudomonas aeruginosa PA01
ccgaccagccgc

SEQ ID NO: 3423416 - RNA, 18 nt, Pseudomonas aeruginosa PA01
ccgaccagccgcaggcug

SEQ ID NO: 3423417 - RNA, 12 nt, Pseudomonas aeruginosa PA01
ccgaccagcgcc

SEQ ID NO: 3423418 - RNA, 14 nt, Pseudomonas aeruginosa PA01
ccgaccagcgcgcu

SEQ ID NO: 3423419 - RNA, 13 nt, Pseudomonas aeruginosa PA01
ccgaccaggccgu

SEQ ID NO: 3423420 - RNA, 19 nt, Pseudomonas aeruginosa PA01
ccgaccaggcggccgucgg

SEQ ID NO: 3423421 - RNA, 22 nt, Pseudomonas aeruginosa PA01
ccgaccaggcggccgucggccu

SEQ ID NO: 3423422 - RNA, 14 nt, Pseudomonas aeruginosa PA01
ccgaccaggucgcu

SEQ ID NO: 3423423 - RNA, 16 nt, Pseudomonas aeruginosa PA01
ccgacccacuugaaca

SEQ ID NO: 3423424 - RNA, 18 nt, Pseudomonas aeruginosa PA01
ccgacccagagcgcgccc

SEQ ID NO: 3423425 - RNA, 20 nt, Pseudomonas aeruginosa PA01
ccgacccagagcgcgcccug

SEQ ID NO: 3423426 - RNA, 21 nt, Pseudomonas aeruginosa PA01
ccgacccagagcgcgcccugc

SEQ ID NO: 3423427 - RNA, 15 nt, Pseudomonas aeruginosa PA01
ccgaccccacgccgg

SEQ ID NO: 3423428 - RNA, 13 nt, Pseudomonas aeruginosa PA01
ccgacccgcagcg

SEQ ID NO: 3423429 - RNA, 18 nt, Pseudomonas aeruginosa PA01
ccgacccggccgaccagg

SEQ ID NO: 3423430 - RNA, 15 nt, Pseudomonas aeruginosa PA01
ccgacccgugcgccg

SEQ ID NO: 3423431 - RNA, 18 nt, Pseudomonas aeruginosa PA01
ccgacccgugcgccgcgg

SEQ ID NO: 3423432 - RNA, 22 nt, Pseudomonas aeruginosa PA01
ccgacccucauggaaaccccgg

SEQ ID NO: 3423433 - RNA, 15 nt, Pseudomonas aeruginosa PA01
ccgaccgagcagcgg

SEQ ID NO: 3423434 - RNA, 17 nt, Pseudomonas aeruginosa PA01
ccgaccgcaccgccagc

SEQ ID NO: 3423435 - RNA, 12 nt, Pseudomonas aeruginosa PA01
ccgaccgccagg

SEQ ID NO: 3423436 - RNA, 14 nt, Pseudomonas aeruginosa PA01
ccgaccgccaggcc

SEQ ID NO: 3423437 - RNA, 20 nt, Pseudomonas aeruginosa PA01
ccgaccgcgaguucgccggc

SEQ ID NO: 3423438 - RNA, 22 nt, Pseudomonas aeruginosa PA01
ccgaccgcgaguucgccggcca

SEQ ID NO: 3423439 - RNA, 20 nt, Pseudomonas aeruginosa PA01
ccgaccgcgcgccugcaacg

SEQ ID NO: 3423440 - RNA, 12 nt, Pseudomonas aeruginosa PA01
ccgaccggcgcc

SEQ ID NO: 3423441 - RNA, 13 nt, Pseudomonas aeruginosa PA01
ccgaccggcgccg

SEQ ID NO: 3423442 - RNA, 14 nt, Pseudomonas aeruginosa PA01
ccgaccggcgccgg

SEQ ID NO: 3423443 - RNA, 16 nt, Pseudomonas aeruginosa PA01
ccgaccgguuccagcg

SEQ ID NO: 3423444 - RNA, 21 nt, Pseudomonas aeruginosa PA01
ccgaccgguuccagcggccgc

SEQ ID NO: 3423445 - RNA, 23 nt, Pseudomonas aeruginosa PA01
ccgaccguccgccugcggauagc

SEQ ID NO: 3423446 - RNA, 14 nt, Pseudomonas aeruginosa PA01
ccgaccucggccgc

SEQ ID NO: 3423447 - RNA, 15 nt, Pseudomonas aeruginosa PA01
ccgaccucggccgcc

SEQ ID NO: 3423448 - RNA, 18 nt, Pseudomonas aeruginosa PA01
ccgaccucggccgccagg

SEQ ID NO: 3423449 - RNA, 18 nt, Pseudomonas aeruginosa PA01
ccgaccucggcggucagg

SEQ ID NO: 3423450 - RNA, 18 nt, Pseudomonas aeruginosa PA01
ccgaccuucaccaccagc

SEQ ID NO: 3423451 - RNA, 22 nt, Pseudomonas aeruginosa PA01
ccgaccuucaccaccagcgagg

SEQ ID NO: 3423452 - RNA, 13 nt, Pseudomonas aeruginosa PA01
ccgaccuugccgg

SEQ ID NO: 3423453 - RNA, 15 nt, Pseudomonas aeruginosa PA01
ccgacgaacagccag

SEQ ID NO: 3423454 - RNA, 16 nt, Pseudomonas aeruginosa PA01
ccgacgaacagccaga

SEQ ID NO: 3423455 - RNA, 23 nt, Pseudomonas aeruginosa PA01
ccgacgaaggcgagggugaacug

SEQ ID NO: 3423456 - RNA, 18 nt, Pseudomonas aeruginosa PA01
ccgacgagcagcucgccg

SEQ ID NO: 3423457 - RNA, 20 nt, Pseudomonas aeruginosa PA01
ccgacgagcagcucgccggc

SEQ ID NO: 3423458 - RNA, 21 nt, Pseudomonas aeruginosa PA01
ccgacgagcagcucgccggcg

SEQ ID NO: 3423459 - RNA, 17 nt, Pseudomonas aeruginosa PA01
ccgacgauccggccgau

SEQ ID NO: 3423460 - RNA, 19 nt, Pseudomonas aeruginosa PA01
ccgacgaucucaucgccca

SEQ ID NO: 3423461 - RNA, 20 nt, Pseudomonas aeruginosa PA01
ccgacgaucucaucgcccau

SEQ ID NO: 3423462 - RNA, 20 nt, Pseudomonas aeruginosa PA01
ccgacgauguucgaggcgcc

SEQ ID NO: 3423463 - RNA, 14 nt, Pseudomonas aeruginosa PA01
ccgacgccaugggu

SEQ ID NO: 3423464 - RNA, 20 nt, Pseudomonas aeruginosa PA01
ccgacgcccgcagccagccu

SEQ ID NO: 3423465 - RNA, 21 nt, Pseudomonas aeruginosa PA01
ccgacgcccuccagcaccgcc

SEQ ID NO: 3423466 - RNA, 16 nt, Pseudomonas aeruginosa PA01
ccgagcagcgccagcc

SEQ ID NO: 3423467 - RNA, 15 nt, Pseudomonas aeruginosa PA01
ccgagcagcggacgc

SEQ ID NO: 3423468 - RNA, 14 nt, Pseudomonas aeruginosa PA01
ccgagcagcggcgc

SEQ ID NO: 3423469 - RNA, 14 nt, Pseudomonas aeruginosa PA01
ccgagcaggacagc

SEQ ID NO: 3423470 - RNA, 13 nt, Pseudomonas aeruginosa PA01
ccgagcaggauga

SEQ ID NO: 3423471 - RNA, 11 nt, Pseudomonas aeruginosa PA01
ccgagcaggca

SEQ ID NO: 3423472 - RNA, 12 nt, Pseudomonas aeruginosa PA01
ccgagcaggccu

SEQ ID NO: 3423473 - RNA, 17 nt, Pseudomonas aeruginosa PA01
ccgagcaggcgcgccag

SEQ ID NO: 3423474 - RNA, 21 nt, Pseudomonas aeruginosa PA01
ccgagcaggcgcgccaggccc

SEQ ID NO: 3423475 - RNA, 18 nt, Pseudomonas aeruginosa PA01
ccgagcagggucacgccg

SEQ ID NO: 3423476 - RNA, 19 nt, Pseudomonas aeruginosa PA01
ccgagcagggucacgccga

SEQ ID NO: 3423477 - RNA, 20 nt, Pseudomonas aeruginosa PA01
ccgagcagggucacgccgau

SEQ ID NO: 3423478 - RNA, 22 nt, Pseudomonas aeruginosa PA01
ccgagcagggucacgccgauca

SEQ ID NO: 3423479 - RNA, 17 nt, Pseudomonas aeruginosa PA01
ccgagcaggucgcggaa

SEQ ID NO: 3423480 - RNA, 14 nt, Pseudomonas aeruginosa PA01
ccgagcaggugcau

SEQ ID NO: 3423481 - RNA, 18 nt, Pseudomonas aeruginosa PA01
ccgagcaugaugcaggca

SEQ ID NO: 3423482 - RNA, 19 nt, Pseudomonas aeruginosa PA01
ccgagcaugcgcggcagga

SEQ ID NO: 3423483 - RNA, 22 nt, Pseudomonas aeruginosa PA01
ccgagcaugcgcggcaggauca

SEQ ID NO: 3423484 - RNA, 16 nt, Pseudomonas aeruginosa PA01
ccgagcauguaggcgc

SEQ ID NO: 3423485 - RNA, 23 nt, Pseudomonas aeruginosa PA01
ccgagcauguaggcgcaccaggc

SEQ ID NO: 3423486 - RNA, 22 nt, Pseudomonas aeruginosa PA01
ccgagccacggauaugcgccgc

SEQ ID NO: 3423487 - RNA, 23 nt, Pseudomonas aeruginosa PA01
ccgagccacggauaugcgccgcc

SEQ ID NO: 3423488 - RNA, 24 nt, Pseudomonas aeruginosa PA01
ccgagccacggauaugcgccgcca

SEQ ID NO: 3423489 - RNA, 14 nt, Pseudomonas aeruginosa PA01
ccgagccagguacg

SEQ ID NO: 3423490 - RNA, 19 nt, Pseudomonas aeruginosa PA01
ccgagccagguacggaugc

SEQ ID NO: 3423491 - RNA, 13 nt, Pseudomonas aeruginosa PA01
ccgagcccagcgg

SEQ ID NO: 3423492 - RNA, 21 nt, Pseudomonas aeruginosa PA01
ccgagcccccauaccgccucg

SEQ ID NO: 3423493 - RNA, 23 nt, Pseudomonas aeruginosa PA01
ccgagccccgguuacucgccggc

SEQ ID NO: 3423494 - RNA, 21 nt, Pseudomonas aeruginosa PA01
ccgagcccgagugcgcccagc

SEQ ID NO: 3423495 - RNA, 15 nt, Pseudomonas aeruginosa PA01
ccgagcccggccggg

SEQ ID NO: 3423496 - RNA, 16 nt, Pseudomonas aeruginosa PA01
ccgagcccggccggga

SEQ ID NO: 3423497 - RNA, 14 nt, Pseudomonas aeruginosa PA01
ccgagccgacaucc

SEQ ID NO: 3423498 - RNA, 16 nt, Pseudomonas aeruginosa PA01
ccgagccgacauccug

SEQ ID NO: 3423499 - RNA, 13 nt, Pseudomonas aeruginosa PA01
ccgagccggcauc

SEQ ID NO: 3423500 - RNA, 11 nt, Pseudomonas aeruginosa PA01
ccgagccggcu

SEQ ID NO: 3423501 - RNA, 13 nt, Pseudomonas aeruginosa PA01
ccgagccggcugc

SEQ ID NO: 3423502 - RNA, 19 nt, Pseudomonas aeruginosa PA01
ccgagcgaaaucggcaggc

SEQ ID NO: 3423503 - RNA, 21 nt, Pseudomonas aeruginosa PA01
ccgagcgaaaucggcaggcug

SEQ ID NO: 3423504 - RNA, 22 nt, Pseudomonas aeruginosa PA01
ccgagcgaaaucggcaggcugc

SEQ ID NO: 3423505 - RNA, 15 nt, Pseudomonas aeruginosa PA01
ccgagcgcagcgcca

SEQ ID NO: 3423506 - RNA, 14 nt, Pseudomonas aeruginosa PA01
ccgagcgccgccag

SEQ ID NO: 3423507 - RNA, 15 nt, Pseudomonas aeruginosa PA01
ccgagcgccgccagg

SEQ ID NO: 3423508 - RNA, 17 nt, Pseudomonas aeruginosa PA01
ccgagcgccgccaggca

SEQ ID NO: 3423509 - RNA, 22 nt, Pseudomonas aeruginosa PA01
ccgagcgccgccaggcaggccg

SEQ ID NO: 3423510 - RNA, 17 nt, Pseudomonas aeruginosa PA01
ccgagcgccgccugggc

SEQ ID NO: 3423511 - RNA, 20 nt, Pseudomonas aeruginosa PA01
ccgagcgccgccugggccgc

SEQ ID NO: 3423512 - RNA, 14 nt, Pseudomonas aeruginosa PA01
ccgagcgccuggca

SEQ ID NO: 3423513 - RNA, 18 nt, Pseudomonas aeruginosa PA01
ccgagcgcgagugcagcg

SEQ ID NO: 3423514 - RNA, 23 nt, Pseudomonas aeruginosa PA01
ccgagcgcgagugcagcgagucg

SEQ ID NO: 3423515 - RNA, 16 nt, Pseudomonas aeruginosa PA01
ccgagcgcgaucagcc

SEQ ID NO: 3423516 - RNA, 15 nt, Pseudomonas aeruginosa PA01
ccgagcgcgccgccg

SEQ ID NO: 3423517 - RNA, 14 nt, Pseudomonas aeruginosa PA01
ccgagcgcucgccg

SEQ ID NO: 3423518 - RNA, 12 nt, Pseudomonas aeruginosa PA01
ccgagcggcaag

SEQ ID NO: 3423519 - RNA, 13 nt, Pseudomonas aeruginosa PA01
ccgagcggcaagg

SEQ ID NO: 3423520 - RNA, 17 nt, Pseudomonas aeruginosa PA01
ccgagcggcaaggccaa

SEQ ID NO: 3423521 - RNA, 16 nt, Pseudomonas aeruginosa PA01
ccgagcggcgcgaagu

SEQ ID NO: 3423522 - RNA, 13 nt, Pseudomonas aeruginosa PA01
ccgagcggucgga

SEQ ID NO: 3423523 - RNA, 16 nt, Pseudomonas aeruginosa PA01
ccgagcgugcgcaugc

SEQ ID NO: 3423524 - RNA, 16 nt, Pseudomonas aeruginosa PA01
ccgagcguugggccuc

SEQ ID NO: 3423525 - RNA, 19 nt, Pseudomonas aeruginosa PA01
ccgagcguugggccucgcu

SEQ ID NO: 3423526 - RNA, 22 nt, Pseudomonas aeruginosa PA01
ccgagcguugggccucgcugcg

SEQ ID NO: 3423527 - RNA, 23 nt, Pseudomonas aeruginosa PA01
ccgagcguuuuuggcaaaccucc

SEQ ID NO: 3423528 - RNA, 19 nt, Pseudomonas aeruginosa PA01
ccgagcugaccaccagggc

SEQ ID NO: 3423529 - RNA, 20 nt, Pseudomonas aeruginosa PA01
ccgagcugaccaccagggcg

SEQ ID NO: 3423530 - RNA, 21 nt, Pseudomonas aeruginosa PA01
ccgagcugaccaccagggcga

SEQ ID NO: 3423531 - RNA, 22 nt, Pseudomonas aeruginosa PA01
ccgagcugaccaccagggcgau

SEQ ID NO: 3423532 - RNA, 13 nt, Pseudomonas aeruginosa PA01
ccgagcugaucgc

SEQ ID NO: 3423533 - RNA, 19 nt, Pseudomonas aeruginosa PA01
ccgagcugaucgcgcagau

SEQ ID NO: 3423534 - RNA, 23 nt, Pseudomonas aeruginosa PA01
ccgagcugaucgcgcagaucgcc

SEQ ID NO: 3423535 - RNA, 18 nt, Pseudomonas aeruginosa PA01
ccgagcugccgcaccgcc

SEQ ID NO: 3423536 - RNA, 22 nt, Pseudomonas aeruginosa PA01
ccgagcugccgcaccgccucga

SEQ ID NO: 3423537 - RNA, 17 nt, Pseudomonas aeruginosa PA01
ccgagcugccgggcgag

SEQ ID NO: 3423538 - RNA, 18 nt, Pseudomonas aeruginosa PA01
ccgagcugccgggcgagc

SEQ ID NO: 3423539 - RNA, 14 nt, Pseudomonas aeruginosa PA01
ccgagcuggcgcgc

SEQ ID NO: 3423540 - RNA, 18 nt, Pseudomonas aeruginosa PA01
ccgagcuggcgcgcgucg

SEQ ID NO: 3423541 - RNA, 12 nt, Pseudomonas aeruginosa PA01
ccgagcuugacc

SEQ ID NO: 3423542 - RNA, 18 nt, Pseudomonas aeruginosa PA01
ccgagcuugaccuugccg

SEQ ID NO: 3423543 - RNA, 18 nt, Pseudomonas aeruginosa PA01
ccgagcuuugcgcagcca

SEQ ID NO: 3423544 - RNA, 19 nt, Pseudomonas aeruginosa PA01
ccgagcuuugcgcagccac

SEQ ID NO: 3423545 - RNA, 23 nt, Pseudomonas aeruginosa PA01
ccgagcuuugcgcagccacccgc

SEQ ID NO: 3423546 - RNA, 23 nt, Pseudomonas aeruginosa PA01
ccgaggaaaugauguugcgccag

SEQ ID NO: 3423547 - RNA, 19 nt, Pseudomonas aeruginosa PA01
ccgaggaacuccuccucgc

SEQ ID NO: 3423548 - RNA, 13 nt, Pseudomonas aeruginosa PA01
ccgaggaaggcgc

SEQ ID NO: 3423549 - RNA, 16 nt, Pseudomonas aeruginosa PA01
ccgaggaagucggcgg

SEQ ID NO: 3423550 - RNA, 19 nt, Pseudomonas aeruginosa PA01
ccgaggaagucggcggccg

SEQ ID NO: 3423551 - RNA, 14 nt, Pseudomonas aeruginosa PA01
ccgaggacccggcg

SEQ ID NO: 3423552 - RNA, 17 nt, Pseudomonas aeruginosa PA01
ccgaggaggaugccgau

SEQ ID NO: 3423553 - RNA, 17 nt, Pseudomonas aeruginosa PA01
ccgaggauagcguccag

SEQ ID NO: 3423554 - RNA, 16 nt, Pseudomonas aeruginosa PA01
ccgaggaugcucgccu

SEQ ID NO: 3423555 - RNA, 18 nt, Pseudomonas aeruginosa PA01
ccgaggaugcucgccugg

SEQ ID NO: 3423556 - RNA, 19 nt, Pseudomonas aeruginosa PA01
ccgaggcagccgucgguga

SEQ ID NO: 3423557 - RNA, 23 nt, Pseudomonas aeruginosa PA01
ccgaggcagccgucggugaucga

SEQ ID NO: 3423558 - RNA, 13 nt, Pseudomonas aeruginosa PA01
ccgaggccaccac

SEQ ID NO: 3423559 - RNA, 14 nt, Pseudomonas aeruginosa PA01
ccgaggccaccacu

SEQ ID NO: 3423560 - RNA, 16 nt, Pseudomonas aeruginosa PA01
ccgaggccagcaggcc

SEQ ID NO: 3423561 - RNA, 14 nt, Pseudomonas aeruginosa PA01
ccgaggcccagcga

SEQ ID NO: 3423562 - RNA, 13 nt, Pseudomonas aeruginosa PA01
ccgaggccgaggu

SEQ ID NO: 3423563 - RNA, 12 nt, Pseudomonas aeruginosa PA01
ccgaggccgccg

SEQ ID NO: 3423564 - RNA, 13 nt, Pseudomonas aeruginosa PA01
ccgaggccgccgc

SEQ ID NO: 3423565 - RNA, 15 nt, Pseudomonas aeruginosa PA01
ccgaggccggcgaag

SEQ ID NO: 3423566 - RNA, 20 nt, Pseudomonas aeruginosa PA01
ccgaggcgaccuuggccagc

SEQ ID NO: 3423567 - RNA, 14 nt, Pseudomonas aeruginosa PA01
ccgaggcgacgccc

SEQ ID NO: 3423568 - RNA, 17 nt, Pseudomonas aeruginosa PA01
ccgaggcgaucgccgcg

SEQ ID NO: 3423569 - RNA, 13 nt, Pseudomonas aeruginosa PA01
ccgaucaccagcg

SEQ ID NO: 3423570 - RNA, 17 nt, Pseudomonas aeruginosa PA01
ccgaucaccagcgccag

SEQ ID NO: 3423571 - RNA, 13 nt, Pseudomonas aeruginosa PA01
ccgaucaccccgc

SEQ ID NO: 3423572 - RNA, 16 nt, Pseudomonas aeruginosa PA01
ccgaucaccuggccgg

SEQ ID NO: 3423573 - RNA, 18 nt, Pseudomonas aeruginosa PA01
ccgaucaccuggccggug

SEQ ID NO: 3423574 - RNA, 18 nt, Pseudomonas aeruginosa PA01
ccgaucaccuucaccggc

SEQ ID NO: 3423575 - RNA, 21 nt, Pseudomonas aeruginosa PA01
ccgaucagcccgucggccucg

SEQ ID NO: 3423576 - RNA, 13 nt, Pseudomonas aeruginosa PA01
ccgaucagcgccu

SEQ ID NO: 3423577 - RNA, 19 nt, Pseudomonas aeruginosa PA01
ccgaucagcgccucggcgc

SEQ ID NO: 3423578 - RNA, 13 nt, Pseudomonas aeruginosa PA01
ccgaucagcggcg

SEQ ID NO: 3423579 - RNA, 19 nt, Pseudomonas aeruginosa PA01
ccgaucagcggcgguccca

SEQ ID NO: 3423580 - RNA, 14 nt, Pseudomonas aeruginosa PA01
ccgaucaggaaaua

SEQ ID NO: 3423581 - RNA, 22 nt, Pseudomonas aeruginosa PA01
ccgaucaggaaauaaccggcgu

SEQ ID NO: 3423582 - RNA, 12 nt, Pseudomonas aeruginosa PA01
ccgaucaggcug

SEQ ID NO: 3423583 - RNA, 21 nt, Pseudomonas aeruginosa PA01
ccgaucaggcugaagcggccg

SEQ ID NO: 3423584 - RNA, 11 nt, Pseudomonas aeruginosa PA01
ccgaucagguc

SEQ ID NO: 3423585 - RNA, 16 nt, Pseudomonas aeruginosa PA01
ccgaucaggucgcgcg

SEQ ID NO: 3423586 - RNA, 17 nt, Pseudomonas aeruginosa PA01
ccgaucaggucgcgcgc

SEQ ID NO: 3423587 - RNA, 19 nt, Pseudomonas aeruginosa PA01
ccgaucaggucgcgcgccu

SEQ ID NO: 3423588 - RNA, 22 nt, Pseudomonas aeruginosa PA01
ccgaucaguggucgcagcucca

SEQ ID NO: 3423589 - RNA, 16 nt, Pseudomonas aeruginosa PA01
ccgaucaugcucggcg

SEQ ID NO: 3423590 - RNA, 20 nt, Pseudomonas aeruginosa PA01
ccgaucaugcucggcgguga

SEQ ID NO: 3423591 - RNA, 19 nt, Pseudomonas aeruginosa PA01
ccgauccagcagucgcggc

SEQ ID NO: 3423592 - RNA, 24 nt, Pseudomonas aeruginosa PA01
ccgauccagcagucgcggcccugg

SEQ ID NO: 3423593 - RNA, 13 nt, Pseudomonas aeruginosa PA01
ccgauccaggcgu

SEQ ID NO: 3423594 - RNA, 21 nt, Pseudomonas aeruginosa PA01
ccgauccgcgaauagggcggc

SEQ ID NO: 3423595 - RNA, 17 nt, Pseudomonas aeruginosa PA01
ccgauccguagggcgaa

SEQ ID NO: 3423596 - RNA, 12 nt, Pseudomonas aeruginosa PA01
ccgauccuccug

SEQ ID NO: 3423597 - RNA, 13 nt, Pseudomonas aeruginosa PA01
ccgauccuccugg

SEQ ID NO: 3423598 - RNA, 16 nt, Pseudomonas aeruginosa PA01
ccgaucgcccgcgccu

SEQ ID NO: 3423599 - RNA, 13 nt, Pseudomonas aeruginosa PA01
ccgaucgccgcgc

SEQ ID NO: 3423600 - RNA, 14 nt, Pseudomonas aeruginosa PA01
ccgaucgccgcgcg

SEQ ID NO: 3423601 - RNA, 16 nt, Pseudomonas aeruginosa PA01
ccgaucgccucggcca

SEQ ID NO: 3423602 - RNA, 22 nt, Pseudomonas aeruginosa PA01
ccgaucgccucgucgagcgcag

SEQ ID NO: 3423603 - RNA, 21 nt, Pseudomonas aeruginosa PA01
ccgaucgccucguucagcagc

SEQ ID NO: 3423604 - RNA, 23 nt, Pseudomonas aeruginosa PA01
ccgaucggcugcccaagggccug

SEQ ID NO: 3423605 - RNA, 16 nt, Pseudomonas aeruginosa PA01
ccgaucuccuccgccc

SEQ ID NO: 3423606 - RNA, 13 nt, Pseudomonas aeruginosa PA01
ccgaucucgccca

SEQ ID NO: 3423607 - RNA, 21 nt, Pseudomonas aeruginosa PA01
ccgaucucgcccaguaccgcc

SEQ ID NO: 3423608 - RNA, 19 nt, Pseudomonas aeruginosa PA01
ccgaucucgguuuccagga

SEQ ID NO: 3423609 - RNA, 22 nt, Pseudomonas aeruginosa PA01
ccgaucucgguuuccaggaugc

SEQ ID NO: 3423610 - RNA, 18 nt, Pseudomonas aeruginosa PA01
ccgaucucgugggccagc

SEQ ID NO: 3423611 - RNA, 19 nt, Pseudomonas aeruginosa PA01
ccgaucucgugggccagca

SEQ ID NO: 3423612 - RNA, 22 nt, Pseudomonas aeruginosa PA01
ccgaucucgugggccagcaggc

SEQ ID NO: 3423613 - RNA, 19 nt, Pseudomonas aeruginosa PA01
ccgaucuucagcagcaggc

SEQ ID NO: 3423614 - RNA, 21 nt, Pseudomonas aeruginosa PA01
ccgaucuucagcagcaggcgc

SEQ ID NO: 3423615 - RNA, 13 nt, Pseudomonas aeruginosa PA01
ccgaucuucgccg

SEQ ID NO: 3423616 - RNA, 16 nt, Pseudomonas aeruginosa PA01
ccgaucuucgccgaca

SEQ ID NO: 3423617 - RNA, 15 nt, Pseudomonas aeruginosa PA01
ccgaugaacgccgcg

SEQ ID NO: 3423618 - RNA, 16 nt, Pseudomonas aeruginosa PA01
ccgaugaucgagcgca

SEQ ID NO: 3423619 - RNA, 18 nt, Pseudomonas aeruginosa PA01
ccgaugaucuccgcgccg

SEQ ID NO: 3423620 - RNA, 19 nt, Pseudomonas aeruginosa PA01
ccgaugaucuccgcgccgg

SEQ ID NO: 3423621 - RNA, 20 nt, Pseudomonas aeruginosa PA01
ccgaugcccgggcguuggua

SEQ ID NO: 3423622 - RNA, 14 nt, Pseudomonas aeruginosa PA01
ccgaugccgaaggc

SEQ ID NO: 3423623 - RNA, 18 nt, Pseudomonas aeruginosa PA01
ccgaugccgaccuugccg

SEQ ID NO: 3423624 - RNA, 13 nt, Pseudomonas aeruginosa PA01
ccgaugccgccga

SEQ ID NO: 3423625 - RNA, 13 nt, Pseudomonas aeruginosa PA01
ccgaugccgcgcc

SEQ ID NO: 3423626 - RNA, 14 nt, Pseudomonas aeruginosa PA01
ccgaugccgcgccg

SEQ ID NO: 3423627 - RNA, 22 nt, Pseudomonas aeruginosa PA01
ccgaugccggaaagccuggccg

SEQ ID NO: 3423628 - RNA, 16 nt, Pseudomonas aeruginosa PA01
ccgaugccggccggca

SEQ ID NO: 3423629 - RNA, 17 nt, Pseudomonas aeruginosa PA01
ccgaugccggccggcag

SEQ ID NO: 3423630 - RNA, 18 nt, Pseudomonas aeruginosa PA01
ccgaugccggccggcagc

SEQ ID NO: 3423631 - RNA, 23 nt, Pseudomonas aeruginosa PA01
ccgaugccggccggcagcgagcg

SEQ ID NO: 3423632 - RNA, 16 nt, Pseudomonas aeruginosa PA01
ccgaugccgggcaacg

SEQ ID NO: 3423633 - RNA, 20 nt, Pseudomonas aeruginosa PA01
ccgaugcgcaacgggcggcg

SEQ ID NO: 3423634 - RNA, 16 nt, Pseudomonas aeruginosa PA01
ccgaugcgccgacgcc

SEQ ID NO: 3423635 - RNA, 21 nt, Pseudomonas aeruginosa PA01
ccgaugcgccgacgccaccag

SEQ ID NO: 3423636 - RNA, 23 nt, Pseudomonas aeruginosa PA01
ccgaugcgccgacgccaccagcc

SEQ ID NO: 3423637 - RNA, 15 nt, Pseudomonas aeruginosa PA01
ccgaugcucgcgcca

SEQ ID NO: 3423638 - RNA, 16 nt, Pseudomonas aeruginosa PA01
ccgaugcucgcgccag

SEQ ID NO: 3423639 - RNA, 20 nt, Pseudomonas aeruginosa PA01
ccgaugcucgcgccagcccc

SEQ ID NO: 3423640 - RNA, 20 nt, Pseudomonas aeruginosa PA01
ccgaugcugaucacccgccc

SEQ ID NO: 3423641 - RNA, 22 nt, Pseudomonas aeruginosa PA01
ccgaugcugaucacccgcccgc

SEQ ID NO: 3423642 - RNA, 21 nt, Pseudomonas aeruginosa PA01
ccgaugcuguauuccuugcgg

SEQ ID NO: 3423643 - RNA, 21 nt, Pseudomonas aeruginosa PA01
ccgaugcuguucagcaggagc

SEQ ID NO: 3423644 - RNA, 17 nt, Pseudomonas aeruginosa PA01
ccgauggaaaucggcca

SEQ ID NO: 3423645 - RNA, 14 nt, Pseudomonas aeruginosa PA01
ccgauggacaggcu

SEQ ID NO: 3423646 - RNA, 20 nt, Pseudomonas aeruginosa PA01
ccgauggauucgaaccacug

SEQ ID NO: 3423647 - RNA, 23 nt, Pseudomonas aeruginosa PA01
ccgauggauucgaaccacugcgc

SEQ ID NO: 3423648 - RNA, 12 nt, Pseudomonas aeruginosa PA01
ccgauggccagg

SEQ ID NO: 3423649 - RNA, 13 nt, Pseudomonas aeruginosa PA01
ccgauggccaggg

SEQ ID NO: 3423650 - RNA, 14 nt, Pseudomonas aeruginosa PA01
ccgauggcgcacca

SEQ ID NO: 3423651 - RNA, 14 nt, Pseudomonas aeruginosa PA01
ccgauggcgccgcc

SEQ ID NO: 3423652 - RNA, 18 nt, Pseudomonas aeruginosa PA01
ccgauggcgccgccgagg

SEQ ID NO: 3423653 - RNA, 20 nt, Pseudomonas aeruginosa PA01
ccgauggcgcgcuuuccggc

SEQ ID NO: 3423654 - RNA, 23 nt, Pseudomonas aeruginosa PA01
ccgauggcgcgcuuuccggcgcg

SEQ ID NO: 3423655 - RNA, 19 nt, Pseudomonas aeruginosa PA01
ccgauggcgcuggaacagc

SEQ ID NO: 3423656 - RNA, 19 nt, Pseudomonas aeruginosa PA01
ccgauggcguuauucgccc

SEQ ID NO: 3423657 - RNA, 19 nt, Pseudomonas aeruginosa PA01
ccgauggcugucggcgccc

SEQ ID NO: 3423658 - RNA, 17 nt, Pseudomonas aeruginosa PA01
ccgaugguuucgugcca

SEQ ID NO: 3423659 - RNA, 16 nt, Pseudomonas aeruginosa PA01
ccgauguacggcacca

SEQ ID NO: 3423660 - RNA, 18 nt, Pseudomonas aeruginosa PA01
ccgauguacggcaccacc

SEQ ID NO: 3423661 - RNA, 19 nt, Pseudomonas aeruginosa PA01
ccgauguccucgaacagcu

SEQ ID NO: 3423662 - RNA, 13 nt, Pseudomonas aeruginosa PA01
ccgaugucgccgg

SEQ ID NO: 3423663 - RNA, 14 nt, Pseudomonas aeruginosa PA01
ccgaugucgccggc

SEQ ID NO: 3423664 - RNA, 16 nt, Pseudomonas aeruginosa PA01
ccgaugucgccggcau

SEQ ID NO: 3423665 - RNA, 18 nt, Pseudomonas aeruginosa PA01
ccgaugucgccggcaugg

SEQ ID NO: 3423666 - RNA, 19 nt, Pseudomonas aeruginosa PA01
ccgaugucguagccgcgcg

SEQ ID NO: 3423667 - RNA, 20 nt, Pseudomonas aeruginosa PA01
ccgaugucguagccgcgcgc

SEQ ID NO: 3423668 - RNA, 12 nt, Pseudomonas aeruginosa PA01
ccgauuccugcg

SEQ ID NO: 3423669 - RNA, 18 nt, Pseudomonas aeruginosa PA01
ccgauuccugcggcuugc

SEQ ID NO: 3423670 - RNA, 13 nt, Pseudomonas aeruginosa PA01
ccgauucgccggc

SEQ ID NO: 3423671 - RNA, 12 nt, Pseudomonas aeruginosa PA01
ccgcagcggcgc

SEQ ID NO: 3423672 - RNA, 23 nt, Pseudomonas aeruginosa PA01
ccgcagcggcgcuacgaaggcgu

SEQ ID NO: 3423673 - RNA, 12 nt, Pseudomonas aeruginosa PA01
ccgcagcggcug

SEQ ID NO: 3423674 - RNA, 19 nt, Pseudomonas aeruginosa PA01
ccgcaggaaaccccucggc

SEQ ID NO: 3423675 - RNA, 22 nt, Pseudomonas aeruginosa PA01
ccgcaggaaggcgaagccguug

SEQ ID NO: 3423676 - RNA, 13 nt, Pseudomonas aeruginosa PA01
ccgcaggaugccg

SEQ ID NO: 3423677 - RNA, 17 nt, Pseudomonas aeruginosa PA01
ccgcaggaugccgccug

SEQ ID NO: 3423678 - RNA, 15 nt, Pseudomonas aeruginosa PA01
ccgcaggcaguggcg

SEQ ID NO: 3423679 - RNA, 17 nt, Pseudomonas aeruginosa PA01
ccgcaggcaguggcgcc

SEQ ID NO: 3423680 - RNA, 23 nt, Pseudomonas aeruginosa PA01
ccgcaggcaguggcgccagccag

SEQ ID NO: 3423681 - RNA, 13 nt, Pseudomonas aeruginosa PA01
ccgcaggccgcgg

SEQ ID NO: 3423682 - RNA, 16 nt, Pseudomonas aeruginosa PA01
ccgcaggccgcggccg

SEQ ID NO: 3423683 - RNA, 14 nt, Pseudomonas aeruginosa PA01
ccgcaggccggcca

SEQ ID NO: 3423684 - RNA, 15 nt, Pseudomonas aeruginosa PA01
ccgcaggcgggcgcc

SEQ ID NO: 3423685 - RNA, 16 nt, Pseudomonas aeruginosa PA01
ccgcagggugcggcug

SEQ ID NO: 3423686 - RNA, 20 nt, Pseudomonas aeruginosa PA01
ccgcagguagcugagcaggc

SEQ ID NO: 3423687 - RNA, 22 nt, Pseudomonas aeruginosa PA01
ccgcagguagcugagcaggccg

SEQ ID NO: 3423688 - RNA, 23 nt, Pseudomonas aeruginosa PA01
ccgcagguagcugagcaggccga

SEQ ID NO: 3423689 - RNA, 14 nt, Pseudomonas aeruginosa PA01
ccgcaggucggcgu

SEQ ID NO: 3423690 - RNA, 15 nt, Pseudomonas aeruginosa PA01
ccgcaggucggcguc

SEQ ID NO: 3423691 - RNA, 14 nt, Pseudomonas aeruginosa PA01
ccgcaggugaagcu

SEQ ID NO: 3423692 - RNA, 18 nt, Pseudomonas aeruginosa PA01
ccgcagguuggccccgcc

SEQ ID NO: 3423693 - RNA, 20 nt, Pseudomonas aeruginosa PA01
ccgcagguuggccccgccga

SEQ ID NO: 3423694 - RNA, 22 nt, Pseudomonas aeruginosa PA01
ccgcagguuggccccgccgagg

SEQ ID NO: 3423695 - RNA, 21 nt, Pseudomonas aeruginosa PA01
ccgcaguacgaggggccgccg

SEQ ID NO: 3423696 - RNA, 21 nt, Pseudomonas aeruginosa PA01
ccgcaguagaugccgcgucgg

SEQ ID NO: 3423697 - RNA, 16 nt, Pseudomonas aeruginosa PA01
ccgcaguagcucgccg

SEQ ID NO: 3423698 - RNA, 17 nt, Pseudomonas aeruginosa PA01
ccgcaguagcucgccga

SEQ ID NO: 3423699 - RNA, 18 nt, Pseudomonas aeruginosa PA01
ccgcaguagcucgccgag

SEQ ID NO: 3423700 - RNA, 19 nt, Pseudomonas aeruginosa PA01
ccgcaguccagggcgaugg

SEQ ID NO: 3423701 - RNA, 16 nt, Pseudomonas aeruginosa PA01
ccgcaguuccucgccg

SEQ ID NO: 3423702 - RNA, 12 nt, Pseudomonas aeruginosa PA01
ccgcaguuccuu

SEQ ID NO: 3423703 - RNA, 20 nt, Pseudomonas aeruginosa PA01
ccgcaguuccuugggcaucg

SEQ ID NO: 3423704 - RNA, 17 nt, Pseudomonas aeruginosa PA01
ccgcaguucgccccgcc

SEQ ID NO: 3423705 - RNA, 18 nt, Pseudomonas aeruginosa PA01
ccgcaguucgccccgccg

SEQ ID NO: 3423706 - RNA, 23 nt, Pseudomonas aeruginosa PA01
ccgcaguucgccccgccgccagg

SEQ ID NO: 3423707 - RNA, 19 nt, Pseudomonas aeruginosa PA01
ccgcaguuguuccucgcgg

SEQ ID NO: 3423708 - RNA, 20 nt, Pseudomonas aeruginosa PA01
ccgcaguuguuccucgcggc

SEQ ID NO: 3423709 - RNA, 22 nt, Pseudomonas aeruginosa PA01
ccgcauaggucaugcccaggcc

SEQ ID NO: 3423710 - RNA, 18 nt, Pseudomonas aeruginosa PA01
ccgcaucccaguagccgg

SEQ ID NO: 3423711 - RNA, 18 nt, Pseudomonas aeruginosa PA01
ccgcauccuccacccccg

SEQ ID NO: 3423712 - RNA, 19 nt, Pseudomonas aeruginosa PA01
ccgcauccuccacccccgc

SEQ ID NO: 3423713 - RNA, 21 nt, Pseudomonas aeruginosa PA01
ccgcaucgaaggcgccggcau

SEQ ID NO: 3423714 - RNA, 23 nt, Pseudomonas aeruginosa PA01
ccgcaucgaaggcgccggcauga

SEQ ID NO: 3423715 - RNA, 21 nt, Pseudomonas aeruginosa PA01
ccgcaucgaccuugcccucgg

SEQ ID NO: 3423716 - RNA, 18 nt, Pseudomonas aeruginosa PA01
ccgcaucgaggccgccca

SEQ ID NO: 3423717 - RNA, 22 nt, Pseudomonas aeruginosa PA01
ccgcaucgaggccgcccagcgc

SEQ ID NO: 3423718 - RNA, 17 nt, Pseudomonas aeruginosa PA01
ccgcaucgcgggcgugc

SEQ ID NO: 3423719 - RNA, 15 nt, Pseudomonas aeruginosa PA01
ccgcaucgcggggcu

SEQ ID NO: 3423720 - RNA, 20 nt, Pseudomonas aeruginosa PA01
ccgcaucgcgguuauccgcc

SEQ ID NO: 3423721 - RNA, 14 nt, Pseudomonas aeruginosa PA01
ccgcaucggccacc

SEQ ID NO: 3423722 - RNA, 16 nt, Pseudomonas aeruginosa PA01
ccgcaucggccaccuu

SEQ ID NO: 3423723 - RNA, 21 nt, Pseudomonas aeruginosa PA01
ccgcaucggccaccuucgccc

SEQ ID NO: 3423724 - RNA, 13 nt, Pseudomonas aeruginosa PA01
ccgcaucggccga

SEQ ID NO: 3423725 - RNA, 15 nt, Pseudomonas aeruginosa PA01
ccgcaucguuggcgc

SEQ ID NO: 3423726 - RNA, 20 nt, Pseudomonas aeruginosa PA01
ccgcaucguuggcgccgucc

SEQ ID NO: 3423727 - RNA, 17 nt, Pseudomonas aeruginosa PA01
ccgcaucuccccaccaa

SEQ ID NO: 3423728 - RNA, 19 nt, Pseudomonas aeruginosa PA01
ccgcaugaacgccucgcca

SEQ ID NO: 3423729 - RNA, 22 nt, Pseudomonas aeruginosa PA01
ccgcaugccagggccuugcuga

SEQ ID NO: 3423730 - RNA, 21 nt, Pseudomonas aeruginosa PA01
ccgcauugacccgggugccuu

SEQ ID NO: 3423731 - RNA, 14 nt, Pseudomonas aeruginosa PA01
ccgcauuggccagg

SEQ ID NO: 3423732 - RNA, 21 nt, Pseudomonas aeruginosa PA01
ccgccaaaguucaguagcggc

SEQ ID NO: 3423733 - RNA, 18 nt, Pseudomonas aeruginosa PA01
ccgccaaccacuccgcca

SEQ ID NO: 3423734 - RNA, 15 nt, Pseudomonas aeruginosa PA01
ccgccaacguccucg

SEQ ID NO: 3423735 - RNA, 17 nt, Pseudomonas aeruginosa PA01
ccgccaacuggcugucg

SEQ ID NO: 3423736 - RNA, 15 nt, Pseudomonas aeruginosa PA01
ccgccaaggccucgg

SEQ ID NO: 3423737 - RNA, 17 nt, Pseudomonas aeruginosa PA01
ccgccaaggccucggca

SEQ ID NO: 3423738 - RNA, 19 nt, Pseudomonas aeruginosa PA01
ccgccaagggcgccgccga

SEQ ID NO: 3423739 - RNA, 20 nt, Pseudomonas aeruginosa PA01
ccgccaagggcgccgccgag

SEQ ID NO: 3423740 - RNA, 22 nt, Pseudomonas aeruginosa PA01
ccgccaagggcgccgccgagga

SEQ ID NO: 3423741 - RNA, 22 nt, Pseudomonas aeruginosa PA01
ccgccaaggucggucucgccac

SEQ ID NO: 3423742 - RNA, 18 nt, Pseudomonas aeruginosa PA01
ccgccacagaucgccagc

SEQ ID NO: 3423743 - RNA, 20 nt, Pseudomonas aeruginosa PA01
ccgccacagaucgccagcuc

SEQ ID NO: 3423744 - RNA, 17 nt, Pseudomonas aeruginosa PA01
ccgccaccacgaucagg

SEQ ID NO: 3423745 - RNA, 22 nt, Pseudomonas aeruginosa PA01
ccgccaccacgaucaggcccuu

SEQ ID NO: 3423746 - RNA, 16 nt, Pseudomonas aeruginosa PA01
ccgccaccagcgaguc

SEQ ID NO: 3423747 - RNA, 24 nt, Pseudomonas aeruginosa PA01
ccgccaccagcgagucgacccagg

SEQ ID NO: 3423748 - RNA, 13 nt, Pseudomonas aeruginosa PA01
ccgccaccccgcc

SEQ ID NO: 3423749 - RNA, 16 nt, Pseudomonas aeruginosa PA01
ccgccaccccgccggc

SEQ ID NO: 3423750 - RNA, 15 nt, Pseudomonas aeruginosa PA01
ccgccaccgccaccg

SEQ ID NO: 3423751 - RNA, 18 nt, Pseudomonas aeruginosa PA01
ccgccaccgccaccgccg

SEQ ID NO: 3423752 - RNA, 22 nt, Pseudomonas aeruginosa PA01
ccgccaccucguauuccacguc

SEQ ID NO: 3423753 - RNA, 16 nt, Pseudomonas aeruginosa PA01
ccgccaccugccccgg

SEQ ID NO: 3423754 - RNA, 23 nt, Pseudomonas aeruginosa PA01
ccgccacgccgauaccggccucg

SEQ ID NO: 3423755 - RNA, 20 nt, Pseudomonas aeruginosa PA01
ccgccacgcuugucguggcg

SEQ ID NO: 3423756 - RNA, 19 nt, Pseudomonas aeruginosa PA01
ccgccacggcgcgcuccgg

SEQ ID NO: 3423757 - RNA, 19 nt, Pseudomonas aeruginosa PA01
ccgccacguacagcgcgac

SEQ ID NO: 3423758 - RNA, 22 nt, Pseudomonas aeruginosa PA01
ccgccacgugcacgccgugcau

SEQ ID NO: 3423759 - RNA, 19 nt, Pseudomonas aeruginosa PA01
ccgccacuuccagcacgcc

SEQ ID NO: 3423760 - RNA, 17 nt, Pseudomonas aeruginosa PA01
ccgccagaaagccucag

SEQ ID NO: 3423761 - RNA, 19 nt, Pseudomonas aeruginosa PA01
ccgccagaaagccucaggc

SEQ ID NO: 3423762 - RNA, 14 nt, Pseudomonas aeruginosa PA01
ccgccagacaggcc

SEQ ID NO: 3423763 - RNA, 16 nt, Pseudomonas aeruginosa PA01
ccgccagacaggccag

SEQ ID NO: 3423764 - RNA, 23 nt, Pseudomonas aeruginosa PA01
ccgccagacaggccagcucgccc

SEQ ID NO: 3423765 - RNA, 17 nt, Pseudomonas aeruginosa PA01
ccgccagaugcgcgucg

SEQ ID NO: 3423766 - RNA, 18 nt, Pseudomonas aeruginosa PA01
ccgccagaugcgcgucgc

SEQ ID NO: 3423767 - RNA, 21 nt, Pseudomonas aeruginosa PA01
ccgccagaugcgcgucgccga

SEQ ID NO: 3423768 - RNA, 23 nt, Pseudomonas aeruginosa PA01
ccgccagaugcgcgucgccgaac

SEQ ID NO: 3423769 - RNA, 12 nt, Pseudomonas aeruginosa PA01
ccgccagcaaca

SEQ ID NO: 3423770 - RNA, 18 nt, Pseudomonas aeruginosa PA01
ccgccagcaacaguugcc

SEQ ID NO: 3423771 - RNA, 12 nt, Pseudomonas aeruginosa PA01
ccgccagcaacg

SEQ ID NO: 3423772 - RNA, 12 nt, Pseudomonas aeruginosa PA01
ccgccagcaaga

SEQ ID NO: 3423773 - RNA, 16 nt, Pseudomonas aeruginosa PA01
ccgccaguuccggcaa

SEQ ID NO: 3423774 - RNA, 16 nt, Pseudomonas aeruginosa PA01
ccgccaguucgcgcag

SEQ ID NO: 3423775 - RNA, 18 nt, Pseudomonas aeruginosa PA01
ccgccauagagugcccag

SEQ ID NO: 3423776 - RNA, 20 nt, Pseudomonas aeruginosa PA01
ccgccauagagugcccaggc

SEQ ID NO: 3423777 - RNA, 21 nt, Pseudomonas aeruginosa PA01
ccgccauagagugcccaggcg

SEQ ID NO: 3423778 - RNA, 22 nt, Pseudomonas aeruginosa PA01
ccgccauagagugcccaggcgc

SEQ ID NO: 3423779 - RNA, 23 nt, Pseudomonas aeruginosa PA01
ccgccauagagugcccaggcgcu

SEQ ID NO: 3423780 - RNA, 21 nt, Pseudomonas aeruginosa PA01
ccgccaucaccagcggcgagc

SEQ ID NO: 3423781 - RNA, 19 nt, Pseudomonas aeruginosa PA01
ccgccaucgacguagagga

SEQ ID NO: 3423782 - RNA, 22 nt, Pseudomonas aeruginosa PA01
ccgccaucgauggucaggcugg

SEQ ID NO: 3423783 - RNA, 13 nt, Pseudomonas aeruginosa PA01
ccgccaucgcccg

SEQ ID NO: 3423784 - RNA, 16 nt, Pseudomonas aeruginosa PA01
ccgccaucgccucgcc

SEQ ID NO: 3423785 - RNA, 19 nt, Pseudomonas aeruginosa PA01
ccgccaucgccucgccggc

SEQ ID NO: 3423786 - RNA, 14 nt, Pseudomonas aeruginosa PA01
ccgccaugcucggc

SEQ ID NO: 3423787 - RNA, 16 nt, Pseudomonas aeruginosa PA01
ccgccauggcgcugag

SEQ ID NO: 3423788 - RNA, 16 nt, Pseudomonas aeruginosa PA01
ccgcccacccugcgcg

SEQ ID NO: 3423789 - RNA, 12 nt, Pseudomonas aeruginosa PA01
ccgcccaccgcg

SEQ ID NO: 3423790 - RNA, 23 nt, Pseudomonas aeruginosa PA01
ccgcccacgccuugcagcaccgc

SEQ ID NO: 3423791 - RNA, 13 nt, Pseudomonas aeruginosa PA01
ccgcccagcagca

SEQ ID NO: 3423792 - RNA, 16 nt, Pseudomonas aeruginosa PA01
ccgcccagcagcacca

SEQ ID NO: 3423793 - RNA, 12 nt, Pseudomonas aeruginosa PA01
ccgcccagccga

SEQ ID NO: 3423794 - RNA, 12 nt, Pseudomonas aeruginosa PA01
ccgcccagcgca

SEQ ID NO: 3423795 - RNA, 14 nt, Pseudomonas aeruginosa PA01
ccgcccagcgcagc

SEQ ID NO: 3423796 - RNA, 20 nt, Pseudomonas aeruginosa PA01
ccgcccagcggaugcgcgaa

SEQ ID NO: 3423797 - RNA, 22 nt, Pseudomonas aeruginosa PA01
ccgcccaggacaacgacagccc

SEQ ID NO: 3423798 - RNA, 20 nt, Pseudomonas aeruginosa PA01
ccgcccaggcugccgccgcc

SEQ ID NO: 3423799 - RNA, 17 nt, Pseudomonas aeruginosa PA01
ccgcccagggggccggg

SEQ ID NO: 3423800 - RNA, 19 nt, Pseudomonas aeruginosa PA01
ccgcccagggggccgggcc

SEQ ID NO: 3423801 - RNA, 17 nt, Pseudomonas aeruginosa PA01
ccgcccaguucgccggc

SEQ ID NO: 3423802 - RNA, 19 nt, Pseudomonas aeruginosa PA01
ccgcccaguucgccggcca

SEQ ID NO: 3423803 - RNA, 20 nt, Pseudomonas aeruginosa PA01
ccgcccaguucgccggccag

SEQ ID NO: 3423804 - RNA, 19 nt, Pseudomonas aeruginosa PA01
ccgcccaucaacgagccga

SEQ ID NO: 3423805 - RNA, 20 nt, Pseudomonas aeruginosa PA01
ccgcccaucaacgagccgag

SEQ ID NO: 3423806 - RNA, 17 nt, Pseudomonas aeruginosa PA01
ccgcccauugcccggcc

SEQ ID NO: 3423807 - RNA, 19 nt, Pseudomonas aeruginosa PA01
ccgcccauugcccggccag

SEQ ID NO: 3423808 - RNA, 21 nt, Pseudomonas aeruginosa PA01
ccgcccauugcccggccaggc

SEQ ID NO: 3423809 - RNA, 23 nt, Pseudomonas aeruginosa PA01
ccgcccauugcccggccaggcgc

SEQ ID NO: 3423810 - RNA, 19 nt, Pseudomonas aeruginosa PA01
ccgccccaccaccaucgcc

SEQ ID NO: 3423811 - RNA, 12 nt, Pseudomonas aeruginosa PA01
ccgccccagccu

SEQ ID NO: 3423812 - RNA, 13 nt, Pseudomonas aeruginosa PA01
ccgccccagccuc

SEQ ID NO: 3423813 - RNA, 14 nt, Pseudomonas aeruginosa PA01
ccgccccagccucg

SEQ ID NO: 3423814 - RNA, 22 nt, Pseudomonas aeruginosa PA01
ccgcccccagcgcgccgccgag

SEQ ID NO: 3423815 - RNA, 13 nt, Pseudomonas aeruginosa PA01
ccgcccccggccc

SEQ ID NO: 3423816 - RNA, 15 nt, Pseudomonas aeruginosa PA01
ccgcccccggcccgg

SEQ ID NO: 3423817 - RNA, 23 nt, Pseudomonas aeruginosa PA01
ccgccccgaaaaaaaaggccgca

SEQ ID NO: 3423818 - RNA, 13 nt, Pseudomonas aeruginosa PA01
ccgccccgcaagg

SEQ ID NO: 3423819 - RNA, 22 nt, Pseudomonas aeruginosa PA01
ccgccccgcaccagccagcccg

SEQ ID NO: 3423820 - RNA, 18 nt, Pseudomonas aeruginosa PA01
ccgccccggaggcggucu

SEQ ID NO: 3423821 - RNA, 17 nt, Pseudomonas aeruginosa PA01
ccgccccggcaagcgcc

SEQ ID NO: 3423822 - RNA, 15 nt, Pseudomonas aeruginosa PA01
ccgccccggcagcca

SEQ ID NO: 3423823 - RNA, 17 nt, Pseudomonas aeruginosa PA01
ccgccccugcuccucgc

SEQ ID NO: 3423824 - RNA, 19 nt, Pseudomonas aeruginosa PA01
ccgccccuuuccgccggac

SEQ ID NO: 3423825 - RNA, 23 nt, Pseudomonas aeruginosa PA01
ccgcccgagaggguggucgcgcu

SEQ ID NO: 3423826 - RNA, 21 nt, Pseudomonas aeruginosa PA01
ccgcccgagcuuugcgcagcc

SEQ ID NO: 3423827 - RNA, 21 nt, Pseudomonas aeruginosa PA01
ccgcccgaucgccucgucgag

SEQ ID NO: 3423828 - RNA, 22 nt, Pseudomonas aeruginosa PA01
ccgcccgcaugccagggccuug

SEQ ID NO: 3423829 - RNA, 13 nt, Pseudomonas aeruginosa PA01
ccgcccgccgucc

SEQ ID NO: 3423830 - RNA, 13 nt, Pseudomonas aeruginosa PA01
ccgcccgcgccuc

SEQ ID NO: 3423831 - RNA, 16 nt, Pseudomonas aeruginosa PA01
ccgcccgcgccuccag

SEQ ID NO: 3423832 - RNA, 21 nt, Pseudomonas aeruginosa PA01
ccgcccgcgccuccaggcgcg

SEQ ID NO: 3423833 - RNA, 20 nt, Pseudomonas aeruginosa PA01
ccgcccgcggaccgggcggc

SEQ ID NO: 3423834 - RNA, 16 nt, Pseudomonas aeruginosa PA01
ccgcccgcucaagggc

SEQ ID NO: 3423835 - RNA, 21 nt, Pseudomonas aeruginosa PA01
ccgcccgcucaagggcuggca

SEQ ID NO: 3423836 - RNA, 17 nt, Pseudomonas aeruginosa PA01
ccgcccggaaccaccgg

SEQ ID NO: 3423837 - RNA, 18 nt, Pseudomonas aeruginosa PA01
ccgcccggaaccaccggu

SEQ ID NO: 3423838 - RNA, 16 nt, Pseudomonas aeruginosa PA01
ccgcccggcaccaccg

SEQ ID NO: 3423839 - RNA, 17 nt, Pseudomonas aeruginosa PA01
ccgcccggcaccaccgg

SEQ ID NO: 3423840 - RNA, 12 nt, Pseudomonas aeruginosa PA01
ccgcccggcagc

SEQ ID NO: 3423841 - RNA, 15 nt, Pseudomonas aeruginosa PA01
ccgcccggcagcggc

SEQ ID NO: 3423842 - RNA, 18 nt, Pseudomonas aeruginosa PA01
ccgcccggcagcggcugg

SEQ ID NO: 3423843 - RNA, 21 nt, Pseudomonas aeruginosa PA01
ccgcccggcagcggcuggccg

SEQ ID NO: 3423844 - RNA, 16 nt, Pseudomonas aeruginosa PA01
ccgcccggccaggcca

SEQ ID NO: 3423845 - RNA, 18 nt, Pseudomonas aeruginosa PA01
ccgcccggcgccaccgcg

SEQ ID NO: 3423846 - RNA, 18 nt, Pseudomonas aeruginosa PA01
ccgcccggcucgccgccg

SEQ ID NO: 3423847 - RNA, 17 nt, Pseudomonas aeruginosa PA01
ccgcccggucuagcgcc

SEQ ID NO: 3423848 - RNA, 16 nt, Pseudomonas aeruginosa PA01
ccgcccggucucagcc

SEQ ID NO: 3423849 - RNA, 19 nt, Pseudomonas aeruginosa PA01
ccgcccggucucagccggc

SEQ ID NO: 3423850 - RNA, 12 nt, Pseudomonas aeruginosa PA01
ccgcccgucaug

SEQ ID NO: 3423851 - RNA, 15 nt, Pseudomonas aeruginosa PA01
ccgcccgucgcgccg

SEQ ID NO: 3423852 - RNA, 16 nt, Pseudomonas aeruginosa PA01
ccgcccgucgcgccgg

SEQ ID NO: 3423853 - RNA, 17 nt, Pseudomonas aeruginosa PA01
ccgcccgucgcgccggc

SEQ ID NO: 3423854 - RNA, 17 nt, Pseudomonas aeruginosa PA01
ccgcccuagcgguccgg

SEQ ID NO: 3423855 - RNA, 23 nt, Pseudomonas aeruginosa PA01
ccgcccucgcaguacagcucggc

SEQ ID NO: 3423856 - RNA, 15 nt, Pseudomonas aeruginosa PA01
ccgcccucgggccgc

SEQ ID NO: 3423857 - RNA, 12 nt, Pseudomonas aeruginosa PA01
ccgcccugcgca

SEQ ID NO: 3423858 - RNA, 12 nt, Pseudomonas aeruginosa PA01
ccgcccugcgcg

SEQ ID NO: 3423859 - RNA, 20 nt, Pseudomonas aeruginosa PA01
ccgcccugcggcaggcgcca

SEQ ID NO: 3423860 - RNA, 12 nt, Pseudomonas aeruginosa PA01
ccgcccuggccg

SEQ ID NO: 3423861 - RNA, 13 nt, Pseudomonas aeruginosa PA01
ccgcccuggccga

SEQ ID NO: 3423862 - RNA, 22 nt, Pseudomonas aeruginosa PA01
ccgcccuggccgcccaguucgc

SEQ ID NO: 3423863 - RNA, 20 nt, Pseudomonas aeruginosa PA01
ccgcccuggcucugggccau

SEQ ID NO: 3423864 - RNA, 21 nt, Pseudomonas aeruginosa PA01
ccgcccugggguuucugcugg

SEQ ID NO: 3423865 - RNA, 16 nt, Pseudomonas aeruginosa PA01
ccgcccuugcggcccg

SEQ ID NO: 3423866 - RNA, 23 nt, Pseudomonas aeruginosa PA01
ccgcccuugcggcccgccucggc

SEQ ID NO: 3423867 - RNA, 17 nt, Pseudomonas aeruginosa PA01
ccgcccuugcucgcggc

SEQ ID NO: 3423868 - RNA, 18 nt, Pseudomonas aeruginosa PA01
ccgcccuugcucgcggcg

SEQ ID NO: 3423869 - RNA, 16 nt, Pseudomonas aeruginosa PA01
ccgcccuuggcggcgc

SEQ ID NO: 3423870 - RNA, 22 nt, Pseudomonas aeruginosa PA01
ccgcccuugucgaugagccagc

SEQ ID NO: 3423871 - RNA, 15 nt, Pseudomonas aeruginosa PA01
ccgcccuuucgaacu

SEQ ID NO: 3423872 - RNA, 20 nt, Pseudomonas aeruginosa PA01
ccgcccuuuuucgucgccag

SEQ ID NO: 3423873 - RNA, 21 nt, Pseudomonas aeruginosa PA01
ccgcccuuuuucgucgccagc

SEQ ID NO: 3423874 - RNA, 15 nt, Pseudomonas aeruginosa PA01
ccgccgaacagcaac

SEQ ID NO: 3423875 - RNA, 13 nt, Pseudomonas aeruginosa PA01
ccgccgcgccggc

SEQ ID NO: 3423876 - RNA, 14 nt, Pseudomonas aeruginosa PA01
ccgccgcgccggcg

SEQ ID NO: 3423877 - RNA, 21 nt, Pseudomonas aeruginosa PA01
ccgccgcgccucgucgcgcca

SEQ ID NO: 3423878 - RNA, 16 nt, Pseudomonas aeruginosa PA01
ccgccgcgccuugaaa

SEQ ID NO: 3423879 - RNA, 18 nt, Pseudomonas aeruginosa PA01
ccgccgcgcugcaggcgg

SEQ ID NO: 3423880 - RNA, 18 nt, Pseudomonas aeruginosa PA01
ccgccgcgcuucaggcag

SEQ ID NO: 3423881 - RNA, 15 nt, Pseudomonas aeruginosa PA01
ccgccgcggcaccgg

SEQ ID NO: 3423882 - RNA, 20 nt, Pseudomonas aeruginosa PA01
ccgccgcggcaccggcgacg

SEQ ID NO: 3423883 - RNA, 12 nt, Pseudomonas aeruginosa PA01
ccgccgcggcca

SEQ ID NO: 3423884 - RNA, 15 nt, Pseudomonas aeruginosa PA01
ccgccgcggcgcgga

SEQ ID NO: 3423885 - RNA, 20 nt, Pseudomonas aeruginosa PA01
ccgccgcgggacgccgcagg

SEQ ID NO: 3423886 - RNA, 20 nt, Pseudomonas aeruginosa PA01
ccgccgcgggcaaccgcggc

SEQ ID NO: 3423887 - RNA, 13 nt, Pseudomonas aeruginosa PA01
ccgccgcgggcga

SEQ ID NO: 3423888 - RNA, 16 nt, Pseudomonas aeruginosa PA01
ccgccgcgggcgaacg

SEQ ID NO: 3423889 - RNA, 21 nt, Pseudomonas aeruginosa PA01
ccgccgcgggcgaacggcagc

SEQ ID NO: 3423890 - RNA, 16 nt, Pseudomonas aeruginosa PA01
ccgccgcgucgucggc

SEQ ID NO: 3423891 - RNA, 20 nt, Pseudomonas aeruginosa PA01
ccgccgcgucgucggcgacg

SEQ ID NO: 3423892 - RNA, 17 nt, Pseudomonas aeruginosa PA01
ccgccgcgugccgccgg

SEQ ID NO: 3423893 - RNA, 19 nt, Pseudomonas aeruginosa PA01
ccgccgcgugccgccggac

SEQ ID NO: 3423894 - RNA, 14 nt, Pseudomonas aeruginosa PA01
ccgccgcgugcgcg

SEQ ID NO: 3423895 - RNA, 15 nt, Pseudomonas aeruginosa PA01
ccgccgcgugcgcgc

SEQ ID NO: 3423896 - RNA, 17 nt, Pseudomonas aeruginosa PA01
ccgccgcgugcgcgccc

SEQ ID NO: 3423897 - RNA, 21 nt, Pseudomonas aeruginosa PA01
ccgccgcgugcgcgcccucgg

SEQ ID NO: 3423898 - RNA, 21 nt, Pseudomonas aeruginosa PA01
ccgccgcgugggcuucgccgc

SEQ ID NO: 3423899 - RNA, 24 nt, Pseudomonas aeruginosa PA01
ccgccgcgugggcuucgccgccgc

SEQ ID NO: 3423900 - RNA, 15 nt, Pseudomonas aeruginosa PA01
ccgccgcuacugcgc

SEQ ID NO: 3423901 - RNA, 17 nt, Pseudomonas aeruginosa PA01
ccgccgcuacugcgcgg

SEQ ID NO: 3423902 - RNA, 16 nt, Pseudomonas aeruginosa PA01
ccgccgcuaucgccgc

SEQ ID NO: 3423903 - RNA, 15 nt, Pseudomonas aeruginosa PA01
ccgccgcuccggcug

SEQ ID NO: 3423904 - RNA, 19 nt, Pseudomonas aeruginosa PA01
ccgccgcuccggcugcgcg

SEQ ID NO: 3423905 - RNA, 14 nt, Pseudomonas aeruginosa PA01
ccgccgcucugcug

SEQ ID NO: 3423906 - RNA, 18 nt, Pseudomonas aeruginosa PA01
ccgccgcucugcuggccg

SEQ ID NO: 3423907 - RNA, 22 nt, Pseudomonas aeruginosa PA01
ccgccgcucugcuggccgcccu

SEQ ID NO: 3423908 - RNA, 20 nt, Pseudomonas aeruginosa PA01
ccgccgcugaucaguaccgg

SEQ ID NO: 3423909 - RNA, 15 nt, Pseudomonas aeruginosa PA01
ccgccgcugcaccga

SEQ ID NO: 3423910 - RNA, 22 nt, Pseudomonas aeruginosa PA01
ccgccgcugcgucgucgcggcg

SEQ ID NO: 3423911 - RNA, 22 nt, Pseudomonas aeruginosa PA01
ccgccgcuggcauaaccggaag

SEQ ID NO: 3423912 - RNA, 12 nt, Pseudomonas aeruginosa PA01
ccgccgcuggcc

SEQ ID NO: 3423913 - RNA, 14 nt, Pseudomonas aeruginosa PA01
ccgccgcuggcgag

SEQ ID NO: 3423914 - RNA, 14 nt, Pseudomonas aeruginosa PA01
ccgccgcuggcggc

SEQ ID NO: 3423915 - RNA, 21 nt, Pseudomonas aeruginosa PA01
ccgccgcuggcggcaugccgu

SEQ ID NO: 3423916 - RNA, 13 nt, Pseudomonas aeruginosa PA01
ccgccgcugggga

SEQ ID NO: 3423917 - RNA, 15 nt, Pseudomonas aeruginosa PA01
ccgccgcuuccgccg

SEQ ID NO: 3423918 - RNA, 16 nt, Pseudomonas aeruginosa PA01
ccgccgcuuccgccgg

SEQ ID NO: 3423919 - RNA, 18 nt, Pseudomonas aeruginosa PA01
ccgccgcuuccgccggcg

SEQ ID NO: 3423920 - RNA, 18 nt, Pseudomonas aeruginosa PA01
ccgccggaagcuuccagc

SEQ ID NO: 3423921 - RNA, 20 nt, Pseudomonas aeruginosa PA01
ccgccggaaugacgagccgc

SEQ ID NO: 3423922 - RNA, 22 nt, Pseudomonas aeruginosa PA01
ccgccggaaugacgagccgcag

SEQ ID NO: 3423923 - RNA, 14 nt, Pseudomonas aeruginosa PA01
ccgccggacccugc

SEQ ID NO: 3423924 - RNA, 17 nt, Pseudomonas aeruginosa PA01
ccgccggacccugccgu

SEQ ID NO: 3423925 - RNA, 17 nt, Pseudomonas aeruginosa PA01
ccgccggaccgucgcga

SEQ ID NO: 3423926 - RNA, 21 nt, Pseudomonas aeruginosa PA01
ccgccggagacuucagcgcau

SEQ ID NO: 3423927 - RNA, 20 nt, Pseudomonas aeruginosa PA01
ccgccggcagugugccgccc

SEQ ID NO: 3423928 - RNA, 10 nt, Pseudomonas aeruginosa PA01
ccgccggcau

SEQ ID NO: 3423929 - RNA, 13 nt, Pseudomonas aeruginosa PA01
ccgccggcauccc

SEQ ID NO: 3423930 - RNA, 17 nt, Pseudomonas aeruginosa PA01
ccgccggccaccagcag

SEQ ID NO: 3423931 - RNA, 19 nt, Pseudomonas aeruginosa PA01
ccgccggccaccagcagca

SEQ ID NO: 3423932 - RNA, 23 nt, Pseudomonas aeruginosa PA01
ccgccggccaccagcagcaacgg

SEQ ID NO: 3423933 - RNA, 16 nt, Pseudomonas aeruginosa PA01
ccgccggccagccgcg

SEQ ID NO: 3423934 - RNA, 19 nt, Pseudomonas aeruginosa PA01
ccgccggccagccgcgcca

SEQ ID NO: 3423935 - RNA, 21 nt, Pseudomonas aeruginosa PA01
ccgccggccagccgcgccagu

SEQ ID NO: 3423936 - RNA, 15 nt, Pseudomonas aeruginosa PA01
ccgccggccaugccg

SEQ ID NO: 3423937 - RNA, 11 nt, Pseudomonas aeruginosa PA01
ccgccggccgg

SEQ ID NO: 3423938 - RNA, 18 nt, Pseudomonas aeruginosa PA01
ccgccggccggggcgcgc

SEQ ID NO: 3423939 - RNA, 19 nt, Pseudomonas aeruginosa PA01
ccgccggccucgcugccgc

SEQ ID NO: 3423940 - RNA, 15 nt, Pseudomonas aeruginosa PA01
ccgccggccugcacg

SEQ ID NO: 3423941 - RNA, 15 nt, Pseudomonas aeruginosa PA01
ccgccggcgaacagc

SEQ ID NO: 3423942 - RNA, 19 nt, Pseudomonas aeruginosa PA01
ccgccggcgaacagccagc

SEQ ID NO: 3423943 - RNA, 20 nt, Pseudomonas aeruginosa PA01
ccgccggcgaacagccagcg

SEQ ID NO: 3423944 - RNA, 22 nt, Pseudomonas aeruginosa PA01
ccgccggcgaacagccagcggu

SEQ ID NO: 3423945 - RNA, 15 nt, Pseudomonas aeruginosa PA01
ccgccggcgaacggc

SEQ ID NO: 3423946 - RNA, 17 nt, Pseudomonas aeruginosa PA01
ccgccggcgaacggcau

SEQ ID NO: 3423947 - RNA, 17 nt, Pseudomonas aeruginosa PA01
ccgccggcgaccgcgcg

SEQ ID NO: 3423948 - RNA, 18 nt, Pseudomonas aeruginosa PA01
ccgccggcgaccgcgcgc

SEQ ID NO: 3423949 - RNA, 12 nt, Pseudomonas aeruginosa PA01
ccgccggcgacg

SEQ ID NO: 3423950 - RNA, 16 nt, Pseudomonas aeruginosa PA01
ccgccggcgacgaggu

SEQ ID NO: 3423951 - RNA, 21 nt, Pseudomonas aeruginosa PA01
ccgccggcgaggaucgcgcug

SEQ ID NO: 3423952 - RNA, 13 nt, Pseudomonas aeruginosa PA01
ccgccggcgaugc

SEQ ID NO: 3423953 - RNA, 15 nt, Pseudomonas aeruginosa PA01
ccgccggcgaugccc

SEQ ID NO: 3423954 - RNA, 22 nt, Pseudomonas aeruginosa PA01
ccgccggcgaugcccaggccgc

SEQ ID NO: 3423955 - RNA, 23 nt, Pseudomonas aeruginosa PA01
ccgccggcgaugcccaggccgcc

SEQ ID NO: 3423956 - RNA, 15 nt, Pseudomonas aeruginosa PA01
ccgccggcgcccugc

SEQ ID NO: 3423957 - RNA, 19 nt, Pseudomonas aeruginosa PA01
ccgccggcgcccugggcgc

SEQ ID NO: 3423958 - RNA, 13 nt, Pseudomonas aeruginosa PA01
ccgccggcgccgc

SEQ ID NO: 3423959 - RNA, 15 nt, Pseudomonas aeruginosa PA01
ccgccggcgccgccg

SEQ ID NO: 3423960 - RNA, 17 nt, Pseudomonas aeruginosa PA01
ccgccggcgccgccggg

SEQ ID NO: 3423961 - RNA, 15 nt, Pseudomonas aeruginosa PA01
ccgccggcgccgccu

SEQ ID NO: 3423962 - RNA, 21 nt, Pseudomonas aeruginosa PA01
ccgccggcgccgccucgggca

SEQ ID NO: 3423963 - RNA, 21 nt, Pseudomonas aeruginosa PA01
ccgccggcgcgucccugggcg

SEQ ID NO: 3423964 - RNA, 23 nt, Pseudomonas aeruginosa PA01
ccgccggcgcgucccugggcgca

SEQ ID NO: 3423965 - RNA, 15 nt, Pseudomonas aeruginosa PA01
ccgccggcggcgaug

SEQ ID NO: 3423966 - RNA, 11 nt, Pseudomonas aeruginosa PA01
ccgccggcguu

SEQ ID NO: 3423967 - RNA, 19 nt, Pseudomonas aeruginosa PA01
ccgccggcguuauccgccg

SEQ ID NO: 3423968 - RNA, 17 nt, Pseudomonas aeruginosa PA01
ccgccggcguugcgcgc

SEQ ID NO: 3423969 - RNA, 19 nt, Pseudomonas aeruginosa PA01
ccgccgggaaucuggccga

SEQ ID NO: 3423970 - RNA, 22 nt, Pseudomonas aeruginosa PA01
ccgccgggaccacgcucagguc

SEQ ID NO: 3423971 - RNA, 16 nt, Pseudomonas aeruginosa PA01
ccgccgggacccuggu

SEQ ID NO: 3423972 - RNA, 16 nt, Pseudomonas aeruginosa PA01
ccgccgggcaucaugc

SEQ ID NO: 3423973 - RNA, 14 nt, Pseudomonas aeruginosa PA01
ccgccgggccgccu

SEQ ID NO: 3423974 - RNA, 17 nt, Pseudomonas aeruginosa PA01
ccgccgggcgcccggcc

SEQ ID NO: 3423975 - RNA, 19 nt, Pseudomonas aeruginosa PA01
ccgccgggcgcccggccgg

SEQ ID NO: 3423976 - RNA, 14 nt, Pseudomonas aeruginosa PA01
ccgccgggcgcgcg

SEQ ID NO: 3423977 - RNA, 16 nt, Pseudomonas aeruginosa PA01
ccgccgggcggcgucg

SEQ ID NO: 3423978 - RNA, 19 nt, Pseudomonas aeruginosa PA01
ccgccuggugcccgaugcc

SEQ ID NO: 3423979 - RNA, 19 nt, Pseudomonas aeruginosa PA01
ccgccuguccaccgguggc

SEQ ID NO: 3423980 - RNA, 17 nt, Pseudomonas aeruginosa PA01
ccgccuuccagcuugcg

SEQ ID NO: 3423981 - RNA, 14 nt, Pseudomonas aeruginosa PA01
ccgccuuccucggc

SEQ ID NO: 3423982 - RNA, 21 nt, Pseudomonas aeruginosa PA01
ccgccuuccucggccgccagg

SEQ ID NO: 3423983 - RNA, 22 nt, Pseudomonas aeruginosa PA01
ccgccuuccucggccgccaggc

SEQ ID NO: 3423984 - RNA, 20 nt, Pseudomonas aeruginosa PA01
ccgccuucgcgggccaggcc

SEQ ID NO: 3423985 - RNA, 23 nt, Pseudomonas aeruginosa PA01
ccgccuucgcgggccaggccgag

SEQ ID NO: 3423986 - RNA, 23 nt, Pseudomonas aeruginosa PA01
ccgccuucgcguucgcuccgggc

SEQ ID NO: 3423987 - RNA, 18 nt, Pseudomonas aeruginosa PA01
ccgccuucuuuucuuccg

SEQ ID NO: 3423988 - RNA, 21 nt, Pseudomonas aeruginosa PA01
ccgccuucuuuucuuccgccu

SEQ ID NO: 3423989 - RNA, 21 nt, Pseudomonas aeruginosa PA01
ccgccuugaccugcugggcca

SEQ ID NO: 3423990 - RNA, 16 nt, Pseudomonas aeruginosa PA01
ccgccuugagcggcgc

SEQ ID NO: 3423991 - RNA, 18 nt, Pseudomonas aeruginosa PA01
ccgccuugcguaccagcg

SEQ ID NO: 3423992 - RNA, 19 nt, Pseudomonas aeruginosa PA01
ccgccuugcguaccagcgc

SEQ ID NO: 3423993 - RNA, 18 nt, Pseudomonas aeruginosa PA01
ccgccuugcucgacccgg

SEQ ID NO: 3423994 - RNA, 21 nt, Pseudomonas aeruginosa PA01
ccgccuuggcaucgccgccca

SEQ ID NO: 3423995 - RNA, 18 nt, Pseudomonas aeruginosa PA01
ccgccuuucugcccggcu

SEQ ID NO: 3423996 - RNA, 21 nt, Pseudomonas aeruginosa PA01
ccgccuuucugcccggcuucg

SEQ ID NO: 3423997 - RNA, 19 nt, Pseudomonas aeruginosa PA01
ccgccuuuuuugugcccgg

SEQ ID NO: 3423998 - RNA, 16 nt, Pseudomonas aeruginosa PA01
ccgcgaaauggcagaa

SEQ ID NO: 3423999 - RNA, 20 nt, Pseudomonas aeruginosa PA01
ccgcgaacacacccugcgca

SEQ ID NO: 3424000 - RNA, 22 nt, Pseudomonas aeruginosa PA01
ccgcgaacacacccugcgcaag

SEQ ID NO: 3424001 - RNA, 14 nt, Pseudomonas aeruginosa PA01
ccgcgaaccgcugg

SEQ ID NO: 3424002 - RNA, 19 nt, Pseudomonas aeruginosa PA01
ccgcgaagcccagcgccgc

SEQ ID NO: 3424003 - RNA, 13 nt, Pseudomonas aeruginosa PA01
ccgcgaagccugc

SEQ ID NO: 3424004 - RNA, 20 nt, Pseudomonas aeruginosa PA01
ccgcgaagcgguuagccggc

SEQ ID NO: 3424005 - RNA, 21 nt, Pseudomonas aeruginosa PA01
ccgcgaagcgguuagccggcg

SEQ ID NO: 3424006 - RNA, 22 nt, Pseudomonas aeruginosa PA01
ccgcgaagcgguuagccggcga

SEQ ID NO: 3424007 - RNA, 20 nt, Pseudomonas aeruginosa PA01
ccgcgaauagggcggcgcca

SEQ ID NO: 3424008 - RNA, 12 nt, Pseudomonas aeruginosa PA01
ccgcgaaugcuc

SEQ ID NO: 3424009 - RNA, 16 nt, Pseudomonas aeruginosa PA01
ccgcgaaugcuccggg

SEQ ID NO: 3424010 - RNA, 18 nt, Pseudomonas aeruginosa PA01
ccgcgaauggcagcaggc

SEQ ID NO: 3424011 - RNA, 21 nt, Pseudomonas aeruginosa PA01
ccgcgaauggcagcaggcaca

SEQ ID NO: 3424012 - RNA, 14 nt, Pseudomonas aeruginosa PA01
ccgcgacaacccug

SEQ ID NO: 3424013 - RNA, 16 nt, Pseudomonas aeruginosa PA01
ccgcgacaacccuguc

SEQ ID NO: 3424014 - RNA, 14 nt, Pseudomonas aeruginosa PA01
ccgcgacaggaugg

SEQ ID NO: 3424015 - RNA, 17 nt, Pseudomonas aeruginosa PA01
ccgcgacaggauggaca

SEQ ID NO: 3424016 - RNA, 19 nt, Pseudomonas aeruginosa PA01
ccgcgacaggauggacagc

SEQ ID NO: 3424017 - RNA, 17 nt, Pseudomonas aeruginosa PA01
ccgcgaccacaggcggc

SEQ ID NO: 3424018 - RNA, 19 nt, Pseudomonas aeruginosa PA01
ccgcgaccacaggcggcgg

SEQ ID NO: 3424019 - RNA, 13 nt, Pseudomonas aeruginosa PA01
ccgcgaccgggca

SEQ ID NO: 3424020 - RNA, 17 nt, Pseudomonas aeruginosa PA01
ccgcgaccugcucgucg

SEQ ID NO: 3424021 - RNA, 14 nt, Pseudomonas aeruginosa PA01
ccgcgacgacugcg

SEQ ID NO: 3424022 - RNA, 19 nt, Pseudomonas aeruginosa PA01
ccgcgacgacugcggcagc

SEQ ID NO: 3424023 - RNA, 13 nt, Pseudomonas aeruginosa PA01
ccgcgacgcucca

SEQ ID NO: 3424024 - RNA, 12 nt, Pseudomonas aeruginosa PA01
ccgcgacggcug

SEQ ID NO: 3424025 - RNA, 14 nt, Pseudomonas aeruginosa PA01
ccgcgacggcugcu

SEQ ID NO: 3424026 - RNA, 17 nt, Pseudomonas aeruginosa PA01
ccgcgacguugcaauug

SEQ ID NO: 3424027 - RNA, 16 nt, Pseudomonas aeruginosa PA01
ccgcgacucggcugca

SEQ ID NO: 3424028 - RNA, 19 nt, Pseudomonas aeruginosa PA01
ccgcgagaccccggcggcg

SEQ ID NO: 3424029 - RNA, 20 nt, Pseudomonas aeruginosa PA01
ccgcgagaccccggcggcgc

SEQ ID NO: 3424030 - RNA, 20 nt, Pseudomonas aeruginosa PA01
ccgcgagagguucaccgacc

SEQ ID NO: 3424031 - RNA, 21 nt, Pseudomonas aeruginosa PA01
ccgcgagagguucaccgacca

SEQ ID NO: 3424032 - RNA, 19 nt, Pseudomonas aeruginosa PA01
ccgcgagcaccaugcagcg

SEQ ID NO: 3424033 - RNA, 16 nt, Pseudomonas aeruginosa PA01
ccgcgagcagccgacg

SEQ ID NO: 3424034 - RNA, 12 nt, Pseudomonas aeruginosa PA01
ccgcgagccagc

SEQ ID NO: 3424035 - RNA, 14 nt, Pseudomonas aeruginosa PA01
ccgcgagccgcgca

SEQ ID NO: 3424036 - RNA, 18 nt, Pseudomonas aeruginosa PA01
ccgcgagccguccugcgg

SEQ ID NO: 3424037 - RNA, 22 nt, Pseudomonas aeruginosa PA01
ccgcgagccguccugcggccgc

SEQ ID NO: 3424038 - RNA, 19 nt, Pseudomonas aeruginosa PA01
ccgcgagccuucagcacgg

SEQ ID NO: 3424039 - RNA, 20 nt, Pseudomonas aeruginosa PA01
ccgcgagccuucagcacggc

SEQ ID NO: 3424040 - RNA, 21 nt, Pseudomonas aeruginosa PA01
ccgcgagccuucagcacggcg

SEQ ID NO: 3424041 - RNA, 22 nt, Pseudomonas aeruginosa PA01
ccgcgagccuucagcacggcgc

SEQ ID NO: 3424042 - RNA, 20 nt, Pseudomonas aeruginosa PA01
ccgcgagcgaaacggcgcug

SEQ ID NO: 3424043 - RNA, 12 nt, Pseudomonas aeruginosa PA01
ccgcgagcgccg

SEQ ID NO: 3424044 - RNA, 16 nt, Pseudomonas aeruginosa PA01
ccgcgagcgccgccgg

SEQ ID NO: 3424045 - RNA, 17 nt, Pseudomonas aeruginosa PA01
ccgcgagcgccgccuug

SEQ ID NO: 3424046 - RNA, 23 nt, Pseudomonas aeruginosa PA01
ccgcgagcgccgccuugagcggc

SEQ ID NO: 3424047 - RNA, 14 nt, Pseudomonas aeruginosa PA01
ccgcgagcgcggcc

SEQ ID NO: 3424048 - RNA, 16 nt, Pseudomonas aeruginosa PA01
ccgcgagcgcggccgg

SEQ ID NO: 3424049 - RNA, 21 nt, Pseudomonas aeruginosa PA01
ccgcgagcgcggccggccacg

SEQ ID NO: 3424050 - RNA, 16 nt, Pseudomonas aeruginosa PA01
ccgcgagcuuggcccu

SEQ ID NO: 3424051 - RNA, 18 nt, Pseudomonas aeruginosa PA01
ccgcgagcuuggcccugg

SEQ ID NO: 3424052 - RNA, 14 nt, Pseudomonas aeruginosa PA01
ccgcgaggaucagc

SEQ ID NO: 3424053 - RNA, 15 nt, Pseudomonas aeruginosa PA01
ccgcgaggaucagcc

SEQ ID NO: 3424054 - RNA, 18 nt, Pseudomonas aeruginosa PA01
ccgcgaggaucagccacg

SEQ ID NO: 3424055 - RNA, 12 nt, Pseudomonas aeruginosa PA01
ccgcgaggccgg

SEQ ID NO: 3424056 - RNA, 16 nt, Pseudomonas aeruginosa PA01
ccgcgagguccggcuc

SEQ ID NO: 3424057 - RNA, 20 nt, Pseudomonas aeruginosa PA01
ccgcgagguccggcuccggc

SEQ ID NO: 3424058 - RNA, 22 nt, Pseudomonas aeruginosa PA01
ccgcgagguggaugaacagcgg

SEQ ID NO: 3424059 - RNA, 14 nt, Pseudomonas aeruginosa PA01
ccgcgaguucgccg

SEQ ID NO: 3424060 - RNA, 16 nt, Pseudomonas aeruginosa PA01
ccgcgaguucgccggc

SEQ ID NO: 3424061 - RNA, 20 nt, Pseudomonas aeruginosa PA01
ccgcgaguucgccggccagg

SEQ ID NO: 3424062 - RNA, 21 nt, Pseudomonas aeruginosa PA01
ccgcgaguucgccggccaggu

SEQ ID NO: 3424063 - RNA, 17 nt, Pseudomonas aeruginosa PA01
ccgcgauagcucagucg

SEQ ID NO: 3424064 - RNA, 23 nt, Pseudomonas aeruginosa PA01
ccgcgauauucgcccuacgaaag

SEQ ID NO: 3424065 - RNA, 21 nt, Pseudomonas aeruginosa PA01
ccgcgaugcguuccagggcga

SEQ ID NO: 3424066 - RNA, 22 nt, Pseudomonas aeruginosa PA01
ccgcgaugcguuccagggcgaa

SEQ ID NO: 3424067 - RNA, 17 nt, Pseudomonas aeruginosa PA01
ccgcgauggcucgcggc

SEQ ID NO: 3424068 - RNA, 19 nt, Pseudomonas aeruginosa PA01
ccgcgauggcucgcggcgc

SEQ ID NO: 3424069 - RNA, 20 nt, Pseudomonas aeruginosa PA01
ccgcgauggcucgcggcgcu

SEQ ID NO: 3424070 - RNA, 24 nt, Pseudomonas aeruginosa PA01
ccgcgaugguauggcggucggcca

SEQ ID NO: 3424071 - RNA, 17 nt, Pseudomonas aeruginosa PA01
ccgcgauguccccggcc

SEQ ID NO: 3424072 - RNA, 19 nt, Pseudomonas aeruginosa PA01
ccgcgauguccccggccag

SEQ ID NO: 3424073 - RNA, 13 nt, Pseudomonas aeruginosa PA01
ccgcgauucgccg

SEQ ID NO: 3424074 - RNA, 14 nt, Pseudomonas aeruginosa PA01
ccgcgauucgccgg

SEQ ID NO: 3424075 - RNA, 15 nt, Pseudomonas aeruginosa PA01
ccgcgauucgccggg

SEQ ID NO: 3424076 - RNA, 21 nt, Pseudomonas aeruginosa PA01
ccgcgauugcagcuccugguc

SEQ ID NO: 3424077 - RNA, 14 nt, Pseudomonas aeruginosa PA01
ccgcgcaaaccggc

SEQ ID NO: 3424078 - RNA, 17 nt, Pseudomonas aeruginosa PA01
ccgcgcaaaccggcagc

SEQ ID NO: 3424079 - RNA, 17 nt, Pseudomonas aeruginosa PA01
ccgcgcaaccguuccag

SEQ ID NO: 3424080 - RNA, 15 nt, Pseudomonas aeruginosa PA01
ccgcgccgcggcggc

SEQ ID NO: 3424081 - RNA, 11 nt, Pseudomonas aeruginosa PA01
ccgcgccgcgu

SEQ ID NO: 3424082 - RNA, 13 nt, Pseudomonas aeruginosa PA01
ccgcgccggcagc

SEQ ID NO: 3424083 - RNA, 18 nt, Pseudomonas aeruginosa PA01
ccgcgccggcagcucggc

SEQ ID NO: 3424084 - RNA, 14 nt, Pseudomonas aeruginosa PA01
ccgcgccgggcugg

SEQ ID NO: 3424085 - RNA, 16 nt, Pseudomonas aeruginosa PA01
ccgcgccgggcuggcc

SEQ ID NO: 3424086 - RNA, 17 nt, Pseudomonas aeruginosa PA01
ccgcgccgggcuggccg

SEQ ID NO: 3424087 - RNA, 15 nt, Pseudomonas aeruginosa PA01
ccgcgccggggcagc

SEQ ID NO: 3424088 - RNA, 21 nt, Pseudomonas aeruginosa PA01
ccgcgccgguaaugacgaucu

SEQ ID NO: 3424089 - RNA, 15 nt, Pseudomonas aeruginosa PA01
ccgcgccgguggcca

SEQ ID NO: 3424090 - RNA, 17 nt, Pseudomonas aeruginosa PA01
ccgcgccgguggccagg

SEQ ID NO: 3424091 - RNA, 11 nt, Pseudomonas aeruginosa PA01
ccgcgccucca

SEQ ID NO: 3424092 - RNA, 13 nt, Pseudomonas aeruginosa PA01
ccgcgccuccagg

SEQ ID NO: 3424093 - RNA, 16 nt, Pseudomonas aeruginosa PA01
ccgcgccuccaggcgc

SEQ ID NO: 3424094 - RNA, 19 nt, Pseudomonas aeruginosa PA01
ccgcgccuccaggcgcgcc

SEQ ID NO: 3424095 - RNA, 20 nt, Pseudomonas aeruginosa PA01
ccgcgccuccaggcgcgccu

SEQ ID NO: 3424096 - RNA, 22 nt, Pseudomonas aeruginosa PA01
ccgcgccuccaggcgcgccugg

SEQ ID NO: 3424097 - RNA, 12 nt, Pseudomonas aeruginosa PA01
ccgcgccucgcg

SEQ ID NO: 3424098 - RNA, 14 nt, Pseudomonas aeruginosa PA01
ccgcgccucgcgca

SEQ ID NO: 3424099 - RNA, 22 nt, Pseudomonas aeruginosa PA01
ccgcgccucgcgcaacgccgac

SEQ ID NO: 3424100 - RNA, 15 nt, Pseudomonas aeruginosa PA01
ccgcgccucgcuagu

SEQ ID NO: 3424101 - RNA, 15 nt, Pseudomonas aeruginosa PA01
ccgcgccucgucgcg

SEQ ID NO: 3424102 - RNA, 20 nt, Pseudomonas aeruginosa PA01
ccgcgccucgucgcgccagg

SEQ ID NO: 3424103 - RNA, 23 nt, Pseudomonas aeruginosa PA01
ccgcgccugcaggucgaggcgcu

SEQ ID NO: 3424104 - RNA, 20 nt, Pseudomonas aeruginosa PA01
ccgcgccugcugcgggucgc

SEQ ID NO: 3424105 - RNA, 14 nt, Pseudomonas aeruginosa PA01
ccgcgccugggccg

SEQ ID NO: 3424106 - RNA, 18 nt, Pseudomonas aeruginosa PA01
ccgcgccuucagcgccag

SEQ ID NO: 3424107 - RNA, 23 nt, Pseudomonas aeruginosa PA01
ccgcgccuucagcgccagcaggc

SEQ ID NO: 3424108 - RNA, 14 nt, Pseudomonas aeruginosa PA01
ccgcgccuucaguu

SEQ ID NO: 3424109 - RNA, 13 nt, Pseudomonas aeruginosa PA01
ccgcgccuuccag

SEQ ID NO: 3424110 - RNA, 16 nt, Pseudomonas aeruginosa PA01
ccgcgccuuccagccc

SEQ ID NO: 3424111 - RNA, 14 nt, Pseudomonas aeruginosa PA01
ccgcgccuucgagc

SEQ ID NO: 3424112 - RNA, 18 nt, Pseudomonas aeruginosa PA01
ccgcgccuugcucagguc

SEQ ID NO: 3424113 - RNA, 23 nt, Pseudomonas aeruginosa PA01
ccgcgccuugcucaggucgucga

SEQ ID NO: 3424114 - RNA, 15 nt, Pseudomonas aeruginosa PA01
ccgcgcgaccgcggc

SEQ ID NO: 3424115 - RNA, 16 nt, Pseudomonas aeruginosa PA01
ccgcgcgaccgcggcg

SEQ ID NO: 3424116 - RNA, 19 nt, Pseudomonas aeruginosa PA01
ccgcgcgaccgcggcgcuc

SEQ ID NO: 3424117 - RNA, 23 nt, Pseudomonas aeruginosa PA01
ccgcgcgacggaacaagccgccu

SEQ ID NO: 3424118 - RNA, 13 nt, Pseudomonas aeruginosa PA01
ccgcgcgaucgag

SEQ ID NO: 3424119 - RNA, 22 nt, Pseudomonas aeruginosa PA01
ccgcgcgaucgaggccuacccg

SEQ ID NO: 3424120 - RNA, 20 nt, Pseudomonas aeruginosa PA01
ccgcgcgauggccggcggag

SEQ ID NO: 3424121 - RNA, 21 nt, Pseudomonas aeruginosa PA01
ccgcgcgauggccggcggaga

SEQ ID NO: 3424122 - RNA, 18 nt, Pseudomonas aeruginosa PA01
ccgcgcgcauggucgcgc

SEQ ID NO: 3424123 - RNA, 16 nt, Pseudomonas aeruginosa PA01
ccgcgcgccagcaacg

SEQ ID NO: 3424124 - RNA, 13 nt, Pseudomonas aeruginosa PA01
ccgcgcgccgagc

SEQ ID NO: 3424125 - RNA, 19 nt, Pseudomonas aeruginosa PA01
ccgcgcgccgagcccccgg

SEQ ID NO: 3424126 - RNA, 20 nt, Pseudomonas aeruginosa PA01
ccgcgcgccgagcccccggc

SEQ ID NO: 3424127 - RNA, 15 nt, Pseudomonas aeruginosa PA01
ccgcgcgccugcaac

SEQ ID NO: 3424128 - RNA, 17 nt, Pseudomonas aeruginosa PA01
ccgcgcgccuggcuggc

SEQ ID NO: 3424129 - RNA, 18 nt, Pseudomonas aeruginosa PA01
ccgcgcgccuggcuggcc

SEQ ID NO: 3424130 - RNA, 19 nt, Pseudomonas aeruginosa PA01
ccgcgcgccuggcuggcca

SEQ ID NO: 3424131 - RNA, 13 nt, Pseudomonas aeruginosa PA01
ccgcgcgcgcaag

SEQ ID NO: 3424132 - RNA, 20 nt, Pseudomonas aeruginosa PA01
ccgcgcgcgcaaggccgaag

SEQ ID NO: 3424133 - RNA, 23 nt, Pseudomonas aeruginosa PA01
ccgcgcgcgcaaggccgaagagg

SEQ ID NO: 3424134 - RNA, 13 nt, Pseudomonas aeruginosa PA01
ccgcgcgcgccug

SEQ ID NO: 3424135 - RNA, 15 nt, Pseudomonas aeruginosa PA01
ccgcgcgcgccugca

SEQ ID NO: 3424136 - RNA, 22 nt, Pseudomonas aeruginosa PA01
ccgcgcgcgcggucgagcagcg

SEQ ID NO: 3424137 - RNA, 11 nt, Pseudomonas aeruginosa PA01
ccgcgcgcugg

SEQ ID NO: 3424138 - RNA, 23 nt, Pseudomonas aeruginosa PA01
ccgcgcgcuggauuucgccgagu

SEQ ID NO: 3424139 - RNA, 14 nt, Pseudomonas aeruginosa PA01
ccgcgcgcugugca

SEQ ID NO: 3424140 - RNA, 17 nt, Pseudomonas aeruginosa PA01
ccgcgcgcugugcacgg

SEQ ID NO: 3424141 - RNA, 18 nt, Pseudomonas aeruginosa PA01
ccgcgcgcuuguggcgaa

SEQ ID NO: 3424142 - RNA, 17 nt, Pseudomonas aeruginosa PA01
ccgcgcgcuuuuccggc

SEQ ID NO: 3424143 - RNA, 21 nt, Pseudomonas aeruginosa PA01
ccgcgcgcuuuuccggcgccg

SEQ ID NO: 3424144 - RNA, 20 nt, Pseudomonas aeruginosa PA01
ccgcgcggauccccucccgc

SEQ ID NO: 3424145 - RNA, 20 nt, Pseudomonas aeruginosa PA01
ccgcgcggcacagcguggcc

SEQ ID NO: 3424146 - RNA, 19 nt, Pseudomonas aeruginosa PA01
ccgcgcggcauagcgcagc

SEQ ID NO: 3424147 - RNA, 12 nt, Pseudomonas aeruginosa PA01
ccgcgcggcccu

SEQ ID NO: 3424148 - RNA, 15 nt, Pseudomonas aeruginosa PA01
ccgcgcggcgccccg

SEQ ID NO: 3424149 - RNA, 18 nt, Pseudomonas aeruginosa PA01
ccgcgcggcgcccugccg

SEQ ID NO: 3424150 - RNA, 23 nt, Pseudomonas aeruginosa PA01
ccgcgcggcgcccugccgggcuc

SEQ ID NO: 3424151 - RNA, 16 nt, Pseudomonas aeruginosa PA01
ccgcgcggcuugccgg

SEQ ID NO: 3424152 - RNA, 21 nt, Pseudomonas aeruginosa PA01
ccgcgcggcuugccggcgcgc

SEQ ID NO: 3424153 - RNA, 23 nt, Pseudomonas aeruginosa PA01
ccgcgcggcuugccggcgcgcgg

SEQ ID NO: 3424154 - RNA, 23 nt, Pseudomonas aeruginosa PA01
ccgcgcgggccggcgauggccca

SEQ ID NO: 3424155 - RNA, 22 nt, Pseudomonas aeruginosa PA01
ccgcgcguaggcuuggucgggc

SEQ ID NO: 3424156 - RNA, 15 nt, Pseudomonas aeruginosa PA01
ccgcgcguucagcca

SEQ ID NO: 3424157 - RNA, 21 nt, Pseudomonas aeruginosa PA01
ccgcgcguucgcgcgaggcgc

SEQ ID NO: 3424158 - RNA, 14 nt, Pseudomonas aeruginosa PA01
ccgcgcuccaguuc

SEQ ID NO: 3424159 - RNA, 14 nt, Pseudomonas aeruginosa PA01
ccgcgcuccgcugg

SEQ ID NO: 3424160 - RNA, 14 nt, Pseudomonas aeruginosa PA01
ccgcgcucgcgcau

SEQ ID NO: 3424161 - RNA, 14 nt, Pseudomonas aeruginosa PA01
ccgcgcucgcggaa

SEQ ID NO: 3424162 - RNA, 13 nt, Pseudomonas aeruginosa PA01
ccgcgcucggauc

SEQ ID NO: 3424163 - RNA, 17 nt, Pseudomonas aeruginosa PA01
ccgcgcucggaucaggc

SEQ ID NO: 3424164 - RNA, 19 nt, Pseudomonas aeruginosa PA01
ccgcgcucggaucaggcgg

SEQ ID NO: 3424165 - RNA, 17 nt, Pseudomonas aeruginosa PA01
ccgcgcucggccgccug

SEQ ID NO: 3424166 - RNA, 13 nt, Pseudomonas aeruginosa PA01
ccgcgcucggcgg

SEQ ID NO: 3424167 - RNA, 15 nt, Pseudomonas aeruginosa PA01
ccgcgcugaccuggu

SEQ ID NO: 3424168 - RNA, 19 nt, Pseudomonas aeruginosa PA01
ccgcgcugcaggcgguagc

SEQ ID NO: 3424169 - RNA, 17 nt, Pseudomonas aeruginosa PA01
ccgcgcugcgccaggcc

SEQ ID NO: 3424170 - RNA, 22 nt, Pseudomonas aeruginosa PA01
ccgcgcugcguggguagccgcc

SEQ ID NO: 3424171 - RNA, 12 nt, Pseudomonas aeruginosa PA01
ccgcgcugcugg

SEQ ID NO: 3424172 - RNA, 19 nt, Pseudomonas aeruginosa PA01
ccgcgcugucggccucgac

SEQ ID NO: 3424173 - RNA, 23 nt, Pseudomonas aeruginosa PA01
ccgcgcuucuucgacuaccuggg

SEQ ID NO: 3424174 - RNA, 17 nt, Pseudomonas aeruginosa PA01
ccgcgcuugacgacugc

SEQ ID NO: 3424175 - RNA, 24 nt, Pseudomonas aeruginosa PA01
ccgcgcuugacgacugcacgcaga

SEQ ID NO: 3424176 - RNA, 21 nt, Pseudomonas aeruginosa PA01
ccgcgcuugccgucgcggaag

SEQ ID NO: 3424177 - RNA, 22 nt, Pseudomonas aeruginosa PA01
ccgcgcuugccgucgcggaagc

SEQ ID NO: 3424178 - RNA, 23 nt, Pseudomonas aeruginosa PA01
ccgcgcuugccgucgcggaagcc

SEQ ID NO: 3424179 - RNA, 17 nt, Pseudomonas aeruginosa PA01
ccgcgcuuggccuugcc

SEQ ID NO: 3424180 - RNA, 18 nt, Pseudomonas aeruginosa PA01
ccgcgcuuggccuugccg

SEQ ID NO: 3424181 - RNA, 19 nt, Pseudomonas aeruginosa PA01
ccgcgcuuggccuugccgu

SEQ ID NO: 3424182 - RNA, 20 nt, Pseudomonas aeruginosa PA01
ccgcggugggcuccagcggg

SEQ ID NO: 3424183 - RNA, 17 nt, Pseudomonas aeruginosa PA01
ccgcggugucggcgauu

SEQ ID NO: 3424184 - RNA, 15 nt, Pseudomonas aeruginosa PA01
ccgcggugucggugc

SEQ ID NO: 3424185 - RNA, 22 nt, Pseudomonas aeruginosa PA01
ccgcggugucggugcccucgcg

SEQ ID NO: 3424186 - RNA, 18 nt, Pseudomonas aeruginosa PA01
ccgcgguuggcgccucgc

SEQ ID NO: 3424187 - RNA, 18 nt, Pseudomonas aeruginosa PA01
ccgcgguuuccgugcgga

SEQ ID NO: 3424188 - RNA, 11 nt, Pseudomonas aeruginosa PA01
ccgcguaagcg

SEQ ID NO: 3424189 - RNA, 15 nt, Pseudomonas aeruginosa PA01
ccgcguaagcggccu

SEQ ID NO: 3424190 - RNA, 16 nt, Pseudomonas aeruginosa PA01
ccgcguaccaguagcg

SEQ ID NO: 3424191 - RNA, 23 nt, Pseudomonas aeruginosa PA01
ccgcguacggucuugcgcuugcc

SEQ ID NO: 3424192 - RNA, 16 nt, Pseudomonas aeruginosa PA01
ccgcguagcgccaggc

SEQ ID NO: 3424193 - RNA, 15 nt, Pseudomonas aeruginosa PA01
ccgcguagggcgaag

SEQ ID NO: 3424194 - RNA, 15 nt, Pseudomonas aeruginosa PA01
ccgcgucacggaccc

SEQ ID NO: 3424195 - RNA, 16 nt, Pseudomonas aeruginosa PA01
ccgcgucacggacccg

SEQ ID NO: 3424196 - RNA, 22 nt, Pseudomonas aeruginosa PA01
ccgcgucacggacccgcucggc

SEQ ID NO: 3424197 - RNA, 14 nt, Pseudomonas aeruginosa PA01
ccgcguccgagagc

SEQ ID NO: 3424198 - RNA, 19 nt, Pseudomonas aeruginosa PA01
ccgcguccgagagcagggc

SEQ ID NO: 3424199 - RNA, 21 nt, Pseudomonas aeruginosa PA01
ccgcguccgagagcagggccu

SEQ ID NO: 3424200 - RNA, 23 nt, Pseudomonas aeruginosa PA01
ccgcguccuccuggaggacgcgg

SEQ ID NO: 3424201 - RNA, 12 nt, Pseudomonas aeruginosa PA01
ccgcgucgaagc

SEQ ID NO: 3424202 - RNA, 22 nt, Pseudomonas aeruginosa PA01
ccgcgucgaagcugucggcccg

SEQ ID NO: 3424203 - RNA, 17 nt, Pseudomonas aeruginosa PA01
ccgcgucgccgccagcg

SEQ ID NO: 3424204 - RNA, 20 nt, Pseudomonas aeruginosa PA01
ccgcgucgccgccagcgccg

SEQ ID NO: 3424205 - RNA, 15 nt, Pseudomonas aeruginosa PA01
ccgcgucgccuucgg

SEQ ID NO: 3424206 - RNA, 13 nt, Pseudomonas aeruginosa PA01
ccgcgucgcgcgc

SEQ ID NO: 3424207 - RNA, 18 nt, Pseudomonas aeruginosa PA01
ccgcgucgcgcgcggcau

SEQ ID NO: 3424208 - RNA, 22 nt, Pseudomonas aeruginosa PA01
ccgcgucgcgcgcggcauccag

SEQ ID NO: 3424209 - RNA, 20 nt, Pseudomonas aeruginosa PA01
ccgcgucgggaaaggccgcc

SEQ ID NO: 3424210 - RNA, 14 nt, Pseudomonas aeruginosa PA01
ccgcgugccgccgg

SEQ ID NO: 3424211 - RNA, 14 nt, Pseudomonas aeruginosa PA01
ccgcgugcgcgccc

SEQ ID NO: 3424212 - RNA, 18 nt, Pseudomonas aeruginosa PA01
ccgcgugcgcgccgccgg

SEQ ID NO: 3424213 - RNA, 19 nt, Pseudomonas aeruginosa PA01
ccgcgugcgcgccgccggg

SEQ ID NO: 3424214 - RNA, 13 nt, Pseudomonas aeruginosa PA01
ccgcguggcgugc

SEQ ID NO: 3424215 - RNA, 18 nt, Pseudomonas aeruginosa PA01
ccgcguggcgugcucggc

SEQ ID NO: 3424216 - RNA, 20 nt, Pseudomonas aeruginosa PA01
ccgcguggcgugcucggcga

SEQ ID NO: 3424217 - RNA, 15 nt, Pseudomonas aeruginosa PA01
ccgcgugggccggca

SEQ ID NO: 3424218 - RNA, 17 nt, Pseudomonas aeruginosa PA01
ccgcgugggcuucgccg

SEQ ID NO: 3424219 - RNA, 20 nt, Pseudomonas aeruginosa PA01
ccgcgugggcuucgccgccg

SEQ ID NO: 3424220 - RNA, 23 nt, Pseudomonas aeruginosa PA01
ccgcguggugagcacgaacaggg

SEQ ID NO: 3424221 - RNA, 19 nt, Pseudomonas aeruginosa PA01
ccgcguucaccguggcgcu

SEQ ID NO: 3424222 - RNA, 23 nt, Pseudomonas aeruginosa PA01
ccgcguucaccguggcgcuggcc

SEQ ID NO: 3424223 - RNA, 20 nt, Pseudomonas aeruginosa PA01
ccgcguucagucccgcggcg

SEQ ID NO: 3424224 - RNA, 21 nt, Pseudomonas aeruginosa PA01
ccgcguucagucccgcggcgc

SEQ ID NO: 3424225 - RNA, 19 nt, Pseudomonas aeruginosa PA01
ccgcguucgccgagcugau

SEQ ID NO: 3424226 - RNA, 20 nt, Pseudomonas aeruginosa PA01
ccgcguucgccgaggcggcg

SEQ ID NO: 3424227 - RNA, 21 nt, Pseudomonas aeruginosa PA01
ccgcguucgccgaggcggcgc

SEQ ID NO: 3424228 - RNA, 14 nt, Pseudomonas aeruginosa PA01
ccgcguucgcgggg

SEQ ID NO: 3424229 - RNA, 11 nt, Pseudomonas aeruginosa PA01
ccgcguugcgg

SEQ ID NO: 3424230 - RNA, 12 nt, Pseudomonas aeruginosa PA01
ccgcguugcggu

SEQ ID NO: 3424231 - RNA, 20 nt, Pseudomonas aeruginosa PA01
ccgcguugcgguuauucgcc

SEQ ID NO: 3424232 - RNA, 23 nt, Pseudomonas aeruginosa PA01
ccgcguugucccugucccgccgc

SEQ ID NO: 3424233 - RNA, 19 nt, Pseudomonas aeruginosa PA01
ccgcuaagcgucacuccca

SEQ ID NO: 3424234 - RNA, 20 nt, Pseudomonas aeruginosa PA01
ccgcuaagcgucacucccag

SEQ ID NO: 3424235 - RNA, 22 nt, Pseudomonas aeruginosa PA01
ccgcuacccagguggucgacca

SEQ ID NO: 3424236 - RNA, 12 nt, Pseudomonas aeruginosa PA01
ccgcuacccugc

SEQ ID NO: 3424237 - RNA, 13 nt, Pseudomonas aeruginosa PA01
ccgcuacccugcc

SEQ ID NO: 3424238 - RNA, 18 nt, Pseudomonas aeruginosa PA01
ccgcuacugcgcgggcau

SEQ ID NO: 3424239 - RNA, 13 nt, Pseudomonas aeruginosa PA01
ccgcuagcccugc

SEQ ID NO: 3424240 - RNA, 22 nt, Pseudomonas aeruginosa PA01
ccgcuagcgguagccgucaagc

SEQ ID NO: 3424241 - RNA, 16 nt, Pseudomonas aeruginosa PA01
ccgcuaucgccgccgc

SEQ ID NO: 3424242 - RNA, 17 nt, Pseudomonas aeruginosa PA01
ccgcuaucgcuggcgca

SEQ ID NO: 3424243 - RNA, 20 nt, Pseudomonas aeruginosa PA01
ccgcuaucgcuggcgcagcc

SEQ ID NO: 3424244 - RNA, 21 nt, Pseudomonas aeruginosa PA01
ccgcuaucgcuggcgcagccg

SEQ ID NO: 3424245 - RNA, 14 nt, Pseudomonas aeruginosa PA01
ccgcuauggcgggg

SEQ ID NO: 3424246 - RNA, 23 nt, Pseudomonas aeruginosa PA01
ccgcuaugggcaccgcgccggcg

SEQ ID NO: 3424247 - RNA, 15 nt, Pseudomonas aeruginosa PA01
ccgcucaaccgaaca

SEQ ID NO: 3424248 - RNA, 17 nt, Pseudomonas aeruginosa PA01
ccgcucaaccgaacagg

SEQ ID NO: 3424249 - RNA, 21 nt, Pseudomonas aeruginosa PA01
ccgcucaagacggcccgcaga

SEQ ID NO: 3424250 - RNA, 23 nt, Pseudomonas aeruginosa PA01
ccgcucaagacggcccgcagauc

SEQ ID NO: 3424251 - RNA, 14 nt, Pseudomonas aeruginosa PA01
ccgcucaccaggcc

SEQ ID NO: 3424252 - RNA, 16 nt, Pseudomonas aeruginosa PA01
ccgcucaccaggcccg

SEQ ID NO: 3424253 - RNA, 18 nt, Pseudomonas aeruginosa PA01
ccgcucaccaggcccgcc

SEQ ID NO: 3424254 - RNA, 18 nt, Pseudomonas aeruginosa PA01
ccgcucaccgccaccccg

SEQ ID NO: 3424255 - RNA, 19 nt, Pseudomonas aeruginosa PA01
ccgcucaccgccaccccgc

SEQ ID NO: 3424256 - RNA, 20 nt, Pseudomonas aeruginosa PA01
ccgcucaccgccaccccgcc

SEQ ID NO: 3424257 - RNA, 16 nt, Pseudomonas aeruginosa PA01
ccgcucaggaugcgau

SEQ ID NO: 3424258 - RNA, 14 nt, Pseudomonas aeruginosa PA01
ccgcucaggcgucc

SEQ ID NO: 3424259 - RNA, 21 nt, Pseudomonas aeruginosa PA01
ccgcucaggcgucccgcucca

SEQ ID NO: 3424260 - RNA, 16 nt, Pseudomonas aeruginosa PA01
ccgcucaggcugugca

SEQ ID NO: 3424261 - RNA, 16 nt, Pseudomonas aeruginosa PA01
ccgcucaucugcacca

SEQ ID NO: 3424262 - RNA, 18 nt, Pseudomonas aeruginosa PA01
ccgcucaugagauccgcc

SEQ ID NO: 3424263 - RNA, 21 nt, Pseudomonas aeruginosa PA01
ccgcucaugagauccgccagc

SEQ ID NO: 3424264 - RNA, 13 nt, Pseudomonas aeruginosa PA01
ccgcuccagccgg

SEQ ID NO: 3424265 - RNA, 15 nt, Pseudomonas aeruginosa PA01
ccgcuccagccggca

SEQ ID NO: 3424266 - RNA, 17 nt, Pseudomonas aeruginosa PA01
ccgcuccagccggcaag

SEQ ID NO: 3424267 - RNA, 12 nt, Pseudomonas aeruginosa PA01
ccgcuccagcgc

SEQ ID NO: 3424268 - RNA, 14 nt, Pseudomonas aeruginosa PA01
ccgcuccagcgccu

SEQ ID NO: 3424269 - RNA, 19 nt, Pseudomonas aeruginosa PA01
ccgcuccagcgccucgacc

SEQ ID NO: 3424270 - RNA, 22 nt, Pseudomonas aeruginosa PA01
ccgcuccaggaucgccuccacc

SEQ ID NO: 3424271 - RNA, 11 nt, Pseudomonas aeruginosa PA01
ccgcuccaggc

SEQ ID NO: 3424272 - RNA, 19 nt, Pseudomonas aeruginosa PA01
ccgcuccgauggcgcugga

SEQ ID NO: 3424273 - RNA, 14 nt, Pseudomonas aeruginosa PA01
ccgcuccggcgccg

SEQ ID NO: 3424274 - RNA, 15 nt, Pseudomonas aeruginosa PA01
ccgcuccggcgccga

SEQ ID NO: 3424275 - RNA, 14 nt, Pseudomonas aeruginosa PA01
ccgcuccggcugcg

SEQ ID NO: 3424276 - RNA, 16 nt, Pseudomonas aeruginosa PA01
ccgcuccuccgggaag

SEQ ID NO: 3424277 - RNA, 16 nt, Pseudomonas aeruginosa PA01
ccgcuccucgucgagu

SEQ ID NO: 3424278 - RNA, 15 nt, Pseudomonas aeruginosa PA01
ccgcuccuggcaggc

SEQ ID NO: 3424279 - RNA, 16 nt, Pseudomonas aeruginosa PA01
ccgcuccuggcaggcu

SEQ ID NO: 3424280 - RNA, 15 nt, Pseudomonas aeruginosa PA01
ccgcucgagggcgac

SEQ ID NO: 3424281 - RNA, 17 nt, Pseudomonas aeruginosa PA01
ccgcucgagggcgaccg

SEQ ID NO: 3424282 - RNA, 21 nt, Pseudomonas aeruginosa PA01
ccgcucgagggcgaccgccag

SEQ ID NO: 3424283 - RNA, 18 nt, Pseudomonas aeruginosa PA01
ccgcucgaucccggcgcg

SEQ ID NO: 3424284 - RNA, 19 nt, Pseudomonas aeruginosa PA01
ccgcuggccuggccacccu

SEQ ID NO: 3424285 - RNA, 12 nt, Pseudomonas aeruginosa PA01
ccgcuggcgacg

SEQ ID NO: 3424286 - RNA, 13 nt, Pseudomonas aeruginosa PA01
ccgcuggcgacgc

SEQ ID NO: 3424287 - RNA, 16 nt, Pseudomonas aeruginosa PA01
ccgcuggcgacgcuuu

SEQ ID NO: 3424288 - RNA, 21 nt, Pseudomonas aeruginosa PA01
ccgcuggcgaggauuuccucg

SEQ ID NO: 3424289 - RNA, 19 nt, Pseudomonas aeruginosa PA01
ccgcuggcgaucucggcgc

SEQ ID NO: 3424290 - RNA, 20 nt, Pseudomonas aeruginosa PA01
ccgcuggcgaucucggcgcg

SEQ ID NO: 3424291 - RNA, 21 nt, Pseudomonas aeruginosa PA01
ccgcuggcggcgacgaagguc

SEQ ID NO: 3424292 - RNA, 14 nt, Pseudomonas aeruginosa PA01
ccgcugggacggcg

SEQ ID NO: 3424293 - RNA, 15 nt, Pseudomonas aeruginosa PA01
ccgcugggacggcgg

SEQ ID NO: 3424294 - RNA, 15 nt, Pseudomonas aeruginosa PA01
ccgcugggcagcacg

SEQ ID NO: 3424295 - RNA, 12 nt, Pseudomonas aeruginosa PA01
ccgcugggcagg

SEQ ID NO: 3424296 - RNA, 13 nt, Pseudomonas aeruginosa PA01
ccgcugggccacg

SEQ ID NO: 3424297 - RNA, 18 nt, Pseudomonas aeruginosa PA01
ccgcugggccacguucug

SEQ ID NO: 3424298 - RNA, 22 nt, Pseudomonas aeruginosa PA01
ccgcuggggaccgcaccuggug

SEQ ID NO: 3424299 - RNA, 22 nt, Pseudomonas aeruginosa PA01
ccgcuggguuuccugcauggcu

SEQ ID NO: 3424300 - RNA, 16 nt, Pseudomonas aeruginosa PA01
ccgcugguagcccagg

SEQ ID NO: 3424301 - RNA, 22 nt, Pseudomonas aeruginosa PA01
ccgcugguagcuaccgucggcc

SEQ ID NO: 3424302 - RNA, 17 nt, Pseudomonas aeruginosa PA01
ccgcugguccagcuggc

SEQ ID NO: 3424303 - RNA, 24 nt, Pseudomonas aeruginosa PA01
ccgcugguccagcuggcgcagccg

SEQ ID NO: 3424304 - RNA, 19 nt, Pseudomonas aeruginosa PA01
ccgcuggucggcauccggc

SEQ ID NO: 3424305 - RNA, 24 nt, Pseudomonas aeruginosa PA01
ccgcuggucggcauccggcaggcg

SEQ ID NO: 3424306 - RNA, 16 nt, Pseudomonas aeruginosa PA01
ccgcuguccgccgccg

SEQ ID NO: 3424307 - RNA, 21 nt, Pseudomonas aeruginosa PA01
ccgcuguccgccgccgcggcg

SEQ ID NO: 3424308 - RNA, 14 nt, Pseudomonas aeruginosa PA01
ccgcuguccgccgg

SEQ ID NO: 3424309 - RNA, 16 nt, Pseudomonas aeruginosa PA01
ccgcuguccgccggcc

SEQ ID NO: 3424310 - RNA, 17 nt, Pseudomonas aeruginosa PA01
ccgcuguccgccggccu

SEQ ID NO: 3424311 - RNA, 20 nt, Pseudomonas aeruginosa PA01
ccgcuguccgccggccucga

SEQ ID NO: 3424312 - RNA, 17 nt, Pseudomonas aeruginosa PA01
ccgcugucguccagcgg

SEQ ID NO: 3424313 - RNA, 18 nt, Pseudomonas aeruginosa PA01
ccgcugucguccagcggg

SEQ ID NO: 3424314 - RNA, 19 nt, Pseudomonas aeruginosa PA01
ccgcugucguccagcgggu

SEQ ID NO: 3424315 - RNA, 20 nt, Pseudomonas aeruginosa PA01
ccgcugucguccagcgggua

SEQ ID NO: 3424316 - RNA, 16 nt, Pseudomonas aeruginosa PA01
ccgcugucgucuucgg

SEQ ID NO: 3424317 - RNA, 19 nt, Pseudomonas aeruginosa PA01
ccgcugucgucuucggcca

SEQ ID NO: 3424318 - RNA, 18 nt, Pseudomonas aeruginosa PA01
ccgcugucuaucugcgcc

SEQ ID NO: 3424319 - RNA, 15 nt, Pseudomonas aeruginosa PA01
ccgcugugcaggguc

SEQ ID NO: 3424320 - RNA, 23 nt, Pseudomonas aeruginosa PA01
ccgcugugcagggucagucgagc

SEQ ID NO: 3424321 - RNA, 21 nt, Pseudomonas aeruginosa PA01
ccgcuguggaaguacggcgcg

SEQ ID NO: 3424322 - RNA, 22 nt, Pseudomonas aeruginosa PA01
ccgcuguggaaguacggcgcgg

SEQ ID NO: 3424323 - RNA, 22 nt, Pseudomonas aeruginosa PA01
ccgcugugugccucugaccgcg

SEQ ID NO: 3424324 - RNA, 17 nt, Pseudomonas aeruginosa PA01
ccgcuguuacugagcgu

SEQ ID NO: 3424325 - RNA, 23 nt, Pseudomonas aeruginosa PA01
ccgcuguuucuccaguucggcga

SEQ ID NO: 3424326 - RNA, 15 nt, Pseudomonas aeruginosa PA01
ccgcuucagcgcgcc

SEQ ID NO: 3424327 - RNA, 16 nt, Pseudomonas aeruginosa PA01
ccgcuucagcgcgccg

SEQ ID NO: 3424328 - RNA, 17 nt, Pseudomonas aeruginosa PA01
ccgcuucagcgcgccga

SEQ ID NO: 3424329 - RNA, 20 nt, Pseudomonas aeruginosa PA01
ccgcuucagcgcgccgagcc

SEQ ID NO: 3424330 - RNA, 23 nt, Pseudomonas aeruginosa PA01
ccgcuucagcgcgccgagccagg

SEQ ID NO: 3424331 - RNA, 22 nt, Pseudomonas aeruginosa PA01
ccgcuuccgccaggcgcagcca

SEQ ID NO: 3424332 - RNA, 14 nt, Pseudomonas aeruginosa PA01
ccgcuuccgcccag

SEQ ID NO: 3424333 - RNA, 13 nt, Pseudomonas aeruginosa PA01
ccgcuuccgccgg

SEQ ID NO: 3424334 - RNA, 21 nt, Pseudomonas aeruginosa PA01
ccgcuuccgccggcgccgccu

SEQ ID NO: 3424335 - RNA, 17 nt, Pseudomonas aeruginosa PA01
ccgcuuccugggcuucg

SEQ ID NO: 3424336 - RNA, 21 nt, Pseudomonas aeruginosa PA01
ccgcuuccugggcuucguccg

SEQ ID NO: 3424337 - RNA, 11 nt, Pseudomonas aeruginosa PA01
ccgcuucgagc

SEQ ID NO: 3424338 - RNA, 14 nt, Pseudomonas aeruginosa PA01
ccgcuucgccgccc

SEQ ID NO: 3424339 - RNA, 15 nt, Pseudomonas aeruginosa PA01
ccgcuucgccgcccu

SEQ ID NO: 3424340 - RNA, 14 nt, Pseudomonas aeruginosa PA01
ccgcuucgcggauc

SEQ ID NO: 3424341 - RNA, 17 nt, Pseudomonas aeruginosa PA01
ccgcuucggcccgcugg

SEQ ID NO: 3424342 - RNA, 12 nt, Pseudomonas aeruginosa PA01
ccgcuucggcgg

SEQ ID NO: 3424343 - RNA, 13 nt, Pseudomonas aeruginosa PA01
ccgcuucggcggg

SEQ ID NO: 3424344 - RNA, 15 nt, Pseudomonas aeruginosa PA01
ccgcuucggcggggc

SEQ ID NO: 3424345 - RNA, 22 nt, Pseudomonas aeruginosa PA01
ccgcuucggcugcugcugcggc

SEQ ID NO: 3424346 - RNA, 12 nt, Pseudomonas aeruginosa PA01
ccgcuucgucgg

SEQ ID NO: 3424347 - RNA, 18 nt, Pseudomonas aeruginosa PA01
ccgcuucgucggucgcga

SEQ ID NO: 3424348 - RNA, 12 nt, Pseudomonas aeruginosa PA01
ccgcuucuuccc

SEQ ID NO: 3424349 - RNA, 13 nt, Pseudomonas aeruginosa PA01
ccgcuucuucccg

SEQ ID NO: 3424350 - RNA, 16 nt, Pseudomonas aeruginosa PA01
ccgcuucuucccgccc

SEQ ID NO: 3424351 - RNA, 19 nt, Pseudomonas aeruginosa PA01
ccgcuugcgccgccucgcg

SEQ ID NO: 3424352 - RNA, 21 nt, Pseudomonas aeruginosa PA01
ccgcuugcgccgccucgcgca

SEQ ID NO: 3424353 - RNA, 22 nt, Pseudomonas aeruginosa PA01
ccgcuugcggucauccgccggc

SEQ ID NO: 3424354 - RNA, 23 nt, Pseudomonas aeruginosa PA01
ccgcuugcggucauccgccggcg

SEQ ID NO: 3424355 - RNA, 21 nt, Pseudomonas aeruginosa PA01
ccgcuugcgguuauccgccgc

SEQ ID NO: 3424356 - RNA, 22 nt, Pseudomonas aeruginosa PA01
ccgcuugcgguuauccgccgcc

SEQ ID NO: 3424357 - RNA, 21 nt, Pseudomonas aeruginosa PA01
ccgcuugcgguuauccgccgu

SEQ ID NO: 3424358 - RNA, 22 nt, Pseudomonas aeruginosa PA01
ccgcuugcgguuauccgccgug

SEQ ID NO: 3424359 - RNA, 23 nt, Pseudomonas aeruginosa PA01
ccgcuugcgguuauccgccgugg

SEQ ID NO: 3424360 - RNA, 17 nt, Pseudomonas aeruginosa PA01
ccgcuuggccauggcgc

SEQ ID NO: 3424361 - RNA, 17 nt, Pseudomonas aeruginosa PA01
ccgcuuucagcgccgcu

SEQ ID NO: 3424362 - RNA, 18 nt, Pseudomonas aeruginosa PA01
ccgcuuucagcgccgcuc

SEQ ID NO: 3424363 - RNA, 22 nt, Pseudomonas aeruginosa PA01
ccgcuuucagcgccgcucggcg

SEQ ID NO: 3424364 - RNA, 22 nt, Pseudomonas aeruginosa PA01
ccgcuuuccacccgaaagccga

SEQ ID NO: 3424365 - RNA, 15 nt, Pseudomonas aeruginosa PA01
ccgcuuucguagggc

SEQ ID NO: 3424366 - RNA, 18 nt, Pseudomonas aeruginosa PA01
ccggaaaaauccucgccu

SEQ ID NO: 3424367 - RNA, 14 nt, Pseudomonas aeruginosa PA01
ccggaaaagaagcc

SEQ ID NO: 3424368 - RNA, 19 nt, Pseudomonas aeruginosa PA01
ccggaaaagaagccgcgca

SEQ ID NO: 3424369 - RNA, 17 nt, Pseudomonas aeruginosa PA01
ccggaaccaccggucaa

SEQ ID NO: 3424370 - RNA, 20 nt, Pseudomonas aeruginosa PA01
ccggaaccuguccgaacagg

SEQ ID NO: 3424371 - RNA, 19 nt, Pseudomonas aeruginosa PA01
ccggaagcguccaggguug

SEQ ID NO: 3424372 - RNA, 20 nt, Pseudomonas aeruginosa PA01
ccggaagguugucgaagcga

SEQ ID NO: 3424373 - RNA, 17 nt, Pseudomonas aeruginosa PA01
ccggaaguggcagcgcc

SEQ ID NO: 3424374 - RNA, 19 nt, Pseudomonas aeruginosa PA01
ccggaaguggcagcgccgu

SEQ ID NO: 3424375 - RNA, 14 nt, Pseudomonas aeruginosa PA01
ccggaaucacgcug

SEQ ID NO: 3424376 - RNA, 16 nt, Pseudomonas aeruginosa PA01
ccggaaucacgucgau

SEQ ID NO: 3424377 - RNA, 22 nt, Pseudomonas aeruginosa PA01
ccggaaucgacggauacgccag

SEQ ID NO: 3424378 - RNA, 15 nt, Pseudomonas aeruginosa PA01
ccggacaacaggccg

SEQ ID NO: 3424379 - RNA, 11 nt, Pseudomonas aeruginosa PA01
ccggacagccu

SEQ ID NO: 3424380 - RNA, 14 nt, Pseudomonas aeruginosa PA01
ccggacagccuucg

SEQ ID NO: 3424381 - RNA, 18 nt, Pseudomonas aeruginosa PA01
ccggacagccuucgagcc

SEQ ID NO: 3424382 - RNA, 23 nt, Pseudomonas aeruginosa PA01
ccggacaggaaaaagcccgcguc

SEQ ID NO: 3424383 - RNA, 15 nt, Pseudomonas aeruginosa PA01
ccggacaggccaccc

SEQ ID NO: 3424384 - RNA, 14 nt, Pseudomonas aeruginosa PA01
ccggacauaucgau

SEQ ID NO: 3424385 - RNA, 15 nt, Pseudomonas aeruginosa PA01
ccggaccagaucggc

SEQ ID NO: 3424386 - RNA, 17 nt, Pseudomonas aeruginosa PA01
ccggcaaggcggccuca

SEQ ID NO: 3424387 - RNA, 14 nt, Pseudomonas aeruginosa PA01
ccggcaagggccug

SEQ ID NO: 3424388 - RNA, 21 nt, Pseudomonas aeruginosa PA01
ccggcaagggccugcucagcg

SEQ ID NO: 3424389 - RNA, 14 nt, Pseudomonas aeruginosa PA01
ccggcaauagccgg

SEQ ID NO: 3424390 - RNA, 16 nt, Pseudomonas aeruginosa PA01
ccggcaaucaggcgcg

SEQ ID NO: 3424391 - RNA, 18 nt, Pseudomonas aeruginosa PA01
ccggcaccaccaccggac

SEQ ID NO: 3424392 - RNA, 18 nt, Pseudomonas aeruginosa PA01
ccggcaccaccagcgcgc

SEQ ID NO: 3424393 - RNA, 14 nt, Pseudomonas aeruginosa PA01
ccggcaccaccggu

SEQ ID NO: 3424394 - RNA, 14 nt, Pseudomonas aeruginosa PA01
ccggcaccagcagu

SEQ ID NO: 3424395 - RNA, 13 nt, Pseudomonas aeruginosa PA01
ccggcaccaggcc

SEQ ID NO: 3424396 - RNA, 15 nt, Pseudomonas aeruginosa PA01
ccggcaccaggccga

SEQ ID NO: 3424397 - RNA, 14 nt, Pseudomonas aeruginosa PA01
ccggcacccugacc

SEQ ID NO: 3424398 - RNA, 18 nt, Pseudomonas aeruginosa PA01
ccggcacccugaccgcga

SEQ ID NO: 3424399 - RNA, 20 nt, Pseudomonas aeruginosa PA01
ccggcacccugaccgcgagc

SEQ ID NO: 3424400 - RNA, 21 nt, Pseudomonas aeruginosa PA01
ccggcaccgcucugcagugcg

SEQ ID NO: 3424401 - RNA, 15 nt, Pseudomonas aeruginosa PA01
ccggcaccgucgagc

SEQ ID NO: 3424402 - RNA, 21 nt, Pseudomonas aeruginosa PA01
ccggcaccgucgagcaccagg

SEQ ID NO: 3424403 - RNA, 21 nt, Pseudomonas aeruginosa PA01
ccggcaccuugcgaaaagccc

SEQ ID NO: 3424404 - RNA, 14 nt, Pseudomonas aeruginosa PA01
ccggcacgcuccag

SEQ ID NO: 3424405 - RNA, 17 nt, Pseudomonas aeruginosa PA01
ccggcacgcuccagggc

SEQ ID NO: 3424406 - RNA, 17 nt, Pseudomonas aeruginosa PA01
ccggcacgcugccgccg

SEQ ID NO: 3424407 - RNA, 20 nt, Pseudomonas aeruginosa PA01
ccggcacggaaacgccgaga

SEQ ID NO: 3424408 - RNA, 21 nt, Pseudomonas aeruginosa PA01
ccggcacggcaucgauccgca

SEQ ID NO: 3424409 - RNA, 17 nt, Pseudomonas aeruginosa PA01
ccggcacucgccgggcg

SEQ ID NO: 3424410 - RNA, 18 nt, Pseudomonas aeruginosa PA01
ccggcacucgccgggcgu

SEQ ID NO: 3424411 - RNA, 18 nt, Pseudomonas aeruginosa PA01
ccggcagcacccgcacca

SEQ ID NO: 3424412 - RNA, 20 nt, Pseudomonas aeruginosa PA01
ccggcagcacccgcaccagc

SEQ ID NO: 3424413 - RNA, 16 nt, Pseudomonas aeruginosa PA01
ccggcagcacggcgau

SEQ ID NO: 3424414 - RNA, 14 nt, Pseudomonas aeruginosa PA01
ccggcagcagcgcc

SEQ ID NO: 3424415 - RNA, 15 nt, Pseudomonas aeruginosa PA01
ccggcagcagcgcca

SEQ ID NO: 3424416 - RNA, 16 nt, Pseudomonas aeruginosa PA01
ccggcagcagcgccag

SEQ ID NO: 3424417 - RNA, 17 nt, Pseudomonas aeruginosa PA01
ccggcagcagcgccagg

SEQ ID NO: 3424418 - RNA, 18 nt, Pseudomonas aeruginosa PA01
ccggcagcagcgccagga

SEQ ID NO: 3424419 - RNA, 19 nt, Pseudomonas aeruginosa PA01
ccggcagcagcggaucggc

SEQ ID NO: 3424420 - RNA, 23 nt, Pseudomonas aeruginosa PA01
ccggcagcagcggaucggcggug

SEQ ID NO: 3424421 - RNA, 14 nt, Pseudomonas aeruginosa PA01
ccggcagcaggccg

SEQ ID NO: 3424422 - RNA, 16 nt, Pseudomonas aeruginosa PA01
ccggcagcaggccgcc

SEQ ID NO: 3424423 - RNA, 17 nt, Pseudomonas aeruginosa PA01
ccggcagcaggccgccg

SEQ ID NO: 3424424 - RNA, 18 nt, Pseudomonas aeruginosa PA01
ccggcagcaggccgccgc

SEQ ID NO: 3424425 - RNA, 13 nt, Pseudomonas aeruginosa PA01
ccggcagcagggu

SEQ ID NO: 3424426 - RNA, 23 nt, Pseudomonas aeruginosa PA01
ccggcagcagggucagcagcgcc

SEQ ID NO: 3424427 - RNA, 15 nt, Pseudomonas aeruginosa PA01
ccggcagcaucucgg

SEQ ID NO: 3424428 - RNA, 14 nt, Pseudomonas aeruginosa PA01
ccggcagccaccag

SEQ ID NO: 3424429 - RNA, 15 nt, Pseudomonas aeruginosa PA01
ccggcagccaccagg

SEQ ID NO: 3424430 - RNA, 16 nt, Pseudomonas aeruginosa PA01
ccggcagccaccaggu

SEQ ID NO: 3424431 - RNA, 17 nt, Pseudomonas aeruginosa PA01
ccggcagccagccgccg

SEQ ID NO: 3424432 - RNA, 18 nt, Pseudomonas aeruginosa PA01
ccggcagccagccgccga

SEQ ID NO: 3424433 - RNA, 18 nt, Pseudomonas aeruginosa PA01
ccggcagccggguuccca

SEQ ID NO: 3424434 - RNA, 21 nt, Pseudomonas aeruginosa PA01
ccggcagcgaccaccaccagg

SEQ ID NO: 3424435 - RNA, 12 nt, Pseudomonas aeruginosa PA01
ccggcagcgacu

SEQ ID NO: 3424436 - RNA, 14 nt, Pseudomonas aeruginosa PA01
ccggcagcgacugg

SEQ ID NO: 3424437 - RNA, 12 nt, Pseudomonas aeruginosa PA01
ccggcagcgccg

SEQ ID NO: 3424438 - RNA, 13 nt, Pseudomonas aeruginosa PA01
ccggcagcgccga

SEQ ID NO: 3424439 - RNA, 14 nt, Pseudomonas aeruginosa PA01
ccggcagcgccgag

SEQ ID NO: 3424440 - RNA, 14 nt, Pseudomonas aeruginosa PA01
ccggcagcgccgcc

SEQ ID NO: 3424441 - RNA, 15 nt, Pseudomonas aeruginosa PA01
ccggcagcgccgcca

SEQ ID NO: 3424442 - RNA, 20 nt, Pseudomonas aeruginosa PA01
ccggcagcgccgccagcagg

SEQ ID NO: 3424443 - RNA, 16 nt, Pseudomonas aeruginosa PA01
ccggcagcgccgcgcg

SEQ ID NO: 3424444 - RNA, 14 nt, Pseudomonas aeruginosa PA01
ccggcagcgccggg

SEQ ID NO: 3424445 - RNA, 16 nt, Pseudomonas aeruginosa PA01
ccggcagcgccgggca

SEQ ID NO: 3424446 - RNA, 20 nt, Pseudomonas aeruginosa PA01
ccggcagcgccgggcauucg

SEQ ID NO: 3424447 - RNA, 13 nt, Pseudomonas aeruginosa PA01
ccggcagcggcug

SEQ ID NO: 3424448 - RNA, 15 nt, Pseudomonas aeruginosa PA01
ccggcagcggcuggc

SEQ ID NO: 3424449 - RNA, 20 nt, Pseudomonas aeruginosa PA01
ccggcagcggcuggccgucg

SEQ ID NO: 3424450 - RNA, 21 nt, Pseudomonas aeruginosa PA01
ccggcagcucccuugccgccg

SEQ ID NO: 3424451 - RNA, 17 nt, Pseudomonas aeruginosa PA01
ccggcagcuccggcggg

SEQ ID NO: 3424452 - RNA, 15 nt, Pseudomonas aeruginosa PA01
ccggcagcucggccg

SEQ ID NO: 3424453 - RNA, 22 nt, Pseudomonas aeruginosa PA01
ccggcagcucggccgagggcag

SEQ ID NO: 3424454 - RNA, 21 nt, Pseudomonas aeruginosa PA01
ccggcaggaacgcccgcggca

SEQ ID NO: 3424455 - RNA, 13 nt, Pseudomonas aeruginosa PA01
ccggcaggccgau

SEQ ID NO: 3424456 - RNA, 21 nt, Pseudomonas aeruginosa PA01
ccggcaggccgauggccccgg

SEQ ID NO: 3424457 - RNA, 16 nt, Pseudomonas aeruginosa PA01
ccggcaggccuucgac

SEQ ID NO: 3424458 - RNA, 18 nt, Pseudomonas aeruginosa PA01
ccggcaggccuucggcgc

SEQ ID NO: 3424459 - RNA, 21 nt, Pseudomonas aeruginosa PA01
ccggcaggccuucggcgccgg

SEQ ID NO: 3424460 - RNA, 12 nt, Pseudomonas aeruginosa PA01
ccggcaggcgca

SEQ ID NO: 3424461 - RNA, 19 nt, Pseudomonas aeruginosa PA01
ccggcaggcgcacgcgcag

SEQ ID NO: 3424462 - RNA, 15 nt, Pseudomonas aeruginosa PA01
ccggcaggcucagcg

SEQ ID NO: 3424463 - RNA, 15 nt, Pseudomonas aeruginosa PA01
ccggcagggccagcg

SEQ ID NO: 3424464 - RNA, 20 nt, Pseudomonas aeruginosa PA01
ccggcagggcgauccgcccg

SEQ ID NO: 3424465 - RNA, 22 nt, Pseudomonas aeruginosa PA01
ccggcagggcgauccgcccgca

SEQ ID NO: 3424466 - RNA, 21 nt, Pseudomonas aeruginosa PA01
ccggcagggucacgccgguga

SEQ ID NO: 3424467 - RNA, 18 nt, Pseudomonas aeruginosa PA01
ccggcagguagaccucga

SEQ ID NO: 3424468 - RNA, 20 nt, Pseudomonas aeruginosa PA01
ccggcagguagaccucgaug

SEQ ID NO: 3424469 - RNA, 17 nt, Pseudomonas aeruginosa PA01
ccggcagguucagcagg

SEQ ID NO: 3424470 - RNA, 13 nt, Pseudomonas aeruginosa PA01
ccggcauaccgcc

SEQ ID NO: 3424471 - RNA, 15 nt, Pseudomonas aeruginosa PA01
ccggcauaccgcccg

SEQ ID NO: 3424472 - RNA, 22 nt, Pseudomonas aeruginosa PA01
ccggcauagccgaacuccgcca

SEQ ID NO: 3424473 - RNA, 15 nt, Pseudomonas aeruginosa PA01
ccggcauaggcgcca

SEQ ID NO: 3424474 - RNA, 17 nt, Pseudomonas aeruginosa PA01
ccggcauaggcgccagc

SEQ ID NO: 3424475 - RNA, 22 nt, Pseudomonas aeruginosa PA01
ccggcauccagcauccgugcga

SEQ ID NO: 3424476 - RNA, 10 nt, Pseudomonas aeruginosa PA01
ccggcauccc

SEQ ID NO: 3424477 - RNA, 14 nt, Pseudomonas aeruginosa PA01
ccggcaucgaccag

SEQ ID NO: 3424478 - RNA, 20 nt, Pseudomonas aeruginosa PA01
ccggcaucgaccagcagcgg

SEQ ID NO: 3424479 - RNA, 23 nt, Pseudomonas aeruginosa PA01
ccggcaucgaccagcagcggcuc

SEQ ID NO: 3424480 - RNA, 15 nt, Pseudomonas aeruginosa PA01
ccggcaucgccaugg

SEQ ID NO: 3424481 - RNA, 13 nt, Pseudomonas aeruginosa PA01
ccggcaucgccgg

SEQ ID NO: 3424482 - RNA, 22 nt, Pseudomonas aeruginosa PA01
ccggcaucgguauucaucggcg

SEQ ID NO: 3424483 - RNA, 14 nt, Pseudomonas aeruginosa PA01
ccggcaucgugccg

SEQ ID NO: 3424484 - RNA, 16 nt, Pseudomonas aeruginosa PA01
ccggcaucgugccgcg

SEQ ID NO: 3424485 - RNA, 15 nt, Pseudomonas aeruginosa PA01
ccggcaucguggcca

SEQ ID NO: 3424486 - RNA, 13 nt, Pseudomonas aeruginosa PA01
ccggcaucugccg

SEQ ID NO: 3424487 - RNA, 17 nt, Pseudomonas aeruginosa PA01
ccggcaucugccgggcg

SEQ ID NO: 3424488 - RNA, 22 nt, Pseudomonas aeruginosa PA01
ccggcaugacggauccacucgu

SEQ ID NO: 3424489 - RNA, 22 nt, Pseudomonas aeruginosa PA01
ccggccgaucuucagcagcagg

SEQ ID NO: 3424490 - RNA, 12 nt, Pseudomonas aeruginosa PA01
ccggccgaugga

SEQ ID NO: 3424491 - RNA, 14 nt, Pseudomonas aeruginosa PA01
ccggccgcagcagg

SEQ ID NO: 3424492 - RNA, 13 nt, Pseudomonas aeruginosa PA01
ccggccgcaggca

SEQ ID NO: 3424493 - RNA, 14 nt, Pseudomonas aeruginosa PA01
ccggccgcaggcag

SEQ ID NO: 3424494 - RNA, 17 nt, Pseudomonas aeruginosa PA01
ccggccgccagcaggua

SEQ ID NO: 3424495 - RNA, 16 nt, Pseudomonas aeruginosa PA01
ccggccgcccgagccg

SEQ ID NO: 3424496 - RNA, 13 nt, Pseudomonas aeruginosa PA01
ccggccgccugcc

SEQ ID NO: 3424497 - RNA, 18 nt, Pseudomonas aeruginosa PA01
ccggccgccuuccucggc

SEQ ID NO: 3424498 - RNA, 21 nt, Pseudomonas aeruginosa PA01
ccggccgccuuccucggccgc

SEQ ID NO: 3424499 - RNA, 19 nt, Pseudomonas aeruginosa PA01
ccggccgcgcucgacgguc

SEQ ID NO: 3424500 - RNA, 18 nt, Pseudomonas aeruginosa PA01
ccggccgcgucgcccagg

SEQ ID NO: 3424501 - RNA, 20 nt, Pseudomonas aeruginosa PA01
ccggccgcgucgcccaggcc

SEQ ID NO: 3424502 - RNA, 21 nt, Pseudomonas aeruginosa PA01
ccggccgcgucgcccaggccg

SEQ ID NO: 3424503 - RNA, 12 nt, Pseudomonas aeruginosa PA01
ccggccgcugcc

SEQ ID NO: 3424504 - RNA, 14 nt, Pseudomonas aeruginosa PA01
ccggccgcugccgg

SEQ ID NO: 3424505 - RNA, 12 nt, Pseudomonas aeruginosa PA01
ccggccgcugga

SEQ ID NO: 3424506 - RNA, 22 nt, Pseudomonas aeruginosa PA01
ccggccggauuggccgaggugg

SEQ ID NO: 3424507 - RNA, 23 nt, Pseudomonas aeruginosa PA01
ccggccggauuggccgaggugga

SEQ ID NO: 3424508 - RNA, 16 nt, Pseudomonas aeruginosa PA01
ccggccggcagcgagc

SEQ ID NO: 3424509 - RNA, 16 nt, Pseudomonas aeruginosa PA01
ccggccggcaggagga

SEQ ID NO: 3424510 - RNA, 22 nt, Pseudomonas aeruginosa PA01
ccggccggcggccugagccggc

SEQ ID NO: 3424511 - RNA, 15 nt, Pseudomonas aeruginosa PA01
ccggccggcucagaa

SEQ ID NO: 3424512 - RNA, 12 nt, Pseudomonas aeruginosa PA01
ccggccggggcg

SEQ ID NO: 3424513 - RNA, 16 nt, Pseudomonas aeruginosa PA01
ccggccgucgcgcacc

SEQ ID NO: 3424514 - RNA, 17 nt, Pseudomonas aeruginosa PA01
ccggccgucgcgcacca

SEQ ID NO: 3424515 - RNA, 18 nt, Pseudomonas aeruginosa PA01
ccggccucaacgaccgcc

SEQ ID NO: 3424516 - RNA, 20 nt, Pseudomonas aeruginosa PA01
ccggccucaacgaccgccca

SEQ ID NO: 3424517 - RNA, 14 nt, Pseudomonas aeruginosa PA01
ccggccucaagcaa

SEQ ID NO: 3424518 - RNA, 16 nt, Pseudomonas aeruginosa PA01
ccggccucaagcaagc

SEQ ID NO: 3424519 - RNA, 14 nt, Pseudomonas aeruginosa PA01
ccggccuccagcgc

SEQ ID NO: 3424520 - RNA, 16 nt, Pseudomonas aeruginosa PA01
ccggccuccagcgccu

SEQ ID NO: 3424521 - RNA, 19 nt, Pseudomonas aeruginosa PA01
ccggccuccaggcuggccu

SEQ ID NO: 3424522 - RNA, 14 nt, Pseudomonas aeruginosa PA01
ccggccuccccggc

SEQ ID NO: 3424523 - RNA, 19 nt, Pseudomonas aeruginosa PA01
ccggccuccccggcccgcg

SEQ ID NO: 3424524 - RNA, 23 nt, Pseudomonas aeruginosa PA01
ccggccucgaagaacuccaucuc

SEQ ID NO: 3424525 - RNA, 16 nt, Pseudomonas aeruginosa PA01
ccggccucgacgcaga

SEQ ID NO: 3424526 - RNA, 17 nt, Pseudomonas aeruginosa PA01
ccggccucgacgcagag

SEQ ID NO: 3424527 - RNA, 21 nt, Pseudomonas aeruginosa PA01
ccggccucgacgcagagcgcc

SEQ ID NO: 3424528 - RNA, 14 nt, Pseudomonas aeruginosa PA01
ccggccucgccggu

SEQ ID NO: 3424529 - RNA, 15 nt, Pseudomonas aeruginosa PA01
ccggccucgccgguc

SEQ ID NO: 3424530 - RNA, 19 nt, Pseudomonas aeruginosa PA01
ccggccucgccugcggcgc

SEQ ID NO: 3424531 - RNA, 14 nt, Pseudomonas aeruginosa PA01
ccggccucgcgcaa

SEQ ID NO: 3424532 - RNA, 15 nt, Pseudomonas aeruginosa PA01
ccggccucgcugccg

SEQ ID NO: 3424533 - RNA, 17 nt, Pseudomonas aeruginosa PA01
ccggccucgcugccgcc

SEQ ID NO: 3424534 - RNA, 12 nt, Pseudomonas aeruginosa PA01
ccggccucggcg

SEQ ID NO: 3424535 - RNA, 14 nt, Pseudomonas aeruginosa PA01
ccggccucggcggc

SEQ ID NO: 3424536 - RNA, 16 nt, Pseudomonas aeruginosa PA01
ccggccucggcggcgc

SEQ ID NO: 3424537 - RNA, 15 nt, Pseudomonas aeruginosa PA01
ccggccugcgcgcac

SEQ ID NO: 3424538 - RNA, 13 nt, Pseudomonas aeruginosa PA01
ccggccuggcgcc

SEQ ID NO: 3424539 - RNA, 16 nt, Pseudomonas aeruginosa PA01
ccggccuggcgccggg

SEQ ID NO: 3424540 - RNA, 18 nt, Pseudomonas aeruginosa PA01
ccggccuggcgccggggu

SEQ ID NO: 3424541 - RNA, 22 nt, Pseudomonas aeruginosa PA01
ccggccuggcgcgcgcgccagg

SEQ ID NO: 3424542 - RNA, 14 nt, Pseudomonas aeruginosa PA01
ccggccuggcgucc

SEQ ID NO: 3424543 - RNA, 17 nt, Pseudomonas aeruginosa PA01
ccggccuggcgucccgg

SEQ ID NO: 3424544 - RNA, 13 nt, Pseudomonas aeruginosa PA01
ccggccugggccc

SEQ ID NO: 3424545 - RNA, 23 nt, Pseudomonas aeruginosa PA01
ccggccugguaggccucgaugau

SEQ ID NO: 3424546 - RNA, 20 nt, Pseudomonas aeruginosa PA01
ccggccuggugacccggaca

SEQ ID NO: 3424547 - RNA, 17 nt, Pseudomonas aeruginosa PA01
ccggccuggugccgggc

SEQ ID NO: 3424548 - RNA, 12 nt, Pseudomonas aeruginosa PA01
ccggcgaacagc

SEQ ID NO: 3424549 - RNA, 16 nt, Pseudomonas aeruginosa PA01
ccggcgaacagccagc

SEQ ID NO: 3424550 - RNA, 21 nt, Pseudomonas aeruginosa PA01
ccggcgaacagccagcgguug

SEQ ID NO: 3424551 - RNA, 21 nt, Pseudomonas aeruginosa PA01
ccggcgaacagcgcuuccugg

SEQ ID NO: 3424552 - RNA, 14 nt, Pseudomonas aeruginosa PA01
ccggcgaaccaggc

SEQ ID NO: 3424553 - RNA, 20 nt, Pseudomonas aeruginosa PA01
ccggcgaaccaggcggccga

SEQ ID NO: 3424554 - RNA, 18 nt, Pseudomonas aeruginosa PA01
ccggcgaaccgugguucu

SEQ ID NO: 3424555 - RNA, 14 nt, Pseudomonas aeruginosa PA01
ccggcgaacgccgg

SEQ ID NO: 3424556 - RNA, 16 nt, Pseudomonas aeruginosa PA01
ccggcgaacgcuugag

SEQ ID NO: 3424557 - RNA, 16 nt, Pseudomonas aeruginosa PA01
ccggcgaacggcaugc

SEQ ID NO: 3424558 - RNA, 17 nt, Pseudomonas aeruginosa PA01
ccggcgaagcuccucga

SEQ ID NO: 3424559 - RNA, 17 nt, Pseudomonas aeruginosa PA01
ccggcgaagggcaggcc

SEQ ID NO: 3424560 - RNA, 23 nt, Pseudomonas aeruginosa PA01
ccggcgaagggcaggccgaucau

SEQ ID NO: 3424561 - RNA, 14 nt, Pseudomonas aeruginosa PA01
ccggcgaaugccgg

SEQ ID NO: 3424562 - RNA, 13 nt, Pseudomonas aeruginosa PA01
ccggcgaccaccg

SEQ ID NO: 3424563 - RNA, 15 nt, Pseudomonas aeruginosa PA01
ccggcgaccaccgcc

SEQ ID NO: 3424564 - RNA, 16 nt, Pseudomonas aeruginosa PA01
ccggcgaccagcgucg

SEQ ID NO: 3424565 - RNA, 19 nt, Pseudomonas aeruginosa PA01
ccggcgaccagcgucgcgc

SEQ ID NO: 3424566 - RNA, 19 nt, Pseudomonas aeruginosa PA01
ccggcgaccuuguccaggc

SEQ ID NO: 3424567 - RNA, 21 nt, Pseudomonas aeruginosa PA01
ccggcgaccuuguccaggcgc

SEQ ID NO: 3424568 - RNA, 23 nt, Pseudomonas aeruginosa PA01
ccggcgaccuuguccaggcgcug

SEQ ID NO: 3424569 - RNA, 13 nt, Pseudomonas aeruginosa PA01
ccggcgacgacga

SEQ ID NO: 3424570 - RNA, 18 nt, Pseudomonas aeruginosa PA01
ccggcgacgacgaucccg

SEQ ID NO: 3424571 - RNA, 13 nt, Pseudomonas aeruginosa PA01
ccggcgacgcagg

SEQ ID NO: 3424572 - RNA, 15 nt, Pseudomonas aeruginosa PA01
ccggcgacgcaggac

SEQ ID NO: 3424573 - RNA, 18 nt, Pseudomonas aeruginosa PA01
ccggcgagaaaggcugcu

SEQ ID NO: 3424574 - RNA, 17 nt, Pseudomonas aeruginosa PA01
ccggcgagcaacgcagg

SEQ ID NO: 3424575 - RNA, 19 nt, Pseudomonas aeruginosa PA01
ccggcgagcaacgcagguc

SEQ ID NO: 3424576 - RNA, 16 nt, Pseudomonas aeruginosa PA01
ccggcgagcacggcga

SEQ ID NO: 3424577 - RNA, 18 nt, Pseudomonas aeruginosa PA01
ccggcgagcacggcgaac

SEQ ID NO: 3424578 - RNA, 14 nt, Pseudomonas aeruginosa PA01
ccggcgagcgagcg

SEQ ID NO: 3424579 - RNA, 15 nt, Pseudomonas aeruginosa PA01
ccggcgaggaucgcg

SEQ ID NO: 3424580 - RNA, 17 nt, Pseudomonas aeruginosa PA01
ccggcgaggcguuccag

SEQ ID NO: 3424581 - RNA, 15 nt, Pseudomonas aeruginosa PA01
ccggcgagggcggcg

SEQ ID NO: 3424582 - RNA, 18 nt, Pseudomonas aeruginosa PA01
ccggcgaucagcucgcgg

SEQ ID NO: 3424583 - RNA, 16 nt, Pseudomonas aeruginosa PA01
ccggcgaucauccagc

SEQ ID NO: 3424584 - RNA, 17 nt, Pseudomonas aeruginosa PA01
ccggcgaucauccagcc

SEQ ID NO: 3424585 - RNA, 14 nt, Pseudomonas aeruginosa PA01
ccggcgauccgcgc

SEQ ID NO: 3424586 - RNA, 12 nt, Pseudomonas aeruginosa PA01
ccggcgaucgcc

SEQ ID NO: 3424587 - RNA, 22 nt, Pseudomonas aeruginosa PA01
ccggcgaucgccaggcgaucca

SEQ ID NO: 3424588 - RNA, 14 nt, Pseudomonas aeruginosa PA01
ccggcgaucgccgg

SEQ ID NO: 3424589 - RNA, 15 nt, Pseudomonas aeruginosa PA01
ccggcgaucgccggc

SEQ ID NO: 3424590 - RNA, 17 nt, Pseudomonas aeruginosa PA01
ccggcgaucgccggcgu

SEQ ID NO: 3424591 - RNA, 23 nt, Pseudomonas aeruginosa PA01
ccggcgaugauggucaacaccag

SEQ ID NO: 3424592 - RNA, 16 nt, Pseudomonas aeruginosa PA01
ccggcgcggcgcagcc

SEQ ID NO: 3424593 - RNA, 19 nt, Pseudomonas aeruginosa PA01
ccggcgcggcgcagccaga

SEQ ID NO: 3424594 - RNA, 19 nt, Pseudomonas aeruginosa PA01
ccggcgcggcgcagcggcg

SEQ ID NO: 3424595 - RNA, 14 nt, Pseudomonas aeruginosa PA01
ccggcgcggcggcc

SEQ ID NO: 3424596 - RNA, 15 nt, Pseudomonas aeruginosa PA01
ccggcgcggcggccg

SEQ ID NO: 3424597 - RNA, 24 nt, Pseudomonas aeruginosa PA01
ccggcgcggcggccgccucggcgu

SEQ ID NO: 3424598 - RNA, 16 nt, Pseudomonas aeruginosa PA01
ccggcgcgggcggccu

SEQ ID NO: 3424599 - RNA, 21 nt, Pseudomonas aeruginosa PA01
ccggcgcgggcggccucgaug

SEQ ID NO: 3424600 - RNA, 17 nt, Pseudomonas aeruginosa PA01
ccggcgcggucucgcgu

SEQ ID NO: 3424601 - RNA, 20 nt, Pseudomonas aeruginosa PA01
ccggcgcgguuucgcagcgc

SEQ ID NO: 3424602 - RNA, 22 nt, Pseudomonas aeruginosa PA01
ccggcgcgguuucgcagcgcuc

SEQ ID NO: 3424603 - RNA, 21 nt, Pseudomonas aeruginosa PA01
ccggcgcguagaggaugccgg

SEQ ID NO: 3424604 - RNA, 23 nt, Pseudomonas aeruginosa PA01
ccggcgcguagaggaugccggcc

SEQ ID NO: 3424605 - RNA, 22 nt, Pseudomonas aeruginosa PA01
ccggcgcgucccugggcgcagg

SEQ ID NO: 3424606 - RNA, 18 nt, Pseudomonas aeruginosa PA01
ccggcgcgucgcugcgca

SEQ ID NO: 3424607 - RNA, 18 nt, Pseudomonas aeruginosa PA01
ccggcgcguuggcuggcg

SEQ ID NO: 3424608 - RNA, 18 nt, Pseudomonas aeruginosa PA01
ccggcgcuccaacagcag

SEQ ID NO: 3424609 - RNA, 20 nt, Pseudomonas aeruginosa PA01
ccggcgcuccaacagcaggu

SEQ ID NO: 3424610 - RNA, 15 nt, Pseudomonas aeruginosa PA01
ccggcgcuccacagc

SEQ ID NO: 3424611 - RNA, 21 nt, Pseudomonas aeruginosa PA01
ccggcgcuccacagcugccag

SEQ ID NO: 3424612 - RNA, 16 nt, Pseudomonas aeruginosa PA01
ccggcgcucggccagg

SEQ ID NO: 3424613 - RNA, 18 nt, Pseudomonas aeruginosa PA01
ccggcgcucggccagguc

SEQ ID NO: 3424614 - RNA, 13 nt, Pseudomonas aeruginosa PA01
ccggcgcugagcg

SEQ ID NO: 3424615 - RNA, 17 nt, Pseudomonas aeruginosa PA01
ccggcgcugagcgagac

SEQ ID NO: 3424616 - RNA, 21 nt, Pseudomonas aeruginosa PA01
ccggcgcugccgaacagcagg

SEQ ID NO: 3424617 - RNA, 22 nt, Pseudomonas aeruginosa PA01
ccggcgcugccgaacagcaggg

SEQ ID NO: 3424618 - RNA, 14 nt, Pseudomonas aeruginosa PA01
ccggcgcugcuucu

SEQ ID NO: 3424619 - RNA, 16 nt, Pseudomonas aeruginosa PA01
ccggcgcugcuucuug

SEQ ID NO: 3424620 - RNA, 15 nt, Pseudomonas aeruginosa PA01
ccggcgcuggccgcg

SEQ ID NO: 3424621 - RNA, 17 nt, Pseudomonas aeruginosa PA01
ccggcgcuggccgcgcg

SEQ ID NO: 3424622 - RNA, 22 nt, Pseudomonas aeruginosa PA01
ccggcgcuggccgcgcgaccgc

SEQ ID NO: 3424623 - RNA, 19 nt, Pseudomonas aeruginosa PA01
ccggcgcugguugaggucg

SEQ ID NO: 3424624 - RNA, 17 nt, Pseudomonas aeruginosa PA01
ccggcgcugucucgcca

SEQ ID NO: 3424625 - RNA, 18 nt, Pseudomonas aeruginosa PA01
ccggcgcuucgcgcagga

SEQ ID NO: 3424626 - RNA, 22 nt, Pseudomonas aeruginosa PA01
ccggcgcuucgcgcaggacgag

SEQ ID NO: 3424627 - RNA, 17 nt, Pseudomonas aeruginosa PA01
ccggcgcuucugcgagc

SEQ ID NO: 3424628 - RNA, 18 nt, Pseudomonas aeruginosa PA01
ccggcggacaaccaccau

SEQ ID NO: 3424629 - RNA, 20 nt, Pseudomonas aeruginosa PA01
ccggcggacaaccaccaugc

SEQ ID NO: 3424630 - RNA, 21 nt, Pseudomonas aeruginosa PA01
ccggcggauaaccgcaagcgg

SEQ ID NO: 3424631 - RNA, 14 nt, Pseudomonas aeruginosa PA01
ccggcggaucagcc

SEQ ID NO: 3424632 - RNA, 16 nt, Pseudomonas aeruginosa PA01
ccggcggaucagcccg

SEQ ID NO: 3424633 - RNA, 17 nt, Pseudomonas aeruginosa PA01
ccggcggaucagcccgc

SEQ ID NO: 3424634 - RNA, 13 nt, Pseudomonas aeruginosa PA01
ccggcggaugacg

SEQ ID NO: 3424635 - RNA, 18 nt, Pseudomonas aeruginosa PA01
ccggcggaugacguuccc

SEQ ID NO: 3424636 - RNA, 22 nt, Pseudomonas aeruginosa PA01
ccggcggaugacguucccgucc

SEQ ID NO: 3424637 - RNA, 21 nt, Pseudomonas aeruginosa PA01
ccggcggauuacuccgccggc

SEQ ID NO: 3424638 - RNA, 15 nt, Pseudomonas aeruginosa PA01
ccggcggccagggcg

SEQ ID NO: 3424639 - RNA, 17 nt, Pseudomonas aeruginosa PA01
ccggcggccggcgcagu

SEQ ID NO: 3424640 - RNA, 12 nt, Pseudomonas aeruginosa PA01
ccggcggccugc

SEQ ID NO: 3424641 - RNA, 16 nt, Pseudomonas aeruginosa PA01
ccggcggccugccccg

SEQ ID NO: 3424642 - RNA, 21 nt, Pseudomonas aeruginosa PA01
ccggcggccugccccgccggc

SEQ ID NO: 3424643 - RNA, 13 nt, Pseudomonas aeruginosa PA01
ccggcggcgaaca

SEQ ID NO: 3424644 - RNA, 18 nt, Pseudomonas aeruginosa PA01
ccggcggcgacccagacc

SEQ ID NO: 3424645 - RNA, 11 nt, Pseudomonas aeruginosa PA01
ccggcggcgau

SEQ ID NO: 3424646 - RNA, 23 nt, Pseudomonas aeruginosa PA01
ccggcggcgaucuucuccgccgc

SEQ ID NO: 3424647 - RNA, 12 nt, Pseudomonas aeruginosa PA01
ccggcggcgaug

SEQ ID NO: 3424648 - RNA, 22 nt, Pseudomonas aeruginosa PA01
ccggcggcgaugaagcugaugc

SEQ ID NO: 3424649 - RNA, 17 nt, Pseudomonas aeruginosa PA01
ccggcggcgaugaucgg

SEQ ID NO: 3424650 - RNA, 19 nt, Pseudomonas aeruginosa PA01
ccggcggcgaugaucggca

SEQ ID NO: 3424651 - RNA, 21 nt, Pseudomonas aeruginosa PA01
ccggcggcgaugaucggcagc

SEQ ID NO: 3424652 - RNA, 16 nt, Pseudomonas aeruginosa PA01
ccggcggcgcggcagu

SEQ ID NO: 3424653 - RNA, 14 nt, Pseudomonas aeruginosa PA01
ccggcggcgcgucc

SEQ ID NO: 3424654 - RNA, 21 nt, Pseudomonas aeruginosa PA01
ccggcggcgcugaggaucagc

SEQ ID NO: 3424655 - RNA, 20 nt, Pseudomonas aeruginosa PA01
ccggcggcggacgcaggccg

SEQ ID NO: 3424656 - RNA, 12 nt, Pseudomonas aeruginosa PA01
ccggcggcggca

SEQ ID NO: 3424657 - RNA, 20 nt, Pseudomonas aeruginosa PA01
ccggcggcggcaccgacgcc

SEQ ID NO: 3424658 - RNA, 17 nt, Pseudomonas aeruginosa PA01
ccggcggcugcugcgcc

SEQ ID NO: 3424659 - RNA, 18 nt, Pseudomonas aeruginosa PA01
ccggcggcugcugcgccu

SEQ ID NO: 3424660 - RNA, 23 nt, Pseudomonas aeruginosa PA01
ccggcggcugcugcgccuggccg

SEQ ID NO: 3424661 - RNA, 17 nt, Pseudomonas aeruginosa PA01
ccggcgggaaacgcgag

SEQ ID NO: 3424662 - RNA, 21 nt, Pseudomonas aeruginosa PA01
ccggcgggacgcgcaugcagg

SEQ ID NO: 3424663 - RNA, 19 nt, Pseudomonas aeruginosa PA01
ccggcgggauguacgccag

SEQ ID NO: 3424664 - RNA, 20 nt, Pseudomonas aeruginosa PA01
ccggcgggauguacgccagg

SEQ ID NO: 3424665 - RNA, 19 nt, Pseudomonas aeruginosa PA01
ccggcgggcgcgaggcgcc

SEQ ID NO: 3424666 - RNA, 17 nt, Pseudomonas aeruginosa PA01
ccggcggguucagcccg

SEQ ID NO: 3424667 - RNA, 18 nt, Pseudomonas aeruginosa PA01
ccggcggguucagcccgc

SEQ ID NO: 3424668 - RNA, 20 nt, Pseudomonas aeruginosa PA01
ccggcggguucagcccgccg

SEQ ID NO: 3424669 - RNA, 21 nt, Pseudomonas aeruginosa PA01
ccggcggguucagcccgccgu

SEQ ID NO: 3424670 - RNA, 17 nt, Pseudomonas aeruginosa PA01
ccggcgguccgccgcgg

SEQ ID NO: 3424671 - RNA, 20 nt, Pseudomonas aeruginosa PA01
ccggcgguccgccgcgggac

SEQ ID NO: 3424672 - RNA, 23 nt, Pseudomonas aeruginosa PA01
ccggcgguccgccgcgggacgcc

SEQ ID NO: 3424673 - RNA, 20 nt, Pseudomonas aeruginosa PA01
ccggcggugagggcgacggc

SEQ ID NO: 3424674 - RNA, 17 nt, Pseudomonas aeruginosa PA01
ccggcgguuucgccgag

SEQ ID NO: 3424675 - RNA, 20 nt, Pseudomonas aeruginosa PA01
ccggcgguuucgccgaggcc

SEQ ID NO: 3424676 - RNA, 23 nt, Pseudomonas aeruginosa PA01
ccggcgguuucgccgaggcccag

SEQ ID NO: 3424677 - RNA, 18 nt, Pseudomonas aeruginosa PA01
ccggcguaccguuggcga

SEQ ID NO: 3424678 - RNA, 16 nt, Pseudomonas aeruginosa PA01
ccggcguaccuugagc

SEQ ID NO: 3424679 - RNA, 17 nt, Pseudomonas aeruginosa PA01
ccggcguacuucggcgc

SEQ ID NO: 3424680 - RNA, 18 nt, Pseudomonas aeruginosa PA01
ccggcguacuucggcgcg

SEQ ID NO: 3424681 - RNA, 19 nt, Pseudomonas aeruginosa PA01
ccggcguacuucggcgcgg

SEQ ID NO: 3424682 - RNA, 18 nt, Pseudomonas aeruginosa PA01
ccggcguccacuccggca

SEQ ID NO: 3424683 - RNA, 20 nt, Pseudomonas aeruginosa PA01
ccggcguccacuccggcagc

SEQ ID NO: 3424684 - RNA, 15 nt, Pseudomonas aeruginosa PA01
ccggcguccaggagg

SEQ ID NO: 3424685 - RNA, 16 nt, Pseudomonas aeruginosa PA01
ccggcguccccuuccu

SEQ ID NO: 3424686 - RNA, 15 nt, Pseudomonas aeruginosa PA01
ccggcguccgggugc

SEQ ID NO: 3424687 - RNA, 20 nt, Pseudomonas aeruginosa PA01
ccggcguccuccuccaguuc

SEQ ID NO: 3424688 - RNA, 13 nt, Pseudomonas aeruginosa PA01
ccggcguccucgg

SEQ ID NO: 3424689 - RNA, 18 nt, Pseudomonas aeruginosa PA01
ccggcguccucggagagc

SEQ ID NO: 3424690 - RNA, 15 nt, Pseudomonas aeruginosa PA01
ccggcgucggcgagc

SEQ ID NO: 3424691 - RNA, 13 nt, Pseudomonas aeruginosa PA01
ccggcgucggcgc

SEQ ID NO: 3424692 - RNA, 15 nt, Pseudomonas aeruginosa PA01
ccggcgucggcgcgg

SEQ ID NO: 3424693 - RNA, 16 nt, Pseudomonas aeruginosa PA01
ccggcgucggcgcggg

SEQ ID NO: 3424694 - RNA, 13 nt, Pseudomonas aeruginosa PA01
ccgggaacacguc

SEQ ID NO: 3424695 - RNA, 18 nt, Pseudomonas aeruginosa PA01
ccgggaagcaccgacucg

SEQ ID NO: 3424696 - RNA, 22 nt, Pseudomonas aeruginosa PA01
ccgggaagcaccgacucgcccu

SEQ ID NO: 3424697 - RNA, 20 nt, Pseudomonas aeruginosa PA01
ccgggaagccgcucggcgua

SEQ ID NO: 3424698 - RNA, 17 nt, Pseudomonas aeruginosa PA01
ccgggaagcgcaggccg

SEQ ID NO: 3424699 - RNA, 23 nt, Pseudomonas aeruginosa PA01
ccgggaagcgcaggccgccggcg

SEQ ID NO: 3424700 - RNA, 19 nt, Pseudomonas aeruginosa PA01
ccgggaaggauuccacccg

SEQ ID NO: 3424701 - RNA, 14 nt, Pseudomonas aeruginosa PA01
ccgggaaggccuga

SEQ ID NO: 3424702 - RNA, 19 nt, Pseudomonas aeruginosa PA01
ccgggaauccccaguagcg

SEQ ID NO: 3424703 - RNA, 20 nt, Pseudomonas aeruginosa PA01
ccgggaaucgccagcaggcu

SEQ ID NO: 3424704 - RNA, 18 nt, Pseudomonas aeruginosa PA01
ccgggaaugcucagcacg

SEQ ID NO: 3424705 - RNA, 13 nt, Pseudomonas aeruginosa PA01
ccgggaauggaga

SEQ ID NO: 3424706 - RNA, 21 nt, Pseudomonas aeruginosa PA01
ccgggaccacgcucaggucgg

SEQ ID NO: 3424707 - RNA, 18 nt, Pseudomonas aeruginosa PA01
ccgggacgaagcggaagc

SEQ ID NO: 3424708 - RNA, 18 nt, Pseudomonas aeruginosa PA01
ccgggagcaucuggcccg

SEQ ID NO: 3424709 - RNA, 13 nt, Pseudomonas aeruginosa PA01
ccgggagcggccg

SEQ ID NO: 3424710 - RNA, 16 nt, Pseudomonas aeruginosa PA01
ccgggagcggccgugc

SEQ ID NO: 3424711 - RNA, 14 nt, Pseudomonas aeruginosa PA01
ccgggaggcgccgc

SEQ ID NO: 3424712 - RNA, 14 nt, Pseudomonas aeruginosa PA01
ccgggauacagcag

SEQ ID NO: 3424713 - RNA, 16 nt, Pseudomonas aeruginosa PA01
ccgggauacagcagcc

SEQ ID NO: 3424714 - RNA, 21 nt, Pseudomonas aeruginosa PA01
ccgggaucaccucgaaccccu

SEQ ID NO: 3424715 - RNA, 16 nt, Pseudomonas aeruginosa PA01
ccgggaucuccucgac

SEQ ID NO: 3424716 - RNA, 20 nt, Pseudomonas aeruginosa PA01
ccgggaucuccucgacggcg

SEQ ID NO: 3424717 - RNA, 14 nt, Pseudomonas aeruginosa PA01
ccgggaucugccgg

SEQ ID NO: 3424718 - RNA, 23 nt, Pseudomonas aeruginosa PA01
ccgggaucuggcccugcaacagg

SEQ ID NO: 3424719 - RNA, 16 nt, Pseudomonas aeruginosa PA01
ccgggaugaacccggc

SEQ ID NO: 3424720 - RNA, 18 nt, Pseudomonas aeruginosa PA01
ccgggaugaacugcagcu

SEQ ID NO: 3424721 - RNA, 16 nt, Pseudomonas aeruginosa PA01
ccgggaugccggugcu

SEQ ID NO: 3424722 - RNA, 19 nt, Pseudomonas aeruginosa PA01
ccgggaugcucaccgcgcu

SEQ ID NO: 3424723 - RNA, 19 nt, Pseudomonas aeruginosa PA01
ccgggauuguugcggcggg

SEQ ID NO: 3424724 - RNA, 16 nt, Pseudomonas aeruginosa PA01
ccgggcaacgccaggc

SEQ ID NO: 3424725 - RNA, 17 nt, Pseudomonas aeruginosa PA01
ccgggcaacgccaggcc

SEQ ID NO: 3424726 - RNA, 17 nt, Pseudomonas aeruginosa PA01
ccgggcaacgcgcagag

SEQ ID NO: 3424727 - RNA, 20 nt, Pseudomonas aeruginosa PA01
ccgggcaacgcgcagaggcg

SEQ ID NO: 3424728 - RNA, 18 nt, Pseudomonas aeruginosa PA01
ccgggcaacugaucagcc

SEQ ID NO: 3424729 - RNA, 20 nt, Pseudomonas aeruginosa PA01
ccgggcaacugaucagccgg

SEQ ID NO: 3424730 - RNA, 21 nt, Pseudomonas aeruginosa PA01
ccgggcaacugaucagccggg

SEQ ID NO: 3424731 - RNA, 14 nt, Pseudomonas aeruginosa PA01
ccgggcaacugccg

SEQ ID NO: 3424732 - RNA, 19 nt, Pseudomonas aeruginosa PA01
ccgggcaccccgagcggcg

SEQ ID NO: 3424733 - RNA, 22 nt, Pseudomonas aeruginosa PA01
ccgggcaccccgagcggcgcga

SEQ ID NO: 3424734 - RNA, 23 nt, Pseudomonas aeruginosa PA01
ccgggcacgcauagcgcgcugua

SEQ ID NO: 3424735 - RNA, 20 nt, Pseudomonas aeruginosa PA01
ccgggcacggaaucggacga

SEQ ID NO: 3424736 - RNA, 16 nt, Pseudomonas aeruginosa PA01
ccgggcagaccagcag

SEQ ID NO: 3424737 - RNA, 17 nt, Pseudomonas aeruginosa PA01
ccgggcagaccagcagc

SEQ ID NO: 3424738 - RNA, 18 nt, Pseudomonas aeruginosa PA01
ccgggcagaccagcagcg

SEQ ID NO: 3424739 - RNA, 13 nt, Pseudomonas aeruginosa PA01
ccgggcagcagcc

SEQ ID NO: 3424740 - RNA, 15 nt, Pseudomonas aeruginosa PA01
ccgggcagcagccgg

SEQ ID NO: 3424741 - RNA, 16 nt, Pseudomonas aeruginosa PA01
ccgggcagcagccgga

SEQ ID NO: 3424742 - RNA, 22 nt, Pseudomonas aeruginosa PA01
ccgggcagcagccggaccagcc

SEQ ID NO: 3424743 - RNA, 14 nt, Pseudomonas aeruginosa PA01
ccgggcagcggcgc

SEQ ID NO: 3424744 - RNA, 15 nt, Pseudomonas aeruginosa PA01
ccgggcagcggcgca

SEQ ID NO: 3424745 - RNA, 15 nt, Pseudomonas aeruginosa PA01
ccgggcaucaugccg

SEQ ID NO: 3424746 - RNA, 16 nt, Pseudomonas aeruginosa PA01
ccgggcaucaugccga

SEQ ID NO: 3424747 - RNA, 15 nt, Pseudomonas aeruginosa PA01
ccgggcaucgccgac

SEQ ID NO: 3424748 - RNA, 16 nt, Pseudomonas aeruginosa PA01
ccgggcaucgccgacc

SEQ ID NO: 3424749 - RNA, 19 nt, Pseudomonas aeruginosa PA01
ccgggcaugccgugggcgc

SEQ ID NO: 3424750 - RNA, 21 nt, Pseudomonas aeruginosa PA01
ccgggcaugccgugggcgccg

SEQ ID NO: 3424751 - RNA, 16 nt, Pseudomonas aeruginosa PA01
ccgggcauucgcagcg

SEQ ID NO: 3424752 - RNA, 15 nt, Pseudomonas aeruginosa PA01
ccgggcauuuccucg

SEQ ID NO: 3424753 - RNA, 23 nt, Pseudomonas aeruginosa PA01
ccgggccagcuccagcaccggcg

SEQ ID NO: 3424754 - RNA, 17 nt, Pseudomonas aeruginosa PA01
ccgggccagcuccgccu

SEQ ID NO: 3424755 - RNA, 16 nt, Pseudomonas aeruginosa PA01
ccgggccaucgcggaa

SEQ ID NO: 3424756 - RNA, 16 nt, Pseudomonas aeruginosa PA01
ccgggcccaagccgag

SEQ ID NO: 3424757 - RNA, 14 nt, Pseudomonas aeruginosa PA01
ccgggcccugcuuc

SEQ ID NO: 3424758 - RNA, 19 nt, Pseudomonas aeruginosa PA01
ccgggcccugcuucgaacg

SEQ ID NO: 3424759 - RNA, 14 nt, Pseudomonas aeruginosa PA01
ccgggccgaccugc

SEQ ID NO: 3424760 - RNA, 20 nt, Pseudomonas aeruginosa PA01
ccgggccgaccugcccgcug

SEQ ID NO: 3424761 - RNA, 19 nt, Pseudomonas aeruginosa PA01
ccgggccgaucaccaccug

SEQ ID NO: 3424762 - RNA, 19 nt, Pseudomonas aeruginosa PA01
ccgggccgaucuucgccga

SEQ ID NO: 3424763 - RNA, 15 nt, Pseudomonas aeruginosa PA01
ccgggccgcagcgca

SEQ ID NO: 3424764 - RNA, 17 nt, Pseudomonas aeruginosa PA01
ccgggccgcagcgcagc

SEQ ID NO: 3424765 - RNA, 23 nt, Pseudomonas aeruginosa PA01
ccgggccgccuugcgcagcaacg

SEQ ID NO: 3424766 - RNA, 12 nt, Pseudomonas aeruginosa PA01
ccgggccgcgca

SEQ ID NO: 3424767 - RNA, 15 nt, Pseudomonas aeruginosa PA01
ccgggccggccaggg

SEQ ID NO: 3424768 - RNA, 14 nt, Pseudomonas aeruginosa PA01
ccgggccgucgggc

SEQ ID NO: 3424769 - RNA, 16 nt, Pseudomonas aeruginosa PA01
ccgggccgucgggcau

SEQ ID NO: 3424770 - RNA, 17 nt, Pseudomonas aeruginosa PA01
ccgggccuccuggcggc

SEQ ID NO: 3424771 - RNA, 18 nt, Pseudomonas aeruginosa PA01
ccgggccuccuggcggcg

SEQ ID NO: 3424772 - RNA, 13 nt, Pseudomonas aeruginosa PA01
ccgggccucggca

SEQ ID NO: 3424773 - RNA, 19 nt, Pseudomonas aeruginosa PA01
ccgggccuggugcacgccg

SEQ ID NO: 3424774 - RNA, 22 nt, Pseudomonas aeruginosa PA01
ccgggccuggugcacgccgaug

SEQ ID NO: 3424775 - RNA, 20 nt, Pseudomonas aeruginosa PA01
ccgggccuuucuuuucugcc

SEQ ID NO: 3424776 - RNA, 15 nt, Pseudomonas aeruginosa PA01
ccgggcgaccugcuc

SEQ ID NO: 3424777 - RNA, 21 nt, Pseudomonas aeruginosa PA01
ccgggcgcaacccugcccagu

SEQ ID NO: 3424778 - RNA, 20 nt, Pseudomonas aeruginosa PA01
ccgggcgccaccgauagcgg

SEQ ID NO: 3424779 - RNA, 14 nt, Pseudomonas aeruginosa PA01
ccgggcgccaccgc

SEQ ID NO: 3424780 - RNA, 14 nt, Pseudomonas aeruginosa PA01
ccgggcgcccggcc

SEQ ID NO: 3424781 - RNA, 15 nt, Pseudomonas aeruginosa PA01
ccgggcgcccggccg

SEQ ID NO: 3424782 - RNA, 20 nt, Pseudomonas aeruginosa PA01
ccgggcgcgcgccucagcgg

SEQ ID NO: 3424783 - RNA, 13 nt, Pseudomonas aeruginosa PA01
ccgggcgcgcugg

SEQ ID NO: 3424784 - RNA, 20 nt, Pseudomonas aeruginosa PA01
ccgggcgcgcuggucguucu

SEQ ID NO: 3424785 - RNA, 15 nt, Pseudomonas aeruginosa PA01
ccgggcgcggcuggu

SEQ ID NO: 3424786 - RNA, 22 nt, Pseudomonas aeruginosa PA01
ccgggcgcggcuggugcgaaaa

SEQ ID NO: 3424787 - RNA, 16 nt, Pseudomonas aeruginosa PA01
ccgggcggaggcgagg

SEQ ID NO: 3424788 - RNA, 18 nt, Pseudomonas aeruginosa PA01
ccgggcggaggcgagguc

SEQ ID NO: 3424789 - RNA, 19 nt, Pseudomonas aeruginosa PA01
ccgggcggcaggcgccggc

SEQ ID NO: 3424790 - RNA, 20 nt, Pseudomonas aeruginosa PA01
ccgggcggcaggcgccggcc

SEQ ID NO: 3424791 - RNA, 21 nt, Pseudomonas aeruginosa PA01
ccgggcggcaggcgccggccg

SEQ ID NO: 3424792 - RNA, 13 nt, Pseudomonas aeruginosa PA01
ccgggcggcgcgg

SEQ ID NO: 3424793 - RNA, 16 nt, Pseudomonas aeruginosa PA01
ccgggcggcgcggcgc

SEQ ID NO: 3424794 - RNA, 17 nt, Pseudomonas aeruginosa PA01
ccgggcggcgcggcgca

SEQ ID NO: 3424795 - RNA, 13 nt, Pseudomonas aeruginosa PA01
ccgggcggcggcg

SEQ ID NO: 3424796 - RNA, 22 nt, Pseudomonas aeruginosa PA01
ccgggcggcggcgcuauccgcc

SEQ ID NO: 3424797 - RNA, 15 nt, Pseudomonas aeruginosa PA01
ccgggucggucacga

SEQ ID NO: 3424798 - RNA, 20 nt, Pseudomonas aeruginosa PA01
ccgggucguacaccagaugg

SEQ ID NO: 3424799 - RNA, 21 nt, Pseudomonas aeruginosa PA01
ccgggucguacaccagauggc

SEQ ID NO: 3424800 - RNA, 18 nt, Pseudomonas aeruginosa PA01
ccgggucgucggucggcc

SEQ ID NO: 3424801 - RNA, 20 nt, Pseudomonas aeruginosa PA01
ccgggucgucggucggccag

SEQ ID NO: 3424802 - RNA, 18 nt, Pseudomonas aeruginosa PA01
ccgggucgugcccgagcg

SEQ ID NO: 3424803 - RNA, 13 nt, Pseudomonas aeruginosa PA01
ccgggucugggga

SEQ ID NO: 3424804 - RNA, 15 nt, Pseudomonas aeruginosa PA01
ccgggugaccgugcg

SEQ ID NO: 3424805 - RNA, 16 nt, Pseudomonas aeruginosa PA01
ccgggugaccgugcgg

SEQ ID NO: 3424806 - RNA, 19 nt, Pseudomonas aeruginosa PA01
ccgggugaccgugcggguc

SEQ ID NO: 3424807 - RNA, 13 nt, Pseudomonas aeruginosa PA01
ccgggugacggcg

SEQ ID NO: 3424808 - RNA, 21 nt, Pseudomonas aeruginosa PA01
ccgggugcagguucaccgccu

SEQ ID NO: 3424809 - RNA, 16 nt, Pseudomonas aeruginosa PA01
ccgggugccccaggcg

SEQ ID NO: 3424810 - RNA, 14 nt, Pseudomonas aeruginosa PA01
ccgggugccuuccg

SEQ ID NO: 3424811 - RNA, 23 nt, Pseudomonas aeruginosa PA01
ccgggugccuuccgcgcccaggc

SEQ ID NO: 3424812 - RNA, 15 nt, Pseudomonas aeruginosa PA01
ccggguggaacgagg

SEQ ID NO: 3424813 - RNA, 16 nt, Pseudomonas aeruginosa PA01
ccggguggaacgaggc

SEQ ID NO: 3424814 - RNA, 19 nt, Pseudomonas aeruginosa PA01
ccggguggaacgaggcgac

SEQ ID NO: 3424815 - RNA, 21 nt, Pseudomonas aeruginosa PA01
ccggguggagaggcgugcugg

SEQ ID NO: 3424816 - RNA, 18 nt, Pseudomonas aeruginosa PA01
ccggguggauaucgucgg

SEQ ID NO: 3424817 - RNA, 15 nt, Pseudomonas aeruginosa PA01
ccggguguuuuuccu

SEQ ID NO: 3424818 - RNA, 23 nt, Pseudomonas aeruginosa PA01
ccggguucccaguugcugggcga

SEQ ID NO: 3424819 - RNA, 15 nt, Pseudomonas aeruginosa PA01
ccggguucugcucga

SEQ ID NO: 3424820 - RNA, 23 nt, Pseudomonas aeruginosa PA01
ccggguucugcucgaacaucagc

SEQ ID NO: 3424821 - RNA, 18 nt, Pseudomonas aeruginosa PA01
ccggguugacccagagcc

SEQ ID NO: 3424822 - RNA, 22 nt, Pseudomonas aeruginosa PA01
ccggguugaccgccagacaggc

SEQ ID NO: 3424823 - RNA, 16 nt, Pseudomonas aeruginosa PA01
ccggguugaugccgag

SEQ ID NO: 3424824 - RNA, 21 nt, Pseudomonas aeruginosa PA01
ccggguugcccucgcagccgg

SEQ ID NO: 3424825 - RNA, 15 nt, Pseudomonas aeruginosa PA01
ccggguugccgcugg

SEQ ID NO: 3424826 - RNA, 16 nt, Pseudomonas aeruginosa PA01
ccggguugccguagcg

SEQ ID NO: 3424827 - RNA, 17 nt, Pseudomonas aeruginosa PA01
ccggguuggcgcaggcc

SEQ ID NO: 3424828 - RNA, 21 nt, Pseudomonas aeruginosa PA01
ccggguugguggccgcgccgc

SEQ ID NO: 3424829 - RNA, 23 nt, Pseudomonas aeruginosa PA01
ccggguugguggccgcgccgccc

SEQ ID NO: 3424830 - RNA, 20 nt, Pseudomonas aeruginosa PA01
ccggguuguccaggcgaugg

SEQ ID NO: 3424831 - RNA, 22 nt, Pseudomonas aeruginosa PA01
ccggguuuccgugugcagcagg

SEQ ID NO: 3424832 - RNA, 23 nt, Pseudomonas aeruginosa PA01
ccggguuuccgugugcagcaggg

SEQ ID NO: 3424833 - RNA, 18 nt, Pseudomonas aeruginosa PA01
ccggguuuccugcccgac

SEQ ID NO: 3424834 - RNA, 20 nt, Pseudomonas aeruginosa PA01
ccggguuuccugcccgaccg

SEQ ID NO: 3424835 - RNA, 17 nt, Pseudomonas aeruginosa PA01
ccggguuucgucgguca

SEQ ID NO: 3424836 - RNA, 13 nt, Pseudomonas aeruginosa PA01
ccgguacagcgcc

SEQ ID NO: 3424837 - RNA, 16 nt, Pseudomonas aeruginosa PA01
ccgguacagcgccugg

SEQ ID NO: 3424838 - RNA, 21 nt, Pseudomonas aeruginosa PA01
ccgguacagcgccuggucggc

SEQ ID NO: 3424839 - RNA, 22 nt, Pseudomonas aeruginosa PA01
ccgguacagcgccuggucggcg

SEQ ID NO: 3424840 - RNA, 22 nt, Pseudomonas aeruginosa PA01
ccgguacccguacgcugccagg

SEQ ID NO: 3424841 - RNA, 23 nt, Pseudomonas aeruginosa PA01
ccgguacccguacgcugccaggu

SEQ ID NO: 3424842 - RNA, 18 nt, Pseudomonas aeruginosa PA01
ccgguacgcaccagcggu

SEQ ID NO: 3424843 - RNA, 17 nt, Pseudomonas aeruginosa PA01
ccgguacgcucaccacc

SEQ ID NO: 3424844 - RNA, 13 nt, Pseudomonas aeruginosa PA01
ccgguacugcugg

SEQ ID NO: 3424845 - RNA, 16 nt, Pseudomonas aeruginosa PA01
ccgguagacgccuccc

SEQ ID NO: 3424846 - RNA, 17 nt, Pseudomonas aeruginosa PA01
ccgguagacgccuccca

SEQ ID NO: 3424847 - RNA, 14 nt, Pseudomonas aeruginosa PA01
ccgguagccggcga

SEQ ID NO: 3424848 - RNA, 15 nt, Pseudomonas aeruginosa PA01
ccgguagccggcgau

SEQ ID NO: 3424849 - RNA, 14 nt, Pseudomonas aeruginosa PA01
ccgguagcgcgccu

SEQ ID NO: 3424850 - RNA, 15 nt, Pseudomonas aeruginosa PA01
ccgguagcgcgccug

SEQ ID NO: 3424851 - RNA, 17 nt, Pseudomonas aeruginosa PA01
ccgguagcggcgcaccg

SEQ ID NO: 3424852 - RNA, 15 nt, Pseudomonas aeruginosa PA01
ccgguaggggccgac

SEQ ID NO: 3424853 - RNA, 21 nt, Pseudomonas aeruginosa PA01
ccgguaguucgcugaccgcga

SEQ ID NO: 3424854 - RNA, 16 nt, Pseudomonas aeruginosa PA01
ccgguaucccggcuga

SEQ ID NO: 3424855 - RNA, 21 nt, Pseudomonas aeruginosa PA01
ccgguaucccggcugagcgcc

SEQ ID NO: 3424856 - RNA, 19 nt, Pseudomonas aeruginosa PA01
ccgguauucagccagagcc

SEQ ID NO: 3424857 - RNA, 20 nt, Pseudomonas aeruginosa PA01
ccggucaaccgcgggcgagg

SEQ ID NO: 3424858 - RNA, 17 nt, Pseudomonas aeruginosa PA01
ccggucaccacccagcc

SEQ ID NO: 3424859 - RNA, 19 nt, Pseudomonas aeruginosa PA01
ccggucacgcaggcgcugg

SEQ ID NO: 3424860 - RNA, 20 nt, Pseudomonas aeruginosa PA01
ccggucacgcaggcgcuggc

SEQ ID NO: 3424861 - RNA, 21 nt, Pseudomonas aeruginosa PA01
ccggucacgcaggcgcuggcc

SEQ ID NO: 3424862 - RNA, 15 nt, Pseudomonas aeruginosa PA01
ccggucagcagcagg

SEQ ID NO: 3424863 - RNA, 19 nt, Pseudomonas aeruginosa PA01
ccggucagcuucgccgccc

SEQ ID NO: 3424864 - RNA, 20 nt, Pseudomonas aeruginosa PA01
ccggucagcuucgccgcccu

SEQ ID NO: 3424865 - RNA, 21 nt, Pseudomonas aeruginosa PA01
ccggucagcuucgccgcccug

SEQ ID NO: 3424866 - RNA, 22 nt, Pseudomonas aeruginosa PA01
ccggucagcuucgccgcccugg

SEQ ID NO: 3424867 - RNA, 23 nt, Pseudomonas aeruginosa PA01
ccggucagcuucgccgcccugga

SEQ ID NO: 3424868 - RNA, 13 nt, Pseudomonas aeruginosa PA01
ccggucaggccga

SEQ ID NO: 3424869 - RNA, 14 nt, Pseudomonas aeruginosa PA01
ccggucaggccgau

SEQ ID NO: 3424870 - RNA, 21 nt, Pseudomonas aeruginosa PA01
ccggucaggccgaucaccacc

SEQ ID NO: 3424871 - RNA, 15 nt, Pseudomonas aeruginosa PA01
ccggucaggcgcccg

SEQ ID NO: 3424872 - RNA, 17 nt, Pseudomonas aeruginosa PA01
ccggucaggcgcccggu

SEQ ID NO: 3424873 - RNA, 20 nt, Pseudomonas aeruginosa PA01
ccggucaggcuggugccgcu

SEQ ID NO: 3424874 - RNA, 18 nt, Pseudomonas aeruginosa PA01
ccggucagguaggcaucg

SEQ ID NO: 3424875 - RNA, 19 nt, Pseudomonas aeruginosa PA01
ccggucauggugccgagca

SEQ ID NO: 3424876 - RNA, 16 nt, Pseudomonas aeruginosa PA01
ccggucccagguagcg

SEQ ID NO: 3424877 - RNA, 20 nt, Pseudomonas aeruginosa PA01
ccggucccagguagcgcugc

SEQ ID NO: 3424878 - RNA, 24 nt, Pseudomonas aeruginosa PA01
ccggucccagguagcgcugcgcca

SEQ ID NO: 3424879 - RNA, 19 nt, Pseudomonas aeruginosa PA01
ccgguccgacaaucagcgg

SEQ ID NO: 3424880 - RNA, 21 nt, Pseudomonas aeruginosa PA01
ccgguccgacaaucagcggcg

SEQ ID NO: 3424881 - RNA, 21 nt, Pseudomonas aeruginosa PA01
ccgguccggugaaccugacca

SEQ ID NO: 3424882 - RNA, 12 nt, Pseudomonas aeruginosa PA01
ccgguccucgac

SEQ ID NO: 3424883 - RNA, 16 nt, Pseudomonas aeruginosa PA01
ccgguccucgcccguc

SEQ ID NO: 3424884 - RNA, 22 nt, Pseudomonas aeruginosa PA01
ccgguccucgcccgucacuuca

SEQ ID NO: 3424885 - RNA, 14 nt, Pseudomonas aeruginosa PA01
ccggucgaaccccu

SEQ ID NO: 3424886 - RNA, 13 nt, Pseudomonas aeruginosa PA01
ccggucgacggcg

SEQ ID NO: 3424887 - RNA, 19 nt, Pseudomonas aeruginosa PA01
ccggucgagguugcgcggc

SEQ ID NO: 3424888 - RNA, 20 nt, Pseudomonas aeruginosa PA01
ccggucgagguugcgcggca

SEQ ID NO: 3424889 - RNA, 22 nt, Pseudomonas aeruginosa PA01
ccggucgagguugcgcggcagg

SEQ ID NO: 3424890 - RNA, 17 nt, Pseudomonas aeruginosa PA01
ccggucgcaccgccagc

SEQ ID NO: 3424891 - RNA, 18 nt, Pseudomonas aeruginosa PA01
ccggucgcaccgccagca

SEQ ID NO: 3424892 - RNA, 19 nt, Pseudomonas aeruginosa PA01
ccggucgcgcucaggcgca

SEQ ID NO: 3424893 - RNA, 12 nt, Pseudomonas aeruginosa PA01
ccggucgcgcug

SEQ ID NO: 3424894 - RNA, 15 nt, Pseudomonas aeruginosa PA01
ccggucgcuguagac

SEQ ID NO: 3424895 - RNA, 21 nt, Pseudomonas aeruginosa PA01
ccggucgcuuuuuccgcugcc

SEQ ID NO: 3424896 - RNA, 22 nt, Pseudomonas aeruginosa PA01
ccggucgcuuuuuccgcugccg

SEQ ID NO: 3424897 - RNA, 20 nt, Pseudomonas aeruginosa PA01
ccggucggaacgaccacgcc

SEQ ID NO: 3424898 - RNA, 20 nt, Pseudomonas aeruginosa PA01
ccgguugccuucgucgcugg

SEQ ID NO: 3424899 - RNA, 15 nt, Pseudomonas aeruginosa PA01
ccgguugcggcgccg

SEQ ID NO: 3424900 - RNA, 15 nt, Pseudomonas aeruginosa PA01
ccgguugcugcugcg

SEQ ID NO: 3424901 - RNA, 21 nt, Pseudomonas aeruginosa PA01
ccgguugcugcuugcgcgcgg

SEQ ID NO: 3424902 - RNA, 22 nt, Pseudomonas aeruginosa PA01
ccgguugcugcuugcgcgcggc

SEQ ID NO: 3424903 - RNA, 15 nt, Pseudomonas aeruginosa PA01
ccgguuggcgcccca

SEQ ID NO: 3424904 - RNA, 22 nt, Pseudomonas aeruginosa PA01
ccgguuggcuacccgcagggcu

SEQ ID NO: 3424905 - RNA, 15 nt, Pseudomonas aeruginosa PA01
ccgguugugcgcccg

SEQ ID NO: 3424906 - RNA, 16 nt, Pseudomonas aeruginosa PA01
ccgguugugcgcccgu

SEQ ID NO: 3424907 - RNA, 16 nt, Pseudomonas aeruginosa PA01
ccgguuucccucgagc

SEQ ID NO: 3424908 - RNA, 20 nt, Pseudomonas aeruginosa PA01
ccgguuucccucgagcaccg

SEQ ID NO: 3424909 - RNA, 15 nt, Pseudomonas aeruginosa PA01
ccgguuucgaccggc

SEQ ID NO: 3424910 - RNA, 16 nt, Pseudomonas aeruginosa PA01
ccgguuucgccaguuc

SEQ ID NO: 3424911 - RNA, 18 nt, Pseudomonas aeruginosa PA01
ccgguuucgccaguucuc

SEQ ID NO: 3424912 - RNA, 16 nt, Pseudomonas aeruginosa PA01
ccgguuugcugaccgg

SEQ ID NO: 3424913 - RNA, 14 nt, Pseudomonas aeruginosa PA01
ccguaagaucgaug

SEQ ID NO: 3424914 - RNA, 23 nt, Pseudomonas aeruginosa PA01
ccguaagaucgaugaugaucgcc

SEQ ID NO: 3424915 - RNA, 18 nt, Pseudomonas aeruginosa PA01
ccguacagcccccgccgg

SEQ ID NO: 3424916 - RNA, 19 nt, Pseudomonas aeruginosa PA01
ccguacagcccccgccggc

SEQ ID NO: 3424917 - RNA, 21 nt, Pseudomonas aeruginosa PA01
ccguacagcccccgccggccg

SEQ ID NO: 3424918 - RNA, 22 nt, Pseudomonas aeruginosa PA01
ccguacagcccccgccggccgg

SEQ ID NO: 3424919 - RNA, 16 nt, Pseudomonas aeruginosa PA01
ccguacaggucggcgc

SEQ ID NO: 3424920 - RNA, 17 nt, Pseudomonas aeruginosa PA01
ccguacaggucggcgcc

SEQ ID NO: 3424921 - RNA, 18 nt, Pseudomonas aeruginosa PA01
ccguacaggucggcgccg

SEQ ID NO: 3424922 - RNA, 19 nt, Pseudomonas aeruginosa PA01
ccguacaggucggcgccgg

SEQ ID NO: 3424923 - RNA, 23 nt, Pseudomonas aeruginosa PA01
ccguaccaagcgagacgccgccc

SEQ ID NO: 3424924 - RNA, 16 nt, Pseudomonas aeruginosa PA01
ccguaccagucgcccg

SEQ ID NO: 3424925 - RNA, 19 nt, Pseudomonas aeruginosa PA01
ccguacucauggccgcagc

SEQ ID NO: 3424926 - RNA, 17 nt, Pseudomonas aeruginosa PA01
ccguagaccaccagcag

SEQ ID NO: 3424927 - RNA, 18 nt, Pseudomonas aeruginosa PA01
ccguagaccaccagcagc

SEQ ID NO: 3424928 - RNA, 21 nt, Pseudomonas aeruginosa PA01
ccguagaccggcuccagggcg

SEQ ID NO: 3424929 - RNA, 22 nt, Pseudomonas aeruginosa PA01
ccguagaccggcuccagggcga

SEQ ID NO: 3424930 - RNA, 19 nt, Pseudomonas aeruginosa PA01
ccguagaggucgccguccu

SEQ ID NO: 3424931 - RNA, 14 nt, Pseudomonas aeruginosa PA01
ccguagaugugcug

SEQ ID NO: 3424932 - RNA, 19 nt, Pseudomonas aeruginosa PA01
ccguagccaugcccggcug

SEQ ID NO: 3424933 - RNA, 21 nt, Pseudomonas aeruginosa PA01
ccguagccggugccgaucucg

SEQ ID NO: 3424934 - RNA, 18 nt, Pseudomonas aeruginosa PA01
ccguagccgucgaacagc

SEQ ID NO: 3424935 - RNA, 17 nt, Pseudomonas aeruginosa PA01
ccguagcgcaguucgcc

SEQ ID NO: 3424936 - RNA, 19 nt, Pseudomonas aeruginosa PA01
ccguagcgcaguucgccgc

SEQ ID NO: 3424937 - RNA, 22 nt, Pseudomonas aeruginosa PA01
ccguagcgcaguucgccgccga

SEQ ID NO: 3424938 - RNA, 12 nt, Pseudomonas aeruginosa PA01
ccguagcggcug

SEQ ID NO: 3424939 - RNA, 22 nt, Pseudomonas aeruginosa PA01
ccguaggccacuucccggcgca

SEQ ID NO: 3424940 - RNA, 18 nt, Pseudomonas aeruginosa PA01
ccguaggcgauggccugg

SEQ ID NO: 3424941 - RNA, 13 nt, Pseudomonas aeruginosa PA01
ccguagggcgaac

SEQ ID NO: 3424942 - RNA, 23 nt, Pseudomonas aeruginosa PA01
ccguagggcgaacaaccgcucgc

SEQ ID NO: 3424943 - RNA, 22 nt, Pseudomonas aeruginosa PA01
ccguagggcgaacaacgccgcc

SEQ ID NO: 3424944 - RNA, 23 nt, Pseudomonas aeruginosa PA01
ccguagggcgaacaacgccgccg

SEQ ID NO: 3424945 - RNA, 21 nt, Pseudomonas aeruginosa PA01
ccguagggcgaauaacgccac

SEQ ID NO: 3424946 - RNA, 14 nt, Pseudomonas aeruginosa PA01
ccguagggcgacgc

SEQ ID NO: 3424947 - RNA, 17 nt, Pseudomonas aeruginosa PA01
ccguagggcgacgcccg

SEQ ID NO: 3424948 - RNA, 12 nt, Pseudomonas aeruginosa PA01
ccguagggcgca

SEQ ID NO: 3424949 - RNA, 18 nt, Pseudomonas aeruginosa PA01
ccguaggugaccgcccag

SEQ ID NO: 3424950 - RNA, 19 nt, Pseudomonas aeruginosa PA01
ccguagugguugcgcacgc

SEQ ID NO: 3424951 - RNA, 18 nt, Pseudomonas aeruginosa PA01
ccguaguucgaaccgugg

SEQ ID NO: 3424952 - RNA, 17 nt, Pseudomonas aeruginosa PA01
ccguauccuccgcgacg

SEQ ID NO: 3424953 - RNA, 19 nt, Pseudomonas aeruginosa PA01
ccguauucgaagcucggca

SEQ ID NO: 3424954 - RNA, 16 nt, Pseudomonas aeruginosa PA01
ccgucaaugcggccug

SEQ ID NO: 3424955 - RNA, 20 nt, Pseudomonas aeruginosa PA01
ccgucaaugcggccugcaac

SEQ ID NO: 3424956 - RNA, 14 nt, Pseudomonas aeruginosa PA01
ccgucaccagcagc

SEQ ID NO: 3424957 - RNA, 18 nt, Pseudomonas aeruginosa PA01
ccgucaccagcagccccg

SEQ ID NO: 3424958 - RNA, 18 nt, Pseudomonas aeruginosa PA01
ccgucacgcggacccagu

SEQ ID NO: 3424959 - RNA, 14 nt, Pseudomonas aeruginosa PA01
ccgucacggccucc

SEQ ID NO: 3424960 - RNA, 16 nt, Pseudomonas aeruginosa PA01
ccgucacggccuccgg

SEQ ID NO: 3424961 - RNA, 20 nt, Pseudomonas aeruginosa PA01
ccgucacggcgaaaccggcc

SEQ ID NO: 3424962 - RNA, 21 nt, Pseudomonas aeruginosa PA01
ccgucacuucacgacaggcgg

SEQ ID NO: 3424963 - RNA, 22 nt, Pseudomonas aeruginosa PA01
ccgucacuucacgacaggcggc

SEQ ID NO: 3424964 - RNA, 13 nt, Pseudomonas aeruginosa PA01
ccgucagccaggc

SEQ ID NO: 3424965 - RNA, 16 nt, Pseudomonas aeruginosa PA01
ccgucagccaggcugg

SEQ ID NO: 3424966 - RNA, 20 nt, Pseudomonas aeruginosa PA01
ccgucaggccuugcgcggcg

SEQ ID NO: 3424967 - RNA, 14 nt, Pseudomonas aeruginosa PA01
ccgucaucgagcag

SEQ ID NO: 3424968 - RNA, 16 nt, Pseudomonas aeruginosa PA01
ccgucaucgagcaguu

SEQ ID NO: 3424969 - RNA, 22 nt, Pseudomonas aeruginosa PA01
ccgucaucgagcaguuccaggc

SEQ ID NO: 3424970 - RNA, 19 nt, Pseudomonas aeruginosa PA01
ccgucaucgcugaccugga

SEQ ID NO: 3424971 - RNA, 21 nt, Pseudomonas aeruginosa PA01
ccguccacaccgagacgugaa

SEQ ID NO: 3424972 - RNA, 13 nt, Pseudomonas aeruginosa PA01
ccguccaccaagc

SEQ ID NO: 3424973 - RNA, 12 nt, Pseudomonas aeruginosa PA01
ccguccaccagc

SEQ ID NO: 3424974 - RNA, 16 nt, Pseudomonas aeruginosa PA01
ccguccaccagccagc

SEQ ID NO: 3424975 - RNA, 19 nt, Pseudomonas aeruginosa PA01
ccguccacggcgcgucggc

SEQ ID NO: 3424976 - RNA, 22 nt, Pseudomonas aeruginosa PA01
ccguccacggcgcgucggcggu

SEQ ID NO: 3424977 - RNA, 12 nt, Pseudomonas aeruginosa PA01
ccguccagccgg

SEQ ID NO: 3424978 - RNA, 14 nt, Pseudomonas aeruginosa PA01
ccguccagccggcg

SEQ ID NO: 3424979 - RNA, 12 nt, Pseudomonas aeruginosa PA01
ccguccagcgcg

SEQ ID NO: 3424980 - RNA, 13 nt, Pseudomonas aeruginosa PA01
ccguccagcgcgc

SEQ ID NO: 3424981 - RNA, 14 nt, Pseudomonas aeruginosa PA01
ccguccagcgcgcc

SEQ ID NO: 3424982 - RNA, 16 nt, Pseudomonas aeruginosa PA01
ccguccagcgcgcccg

SEQ ID NO: 3424983 - RNA, 22 nt, Pseudomonas aeruginosa PA01
ccguccagcgcgcccggcgcca

SEQ ID NO: 3424984 - RNA, 23 nt, Pseudomonas aeruginosa PA01
ccguccagcgcgcccggcgccac

SEQ ID NO: 3424985 - RNA, 15 nt, Pseudomonas aeruginosa PA01
ccguccagcgcgccg

SEQ ID NO: 3424986 - RNA, 15 nt, Pseudomonas aeruginosa PA01
ccguccagcgcuuga

SEQ ID NO: 3424987 - RNA, 13 nt, Pseudomonas aeruginosa PA01
ccguccaggcgcg

SEQ ID NO: 3424988 - RNA, 15 nt, Pseudomonas aeruginosa PA01
ccguccaggcgcgaa

SEQ ID NO: 3424989 - RNA, 17 nt, Pseudomonas aeruginosa PA01
ccguccagugcggcagu

SEQ ID NO: 3424990 - RNA, 16 nt, Pseudomonas aeruginosa PA01
ccgucccacaggccgg

SEQ ID NO: 3424991 - RNA, 18 nt, Pseudomonas aeruginosa PA01
ccgucccacaggccggcu

SEQ ID NO: 3424992 - RNA, 12 nt, Pseudomonas aeruginosa PA01
ccgucccgcgcg

SEQ ID NO: 3424993 - RNA, 16 nt, Pseudomonas aeruginosa PA01
ccgucccgcgcgccga

SEQ ID NO: 3424994 - RNA, 16 nt, Pseudomonas aeruginosa PA01
ccgucccggaguucca

SEQ ID NO: 3424995 - RNA, 14 nt, Pseudomonas aeruginosa PA01
ccgucccugaccag

SEQ ID NO: 3424996 - RNA, 23 nt, Pseudomonas aeruginosa PA01
ccguccgaggauaccgcacggcc

SEQ ID NO: 3424997 - RNA, 24 nt, Pseudomonas aeruginosa PA01
ccguccgaggauaccgcacggccg

SEQ ID NO: 3424998 - RNA, 21 nt, Pseudomonas aeruginosa PA01
ccguccgcagcgccacuucca

SEQ ID NO: 3424999 - RNA, 12 nt, Pseudomonas aeruginosa PA01
ccguccgccagg

SEQ ID NO: 3425000 - RNA, 22 nt, Pseudomonas aeruginosa PA01
ccgucuuccaccagaaggcggg

SEQ ID NO: 3425001 - RNA, 17 nt, Pseudomonas aeruginosa PA01
ccgucuuccagggcggc

SEQ ID NO: 3425002 - RNA, 18 nt, Pseudomonas aeruginosa PA01
ccgucuuccagggcggcg

SEQ ID NO: 3425003 - RNA, 16 nt, Pseudomonas aeruginosa PA01
ccgugaaaagcggcgu

SEQ ID NO: 3425004 - RNA, 18 nt, Pseudomonas aeruginosa PA01
ccgugaccagcauggcgg

SEQ ID NO: 3425005 - RNA, 14 nt, Pseudomonas aeruginosa PA01
ccgugacgaggggc

SEQ ID NO: 3425006 - RNA, 22 nt, Pseudomonas aeruginosa PA01
ccgugacgaggggcugcggagc

SEQ ID NO: 3425007 - RNA, 14 nt, Pseudomonas aeruginosa PA01
ccgugacgucggcg

SEQ ID NO: 3425008 - RNA, 20 nt, Pseudomonas aeruginosa PA01
ccgugagcuuguccagggcg

SEQ ID NO: 3425009 - RNA, 22 nt, Pseudomonas aeruginosa PA01
ccgugagcuuguccagggcgcc

SEQ ID NO: 3425010 - RNA, 16 nt, Pseudomonas aeruginosa PA01
ccgugaggcgcagggg

SEQ ID NO: 3425011 - RNA, 14 nt, Pseudomonas aeruginosa PA01
ccgugaggcgcgcg

SEQ ID NO: 3425012 - RNA, 23 nt, Pseudomonas aeruginosa PA01
ccgugaggcgcgcgccgaacucg

SEQ ID NO: 3425013 - RNA, 20 nt, Pseudomonas aeruginosa PA01
ccgugaucccgcgcgggccg

SEQ ID NO: 3425014 - RNA, 17 nt, Pseudomonas aeruginosa PA01
ccgugaucucgaacucg

SEQ ID NO: 3425015 - RNA, 16 nt, Pseudomonas aeruginosa PA01
ccgugaugcccagcgg

SEQ ID NO: 3425016 - RNA, 17 nt, Pseudomonas aeruginosa PA01
ccgugaugcccagcggc

SEQ ID NO: 3425017 - RNA, 18 nt, Pseudomonas aeruginosa PA01
ccgugcaccgaggcgcgc

SEQ ID NO: 3425018 - RNA, 21 nt, Pseudomonas aeruginosa PA01
ccgugcaccgaggcgcgccga

SEQ ID NO: 3425019 - RNA, 17 nt, Pseudomonas aeruginosa PA01
ccgugcagcagcgaccu

SEQ ID NO: 3425020 - RNA, 14 nt, Pseudomonas aeruginosa PA01
ccgugcagcccucg

SEQ ID NO: 3425021 - RNA, 15 nt, Pseudomonas aeruginosa PA01
ccgugcaucaccggc

SEQ ID NO: 3425022 - RNA, 21 nt, Pseudomonas aeruginosa PA01
ccgugcaucaccggcagcagc

SEQ ID NO: 3425023 - RNA, 22 nt, Pseudomonas aeruginosa PA01
ccgugcaucaccggcagcagcg

SEQ ID NO: 3425024 - RNA, 18 nt, Pseudomonas aeruginosa PA01
ccgugccagagcuugagg

SEQ ID NO: 3425025 - RNA, 14 nt, Pseudomonas aeruginosa PA01
ccgugcccguccua

SEQ ID NO: 3425026 - RNA, 16 nt, Pseudomonas aeruginosa PA01
ccgugccgccggggcg

SEQ ID NO: 3425027 - RNA, 12 nt, Pseudomonas aeruginosa PA01
ccgugccgggcc

SEQ ID NO: 3425028 - RNA, 18 nt, Pseudomonas aeruginosa PA01
ccgugccggucgcgcagc

SEQ ID NO: 3425029 - RNA, 15 nt, Pseudomonas aeruginosa PA01
ccgugccucggcgga

SEQ ID NO: 3425030 - RNA, 18 nt, Pseudomonas aeruginosa PA01
ccgugcgaacacaccgac

SEQ ID NO: 3425031 - RNA, 19 nt, Pseudomonas aeruginosa PA01
ccgugcgaacacaccgacc

SEQ ID NO: 3425032 - RNA, 20 nt, Pseudomonas aeruginosa PA01
ccgugcgaacacaccgaccg

SEQ ID NO: 3425033 - RNA, 16 nt, Pseudomonas aeruginosa PA01
ccgugcgcaccucgcc

SEQ ID NO: 3425034 - RNA, 13 nt, Pseudomonas aeruginosa PA01
ccgugcgccccag

SEQ ID NO: 3425035 - RNA, 12 nt, Pseudomonas aeruginosa PA01
ccgugcgccgcg

SEQ ID NO: 3425036 - RNA, 14 nt, Pseudomonas aeruginosa PA01
ccgugcgccgcggg

SEQ ID NO: 3425037 - RNA, 16 nt, Pseudomonas aeruginosa PA01
ccgugcgcgcggccug

SEQ ID NO: 3425038 - RNA, 20 nt, Pseudomonas aeruginosa PA01
ccgugcgcuccgccaggccg

SEQ ID NO: 3425039 - RNA, 24 nt, Pseudomonas aeruginosa PA01
ccgugcgcuccgccaggccgcgca

SEQ ID NO: 3425040 - RNA, 14 nt, Pseudomonas aeruginosa PA01
ccgugcgcugcgcg

SEQ ID NO: 3425041 - RNA, 20 nt, Pseudomonas aeruginosa PA01
ccgugcggaaaccgcggccg

SEQ ID NO: 3425042 - RNA, 21 nt, Pseudomonas aeruginosa PA01
ccgugcggaaaccgcggccgg

SEQ ID NO: 3425043 - RNA, 23 nt, Pseudomonas aeruginosa PA01
ccgugcggaaaccgcggccggcu

SEQ ID NO: 3425044 - RNA, 18 nt, Pseudomonas aeruginosa PA01
ccgugcggcguucgccgc

SEQ ID NO: 3425045 - RNA, 16 nt, Pseudomonas aeruginosa PA01
ccgugcgggucgaggc

SEQ ID NO: 3425046 - RNA, 12 nt, Pseudomonas aeruginosa PA01
ccgugcuggccg

SEQ ID NO: 3425047 - RNA, 14 nt, Pseudomonas aeruginosa PA01
ccgugcuggccggc

SEQ ID NO: 3425048 - RNA, 16 nt, Pseudomonas aeruginosa PA01
ccgugcuggccggcag

SEQ ID NO: 3425049 - RNA, 19 nt, Pseudomonas aeruginosa PA01
ccgugcuucaucggcccgg

SEQ ID NO: 3425050 - RNA, 22 nt, Pseudomonas aeruginosa PA01
ccgugcuucaucggcccggcuu

SEQ ID NO: 3425051 - RNA, 18 nt, Pseudomonas aeruginosa PA01
ccguggaaaccucgccga

SEQ ID NO: 3425052 - RNA, 19 nt, Pseudomonas aeruginosa PA01
ccguggaaaccucgccgau

SEQ ID NO: 3425053 - RNA, 17 nt, Pseudomonas aeruginosa PA01
ccguggaaccgauggcc

SEQ ID NO: 3425054 - RNA, 16 nt, Pseudomonas aeruginosa PA01
ccguggaacgcagggg

SEQ ID NO: 3425055 - RNA, 18 nt, Pseudomonas aeruginosa PA01
ccguggaccaacagccgg

SEQ ID NO: 3425056 - RNA, 19 nt, Pseudomonas aeruginosa PA01
ccguggaccaacagccggc

SEQ ID NO: 3425057 - RNA, 22 nt, Pseudomonas aeruginosa PA01
ccguggaccaacagccggcggg

SEQ ID NO: 3425058 - RNA, 17 nt, Pseudomonas aeruginosa PA01
ccguggagaggucgccg

SEQ ID NO: 3425059 - RNA, 22 nt, Pseudomonas aeruginosa PA01
ccguggagaggucgccgacacg

SEQ ID NO: 3425060 - RNA, 12 nt, Pseudomonas aeruginosa PA01
ccguggaucgcc

SEQ ID NO: 3425061 - RNA, 22 nt, Pseudomonas aeruginosa PA01
ccguggaucgccauaggaugcc

SEQ ID NO: 3425062 - RNA, 16 nt, Pseudomonas aeruginosa PA01
ccguggaucgcccggc

SEQ ID NO: 3425063 - RNA, 18 nt, Pseudomonas aeruginosa PA01
ccguggaucgcccggcug

SEQ ID NO: 3425064 - RNA, 21 nt, Pseudomonas aeruginosa PA01
ccguggaugucgaggaacagg

SEQ ID NO: 3425065 - RNA, 15 nt, Pseudomonas aeruginosa PA01
ccguggauuucagca

SEQ ID NO: 3425066 - RNA, 14 nt, Pseudomonas aeruginosa PA01
ccguggcaggcgcc

SEQ ID NO: 3425067 - RNA, 22 nt, Pseudomonas aeruginosa PA01
ccguggcaggcgcccggucagg

SEQ ID NO: 3425068 - RNA, 14 nt, Pseudomonas aeruginosa PA01
ccguggcgacgaug

SEQ ID NO: 3425069 - RNA, 20 nt, Pseudomonas aeruginosa PA01
ccguggcgacgaugcgcccc

SEQ ID NO: 3425070 - RNA, 23 nt, Pseudomonas aeruginosa PA01
ccguggcgacgaugcgccccagc

SEQ ID NO: 3425071 - RNA, 18 nt, Pseudomonas aeruginosa PA01
ccguggcgacgcagcacg

SEQ ID NO: 3425072 - RNA, 20 nt, Pseudomonas aeruginosa PA01
ccguggcgacgcagcacggc

SEQ ID NO: 3425073 - RNA, 17 nt, Pseudomonas aeruginosa PA01
ccguggcgccccaggcg

SEQ ID NO: 3425074 - RNA, 13 nt, Pseudomonas aeruginosa PA01
ccguggcgccgca

SEQ ID NO: 3425075 - RNA, 21 nt, Pseudomonas aeruginosa PA01
ccguggcgcgaauccuguccg

SEQ ID NO: 3425076 - RNA, 12 nt, Pseudomonas aeruginosa PA01
ccguggcgcgga

SEQ ID NO: 3425077 - RNA, 22 nt, Pseudomonas aeruginosa PA01
ccguggcgcggacgggccgcgc

SEQ ID NO: 3425078 - RNA, 19 nt, Pseudomonas aeruginosa PA01
ccguggcgcuacgcucgcc

SEQ ID NO: 3425079 - RNA, 17 nt, Pseudomonas aeruginosa PA01
ccguggcgcuggccgaa

SEQ ID NO: 3425080 - RNA, 18 nt, Pseudomonas aeruginosa PA01
ccguggcggccgccgcgc

SEQ ID NO: 3425081 - RNA, 22 nt, Pseudomonas aeruginosa PA01
ccguggcggccgccgcgcagca

SEQ ID NO: 3425082 - RNA, 13 nt, Pseudomonas aeruginosa PA01
ccguggcgggcca

SEQ ID NO: 3425083 - RNA, 16 nt, Pseudomonas aeruginosa PA01
ccguggcgggccagca

SEQ ID NO: 3425084 - RNA, 19 nt, Pseudomonas aeruginosa PA01
ccguggcgggccagcaggc

SEQ ID NO: 3425085 - RNA, 20 nt, Pseudomonas aeruginosa PA01
ccguggcgggccagcaggcg

SEQ ID NO: 3425086 - RNA, 23 nt, Pseudomonas aeruginosa PA01
ccguggcgggccagcaggcgcuc

SEQ ID NO: 3425087 - RNA, 20 nt, Pseudomonas aeruginosa PA01
ccguggcgggccaugcgcuc

SEQ ID NO: 3425088 - RNA, 13 nt, Pseudomonas aeruginosa PA01
ccguggcucggcg

SEQ ID NO: 3425089 - RNA, 16 nt, Pseudomonas aeruginosa PA01
ccguggcucggcggca

SEQ ID NO: 3425090 - RNA, 21 nt, Pseudomonas aeruginosa PA01
ccguggcuggggccggccugg

SEQ ID NO: 3425091 - RNA, 15 nt, Pseudomonas aeruginosa PA01
ccguggcugugcugg

SEQ ID NO: 3425092 - RNA, 17 nt, Pseudomonas aeruginosa PA01
ccguggcugugcuggcc

SEQ ID NO: 3425093 - RNA, 22 nt, Pseudomonas aeruginosa PA01
ccgugggaguccagguacacca

SEQ ID NO: 3425094 - RNA, 17 nt, Pseudomonas aeruginosa PA01
ccgugggaucgccacgc

SEQ ID NO: 3425095 - RNA, 22 nt, Pseudomonas aeruginosa PA01
ccgugggaucgccacgccggcg

SEQ ID NO: 3425096 - RNA, 13 nt, Pseudomonas aeruginosa PA01
ccgugggccggcg

SEQ ID NO: 3425097 - RNA, 15 nt, Pseudomonas aeruginosa PA01
ccgugggccggcgcg

SEQ ID NO: 3425098 - RNA, 16 nt, Pseudomonas aeruginosa PA01
ccgugggccggcgcgc

SEQ ID NO: 3425099 - RNA, 21 nt, Pseudomonas aeruginosa PA01
ccgugggucguugagggcacg

SEQ ID NO: 3425100 - RNA, 17 nt, Pseudomonas aeruginosa PA01
ccgugguagucgagccg

SEQ ID NO: 3425101 - RNA, 18 nt, Pseudomonas aeruginosa PA01
ccgugguagucgagccgg

SEQ ID NO: 3425102 - RNA, 22 nt, Pseudomonas aeruginosa PA01
ccuacgaaggcauauccccucu

SEQ ID NO: 3425103 - RNA, 19 nt, Pseudomonas aeruginosa PA01
ccuacgcaacccgcccggc

SEQ ID NO: 3425104 - RNA, 19 nt, Pseudomonas aeruginosa PA01
ccuacgcggcaccgcuuuc

SEQ ID NO: 3425105 - RNA, 18 nt, Pseudomonas aeruginosa PA01
ccuacggccccaggcugc

SEQ ID NO: 3425106 - RNA, 15 nt, Pseudomonas aeruginosa PA01
ccuacuaccgcuggg

SEQ ID NO: 3425107 - RNA, 19 nt, Pseudomonas aeruginosa PA01
ccuacugggcguggcggcc

SEQ ID NO: 3425108 - RNA, 23 nt, Pseudomonas aeruginosa PA01
ccuacugggcguggcggccgccg

SEQ ID NO: 3425109 - RNA, 20 nt, Pseudomonas aeruginosa PA01
ccuacuugaucagccgcagg

SEQ ID NO: 3425110 - RNA, 23 nt, Pseudomonas aeruginosa PA01
ccuacuugaucagccgcaggcag

SEQ ID NO: 3425111 - RNA, 17 nt, Pseudomonas aeruginosa PA01
ccuaggcgacccggcau

SEQ ID NO: 3425112 - RNA, 14 nt, Pseudomonas aeruginosa PA01
ccuagggucggcgu

SEQ ID NO: 3425113 - RNA, 11 nt, Pseudomonas aeruginosa PA01
ccuauaaugcg

SEQ ID NO: 3425114 - RNA, 18 nt, Pseudomonas aeruginosa PA01
ccuauccacgacgucggc

SEQ ID NO: 3425115 - RNA, 18 nt, Pseudomonas aeruginosa PA01
ccuauggcguuauucgcc

SEQ ID NO: 3425116 - RNA, 20 nt, Pseudomonas aeruginosa PA01
ccucaaccggcguccccuuc

SEQ ID NO: 3425117 - RNA, 13 nt, Pseudomonas aeruginosa PA01
ccucaacgaccgc

SEQ ID NO: 3425118 - RNA, 16 nt, Pseudomonas aeruginosa PA01
ccucaacgaccgccca

SEQ ID NO: 3425119 - RNA, 18 nt, Pseudomonas aeruginosa PA01
ccucaacgaccgcccagg

SEQ ID NO: 3425120 - RNA, 16 nt, Pseudomonas aeruginosa PA01
ccucaaggcaucgcga

SEQ ID NO: 3425121 - RNA, 21 nt, Pseudomonas aeruginosa PA01
ccucaaggugaagugaucgau

SEQ ID NO: 3425122 - RNA, 15 nt, Pseudomonas aeruginosa PA01
ccucaagucuccagc

SEQ ID NO: 3425123 - RNA, 16 nt, Pseudomonas aeruginosa PA01
ccucaagucuccagcg

SEQ ID NO: 3425124 - RNA, 16 nt, Pseudomonas aeruginosa PA01
ccucacaccaccagca

SEQ ID NO: 3425125 - RNA, 14 nt, Pseudomonas aeruginosa PA01
ccucacccugcugg

SEQ ID NO: 3425126 - RNA, 20 nt, Pseudomonas aeruginosa PA01
ccucacggcgcgagaaaaac

SEQ ID NO: 3425127 - RNA, 12 nt, Pseudomonas aeruginosa PA01
ccucacgggccg

SEQ ID NO: 3425128 - RNA, 21 nt, Pseudomonas aeruginosa PA01
ccucacggguguuucggccgc

SEQ ID NO: 3425129 - RNA, 24 nt, Pseudomonas aeruginosa PA01
ccucacggguguuucggccgcugc

SEQ ID NO: 3425130 - RNA, 20 nt, Pseudomonas aeruginosa PA01
ccucacggucgcaggggcuu

SEQ ID NO: 3425131 - RNA, 20 nt, Pseudomonas aeruginosa PA01
ccucagaccacgcccugcgc

SEQ ID NO: 3425132 - RNA, 23 nt, Pseudomonas aeruginosa PA01
ccucagaccacgcccugcgccag

SEQ ID NO: 3425133 - RNA, 18 nt, Pseudomonas aeruginosa PA01
ccucagaggcgaccagcc

SEQ ID NO: 3425134 - RNA, 19 nt, Pseudomonas aeruginosa PA01
ccucagaggcgaccagccg

SEQ ID NO: 3425135 - RNA, 21 nt, Pseudomonas aeruginosa PA01
ccucagaggcgaccagccggg

SEQ ID NO: 3425136 - RNA, 19 nt, Pseudomonas aeruginosa PA01
ccucagagucgcaccggga

SEQ ID NO: 3425137 - RNA, 14 nt, Pseudomonas aeruginosa PA01
ccucagcagcgccg

SEQ ID NO: 3425138 - RNA, 17 nt, Pseudomonas aeruginosa PA01
ccucagcagcgccgccc

SEQ ID NO: 3425139 - RNA, 17 nt, Pseudomonas aeruginosa PA01
ccucagccucacccugc

SEQ ID NO: 3425140 - RNA, 19 nt, Pseudomonas aeruginosa PA01
ccucagccucacccugcug

SEQ ID NO: 3425141 - RNA, 18 nt, Pseudomonas aeruginosa PA01
ccucaggauagccggcgc

SEQ ID NO: 3425142 - RNA, 19 nt, Pseudomonas aeruginosa PA01
ccucaggauagccggcgcg

SEQ ID NO: 3425143 - RNA, 20 nt, Pseudomonas aeruginosa PA01
ccucaggauagccggcgcgu

SEQ ID NO: 3425144 - RNA, 21 nt, Pseudomonas aeruginosa PA01
ccucaggccuggcgcaacagg

SEQ ID NO: 3425145 - RNA, 14 nt, Pseudomonas aeruginosa PA01
ccucaggcgccgcu

SEQ ID NO: 3425146 - RNA, 17 nt, Pseudomonas aeruginosa PA01
ccucaggcgcugcgcgg

SEQ ID NO: 3425147 - RNA, 19 nt, Pseudomonas aeruginosa PA01
ccucaggcgcugcgcggcc

SEQ ID NO: 3425148 - RNA, 15 nt, Pseudomonas aeruginosa PA01
ccucaggggugcagc

SEQ ID NO: 3425149 - RNA, 14 nt, Pseudomonas aeruginosa PA01
ccucaggucggcgc

SEQ ID NO: 3425150 - RNA, 15 nt, Pseudomonas aeruginosa PA01
ccucaggucggcgcc

SEQ ID NO: 3425151 - RNA, 15 nt, Pseudomonas aeruginosa PA01
ccucagugcgggcag

SEQ ID NO: 3425152 - RNA, 16 nt, Pseudomonas aeruginosa PA01
ccucagugcgggcagu

SEQ ID NO: 3425153 - RNA, 22 nt, Pseudomonas aeruginosa PA01
ccucaguuuucuaaccggcguc

SEQ ID NO: 3425154 - RNA, 20 nt, Pseudomonas aeruginosa PA01
ccucauagugcugcggcagg

SEQ ID NO: 3425155 - RNA, 16 nt, Pseudomonas aeruginosa PA01
ccucaucuccugugga

SEQ ID NO: 3425156 - RNA, 17 nt, Pseudomonas aeruginosa PA01
ccucauggcuguagcuc

SEQ ID NO: 3425157 - RNA, 21 nt, Pseudomonas aeruginosa PA01
ccucauucgcucugcgccagg

SEQ ID NO: 3425158 - RNA, 17 nt, Pseudomonas aeruginosa PA01
ccuccaccagcgccggc

SEQ ID NO: 3425159 - RNA, 18 nt, Pseudomonas aeruginosa PA01
ccuccaccagcgccggcg

SEQ ID NO: 3425160 - RNA, 20 nt, Pseudomonas aeruginosa PA01
ccuccaccagcgccggcggc

SEQ ID NO: 3425161 - RNA, 23 nt, Pseudomonas aeruginosa PA01
ccuccacccccaucgcccgcagc

SEQ ID NO: 3425162 - RNA, 17 nt, Pseudomonas aeruginosa PA01
ccuccaccgcuccggcg

SEQ ID NO: 3425163 - RNA, 17 nt, Pseudomonas aeruginosa PA01
ccuccaccucgacccug

SEQ ID NO: 3425164 - RNA, 14 nt, Pseudomonas aeruginosa PA01
ccuccacggcggcc

SEQ ID NO: 3425165 - RNA, 21 nt, Pseudomonas aeruginosa PA01
ccuccagagugcgcagcagcg

SEQ ID NO: 3425166 - RNA, 20 nt, Pseudomonas aeruginosa PA01
ccuccagcaacgccgccccc

SEQ ID NO: 3425167 - RNA, 12 nt, Pseudomonas aeruginosa PA01
ccuccagcacuc

SEQ ID NO: 3425168 - RNA, 19 nt, Pseudomonas aeruginosa PA01
ccuccagcacucgcuccuc

SEQ ID NO: 3425169 - RNA, 21 nt, Pseudomonas aeruginosa PA01
ccuccagcacucgcuccuccg

SEQ ID NO: 3425170 - RNA, 17 nt, Pseudomonas aeruginosa PA01
ccuccagcagacggcug

SEQ ID NO: 3425171 - RNA, 12 nt, Pseudomonas aeruginosa PA01
ccuccagcagcu

SEQ ID NO: 3425172 - RNA, 18 nt, Pseudomonas aeruginosa PA01
ccuccagcaggaccuggc

SEQ ID NO: 3425173 - RNA, 21 nt, Pseudomonas aeruginosa PA01
ccuccagcaggaccuggccgu

SEQ ID NO: 3425174 - RNA, 14 nt, Pseudomonas aeruginosa PA01
ccuccagcauccag

SEQ ID NO: 3425175 - RNA, 18 nt, Pseudomonas aeruginosa PA01
ccuccagcauccagcgau

SEQ ID NO: 3425176 - RNA, 12 nt, Pseudomonas aeruginosa PA01
ccuccagccagc

SEQ ID NO: 3425177 - RNA, 15 nt, Pseudomonas aeruginosa PA01
ccuccagccagcagc

SEQ ID NO: 3425178 - RNA, 21 nt, Pseudomonas aeruginosa PA01
ccuccagccagcagcccggcc

SEQ ID NO: 3425179 - RNA, 12 nt, Pseudomonas aeruginosa PA01
ccuccagccgcg

SEQ ID NO: 3425180 - RNA, 12 nt, Pseudomonas aeruginosa PA01
ccuccagccggc

SEQ ID NO: 3425181 - RNA, 13 nt, Pseudomonas aeruginosa PA01
ccuccagccggcc

SEQ ID NO: 3425182 - RNA, 14 nt, Pseudomonas aeruginosa PA01
ccuccagccggcca

SEQ ID NO: 3425183 - RNA, 24 nt, Pseudomonas aeruginosa PA01
ccuccagccggcgacgcaggacgu

SEQ ID NO: 3425184 - RNA, 14 nt, Pseudomonas aeruginosa PA01
ccuccagcgccgca

SEQ ID NO: 3425185 - RNA, 16 nt, Pseudomonas aeruginosa PA01
ccuccagcgccgccag

SEQ ID NO: 3425186 - RNA, 18 nt, Pseudomonas aeruginosa PA01
ccuccagcgccgccaggc

SEQ ID NO: 3425187 - RNA, 19 nt, Pseudomonas aeruginosa PA01
ccuccagcgccgccaggcg

SEQ ID NO: 3425188 - RNA, 16 nt, Pseudomonas aeruginosa PA01
ccuccagcgccgccuc

SEQ ID NO: 3425189 - RNA, 17 nt, Pseudomonas aeruginosa PA01
ccuccagcgccgccucg

SEQ ID NO: 3425190 - RNA, 18 nt, Pseudomonas aeruginosa PA01
ccuccagcgccucgccga

SEQ ID NO: 3425191 - RNA, 16 nt, Pseudomonas aeruginosa PA01
ccuccagcggcgggaa

SEQ ID NO: 3425192 - RNA, 22 nt, Pseudomonas aeruginosa PA01
ccuccagcgucugccgcuggcg

SEQ ID NO: 3425193 - RNA, 23 nt, Pseudomonas aeruginosa PA01
ccuccagcgucugccgcuggcgg

SEQ ID NO: 3425194 - RNA, 15 nt, Pseudomonas aeruginosa PA01
ccuccagcguggcgg

SEQ ID NO: 3425195 - RNA, 13 nt, Pseudomonas aeruginosa PA01
ccuccagcugcgc

SEQ ID NO: 3425196 - RNA, 14 nt, Pseudomonas aeruginosa PA01
ccuccagcugcgcc

SEQ ID NO: 3425197 - RNA, 19 nt, Pseudomonas aeruginosa PA01
ccuccaggaauccuccgcc

SEQ ID NO: 3425198 - RNA, 21 nt, Pseudomonas aeruginosa PA01
ccuccaggaauccuccgccag

SEQ ID NO: 3425199 - RNA, 21 nt, Pseudomonas aeruginosa PA01
ccuccaggccgaagccgccgg

SEQ ID NO: 3425200 - RNA, 22 nt, Pseudomonas aeruginosa PA01
ccuccaggccgaagccgccggg

SEQ ID NO: 3425201 - RNA, 17 nt, Pseudomonas aeruginosa PA01
ccuccaggccgccggcg

SEQ ID NO: 3425202 - RNA, 12 nt, Pseudomonas aeruginosa PA01
ccuccaggcgcg

SEQ ID NO: 3425203 - RNA, 14 nt, Pseudomonas aeruginosa PA01
ccuccaggcgcgcc

SEQ ID NO: 3425204 - RNA, 19 nt, Pseudomonas aeruginosa PA01
ccucgaggucggccuggcu

SEQ ID NO: 3425205 - RNA, 17 nt, Pseudomonas aeruginosa PA01
ccucgauaaacggcgcu

SEQ ID NO: 3425206 - RNA, 13 nt, Pseudomonas aeruginosa PA01
ccucgaucacccg

SEQ ID NO: 3425207 - RNA, 14 nt, Pseudomonas aeruginosa PA01
ccucgaucaggccu

SEQ ID NO: 3425208 - RNA, 22 nt, Pseudomonas aeruginosa PA01
ccucgaucagugcaucggccgc

SEQ ID NO: 3425209 - RNA, 13 nt, Pseudomonas aeruginosa PA01
ccucgauccgcuc

SEQ ID NO: 3425210 - RNA, 15 nt, Pseudomonas aeruginosa PA01
ccucgauccgcuggg

SEQ ID NO: 3425211 - RNA, 20 nt, Pseudomonas aeruginosa PA01
ccucgaucgccucgggcgag

SEQ ID NO: 3425212 - RNA, 23 nt, Pseudomonas aeruginosa PA01
ccucgaucucguccucggcguag

SEQ ID NO: 3425213 - RNA, 15 nt, Pseudomonas aeruginosa PA01
ccucgaucuucuucc

SEQ ID NO: 3425214 - RNA, 23 nt, Pseudomonas aeruginosa PA01
ccucgaucuucuuccccgccacu

SEQ ID NO: 3425215 - RNA, 16 nt, Pseudomonas aeruginosa PA01
ccucgaugaaacgcag

SEQ ID NO: 3425216 - RNA, 21 nt, Pseudomonas aeruginosa PA01
ccucgaugaacagugcgcccg

SEQ ID NO: 3425217 - RNA, 21 nt, Pseudomonas aeruginosa PA01
ccucgaugagcaugccgcaga

SEQ ID NO: 3425218 - RNA, 19 nt, Pseudomonas aeruginosa PA01
ccucgaugauccgcucgau

SEQ ID NO: 3425219 - RNA, 18 nt, Pseudomonas aeruginosa PA01
ccucgaugaucgccgggu

SEQ ID NO: 3425220 - RNA, 19 nt, Pseudomonas aeruginosa PA01
ccucgaugaucgccgggug

SEQ ID NO: 3425221 - RNA, 15 nt, Pseudomonas aeruginosa PA01
ccucgaugcccgccu

SEQ ID NO: 3425222 - RNA, 13 nt, Pseudomonas aeruginosa PA01
ccucgauggcggc

SEQ ID NO: 3425223 - RNA, 14 nt, Pseudomonas aeruginosa PA01
ccucgauggcggca

SEQ ID NO: 3425224 - RNA, 16 nt, Pseudomonas aeruginosa PA01
ccucgauggcggcggc

SEQ ID NO: 3425225 - RNA, 13 nt, Pseudomonas aeruginosa PA01
ccucgauggcgug

SEQ ID NO: 3425226 - RNA, 20 nt, Pseudomonas aeruginosa PA01
ccucgauggcguguucgucg

SEQ ID NO: 3425227 - RNA, 22 nt, Pseudomonas aeruginosa PA01
ccucgauguaggccucggccug

SEQ ID NO: 3425228 - RNA, 14 nt, Pseudomonas aeruginosa PA01
ccucgauguccggg

SEQ ID NO: 3425229 - RNA, 15 nt, Pseudomonas aeruginosa PA01
ccucgauguccggga

SEQ ID NO: 3425230 - RNA, 23 nt, Pseudomonas aeruginosa PA01
ccucgaugugcuugagucgcagg

SEQ ID NO: 3425231 - RNA, 19 nt, Pseudomonas aeruginosa PA01
ccucgcaaaggucggcgaa

SEQ ID NO: 3425232 - RNA, 16 nt, Pseudomonas aeruginosa PA01
ccucgcagagcgccag

SEQ ID NO: 3425233 - RNA, 17 nt, Pseudomonas aeruginosa PA01
ccucgcagagcgccagc

SEQ ID NO: 3425234 - RNA, 21 nt, Pseudomonas aeruginosa PA01
ccucgcagagcgccagccagc

SEQ ID NO: 3425235 - RNA, 16 nt, Pseudomonas aeruginosa PA01
ccucgcagccggcggc

SEQ ID NO: 3425236 - RNA, 20 nt, Pseudomonas aeruginosa PA01
ccucgcaguacagcucggcg

SEQ ID NO: 3425237 - RNA, 14 nt, Pseudomonas aeruginosa PA01
ccucgccaaccagg

SEQ ID NO: 3425238 - RNA, 17 nt, Pseudomonas aeruginosa PA01
ccucgccaagcuggcga

SEQ ID NO: 3425239 - RNA, 16 nt, Pseudomonas aeruginosa PA01
ccucgccaggcuggcu

SEQ ID NO: 3425240 - RNA, 16 nt, Pseudomonas aeruginosa PA01
ccucgccauucucgcc

SEQ ID NO: 3425241 - RNA, 17 nt, Pseudomonas aeruginosa PA01
ccucgccauucucgcca

SEQ ID NO: 3425242 - RNA, 21 nt, Pseudomonas aeruginosa PA01
ccucgcccaggugcgccgagc

SEQ ID NO: 3425243 - RNA, 16 nt, Pseudomonas aeruginosa PA01
ccucgcccaucgccag

SEQ ID NO: 3425244 - RNA, 13 nt, Pseudomonas aeruginosa PA01
ccucgccccgccg

SEQ ID NO: 3425245 - RNA, 14 nt, Pseudomonas aeruginosa PA01
ccucgccccgccgg

SEQ ID NO: 3425246 - RNA, 18 nt, Pseudomonas aeruginosa PA01
ccucgccccgccgggagc

SEQ ID NO: 3425247 - RNA, 20 nt, Pseudomonas aeruginosa PA01
ccucgcccucgaagcccugc

SEQ ID NO: 3425248 - RNA, 21 nt, Pseudomonas aeruginosa PA01
ccucgcccucgaagcccugca

SEQ ID NO: 3425249 - RNA, 14 nt, Pseudomonas aeruginosa PA01
ccucgcccucgcuc

SEQ ID NO: 3425250 - RNA, 21 nt, Pseudomonas aeruginosa PA01
ccucgccgaaaagaagccccg

SEQ ID NO: 3425251 - RNA, 12 nt, Pseudomonas aeruginosa PA01
ccucgccgaggc

SEQ ID NO: 3425252 - RNA, 23 nt, Pseudomonas aeruginosa PA01
ccucgccgaucuccuccgccccg

SEQ ID NO: 3425253 - RNA, 17 nt, Pseudomonas aeruginosa PA01
ccucgccgaugucguag

SEQ ID NO: 3425254 - RNA, 13 nt, Pseudomonas aeruginosa PA01
ccucgccgcugcu

SEQ ID NO: 3425255 - RNA, 14 nt, Pseudomonas aeruginosa PA01
ccucgccgcuggcg

SEQ ID NO: 3425256 - RNA, 15 nt, Pseudomonas aeruginosa PA01
ccucgccguacagca

SEQ ID NO: 3425257 - RNA, 17 nt, Pseudomonas aeruginosa PA01
ccucgccguacagcagg

SEQ ID NO: 3425258 - RNA, 16 nt, Pseudomonas aeruginosa PA01
ccucgccgucgucggg

SEQ ID NO: 3425259 - RNA, 19 nt, Pseudomonas aeruginosa PA01
ccucgccgugacgaggggc

SEQ ID NO: 3425260 - RNA, 16 nt, Pseudomonas aeruginosa PA01
ccucgccugcggcgcc

SEQ ID NO: 3425261 - RNA, 23 nt, Pseudomonas aeruginosa PA01
ccucgccuucguccaugcucgcc

SEQ ID NO: 3425262 - RNA, 14 nt, Pseudomonas aeruginosa PA01
ccucgcgacugcug

SEQ ID NO: 3425263 - RNA, 14 nt, Pseudomonas aeruginosa PA01
ccucgcgcaacgcc

SEQ ID NO: 3425264 - RNA, 19 nt, Pseudomonas aeruginosa PA01
ccucgcgcaacgccgacgg

SEQ ID NO: 3425265 - RNA, 20 nt, Pseudomonas aeruginosa PA01
ccucgcgcaacgccgacggc

SEQ ID NO: 3425266 - RNA, 12 nt, Pseudomonas aeruginosa PA01
ccucgcgcaccg

SEQ ID NO: 3425267 - RNA, 14 nt, Pseudomonas aeruginosa PA01
ccucgcgcagcggc

SEQ ID NO: 3425268 - RNA, 16 nt, Pseudomonas aeruginosa PA01
ccucgcgccgcgccag

SEQ ID NO: 3425269 - RNA, 20 nt, Pseudomonas aeruginosa PA01
ccucgcgccgcgccagcagg

SEQ ID NO: 3425270 - RNA, 22 nt, Pseudomonas aeruginosa PA01
ccucgcgccgcuuugcaggguc

SEQ ID NO: 3425271 - RNA, 19 nt, Pseudomonas aeruginosa PA01
ccucgcgcguggccgccag

SEQ ID NO: 3425272 - RNA, 20 nt, Pseudomonas aeruginosa PA01
ccucgcgcguggccgccagg

SEQ ID NO: 3425273 - RNA, 13 nt, Pseudomonas aeruginosa PA01
ccucgcgcucggc

SEQ ID NO: 3425274 - RNA, 17 nt, Pseudomonas aeruginosa PA01
ccucgcgcucggcggcc

SEQ ID NO: 3425275 - RNA, 18 nt, Pseudomonas aeruginosa PA01
ccucgcgcucggcggccu

SEQ ID NO: 3425276 - RNA, 23 nt, Pseudomonas aeruginosa PA01
ccucgcgcucggcggccucgcgg

SEQ ID NO: 3425277 - RNA, 13 nt, Pseudomonas aeruginosa PA01
ccucgcgcugccc

SEQ ID NO: 3425278 - RNA, 17 nt, Pseudomonas aeruginosa PA01
ccucgcgcugcccggcg

SEQ ID NO: 3425279 - RNA, 17 nt, Pseudomonas aeruginosa PA01
ccucgcggaagucggcg

SEQ ID NO: 3425280 - RNA, 19 nt, Pseudomonas aeruginosa PA01
ccucgcggaagucggcggg

SEQ ID NO: 3425281 - RNA, 14 nt, Pseudomonas aeruginosa PA01
ccucgcggaccucg

SEQ ID NO: 3425282 - RNA, 15 nt, Pseudomonas aeruginosa PA01
ccucgcggacgcugg

SEQ ID NO: 3425283 - RNA, 17 nt, Pseudomonas aeruginosa PA01
ccucgcggacgcuggcg

SEQ ID NO: 3425284 - RNA, 23 nt, Pseudomonas aeruginosa PA01
ccucgcggacgcuggcgaucaug

SEQ ID NO: 3425285 - RNA, 15 nt, Pseudomonas aeruginosa PA01
ccucgcggagcugga

SEQ ID NO: 3425286 - RNA, 20 nt, Pseudomonas aeruginosa PA01
ccucgcggcgcucgaggggc

SEQ ID NO: 3425287 - RNA, 13 nt, Pseudomonas aeruginosa PA01
ccucgcggcggca

SEQ ID NO: 3425288 - RNA, 20 nt, Pseudomonas aeruginosa PA01
ccucgcggcuaucgaucacu

SEQ ID NO: 3425289 - RNA, 17 nt, Pseudomonas aeruginosa PA01
ccucgcggcucaccgag

SEQ ID NO: 3425290 - RNA, 18 nt, Pseudomonas aeruginosa PA01
ccucgcggcucaccgaga

SEQ ID NO: 3425291 - RNA, 16 nt, Pseudomonas aeruginosa PA01
ccucgcgggaacggcg

SEQ ID NO: 3425292 - RNA, 23 nt, Pseudomonas aeruginosa PA01
ccucgcgggaacggcguaccagg

SEQ ID NO: 3425293 - RNA, 14 nt, Pseudomonas aeruginosa PA01
ccucgcggguaucg

SEQ ID NO: 3425294 - RNA, 18 nt, Pseudomonas aeruginosa PA01
ccucgcgguucugcuccu

SEQ ID NO: 3425295 - RNA, 15 nt, Pseudomonas aeruginosa PA01
ccucgcgugcgcugg

SEQ ID NO: 3425296 - RNA, 16 nt, Pseudomonas aeruginosa PA01
ccucgcguucgcgguc

SEQ ID NO: 3425297 - RNA, 19 nt, Pseudomonas aeruginosa PA01
ccucgcuacggaaggucgc

SEQ ID NO: 3425298 - RNA, 17 nt, Pseudomonas aeruginosa PA01
ccucgcuagucuuccug

SEQ ID NO: 3425299 - RNA, 18 nt, Pseudomonas aeruginosa PA01
ccucgcuagucuuccugc

SEQ ID NO: 3425300 - RNA, 24 nt, Pseudomonas aeruginosa PA01
ccucgcuagucuuccugcacgcug

SEQ ID NO: 3425301 - RNA, 17 nt, Pseudomonas aeruginosa PA01
ccucgcuccaacgcagg

SEQ ID NO: 3425302 - RNA, 19 nt, Pseudomonas aeruginosa PA01
ccucgcucgcuacagccgg

SEQ ID NO: 3425303 - RNA, 20 nt, Pseudomonas aeruginosa PA01
ccucgcucguuccgcggagu

SEQ ID NO: 3425304 - RNA, 19 nt, Pseudomonas aeruginosa PA01
ccucgcucugcgccgcggc

SEQ ID NO: 3425305 - RNA, 21 nt, Pseudomonas aeruginosa PA01
ccucgcugaugugccgcacgg

SEQ ID NO: 3425306 - RNA, 22 nt, Pseudomonas aeruginosa PA01
ccucggucagguauucgccggc

SEQ ID NO: 3425307 - RNA, 18 nt, Pseudomonas aeruginosa PA01
ccucggugauaccgccgg

SEQ ID NO: 3425308 - RNA, 16 nt, Pseudomonas aeruginosa PA01
ccucggugcgcacgca

SEQ ID NO: 3425309 - RNA, 15 nt, Pseudomonas aeruginosa PA01
ccucggugcggccga

SEQ ID NO: 3425310 - RNA, 22 nt, Pseudomonas aeruginosa PA01
ccucggugcgguuggagcggau

SEQ ID NO: 3425311 - RNA, 14 nt, Pseudomonas aeruginosa PA01
ccucggugucggcc

SEQ ID NO: 3425312 - RNA, 23 nt, Pseudomonas aeruginosa PA01
ccucgguuuccggccaggcgcgg

SEQ ID NO: 3425313 - RNA, 16 nt, Pseudomonas aeruginosa PA01
ccucguacaugcgcga

SEQ ID NO: 3425314 - RNA, 15 nt, Pseudomonas aeruginosa PA01
ccucguaggccgacu

SEQ ID NO: 3425315 - RNA, 21 nt, Pseudomonas aeruginosa PA01
ccucguaggcguccuggcgag

SEQ ID NO: 3425316 - RNA, 22 nt, Pseudomonas aeruginosa PA01
ccucguccagcaggacgucgag

SEQ ID NO: 3425317 - RNA, 21 nt, Pseudomonas aeruginosa PA01
ccucguccagcaggcccagcc

SEQ ID NO: 3425318 - RNA, 20 nt, Pseudomonas aeruginosa PA01
ccucguccaguucagggcca

SEQ ID NO: 3425319 - RNA, 15 nt, Pseudomonas aeruginosa PA01
ccucguccgacagca

SEQ ID NO: 3425320 - RNA, 17 nt, Pseudomonas aeruginosa PA01
ccucguccgacagcagg

SEQ ID NO: 3425321 - RNA, 17 nt, Pseudomonas aeruginosa PA01
ccucgucgacgcccugg

SEQ ID NO: 3425322 - RNA, 18 nt, Pseudomonas aeruginosa PA01
ccucgucgacgcucagca

SEQ ID NO: 3425323 - RNA, 11 nt, Pseudomonas aeruginosa PA01
ccucgucgagc

SEQ ID NO: 3425324 - RNA, 15 nt, Pseudomonas aeruginosa PA01
ccucgucgagcagcg

SEQ ID NO: 3425325 - RNA, 20 nt, Pseudomonas aeruginosa PA01
ccucgucgagcagcgcgcgg

SEQ ID NO: 3425326 - RNA, 16 nt, Pseudomonas aeruginosa PA01
ccucgucgagcgcagc

SEQ ID NO: 3425327 - RNA, 22 nt, Pseudomonas aeruginosa PA01
ccucgucgauacgcaucugcuc

SEQ ID NO: 3425328 - RNA, 14 nt, Pseudomonas aeruginosa PA01
ccucgucgaucucg

SEQ ID NO: 3425329 - RNA, 16 nt, Pseudomonas aeruginosa PA01
ccucgucgccaugcgg

SEQ ID NO: 3425330 - RNA, 14 nt, Pseudomonas aeruginosa PA01
ccucgucgcccgga

SEQ ID NO: 3425331 - RNA, 14 nt, Pseudomonas aeruginosa PA01
ccucgucgcgccag

SEQ ID NO: 3425332 - RNA, 23 nt, Pseudomonas aeruginosa PA01
ccucgucguucagcccacccccg

SEQ ID NO: 3425333 - RNA, 12 nt, Pseudomonas aeruginosa PA01
ccucgugcagca

SEQ ID NO: 3425334 - RNA, 20 nt, Pseudomonas aeruginosa PA01
ccucgugcagcaagccgcag

SEQ ID NO: 3425335 - RNA, 20 nt, Pseudomonas aeruginosa PA01
ccucguggcgcgccgcuaug

SEQ ID NO: 3425336 - RNA, 15 nt, Pseudomonas aeruginosa PA01
ccucguucagcagca

SEQ ID NO: 3425337 - RNA, 20 nt, Pseudomonas aeruginosa PA01
ccucguucggcgaccauuca

SEQ ID NO: 3425338 - RNA, 19 nt, Pseudomonas aeruginosa PA01
ccucguucgucgccgacug

SEQ ID NO: 3425339 - RNA, 15 nt, Pseudomonas aeruginosa PA01
ccucguugaucggca

SEQ ID NO: 3425340 - RNA, 18 nt, Pseudomonas aeruginosa PA01
ccucguugauuccgccgg

SEQ ID NO: 3425341 - RNA, 14 nt, Pseudomonas aeruginosa PA01
ccucuaaggaaaaa

SEQ ID NO: 3425342 - RNA, 21 nt, Pseudomonas aeruginosa PA01
ccucuaaggaaaaacccggcc

SEQ ID NO: 3425343 - RNA, 22 nt, Pseudomonas aeruginosa PA01
ccucuaaggaaaaacccggccc

SEQ ID NO: 3425344 - RNA, 17 nt, Pseudomonas aeruginosa PA01
ccucuaugggacgaccu

SEQ ID NO: 3425345 - RNA, 22 nt, Pseudomonas aeruginosa PA01
ccucucaggagcgccgcgcagc

SEQ ID NO: 3425346 - RNA, 19 nt, Pseudomonas aeruginosa PA01
ccucuccccaaccuucucc

SEQ ID NO: 3425347 - RNA, 21 nt, Pseudomonas aeruginosa PA01
ccucuccccaaccuucucccu

SEQ ID NO: 3425348 - RNA, 12 nt, Pseudomonas aeruginosa PA01
ccucuccccaga

SEQ ID NO: 3425349 - RNA, 20 nt, Pseudomonas aeruginosa PA01
ccucuccccagacccucucc

SEQ ID NO: 3425350 - RNA, 20 nt, Pseudomonas aeruginosa PA01
ccucucuacacucugaggga

SEQ ID NO: 3425351 - RNA, 14 nt, Pseudomonas aeruginosa PA01
ccucucucgcugcg

SEQ ID NO: 3425352 - RNA, 16 nt, Pseudomonas aeruginosa PA01
ccucucucgcugcgcg

SEQ ID NO: 3425353 - RNA, 17 nt, Pseudomonas aeruginosa PA01
ccucugaccgcgcccgg

SEQ ID NO: 3425354 - RNA, 18 nt, Pseudomonas aeruginosa PA01
ccucugaccgcgcccgga

SEQ ID NO: 3425355 - RNA, 15 nt, Pseudomonas aeruginosa PA01
ccucugccucgacgc

SEQ ID NO: 3425356 - RNA, 16 nt, Pseudomonas aeruginosa PA01
ccucugcgcugagcag

SEQ ID NO: 3425357 - RNA, 13 nt, Pseudomonas aeruginosa PA01
ccucugcguucug

SEQ ID NO: 3425358 - RNA, 24 nt, Pseudomonas aeruginosa PA01
ccucugguuggccgaaagcacugc

SEQ ID NO: 3425359 - RNA, 20 nt, Pseudomonas aeruginosa PA01
ccucuuccgcgcugaccugg

SEQ ID NO: 3425360 - RNA, 20 nt, Pseudomonas aeruginosa PA01
ccucuuccuggaccuccgcc

SEQ ID NO: 3425361 - RNA, 20 nt, Pseudomonas aeruginosa PA01
ccucuucgccauccuugagu

SEQ ID NO: 3425362 - RNA, 21 nt, Pseudomonas aeruginosa PA01
ccucuugaaaacugucggcgg

SEQ ID NO: 3425363 - RNA, 14 nt, Pseudomonas aeruginosa PA01
ccugaaaagcgcug

SEQ ID NO: 3425364 - RNA, 15 nt, Pseudomonas aeruginosa PA01
ccugaacgcgcccgg

SEQ ID NO: 3425365 - RNA, 19 nt, Pseudomonas aeruginosa PA01
ccugaaggcgcggggcgag

SEQ ID NO: 3425366 - RNA, 15 nt, Pseudomonas aeruginosa PA01
ccugaagggagaggg

SEQ ID NO: 3425367 - RNA, 20 nt, Pseudomonas aeruginosa PA01
ccugaagggagagggaacca

SEQ ID NO: 3425368 - RNA, 15 nt, Pseudomonas aeruginosa PA01
ccugaccaucgucgc

SEQ ID NO: 3425369 - RNA, 14 nt, Pseudomonas aeruginosa PA01
ccugaccccggccu

SEQ ID NO: 3425370 - RNA, 18 nt, Pseudomonas aeruginosa PA01
ccugaccccggccuggcu

SEQ ID NO: 3425371 - RNA, 15 nt, Pseudomonas aeruginosa PA01
ccugacccgcuccuc

SEQ ID NO: 3425372 - RNA, 21 nt, Pseudomonas aeruginosa PA01
ccugacccgcuccucgucgag

SEQ ID NO: 3425373 - RNA, 19 nt, Pseudomonas aeruginosa PA01
ccugacgcaagcgcucggc

SEQ ID NO: 3425374 - RNA, 21 nt, Pseudomonas aeruginosa PA01
ccugacgcaagcgcucggccu

SEQ ID NO: 3425375 - RNA, 22 nt, Pseudomonas aeruginosa PA01
ccugacguugccgcgcgggccg

SEQ ID NO: 3425376 - RNA, 16 nt, Pseudomonas aeruginosa PA01
ccugagaucagcgccc

SEQ ID NO: 3425377 - RNA, 18 nt, Pseudomonas aeruginosa PA01
ccugagaucagcgcccgg

SEQ ID NO: 3425378 - RNA, 19 nt, Pseudomonas aeruginosa PA01
ccugagaucagcgcccggc

SEQ ID NO: 3425379 - RNA, 13 nt, Pseudomonas aeruginosa PA01
ccugagccggccg

SEQ ID NO: 3425380 - RNA, 21 nt, Pseudomonas aeruginosa PA01
ccugagccugucgauuucccc

SEQ ID NO: 3425381 - RNA, 22 nt, Pseudomonas aeruginosa PA01
ccugagcugccgcuucggcugc

SEQ ID NO: 3425382 - RNA, 14 nt, Pseudomonas aeruginosa PA01
ccugagcuggccca

SEQ ID NO: 3425383 - RNA, 13 nt, Pseudomonas aeruginosa PA01
ccugagcuggcug

SEQ ID NO: 3425384 - RNA, 23 nt, Pseudomonas aeruginosa PA01
ccugagugcgccauauuucgaag

SEQ ID NO: 3425385 - RNA, 13 nt, Pseudomonas aeruginosa PA01
ccugaucaucugg

SEQ ID NO: 3425386 - RNA, 22 nt, Pseudomonas aeruginosa PA01
ccugaucaucugggccaucgcc

SEQ ID NO: 3425387 - RNA, 17 nt, Pseudomonas aeruginosa PA01
ccugauccgcguuaccg

SEQ ID NO: 3425388 - RNA, 23 nt, Pseudomonas aeruginosa PA01
ccugcaaacgggcaucgucgaag

SEQ ID NO: 3425389 - RNA, 16 nt, Pseudomonas aeruginosa PA01
ccugcaaagaggcgcu

SEQ ID NO: 3425390 - RNA, 18 nt, Pseudomonas aeruginosa PA01
ccugcaaagcggcgacgc

SEQ ID NO: 3425391 - RNA, 21 nt, Pseudomonas aeruginosa PA01
ccugcaaagcggcgacgccac

SEQ ID NO: 3425392 - RNA, 20 nt, Pseudomonas aeruginosa PA01
ccugcaacacccaggccugg

SEQ ID NO: 3425393 - RNA, 22 nt, Pseudomonas aeruginosa PA01
ccugcaacagaaguugcuggcg

SEQ ID NO: 3425394 - RNA, 21 nt, Pseudomonas aeruginosa PA01
ccugcaacaggacccagccau

SEQ ID NO: 3425395 - RNA, 22 nt, Pseudomonas aeruginosa PA01
ccugcaacagggcauuggccau

SEQ ID NO: 3425396 - RNA, 13 nt, Pseudomonas aeruginosa PA01
ccugcaacagugg

SEQ ID NO: 3425397 - RNA, 17 nt, Pseudomonas aeruginosa PA01
ccugcaacgccagcagg

SEQ ID NO: 3425398 - RNA, 18 nt, Pseudomonas aeruginosa PA01
ccugcaacgcccgcgagc

SEQ ID NO: 3425399 - RNA, 23 nt, Pseudomonas aeruginosa PA01
ccugcaacgcccgcgagccgucc

SEQ ID NO: 3425400 - RNA, 15 nt, Pseudomonas aeruginosa PA01
ccugcaacgccgcca

SEQ ID NO: 3425401 - RNA, 16 nt, Pseudomonas aeruginosa PA01
ccugcaacgccgccaa

SEQ ID NO: 3425402 - RNA, 17 nt, Pseudomonas aeruginosa PA01
ccugcaacgccgccaac

SEQ ID NO: 3425403 - RNA, 18 nt, Pseudomonas aeruginosa PA01
ccugcaacgccgccaacu

SEQ ID NO: 3425404 - RNA, 22 nt, Pseudomonas aeruginosa PA01
ccugcaacgccuggugcagguc

SEQ ID NO: 3425405 - RNA, 22 nt, Pseudomonas aeruginosa PA01
ccugcaacguccucgcgccgcu

SEQ ID NO: 3425406 - RNA, 13 nt, Pseudomonas aeruginosa PA01
ccugcaacucggc

SEQ ID NO: 3425407 - RNA, 14 nt, Pseudomonas aeruginosa PA01
ccugcaacucggcg

SEQ ID NO: 3425408 - RNA, 17 nt, Pseudomonas aeruginosa PA01
ccugcgcgccucuuccu

SEQ ID NO: 3425409 - RNA, 13 nt, Pseudomonas aeruginosa PA01
ccugcgcggcgac

SEQ ID NO: 3425410 - RNA, 15 nt, Pseudomonas aeruginosa PA01
ccugcgcggcgacga

SEQ ID NO: 3425411 - RNA, 17 nt, Pseudomonas aeruginosa PA01
ccugcgcggcgacgauc

SEQ ID NO: 3425412 - RNA, 20 nt, Pseudomonas aeruginosa PA01
ccugcgcggcgacgaucagc

SEQ ID NO: 3425413 - RNA, 18 nt, Pseudomonas aeruginosa PA01
ccugcgcuuccggcagcc

SEQ ID NO: 3425414 - RNA, 20 nt, Pseudomonas aeruginosa PA01
ccugcgcuuccggcagccag

SEQ ID NO: 3425415 - RNA, 23 nt, Pseudomonas aeruginosa PA01
ccugcgcuuccggcagccagccg

SEQ ID NO: 3425416 - RNA, 18 nt, Pseudomonas aeruginosa PA01
ccugcgcuucguuggcga

SEQ ID NO: 3425417 - RNA, 19 nt, Pseudomonas aeruginosa PA01
ccugcggaaacggacccca

SEQ ID NO: 3425418 - RNA, 14 nt, Pseudomonas aeruginosa PA01
ccugcggaccgcag

SEQ ID NO: 3425419 - RNA, 13 nt, Pseudomonas aeruginosa PA01
ccugcggauggcg

SEQ ID NO: 3425420 - RNA, 22 nt, Pseudomonas aeruginosa PA01
ccugcggauggcgcggggcccc

SEQ ID NO: 3425421 - RNA, 18 nt, Pseudomonas aeruginosa PA01
ccugcggauucaucggcg

SEQ ID NO: 3425422 - RNA, 12 nt, Pseudomonas aeruginosa PA01
ccugcggcacga

SEQ ID NO: 3425423 - RNA, 22 nt, Pseudomonas aeruginosa PA01
ccugcggcacgaaccauugcgg

SEQ ID NO: 3425424 - RNA, 15 nt, Pseudomonas aeruginosa PA01
ccugcggccagcgcc

SEQ ID NO: 3425425 - RNA, 17 nt, Pseudomonas aeruginosa PA01
ccugcggccagcgccag

SEQ ID NO: 3425426 - RNA, 23 nt, Pseudomonas aeruginosa PA01
ccugcggccagcgccaggagcag

SEQ ID NO: 3425427 - RNA, 21 nt, Pseudomonas aeruginosa PA01
ccugcggccccaaggggccgc

SEQ ID NO: 3425428 - RNA, 16 nt, Pseudomonas aeruginosa PA01
ccugcggcccgagggc

SEQ ID NO: 3425429 - RNA, 20 nt, Pseudomonas aeruginosa PA01
ccugcggccgcaaccagccc

SEQ ID NO: 3425430 - RNA, 17 nt, Pseudomonas aeruginosa PA01
ccugcggccguucgccc

SEQ ID NO: 3425431 - RNA, 21 nt, Pseudomonas aeruginosa PA01
ccugcggccguucgcccuuca

SEQ ID NO: 3425432 - RNA, 18 nt, Pseudomonas aeruginosa PA01
ccugcggcguuauccgcc

SEQ ID NO: 3425433 - RNA, 15 nt, Pseudomonas aeruginosa PA01
ccugcggcuggcgaa

SEQ ID NO: 3425434 - RNA, 22 nt, Pseudomonas aeruginosa PA01
ccugcggggcggcgucccggcg

SEQ ID NO: 3425435 - RNA, 23 nt, Pseudomonas aeruginosa PA01
ccugcggggcggcgucccggcgc

SEQ ID NO: 3425436 - RNA, 21 nt, Pseudomonas aeruginosa PA01
ccugcgggucauagucgguga

SEQ ID NO: 3425437 - RNA, 16 nt, Pseudomonas aeruginosa PA01
ccugcggguucggcga

SEQ ID NO: 3425438 - RNA, 18 nt, Pseudomonas aeruginosa PA01
ccugcggguucggcgaga

SEQ ID NO: 3425439 - RNA, 19 nt, Pseudomonas aeruginosa PA01
ccugcggguuggucggcac

SEQ ID NO: 3425440 - RNA, 20 nt, Pseudomonas aeruginosa PA01
ccugcggguuggucggcacc

SEQ ID NO: 3425441 - RNA, 22 nt, Pseudomonas aeruginosa PA01
ccugcggguuggucggcaccag

SEQ ID NO: 3425442 - RNA, 14 nt, Pseudomonas aeruginosa PA01
ccugcggucgggug

SEQ ID NO: 3425443 - RNA, 17 nt, Pseudomonas aeruginosa PA01
ccugcggugucccuucu

SEQ ID NO: 3425444 - RNA, 22 nt, Pseudomonas aeruginosa PA01
ccugcgucgcagagacgcagcg

SEQ ID NO: 3425445 - RNA, 14 nt, Pseudomonas aeruginosa PA01
ccugcgucgcaucc

SEQ ID NO: 3425446 - RNA, 14 nt, Pseudomonas aeruginosa PA01
ccugcgugagcugg

SEQ ID NO: 3425447 - RNA, 16 nt, Pseudomonas aeruginosa PA01
ccugcgugagcugggc

SEQ ID NO: 3425448 - RNA, 19 nt, Pseudomonas aeruginosa PA01
ccugcguggaaccgcggcg

SEQ ID NO: 3425449 - RNA, 20 nt, Pseudomonas aeruginosa PA01
ccugcguggaaccgcggcgc

SEQ ID NO: 3425450 - RNA, 22 nt, Pseudomonas aeruginosa PA01
ccugcguggaaccgcggcgccc

SEQ ID NO: 3425451 - RNA, 16 nt, Pseudomonas aeruginosa PA01
ccugcguuucgccggg

SEQ ID NO: 3425452 - RNA, 15 nt, Pseudomonas aeruginosa PA01
ccugcucacggccga

SEQ ID NO: 3425453 - RNA, 20 nt, Pseudomonas aeruginosa PA01
ccugcucacggccgaacaga

SEQ ID NO: 3425454 - RNA, 11 nt, Pseudomonas aeruginosa PA01
ccugcucagcg

SEQ ID NO: 3425455 - RNA, 19 nt, Pseudomonas aeruginosa PA01
ccugcucagcggcccagcg

SEQ ID NO: 3425456 - RNA, 12 nt, Pseudomonas aeruginosa PA01
ccugcucagcgu

SEQ ID NO: 3425457 - RNA, 20 nt, Pseudomonas aeruginosa PA01
ccugcucagcguccucagcc

SEQ ID NO: 3425458 - RNA, 21 nt, Pseudomonas aeruginosa PA01
ccugcucagcguccucagccu

SEQ ID NO: 3425459 - RNA, 21 nt, Pseudomonas aeruginosa PA01
ccugcuccagcagggccagcg

SEQ ID NO: 3425460 - RNA, 13 nt, Pseudomonas aeruginosa PA01
ccugcuccagcgg

SEQ ID NO: 3425461 - RNA, 15 nt, Pseudomonas aeruginosa PA01
ccugcuccuccaggc

SEQ ID NO: 3425462 - RNA, 12 nt, Pseudomonas aeruginosa PA01
ccugcuccuccg

SEQ ID NO: 3425463 - RNA, 22 nt, Pseudomonas aeruginosa PA01
ccugcuccuccgacgcccccca

SEQ ID NO: 3425464 - RNA, 13 nt, Pseudomonas aeruginosa PA01
ccugcuccucgcc

SEQ ID NO: 3425465 - RNA, 17 nt, Pseudomonas aeruginosa PA01
ccugcuccucgccguac

SEQ ID NO: 3425466 - RNA, 12 nt, Pseudomonas aeruginosa PA01
ccugcuccucgg

SEQ ID NO: 3425467 - RNA, 14 nt, Pseudomonas aeruginosa PA01
ccugcuccucggca

SEQ ID NO: 3425468 - RNA, 15 nt, Pseudomonas aeruginosa PA01
ccugcuccucggcag

SEQ ID NO: 3425469 - RNA, 19 nt, Pseudomonas aeruginosa PA01
ccugcuccucggcagcgcu

SEQ ID NO: 3425470 - RNA, 15 nt, Pseudomonas aeruginosa PA01
ccugcuccugaagga

SEQ ID NO: 3425471 - RNA, 16 nt, Pseudomonas aeruginosa PA01
ccugcuccugaaggac

SEQ ID NO: 3425472 - RNA, 13 nt, Pseudomonas aeruginosa PA01
ccugcucgaucca

SEQ ID NO: 3425473 - RNA, 18 nt, Pseudomonas aeruginosa PA01
ccugcucgauccagccgg

SEQ ID NO: 3425474 - RNA, 21 nt, Pseudomonas aeruginosa PA01
ccugcucgauccagccggcau

SEQ ID NO: 3425475 - RNA, 13 nt, Pseudomonas aeruginosa PA01
ccugcucgccgcu

SEQ ID NO: 3425476 - RNA, 13 nt, Pseudomonas aeruginosa PA01
ccugcucgccggc

SEQ ID NO: 3425477 - RNA, 16 nt, Pseudomonas aeruginosa PA01
ccugcucgcgcaccgc

SEQ ID NO: 3425478 - RNA, 18 nt, Pseudomonas aeruginosa PA01
ccugcucgcgcaccgcgg

SEQ ID NO: 3425479 - RNA, 19 nt, Pseudomonas aeruginosa PA01
ccugcucgcgcaccgcggc

SEQ ID NO: 3425480 - RNA, 14 nt, Pseudomonas aeruginosa PA01
ccugcucgcgcagc

SEQ ID NO: 3425481 - RNA, 16 nt, Pseudomonas aeruginosa PA01
ccugcucgcgcagcca

SEQ ID NO: 3425482 - RNA, 18 nt, Pseudomonas aeruginosa PA01
ccugcucgcgcagccagg

SEQ ID NO: 3425483 - RNA, 21 nt, Pseudomonas aeruginosa PA01
ccugcucgcgcagccaggcga

SEQ ID NO: 3425484 - RNA, 17 nt, Pseudomonas aeruginosa PA01
ccugcucgcgcaggguc

SEQ ID NO: 3425485 - RNA, 16 nt, Pseudomonas aeruginosa PA01
ccugcucgcggcuggc

SEQ ID NO: 3425486 - RNA, 16 nt, Pseudomonas aeruginosa PA01
ccugcucuucggcggc

SEQ ID NO: 3425487 - RNA, 17 nt, Pseudomonas aeruginosa PA01
ccugcucuucggcggcc

SEQ ID NO: 3425488 - RNA, 18 nt, Pseudomonas aeruginosa PA01
ccugcucuucggcggcca

SEQ ID NO: 3425489 - RNA, 17 nt, Pseudomonas aeruginosa PA01
ccugcugagcagucgcc

SEQ ID NO: 3425490 - RNA, 21 nt, Pseudomonas aeruginosa PA01
ccugcugagcagucgccuggc

SEQ ID NO: 3425491 - RNA, 17 nt, Pseudomonas aeruginosa PA01
ccugcugcagggccucg

SEQ ID NO: 3425492 - RNA, 15 nt, Pseudomonas aeruginosa PA01
ccugcugcccggcau

SEQ ID NO: 3425493 - RNA, 14 nt, Pseudomonas aeruginosa PA01
ccugcugcgccggc

SEQ ID NO: 3425494 - RNA, 16 nt, Pseudomonas aeruginosa PA01
ccugcugcgccggcac

SEQ ID NO: 3425495 - RNA, 12 nt, Pseudomonas aeruginosa PA01
ccugcugcgcgg

SEQ ID NO: 3425496 - RNA, 20 nt, Pseudomonas aeruginosa PA01
ccugcugcucgaccgccugc

SEQ ID NO: 3425497 - RNA, 21 nt, Pseudomonas aeruginosa PA01
ccugcugcucgaccgccugcu

SEQ ID NO: 3425498 - RNA, 19 nt, Pseudomonas aeruginosa PA01
ccugcugcugcucagcgcg

SEQ ID NO: 3425499 - RNA, 23 nt, Pseudomonas aeruginosa PA01
ccugcugcugcucagcgcgcucg

SEQ ID NO: 3425500 - RNA, 14 nt, Pseudomonas aeruginosa PA01
ccugcugcuggccu

SEQ ID NO: 3425501 - RNA, 16 nt, Pseudomonas aeruginosa PA01
ccugcugcuggccuuc

SEQ ID NO: 3425502 - RNA, 19 nt, Pseudomonas aeruginosa PA01
ccugcuggccggugccgcc

SEQ ID NO: 3425503 - RNA, 20 nt, Pseudomonas aeruginosa PA01
ccugcuggccggugccgccc

SEQ ID NO: 3425504 - RNA, 21 nt, Pseudomonas aeruginosa PA01
ccugcuggccugggacggcgu

SEQ ID NO: 3425505 - RNA, 20 nt, Pseudomonas aeruginosa PA01
ccugcuggcgaauuuccugc

SEQ ID NO: 3425506 - RNA, 23 nt, Pseudomonas aeruginosa PA01
ccugcuggcgaauuuccugcugg

SEQ ID NO: 3425507 - RNA, 14 nt, Pseudomonas aeruginosa PA01
ccugcuggcgcagc

SEQ ID NO: 3425508 - RNA, 16 nt, Pseudomonas aeruginosa PA01
ccugcuggcugcccag

SEQ ID NO: 3425509 - RNA, 15 nt, Pseudomonas aeruginosa PA01
ccugcugggccagcg

SEQ ID NO: 3425510 - RNA, 16 nt, Pseudomonas aeruginosa PA01
ccuggccggcacccug

SEQ ID NO: 3425511 - RNA, 23 nt, Pseudomonas aeruginosa PA01
ccuggccggcacccugaccgcga

SEQ ID NO: 3425512 - RNA, 14 nt, Pseudomonas aeruginosa PA01
ccuggccggccagc

SEQ ID NO: 3425513 - RNA, 12 nt, Pseudomonas aeruginosa PA01
ccuggccggccu

SEQ ID NO: 3425514 - RNA, 11 nt, Pseudomonas aeruginosa PA01
ccuggccggcg

SEQ ID NO: 3425515 - RNA, 14 nt, Pseudomonas aeruginosa PA01
ccuggccggcgaac

SEQ ID NO: 3425516 - RNA, 13 nt, Pseudomonas aeruginosa PA01
ccuggccggcgac

SEQ ID NO: 3425517 - RNA, 14 nt, Pseudomonas aeruginosa PA01
ccuggccggcgacc

SEQ ID NO: 3425518 - RNA, 20 nt, Pseudomonas aeruginosa PA01
ccuggccggcgauggccgcc

SEQ ID NO: 3425519 - RNA, 21 nt, Pseudomonas aeruginosa PA01
ccuggccggcgauggccgccu

SEQ ID NO: 3425520 - RNA, 21 nt, Pseudomonas aeruginosa PA01
ccuggccgggggucgcggcga

SEQ ID NO: 3425521 - RNA, 22 nt, Pseudomonas aeruginosa PA01
ccuggccgggggucgcggcgac

SEQ ID NO: 3425522 - RNA, 18 nt, Pseudomonas aeruginosa PA01
ccuggccggucguucgcc

SEQ ID NO: 3425523 - RNA, 20 nt, Pseudomonas aeruginosa PA01
ccuggccggucguucgcccu

SEQ ID NO: 3425524 - RNA, 14 nt, Pseudomonas aeruginosa PA01
ccuggccggugacg

SEQ ID NO: 3425525 - RNA, 23 nt, Pseudomonas aeruginosa PA01
ccuggccggugacgaaaccggcg

SEQ ID NO: 3425526 - RNA, 17 nt, Pseudomonas aeruginosa PA01
ccuggccgucggccugc

SEQ ID NO: 3425527 - RNA, 15 nt, Pseudomonas aeruginosa PA01
ccuggccgugcucga

SEQ ID NO: 3425528 - RNA, 23 nt, Pseudomonas aeruginosa PA01
ccuggccgugcucgaugaucgac

SEQ ID NO: 3425529 - RNA, 22 nt, Pseudomonas aeruginosa PA01
ccuggccguugaccagcgcguc

SEQ ID NO: 3425530 - RNA, 16 nt, Pseudomonas aeruginosa PA01
ccuggccguugcgcag

SEQ ID NO: 3425531 - RNA, 19 nt, Pseudomonas aeruginosa PA01
ccuggccguugcgcaggcg

SEQ ID NO: 3425532 - RNA, 14 nt, Pseudomonas aeruginosa PA01
ccuggccucggcgu

SEQ ID NO: 3425533 - RNA, 15 nt, Pseudomonas aeruginosa PA01
ccuggccucggcguc

SEQ ID NO: 3425534 - RNA, 17 nt, Pseudomonas aeruginosa PA01
ccuggccuuggccacga

SEQ ID NO: 3425535 - RNA, 22 nt, Pseudomonas aeruginosa PA01
ccuggccuuggccacgacccug

SEQ ID NO: 3425536 - RNA, 20 nt, Pseudomonas aeruginosa PA01
ccuggcgacaggcgaucgac

SEQ ID NO: 3425537 - RNA, 22 nt, Pseudomonas aeruginosa PA01
ccuggcgagggcgucccgcugc

SEQ ID NO: 3425538 - RNA, 22 nt, Pseudomonas aeruginosa PA01
ccuggcgaguggcgaagccagc

SEQ ID NO: 3425539 - RNA, 19 nt, Pseudomonas aeruginosa PA01
ccuggcgaucaggccaagc

SEQ ID NO: 3425540 - RNA, 19 nt, Pseudomonas aeruginosa PA01
ccuggcgaugcccuggccg

SEQ ID NO: 3425541 - RNA, 18 nt, Pseudomonas aeruginosa PA01
ccuggcgcaacaggcgca

SEQ ID NO: 3425542 - RNA, 22 nt, Pseudomonas aeruginosa PA01
ccuggcgcaacaggcgcaugcc

SEQ ID NO: 3425543 - RNA, 19 nt, Pseudomonas aeruginosa PA01
ccuggcgcaacgccggcag

SEQ ID NO: 3425544 - RNA, 20 nt, Pseudomonas aeruginosa PA01
ccuggcgcaacgccggcagg

SEQ ID NO: 3425545 - RNA, 14 nt, Pseudomonas aeruginosa PA01
ccuggcgcaaggug

SEQ ID NO: 3425546 - RNA, 18 nt, Pseudomonas aeruginosa PA01
ccuggcgcaaggugccga

SEQ ID NO: 3425547 - RNA, 14 nt, Pseudomonas aeruginosa PA01
ccuggcgcagacag

SEQ ID NO: 3425548 - RNA, 22 nt, Pseudomonas aeruginosa PA01
ccuggcgcagacaggccuccag

SEQ ID NO: 3425549 - RNA, 23 nt, Pseudomonas aeruginosa PA01
ccuggcgcagacaggccuccagc

SEQ ID NO: 3425550 - RNA, 13 nt, Pseudomonas aeruginosa PA01
ccuggcgcagcgg

SEQ ID NO: 3425551 - RNA, 16 nt, Pseudomonas aeruginosa PA01
ccuggcgcagcggcag

SEQ ID NO: 3425552 - RNA, 17 nt, Pseudomonas aeruginosa PA01
ccuggcgcagcggcagc

SEQ ID NO: 3425553 - RNA, 13 nt, Pseudomonas aeruginosa PA01
ccuggcgcaggcg

SEQ ID NO: 3425554 - RNA, 14 nt, Pseudomonas aeruginosa PA01
ccuggcgcauggcg

SEQ ID NO: 3425555 - RNA, 17 nt, Pseudomonas aeruginosa PA01
ccuggcgcauggcgcuc

SEQ ID NO: 3425556 - RNA, 16 nt, Pseudomonas aeruginosa PA01
ccuggcgcaugucgcg

SEQ ID NO: 3425557 - RNA, 17 nt, Pseudomonas aeruginosa PA01
ccuggcgcaugucgcga

SEQ ID NO: 3425558 - RNA, 12 nt, Pseudomonas aeruginosa PA01
ccuggcgccgac

SEQ ID NO: 3425559 - RNA, 12 nt, Pseudomonas aeruginosa PA01
ccuggcgccggu

SEQ ID NO: 3425560 - RNA, 22 nt, Pseudomonas aeruginosa PA01
ccuggcgcgagaagccagccag

SEQ ID NO: 3425561 - RNA, 14 nt, Pseudomonas aeruginosa PA01
ccuggcgcgcgccc

SEQ ID NO: 3425562 - RNA, 18 nt, Pseudomonas aeruginosa PA01
ccuggcgcgcgcgccagg

SEQ ID NO: 3425563 - RNA, 17 nt, Pseudomonas aeruginosa PA01
ccuggcgcgcggccgcg

SEQ ID NO: 3425564 - RNA, 20 nt, Pseudomonas aeruginosa PA01
ccuggcgcgcugcggcaggg

SEQ ID NO: 3425565 - RNA, 12 nt, Pseudomonas aeruginosa PA01
ccuggcgcggca

SEQ ID NO: 3425566 - RNA, 19 nt, Pseudomonas aeruginosa PA01
ccuggcgcguacgcccgca

SEQ ID NO: 3425567 - RNA, 22 nt, Pseudomonas aeruginosa PA01
ccuggcgcguacgcccgcagcc

SEQ ID NO: 3425568 - RNA, 14 nt, Pseudomonas aeruginosa PA01
ccuggcgcgucaug

SEQ ID NO: 3425569 - RNA, 23 nt, Pseudomonas aeruginosa PA01
ccuggcgcgucggccgcucggcc

SEQ ID NO: 3425570 - RNA, 17 nt, Pseudomonas aeruginosa PA01
ccuggcgcucagcgccg

SEQ ID NO: 3425571 - RNA, 21 nt, Pseudomonas aeruginosa PA01
ccuggcgcucgaagcuccagc

SEQ ID NO: 3425572 - RNA, 24 nt, Pseudomonas aeruginosa PA01
ccuggcgcucgaagcuccagcgug

SEQ ID NO: 3425573 - RNA, 15 nt, Pseudomonas aeruginosa PA01
ccuggcgcucgccgu

SEQ ID NO: 3425574 - RNA, 16 nt, Pseudomonas aeruginosa PA01
ccuggcgcucgccgug

SEQ ID NO: 3425575 - RNA, 23 nt, Pseudomonas aeruginosa PA01
ccuggcgcugaacaagcccuggu

SEQ ID NO: 3425576 - RNA, 14 nt, Pseudomonas aeruginosa PA01
ccuggcgcugggcc

SEQ ID NO: 3425577 - RNA, 17 nt, Pseudomonas aeruginosa PA01
ccuggcgcugucgcccg

SEQ ID NO: 3425578 - RNA, 15 nt, Pseudomonas aeruginosa PA01
ccuggcggauaucgc

SEQ ID NO: 3425579 - RNA, 19 nt, Pseudomonas aeruginosa PA01
ccuggcggauaucgcgccg

SEQ ID NO: 3425580 - RNA, 22 nt, Pseudomonas aeruginosa PA01
ccuggcggauaucgcgccgcga

SEQ ID NO: 3425581 - RNA, 14 nt, Pseudomonas aeruginosa PA01
ccuggcggcguggc

SEQ ID NO: 3425582 - RNA, 12 nt, Pseudomonas aeruginosa PA01
ccuggcggcugg

SEQ ID NO: 3425583 - RNA, 17 nt, Pseudomonas aeruginosa PA01
ccuggcgguacagcccc

SEQ ID NO: 3425584 - RNA, 18 nt, Pseudomonas aeruginosa PA01
ccuggcgguacagccccc

SEQ ID NO: 3425585 - RNA, 20 nt, Pseudomonas aeruginosa PA01
ccuggcgguacagcccccag

SEQ ID NO: 3425586 - RNA, 18 nt, Pseudomonas aeruginosa PA01
ccuggcgguagcccggca

SEQ ID NO: 3425587 - RNA, 20 nt, Pseudomonas aeruginosa PA01
ccuggcgguagcccggcagc

SEQ ID NO: 3425588 - RNA, 17 nt, Pseudomonas aeruginosa PA01
ccuggcggucgccgccg

SEQ ID NO: 3425589 - RNA, 18 nt, Pseudomonas aeruginosa PA01
ccuggcggucgccgccgg

SEQ ID NO: 3425590 - RNA, 19 nt, Pseudomonas aeruginosa PA01
ccuggcggucgccgccggc

SEQ ID NO: 3425591 - RNA, 23 nt, Pseudomonas aeruginosa PA01
ccuggcggucgccgccggcgaac

SEQ ID NO: 3425592 - RNA, 14 nt, Pseudomonas aeruginosa PA01
ccuggcgucccggg

SEQ ID NO: 3425593 - RNA, 15 nt, Pseudomonas aeruginosa PA01
ccuggcgucgaugcc

SEQ ID NO: 3425594 - RNA, 21 nt, Pseudomonas aeruginosa PA01
ccuggcgucgaugccgaaucc

SEQ ID NO: 3425595 - RNA, 15 nt, Pseudomonas aeruginosa PA01
ccuggcgucgcacug

SEQ ID NO: 3425596 - RNA, 13 nt, Pseudomonas aeruginosa PA01
ccuggcgugccgc

SEQ ID NO: 3425597 - RNA, 16 nt, Pseudomonas aeruginosa PA01
ccuggcgugccgccag

SEQ ID NO: 3425598 - RNA, 17 nt, Pseudomonas aeruginosa PA01
ccuggcgugccgccagg

SEQ ID NO: 3425599 - RNA, 20 nt, Pseudomonas aeruginosa PA01
ccuggcgugccgccaggccu

SEQ ID NO: 3425600 - RNA, 21 nt, Pseudomonas aeruginosa PA01
ccuggcgugccgccaggccuu

SEQ ID NO: 3425601 - RNA, 17 nt, Pseudomonas aeruginosa PA01
ccuggcguggccggcga

SEQ ID NO: 3425602 - RNA, 18 nt, Pseudomonas aeruginosa PA01
ccuggcguggccggcgag

SEQ ID NO: 3425603 - RNA, 19 nt, Pseudomonas aeruginosa PA01
ccuggcguggccggcgagg

SEQ ID NO: 3425604 - RNA, 20 nt, Pseudomonas aeruginosa PA01
ccuggcuacgcuccguaggg

SEQ ID NO: 3425605 - RNA, 20 nt, Pseudomonas aeruginosa PA01
ccuggcucaggcacucgaug

SEQ ID NO: 3425606 - RNA, 20 nt, Pseudomonas aeruginosa PA01
ccuggcucaugucguggaca

SEQ ID NO: 3425607 - RNA, 23 nt, Pseudomonas aeruginosa PA01
ccuggcuccacugcuuggccagg

SEQ ID NO: 3425608 - RNA, 18 nt, Pseudomonas aeruginosa PA01
ccuggcucuguuccucgg

SEQ ID NO: 3425609 - RNA, 14 nt, Pseudomonas aeruginosa PA01
ccuggcuggaguag

SEQ ID NO: 3425610 - RNA, 14 nt, Pseudomonas aeruginosa PA01
ccuggcuggccagc

SEQ ID NO: 3425611 - RNA, 17 nt, Pseudomonas aeruginosa PA01
ccuggcuggccagcagg

SEQ ID NO: 3425612 - RNA, 20 nt, Pseudomonas aeruginosa PA01
ccugguggaacagccgcagc

SEQ ID NO: 3425613 - RNA, 24 nt, Pseudomonas aeruginosa PA01
ccugguggaacagccgcagcggca

SEQ ID NO: 3425614 - RNA, 20 nt, Pseudomonas aeruginosa PA01
ccugguggacacccugcugc

SEQ ID NO: 3425615 - RNA, 14 nt, Pseudomonas aeruginosa PA01
ccugguggcgccgg

SEQ ID NO: 3425616 - RNA, 15 nt, Pseudomonas aeruginosa PA01
ccugguggcgccggc

SEQ ID NO: 3425617 - RNA, 16 nt, Pseudomonas aeruginosa PA01
ccugguggcgccggcu

SEQ ID NO: 3425618 - RNA, 17 nt, Pseudomonas aeruginosa PA01
ccugguggcgccggcug

SEQ ID NO: 3425619 - RNA, 19 nt, Pseudomonas aeruginosa PA01
ccugguggcgccggcugac

SEQ ID NO: 3425620 - RNA, 13 nt, Pseudomonas aeruginosa PA01
ccuggugggcggc

SEQ ID NO: 3425621 - RNA, 16 nt, Pseudomonas aeruginosa PA01
ccuggugggcggcggc

SEQ ID NO: 3425622 - RNA, 20 nt, Pseudomonas aeruginosa PA01
ccugguggugaucagcggcc

SEQ ID NO: 3425623 - RNA, 21 nt, Pseudomonas aeruginosa PA01
ccugguucaucgagcggcggc

SEQ ID NO: 3425624 - RNA, 17 nt, Pseudomonas aeruginosa PA01
ccugguucgaguccagg

SEQ ID NO: 3425625 - RNA, 18 nt, Pseudomonas aeruginosa PA01
ccugguucugcuccggac

SEQ ID NO: 3425626 - RNA, 21 nt, Pseudomonas aeruginosa PA01
ccugguugcggaacggcucgc

SEQ ID NO: 3425627 - RNA, 21 nt, Pseudomonas aeruginosa PA01
ccugguuguaggcgccgccgu

SEQ ID NO: 3425628 - RNA, 22 nt, Pseudomonas aeruginosa PA01
ccuguacagaaacaaagagccc

SEQ ID NO: 3425629 - RNA, 17 nt, Pseudomonas aeruginosa PA01
ccuguacauagcggguc

SEQ ID NO: 3425630 - RNA, 16 nt, Pseudomonas aeruginosa PA01
ccuguagcguuccggg

SEQ ID NO: 3425631 - RNA, 13 nt, Pseudomonas aeruginosa PA01
ccuguccagcucc

SEQ ID NO: 3425632 - RNA, 21 nt, Pseudomonas aeruginosa PA01
ccuguccagucaccaggucgc

SEQ ID NO: 3425633 - RNA, 20 nt, Pseudomonas aeruginosa PA01
ccuguccauuuccacgcucc

SEQ ID NO: 3425634 - RNA, 15 nt, Pseudomonas aeruginosa PA01
ccugucccagcgagu

SEQ ID NO: 3425635 - RNA, 15 nt, Pseudomonas aeruginosa PA01
ccugucccaucacgg

SEQ ID NO: 3425636 - RNA, 19 nt, Pseudomonas aeruginosa PA01
ccugucccaucacggcccc

SEQ ID NO: 3425637 - RNA, 16 nt, Pseudomonas aeruginosa PA01
ccuguccccucacggc

SEQ ID NO: 3425638 - RNA, 23 nt, Pseudomonas aeruginosa PA01
ccuguccccucacggcgcgagaa

SEQ ID NO: 3425639 - RNA, 16 nt, Pseudomonas aeruginosa PA01
ccugucccgccgcgcc

SEQ ID NO: 3425640 - RNA, 13 nt, Pseudomonas aeruginosa PA01
ccugucccggacg

SEQ ID NO: 3425641 - RNA, 22 nt, Pseudomonas aeruginosa PA01
ccuguccgggaaugcucagcac

SEQ ID NO: 3425642 - RNA, 17 nt, Pseudomonas aeruginosa PA01
ccugucgauuucccccg

SEQ ID NO: 3425643 - RNA, 14 nt, Pseudomonas aeruginosa PA01
ccugucgcuccggc

SEQ ID NO: 3425644 - RNA, 16 nt, Pseudomonas aeruginosa PA01
ccugucgcuccggcag

SEQ ID NO: 3425645 - RNA, 20 nt, Pseudomonas aeruginosa PA01
ccugucgcuccggcagcgcg

SEQ ID NO: 3425646 - RNA, 15 nt, Pseudomonas aeruginosa PA01
ccugucggcucgcgc

SEQ ID NO: 3425647 - RNA, 17 nt, Pseudomonas aeruginosa PA01
ccugucggcucgcgccg

SEQ ID NO: 3425648 - RNA, 19 nt, Pseudomonas aeruginosa PA01
ccugucggcucgcgccggc

SEQ ID NO: 3425649 - RNA, 21 nt, Pseudomonas aeruginosa PA01
ccugucggcucgcgccggcgc

SEQ ID NO: 3425650 - RNA, 19 nt, Pseudomonas aeruginosa PA01
ccugucuacucgacgcugc

SEQ ID NO: 3425651 - RNA, 22 nt, Pseudomonas aeruginosa PA01
ccuguggaauguccugccgcag

SEQ ID NO: 3425652 - RNA, 22 nt, Pseudomonas aeruginosa PA01
ccuguggauaaaaaggcccgga

SEQ ID NO: 3425653 - RNA, 18 nt, Pseudomonas aeruginosa PA01
ccuguggcguuauucgcc

SEQ ID NO: 3425654 - RNA, 20 nt, Pseudomonas aeruginosa PA01
ccuguggcguuauucgcccu

SEQ ID NO: 3425655 - RNA, 14 nt, Pseudomonas aeruginosa PA01
ccuguggucaggcg

SEQ ID NO: 3425656 - RNA, 19 nt, Pseudomonas aeruginosa PA01
ccuguggucaggcgccagg

SEQ ID NO: 3425657 - RNA, 21 nt, Pseudomonas aeruginosa PA01
ccugugguuggaaaagccccg

SEQ ID NO: 3425658 - RNA, 16 nt, Pseudomonas aeruginosa PA01
ccuguuccagggccug

SEQ ID NO: 3425659 - RNA, 14 nt, Pseudomonas aeruginosa PA01
ccuguuccgcgauc

SEQ ID NO: 3425660 - RNA, 16 nt, Pseudomonas aeruginosa PA01
ccuguuccuccgccag

SEQ ID NO: 3425661 - RNA, 16 nt, Pseudomonas aeruginosa PA01
ccuguucgaaguucuc

SEQ ID NO: 3425662 - RNA, 13 nt, Pseudomonas aeruginosa PA01
ccuguucggccuu

SEQ ID NO: 3425663 - RNA, 13 nt, Pseudomonas aeruginosa PA01
ccuguucggcgcu

SEQ ID NO: 3425664 - RNA, 23 nt, Pseudomonas aeruginosa PA01
ccuguucggcgcugaccucgaug

SEQ ID NO: 3425665 - RNA, 17 nt, Pseudomonas aeruginosa PA01
ccuguucggcgggaucg

SEQ ID NO: 3425666 - RNA, 22 nt, Pseudomonas aeruginosa PA01
ccuguucggcgggaucgacgcc

SEQ ID NO: 3425667 - RNA, 20 nt, Pseudomonas aeruginosa PA01
ccuguucgucuggcgccugg

SEQ ID NO: 3425668 - RNA, 23 nt, Pseudomonas aeruginosa PA01
ccuguucgucuggcgccuggccu

SEQ ID NO: 3425669 - RNA, 15 nt, Pseudomonas aeruginosa PA01
ccuguugaaaaccgg

SEQ ID NO: 3425670 - RNA, 19 nt, Pseudomonas aeruginosa PA01
ccuguugcagagcggccag

SEQ ID NO: 3425671 - RNA, 22 nt, Pseudomonas aeruginosa PA01
ccuguugcagagcggccagguc

SEQ ID NO: 3425672 - RNA, 15 nt, Pseudomonas aeruginosa PA01
ccuguugcuggccgg

SEQ ID NO: 3425673 - RNA, 18 nt, Pseudomonas aeruginosa PA01
ccuguuucgaugagcuuc

SEQ ID NO: 3425674 - RNA, 13 nt, Pseudomonas aeruginosa PA01
ccuguuucggguc

SEQ ID NO: 3425675 - RNA, 22 nt, Pseudomonas aeruginosa PA01
ccuuagacccacugaagacccg

SEQ ID NO: 3425676 - RNA, 21 nt, Pseudomonas aeruginosa PA01
ccuuaguuaucacaaccuuuc

SEQ ID NO: 3425677 - RNA, 14 nt, Pseudomonas aeruginosa PA01
ccuucaccaccagc

SEQ ID NO: 3425678 - RNA, 13 nt, Pseudomonas aeruginosa PA01
ccuucaccgcgcc

SEQ ID NO: 3425679 - RNA, 17 nt, Pseudomonas aeruginosa PA01
ccuucaccggacggcug

SEQ ID NO: 3425680 - RNA, 19 nt, Pseudomonas aeruginosa PA01
ccuucaccggacggcugag

SEQ ID NO: 3425681 - RNA, 16 nt, Pseudomonas aeruginosa PA01
ccuucaccggcacgcc

SEQ ID NO: 3425682 - RNA, 13 nt, Pseudomonas aeruginosa PA01
ccuucaccggcgg

SEQ ID NO: 3425683 - RNA, 22 nt, Pseudomonas aeruginosa PA01
ccuucaccggcggaugacguuc

SEQ ID NO: 3425684 - RNA, 24 nt, Pseudomonas aeruginosa PA01
ccuucaccucguuuuccucauagu

SEQ ID NO: 3425685 - RNA, 14 nt, Pseudomonas aeruginosa PA01
ccuucagacgcacc

SEQ ID NO: 3425686 - RNA, 20 nt, Pseudomonas aeruginosa PA01
ccuucagauacuccagcagc

SEQ ID NO: 3425687 - RNA, 17 nt, Pseudomonas aeruginosa PA01
ccuucagcaccugcgcc

SEQ ID NO: 3425688 - RNA, 16 nt, Pseudomonas aeruginosa PA01
ccuucagcacggcgcg

SEQ ID NO: 3425689 - RNA, 17 nt, Pseudomonas aeruginosa PA01
ccuucagcacggcgcgg

SEQ ID NO: 3425690 - RNA, 15 nt, Pseudomonas aeruginosa PA01
ccuucagccccagca

SEQ ID NO: 3425691 - RNA, 23 nt, Pseudomonas aeruginosa PA01
ccuucagcgccgccaggcccugg

SEQ ID NO: 3425692 - RNA, 13 nt, Pseudomonas aeruginosa PA01
ccuucagcgccuc

SEQ ID NO: 3425693 - RNA, 14 nt, Pseudomonas aeruginosa PA01
ccuucagcgccucc

SEQ ID NO: 3425694 - RNA, 16 nt, Pseudomonas aeruginosa PA01
ccuucagcgccuccag

SEQ ID NO: 3425695 - RNA, 13 nt, Pseudomonas aeruginosa PA01
ccuucaggcgcuc

SEQ ID NO: 3425696 - RNA, 14 nt, Pseudomonas aeruginosa PA01
ccuucaucaccagg

SEQ ID NO: 3425697 - RNA, 19 nt, Pseudomonas aeruginosa PA01
ccuucaucaccaggucgcu

SEQ ID NO: 3425698 - RNA, 15 nt, Pseudomonas aeruginosa PA01
ccuucaucaggcggc

SEQ ID NO: 3425699 - RNA, 14 nt, Pseudomonas aeruginosa PA01
ccuucaucccuucu

SEQ ID NO: 3425700 - RNA, 13 nt, Pseudomonas aeruginosa PA01
ccuucaucgccac

SEQ ID NO: 3425701 - RNA, 15 nt, Pseudomonas aeruginosa PA01
ccuucaucgccaccu

SEQ ID NO: 3425702 - RNA, 17 nt, Pseudomonas aeruginosa PA01
ccuucaucuuggcccau

SEQ ID NO: 3425703 - RNA, 24 nt, Pseudomonas aeruginosa PA01
ccuucauuacuauuuaccugagua

SEQ ID NO: 3425704 - RNA, 16 nt, Pseudomonas aeruginosa PA01
ccuuccaccggcgucc

SEQ ID NO: 3425705 - RNA, 17 nt, Pseudomonas aeruginosa PA01
ccuuccagaacgccgcg

SEQ ID NO: 3425706 - RNA, 19 nt, Pseudomonas aeruginosa PA01
ccuuccagaacgccgcgca

SEQ ID NO: 3425707 - RNA, 14 nt, Pseudomonas aeruginosa PA01
ccuuccagccgccc

SEQ ID NO: 3425708 - RNA, 15 nt, Pseudomonas aeruginosa PA01
ccuuccagccgcgcg

SEQ ID NO: 3425709 - RNA, 15 nt, Pseudomonas aeruginosa PA01
ccuucccagccgagg

SEQ ID NO: 3425710 - RNA, 20 nt, Pseudomonas aeruginosa PA01
ccuucccagccgaggcagcc

SEQ ID NO: 3425711 - RNA, 14 nt, Pseudomonas aeruginosa PA01
ccuuccgacgccgc

SEQ ID NO: 3425712 - RNA, 13 nt, Pseudomonas aeruginosa PA01
ccuuccgcgccca

SEQ ID NO: 3425713 - RNA, 15 nt, Pseudomonas aeruginosa PA01
ccuuccgcgcccagg

SEQ ID NO: 3425714 - RNA, 14 nt, Pseudomonas aeruginosa PA01
ccuugaugccggcg

SEQ ID NO: 3425715 - RNA, 17 nt, Pseudomonas aeruginosa PA01
ccuugauggugugcagc

SEQ ID NO: 3425716 - RNA, 21 nt, Pseudomonas aeruginosa PA01
ccuugauggugugcagcagca

SEQ ID NO: 3425717 - RNA, 20 nt, Pseudomonas aeruginosa PA01
ccuugauuugcccggcgagg

SEQ ID NO: 3425718 - RNA, 20 nt, Pseudomonas aeruginosa PA01
ccuugcacauccagcccugg

SEQ ID NO: 3425719 - RNA, 17 nt, Pseudomonas aeruginosa PA01
ccuugcacuugcggcag

SEQ ID NO: 3425720 - RNA, 21 nt, Pseudomonas aeruginosa PA01
ccuugcagcaacucgccgccg

SEQ ID NO: 3425721 - RNA, 16 nt, Pseudomonas aeruginosa PA01
ccuugcagccagccgu

SEQ ID NO: 3425722 - RNA, 18 nt, Pseudomonas aeruginosa PA01
ccuugcagccagccgucg

SEQ ID NO: 3425723 - RNA, 12 nt, Pseudomonas aeruginosa PA01
ccuugcagcgcc

SEQ ID NO: 3425724 - RNA, 17 nt, Pseudomonas aeruginosa PA01
ccuugcagggccgccag

SEQ ID NO: 3425725 - RNA, 20 nt, Pseudomonas aeruginosa PA01
ccuugcagggccgccagccg

SEQ ID NO: 3425726 - RNA, 22 nt, Pseudomonas aeruginosa PA01
ccuugcagggccgccagccgcc

SEQ ID NO: 3425727 - RNA, 17 nt, Pseudomonas aeruginosa PA01
ccuugccauccuccagc

SEQ ID NO: 3425728 - RNA, 22 nt, Pseudomonas aeruginosa PA01
ccuugcccggauuuugggcagc

SEQ ID NO: 3425729 - RNA, 23 nt, Pseudomonas aeruginosa PA01
ccuugcccggauuuugggcagcg

SEQ ID NO: 3425730 - RNA, 14 nt, Pseudomonas aeruginosa PA01
ccuugcccggcgcg

SEQ ID NO: 3425731 - RNA, 14 nt, Pseudomonas aeruginosa PA01
ccuugcccucggcg

SEQ ID NO: 3425732 - RNA, 17 nt, Pseudomonas aeruginosa PA01
ccuugcccuggccggca

SEQ ID NO: 3425733 - RNA, 19 nt, Pseudomonas aeruginosa PA01
ccuugcccuggccggcacc

SEQ ID NO: 3425734 - RNA, 22 nt, Pseudomonas aeruginosa PA01
ccuugcccuggccggcacccug

SEQ ID NO: 3425735 - RNA, 15 nt, Pseudomonas aeruginosa PA01
ccuugcccugggcgu

SEQ ID NO: 3425736 - RNA, 20 nt, Pseudomonas aeruginosa PA01
ccuugcccugggcgucgacg

SEQ ID NO: 3425737 - RNA, 14 nt, Pseudomonas aeruginosa PA01
ccuugccgacgccg

SEQ ID NO: 3425738 - RNA, 23 nt, Pseudomonas aeruginosa PA01
ccuugccgaggaagucggcggcc

SEQ ID NO: 3425739 - RNA, 17 nt, Pseudomonas aeruginosa PA01
ccuugccgccggucuuc

SEQ ID NO: 3425740 - RNA, 14 nt, Pseudomonas aeruginosa PA01
ccuugccgcgcccg

SEQ ID NO: 3425741 - RNA, 15 nt, Pseudomonas aeruginosa PA01
ccuugccgcgcccgg

SEQ ID NO: 3425742 - RNA, 12 nt, Pseudomonas aeruginosa PA01
ccuugccggugc

SEQ ID NO: 3425743 - RNA, 23 nt, Pseudomonas aeruginosa PA01
ccuugccguaguggcguuccagg

SEQ ID NO: 3425744 - RNA, 13 nt, Pseudomonas aeruginosa PA01
ccuugccguccag

SEQ ID NO: 3425745 - RNA, 17 nt, Pseudomonas aeruginosa PA01
ccuugccguccagccgg

SEQ ID NO: 3425746 - RNA, 21 nt, Pseudomonas aeruginosa PA01
ccuugccugucuacucgacgc

SEQ ID NO: 3425747 - RNA, 16 nt, Pseudomonas aeruginosa PA01
ccuugcgaaaagcccg

SEQ ID NO: 3425748 - RNA, 18 nt, Pseudomonas aeruginosa PA01
ccuugcgaaaagcccgcc

SEQ ID NO: 3425749 - RNA, 18 nt, Pseudomonas aeruginosa PA01
ccuugcgaccagguccgg

SEQ ID NO: 3425750 - RNA, 23 nt, Pseudomonas aeruginosa PA01
ccuugcgaccagguccggagggc

SEQ ID NO: 3425751 - RNA, 14 nt, Pseudomonas aeruginosa PA01
ccuugcgcaccagg

SEQ ID NO: 3425752 - RNA, 14 nt, Pseudomonas aeruginosa PA01
ccuugcgcaccgcc

SEQ ID NO: 3425753 - RNA, 17 nt, Pseudomonas aeruginosa PA01
ccuugcgcaccgccugc

SEQ ID NO: 3425754 - RNA, 20 nt, Pseudomonas aeruginosa PA01
ccuugcgcaccgccugcagc

SEQ ID NO: 3425755 - RNA, 23 nt, Pseudomonas aeruginosa PA01
ccuugcgcagcaacgcgacgauc

SEQ ID NO: 3425756 - RNA, 21 nt, Pseudomonas aeruginosa PA01
ccuugcgccaggcccggcgcu

SEQ ID NO: 3425757 - RNA, 20 nt, Pseudomonas aeruginosa PA01
ccuugcgccaugcgcccgcu

SEQ ID NO: 3425758 - RNA, 15 nt, Pseudomonas aeruginosa PA01
ccuugcgcccggcuu

SEQ ID NO: 3425759 - RNA, 12 nt, Pseudomonas aeruginosa PA01
ccuugcgccgcg

SEQ ID NO: 3425760 - RNA, 16 nt, Pseudomonas aeruginosa PA01
ccuugcgccgcgguuc

SEQ ID NO: 3425761 - RNA, 16 nt, Pseudomonas aeruginosa PA01
ccuugcgcggcaggcc

SEQ ID NO: 3425762 - RNA, 15 nt, Pseudomonas aeruginosa PA01
ccuugcgcggcgccg

SEQ ID NO: 3425763 - RNA, 15 nt, Pseudomonas aeruginosa PA01
ccuugcgcgugcugg

SEQ ID NO: 3425764 - RNA, 19 nt, Pseudomonas aeruginosa PA01
ccuugcgcucuggcgcaua

SEQ ID NO: 3425765 - RNA, 19 nt, Pseudomonas aeruginosa PA01
ccuugcgcuguuccgccgu

SEQ ID NO: 3425766 - RNA, 17 nt, Pseudomonas aeruginosa PA01
ccuugcggcagacgugc

SEQ ID NO: 3425767 - RNA, 20 nt, Pseudomonas aeruginosa PA01
ccuugcggcagacgugcugg

SEQ ID NO: 3425768 - RNA, 13 nt, Pseudomonas aeruginosa PA01
ccuugcggccccc

SEQ ID NO: 3425769 - RNA, 12 nt, Pseudomonas aeruginosa PA01
ccuugcggcgcc

SEQ ID NO: 3425770 - RNA, 13 nt, Pseudomonas aeruginosa PA01
ccuugcggcgccg

SEQ ID NO: 3425771 - RNA, 14 nt, Pseudomonas aeruginosa PA01
ccuugcggcgcggc

SEQ ID NO: 3425772 - RNA, 15 nt, Pseudomonas aeruginosa PA01
ccuugcggcgcggcc

SEQ ID NO: 3425773 - RNA, 17 nt, Pseudomonas aeruginosa PA01
ccuugcggcgcggcccg

SEQ ID NO: 3425774 - RNA, 13 nt, Pseudomonas aeruginosa PA01
ccuugcggggcgg

SEQ ID NO: 3425775 - RNA, 23 nt, Pseudomonas aeruginosa PA01
ccuugcggggcggcgcaucggcg

SEQ ID NO: 3425776 - RNA, 13 nt, Pseudomonas aeruginosa PA01
ccuugcgguccag

SEQ ID NO: 3425777 - RNA, 17 nt, Pseudomonas aeruginosa PA01
ccuugcgucccugggcc

SEQ ID NO: 3425778 - RNA, 15 nt, Pseudomonas aeruginosa PA01
ccuugcguccugccu

SEQ ID NO: 3425779 - RNA, 19 nt, Pseudomonas aeruginosa PA01
ccuugcgucuucgccgaug

SEQ ID NO: 3425780 - RNA, 14 nt, Pseudomonas aeruginosa PA01
ccuugcucccgccg

SEQ ID NO: 3425781 - RNA, 18 nt, Pseudomonas aeruginosa PA01
ccuugcucccgccgcucc

SEQ ID NO: 3425782 - RNA, 14 nt, Pseudomonas aeruginosa PA01
ccuugcucgacccg

SEQ ID NO: 3425783 - RNA, 18 nt, Pseudomonas aeruginosa PA01
ccuugcucucgcgcacgc

SEQ ID NO: 3425784 - RNA, 21 nt, Pseudomonas aeruginosa PA01
ccuugcucuugaggucggcgc

SEQ ID NO: 3425785 - RNA, 23 nt, Pseudomonas aeruginosa PA01
ccuugcucuugaggucggcgcgc

SEQ ID NO: 3425786 - RNA, 20 nt, Pseudomonas aeruginosa PA01
ccuugcugaagcccaggcgu

SEQ ID NO: 3425787 - RNA, 22 nt, Pseudomonas aeruginosa PA01
ccuugcugaucagguugccggc

SEQ ID NO: 3425788 - RNA, 11 nt, Pseudomonas aeruginosa PA01
ccuugcuggcg

SEQ ID NO: 3425789 - RNA, 14 nt, Pseudomonas aeruginosa PA01
ccuuggagccgccc

SEQ ID NO: 3425790 - RNA, 10 nt, Pseudomonas aeruginosa PA01
ccuuggccac

SEQ ID NO: 3425791 - RNA, 16 nt, Pseudomonas aeruginosa PA01
ccuuggccacgacccu

SEQ ID NO: 3425792 - RNA, 17 nt, Pseudomonas aeruginosa PA01
ccuuggccacgacccug

SEQ ID NO: 3425793 - RNA, 20 nt, Pseudomonas aeruginosa PA01
ccuuggccacgacccugcug

SEQ ID NO: 3425794 - RNA, 13 nt, Pseudomonas aeruginosa PA01
ccuuggccacgcu

SEQ ID NO: 3425795 - RNA, 13 nt, Pseudomonas aeruginosa PA01
ccuuggccacggc

SEQ ID NO: 3425796 - RNA, 14 nt, Pseudomonas aeruginosa PA01
ccuuggccagcacc

SEQ ID NO: 3425797 - RNA, 15 nt, Pseudomonas aeruginosa PA01
ccuuggccagcacca

SEQ ID NO: 3425798 - RNA, 14 nt, Pseudomonas aeruginosa PA01
ccuuggccaugccc

SEQ ID NO: 3425799 - RNA, 24 nt, Pseudomonas aeruginosa PA01
ccuuggcccgguuggccaggacca

SEQ ID NO: 3425800 - RNA, 14 nt, Pseudomonas aeruginosa PA01
ccuuggcgcaggua

SEQ ID NO: 3425801 - RNA, 13 nt, Pseudomonas aeruginosa PA01
ccuuggcggcgcc

SEQ ID NO: 3425802 - RNA, 17 nt, Pseudomonas aeruginosa PA01
ccuuggcuuccuggcgc

SEQ ID NO: 3425803 - RNA, 18 nt, Pseudomonas aeruginosa PA01
ccuuggcuugcagguagc

SEQ ID NO: 3425804 - RNA, 12 nt, Pseudomonas aeruginosa PA01
ccuugggccagg

SEQ ID NO: 3425805 - RNA, 18 nt, Pseudomonas aeruginosa PA01
ccuuggucaggccgacca

SEQ ID NO: 3425806 - RNA, 15 nt, Pseudomonas aeruginosa PA01
ccuuggucagggugc

SEQ ID NO: 3425807 - RNA, 16 nt, Pseudomonas aeruginosa PA01
ccuuggucagggugcc

SEQ ID NO: 3425808 - RNA, 18 nt, Pseudomonas aeruginosa PA01
ccuuggucaucagcacau

SEQ ID NO: 3425809 - RNA, 15 nt, Pseudomonas aeruginosa PA01
ccuuguccaggcgcu

SEQ ID NO: 3425810 - RNA, 17 nt, Pseudomonas aeruginosa PA01
ccuuguccaggcgcugc

SEQ ID NO: 3425811 - RNA, 12 nt, Pseudomonas aeruginosa PA01
ccuuguccgggu

SEQ ID NO: 3425812 - RNA, 18 nt, Pseudomonas aeruginosa PA01
ccuuguccugcggccggg

SEQ ID NO: 3425813 - RNA, 19 nt, Pseudomonas aeruginosa PA01
ccuuguccugcggccgggu

SEQ ID NO: 3425814 - RNA, 17 nt, Pseudomonas aeruginosa PA01
ccuuguccuggccggcg

SEQ ID NO: 3425815 - RNA, 21 nt, Pseudomonas aeruginosa PA01
ccuugucgaugagccagccug

SEQ ID NO: 3425816 - RNA, 16 nt, Pseudomonas aeruginosa PA01
ccuugucgcagcggcc

SEQ ID NO: 3425817 - RNA, 17 nt, Pseudomonas aeruginosa PA01
cgaacagccgccccacc

SEQ ID NO: 3425818 - RNA, 15 nt, Pseudomonas aeruginosa PA01
cgaacagcgagaccc

SEQ ID NO: 3425819 - RNA, 17 nt, Pseudomonas aeruginosa PA01
cgaacagcgagucgucg

SEQ ID NO: 3425820 - RNA, 13 nt, Pseudomonas aeruginosa PA01
cgaacagcgcgcc

SEQ ID NO: 3425821 - RNA, 17 nt, Pseudomonas aeruginosa PA01
cgaacagcgcgccaucg

SEQ ID NO: 3425822 - RNA, 17 nt, Pseudomonas aeruginosa PA01
cgaacagcuccuccagc

SEQ ID NO: 3425823 - RNA, 20 nt, Pseudomonas aeruginosa PA01
cgaacagcuccuccagccgc

SEQ ID NO: 3425824 - RNA, 13 nt, Pseudomonas aeruginosa PA01
cgaacagcuugcc

SEQ ID NO: 3425825 - RNA, 15 nt, Pseudomonas aeruginosa PA01
cgaacagcuugccgu

SEQ ID NO: 3425826 - RNA, 23 nt, Pseudomonas aeruginosa PA01
cgaacaggcccuugauggugugc

SEQ ID NO: 3425827 - RNA, 20 nt, Pseudomonas aeruginosa PA01
cgaacaggcgacgguaccag

SEQ ID NO: 3425828 - RNA, 18 nt, Pseudomonas aeruginosa PA01
cgaacaggcgucccaugg

SEQ ID NO: 3425829 - RNA, 21 nt, Pseudomonas aeruginosa PA01
cgaacagggccaucagggcga

SEQ ID NO: 3425830 - RNA, 19 nt, Pseudomonas aeruginosa PA01
cgaacagggcgagcagggc

SEQ ID NO: 3425831 - RNA, 22 nt, Pseudomonas aeruginosa PA01
cgaacagggucuucaggccgag

SEQ ID NO: 3425832 - RNA, 17 nt, Pseudomonas aeruginosa PA01
cgaacagguagccccgg

SEQ ID NO: 3425833 - RNA, 20 nt, Pseudomonas aeruginosa PA01
cgaacagguggcuuuccagc

SEQ ID NO: 3425834 - RNA, 15 nt, Pseudomonas aeruginosa PA01
cgaacaguucggcgg

SEQ ID NO: 3425835 - RNA, 18 nt, Pseudomonas aeruginosa PA01
cgaacaguuguuccgggu

SEQ ID NO: 3425836 - RNA, 19 nt, Pseudomonas aeruginosa PA01
cgaacaguuguuccggguu

SEQ ID NO: 3425837 - RNA, 18 nt, Pseudomonas aeruginosa PA01
cgaacaucgccagcgcca

SEQ ID NO: 3425838 - RNA, 20 nt, Pseudomonas aeruginosa PA01
cgaacaugaagccgcgcgcc

SEQ ID NO: 3425839 - RNA, 17 nt, Pseudomonas aeruginosa PA01
cgaacaugagcgauccc

SEQ ID NO: 3425840 - RNA, 11 nt, Pseudomonas aeruginosa PA01
cgaacauggcc

SEQ ID NO: 3425841 - RNA, 18 nt, Pseudomonas aeruginosa PA01
cgaaccacauccuugccg

SEQ ID NO: 3425842 - RNA, 19 nt, Pseudomonas aeruginosa PA01
cgaaccacgaagaacggcg

SEQ ID NO: 3425843 - RNA, 18 nt, Pseudomonas aeruginosa PA01
cgaaccacugcgccaugc

SEQ ID NO: 3425844 - RNA, 12 nt, Pseudomonas aeruginosa PA01
cgaaccagcagc

SEQ ID NO: 3425845 - RNA, 16 nt, Pseudomonas aeruginosa PA01
cgaaccagcucagcuc

SEQ ID NO: 3425846 - RNA, 19 nt, Pseudomonas aeruginosa PA01
cgaaccagcucagcuccag

SEQ ID NO: 3425847 - RNA, 22 nt, Pseudomonas aeruginosa PA01
cgaaccagcucagcuccaggcc

SEQ ID NO: 3425848 - RNA, 18 nt, Pseudomonas aeruginosa PA01
cgaaccaggcaauggccg

SEQ ID NO: 3425849 - RNA, 15 nt, Pseudomonas aeruginosa PA01
cgaaccaggcggccg

SEQ ID NO: 3425850 - RNA, 16 nt, Pseudomonas aeruginosa PA01
cgaaccaggcggccga

SEQ ID NO: 3425851 - RNA, 15 nt, Pseudomonas aeruginosa PA01
cgaaccagggacgcc

SEQ ID NO: 3425852 - RNA, 13 nt, Pseudomonas aeruginosa PA01
cgaaccaguccag

SEQ ID NO: 3425853 - RNA, 15 nt, Pseudomonas aeruginosa PA01
cgaaccagugcaccg

SEQ ID NO: 3425854 - RNA, 18 nt, Pseudomonas aeruginosa PA01
cgaaccagugcaccgccg

SEQ ID NO: 3425855 - RNA, 22 nt, Pseudomonas aeruginosa PA01
cgaacccaggccgcgcagcaac

SEQ ID NO: 3425856 - RNA, 23 nt, Pseudomonas aeruginosa PA01
cgaacccaggccgcgcagcaacg

SEQ ID NO: 3425857 - RNA, 16 nt, Pseudomonas aeruginosa PA01
cgaacccccgaccuuc

SEQ ID NO: 3425858 - RNA, 15 nt, Pseudomonas aeruginosa PA01
cgaaccccuggcgcu

SEQ ID NO: 3425859 - RNA, 15 nt, Pseudomonas aeruginosa PA01
cgaacccgcccucgu

SEQ ID NO: 3425860 - RNA, 20 nt, Pseudomonas aeruginosa PA01
cgaaccgagacccuggcgcu

SEQ ID NO: 3425861 - RNA, 14 nt, Pseudomonas aeruginosa PA01
cgaaccgccggccu

SEQ ID NO: 3425862 - RNA, 22 nt, Pseudomonas aeruginosa PA01
cgaaccgccggccucgcugccg

SEQ ID NO: 3425863 - RNA, 23 nt, Pseudomonas aeruginosa PA01
cgaaccggaaaagaagccgcgca

SEQ ID NO: 3425864 - RNA, 14 nt, Pseudomonas aeruginosa PA01
cgaaccguggcggc

SEQ ID NO: 3425865 - RNA, 16 nt, Pseudomonas aeruginosa PA01
cgaaccguggcggccg

SEQ ID NO: 3425866 - RNA, 18 nt, Pseudomonas aeruginosa PA01
cgaaccguggcggccgcc

SEQ ID NO: 3425867 - RNA, 13 nt, Pseudomonas aeruginosa PA01
cgaaccuggagaa

SEQ ID NO: 3425868 - RNA, 14 nt, Pseudomonas aeruginosa PA01
cgaacgaagcgccc

SEQ ID NO: 3425869 - RNA, 15 nt, Pseudomonas aeruginosa PA01
cgaacgaagcgcccu

SEQ ID NO: 3425870 - RNA, 18 nt, Pseudomonas aeruginosa PA01
cgaacgaagcgcccucgc

SEQ ID NO: 3425871 - RNA, 14 nt, Pseudomonas aeruginosa PA01
cgaacgacagcacc

SEQ ID NO: 3425872 - RNA, 20 nt, Pseudomonas aeruginosa PA01
cgaacgagaagccgaucagg

SEQ ID NO: 3425873 - RNA, 22 nt, Pseudomonas aeruginosa PA01
cgaacgaggcgaggguggcgcc

SEQ ID NO: 3425874 - RNA, 18 nt, Pseudomonas aeruginosa PA01
cgaacgaggcucggucgc

SEQ ID NO: 3425875 - RNA, 18 nt, Pseudomonas aeruginosa PA01
cgaacgaugguggucggc

SEQ ID NO: 3425876 - RNA, 12 nt, Pseudomonas aeruginosa PA01
cgaacgccaggc

SEQ ID NO: 3425877 - RNA, 14 nt, Pseudomonas aeruginosa PA01
cgaacgcccggcuu

SEQ ID NO: 3425878 - RNA, 22 nt, Pseudomonas aeruginosa PA01
cgaacgccgcccgucgcgccgg

SEQ ID NO: 3425879 - RNA, 23 nt, Pseudomonas aeruginosa PA01
cgaacgcgcugacggcaaggacc

SEQ ID NO: 3425880 - RNA, 18 nt, Pseudomonas aeruginosa PA01
cgaacgcucccagccgac

SEQ ID NO: 3425881 - RNA, 19 nt, Pseudomonas aeruginosa PA01
cgaacgcuugagccccggc

SEQ ID NO: 3425882 - RNA, 23 nt, Pseudomonas aeruginosa PA01
cgaacgcuugagccccggcaggc

SEQ ID NO: 3425883 - RNA, 12 nt, Pseudomonas aeruginosa PA01
cgaacggcaucu

SEQ ID NO: 3425884 - RNA, 16 nt, Pseudomonas aeruginosa PA01
cgaacggcggaucgau

SEQ ID NO: 3425885 - RNA, 18 nt, Pseudomonas aeruginosa PA01
cgaacggcggaucgauca

SEQ ID NO: 3425886 - RNA, 19 nt, Pseudomonas aeruginosa PA01
cgaacggcggaucgaucag

SEQ ID NO: 3425887 - RNA, 18 nt, Pseudomonas aeruginosa PA01
cgaacggcgugagggucg

SEQ ID NO: 3425888 - RNA, 23 nt, Pseudomonas aeruginosa PA01
cgaacggcgugagggucgcgccg

SEQ ID NO: 3425889 - RNA, 19 nt, Pseudomonas aeruginosa PA01
cgaacggcucaauccggcu

SEQ ID NO: 3425890 - RNA, 21 nt, Pseudomonas aeruginosa PA01
cgaacggcucaauccggcugg

SEQ ID NO: 3425891 - RNA, 21 nt, Pseudomonas aeruginosa PA01
cgaacgggaaguaggccuggc

SEQ ID NO: 3425892 - RNA, 23 nt, Pseudomonas aeruginosa PA01
cgaacgggcacuucucgaacagc

SEQ ID NO: 3425893 - RNA, 22 nt, Pseudomonas aeruginosa PA01
cgaacgguagguagcguugcgc

SEQ ID NO: 3425894 - RNA, 19 nt, Pseudomonas aeruginosa PA01
cgaacggugcagcuugacc

SEQ ID NO: 3425895 - RNA, 23 nt, Pseudomonas aeruginosa PA01
cgaacgguggccccucagaagua

SEQ ID NO: 3425896 - RNA, 17 nt, Pseudomonas aeruginosa PA01
cgaacucacggaugccg

SEQ ID NO: 3425897 - RNA, 20 nt, Pseudomonas aeruginosa PA01
cgaacucacggaugccgggc

SEQ ID NO: 3425898 - RNA, 16 nt, Pseudomonas aeruginosa PA01
cgaacucaugcccagc

SEQ ID NO: 3425899 - RNA, 15 nt, Pseudomonas aeruginosa PA01
cgaacuccgccagca

SEQ ID NO: 3425900 - RNA, 20 nt, Pseudomonas aeruginosa PA01
cgaacuccgccagcaccacc

SEQ ID NO: 3425901 - RNA, 21 nt, Pseudomonas aeruginosa PA01
cgaacuccgccagcaccaccc

SEQ ID NO: 3425902 - RNA, 17 nt, Pseudomonas aeruginosa PA01
cgaacucgaaggccagc

SEQ ID NO: 3425903 - RNA, 14 nt, Pseudomonas aeruginosa PA01
cgaacucggcgccg

SEQ ID NO: 3425904 - RNA, 16 nt, Pseudomonas aeruginosa PA01
cgaacugaccaccagg

SEQ ID NO: 3425905 - RNA, 21 nt, Pseudomonas aeruginosa PA01
cgaacugcacccgccgaccgg

SEQ ID NO: 3425906 - RNA, 13 nt, Pseudomonas aeruginosa PA01
cgaacugcacgcc

SEQ ID NO: 3425907 - RNA, 16 nt, Pseudomonas aeruginosa PA01
cgaacugcagggcguc

SEQ ID NO: 3425908 - RNA, 20 nt, Pseudomonas aeruginosa PA01
cgaacugcagggcgucgccg

SEQ ID NO: 3425909 - RNA, 22 nt, Pseudomonas aeruginosa PA01
cgaacugcagggcgucgccggg

SEQ ID NO: 3425910 - RNA, 23 nt, Pseudomonas aeruginosa PA01
cgaacugcagggcgucgccggga

SEQ ID NO: 3425911 - RNA, 17 nt, Pseudomonas aeruginosa PA01
cgaacugcauggccuug

SEQ ID NO: 3425912 - RNA, 18 nt, Pseudomonas aeruginosa PA01
cgaacugcauggccuugu

SEQ ID NO: 3425913 - RNA, 14 nt, Pseudomonas aeruginosa PA01
cgaacugccgacgg

SEQ ID NO: 3425914 - RNA, 21 nt, Pseudomonas aeruginosa PA01
cgaacugcucgaaagccucca

SEQ ID NO: 3425915 - RNA, 14 nt, Pseudomonas aeruginosa PA01
cgaacuggccaccg

SEQ ID NO: 3425916 - RNA, 17 nt, Pseudomonas aeruginosa PA01
cgaacuggccagcacca

SEQ ID NO: 3425917 - RNA, 15 nt, Pseudomonas aeruginosa PA01
cgaacuucaggccgg

SEQ ID NO: 3425918 - RNA, 18 nt, Pseudomonas aeruginosa PA01
cgaacuucaggccggcgc

SEQ ID NO: 3425919 - RNA, 21 nt, Pseudomonas aeruginosa PA01
cgaagcugucguaguccuggg

SEQ ID NO: 3425920 - RNA, 19 nt, Pseudomonas aeruginosa PA01
cgaagcuucaucgaggugc

SEQ ID NO: 3425921 - RNA, 14 nt, Pseudomonas aeruginosa PA01
cgaaggacaggccg

SEQ ID NO: 3425922 - RNA, 20 nt, Pseudomonas aeruginosa PA01
cgaaggacaggucgcggaag

SEQ ID NO: 3425923 - RNA, 16 nt, Pseudomonas aeruginosa PA01
cgaaggaucggggaag

SEQ ID NO: 3425924 - RNA, 16 nt, Pseudomonas aeruginosa PA01
cgaaggcaacagcccg

SEQ ID NO: 3425925 - RNA, 18 nt, Pseudomonas aeruginosa PA01
cgaaggcaacagcccgcg

SEQ ID NO: 3425926 - RNA, 21 nt, Pseudomonas aeruginosa PA01
cgaaggcaaugccgcccucca

SEQ ID NO: 3425927 - RNA, 17 nt, Pseudomonas aeruginosa PA01
cgaaggcauauccccuc

SEQ ID NO: 3425928 - RNA, 12 nt, Pseudomonas aeruginosa PA01
cgaaggccacca

SEQ ID NO: 3425929 - RNA, 23 nt, Pseudomonas aeruginosa PA01
cgaaggccaccaucgcggcgaug

SEQ ID NO: 3425930 - RNA, 14 nt, Pseudomonas aeruginosa PA01
cgaaggccagcucg

SEQ ID NO: 3425931 - RNA, 19 nt, Pseudomonas aeruginosa PA01
cgaaggccagcucgucgcc

SEQ ID NO: 3425932 - RNA, 12 nt, Pseudomonas aeruginosa PA01
cgaaggccagga

SEQ ID NO: 3425933 - RNA, 15 nt, Pseudomonas aeruginosa PA01
cgaaggccaggaccg

SEQ ID NO: 3425934 - RNA, 14 nt, Pseudomonas aeruginosa PA01
cgaaggccaggccg

SEQ ID NO: 3425935 - RNA, 15 nt, Pseudomonas aeruginosa PA01
cgaaggccaggccgg

SEQ ID NO: 3425936 - RNA, 18 nt, Pseudomonas aeruginosa PA01
cgaaggccaggccggcgc

SEQ ID NO: 3425937 - RNA, 19 nt, Pseudomonas aeruginosa PA01
cgaaggccaggccggcgcc

SEQ ID NO: 3425938 - RNA, 22 nt, Pseudomonas aeruginosa PA01
cgaaggccuccucguaggcguc

SEQ ID NO: 3425939 - RNA, 17 nt, Pseudomonas aeruginosa PA01
cgaaggccucgucgauc

SEQ ID NO: 3425940 - RNA, 14 nt, Pseudomonas aeruginosa PA01
cgaaggccuggccg

SEQ ID NO: 3425941 - RNA, 15 nt, Pseudomonas aeruginosa PA01
cgaaggccuggccgu

SEQ ID NO: 3425942 - RNA, 20 nt, Pseudomonas aeruginosa PA01
cgaaggccuggccguugcgc

SEQ ID NO: 3425943 - RNA, 20 nt, Pseudomonas aeruginosa PA01
cgaaggcgaucacgguggua

SEQ ID NO: 3425944 - RNA, 23 nt, Pseudomonas aeruginosa PA01
cgaaggcgccuuccaggcgugcc

SEQ ID NO: 3425945 - RNA, 20 nt, Pseudomonas aeruginosa PA01
cgaaggcgcgcucgaucagg

SEQ ID NO: 3425946 - RNA, 14 nt, Pseudomonas aeruginosa PA01
cgaaggcgcggcgg

SEQ ID NO: 3425947 - RNA, 14 nt, Pseudomonas aeruginosa PA01
cgaaggcgcuccgg

SEQ ID NO: 3425948 - RNA, 19 nt, Pseudomonas aeruginosa PA01
cgaaggcggcagcggugaa

SEQ ID NO: 3425949 - RNA, 18 nt, Pseudomonas aeruginosa PA01
cgaaggcggcgcggcggg

SEQ ID NO: 3425950 - RNA, 17 nt, Pseudomonas aeruginosa PA01
cgaaggcgugccgcugg

SEQ ID NO: 3425951 - RNA, 19 nt, Pseudomonas aeruginosa PA01
cgaaggcgugccgcuggcc

SEQ ID NO: 3425952 - RNA, 20 nt, Pseudomonas aeruginosa PA01
cgaaggcgugccgcuggccg

SEQ ID NO: 3425953 - RNA, 16 nt, Pseudomonas aeruginosa PA01
cgaaggcgugggcgcc

SEQ ID NO: 3425954 - RNA, 21 nt, Pseudomonas aeruginosa PA01
cgaaggcgugggcgccggcgc

SEQ ID NO: 3425955 - RNA, 20 nt, Pseudomonas aeruginosa PA01
cgaaggcuggagcgcugcgg

SEQ ID NO: 3425956 - RNA, 20 nt, Pseudomonas aeruginosa PA01
cgaagggaaacaccaggccg

SEQ ID NO: 3425957 - RNA, 15 nt, Pseudomonas aeruginosa PA01
cgaagggaacccgcg

SEQ ID NO: 3425958 - RNA, 19 nt, Pseudomonas aeruginosa PA01
cgaagggccgcagguuggc

SEQ ID NO: 3425959 - RNA, 15 nt, Pseudomonas aeruginosa PA01
cgaagggcgcuucgg

SEQ ID NO: 3425960 - RNA, 20 nt, Pseudomonas aeruginosa PA01
cgaaggguuggccgcagcag

SEQ ID NO: 3425961 - RNA, 22 nt, Pseudomonas aeruginosa PA01
cgaagguaaggauguccgggug

SEQ ID NO: 3425962 - RNA, 13 nt, Pseudomonas aeruginosa PA01
cgaaggucagccc

SEQ ID NO: 3425963 - RNA, 14 nt, Pseudomonas aeruginosa PA01
cgaaggucgaaggc

SEQ ID NO: 3425964 - RNA, 18 nt, Pseudomonas aeruginosa PA01
cgaaggucgaaggcgcgg

SEQ ID NO: 3425965 - RNA, 14 nt, Pseudomonas aeruginosa PA01
cgaaggucgccguc

SEQ ID NO: 3425966 - RNA, 17 nt, Pseudomonas aeruginosa PA01
cgaaggucggcggcagc

SEQ ID NO: 3425967 - RNA, 21 nt, Pseudomonas aeruginosa PA01
cgaaggucugccccggcuugg

SEQ ID NO: 3425968 - RNA, 16 nt, Pseudomonas aeruginosa PA01
cgaaggugaagcugcc

SEQ ID NO: 3425969 - RNA, 14 nt, Pseudomonas aeruginosa PA01
cgaaggugcaggcc

SEQ ID NO: 3425970 - RNA, 15 nt, Pseudomonas aeruginosa PA01
cgaaggugcaggccg

SEQ ID NO: 3425971 - RNA, 19 nt, Pseudomonas aeruginosa PA01
cgaaggugcaggccgcgcg

SEQ ID NO: 3425972 - RNA, 18 nt, Pseudomonas aeruginosa PA01
cgaagguuucguccccuu

SEQ ID NO: 3425973 - RNA, 17 nt, Pseudomonas aeruginosa PA01
cgaaguagccggaaaac

SEQ ID NO: 3425974 - RNA, 15 nt, Pseudomonas aeruginosa PA01
cgaaguagccggcgu

SEQ ID NO: 3425975 - RNA, 19 nt, Pseudomonas aeruginosa PA01
cgaaguagcgacggaagcc

SEQ ID NO: 3425976 - RNA, 16 nt, Pseudomonas aeruginosa PA01
cgaaguccaccaggcg

SEQ ID NO: 3425977 - RNA, 11 nt, Pseudomonas aeruginosa PA01
cgaaguccacu

SEQ ID NO: 3425978 - RNA, 17 nt, Pseudomonas aeruginosa PA01
cgaaguccggguugagc

SEQ ID NO: 3425979 - RNA, 21 nt, Pseudomonas aeruginosa PA01
cgaaguccggguugagcaccc

SEQ ID NO: 3425980 - RNA, 13 nt, Pseudomonas aeruginosa PA01
cgaagucgaagca

SEQ ID NO: 3425981 - RNA, 16 nt, Pseudomonas aeruginosa PA01
cgaagucgaagcagcc

SEQ ID NO: 3425982 - RNA, 17 nt, Pseudomonas aeruginosa PA01
cgaagucgaagcagccc

SEQ ID NO: 3425983 - RNA, 21 nt, Pseudomonas aeruginosa PA01
cgaagucgaagcagcccagcg

SEQ ID NO: 3425984 - RNA, 13 nt, Pseudomonas aeruginosa PA01
cgaagucgaucac

SEQ ID NO: 3425985 - RNA, 17 nt, Pseudomonas aeruginosa PA01
cgaagucgcccgccggc

SEQ ID NO: 3425986 - RNA, 19 nt, Pseudomonas aeruginosa PA01
cgaagucgcccgccggcgu

SEQ ID NO: 3425987 - RNA, 14 nt, Pseudomonas aeruginosa PA01
cgaagucgccggca

SEQ ID NO: 3425988 - RNA, 17 nt, Pseudomonas aeruginosa PA01
cgaagucgccggcaucg

SEQ ID NO: 3425989 - RNA, 19 nt, Pseudomonas aeruginosa PA01
cgaagucgccgucguccgg

SEQ ID NO: 3425990 - RNA, 17 nt, Pseudomonas aeruginosa PA01
cgaagucgcgagguucc

SEQ ID NO: 3425991 - RNA, 19 nt, Pseudomonas aeruginosa PA01
cgaagucggcgagccggcg

SEQ ID NO: 3425992 - RNA, 13 nt, Pseudomonas aeruginosa PA01
cgaagucggcgcg

SEQ ID NO: 3425993 - RNA, 16 nt, Pseudomonas aeruginosa PA01
cgaagucggcgcgcca

SEQ ID NO: 3425994 - RNA, 22 nt, Pseudomonas aeruginosa PA01
cgaagucggcgcgccagaagcg

SEQ ID NO: 3425995 - RNA, 20 nt, Pseudomonas aeruginosa PA01
cgaagucguuguacuggccg

SEQ ID NO: 3425996 - RNA, 21 nt, Pseudomonas aeruginosa PA01
cgaagucugccuguccgcugc

SEQ ID NO: 3425997 - RNA, 15 nt, Pseudomonas aeruginosa PA01
cgaagugaagcgauc

SEQ ID NO: 3425998 - RNA, 18 nt, Pseudomonas aeruginosa PA01
cgaagugaagcgauccag

SEQ ID NO: 3425999 - RNA, 13 nt, Pseudomonas aeruginosa PA01
cgaagugaccgcg

SEQ ID NO: 3426000 - RNA, 18 nt, Pseudomonas aeruginosa PA01
cgaagugaccgcgcgcca

SEQ ID NO: 3426001 - RNA, 23 nt, Pseudomonas aeruginosa PA01
cgaagugaucuggcauaccgcgu

SEQ ID NO: 3426002 - RNA, 20 nt, Pseudomonas aeruginosa PA01
cgaagugauggaagagcgcc

SEQ ID NO: 3426003 - RNA, 23 nt, Pseudomonas aeruginosa PA01
cgaagugauggaagagcgccgcg

SEQ ID NO: 3426004 - RNA, 18 nt, Pseudomonas aeruginosa PA01
cgaagugcgcugcuugaa

SEQ ID NO: 3426005 - RNA, 17 nt, Pseudomonas aeruginosa PA01
cgaaguguuacagcagg

SEQ ID NO: 3426006 - RNA, 16 nt, Pseudomonas aeruginosa PA01
cgaaguucccgccgcu

SEQ ID NO: 3426007 - RNA, 17 nt, Pseudomonas aeruginosa PA01
cgaaguucccgccgcuc

SEQ ID NO: 3426008 - RNA, 14 nt, Pseudomonas aeruginosa PA01
cgaaguucuccagc

SEQ ID NO: 3426009 - RNA, 19 nt, Pseudomonas aeruginosa PA01
cgaaguucuccagcaagcc

SEQ ID NO: 3426010 - RNA, 17 nt, Pseudomonas aeruginosa PA01
cgaaguugcaggccagc

SEQ ID NO: 3426011 - RNA, 15 nt, Pseudomonas aeruginosa PA01
cgaaguugccgccgc

SEQ ID NO: 3426012 - RNA, 17 nt, Pseudomonas aeruginosa PA01
cgaaguugccgccgcug

SEQ ID NO: 3426013 - RNA, 20 nt, Pseudomonas aeruginosa PA01
cgaauaaccauugcgcggga

SEQ ID NO: 3426014 - RNA, 21 nt, Pseudomonas aeruginosa PA01
cgaauaaccgcaucgcgguua

SEQ ID NO: 3426015 - RNA, 21 nt, Pseudomonas aeruginosa PA01
cgaauaaccgcugcgcgguua

SEQ ID NO: 3426016 - RNA, 16 nt, Pseudomonas aeruginosa PA01
cgaauaacgccaccgg

SEQ ID NO: 3426017 - RNA, 13 nt, Pseudomonas aeruginosa PA01
cgaauaacgccgc

SEQ ID NO: 3426018 - RNA, 20 nt, Pseudomonas aeruginosa PA01
cgaauaacgccgcaggcguu

SEQ ID NO: 3426019 - RNA, 21 nt, Pseudomonas aeruginosa PA01
cgaauaacgccgcaggcguua

SEQ ID NO: 3426020 - RNA, 15 nt, Pseudomonas aeruginosa PA01
cgaauacaccgagcg

SEQ ID NO: 3426021 - RNA, 17 nt, Pseudomonas aeruginosa PA01
cgacaggucggccggca

SEQ ID NO: 3426022 - RNA, 20 nt, Pseudomonas aeruginosa PA01
cgacaggucggccggcagcu

SEQ ID NO: 3426023 - RNA, 22 nt, Pseudomonas aeruginosa PA01
cgacaggucggccggcagcucc

SEQ ID NO: 3426024 - RNA, 14 nt, Pseudomonas aeruginosa PA01
cgacaggucggcga

SEQ ID NO: 3426025 - RNA, 16 nt, Pseudomonas aeruginosa PA01
cgacagguucaggacg

SEQ ID NO: 3426026 - RNA, 17 nt, Pseudomonas aeruginosa PA01
cgacagguucaggacgc

SEQ ID NO: 3426027 - RNA, 16 nt, Pseudomonas aeruginosa PA01
cgacagucagaacaca

SEQ ID NO: 3426028 - RNA, 16 nt, Pseudomonas aeruginosa PA01
cgacagucccaggcca

SEQ ID NO: 3426029 - RNA, 19 nt, Pseudomonas aeruginosa PA01
cgacagucccaggccaacc

SEQ ID NO: 3426030 - RNA, 15 nt, Pseudomonas aeruginosa PA01
cgacaguucgccgcc

SEQ ID NO: 3426031 - RNA, 16 nt, Pseudomonas aeruginosa PA01
cgacaguucgccgccc

SEQ ID NO: 3426032 - RNA, 14 nt, Pseudomonas aeruginosa PA01
cgacauacuccgcc

SEQ ID NO: 3426033 - RNA, 15 nt, Pseudomonas aeruginosa PA01
cgacauacuccgccg

SEQ ID NO: 3426034 - RNA, 19 nt, Pseudomonas aeruginosa PA01
cgacauacuccgccgcuuc

SEQ ID NO: 3426035 - RNA, 14 nt, Pseudomonas aeruginosa PA01
cgacauagccggcg

SEQ ID NO: 3426036 - RNA, 18 nt, Pseudomonas aeruginosa PA01
cgacauagccggcgaacc

SEQ ID NO: 3426037 - RNA, 17 nt, Pseudomonas aeruginosa PA01
cgacauagcgcagcacc

SEQ ID NO: 3426038 - RNA, 18 nt, Pseudomonas aeruginosa PA01
cgacauagcgcagcaccg

SEQ ID NO: 3426039 - RNA, 15 nt, Pseudomonas aeruginosa PA01
cgacauagcggcugc

SEQ ID NO: 3426040 - RNA, 16 nt, Pseudomonas aeruginosa PA01
cgacauccugucgagg

SEQ ID NO: 3426041 - RNA, 19 nt, Pseudomonas aeruginosa PA01
cgacauccugucgaggccu

SEQ ID NO: 3426042 - RNA, 18 nt, Pseudomonas aeruginosa PA01
cgacaucgacgcccucgg

SEQ ID NO: 3426043 - RNA, 20 nt, Pseudomonas aeruginosa PA01
cgacaucggagugcaugccg

SEQ ID NO: 3426044 - RNA, 16 nt, Pseudomonas aeruginosa PA01
cgacaucuccaggccg

SEQ ID NO: 3426045 - RNA, 12 nt, Pseudomonas aeruginosa PA01
cgacaucucguc

SEQ ID NO: 3426046 - RNA, 18 nt, Pseudomonas aeruginosa PA01
cgacaugcaggccggccu

SEQ ID NO: 3426047 - RNA, 13 nt, Pseudomonas aeruginosa PA01
cgacaugccccgc

SEQ ID NO: 3426048 - RNA, 14 nt, Pseudomonas aeruginosa PA01
cgacaugccccgcc

SEQ ID NO: 3426049 - RNA, 15 nt, Pseudomonas aeruginosa PA01
cgacaugccccgccg

SEQ ID NO: 3426050 - RNA, 20 nt, Pseudomonas aeruginosa PA01
cgacaugccgguucccgcag

SEQ ID NO: 3426051 - RNA, 21 nt, Pseudomonas aeruginosa PA01
cgacaugccgguucccgcagc

SEQ ID NO: 3426052 - RNA, 16 nt, Pseudomonas aeruginosa PA01
cgacauggaucaccgc

SEQ ID NO: 3426053 - RNA, 17 nt, Pseudomonas aeruginosa PA01
cgacauggaucaccgcc

SEQ ID NO: 3426054 - RNA, 16 nt, Pseudomonas aeruginosa PA01
cgacaugggccgcgca

SEQ ID NO: 3426055 - RNA, 23 nt, Pseudomonas aeruginosa PA01
cgacaugggccgcgcagaucgcg

SEQ ID NO: 3426056 - RNA, 14 nt, Pseudomonas aeruginosa PA01
cgacauugcugccg

SEQ ID NO: 3426057 - RNA, 14 nt, Pseudomonas aeruginosa PA01
cgaccaacagggcg

SEQ ID NO: 3426058 - RNA, 21 nt, Pseudomonas aeruginosa PA01
cgaccacacaugcaggucgug

SEQ ID NO: 3426059 - RNA, 15 nt, Pseudomonas aeruginosa PA01
cgaccacaugggcga

SEQ ID NO: 3426060 - RNA, 16 nt, Pseudomonas aeruginosa PA01
cgaccacaugggcgac

SEQ ID NO: 3426061 - RNA, 23 nt, Pseudomonas aeruginosa PA01
cgaccaccaccaggucggcgcgc

SEQ ID NO: 3426062 - RNA, 13 nt, Pseudomonas aeruginosa PA01
cgaccaccaucac

SEQ ID NO: 3426063 - RNA, 16 nt, Pseudomonas aeruginosa PA01
cgaccaccaucaccgc

SEQ ID NO: 3426064 - RNA, 14 nt, Pseudomonas aeruginosa PA01
cgaccaccgccggg

SEQ ID NO: 3426065 - RNA, 15 nt, Pseudomonas aeruginosa PA01
cgaccaccgccggga

SEQ ID NO: 3426066 - RNA, 12 nt, Pseudomonas aeruginosa PA01
cgaccaccgcga

SEQ ID NO: 3426067 - RNA, 18 nt, Pseudomonas aeruginosa PA01
cgaccaccgcgaauccgc

SEQ ID NO: 3426068 - RNA, 12 nt, Pseudomonas aeruginosa PA01
cgaccaccgcgu

SEQ ID NO: 3426069 - RNA, 16 nt, Pseudomonas aeruginosa PA01
cgaccaccgcguggug

SEQ ID NO: 3426070 - RNA, 14 nt, Pseudomonas aeruginosa PA01
cgaccaccucggcg

SEQ ID NO: 3426071 - RNA, 19 nt, Pseudomonas aeruginosa PA01
cgaccaccucggcgucggc

SEQ ID NO: 3426072 - RNA, 18 nt, Pseudomonas aeruginosa PA01
cgaccaccuucaggcugc

SEQ ID NO: 3426073 - RNA, 14 nt, Pseudomonas aeruginosa PA01
cgaccacgacccgg

SEQ ID NO: 3426074 - RNA, 15 nt, Pseudomonas aeruginosa PA01
cgaccacgacccggg

SEQ ID NO: 3426075 - RNA, 18 nt, Pseudomonas aeruginosa PA01
cgaccacgacccgggucu

SEQ ID NO: 3426076 - RNA, 15 nt, Pseudomonas aeruginosa PA01
cgaccacgccugcca

SEQ ID NO: 3426077 - RNA, 21 nt, Pseudomonas aeruginosa PA01
cgaccacgcucuugaucgucu

SEQ ID NO: 3426078 - RNA, 19 nt, Pseudomonas aeruginosa PA01
cgaccacggccuucggcag

SEQ ID NO: 3426079 - RNA, 19 nt, Pseudomonas aeruginosa PA01
cgaccacguaguaggcgcg

SEQ ID NO: 3426080 - RNA, 15 nt, Pseudomonas aeruginosa PA01
cgaccacuucggcgg

SEQ ID NO: 3426081 - RNA, 16 nt, Pseudomonas aeruginosa PA01
cgaccacuucggcggu

SEQ ID NO: 3426082 - RNA, 20 nt, Pseudomonas aeruginosa PA01
cgaccagaaggucuugccca

SEQ ID NO: 3426083 - RNA, 17 nt, Pseudomonas aeruginosa PA01
cgaccagacgcagcagc

SEQ ID NO: 3426084 - RNA, 16 nt, Pseudomonas aeruginosa PA01
cgaccagaucggcaug

SEQ ID NO: 3426085 - RNA, 12 nt, Pseudomonas aeruginosa PA01
cgaccagcacgg

SEQ ID NO: 3426086 - RNA, 13 nt, Pseudomonas aeruginosa PA01
cgaccagcacggc

SEQ ID NO: 3426087 - RNA, 14 nt, Pseudomonas aeruginosa PA01
cgaccagcagcggc

SEQ ID NO: 3426088 - RNA, 15 nt, Pseudomonas aeruginosa PA01
cgaccagcagcggcu

SEQ ID NO: 3426089 - RNA, 21 nt, Pseudomonas aeruginosa PA01
cgaccagcagcggcucacgcc

SEQ ID NO: 3426090 - RNA, 22 nt, Pseudomonas aeruginosa PA01
cgaccagcagggccagcagcgc

SEQ ID NO: 3426091 - RNA, 13 nt, Pseudomonas aeruginosa PA01
cgaccagcccgcg

SEQ ID NO: 3426092 - RNA, 14 nt, Pseudomonas aeruginosa PA01
cgaccagccgcagg

SEQ ID NO: 3426093 - RNA, 18 nt, Pseudomonas aeruginosa PA01
cgaccagccgcaggcugc

SEQ ID NO: 3426094 - RNA, 19 nt, Pseudomonas aeruginosa PA01
cgaccagccgcaggcugcc

SEQ ID NO: 3426095 - RNA, 20 nt, Pseudomonas aeruginosa PA01
cgaccagccgcaggcugccg

SEQ ID NO: 3426096 - RNA, 11 nt, Pseudomonas aeruginosa PA01
cgaccagcgcc

SEQ ID NO: 3426097 - RNA, 14 nt, Pseudomonas aeruginosa PA01
cgaccagcgccagg

SEQ ID NO: 3426098 - RNA, 16 nt, Pseudomonas aeruginosa PA01
cgaccagcgccaggcg

SEQ ID NO: 3426099 - RNA, 18 nt, Pseudomonas aeruginosa PA01
cgaccagcgccaggcgcg

SEQ ID NO: 3426100 - RNA, 12 nt, Pseudomonas aeruginosa PA01
cgaccagcgccg

SEQ ID NO: 3426101 - RNA, 14 nt, Pseudomonas aeruginosa PA01
cgaccagcgccgcg

SEQ ID NO: 3426102 - RNA, 15 nt, Pseudomonas aeruginosa PA01
cgaccagcgccgcgg

SEQ ID NO: 3426103 - RNA, 16 nt, Pseudomonas aeruginosa PA01
cgaccagcgccgcggc

SEQ ID NO: 3426104 - RNA, 20 nt, Pseudomonas aeruginosa PA01
cgaccagcgccgcggcgacc

SEQ ID NO: 3426105 - RNA, 19 nt, Pseudomonas aeruginosa PA01
cgaccagcgucgcgcgugc

SEQ ID NO: 3426106 - RNA, 16 nt, Pseudomonas aeruginosa PA01
cgaccagcuucaaccg

SEQ ID NO: 3426107 - RNA, 20 nt, Pseudomonas aeruginosa PA01
cgaccaggaauuccuggccg

SEQ ID NO: 3426108 - RNA, 22 nt, Pseudomonas aeruginosa PA01
cgaccaggaauuccuggccggu

SEQ ID NO: 3426109 - RNA, 19 nt, Pseudomonas aeruginosa PA01
cgaccaggacagcacgcuc

SEQ ID NO: 3426110 - RNA, 22 nt, Pseudomonas aeruginosa PA01
cgaccaggacagcacgcucagg

SEQ ID NO: 3426111 - RNA, 17 nt, Pseudomonas aeruginosa PA01
cgaccaggccguaggcg

SEQ ID NO: 3426112 - RNA, 19 nt, Pseudomonas aeruginosa PA01
cgaccaggcggccgucggc

SEQ ID NO: 3426113 - RNA, 20 nt, Pseudomonas aeruginosa PA01
cgaccaggcguuccaccagg

SEQ ID NO: 3426114 - RNA, 14 nt, Pseudomonas aeruginosa PA01
cgaccagggcaucc

SEQ ID NO: 3426115 - RNA, 14 nt, Pseudomonas aeruginosa PA01
cgaccagggccggg

SEQ ID NO: 3426116 - RNA, 23 nt, Pseudomonas aeruginosa PA01
cgaccagggggcgacauagcggc

SEQ ID NO: 3426117 - RNA, 22 nt, Pseudomonas aeruginosa PA01
cgaccagguagagcagcccggg

SEQ ID NO: 3426118 - RNA, 16 nt, Pseudomonas aeruginosa PA01
cgaccagguccgccac

SEQ ID NO: 3426119 - RNA, 15 nt, Pseudomonas aeruginosa PA01
cgaccagguccggag

SEQ ID NO: 3426120 - RNA, 22 nt, Pseudomonas aeruginosa PA01
cgaccagguccggagggcccgg

SEQ ID NO: 3426121 - RNA, 18 nt, Pseudomonas aeruginosa PA01
cgaccagguccggcagcg

SEQ ID NO: 3426122 - RNA, 18 nt, Pseudomonas aeruginosa PA01
cgaccaguaccagcaaug

SEQ ID NO: 3426123 - RNA, 15 nt, Pseudomonas aeruginosa PA01
cgaccaguaccaggc

SEQ ID NO: 3426124 - RNA, 17 nt, Pseudomonas aeruginosa PA01
cgaccggguccugcaga

SEQ ID NO: 3426125 - RNA, 17 nt, Pseudomonas aeruginosa PA01
cgaccggguugaugccg

SEQ ID NO: 3426126 - RNA, 22 nt, Pseudomonas aeruginosa PA01
cgaccggguugaugccgaggcu

SEQ ID NO: 3426127 - RNA, 18 nt, Pseudomonas aeruginosa PA01
cgaccgguaacuggccag

SEQ ID NO: 3426128 - RNA, 19 nt, Pseudomonas aeruginosa PA01
cgaccgguaacuggccagg

SEQ ID NO: 3426129 - RNA, 12 nt, Pseudomonas aeruginosa PA01
cgaccgguagcc

SEQ ID NO: 3426130 - RNA, 13 nt, Pseudomonas aeruginosa PA01
cgaccgguagcca

SEQ ID NO: 3426131 - RNA, 14 nt, Pseudomonas aeruginosa PA01
cgaccgguagccau

SEQ ID NO: 3426132 - RNA, 17 nt, Pseudomonas aeruginosa PA01
cgaccgguuccagcggc

SEQ ID NO: 3426133 - RNA, 19 nt, Pseudomonas aeruginosa PA01
cgaccgguuccagcggccg

SEQ ID NO: 3426134 - RNA, 20 nt, Pseudomonas aeruginosa PA01
cgaccgguuccagcggccgc

SEQ ID NO: 3426135 - RNA, 21 nt, Pseudomonas aeruginosa PA01
cgaccgguuccagcggccgcg

SEQ ID NO: 3426136 - RNA, 22 nt, Pseudomonas aeruginosa PA01
cgaccgguuccgcgucgccuuc

SEQ ID NO: 3426137 - RNA, 15 nt, Pseudomonas aeruginosa PA01
cgaccgucgccacgc

SEQ ID NO: 3426138 - RNA, 16 nt, Pseudomonas aeruginosa PA01
cgaccgucgccacgcu

SEQ ID NO: 3426139 - RNA, 13 nt, Pseudomonas aeruginosa PA01
cgaccgucggccg

SEQ ID NO: 3426140 - RNA, 14 nt, Pseudomonas aeruginosa PA01
cgaccgucggccgg

SEQ ID NO: 3426141 - RNA, 15 nt, Pseudomonas aeruginosa PA01
cgaccgucggccggg

SEQ ID NO: 3426142 - RNA, 14 nt, Pseudomonas aeruginosa PA01
cgaccgugaggcgc

SEQ ID NO: 3426143 - RNA, 14 nt, Pseudomonas aeruginosa PA01
cgaccuccaggccg

SEQ ID NO: 3426144 - RNA, 20 nt, Pseudomonas aeruginosa PA01
cgaccuccaggccgaagccg

SEQ ID NO: 3426145 - RNA, 23 nt, Pseudomonas aeruginosa PA01
cgaccuccaggccgaagccgccg

SEQ ID NO: 3426146 - RNA, 15 nt, Pseudomonas aeruginosa PA01
cgaccuccgccgcuu

SEQ ID NO: 3426147 - RNA, 16 nt, Pseudomonas aeruginosa PA01
cgaccuccgccgcuuc

SEQ ID NO: 3426148 - RNA, 19 nt, Pseudomonas aeruginosa PA01
cgaccuccgccgcuuccgc

SEQ ID NO: 3426149 - RNA, 23 nt, Pseudomonas aeruginosa PA01
cgaccuccgccgcuuccgccagg

SEQ ID NO: 3426150 - RNA, 20 nt, Pseudomonas aeruginosa PA01
cgaccucgauggcgauaugg

SEQ ID NO: 3426151 - RNA, 14 nt, Pseudomonas aeruginosa PA01
cgaccucgcgggcg

SEQ ID NO: 3426152 - RNA, 15 nt, Pseudomonas aeruginosa PA01
cgaccucgcgggcga

SEQ ID NO: 3426153 - RNA, 16 nt, Pseudomonas aeruginosa PA01
cgaccucgcgggcgac

SEQ ID NO: 3426154 - RNA, 12 nt, Pseudomonas aeruginosa PA01
cgaccucggccg

SEQ ID NO: 3426155 - RNA, 14 nt, Pseudomonas aeruginosa PA01
cgaccucggccgca

SEQ ID NO: 3426156 - RNA, 14 nt, Pseudomonas aeruginosa PA01
cgaccucggccgcc

SEQ ID NO: 3426157 - RNA, 15 nt, Pseudomonas aeruginosa PA01
cgaccucggccgcca

SEQ ID NO: 3426158 - RNA, 18 nt, Pseudomonas aeruginosa PA01
cgaccucggccgccaggg

SEQ ID NO: 3426159 - RNA, 13 nt, Pseudomonas aeruginosa PA01
cgaccucggcggu

SEQ ID NO: 3426160 - RNA, 18 nt, Pseudomonas aeruginosa PA01
cgaccucguugcaggcac

SEQ ID NO: 3426161 - RNA, 19 nt, Pseudomonas aeruginosa PA01
cgaccucguugcaggcacg

SEQ ID NO: 3426162 - RNA, 15 nt, Pseudomonas aeruginosa PA01
cgaccugcggggcgg

SEQ ID NO: 3426163 - RNA, 16 nt, Pseudomonas aeruginosa PA01
cgaccugcggggcgga

SEQ ID NO: 3426164 - RNA, 19 nt, Pseudomonas aeruginosa PA01
cgaccugcggugucccuuc

SEQ ID NO: 3426165 - RNA, 17 nt, Pseudomonas aeruginosa PA01
cgaccugcucgaaccgg

SEQ ID NO: 3426166 - RNA, 21 nt, Pseudomonas aeruginosa PA01
cgaccugcucgaaccggaaaa

SEQ ID NO: 3426167 - RNA, 15 nt, Pseudomonas aeruginosa PA01
cgaccugcucgcgca

SEQ ID NO: 3426168 - RNA, 18 nt, Pseudomonas aeruginosa PA01
cgaccugcucgcgcaccg

SEQ ID NO: 3426169 - RNA, 19 nt, Pseudomonas aeruginosa PA01
cgaccugcucgcgcaccgc

SEQ ID NO: 3426170 - RNA, 14 nt, Pseudomonas aeruginosa PA01
cgaccugcucgucg

SEQ ID NO: 3426171 - RNA, 23 nt, Pseudomonas aeruginosa PA01
cgaccugcucgucgaugcugccg

SEQ ID NO: 3426172 - RNA, 17 nt, Pseudomonas aeruginosa PA01
cgaccuggccacgcccg

SEQ ID NO: 3426173 - RNA, 18 nt, Pseudomonas aeruginosa PA01
cgaccuggccacgcccgg

SEQ ID NO: 3426174 - RNA, 20 nt, Pseudomonas aeruginosa PA01
cgaccugggcgucgcuguag

SEQ ID NO: 3426175 - RNA, 17 nt, Pseudomonas aeruginosa PA01
cgaccuggguaccgacg

SEQ ID NO: 3426176 - RNA, 18 nt, Pseudomonas aeruginosa PA01
cgaccuggguaccgacgg

SEQ ID NO: 3426177 - RNA, 23 nt, Pseudomonas aeruginosa PA01
cgaccugguagcagagggucgcc

SEQ ID NO: 3426178 - RNA, 21 nt, Pseudomonas aeruginosa PA01
cgaccugguggcgccggcuga

SEQ ID NO: 3426179 - RNA, 19 nt, Pseudomonas aeruginosa PA01
cgaccuguaccgcucccca

SEQ ID NO: 3426180 - RNA, 15 nt, Pseudomonas aeruginosa PA01
cgaccuucaccacca

SEQ ID NO: 3426181 - RNA, 18 nt, Pseudomonas aeruginosa PA01
cgaccuucaccaccagcg

SEQ ID NO: 3426182 - RNA, 18 nt, Pseudomonas aeruginosa PA01
cgaccuucaucaggcggc

SEQ ID NO: 3426183 - RNA, 19 nt, Pseudomonas aeruginosa PA01
cgaccuucaucaggcggca

SEQ ID NO: 3426184 - RNA, 17 nt, Pseudomonas aeruginosa PA01
cgaccuucuccgaccag

SEQ ID NO: 3426185 - RNA, 18 nt, Pseudomonas aeruginosa PA01
cgaccuucuccgaccagg

SEQ ID NO: 3426186 - RNA, 17 nt, Pseudomonas aeruginosa PA01
cgaccuugacgaagccg

SEQ ID NO: 3426187 - RNA, 20 nt, Pseudomonas aeruginosa PA01
cgaccuugacgaagccggcg

SEQ ID NO: 3426188 - RNA, 15 nt, Pseudomonas aeruginosa PA01
cgaccuugcccucgg

SEQ ID NO: 3426189 - RNA, 17 nt, Pseudomonas aeruginosa PA01
cgaccuugcccucggcg

SEQ ID NO: 3426190 - RNA, 18 nt, Pseudomonas aeruginosa PA01
cgaccuugcccucggcgc

SEQ ID NO: 3426191 - RNA, 20 nt, Pseudomonas aeruginosa PA01
cgaccuugcccucggcgccc

SEQ ID NO: 3426192 - RNA, 14 nt, Pseudomonas aeruginosa PA01
cgaccuugcccuug

SEQ ID NO: 3426193 - RNA, 19 nt, Pseudomonas aeruginosa PA01
cgaccuugccgacgccgcg

SEQ ID NO: 3426194 - RNA, 23 nt, Pseudomonas aeruginosa PA01
cgaccuugccgacgccgcggccg

SEQ ID NO: 3426195 - RNA, 21 nt, Pseudomonas aeruginosa PA01
cgaccuugcgcaccagggcca

SEQ ID NO: 3426196 - RNA, 18 nt, Pseudomonas aeruginosa PA01
cgaccuugcgucuucgcc

SEQ ID NO: 3426197 - RNA, 23 nt, Pseudomonas aeruginosa PA01
cgaccuugcuggugcccugggcg

SEQ ID NO: 3426198 - RNA, 14 nt, Pseudomonas aeruginosa PA01
cgaccuuggccagc

SEQ ID NO: 3426199 - RNA, 19 nt, Pseudomonas aeruginosa PA01
cgaccuuguccaggcgcug

SEQ ID NO: 3426200 - RNA, 20 nt, Pseudomonas aeruginosa PA01
cgaccuuguccaggcgcugc

SEQ ID NO: 3426201 - RNA, 16 nt, Pseudomonas aeruginosa PA01
cgaccuuugaggguca

SEQ ID NO: 3426202 - RNA, 21 nt, Pseudomonas aeruginosa PA01
cgacgaaacggcucugcuucu

SEQ ID NO: 3426203 - RNA, 16 nt, Pseudomonas aeruginosa PA01
cgacgaaagaagccgc

SEQ ID NO: 3426204 - RNA, 17 nt, Pseudomonas aeruginosa PA01
cgacgaaagacgcugcg

SEQ ID NO: 3426205 - RNA, 15 nt, Pseudomonas aeruginosa PA01
cgacgaaaggccgcg

SEQ ID NO: 3426206 - RNA, 18 nt, Pseudomonas aeruginosa PA01
cgacgaaaggccgcgccg

SEQ ID NO: 3426207 - RNA, 22 nt, Pseudomonas aeruginosa PA01
cgacgaaauaaugcggcgcgau

SEQ ID NO: 3426208 - RNA, 17 nt, Pseudomonas aeruginosa PA01
cgacgaaauagucgcgg

SEQ ID NO: 3426209 - RNA, 17 nt, Pseudomonas aeruginosa PA01
cgacgaacaggaagcgc

SEQ ID NO: 3426210 - RNA, 17 nt, Pseudomonas aeruginosa PA01
cgacgaacucgacgcgc

SEQ ID NO: 3426211 - RNA, 14 nt, Pseudomonas aeruginosa PA01
cgacgaagacgcuc

SEQ ID NO: 3426212 - RNA, 19 nt, Pseudomonas aeruginosa PA01
cgacgaagacgcugcgcac

SEQ ID NO: 3426213 - RNA, 13 nt, Pseudomonas aeruginosa PA01
cgacgaagcccag

SEQ ID NO: 3426214 - RNA, 17 nt, Pseudomonas aeruginosa PA01
cgacgaagcccaggcug

SEQ ID NO: 3426215 - RNA, 15 nt, Pseudomonas aeruginosa PA01
cgacgaagcccucgc

SEQ ID NO: 3426216 - RNA, 18 nt, Pseudomonas aeruginosa PA01
cgacgaagcgccggcggc

SEQ ID NO: 3426217 - RNA, 19 nt, Pseudomonas aeruginosa PA01
cgacgaagcgccggcggcc

SEQ ID NO: 3426218 - RNA, 22 nt, Pseudomonas aeruginosa PA01
cgacgaagcgccggcggccugc

SEQ ID NO: 3426219 - RNA, 15 nt, Pseudomonas aeruginosa PA01
cgacgaaggccgcgg

SEQ ID NO: 3426220 - RNA, 11 nt, Pseudomonas aeruginosa PA01
cgacgaaggcg

SEQ ID NO: 3426221 - RNA, 12 nt, Pseudomonas aeruginosa PA01
cgacgaaggcga

SEQ ID NO: 3426222 - RNA, 18 nt, Pseudomonas aeruginosa PA01
cgacgaaggcgcgcucga

SEQ ID NO: 3426223 - RNA, 14 nt, Pseudomonas aeruginosa PA01
cgacgaaggucggc

SEQ ID NO: 3426224 - RNA, 15 nt, Pseudomonas aeruginosa PA01
cgacgaaggucggcg

SEQ ID NO: 3426225 - RNA, 16 nt, Pseudomonas aeruginosa PA01
cgacgaaggucggcgg

SEQ ID NO: 3426226 - RNA, 20 nt, Pseudomonas aeruginosa PA01
cgacgaaggucggcggcagc

SEQ ID NO: 3426227 - RNA, 22 nt, Pseudomonas aeruginosa PA01
cgacgccgcgucccugcacagg

SEQ ID NO: 3426228 - RNA, 12 nt, Pseudomonas aeruginosa PA01
cgacgccgcugg

SEQ ID NO: 3426229 - RNA, 15 nt, Pseudomonas aeruginosa PA01
cgacgccgcuggcgg

SEQ ID NO: 3426230 - RNA, 17 nt, Pseudomonas aeruginosa PA01
cgacgccgcuggcggcg

SEQ ID NO: 3426231 - RNA, 19 nt, Pseudomonas aeruginosa PA01
cgacgccgcuggcggcgcu

SEQ ID NO: 3426232 - RNA, 18 nt, Pseudomonas aeruginosa PA01
cgacgccggacgcaccag

SEQ ID NO: 3426233 - RNA, 14 nt, Pseudomonas aeruginosa PA01
cgacgccggcuucc

SEQ ID NO: 3426234 - RNA, 13 nt, Pseudomonas aeruginosa PA01
cgacgccggucgg

SEQ ID NO: 3426235 - RNA, 14 nt, Pseudomonas aeruginosa PA01
cgacgccgucccau

SEQ ID NO: 3426236 - RNA, 16 nt, Pseudomonas aeruginosa PA01
cgacgccucggcgcga

SEQ ID NO: 3426237 - RNA, 15 nt, Pseudomonas aeruginosa PA01
cgacgccuucagcau

SEQ ID NO: 3426238 - RNA, 16 nt, Pseudomonas aeruginosa PA01
cgacgccuucagcaug

SEQ ID NO: 3426239 - RNA, 23 nt, Pseudomonas aeruginosa PA01
cgacgccuugcccggcgcguaga

SEQ ID NO: 3426240 - RNA, 16 nt, Pseudomonas aeruginosa PA01
cgacgcgacauccucc

SEQ ID NO: 3426241 - RNA, 15 nt, Pseudomonas aeruginosa PA01
cgacgcgaccuccgg

SEQ ID NO: 3426242 - RNA, 17 nt, Pseudomonas aeruginosa PA01
cgacgcgaccuccggcg

SEQ ID NO: 3426243 - RNA, 19 nt, Pseudomonas aeruginosa PA01
cgacgcgaccuccggcgcc

SEQ ID NO: 3426244 - RNA, 20 nt, Pseudomonas aeruginosa PA01
cgacgcgaccuccggcgcca

SEQ ID NO: 3426245 - RNA, 22 nt, Pseudomonas aeruginosa PA01
cgacgcgaccuccggcgccagg

SEQ ID NO: 3426246 - RNA, 14 nt, Pseudomonas aeruginosa PA01
cgacgcgcaggccg

SEQ ID NO: 3426247 - RNA, 12 nt, Pseudomonas aeruginosa PA01
cgacgcgccagg

SEQ ID NO: 3426248 - RNA, 13 nt, Pseudomonas aeruginosa PA01
cgacgcgccaggu

SEQ ID NO: 3426249 - RNA, 12 nt, Pseudomonas aeruginosa PA01
cgacgcgcugcc

SEQ ID NO: 3426250 - RNA, 14 nt, Pseudomonas aeruginosa PA01
cgacgcgcuggacc

SEQ ID NO: 3426251 - RNA, 15 nt, Pseudomonas aeruginosa PA01
cgacgcgcuggacca

SEQ ID NO: 3426252 - RNA, 19 nt, Pseudomonas aeruginosa PA01
cgacgcggauaccgagggu

SEQ ID NO: 3426253 - RNA, 12 nt, Pseudomonas aeruginosa PA01
cgacgcguccgg

SEQ ID NO: 3426254 - RNA, 22 nt, Pseudomonas aeruginosa PA01
cgacgcguugcuuguguccgcc

SEQ ID NO: 3426255 - RNA, 16 nt, Pseudomonas aeruginosa PA01
cgacgcuacguuccag

SEQ ID NO: 3426256 - RNA, 16 nt, Pseudomonas aeruginosa PA01
cgacgcucagcacccu

SEQ ID NO: 3426257 - RNA, 17 nt, Pseudomonas aeruginosa PA01
cgacgcucagcacccug

SEQ ID NO: 3426258 - RNA, 14 nt, Pseudomonas aeruginosa PA01
cgacgcuccagcgg

SEQ ID NO: 3426259 - RNA, 17 nt, Pseudomonas aeruginosa PA01
cgacgcuccagcggcag

SEQ ID NO: 3426260 - RNA, 20 nt, Pseudomonas aeruginosa PA01
cgacgcuccaggugcacggc

SEQ ID NO: 3426261 - RNA, 14 nt, Pseudomonas aeruginosa PA01
cgacgcucgcggca

SEQ ID NO: 3426262 - RNA, 21 nt, Pseudomonas aeruginosa PA01
cgacgcucugcucggccagcg

SEQ ID NO: 3426263 - RNA, 11 nt, Pseudomonas aeruginosa PA01
cgacgcucuuc

SEQ ID NO: 3426264 - RNA, 20 nt, Pseudomonas aeruginosa PA01
cgacgcucuucagcgguccg

SEQ ID NO: 3426265 - RNA, 18 nt, Pseudomonas aeruginosa PA01
cgacgcugaggaucacga

SEQ ID NO: 3426266 - RNA, 16 nt, Pseudomonas aeruginosa PA01
cgacgcugaucaucga

SEQ ID NO: 3426267 - RNA, 17 nt, Pseudomonas aeruginosa PA01
cgacgcugaugaugccg

SEQ ID NO: 3426268 - RNA, 16 nt, Pseudomonas aeruginosa PA01
cgacgcugaugccggc

SEQ ID NO: 3426269 - RNA, 18 nt, Pseudomonas aeruginosa PA01
cgacgcugaugccggcga

SEQ ID NO: 3426270 - RNA, 18 nt, Pseudomonas aeruginosa PA01
cgacgcugcccagcccgc

SEQ ID NO: 3426271 - RNA, 19 nt, Pseudomonas aeruginosa PA01
cgacgcugcccagcccgcc

SEQ ID NO: 3426272 - RNA, 17 nt, Pseudomonas aeruginosa PA01
cgacgcuggccugccga

SEQ ID NO: 3426273 - RNA, 18 nt, Pseudomonas aeruginosa PA01
cgacgcuggccugccgau

SEQ ID NO: 3426274 - RNA, 21 nt, Pseudomonas aeruginosa PA01
cgacgcuggccugccgauggg

SEQ ID NO: 3426275 - RNA, 17 nt, Pseudomonas aeruginosa PA01
cgacgcuguugccggca

SEQ ID NO: 3426276 - RNA, 17 nt, Pseudomonas aeruginosa PA01
cgacggaacaagccgcc

SEQ ID NO: 3426277 - RNA, 13 nt, Pseudomonas aeruginosa PA01
cgacggaacagga

SEQ ID NO: 3426278 - RNA, 13 nt, Pseudomonas aeruginosa PA01
cgacggaagcccu

SEQ ID NO: 3426279 - RNA, 15 nt, Pseudomonas aeruginosa PA01
cgacggaaggugcgg

SEQ ID NO: 3426280 - RNA, 23 nt, Pseudomonas aeruginosa PA01
cgacggcaacugagcgcaacucg

SEQ ID NO: 3426281 - RNA, 16 nt, Pseudomonas aeruginosa PA01
cgacggcaccagcgcg

SEQ ID NO: 3426282 - RNA, 18 nt, Pseudomonas aeruginosa PA01
cgacggcaccagcgcguc

SEQ ID NO: 3426283 - RNA, 23 nt, Pseudomonas aeruginosa PA01
cgacggcauuccugguccagcca

SEQ ID NO: 3426284 - RNA, 14 nt, Pseudomonas aeruginosa PA01
cgacggcccuccgg

SEQ ID NO: 3426285 - RNA, 21 nt, Pseudomonas aeruginosa PA01
cgacggcccugacauccuugg

SEQ ID NO: 3426286 - RNA, 15 nt, Pseudomonas aeruginosa PA01
cgacggcgaucucag

SEQ ID NO: 3426287 - RNA, 22 nt, Pseudomonas aeruginosa PA01
cgacggcgcaagggcgccgccg

SEQ ID NO: 3426288 - RNA, 14 nt, Pseudomonas aeruginosa PA01
cgacggcgcgcugc

SEQ ID NO: 3426289 - RNA, 12 nt, Pseudomonas aeruginosa PA01
cgacggcggccg

SEQ ID NO: 3426290 - RNA, 14 nt, Pseudomonas aeruginosa PA01
cgacggcggccgcc

SEQ ID NO: 3426291 - RNA, 16 nt, Pseudomonas aeruginosa PA01
cgacggcggccgccau

SEQ ID NO: 3426292 - RNA, 13 nt, Pseudomonas aeruginosa PA01
cgacggcggcggc

SEQ ID NO: 3426293 - RNA, 13 nt, Pseudomonas aeruginosa PA01
cgacggcggugcg

SEQ ID NO: 3426294 - RNA, 15 nt, Pseudomonas aeruginosa PA01
cgacggcgugcaggu

SEQ ID NO: 3426295 - RNA, 23 nt, Pseudomonas aeruginosa PA01
cgacggcucgaacgaguggggcg

SEQ ID NO: 3426296 - RNA, 15 nt, Pseudomonas aeruginosa PA01
cgacggcucuucccc

SEQ ID NO: 3426297 - RNA, 15 nt, Pseudomonas aeruginosa PA01
cgacggcugcuccgg

SEQ ID NO: 3426298 - RNA, 13 nt, Pseudomonas aeruginosa PA01
cgacggcuuccag

SEQ ID NO: 3426299 - RNA, 14 nt, Pseudomonas aeruginosa PA01
cgacggcuuccagg

SEQ ID NO: 3426300 - RNA, 15 nt, Pseudomonas aeruginosa PA01
cgacggcuuccaggg

SEQ ID NO: 3426301 - RNA, 14 nt, Pseudomonas aeruginosa PA01
cgacggcuucgacc

SEQ ID NO: 3426302 - RNA, 15 nt, Pseudomonas aeruginosa PA01
cgacggcuugaucac

SEQ ID NO: 3426303 - RNA, 18 nt, Pseudomonas aeruginosa PA01
cgacgggaagcgaaccag

SEQ ID NO: 3426304 - RNA, 21 nt, Pseudomonas aeruginosa PA01
cgacgggaagcgaaccaggca

SEQ ID NO: 3426305 - RNA, 22 nt, Pseudomonas aeruginosa PA01
cgacgggagcgcgaggcgcagg

SEQ ID NO: 3426306 - RNA, 16 nt, Pseudomonas aeruginosa PA01
cgacgggcgcuuccgg

SEQ ID NO: 3426307 - RNA, 12 nt, Pseudomonas aeruginosa PA01
cgacgggucgcc

SEQ ID NO: 3426308 - RNA, 14 nt, Pseudomonas aeruginosa PA01
cgacgggucgccau

SEQ ID NO: 3426309 - RNA, 16 nt, Pseudomonas aeruginosa PA01
cgacggguuugugccg

SEQ ID NO: 3426310 - RNA, 19 nt, Pseudomonas aeruginosa PA01
cgacgguaccagggaagcg

SEQ ID NO: 3426311 - RNA, 20 nt, Pseudomonas aeruginosa PA01
cgacgguaccagggaagcgc

SEQ ID NO: 3426312 - RNA, 16 nt, Pseudomonas aeruginosa PA01
cgacggucagcaggcc

SEQ ID NO: 3426313 - RNA, 13 nt, Pseudomonas aeruginosa PA01
cgacggucaggcc

SEQ ID NO: 3426314 - RNA, 18 nt, Pseudomonas aeruginosa PA01
cgacggucaggccgagca

SEQ ID NO: 3426315 - RNA, 20 nt, Pseudomonas aeruginosa PA01
cgacggucaggccgagcagc

SEQ ID NO: 3426316 - RNA, 21 nt, Pseudomonas aeruginosa PA01
cgacggucaggccgagcagcg

SEQ ID NO: 3426317 - RNA, 23 nt, Pseudomonas aeruginosa PA01
cgacggucaggccgagcagcgcc

SEQ ID NO: 3426318 - RNA, 23 nt, Pseudomonas aeruginosa PA01
cgacggugaaguagaucgcccgc

SEQ ID NO: 3426319 - RNA, 20 nt, Pseudomonas aeruginosa PA01
cgacggugauagagcacgcc

SEQ ID NO: 3426320 - RNA, 17 nt, Pseudomonas aeruginosa PA01
cgacgguugauagcgcg

SEQ ID NO: 3426321 - RNA, 18 nt, Pseudomonas aeruginosa PA01
cgacguaccgccugccau

SEQ ID NO: 3426322 - RNA, 12 nt, Pseudomonas aeruginosa PA01
cgacguagaccu

SEQ ID NO: 3426323 - RNA, 14 nt, Pseudomonas aeruginosa PA01
cgacguagccgcgu

SEQ ID NO: 3426324 - RNA, 15 nt, Pseudomonas aeruginosa PA01
cgacguaggcggcga

SEQ ID NO: 3426325 - RNA, 22 nt, Pseudomonas aeruginosa PA01
cgacgucacggauaggcggcgg

SEQ ID NO: 3426326 - RNA, 23 nt, Pseudomonas aeruginosa PA01
cgacgucacggauaggcggcgga

SEQ ID NO: 3426327 - RNA, 18 nt, Pseudomonas aeruginosa PA01
cgacgucauaggccuugg

SEQ ID NO: 3426328 - RNA, 14 nt, Pseudomonas aeruginosa PA01
cgacguccaucagc

SEQ ID NO: 3426329 - RNA, 17 nt, Pseudomonas aeruginosa PA01
cgacgucccuuccccga

SEQ ID NO: 3426330 - RNA, 19 nt, Pseudomonas aeruginosa PA01
cgagaccucgcccaucgcc

SEQ ID NO: 3426331 - RNA, 23 nt, Pseudomonas aeruginosa PA01
cgagaccucgcccaucgccaggg

SEQ ID NO: 3426332 - RNA, 16 nt, Pseudomonas aeruginosa PA01
cgagacgaucagcagg

SEQ ID NO: 3426333 - RNA, 15 nt, Pseudomonas aeruginosa PA01
cgagacgccagccgc

SEQ ID NO: 3426334 - RNA, 17 nt, Pseudomonas aeruginosa PA01
cgagacgccagccgccc

SEQ ID NO: 3426335 - RNA, 20 nt, Pseudomonas aeruginosa PA01
cgagacgccagccgcccugg

SEQ ID NO: 3426336 - RNA, 18 nt, Pseudomonas aeruginosa PA01
cgagacgccaucaacgga

SEQ ID NO: 3426337 - RNA, 17 nt, Pseudomonas aeruginosa PA01
cgagacgcccuggauga

SEQ ID NO: 3426338 - RNA, 12 nt, Pseudomonas aeruginosa PA01
cgagacgccgag

SEQ ID NO: 3426339 - RNA, 15 nt, Pseudomonas aeruginosa PA01
cgagacgcugcaccg

SEQ ID NO: 3426340 - RNA, 21 nt, Pseudomonas aeruginosa PA01
cgagacgcugcaccgcggcgc

SEQ ID NO: 3426341 - RNA, 22 nt, Pseudomonas aeruginosa PA01
cgagacgcugcaccgcggcgcg

SEQ ID NO: 3426342 - RNA, 14 nt, Pseudomonas aeruginosa PA01
cgagacgggcgagg

SEQ ID NO: 3426343 - RNA, 21 nt, Pseudomonas aeruginosa PA01
cgagacgugaagccccuggcg

SEQ ID NO: 3426344 - RNA, 22 nt, Pseudomonas aeruginosa PA01
cgagacguugacgaucgccccg

SEQ ID NO: 3426345 - RNA, 16 nt, Pseudomonas aeruginosa PA01
cgagacuaccgaucgg

SEQ ID NO: 3426346 - RNA, 17 nt, Pseudomonas aeruginosa PA01
cgagacuaccgaucggc

SEQ ID NO: 3426347 - RNA, 21 nt, Pseudomonas aeruginosa PA01
cgagacuaccgaucggcugcc

SEQ ID NO: 3426348 - RNA, 21 nt, Pseudomonas aeruginosa PA01
cgagacuugaucgcacggcgg

SEQ ID NO: 3426349 - RNA, 22 nt, Pseudomonas aeruginosa PA01
cgagacuugaucgcacggcggg

SEQ ID NO: 3426350 - RNA, 16 nt, Pseudomonas aeruginosa PA01
cgagagaauccgccgu

SEQ ID NO: 3426351 - RNA, 17 nt, Pseudomonas aeruginosa PA01
cgagagaauccgccguu

SEQ ID NO: 3426352 - RNA, 15 nt, Pseudomonas aeruginosa PA01
cgagagcagggccug

SEQ ID NO: 3426353 - RNA, 18 nt, Pseudomonas aeruginosa PA01
cgagagcgccgaccagca

SEQ ID NO: 3426354 - RNA, 12 nt, Pseudomonas aeruginosa PA01
cgagagcgcugc

SEQ ID NO: 3426355 - RNA, 16 nt, Pseudomonas aeruginosa PA01
cgagagcgcugccgca

SEQ ID NO: 3426356 - RNA, 14 nt, Pseudomonas aeruginosa PA01
cgagagcggcgcca

SEQ ID NO: 3426357 - RNA, 16 nt, Pseudomonas aeruginosa PA01
cgagagcggcgccagg

SEQ ID NO: 3426358 - RNA, 17 nt, Pseudomonas aeruginosa PA01
cgagagcggguagcgcc

SEQ ID NO: 3426359 - RNA, 15 nt, Pseudomonas aeruginosa PA01
cgagagcguccggca

SEQ ID NO: 3426360 - RNA, 12 nt, Pseudomonas aeruginosa PA01
cgagagcugcaa

SEQ ID NO: 3426361 - RNA, 20 nt, Pseudomonas aeruginosa PA01
cgagagcuguccggcgcuga

SEQ ID NO: 3426362 - RNA, 22 nt, Pseudomonas aeruginosa PA01
cgagagcuguccggcgcugagc

SEQ ID NO: 3426363 - RNA, 21 nt, Pseudomonas aeruginosa PA01
cgagaggaagucgcuucaccg

SEQ ID NO: 3426364 - RNA, 14 nt, Pseudomonas aeruginosa PA01
cgagaggggcgcuc

SEQ ID NO: 3426365 - RNA, 23 nt, Pseudomonas aeruginosa PA01
cgagaggggcgcucguugcgccg

SEQ ID NO: 3426366 - RNA, 17 nt, Pseudomonas aeruginosa PA01
cgagaggguggucgcgc

SEQ ID NO: 3426367 - RNA, 17 nt, Pseudomonas aeruginosa PA01
cgagaggucggcgcgcc

SEQ ID NO: 3426368 - RNA, 20 nt, Pseudomonas aeruginosa PA01
cgagagugguauuggucgcg

SEQ ID NO: 3426369 - RNA, 15 nt, Pseudomonas aeruginosa PA01
cgagauagcggcaac

SEQ ID NO: 3426370 - RNA, 16 nt, Pseudomonas aeruginosa PA01
cgagaucaccuugucg

SEQ ID NO: 3426371 - RNA, 19 nt, Pseudomonas aeruginosa PA01
cgagaucuucaggccgaag

SEQ ID NO: 3426372 - RNA, 14 nt, Pseudomonas aeruginosa PA01
cgagaugaagcgcc

SEQ ID NO: 3426373 - RNA, 18 nt, Pseudomonas aeruginosa PA01
cgagaugcucgcgcagcg

SEQ ID NO: 3426374 - RNA, 22 nt, Pseudomonas aeruginosa PA01
cgagaugcucgcgcagcgacuc

SEQ ID NO: 3426375 - RNA, 17 nt, Pseudomonas aeruginosa PA01
cgagcaacacaugcagg

SEQ ID NO: 3426376 - RNA, 20 nt, Pseudomonas aeruginosa PA01
cgagcaacacaugcaggcuc

SEQ ID NO: 3426377 - RNA, 16 nt, Pseudomonas aeruginosa PA01
cgagcaacagcaggag

SEQ ID NO: 3426378 - RNA, 18 nt, Pseudomonas aeruginosa PA01
cgagcaaccgcgauggcg

SEQ ID NO: 3426379 - RNA, 14 nt, Pseudomonas aeruginosa PA01
cgagcaacggcagc

SEQ ID NO: 3426380 - RNA, 15 nt, Pseudomonas aeruginosa PA01
cgagcaacggcagca

SEQ ID NO: 3426381 - RNA, 14 nt, Pseudomonas aeruginosa PA01
cgagcaacucggcg

SEQ ID NO: 3426382 - RNA, 15 nt, Pseudomonas aeruginosa PA01
cgagcaacucggcgg

SEQ ID NO: 3426383 - RNA, 16 nt, Pseudomonas aeruginosa PA01
cgagcaacucggcggc

SEQ ID NO: 3426384 - RNA, 19 nt, Pseudomonas aeruginosa PA01
cgagcaacucggcggcgag

SEQ ID NO: 3426385 - RNA, 23 nt, Pseudomonas aeruginosa PA01
cgagcaacucggcggcgagcgcc

SEQ ID NO: 3426386 - RNA, 19 nt, Pseudomonas aeruginosa PA01
cgagcaacugcucgggcgu

SEQ ID NO: 3426387 - RNA, 21 nt, Pseudomonas aeruginosa PA01
cgagcaagccuuccagguagu

SEQ ID NO: 3426388 - RNA, 18 nt, Pseudomonas aeruginosa PA01
cgagcaauccggcgcugc

SEQ ID NO: 3426389 - RNA, 21 nt, Pseudomonas aeruginosa PA01
cgagcaauccggcgcugccga

SEQ ID NO: 3426390 - RNA, 22 nt, Pseudomonas aeruginosa PA01
cgagcaauccggcgcugccgaa

SEQ ID NO: 3426391 - RNA, 22 nt, Pseudomonas aeruginosa PA01
cgagcaaugaaaaaggcgaucg

SEQ ID NO: 3426392 - RNA, 23 nt, Pseudomonas aeruginosa PA01
cgagcaaugaaaaaggcgaucga

SEQ ID NO: 3426393 - RNA, 12 nt, Pseudomonas aeruginosa PA01
cgagcaccacca

SEQ ID NO: 3426394 - RNA, 21 nt, Pseudomonas aeruginosa PA01
cgagcaccaccacucgcgagc

SEQ ID NO: 3426395 - RNA, 18 nt, Pseudomonas aeruginosa PA01
cgagcaccacgcgcaagc

SEQ ID NO: 3426396 - RNA, 22 nt, Pseudomonas aeruginosa PA01
cgagcaccagcaggucggcgcg

SEQ ID NO: 3426397 - RNA, 14 nt, Pseudomonas aeruginosa PA01
cgagcaccaugcag

SEQ ID NO: 3426398 - RNA, 13 nt, Pseudomonas aeruginosa PA01
cgagcaccaugcc

SEQ ID NO: 3426399 - RNA, 18 nt, Pseudomonas aeruginosa PA01
cgagcaccaugccgauga

SEQ ID NO: 3426400 - RNA, 14 nt, Pseudomonas aeruginosa PA01
cgagcaccccgagc

SEQ ID NO: 3426401 - RNA, 15 nt, Pseudomonas aeruginosa PA01
cgagcaccgcgcaga

SEQ ID NO: 3426402 - RNA, 12 nt, Pseudomonas aeruginosa PA01
cgagcaccgcgg

SEQ ID NO: 3426403 - RNA, 15 nt, Pseudomonas aeruginosa PA01
cgagcaccggccuca

SEQ ID NO: 3426404 - RNA, 19 nt, Pseudomonas aeruginosa PA01
cgagcagaguuuagccgcc

SEQ ID NO: 3426405 - RNA, 18 nt, Pseudomonas aeruginosa PA01
cgagcagcaccaggcugg

SEQ ID NO: 3426406 - RNA, 20 nt, Pseudomonas aeruginosa PA01
cgagcagcaccaggcuggcc

SEQ ID NO: 3426407 - RNA, 19 nt, Pseudomonas aeruginosa PA01
cgagcagccgacgauccgg

SEQ ID NO: 3426408 - RNA, 15 nt, Pseudomonas aeruginosa PA01
cgagcagcgccagcc

SEQ ID NO: 3426409 - RNA, 18 nt, Pseudomonas aeruginosa PA01
cgagcagcgccagccagg

SEQ ID NO: 3426410 - RNA, 20 nt, Pseudomonas aeruginosa PA01
cgagcagcgcgcggcucggc

SEQ ID NO: 3426411 - RNA, 22 nt, Pseudomonas aeruginosa PA01
cgagcagcgcgcggcucggcgg

SEQ ID NO: 3426412 - RNA, 16 nt, Pseudomonas aeruginosa PA01
cgagcagcggacgcag

SEQ ID NO: 3426413 - RNA, 17 nt, Pseudomonas aeruginosa PA01
cgagcagcggacgcagc

SEQ ID NO: 3426414 - RNA, 15 nt, Pseudomonas aeruginosa PA01
cgagcagcggcacgc

SEQ ID NO: 3426415 - RNA, 13 nt, Pseudomonas aeruginosa PA01
cgagcagcggcgc

SEQ ID NO: 3426416 - RNA, 20 nt, Pseudomonas aeruginosa PA01
cgagcagcggcgcgccaugc

SEQ ID NO: 3426417 - RNA, 15 nt, Pseudomonas aeruginosa PA01
cgagcagcggcgcuu

SEQ ID NO: 3426418 - RNA, 16 nt, Pseudomonas aeruginosa PA01
cgagcagcucgccggc

SEQ ID NO: 3426419 - RNA, 17 nt, Pseudomonas aeruginosa PA01
cgagcagcucgccggcg

SEQ ID NO: 3426420 - RNA, 18 nt, Pseudomonas aeruginosa PA01
cgagcagcucgccggcgu

SEQ ID NO: 3426421 - RNA, 18 nt, Pseudomonas aeruginosa PA01
cgagcaggaagaagccga

SEQ ID NO: 3426422 - RNA, 13 nt, Pseudomonas aeruginosa PA01
cgagcaggacagc

SEQ ID NO: 3426423 - RNA, 16 nt, Pseudomonas aeruginosa PA01
cgagcaggacagcagg

SEQ ID NO: 3426424 - RNA, 20 nt, Pseudomonas aeruginosa PA01
cgagcaggacagcagggucg

SEQ ID NO: 3426425 - RNA, 15 nt, Pseudomonas aeruginosa PA01
cgagcaggacugccc

SEQ ID NO: 3426426 - RNA, 23 nt, Pseudomonas aeruginosa PA01
cgagcaggaggauacggcgcagc

SEQ ID NO: 3426427 - RNA, 14 nt, Pseudomonas aeruginosa PA01
cgagcaggcacccg

SEQ ID NO: 3426428 - RNA, 17 nt, Pseudomonas aeruginosa PA01
cgagcaggcacccgcgg

SEQ ID NO: 3426429 - RNA, 20 nt, Pseudomonas aeruginosa PA01
cgagcaggccacgcaccagc

SEQ ID NO: 3426430 - RNA, 13 nt, Pseudomonas aeruginosa PA01
cgagcaggcccau

SEQ ID NO: 3426431 - RNA, 13 nt, Pseudomonas aeruginosa PA01
cgagcaggccgag

SEQ ID NO: 3426432 - RNA, 16 nt, Pseudomonas aeruginosa PA01
cgagccuucagcacgg

SEQ ID NO: 3426433 - RNA, 22 nt, Pseudomonas aeruginosa PA01
cgagccuucagcacggcgcggg

SEQ ID NO: 3426434 - RNA, 15 nt, Pseudomonas aeruginosa PA01
cgagccuugcggcgc

SEQ ID NO: 3426435 - RNA, 16 nt, Pseudomonas aeruginosa PA01
cgagcgaaaucggcag

SEQ ID NO: 3426436 - RNA, 20 nt, Pseudomonas aeruginosa PA01
cgagcgacuccgggaacagc

SEQ ID NO: 3426437 - RNA, 22 nt, Pseudomonas aeruginosa PA01
cgagcgacuccgggaacagccc

SEQ ID NO: 3426438 - RNA, 15 nt, Pseudomonas aeruginosa PA01
cgagcgagcggcaga

SEQ ID NO: 3426439 - RNA, 14 nt, Pseudomonas aeruginosa PA01
cgagcgagcuugca

SEQ ID NO: 3426440 - RNA, 15 nt, Pseudomonas aeruginosa PA01
cgagcgagggcgucg

SEQ ID NO: 3426441 - RNA, 19 nt, Pseudomonas aeruginosa PA01
cgagcgcacaacgccuucc

SEQ ID NO: 3426442 - RNA, 13 nt, Pseudomonas aeruginosa PA01
cgagcgcacgugg

SEQ ID NO: 3426443 - RNA, 19 nt, Pseudomonas aeruginosa PA01
cgagcgcagcgacacaacg

SEQ ID NO: 3426444 - RNA, 12 nt, Pseudomonas aeruginosa PA01
cgagcgcagcgc

SEQ ID NO: 3426445 - RNA, 13 nt, Pseudomonas aeruginosa PA01
cgagcgcagcgcc

SEQ ID NO: 3426446 - RNA, 17 nt, Pseudomonas aeruginosa PA01
cgagcgcagcgccacca

SEQ ID NO: 3426447 - RNA, 20 nt, Pseudomonas aeruginosa PA01
cgagcgccaggaacgccucu

SEQ ID NO: 3426448 - RNA, 14 nt, Pseudomonas aeruginosa PA01
cgagcgccagggcc

SEQ ID NO: 3426449 - RNA, 14 nt, Pseudomonas aeruginosa PA01
cgagcgccgccagg

SEQ ID NO: 3426450 - RNA, 17 nt, Pseudomonas aeruginosa PA01
cgagcgccgccaggcag

SEQ ID NO: 3426451 - RNA, 21 nt, Pseudomonas aeruginosa PA01
cgagcgccgccaggcaggccg

SEQ ID NO: 3426452 - RNA, 13 nt, Pseudomonas aeruginosa PA01
cgagcgccgccuu

SEQ ID NO: 3426453 - RNA, 22 nt, Pseudomonas aeruginosa PA01
cgagcgccgccuugagcggcgc

SEQ ID NO: 3426454 - RNA, 12 nt, Pseudomonas aeruginosa PA01
cgagcgccuggc

SEQ ID NO: 3426455 - RNA, 16 nt, Pseudomonas aeruginosa PA01
cgagcgccuggcaacc

SEQ ID NO: 3426456 - RNA, 17 nt, Pseudomonas aeruginosa PA01
cgagcgccuggcaaccg

SEQ ID NO: 3426457 - RNA, 13 nt, Pseudomonas aeruginosa PA01
cgagcgcgacucg

SEQ ID NO: 3426458 - RNA, 14 nt, Pseudomonas aeruginosa PA01
cgagcgcgaucagc

SEQ ID NO: 3426459 - RNA, 19 nt, Pseudomonas aeruginosa PA01
cgagcgcgaucagccgcuc

SEQ ID NO: 3426460 - RNA, 15 nt, Pseudomonas aeruginosa PA01
cgagcgcgcccaggu

SEQ ID NO: 3426461 - RNA, 14 nt, Pseudomonas aeruginosa PA01
cgagcgcgccgccg

SEQ ID NO: 3426462 - RNA, 19 nt, Pseudomonas aeruginosa PA01
cgagcgcggccggccacgc

SEQ ID NO: 3426463 - RNA, 18 nt, Pseudomonas aeruginosa PA01
cgagcgcggcuucagagc

SEQ ID NO: 3426464 - RNA, 23 nt, Pseudomonas aeruginosa PA01
cgagcgcuucauccugcgcgccu

SEQ ID NO: 3426465 - RNA, 24 nt, Pseudomonas aeruginosa PA01
cgagcgcuucauccugcgcgccuc

SEQ ID NO: 3426466 - RNA, 14 nt, Pseudomonas aeruginosa PA01
cgagcggcgcgaag

SEQ ID NO: 3426467 - RNA, 16 nt, Pseudomonas aeruginosa PA01
cgagcggcgcgaaguc

SEQ ID NO: 3426468 - RNA, 12 nt, Pseudomonas aeruginosa PA01
cgagcggcggcc

SEQ ID NO: 3426469 - RNA, 20 nt, Pseudomonas aeruginosa PA01
cgagcggcggccgucgcugg

SEQ ID NO: 3426470 - RNA, 21 nt, Pseudomonas aeruginosa PA01
cgagcgggaagcguuccugga

SEQ ID NO: 3426471 - RNA, 18 nt, Pseudomonas aeruginosa PA01
cgagcgggcggucgucgc

SEQ ID NO: 3426472 - RNA, 19 nt, Pseudomonas aeruginosa PA01
cgagcgggcggucgucgcc

SEQ ID NO: 3426473 - RNA, 21 nt, Pseudomonas aeruginosa PA01
cgagcgggcuuuuucaugcgu

SEQ ID NO: 3426474 - RNA, 12 nt, Pseudomonas aeruginosa PA01
cgagcgggucga

SEQ ID NO: 3426475 - RNA, 15 nt, Pseudomonas aeruginosa PA01
cgagcggucggccau

SEQ ID NO: 3426476 - RNA, 13 nt, Pseudomonas aeruginosa PA01
cgagcguccgccg

SEQ ID NO: 3426477 - RNA, 14 nt, Pseudomonas aeruginosa PA01
cgagcguccgccgc

SEQ ID NO: 3426478 - RNA, 15 nt, Pseudomonas aeruginosa PA01
cgagcguccgccgcc

SEQ ID NO: 3426479 - RNA, 20 nt, Pseudomonas aeruginosa PA01
cgagcguccgccgccguggc

SEQ ID NO: 3426480 - RNA, 16 nt, Pseudomonas aeruginosa PA01
cgagcgugcgcaugcc

SEQ ID NO: 3426481 - RNA, 18 nt, Pseudomonas aeruginosa PA01
cgagcgugcgcaugcccg

SEQ ID NO: 3426482 - RNA, 14 nt, Pseudomonas aeruginosa PA01
cgagcguucggauc

SEQ ID NO: 3426483 - RNA, 21 nt, Pseudomonas aeruginosa PA01
cgagcguucggaucggcccgg

SEQ ID NO: 3426484 - RNA, 16 nt, Pseudomonas aeruginosa PA01
cgagcguugggccucg

SEQ ID NO: 3426485 - RNA, 20 nt, Pseudomonas aeruginosa PA01
cgagcugaccaccagggcga

SEQ ID NO: 3426486 - RNA, 17 nt, Pseudomonas aeruginosa PA01
cgagcugaucgcgcaga

SEQ ID NO: 3426487 - RNA, 21 nt, Pseudomonas aeruginosa PA01
cgagcugauugagggucagcu

SEQ ID NO: 3426488 - RNA, 20 nt, Pseudomonas aeruginosa PA01
cgagcugccccucguggcgc

SEQ ID NO: 3426489 - RNA, 17 nt, Pseudomonas aeruginosa PA01
cgagcugccgcaccgcc

SEQ ID NO: 3426490 - RNA, 21 nt, Pseudomonas aeruginosa PA01
cgagcugccgcaccgccucga

SEQ ID NO: 3426491 - RNA, 23 nt, Pseudomonas aeruginosa PA01
cgagcugccgcaccgccucgauc

SEQ ID NO: 3426492 - RNA, 15 nt, Pseudomonas aeruginosa PA01
cgagcugccgggcga

SEQ ID NO: 3426493 - RNA, 12 nt, Pseudomonas aeruginosa PA01
cgagcugcgagg

SEQ ID NO: 3426494 - RNA, 12 nt, Pseudomonas aeruginosa PA01
cgagcugcucga

SEQ ID NO: 3426495 - RNA, 17 nt, Pseudomonas aeruginosa PA01
cgagcugcucgauggcg

SEQ ID NO: 3426496 - RNA, 17 nt, Pseudomonas aeruginosa PA01
cgagcugcucggcggug

SEQ ID NO: 3426497 - RNA, 14 nt, Pseudomonas aeruginosa PA01
cgagcuggcgcagg

SEQ ID NO: 3426498 - RNA, 16 nt, Pseudomonas aeruginosa PA01
cgagcuggcgcaggcc

SEQ ID NO: 3426499 - RNA, 19 nt, Pseudomonas aeruginosa PA01
cgagcuggcgcaggccuuc

SEQ ID NO: 3426500 - RNA, 21 nt, Pseudomonas aeruginosa PA01
cgagcuggcgcaggccuucga

SEQ ID NO: 3426501 - RNA, 18 nt, Pseudomonas aeruginosa PA01
cgagcugggucacuccgc

SEQ ID NO: 3426502 - RNA, 23 nt, Pseudomonas aeruginosa PA01
cgagcugguggauguucgccgcc

SEQ ID NO: 3426503 - RNA, 21 nt, Pseudomonas aeruginosa PA01
cgagcuguccaucucgccgcg

SEQ ID NO: 3426504 - RNA, 22 nt, Pseudomonas aeruginosa PA01
cgagcuguccaucucgccgcgc

SEQ ID NO: 3426505 - RNA, 13 nt, Pseudomonas aeruginosa PA01
cgagcuugaccuu

SEQ ID NO: 3426506 - RNA, 15 nt, Pseudomonas aeruginosa PA01
cgagcuugcaauccg

SEQ ID NO: 3426507 - RNA, 14 nt, Pseudomonas aeruginosa PA01
cgagcuugccgagg

SEQ ID NO: 3426508 - RNA, 19 nt, Pseudomonas aeruginosa PA01
cgagcuuggccacuccggg

SEQ ID NO: 3426509 - RNA, 15 nt, Pseudomonas aeruginosa PA01
cgagcuuggcccugg

SEQ ID NO: 3426510 - RNA, 21 nt, Pseudomonas aeruginosa PA01
cgagcuuguuggccagcagcc

SEQ ID NO: 3426511 - RNA, 12 nt, Pseudomonas aeruginosa PA01
cgagcuuuccug

SEQ ID NO: 3426512 - RNA, 15 nt, Pseudomonas aeruginosa PA01
cgagcuuugcgcagc

SEQ ID NO: 3426513 - RNA, 16 nt, Pseudomonas aeruginosa PA01
cgagcuuugcgcagcc

SEQ ID NO: 3426514 - RNA, 17 nt, Pseudomonas aeruginosa PA01
cgaggaaaaggaucgcc

SEQ ID NO: 3426515 - RNA, 20 nt, Pseudomonas aeruginosa PA01
cgaggaaaaggaucgccgcg

SEQ ID NO: 3426516 - RNA, 17 nt, Pseudomonas aeruginosa PA01
cgaggaacagcaccagc

SEQ ID NO: 3426517 - RNA, 19 nt, Pseudomonas aeruginosa PA01
cgaggaacagcaccagcaa

SEQ ID NO: 3426518 - RNA, 23 nt, Pseudomonas aeruginosa PA01
cgaggaacagcgagaggggcgcu

SEQ ID NO: 3426519 - RNA, 15 nt, Pseudomonas aeruginosa PA01
cgaggaacaggucga

SEQ ID NO: 3426520 - RNA, 20 nt, Pseudomonas aeruginosa PA01
cgaggaacaggucgacgcca

SEQ ID NO: 3426521 - RNA, 21 nt, Pseudomonas aeruginosa PA01
cgaggaacaggucgacgccau

SEQ ID NO: 3426522 - RNA, 18 nt, Pseudomonas aeruginosa PA01
cgaggaacaggucgacgg

SEQ ID NO: 3426523 - RNA, 16 nt, Pseudomonas aeruginosa PA01
cgaggaacauccgcgg

SEQ ID NO: 3426524 - RNA, 18 nt, Pseudomonas aeruginosa PA01
cgaggaacauccgcggcc

SEQ ID NO: 3426525 - RNA, 20 nt, Pseudomonas aeruginosa PA01
cgaggaacgccgacaggccg

SEQ ID NO: 3426526 - RNA, 23 nt, Pseudomonas aeruginosa PA01
cgaggaacuccuccucgcuccag

SEQ ID NO: 3426527 - RNA, 13 nt, Pseudomonas aeruginosa PA01
cgaggaagccgac

SEQ ID NO: 3426528 - RNA, 19 nt, Pseudomonas aeruginosa PA01
cgaggaagccgaccggcgc

SEQ ID NO: 3426529 - RNA, 16 nt, Pseudomonas aeruginosa PA01
cgaggaaggccagcag

SEQ ID NO: 3426530 - RNA, 18 nt, Pseudomonas aeruginosa PA01
cgaggaaggccaggucgc

SEQ ID NO: 3426531 - RNA, 12 nt, Pseudomonas aeruginosa PA01
cgaggaaggcgc

SEQ ID NO: 3426532 - RNA, 19 nt, Pseudomonas aeruginosa PA01
cgaggaaggcgcgcaccag

SEQ ID NO: 3426533 - RNA, 20 nt, Pseudomonas aeruginosa PA01
cgaggaaggcgcgcaccagc

SEQ ID NO: 3426534 - RNA, 16 nt, Pseudomonas aeruginosa PA01
cgaggaaggcgcuggc

SEQ ID NO: 3426535 - RNA, 18 nt, Pseudomonas aeruginosa PA01
cgaggaaggcgcuggcgc

SEQ ID NO: 3426536 - RNA, 20 nt, Pseudomonas aeruginosa PA01
cgaggaagucggcggccgcc

SEQ ID NO: 3426537 - RNA, 17 nt, Pseudomonas aeruginosa PA01
cgaggaauuccggcagc

SEQ ID NO: 3426538 - RNA, 20 nt, Pseudomonas aeruginosa PA01
cgaggaauuccggcagcgac

SEQ ID NO: 3426539 - RNA, 23 nt, Pseudomonas aeruginosa PA01
cgaggaauuccggcagcgacugg

SEQ ID NO: 3426540 - RNA, 22 nt, Pseudomonas aeruginosa PA01
cgaggacaacacuuccucgugg

SEQ ID NO: 3426541 - RNA, 16 nt, Pseudomonas aeruginosa PA01
cgaggacccggcggaa

SEQ ID NO: 3426542 - RNA, 23 nt, Pseudomonas aeruginosa PA01
cgaggacgaucagcucuuccagg

SEQ ID NO: 3426543 - RNA, 15 nt, Pseudomonas aeruginosa PA01
cgaggacgccgccgg

SEQ ID NO: 3426544 - RNA, 13 nt, Pseudomonas aeruginosa PA01
cgaggacgccggg

SEQ ID NO: 3426545 - RNA, 22 nt, Pseudomonas aeruginosa PA01
cgaggacuucauggaggaagcu

SEQ ID NO: 3426546 - RNA, 23 nt, Pseudomonas aeruginosa PA01
cgaggacuucauggaggaagcuc

SEQ ID NO: 3426547 - RNA, 16 nt, Pseudomonas aeruginosa PA01
cgaggagacgcggcau

SEQ ID NO: 3426548 - RNA, 14 nt, Pseudomonas aeruginosa PA01
cgaggagaucggcg

SEQ ID NO: 3426549 - RNA, 20 nt, Pseudomonas aeruginosa PA01
cgaggagccguagggcgcau

SEQ ID NO: 3426550 - RNA, 17 nt, Pseudomonas aeruginosa PA01
cgaggaggacgauggaa

SEQ ID NO: 3426551 - RNA, 17 nt, Pseudomonas aeruginosa PA01
cgaggaggacgucgcgg

SEQ ID NO: 3426552 - RNA, 18 nt, Pseudomonas aeruginosa PA01
cgaggaggaucucgcgcc

SEQ ID NO: 3426553 - RNA, 23 nt, Pseudomonas aeruginosa PA01
cgaggaggaucucgcgccccggg

SEQ ID NO: 3426554 - RNA, 18 nt, Pseudomonas aeruginosa PA01
cgaggaggaugccgauca

SEQ ID NO: 3426555 - RNA, 23 nt, Pseudomonas aeruginosa PA01
cgaggaggaugccgaucaccgcc

SEQ ID NO: 3426556 - RNA, 17 nt, Pseudomonas aeruginosa PA01
cgaggagguuggucugc

SEQ ID NO: 3426557 - RNA, 16 nt, Pseudomonas aeruginosa PA01
cgaggauagcguccag

SEQ ID NO: 3426558 - RNA, 18 nt, Pseudomonas aeruginosa PA01
cgaggaucacgcagcagg

SEQ ID NO: 3426559 - RNA, 19 nt, Pseudomonas aeruginosa PA01
cgaggaucacgcagcaggc

SEQ ID NO: 3426560 - RNA, 23 nt, Pseudomonas aeruginosa PA01
cgaggaucagucgcugcucggcc

SEQ ID NO: 3426561 - RNA, 14 nt, Pseudomonas aeruginosa PA01
cgaggaucgccagc

SEQ ID NO: 3426562 - RNA, 19 nt, Pseudomonas aeruginosa PA01
cgaggaucgcgcuggccag

SEQ ID NO: 3426563 - RNA, 17 nt, Pseudomonas aeruginosa PA01
cgaggaucgcucccagg

SEQ ID NO: 3426564 - RNA, 20 nt, Pseudomonas aeruginosa PA01
cgaggaucuugcgcccggcg

SEQ ID NO: 3426565 - RNA, 15 nt, Pseudomonas aeruginosa PA01
cgaggaugcucgccu

SEQ ID NO: 3426566 - RNA, 16 nt, Pseudomonas aeruginosa PA01
cgaggaugcucgccug

SEQ ID NO: 3426567 - RNA, 14 nt, Pseudomonas aeruginosa PA01
cgaggauggccguc

SEQ ID NO: 3426568 - RNA, 23 nt, Pseudomonas aeruginosa PA01
cgaggauggccguccucgucgag

SEQ ID NO: 3426569 - RNA, 17 nt, Pseudomonas aeruginosa PA01
cgaggauggucaggccg

SEQ ID NO: 3426570 - RNA, 22 nt, Pseudomonas aeruginosa PA01
cgaggauggucaggccggcgcg

SEQ ID NO: 3426571 - RNA, 17 nt, Pseudomonas aeruginosa PA01
cgaggaugucggcgaac

SEQ ID NO: 3426572 - RNA, 18 nt, Pseudomonas aeruginosa PA01
cgaggauuuccgcgcccg

SEQ ID NO: 3426573 - RNA, 19 nt, Pseudomonas aeruginosa PA01
cgaggauuuccgcgcccgg

SEQ ID NO: 3426574 - RNA, 21 nt, Pseudomonas aeruginosa PA01
cgaggauuuccggcuugccga

SEQ ID NO: 3426575 - RNA, 15 nt, Pseudomonas aeruginosa PA01
cgaggauuuccucgc

SEQ ID NO: 3426576 - RNA, 20 nt, Pseudomonas aeruginosa PA01
cgaggauuuccucgcgcacc

SEQ ID NO: 3426577 - RNA, 23 nt, Pseudomonas aeruginosa PA01
cgaggauuuccucgcgcaccgcg

SEQ ID NO: 3426578 - RNA, 17 nt, Pseudomonas aeruginosa PA01
cgaggcagccgucggug

SEQ ID NO: 3426579 - RNA, 13 nt, Pseudomonas aeruginosa PA01
cgaggccagcagg

SEQ ID NO: 3426580 - RNA, 16 nt, Pseudomonas aeruginosa PA01
cgaggccagcaggccg

SEQ ID NO: 3426581 - RNA, 13 nt, Pseudomonas aeruginosa PA01
cgaggccaggccg

SEQ ID NO: 3426582 - RNA, 14 nt, Pseudomonas aeruginosa PA01
cgaggccaggccga

SEQ ID NO: 3426583 - RNA, 19 nt, Pseudomonas aeruginosa PA01
cgaggccaggccgagcgcc

SEQ ID NO: 3426584 - RNA, 22 nt, Pseudomonas aeruginosa PA01
cgaggccaggccgagcgccagg

SEQ ID NO: 3426585 - RNA, 23 nt, Pseudomonas aeruginosa PA01
cgaggccaggccgagcgccaggg

SEQ ID NO: 3426586 - RNA, 22 nt, Pseudomonas aeruginosa PA01
cgaggcccagcgacuccgccag

SEQ ID NO: 3426587 - RNA, 22 nt, Pseudomonas aeruginosa PA01
cgaggcccgcccaguugcgggc

SEQ ID NO: 3426588 - RNA, 12 nt, Pseudomonas aeruginosa PA01
cgaggcccgcgc

SEQ ID NO: 3426589 - RNA, 16 nt, Pseudomonas aeruginosa PA01
cgaggcccgcgccgcc

SEQ ID NO: 3426590 - RNA, 20 nt, Pseudomonas aeruginosa PA01
cgaggcccgcgccgccggua

SEQ ID NO: 3426591 - RNA, 12 nt, Pseudomonas aeruginosa PA01
cgaggcccucgg

SEQ ID NO: 3426592 - RNA, 20 nt, Pseudomonas aeruginosa PA01
cgaggcccucggcggcgagc

SEQ ID NO: 3426593 - RNA, 14 nt, Pseudomonas aeruginosa PA01
cgaggccgcccagc

SEQ ID NO: 3426594 - RNA, 16 nt, Pseudomonas aeruginosa PA01
cgaggccgcccagcgc

SEQ ID NO: 3426595 - RNA, 20 nt, Pseudomonas aeruginosa PA01
cgaggccgcccagcgcagcc

SEQ ID NO: 3426596 - RNA, 13 nt, Pseudomonas aeruginosa PA01
cgaggccgccgcg

SEQ ID NO: 3426597 - RNA, 22 nt, Pseudomonas aeruginosa PA01
cgaggccgccgcgggcaaccgc

SEQ ID NO: 3426598 - RNA, 17 nt, Pseudomonas aeruginosa PA01
cgaggccgcggagcacc

SEQ ID NO: 3426599 - RNA, 22 nt, Pseudomonas aeruginosa PA01
cgaggccgcggagcaccgcgcc

SEQ ID NO: 3426600 - RNA, 14 nt, Pseudomonas aeruginosa PA01
cgaggccggcaugc

SEQ ID NO: 3426601 - RNA, 15 nt, Pseudomonas aeruginosa PA01
cgaggccggcgauca

SEQ ID NO: 3426602 - RNA, 17 nt, Pseudomonas aeruginosa PA01
cgaggccggcgaucagc

SEQ ID NO: 3426603 - RNA, 22 nt, Pseudomonas aeruginosa PA01
cgaggccggcgaucagcucgcg

SEQ ID NO: 3426604 - RNA, 19 nt, Pseudomonas aeruginosa PA01
cgaggccguaccagucgcc

SEQ ID NO: 3426605 - RNA, 15 nt, Pseudomonas aeruginosa PA01
cgaggccuacccgcg

SEQ ID NO: 3426606 - RNA, 22 nt, Pseudomonas aeruginosa PA01
cgaggccucgucguucagccca

SEQ ID NO: 3426607 - RNA, 18 nt, Pseudomonas aeruginosa PA01
cgaggcgaccuuggccag

SEQ ID NO: 3426608 - RNA, 20 nt, Pseudomonas aeruginosa PA01
cgaggcgaguaccaccgugc

SEQ ID NO: 3426609 - RNA, 22 nt, Pseudomonas aeruginosa PA01
cgaggcgaguaccaccgugccc

SEQ ID NO: 3426610 - RNA, 16 nt, Pseudomonas aeruginosa PA01
cgaggcgaucgccgcg

SEQ ID NO: 3426611 - RNA, 22 nt, Pseudomonas aeruginosa PA01
cgaggcgauguugacgauggcg

SEQ ID NO: 3426612 - RNA, 18 nt, Pseudomonas aeruginosa PA01
cgaggcgcccgccggccg

SEQ ID NO: 3426613 - RNA, 14 nt, Pseudomonas aeruginosa PA01
cgaggcgccgacca

SEQ ID NO: 3426614 - RNA, 17 nt, Pseudomonas aeruginosa PA01
cgaggcgccgaccacga

SEQ ID NO: 3426615 - RNA, 21 nt, Pseudomonas aeruginosa PA01
cgaggcgccgaccacgaccgc

SEQ ID NO: 3426616 - RNA, 22 nt, Pseudomonas aeruginosa PA01
cgaggcgccgaccacgaccgcg

SEQ ID NO: 3426617 - RNA, 15 nt, Pseudomonas aeruginosa PA01
cgaggcgcgccgaca

SEQ ID NO: 3426618 - RNA, 19 nt, Pseudomonas aeruginosa PA01
cgaggcgcgccgacagcac

SEQ ID NO: 3426619 - RNA, 18 nt, Pseudomonas aeruginosa PA01
cgaggcgcuccaccgccc

SEQ ID NO: 3426620 - RNA, 14 nt, Pseudomonas aeruginosa PA01
cgaggcgcucgacg

SEQ ID NO: 3426621 - RNA, 19 nt, Pseudomonas aeruginosa PA01
cgaggcgcucgacgaucag

SEQ ID NO: 3426622 - RNA, 20 nt, Pseudomonas aeruginosa PA01
cgaggcgcucgacgaucagg

SEQ ID NO: 3426623 - RNA, 22 nt, Pseudomonas aeruginosa PA01
cgaggcgcuucugcucggccug

SEQ ID NO: 3426624 - RNA, 22 nt, Pseudomonas aeruginosa PA01
cgaggcggaagaaaagaaggcg

SEQ ID NO: 3426625 - RNA, 23 nt, Pseudomonas aeruginosa PA01
cgaggcggaagaaaagaaggcgg

SEQ ID NO: 3426626 - RNA, 14 nt, Pseudomonas aeruginosa PA01
cgaggcggaagacg

SEQ ID NO: 3426627 - RNA, 18 nt, Pseudomonas aeruginosa PA01
cgaggcggaagacgaucu

SEQ ID NO: 3426628 - RNA, 20 nt, Pseudomonas aeruginosa PA01
cgaggcggagaagccgcuga

SEQ ID NO: 3426629 - RNA, 22 nt, Pseudomonas aeruginosa PA01
cgaggcggagaagccgcugacc

SEQ ID NO: 3426630 - RNA, 19 nt, Pseudomonas aeruginosa PA01
cgaggcggauuugccgccg

SEQ ID NO: 3426631 - RNA, 21 nt, Pseudomonas aeruginosa PA01
cgaggcggauuugccgccgag

SEQ ID NO: 3426632 - RNA, 14 nt, Pseudomonas aeruginosa PA01
cgaggcggcgcagc

SEQ ID NO: 3426633 - RNA, 16 nt, Pseudomonas aeruginosa PA01
cgaggcggcgcagcaa

SEQ ID NO: 3426634 - RNA, 12 nt, Pseudomonas aeruginosa PA01
cgaggcgggcgc

SEQ ID NO: 3426635 - RNA, 15 nt, Pseudomonas aeruginosa PA01
cgaggcgggcgcgga

SEQ ID NO: 3426636 - RNA, 20 nt, Pseudomonas aeruginosa PA01
cgaggcgggcgcggaucggc

SEQ ID NO: 3426637 - RNA, 17 nt, Pseudomonas aeruginosa PA01
cgaggcggucaugcgcc

SEQ ID NO: 3426638 - RNA, 19 nt, Pseudomonas aeruginosa PA01
cgaggcggucaugcgcccu

SEQ ID NO: 3426639 - RNA, 16 nt, Pseudomonas aeruginosa PA01
cgaggcggugcagcgg

SEQ ID NO: 3426640 - RNA, 17 nt, Pseudomonas aeruginosa PA01
cgaggcggugcagcgga

SEQ ID NO: 3426641 - RNA, 23 nt, Pseudomonas aeruginosa PA01
cgaggcguaccggcuacaggccg

SEQ ID NO: 3426642 - RNA, 20 nt, Pseudomonas aeruginosa PA01
cgaggcgucgaaacgggcgc

SEQ ID NO: 3426643 - RNA, 14 nt, Pseudomonas aeruginosa PA01
cgaggcgucggcgg

SEQ ID NO: 3426644 - RNA, 14 nt, Pseudomonas aeruginosa PA01
cgaggcguggaagg

SEQ ID NO: 3426645 - RNA, 14 nt, Pseudomonas aeruginosa PA01
cgaggcuaacgccg

SEQ ID NO: 3426646 - RNA, 16 nt, Pseudomonas aeruginosa PA01
cgaggcuaacgccgag

SEQ ID NO: 3426647 - RNA, 17 nt, Pseudomonas aeruginosa PA01
cgaggcucggucgcgcg

SEQ ID NO: 3426648 - RNA, 18 nt, Pseudomonas aeruginosa PA01
cgaggcugaucugccggu

SEQ ID NO: 3426649 - RNA, 17 nt, Pseudomonas aeruginosa PA01
cgaggcugcgggcgaug

SEQ ID NO: 3426650 - RNA, 13 nt, Pseudomonas aeruginosa PA01
cgaggcuggccuc

SEQ ID NO: 3426651 - RNA, 21 nt, Pseudomonas aeruginosa PA01
cgaggcugucgcggacccgcg

SEQ ID NO: 3426652 - RNA, 15 nt, Pseudomonas aeruginosa PA01
cgaggcuuuccagca

SEQ ID NO: 3426653 - RNA, 16 nt, Pseudomonas aeruginosa PA01
cgaggcuuuccagcag

SEQ ID NO: 3426654 - RNA, 21 nt, Pseudomonas aeruginosa PA01
cgaggcuuuccagcaggcgcu

SEQ ID NO: 3426655 - RNA, 18 nt, Pseudomonas aeruginosa PA01
cgagggaggaggcgccgg

SEQ ID NO: 3426656 - RNA, 21 nt, Pseudomonas aeruginosa PA01
cgagggaggucgcacgcagcg

SEQ ID NO: 3426657 - RNA, 17 nt, Pseudomonas aeruginosa PA01
cgagggauguuccaggc

SEQ ID NO: 3426658 - RNA, 18 nt, Pseudomonas aeruginosa PA01
cgagggauguuccaggcc

SEQ ID NO: 3426659 - RNA, 16 nt, Pseudomonas aeruginosa PA01
cgagggcaaaggcgcg

SEQ ID NO: 3426660 - RNA, 21 nt, Pseudomonas aeruginosa PA01
cgagggcaaaggcgcgcaggg

SEQ ID NO: 3426661 - RNA, 12 nt, Pseudomonas aeruginosa PA01
cgagggcaccac

SEQ ID NO: 3426662 - RNA, 13 nt, Pseudomonas aeruginosa PA01
cgagggcaccacg

SEQ ID NO: 3426663 - RNA, 20 nt, Pseudomonas aeruginosa PA01
cgagggcagccucagcgaca

SEQ ID NO: 3426664 - RNA, 18 nt, Pseudomonas aeruginosa PA01
cgagggcauguuggcgcc

SEQ ID NO: 3426665 - RNA, 22 nt, Pseudomonas aeruginosa PA01
cgagggcauuuccugggugccg

SEQ ID NO: 3426666 - RNA, 15 nt, Pseudomonas aeruginosa PA01
cgagggccgcgccga

SEQ ID NO: 3426667 - RNA, 17 nt, Pseudomonas aeruginosa PA01
cgagggccgcgccgacc

SEQ ID NO: 3426668 - RNA, 18 nt, Pseudomonas aeruginosa PA01
cgagggccgcgccgaccc

SEQ ID NO: 3426669 - RNA, 21 nt, Pseudomonas aeruginosa PA01
cgagggccgcgccgacccaga

SEQ ID NO: 3426670 - RNA, 14 nt, Pseudomonas aeruginosa PA01
cgagggccuugucg

SEQ ID NO: 3426671 - RNA, 12 nt, Pseudomonas aeruginosa PA01
cgagggcgaaca

SEQ ID NO: 3426672 - RNA, 20 nt, Pseudomonas aeruginosa PA01
cgagggcgaagaucucgcca

SEQ ID NO: 3426673 - RNA, 17 nt, Pseudomonas aeruginosa PA01
cgagggcgaccgccagg

SEQ ID NO: 3426674 - RNA, 18 nt, Pseudomonas aeruginosa PA01
cgagggcgaccgccaggc

SEQ ID NO: 3426675 - RNA, 20 nt, Pseudomonas aeruginosa PA01
cgagggcgaccgccaggcgg

SEQ ID NO: 3426676 - RNA, 20 nt, Pseudomonas aeruginosa PA01
cgagggcgaguucggcgagc

SEQ ID NO: 3426677 - RNA, 22 nt, Pseudomonas aeruginosa PA01
cgagggcgaguucggcgagcag

SEQ ID NO: 3426678 - RNA, 23 nt, Pseudomonas aeruginosa PA01
cgagggcgaguucggcgagcagg

SEQ ID NO: 3426679 - RNA, 17 nt, Pseudomonas aeruginosa PA01
cgagggcgccaggugca

SEQ ID NO: 3426680 - RNA, 19 nt, Pseudomonas aeruginosa PA01
cgagggcgccaggugcagg

SEQ ID NO: 3426681 - RNA, 20 nt, Pseudomonas aeruginosa PA01
cgagggcgccaggugcagga

SEQ ID NO: 3426682 - RNA, 16 nt, Pseudomonas aeruginosa PA01
cgagggcgcguugccc

SEQ ID NO: 3426683 - RNA, 20 nt, Pseudomonas aeruginosa PA01
cgagggcgcguugcccagcc

SEQ ID NO: 3426684 - RNA, 17 nt, Pseudomonas aeruginosa PA01
cgagggcggcgaccugg

SEQ ID NO: 3426685 - RNA, 14 nt, Pseudomonas aeruginosa PA01
cgagggcggcgcgg

SEQ ID NO: 3426686 - RNA, 15 nt, Pseudomonas aeruginosa PA01
cgagggcggcgcggg

SEQ ID NO: 3426687 - RNA, 16 nt, Pseudomonas aeruginosa PA01
cgagggcggcgcgggc

SEQ ID NO: 3426688 - RNA, 12 nt, Pseudomonas aeruginosa PA01
cgagggcggcgg

SEQ ID NO: 3426689 - RNA, 17 nt, Pseudomonas aeruginosa PA01
cgagggcgucccgcugc

SEQ ID NO: 3426690 - RNA, 19 nt, Pseudomonas aeruginosa PA01
cgagggcgucccgcugcgu

SEQ ID NO: 3426691 - RNA, 16 nt, Pseudomonas aeruginosa PA01
cgagggcucgggcgcg

SEQ ID NO: 3426692 - RNA, 18 nt, Pseudomonas aeruginosa PA01
cgagggcuguaaucgccg

SEQ ID NO: 3426693 - RNA, 20 nt, Pseudomonas aeruginosa PA01
cgaggggaacauugccacca

SEQ ID NO: 3426694 - RNA, 22 nt, Pseudomonas aeruginosa PA01
cgaggggaacauugccaccacc

SEQ ID NO: 3426695 - RNA, 15 nt, Pseudomonas aeruginosa PA01
cgaggggaaccgggu

SEQ ID NO: 3426696 - RNA, 19 nt, Pseudomonas aeruginosa PA01
cgaggggaagaucuccggg

SEQ ID NO: 3426697 - RNA, 20 nt, Pseudomonas aeruginosa PA01
cgaggggcgacggaaacgac

SEQ ID NO: 3426698 - RNA, 15 nt, Pseudomonas aeruginosa PA01
cgaggggcggagcag

SEQ ID NO: 3426699 - RNA, 16 nt, Pseudomonas aeruginosa PA01
cgaggggcggagcagc

SEQ ID NO: 3426700 - RNA, 17 nt, Pseudomonas aeruginosa PA01
cgaggggcggagcagcc

SEQ ID NO: 3426701 - RNA, 18 nt, Pseudomonas aeruginosa PA01
cgagggggccucggccag

SEQ ID NO: 3426702 - RNA, 21 nt, Pseudomonas aeruginosa PA01
cgagggguaaggcaugcccag

SEQ ID NO: 3426703 - RNA, 15 nt, Pseudomonas aeruginosa PA01
cgagggucgccuuga

SEQ ID NO: 3426704 - RNA, 18 nt, Pseudomonas aeruginosa PA01
cgagggugaacuggccgu

SEQ ID NO: 3426705 - RNA, 12 nt, Pseudomonas aeruginosa PA01
cgagggugcaga

SEQ ID NO: 3426706 - RNA, 16 nt, Pseudomonas aeruginosa PA01
cgagggugcagagcag

SEQ ID NO: 3426707 - RNA, 19 nt, Pseudomonas aeruginosa PA01
cgaggguggcgccgagcag

SEQ ID NO: 3426708 - RNA, 20 nt, Pseudomonas aeruginosa PA01
cgaggguggcgccgagcagc

SEQ ID NO: 3426709 - RNA, 22 nt, Pseudomonas aeruginosa PA01
cgaggguggucagccagccgag

SEQ ID NO: 3426710 - RNA, 18 nt, Pseudomonas aeruginosa PA01
cgaggguugggcagcguc

SEQ ID NO: 3426711 - RNA, 17 nt, Pseudomonas aeruginosa PA01
cgaggguugucaccggc

SEQ ID NO: 3426712 - RNA, 15 nt, Pseudomonas aeruginosa PA01
cgagguacaacggca

SEQ ID NO: 3426713 - RNA, 22 nt, Pseudomonas aeruginosa PA01
cgagguagucccagaccacccg

SEQ ID NO: 3426714 - RNA, 20 nt, Pseudomonas aeruginosa PA01
cgagguagucggugaagcgc

SEQ ID NO: 3426715 - RNA, 21 nt, Pseudomonas aeruginosa PA01
cgaggucaguucggugccgcc

SEQ ID NO: 3426716 - RNA, 17 nt, Pseudomonas aeruginosa PA01
cgagguccggcuccggc

SEQ ID NO: 3426717 - RNA, 17 nt, Pseudomonas aeruginosa PA01
cgaggucgaccagccag

SEQ ID NO: 3426718 - RNA, 15 nt, Pseudomonas aeruginosa PA01
cgaggucgacggcgg

SEQ ID NO: 3426719 - RNA, 16 nt, Pseudomonas aeruginosa PA01
cgaggucgacggcggc

SEQ ID NO: 3426720 - RNA, 16 nt, Pseudomonas aeruginosa PA01
cgaggucgccgccagc

SEQ ID NO: 3426721 - RNA, 12 nt, Pseudomonas aeruginosa PA01
cgaggucgccgg

SEQ ID NO: 3426722 - RNA, 20 nt, Pseudomonas aeruginosa PA01
cgaggucgccggggccuacu

SEQ ID NO: 3426723 - RNA, 11 nt, Pseudomonas aeruginosa PA01
cgaggucggcc

SEQ ID NO: 3426724 - RNA, 14 nt, Pseudomonas aeruginosa PA01
cgaggucggccugc

SEQ ID NO: 3426725 - RNA, 15 nt, Pseudomonas aeruginosa PA01
cgaggucggccugcg

SEQ ID NO: 3426726 - RNA, 15 nt, Pseudomonas aeruginosa PA01
cgaggucggcgaaca

SEQ ID NO: 3426727 - RNA, 14 nt, Pseudomonas aeruginosa PA01
cgaggucggcggcg

SEQ ID NO: 3426728 - RNA, 16 nt, Pseudomonas aeruginosa PA01
cgaggucggcggcggg

SEQ ID NO: 3426729 - RNA, 15 nt, Pseudomonas aeruginosa PA01
cgaggucgucgcuga

SEQ ID NO: 3426730 - RNA, 19 nt, Pseudomonas aeruginosa PA01
cgaggucuuggccagccgc

SEQ ID NO: 3426731 - RNA, 21 nt, Pseudomonas aeruginosa PA01
cgaggucuuggccagccgcgc

SEQ ID NO: 3426732 - RNA, 18 nt, Pseudomonas aeruginosa PA01
cgaggugaucgagggcca

SEQ ID NO: 3426733 - RNA, 15 nt, Pseudomonas aeruginosa PA01
cgaggugcugcaccg

SEQ ID NO: 3426734 - RNA, 17 nt, Pseudomonas aeruginosa PA01
cgaggugcugcaccggg

SEQ ID NO: 3426735 - RNA, 18 nt, Pseudomonas aeruginosa PA01
cgaggugcuugacagcga

SEQ ID NO: 3426736 - RNA, 17 nt, Pseudomonas aeruginosa PA01
cgagguggaugaacagc

SEQ ID NO: 3426737 - RNA, 19 nt, Pseudomonas aeruginosa PA01
cgagguggcugaagcccca

SEQ ID NO: 3426738 - RNA, 16 nt, Pseudomonas aeruginosa PA01
cgaggugucguccauc

SEQ ID NO: 3426739 - RNA, 20 nt, Pseudomonas aeruginosa PA01
cgagguguucccggaucagc

SEQ ID NO: 3426740 - RNA, 22 nt, Pseudomonas aeruginosa PA01
cgagguguuguguggcugcgcu

SEQ ID NO: 3426741 - RNA, 22 nt, Pseudomonas aeruginosa PA01
cgagguucuuccacuugcgccg

SEQ ID NO: 3426742 - RNA, 18 nt, Pseudomonas aeruginosa PA01
cgagguucuugcccagca

SEQ ID NO: 3426743 - RNA, 13 nt, Pseudomonas aeruginosa PA01
cgagguugcccac

SEQ ID NO: 3426744 - RNA, 13 nt, Pseudomonas aeruginosa PA01
cgagguugcgcag

SEQ ID NO: 3426745 - RNA, 15 nt, Pseudomonas aeruginosa PA01
cgagguugcgcggca

SEQ ID NO: 3426746 - RNA, 16 nt, Pseudomonas aeruginosa PA01
cgagguugcgcggcag

SEQ ID NO: 3426747 - RNA, 16 nt, Pseudomonas aeruginosa PA01
cgagguugcgcuccau

SEQ ID NO: 3426748 - RNA, 22 nt, Pseudomonas aeruginosa PA01
cgagguugcucugggcauggcu

SEQ ID NO: 3426749 - RNA, 19 nt, Pseudomonas aeruginosa PA01
cgagguuguagcccugggc

SEQ ID NO: 3426750 - RNA, 13 nt, Pseudomonas aeruginosa PA01
cgaguaaccaccg

SEQ ID NO: 3426751 - RNA, 13 nt, Pseudomonas aeruginosa PA01
cgaguaccgcugc

SEQ ID NO: 3426752 - RNA, 19 nt, Pseudomonas aeruginosa PA01
cgaguaccgcugcggccgg

SEQ ID NO: 3426753 - RNA, 18 nt, Pseudomonas aeruginosa PA01
cgaguaggcgaagcccag

SEQ ID NO: 3426754 - RNA, 20 nt, Pseudomonas aeruginosa PA01
cgaguaggcgaagcccagcg

SEQ ID NO: 3426755 - RNA, 14 nt, Pseudomonas aeruginosa PA01
cgaguaggcgcugc

SEQ ID NO: 3426756 - RNA, 11 nt, Pseudomonas aeruginosa PA01
cgaguaggucc

SEQ ID NO: 3426757 - RNA, 21 nt, Pseudomonas aeruginosa PA01
cgaguaguagcguuccuggcg

SEQ ID NO: 3426758 - RNA, 23 nt, Pseudomonas aeruginosa PA01
cgaguaguagcguuccuggcgcg

SEQ ID NO: 3426759 - RNA, 23 nt, Pseudomonas aeruginosa PA01
cgaguaguaggucgguucgccca

SEQ ID NO: 3426760 - RNA, 15 nt, Pseudomonas aeruginosa PA01
cgagucaccccgacc

SEQ ID NO: 3426761 - RNA, 22 nt, Pseudomonas aeruginosa PA01
cgagucaccccgaccagcgcgc

SEQ ID NO: 3426762 - RNA, 11 nt, Pseudomonas aeruginosa PA01
cgaguccccua

SEQ ID NO: 3426763 - RNA, 14 nt, Pseudomonas aeruginosa PA01
cgagucccguccgc

SEQ ID NO: 3426764 - RNA, 21 nt, Pseudomonas aeruginosa PA01
cgagucccguccgcugcgcca

SEQ ID NO: 3426765 - RNA, 22 nt, Pseudomonas aeruginosa PA01
cgagucccguccgcugcgccau

SEQ ID NO: 3426766 - RNA, 18 nt, Pseudomonas aeruginosa PA01
cgagucccuugcggcaga

SEQ ID NO: 3426767 - RNA, 16 nt, Pseudomonas aeruginosa PA01
cgaguccgacccgcuc

SEQ ID NO: 3426768 - RNA, 18 nt, Pseudomonas aeruginosa PA01
cgaguccgacccgcuccg

SEQ ID NO: 3426769 - RNA, 18 nt, Pseudomonas aeruginosa PA01
cgaguccgcgcgcgcgcu

SEQ ID NO: 3426770 - RNA, 16 nt, Pseudomonas aeruginosa PA01
cgaguccuucggcgca

SEQ ID NO: 3426771 - RNA, 19 nt, Pseudomonas aeruginosa PA01
cgagucgacccaggcccag

SEQ ID NO: 3426772 - RNA, 22 nt, Pseudomonas aeruginosa PA01
cgagucgacccaggcccagccg

SEQ ID NO: 3426773 - RNA, 23 nt, Pseudomonas aeruginosa PA01
cgagucgaucaggucgccgccgc

SEQ ID NO: 3426774 - RNA, 11 nt, Pseudomonas aeruginosa PA01
cgagucgccgg

SEQ ID NO: 3426775 - RNA, 22 nt, Pseudomonas aeruginosa PA01
cgagucggcgacgaugccgccg

SEQ ID NO: 3426776 - RNA, 14 nt, Pseudomonas aeruginosa PA01
cgagucgggucuuc

SEQ ID NO: 3426777 - RNA, 21 nt, Pseudomonas aeruginosa PA01
cgagugcagcgagucgccgug

SEQ ID NO: 3426778 - RNA, 13 nt, Pseudomonas aeruginosa PA01
cgagugccggcgc

SEQ ID NO: 3426779 - RNA, 16 nt, Pseudomonas aeruginosa PA01
cgagugcgcccagcag

SEQ ID NO: 3426780 - RNA, 22 nt, Pseudomonas aeruginosa PA01
cgagugcgcccagcagcaggcc

SEQ ID NO: 3426781 - RNA, 23 nt, Pseudomonas aeruginosa PA01
cgagugcgcccagcagcaggccg

SEQ ID NO: 3426782 - RNA, 20 nt, Pseudomonas aeruginosa PA01
cgagugcugaacaucagguu

SEQ ID NO: 3426783 - RNA, 23 nt, Pseudomonas aeruginosa PA01
cgaguggccgcgccccacggcgc

SEQ ID NO: 3426784 - RNA, 18 nt, Pseudomonas aeruginosa PA01
cgaguggccgcugagcag

SEQ ID NO: 3426785 - RNA, 20 nt, Pseudomonas aeruginosa PA01
cgaguggccgcugagcagca

SEQ ID NO: 3426786 - RNA, 15 nt, Pseudomonas aeruginosa PA01
cgaguggcgcagcgc

SEQ ID NO: 3426787 - RNA, 17 nt, Pseudomonas aeruginosa PA01
cgaguggcgcagcgccc

SEQ ID NO: 3426788 - RNA, 13 nt, Pseudomonas aeruginosa PA01
cgaguggggcgga

SEQ ID NO: 3426789 - RNA, 14 nt, Pseudomonas aeruginosa PA01
cgagugugccggcc

SEQ ID NO: 3426790 - RNA, 15 nt, Pseudomonas aeruginosa PA01
cgaguucgccgcgag

SEQ ID NO: 3426791 - RNA, 19 nt, Pseudomonas aeruginosa PA01
cgaguucgccgcgagcacc

SEQ ID NO: 3426792 - RNA, 17 nt, Pseudomonas aeruginosa PA01
cgaguucgccggccagg

SEQ ID NO: 3426793 - RNA, 18 nt, Pseudomonas aeruginosa PA01
cgaguucgccggccaggu

SEQ ID NO: 3426794 - RNA, 19 nt, Pseudomonas aeruginosa PA01
cgaguucgccggccaggug

SEQ ID NO: 3426795 - RNA, 15 nt, Pseudomonas aeruginosa PA01
cgaguucgcgcaggc

SEQ ID NO: 3426796 - RNA, 17 nt, Pseudomonas aeruginosa PA01
cgaguucgcgcaggcgc

SEQ ID NO: 3426797 - RNA, 18 nt, Pseudomonas aeruginosa PA01
cgaguucgcgcaggcgcu

SEQ ID NO: 3426798 - RNA, 14 nt, Pseudomonas aeruginosa PA01
cgaguugaccagca

SEQ ID NO: 3426799 - RNA, 15 nt, Pseudomonas aeruginosa PA01
cgaguugaccagcau

SEQ ID NO: 3426800 - RNA, 22 nt, Pseudomonas aeruginosa PA01
cgaguuggcccaauccgcgccg

SEQ ID NO: 3426801 - RNA, 18 nt, Pseudomonas aeruginosa PA01
cgaguugggcgaccugcu

SEQ ID NO: 3426802 - RNA, 19 nt, Pseudomonas aeruginosa PA01
cgaguugggcgaccugcuc

SEQ ID NO: 3426803 - RNA, 18 nt, Pseudomonas aeruginosa PA01
cgaguuucccggcgcggc

SEQ ID NO: 3426804 - RNA, 19 nt, Pseudomonas aeruginosa PA01
cgaguuucccggcgcggcc

SEQ ID NO: 3426805 - RNA, 21 nt, Pseudomonas aeruginosa PA01
cgaguuuccggugcaccuggg

SEQ ID NO: 3426806 - RNA, 22 nt, Pseudomonas aeruginosa PA01
cgaguuugacggaacgcauggg

SEQ ID NO: 3426807 - RNA, 21 nt, Pseudomonas aeruginosa PA01
cgauaaacggcgcuuucauca

SEQ ID NO: 3426808 - RNA, 15 nt, Pseudomonas aeruginosa PA01
cgauaacaccaggag

SEQ ID NO: 3426809 - RNA, 17 nt, Pseudomonas aeruginosa PA01
cgauaacaccaggagcg

SEQ ID NO: 3426810 - RNA, 21 nt, Pseudomonas aeruginosa PA01
cgauaacaccaggagcgccag

SEQ ID NO: 3426811 - RNA, 22 nt, Pseudomonas aeruginosa PA01
cgauaacaccaggagcgccagc

SEQ ID NO: 3426812 - RNA, 21 nt, Pseudomonas aeruginosa PA01
cgauacaccugcaacucggcg

SEQ ID NO: 3426813 - RNA, 14 nt, Pseudomonas aeruginosa PA01
cgauaccagcgccg

SEQ ID NO: 3426814 - RNA, 16 nt, Pseudomonas aeruginosa PA01
cgauaccagcgccgcu

SEQ ID NO: 3426815 - RNA, 14 nt, Pseudomonas aeruginosa PA01
cgauacccuggccg

SEQ ID NO: 3426816 - RNA, 22 nt, Pseudomonas aeruginosa PA01
cgauacccugggagccgccgga

SEQ ID NO: 3426817 - RNA, 14 nt, Pseudomonas aeruginosa PA01
cgauaccgccgccg

SEQ ID NO: 3426818 - RNA, 13 nt, Pseudomonas aeruginosa PA01
cgauacgcggccc

SEQ ID NO: 3426819 - RNA, 14 nt, Pseudomonas aeruginosa PA01
cgauacgcucggcg

SEQ ID NO: 3426820 - RNA, 14 nt, Pseudomonas aeruginosa PA01
cgauacggaacaca

SEQ ID NO: 3426821 - RNA, 18 nt, Pseudomonas aeruginosa PA01
cgauacucgugggccggu

SEQ ID NO: 3426822 - RNA, 20 nt, Pseudomonas aeruginosa PA01
cgauagaccaggaaggccgg

SEQ ID NO: 3426823 - RNA, 12 nt, Pseudomonas aeruginosa PA01
cgauagaccgcu

SEQ ID NO: 3426824 - RNA, 16 nt, Pseudomonas aeruginosa PA01
cgauagccuggcuggc

SEQ ID NO: 3426825 - RNA, 15 nt, Pseudomonas aeruginosa PA01
cgauagcggcgcgag

SEQ ID NO: 3426826 - RNA, 19 nt, Pseudomonas aeruginosa PA01
cgauagcggcgcgaggccg

SEQ ID NO: 3426827 - RNA, 16 nt, Pseudomonas aeruginosa PA01
cgauagcguccaggug

SEQ ID NO: 3426828 - RNA, 15 nt, Pseudomonas aeruginosa PA01
cgauagcucagucgg

SEQ ID NO: 3426829 - RNA, 18 nt, Pseudomonas aeruginosa PA01
cgauaggcgccggcgcgc

SEQ ID NO: 3426830 - RNA, 16 nt, Pseudomonas aeruginosa PA01
cgauaggcgcgcaacg

SEQ ID NO: 3426831 - RNA, 15 nt, Pseudomonas aeruginosa PA01
cgauauacaaagcau

SEQ ID NO: 3426832 - RNA, 12 nt, Pseudomonas aeruginosa PA01
cgauaucacgcc

SEQ ID NO: 3426833 - RNA, 17 nt, Pseudomonas aeruginosa PA01
cgauaucccgccgccgc

SEQ ID NO: 3426834 - RNA, 16 nt, Pseudomonas aeruginosa PA01
cgauaucgcaggccag

SEQ ID NO: 3426835 - RNA, 22 nt, Pseudomonas aeruginosa PA01
cgauaucgcaggccaggcccca

SEQ ID NO: 3426836 - RNA, 16 nt, Pseudomonas aeruginosa PA01
cgauaucggcgccggc

SEQ ID NO: 3426837 - RNA, 14 nt, Pseudomonas aeruginosa PA01
cgauaugcaggucg

SEQ ID NO: 3426838 - RNA, 17 nt, Pseudomonas aeruginosa PA01
cgauauggccguagccg

SEQ ID NO: 3426839 - RNA, 15 nt, Pseudomonas aeruginosa PA01
cgaucaacgcggcca

SEQ ID NO: 3426840 - RNA, 17 nt, Pseudomonas aeruginosa PA01
cgaucaacgcggccagc

SEQ ID NO: 3426841 - RNA, 22 nt, Pseudomonas aeruginosa PA01
cgaucaacgcggccagcagcac

SEQ ID NO: 3426842 - RNA, 15 nt, Pseudomonas aeruginosa PA01
cgaucaacgugguga

SEQ ID NO: 3426843 - RNA, 14 nt, Pseudomonas aeruginosa PA01
cgaucaccaccacg

SEQ ID NO: 3426844 - RNA, 14 nt, Pseudomonas aeruginosa PA01
cgaucaccaccagc

SEQ ID NO: 3426845 - RNA, 15 nt, Pseudomonas aeruginosa PA01
cgaucaccaccagca

SEQ ID NO: 3426846 - RNA, 22 nt, Pseudomonas aeruginosa PA01
cgaucaccaccagcaucagcag

SEQ ID NO: 3426847 - RNA, 15 nt, Pseudomonas aeruginosa PA01
cgaucaccaccagcg

SEQ ID NO: 3426848 - RNA, 16 nt, Pseudomonas aeruginosa PA01
cgaucaccaccuggau

SEQ ID NO: 3426849 - RNA, 18 nt, Pseudomonas aeruginosa PA01
cgaucaccaccuggaugg

SEQ ID NO: 3426850 - RNA, 19 nt, Pseudomonas aeruginosa PA01
cgaucaccaccuggauggu

SEQ ID NO: 3426851 - RNA, 12 nt, Pseudomonas aeruginosa PA01
cgaucaccagca

SEQ ID NO: 3426852 - RNA, 21 nt, Pseudomonas aeruginosa PA01
cgaucaccagcaauugccggc

SEQ ID NO: 3426853 - RNA, 14 nt, Pseudomonas aeruginosa PA01
cgaucaccagcgcc

SEQ ID NO: 3426854 - RNA, 19 nt, Pseudomonas aeruginosa PA01
cgaucaccagcgccaggcc

SEQ ID NO: 3426855 - RNA, 18 nt, Pseudomonas aeruginosa PA01
cgaucacccccagcgagc

SEQ ID NO: 3426856 - RNA, 20 nt, Pseudomonas aeruginosa PA01
cgaucacccccagcgagccg

SEQ ID NO: 3426857 - RNA, 14 nt, Pseudomonas aeruginosa PA01
cgaucaccgcgucc

SEQ ID NO: 3426858 - RNA, 21 nt, Pseudomonas aeruginosa PA01
cgaucaccgcguccauccccg

SEQ ID NO: 3426859 - RNA, 14 nt, Pseudomonas aeruginosa PA01
cgaucaccuugccc

SEQ ID NO: 3426860 - RNA, 20 nt, Pseudomonas aeruginosa PA01
cgaucaccuugcccucgcgg

SEQ ID NO: 3426861 - RNA, 22 nt, Pseudomonas aeruginosa PA01
cgaucacgucguacucggcggg

SEQ ID NO: 3426862 - RNA, 22 nt, Pseudomonas aeruginosa PA01
cgaucacucccugcucgcgcag

SEQ ID NO: 3426863 - RNA, 11 nt, Pseudomonas aeruginosa PA01
cgaucagaacg

SEQ ID NO: 3426864 - RNA, 20 nt, Pseudomonas aeruginosa PA01
cgaucagcaccgccaccagc

SEQ ID NO: 3426865 - RNA, 12 nt, Pseudomonas aeruginosa PA01
cgaucagcagca

SEQ ID NO: 3426866 - RNA, 14 nt, Pseudomonas aeruginosa PA01
cgaucagcagcacc

SEQ ID NO: 3426867 - RNA, 15 nt, Pseudomonas aeruginosa PA01
cgaucagcagcaccg

SEQ ID NO: 3426868 - RNA, 16 nt, Pseudomonas aeruginosa PA01
cgaucagcagcaccgc

SEQ ID NO: 3426869 - RNA, 17 nt, Pseudomonas aeruginosa PA01
cgaucagcagcagcgcc

SEQ ID NO: 3426870 - RNA, 21 nt, Pseudomonas aeruginosa PA01
cgaucagcagcagcgccaugc

SEQ ID NO: 3426871 - RNA, 15 nt, Pseudomonas aeruginosa PA01
cgaucagcagcgcca

SEQ ID NO: 3426872 - RNA, 16 nt, Pseudomonas aeruginosa PA01
cgaucagcagcgccac

SEQ ID NO: 3426873 - RNA, 15 nt, Pseudomonas aeruginosa PA01
cgaucagccagggca

SEQ ID NO: 3426874 - RNA, 16 nt, Pseudomonas aeruginosa PA01
cgaucagccagggcaa

SEQ ID NO: 3426875 - RNA, 21 nt, Pseudomonas aeruginosa PA01
cgaucagccagggcaacgcca

SEQ ID NO: 3426876 - RNA, 22 nt, Pseudomonas aeruginosa PA01
cgaucagccauuggccgacgcc

SEQ ID NO: 3426877 - RNA, 13 nt, Pseudomonas aeruginosa PA01
cgaucagcccgcc

SEQ ID NO: 3426878 - RNA, 16 nt, Pseudomonas aeruginosa PA01
cgaucagcccgccaac

SEQ ID NO: 3426879 - RNA, 19 nt, Pseudomonas aeruginosa PA01
cgaucagcccgccggcgau

SEQ ID NO: 3426880 - RNA, 22 nt, Pseudomonas aeruginosa PA01
cgaucagcccgucggccucgcc

SEQ ID NO: 3426881 - RNA, 15 nt, Pseudomonas aeruginosa PA01
cgaucagccggcgcg

SEQ ID NO: 3426882 - RNA, 11 nt, Pseudomonas aeruginosa PA01
cgaucagcgaa

SEQ ID NO: 3426883 - RNA, 12 nt, Pseudomonas aeruginosa PA01
cgaucagcgccg

SEQ ID NO: 3426884 - RNA, 17 nt, Pseudomonas aeruginosa PA01
cgaucagcgccggguga

SEQ ID NO: 3426885 - RNA, 17 nt, Pseudomonas aeruginosa PA01
cgaucagcgccucggcg

SEQ ID NO: 3426886 - RNA, 18 nt, Pseudomonas aeruginosa PA01
cgaucagcgccucggcgc

SEQ ID NO: 3426887 - RNA, 14 nt, Pseudomonas aeruginosa PA01
cgaucagcgcgcgg

SEQ ID NO: 3426888 - RNA, 15 nt, Pseudomonas aeruginosa PA01
cgaucagcggcccga

SEQ ID NO: 3426889 - RNA, 19 nt, Pseudomonas aeruginosa PA01
cgaucagcggcccgagcag

SEQ ID NO: 3426890 - RNA, 13 nt, Pseudomonas aeruginosa PA01
cgaucagcgggua

SEQ ID NO: 3426891 - RNA, 16 nt, Pseudomonas aeruginosa PA01
cgaucagcucgcggua

SEQ ID NO: 3426892 - RNA, 21 nt, Pseudomonas aeruginosa PA01
cgaucagcucuuccaggugau

SEQ ID NO: 3426893 - RNA, 15 nt, Pseudomonas aeruginosa PA01
cgaucagcuuggccu

SEQ ID NO: 3426894 - RNA, 17 nt, Pseudomonas aeruginosa PA01
cgaucagcuuguggucg

SEQ ID NO: 3426895 - RNA, 21 nt, Pseudomonas aeruginosa PA01
cgaucaggaaauaaccggcgu

SEQ ID NO: 3426896 - RNA, 16 nt, Pseudomonas aeruginosa PA01
cgaucaggaacacccg

SEQ ID NO: 3426897 - RNA, 16 nt, Pseudomonas aeruginosa PA01
cgaucaggaacgcgcc

SEQ ID NO: 3426898 - RNA, 23 nt, Pseudomonas aeruginosa PA01
cgaucaggauguggccgucgcgc

SEQ ID NO: 3426899 - RNA, 14 nt, Pseudomonas aeruginosa PA01
cgaucaggcagcgc

SEQ ID NO: 3426900 - RNA, 15 nt, Pseudomonas aeruginosa PA01
cgaucaggcagcgcg

SEQ ID NO: 3426901 - RNA, 20 nt, Pseudomonas aeruginosa PA01
cgaucaggcagcgcgcggcc

SEQ ID NO: 3426902 - RNA, 14 nt, Pseudomonas aeruginosa PA01
cgaucaggccaagc

SEQ ID NO: 3426903 - RNA, 12 nt, Pseudomonas aeruginosa PA01
cgaucaggccga

SEQ ID NO: 3426904 - RNA, 15 nt, Pseudomonas aeruginosa PA01
cgaucaggccgaugc

SEQ ID NO: 3426905 - RNA, 16 nt, Pseudomonas aeruginosa PA01
cgaucaggccgaugcg

SEQ ID NO: 3426906 - RNA, 17 nt, Pseudomonas aeruginosa PA01
cgaucaggccgaugcgc

SEQ ID NO: 3426907 - RNA, 12 nt, Pseudomonas aeruginosa PA01
cgaucaggcgca

SEQ ID NO: 3426908 - RNA, 20 nt, Pseudomonas aeruginosa PA01
cgaucaggcgcaugcccagg

SEQ ID NO: 3426909 - RNA, 15 nt, Pseudomonas aeruginosa PA01
cgaucaggcgggcgu

SEQ ID NO: 3426910 - RNA, 17 nt, Pseudomonas aeruginosa PA01
cgaucaggcguaggccg

SEQ ID NO: 3426911 - RNA, 13 nt, Pseudomonas aeruginosa PA01
cgaucaggcugaa

SEQ ID NO: 3426912 - RNA, 17 nt, Pseudomonas aeruginosa PA01
cgaucagggccucgcca

SEQ ID NO: 3426913 - RNA, 23 nt, Pseudomonas aeruginosa PA01
cgaucagggccucgccacgcuuc

SEQ ID NO: 3426914 - RNA, 15 nt, Pseudomonas aeruginosa PA01
cgaucagguccuggc

SEQ ID NO: 3426915 - RNA, 17 nt, Pseudomonas aeruginosa PA01
cgaucagguccuggccg

SEQ ID NO: 3426916 - RNA, 20 nt, Pseudomonas aeruginosa PA01
cgaucagguccuggccgaag

SEQ ID NO: 3426917 - RNA, 13 nt, Pseudomonas aeruginosa PA01
cgaucaggucgcc

SEQ ID NO: 3426918 - RNA, 16 nt, Pseudomonas aeruginosa PA01
cgaucaggucgccgcc

SEQ ID NO: 3426919 - RNA, 18 nt, Pseudomonas aeruginosa PA01
cgaucaggucgccgccgc

SEQ ID NO: 3426920 - RNA, 17 nt, Pseudomonas aeruginosa PA01
cgaucaggucgcgcgcc

SEQ ID NO: 3426921 - RNA, 19 nt, Pseudomonas aeruginosa PA01
cgaucaggugcaggaacag

SEQ ID NO: 3426922 - RNA, 18 nt, Pseudomonas aeruginosa PA01
cgaucagugcaucggccg

SEQ ID NO: 3426923 - RNA, 21 nt, Pseudomonas aeruginosa PA01
cgaucaguggucgcagcucca

SEQ ID NO: 3426924 - RNA, 22 nt, Pseudomonas aeruginosa PA01
cgaucaguggucgcagcuccag

SEQ ID NO: 3426925 - RNA, 15 nt, Pseudomonas aeruginosa PA01
cgaucauccagcccc

SEQ ID NO: 3426926 - RNA, 16 nt, Pseudomonas aeruginosa PA01
cgaucaucgccaccgg

SEQ ID NO: 3426927 - RNA, 17 nt, Pseudomonas aeruginosa PA01
cgaucaucgccaccggu

SEQ ID NO: 3426928 - RNA, 13 nt, Pseudomonas aeruginosa PA01
cgaucaucgccag

SEQ ID NO: 3426929 - RNA, 15 nt, Pseudomonas aeruginosa PA01
cgaucaucgccagcg

SEQ ID NO: 3426930 - RNA, 17 nt, Pseudomonas aeruginosa PA01
cgaucaucgccagcggc

SEQ ID NO: 3426931 - RNA, 19 nt, Pseudomonas aeruginosa PA01
cgaucaucgccagcggcgu

SEQ ID NO: 3426932 - RNA, 13 nt, Pseudomonas aeruginosa PA01
cgaucaucggcug

SEQ ID NO: 3426933 - RNA, 16 nt, Pseudomonas aeruginosa PA01
cgaucaucggcugguc

SEQ ID NO: 3426934 - RNA, 15 nt, Pseudomonas aeruginosa PA01
cgaucaugccuucga

SEQ ID NO: 3426935 - RNA, 18 nt, Pseudomonas aeruginosa PA01
cgaucaugggggccagca

SEQ ID NO: 3426936 - RNA, 22 nt, Pseudomonas aeruginosa PA01
cgaucaugggggccagcagggc

SEQ ID NO: 3426937 - RNA, 20 nt, Pseudomonas aeruginosa PA01
cgaucauggugaagcccacc

SEQ ID NO: 3426938 - RNA, 14 nt, Pseudomonas aeruginosa PA01
cgauccaccgccag

SEQ ID NO: 3426939 - RNA, 16 nt, Pseudomonas aeruginosa PA01
cgauccaccgccaggg

SEQ ID NO: 3426940 - RNA, 12 nt, Pseudomonas aeruginosa PA01
cgauccagaaga

SEQ ID NO: 3426941 - RNA, 16 nt, Pseudomonas aeruginosa PA01
cgauccagaagaucag

SEQ ID NO: 3426942 - RNA, 18 nt, Pseudomonas aeruginosa PA01
cgauccagcagucgcggc

SEQ ID NO: 3426943 - RNA, 15 nt, Pseudomonas aeruginosa PA01
cgauccagccggcau

SEQ ID NO: 3426944 - RNA, 17 nt, Pseudomonas aeruginosa PA01
cgauccaggaaccggcc

SEQ ID NO: 3426945 - RNA, 18 nt, Pseudomonas aeruginosa PA01
cgauccaggaaccggcca

SEQ ID NO: 3426946 - RNA, 16 nt, Pseudomonas aeruginosa PA01
cgauccaugcgcacca

SEQ ID NO: 3426947 - RNA, 22 nt, Pseudomonas aeruginosa PA01
cgauccaugcgcaccaggucgc

SEQ ID NO: 3426948 - RNA, 18 nt, Pseudomonas aeruginosa PA01
cgaucccaggucggcggg

SEQ ID NO: 3426949 - RNA, 22 nt, Pseudomonas aeruginosa PA01
cgauccccaacccggccagccc

SEQ ID NO: 3426950 - RNA, 13 nt, Pseudomonas aeruginosa PA01
cgaucccccgccc

SEQ ID NO: 3426951 - RNA, 20 nt, Pseudomonas aeruginosa PA01
cgaucccccgccccucacuc

SEQ ID NO: 3426952 - RNA, 14 nt, Pseudomonas aeruginosa PA01
cgaucccgaucggc

SEQ ID NO: 3426953 - RNA, 14 nt, Pseudomonas aeruginosa PA01
cgaucccguagacc

SEQ ID NO: 3426954 - RNA, 15 nt, Pseudomonas aeruginosa PA01
cgaucccguagaccg

SEQ ID NO: 3426955 - RNA, 13 nt, Pseudomonas aeruginosa PA01
cgauccgcacccg

SEQ ID NO: 3426956 - RNA, 14 nt, Pseudomonas aeruginosa PA01
cgauccgcgccugc

SEQ ID NO: 3426957 - RNA, 12 nt, Pseudomonas aeruginosa PA01
cgauccgcugca

SEQ ID NO: 3426958 - RNA, 22 nt, Pseudomonas aeruginosa PA01
cgauccggccgaucuccuggcg

SEQ ID NO: 3426959 - RNA, 16 nt, Pseudomonas aeruginosa PA01
cgauccuccgccagcc

SEQ ID NO: 3426960 - RNA, 20 nt, Pseudomonas aeruginosa PA01
cgauccuggcggcacuccag

SEQ ID NO: 3426961 - RNA, 21 nt, Pseudomonas aeruginosa PA01
cgaucgaagaaggcucaccgg

SEQ ID NO: 3426962 - RNA, 20 nt, Pseudomonas aeruginosa PA01
cgaucgacgccucggcgcga

SEQ ID NO: 3426963 - RNA, 16 nt, Pseudomonas aeruginosa PA01
cgaucgagcggcccgc

SEQ ID NO: 3426964 - RNA, 22 nt, Pseudomonas aeruginosa PA01
cgaucgagcuguccaucucgcc

SEQ ID NO: 3426965 - RNA, 20 nt, Pseudomonas aeruginosa PA01
cgaucgaggaugaucggcuc

SEQ ID NO: 3426966 - RNA, 15 nt, Pseudomonas aeruginosa PA01
cgaucgagucgccga

SEQ ID NO: 3426967 - RNA, 18 nt, Pseudomonas aeruginosa PA01
cgaucgauagccuggcug

SEQ ID NO: 3426968 - RNA, 19 nt, Pseudomonas aeruginosa PA01
cgaucgauagccuggcugg

SEQ ID NO: 3426969 - RNA, 20 nt, Pseudomonas aeruginosa PA01
cgaucgccaggcgauccagc

SEQ ID NO: 3426970 - RNA, 19 nt, Pseudomonas aeruginosa PA01
cgaucgccagguggaagcg

SEQ ID NO: 3426971 - RNA, 13 nt, Pseudomonas aeruginosa PA01
cgaucgccgccau

SEQ ID NO: 3426972 - RNA, 16 nt, Pseudomonas aeruginosa PA01
cgaucgccgccauuga

SEQ ID NO: 3426973 - RNA, 12 nt, Pseudomonas aeruginosa PA01
cgaucgccgcgg

SEQ ID NO: 3426974 - RNA, 13 nt, Pseudomonas aeruginosa PA01
cgaucgccgcggc

SEQ ID NO: 3426975 - RNA, 12 nt, Pseudomonas aeruginosa PA01
cgaucgccgggu

SEQ ID NO: 3426976 - RNA, 21 nt, Pseudomonas aeruginosa PA01
cgaucgccggguugccgcugg

SEQ ID NO: 3426977 - RNA, 15 nt, Pseudomonas aeruginosa PA01
cgaucgccucggcca

SEQ ID NO: 3426978 - RNA, 21 nt, Pseudomonas aeruginosa PA01
cgaucgccucgggcgagcgca

SEQ ID NO: 3426979 - RNA, 20 nt, Pseudomonas aeruginosa PA01
cgaucgccucguucagcagc

SEQ ID NO: 3426980 - RNA, 17 nt, Pseudomonas aeruginosa PA01
cgaucgcggccagccgc

SEQ ID NO: 3426981 - RNA, 16 nt, Pseudomonas aeruginosa PA01
cgaucgcggcgacgau

SEQ ID NO: 3426982 - RNA, 20 nt, Pseudomonas aeruginosa PA01
cgaucgcggcgacgaucacc

SEQ ID NO: 3426983 - RNA, 19 nt, Pseudomonas aeruginosa PA01
cgaucgcguuccagcaacg

SEQ ID NO: 3426984 - RNA, 18 nt, Pseudomonas aeruginosa PA01
cgaucggaagaucgcccg

SEQ ID NO: 3426985 - RNA, 21 nt, Pseudomonas aeruginosa PA01
cgaucggaagaucgcccgccu

SEQ ID NO: 3426986 - RNA, 22 nt, Pseudomonas aeruginosa PA01
cgaucggaugcacgugcagcuc

SEQ ID NO: 3426987 - RNA, 20 nt, Pseudomonas aeruginosa PA01
cgaucggcagggcgccgacc

SEQ ID NO: 3426988 - RNA, 21 nt, Pseudomonas aeruginosa PA01
cgaucggcagggcgccgacca

SEQ ID NO: 3426989 - RNA, 13 nt, Pseudomonas aeruginosa PA01
cgaucggcccggg

SEQ ID NO: 3426990 - RNA, 15 nt, Pseudomonas aeruginosa PA01
cgaucggcccgggcg

SEQ ID NO: 3426991 - RNA, 23 nt, Pseudomonas aeruginosa PA01
cgaucggcugcccaagggccugg

SEQ ID NO: 3426992 - RNA, 15 nt, Pseudomonas aeruginosa PA01
cgaucggcuggucgu

SEQ ID NO: 3426993 - RNA, 13 nt, Pseudomonas aeruginosa PA01
cgaucggggcaga

SEQ ID NO: 3426994 - RNA, 23 nt, Pseudomonas aeruginosa PA01
cgaucuaccugcgugcgccguag

SEQ ID NO: 3426995 - RNA, 17 nt, Pseudomonas aeruginosa PA01
cgaucucauggucgggc

SEQ ID NO: 3426996 - RNA, 14 nt, Pseudomonas aeruginosa PA01
cgaucucccgcgau

SEQ ID NO: 3426997 - RNA, 15 nt, Pseudomonas aeruginosa PA01
cgaucucccgcgauu

SEQ ID NO: 3426998 - RNA, 17 nt, Pseudomonas aeruginosa PA01
cgaucuccgccaggcgg

SEQ ID NO: 3426999 - RNA, 23 nt, Pseudomonas aeruginosa PA01
cgaucuccgccaggcggccgaag

SEQ ID NO: 3427000 - RNA, 14 nt, Pseudomonas aeruginosa PA01
cgaucuccuccgcc

SEQ ID NO: 3427001 - RNA, 15 nt, Pseudomonas aeruginosa PA01
cgaucuccuccgccc

SEQ ID NO: 3427002 - RNA, 19 nt, Pseudomonas aeruginosa PA01
cgaucuccuccgccccggc

SEQ ID NO: 3427003 - RNA, 13 nt, Pseudomonas aeruginosa PA01
cgaucuccuccuc

SEQ ID NO: 3427004 - RNA, 15 nt, Pseudomonas aeruginosa PA01
cgaucuccuccucgg

SEQ ID NO: 3427005 - RNA, 22 nt, Pseudomonas aeruginosa PA01
cgaucuccuccucggcggcuuc

SEQ ID NO: 3427006 - RNA, 17 nt, Pseudomonas aeruginosa PA01
cgaucuccucgcgcagc

SEQ ID NO: 3427007 - RNA, 16 nt, Pseudomonas aeruginosa PA01
cgaucuccugcugggc

SEQ ID NO: 3427008 - RNA, 13 nt, Pseudomonas aeruginosa PA01
cgaucuccuggcg

SEQ ID NO: 3427009 - RNA, 20 nt, Pseudomonas aeruginosa PA01
cgaucucgaagaccagcgga

SEQ ID NO: 3427010 - RNA, 14 nt, Pseudomonas aeruginosa PA01
cgaucucgaucgag

SEQ ID NO: 3427011 - RNA, 17 nt, Pseudomonas aeruginosa PA01
cgaucucgcccagggcg

SEQ ID NO: 3427012 - RNA, 22 nt, Pseudomonas aeruginosa PA01
cgaucucgcccaguaccgccac

SEQ ID NO: 3427013 - RNA, 20 nt, Pseudomonas aeruginosa PA01
cgaucucgcguuccagcacc

SEQ ID NO: 3427014 - RNA, 17 nt, Pseudomonas aeruginosa PA01
cgaucucgcucucgagc

SEQ ID NO: 3427015 - RNA, 15 nt, Pseudomonas aeruginosa PA01
cgaucucggcgcggg

SEQ ID NO: 3427016 - RNA, 14 nt, Pseudomonas aeruginosa PA01
cgaucucggugggc

SEQ ID NO: 3427017 - RNA, 16 nt, Pseudomonas aeruginosa PA01
cgaucucggugggcuu

SEQ ID NO: 3427018 - RNA, 18 nt, Pseudomonas aeruginosa PA01
cgaucucgguuuccagga

SEQ ID NO: 3427019 - RNA, 22 nt, Pseudomonas aeruginosa PA01
cgaucucguagcggucgugcag

SEQ ID NO: 3427020 - RNA, 23 nt, Pseudomonas aeruginosa PA01
cgaucucgucgaagcgcaguacc

SEQ ID NO: 3427021 - RNA, 16 nt, Pseudomonas aeruginosa PA01
cgaucucgucggcggg

SEQ ID NO: 3427022 - RNA, 18 nt, Pseudomonas aeruginosa PA01
cgaucucgugcuuggugu

SEQ ID NO: 3427023 - RNA, 18 nt, Pseudomonas aeruginosa PA01
cgaucucguucggguagu

SEQ ID NO: 3427024 - RNA, 20 nt, Pseudomonas aeruginosa PA01
cgaucucuacuaccgccagc

SEQ ID NO: 3427025 - RNA, 22 nt, Pseudomonas aeruginosa PA01
cgaucucuacuaccgccagcgc

SEQ ID NO: 3427026 - RNA, 19 nt, Pseudomonas aeruginosa PA01
cgaucucucaguccaucgu

SEQ ID NO: 3427027 - RNA, 13 nt, Pseudomonas aeruginosa PA01
cgaucucuucccg

SEQ ID NO: 3427028 - RNA, 15 nt, Pseudomonas aeruginosa PA01
cgaucucuucccggc

SEQ ID NO: 3427029 - RNA, 17 nt, Pseudomonas aeruginosa PA01
cgaucucuucccggcuc

SEQ ID NO: 3427030 - RNA, 19 nt, Pseudomonas aeruginosa PA01
cgaucucuucccggcucgg

SEQ ID NO: 3427031 - RNA, 22 nt, Pseudomonas aeruginosa PA01
cgaucucuucccggcucggcac

SEQ ID NO: 3427032 - RNA, 24 nt, Pseudomonas aeruginosa PA01
cgaucugcagguuggcgugcauca

SEQ ID NO: 3427033 - RNA, 14 nt, Pseudomonas aeruginosa PA01
cgaucugcgccgca

SEQ ID NO: 3427034 - RNA, 21 nt, Pseudomonas aeruginosa PA01
cgaucugcucguccaggccgc

SEQ ID NO: 3427035 - RNA, 20 nt, Pseudomonas aeruginosa PA01
cgaucugcugguugaggccg

SEQ ID NO: 3427036 - RNA, 23 nt, Pseudomonas aeruginosa PA01
cgaucugcugguugaggccgucc

SEQ ID NO: 3427037 - RNA, 17 nt, Pseudomonas aeruginosa PA01
cgaucugcuugcgcgcc

SEQ ID NO: 3427038 - RNA, 18 nt, Pseudomonas aeruginosa PA01
cgaucugcuugcgcgccg

SEQ ID NO: 3427039 - RNA, 19 nt, Pseudomonas aeruginosa PA01
cgaucugcuugcgcgccgc

SEQ ID NO: 3427040 - RNA, 21 nt, Pseudomonas aeruginosa PA01
cgaucugcuugcgcgccgccg

SEQ ID NO: 3427041 - RNA, 22 nt, Pseudomonas aeruginosa PA01
cgaucugcuugcgcgccgccgc

SEQ ID NO: 3427042 - RNA, 23 nt, Pseudomonas aeruginosa PA01
cgaucugcuugcgcgccgccgcc

SEQ ID NO: 3427043 - RNA, 15 nt, Pseudomonas aeruginosa PA01
cgaucuggcugccca

SEQ ID NO: 3427044 - RNA, 18 nt, Pseudomonas aeruginosa PA01
cgaucuggcugcccaggc

SEQ ID NO: 3427045 - RNA, 20 nt, Pseudomonas aeruginosa PA01
cgaucugucgauaccagcgc

SEQ ID NO: 3427046 - RNA, 14 nt, Pseudomonas aeruginosa PA01
cgaucugucgcagc

SEQ ID NO: 3427047 - RNA, 13 nt, Pseudomonas aeruginosa PA01
cgaucuucagcag

SEQ ID NO: 3427048 - RNA, 22 nt, Pseudomonas aeruginosa PA01
cgaucuucagcagcaggcgcuc

SEQ ID NO: 3427049 - RNA, 16 nt, Pseudomonas aeruginosa PA01
cgaucuucuccgccgc

SEQ ID NO: 3427050 - RNA, 13 nt, Pseudomonas aeruginosa PA01
cgaucuucugcac

SEQ ID NO: 3427051 - RNA, 15 nt, Pseudomonas aeruginosa PA01
cgaucuucugcaccc

SEQ ID NO: 3427052 - RNA, 16 nt, Pseudomonas aeruginosa PA01
cgaucuucugcacccc

SEQ ID NO: 3427053 - RNA, 23 nt, Pseudomonas aeruginosa PA01
cgaucuugaggaaguggaucggc

SEQ ID NO: 3427054 - RNA, 16 nt, Pseudomonas aeruginosa PA01
cgaucuugaucgccag

SEQ ID NO: 3427055 - RNA, 18 nt, Pseudomonas aeruginosa PA01
cgaucuugaucgccagcg

SEQ ID NO: 3427056 - RNA, 21 nt, Pseudomonas aeruginosa PA01
cgaugaaauagcucugccgau

SEQ ID NO: 3427057 - RNA, 17 nt, Pseudomonas aeruginosa PA01
cgaugaacagcgacucg

SEQ ID NO: 3427058 - RNA, 18 nt, Pseudomonas aeruginosa PA01
cgaugaacagugcgcccg

SEQ ID NO: 3427059 - RNA, 14 nt, Pseudomonas aeruginosa PA01
cgaugaacgcccug

SEQ ID NO: 3427060 - RNA, 14 nt, Pseudomonas aeruginosa PA01
cgaugaacgccgcg

SEQ ID NO: 3427061 - RNA, 19 nt, Pseudomonas aeruginosa PA01
cgaugaacggcgucacgcc

SEQ ID NO: 3427062 - RNA, 14 nt, Pseudomonas aeruginosa PA01
cgaugaagcgguuc

SEQ ID NO: 3427063 - RNA, 12 nt, Pseudomonas aeruginosa PA01
cgaugaagcuga

SEQ ID NO: 3427064 - RNA, 15 nt, Pseudomonas aeruginosa PA01
cgaugaaugcgcagg

SEQ ID NO: 3427065 - RNA, 16 nt, Pseudomonas aeruginosa PA01
cgaugaaugcgcaggu

SEQ ID NO: 3427066 - RNA, 21 nt, Pseudomonas aeruginosa PA01
cgaugaccaggguggcggcgg

SEQ ID NO: 3427067 - RNA, 14 nt, Pseudomonas aeruginosa PA01
cgaugaccgccccg

SEQ ID NO: 3427068 - RNA, 15 nt, Pseudomonas aeruginosa PA01
cgaugaccgccccgg

SEQ ID NO: 3427069 - RNA, 23 nt, Pseudomonas aeruginosa PA01
cgaugaccgccccggcagccacc

SEQ ID NO: 3427070 - RNA, 16 nt, Pseudomonas aeruginosa PA01
cgaugacgauggcgcc

SEQ ID NO: 3427071 - RNA, 18 nt, Pseudomonas aeruginosa PA01
cgaugacgauggcgccuu

SEQ ID NO: 3427072 - RNA, 22 nt, Pseudomonas aeruginosa PA01
cgaugacguugcugcccuggcg

SEQ ID NO: 3427073 - RNA, 20 nt, Pseudomonas aeruginosa PA01
cgaugagcaugccgcagacg

SEQ ID NO: 3427074 - RNA, 16 nt, Pseudomonas aeruginosa PA01
cgaugagccagccugc

SEQ ID NO: 3427075 - RNA, 16 nt, Pseudomonas aeruginosa PA01
cgaugagcuucgccgg

SEQ ID NO: 3427076 - RNA, 23 nt, Pseudomonas aeruginosa PA01
cgaugaggcuguccagcaggcgu

SEQ ID NO: 3427077 - RNA, 15 nt, Pseudomonas aeruginosa PA01
cgaugaggucgcagc

SEQ ID NO: 3427078 - RNA, 16 nt, Pseudomonas aeruginosa PA01
cgaugaggucgcagcg

SEQ ID NO: 3427079 - RNA, 22 nt, Pseudomonas aeruginosa PA01
cgaugaggucgcagcguuccag

SEQ ID NO: 3427080 - RNA, 13 nt, Pseudomonas aeruginosa PA01
cgaugaucagccc

SEQ ID NO: 3427081 - RNA, 18 nt, Pseudomonas aeruginosa PA01
cgaugaucagcccuucgc

SEQ ID NO: 3427082 - RNA, 19 nt, Pseudomonas aeruginosa PA01
cgaugaucagcccuucgcg

SEQ ID NO: 3427083 - RNA, 15 nt, Pseudomonas aeruginosa PA01
cgaugaucgagcgca

SEQ ID NO: 3427084 - RNA, 15 nt, Pseudomonas aeruginosa PA01
cgaugaucgccgggu

SEQ ID NO: 3427085 - RNA, 14 nt, Pseudomonas aeruginosa PA01
cgaugaucggcagc

SEQ ID NO: 3427086 - RNA, 22 nt, Pseudomonas aeruginosa PA01
cgaugaucgguucccgcccgcu

SEQ ID NO: 3427087 - RNA, 16 nt, Pseudomonas aeruginosa PA01
cgaugaucuccgcgcc

SEQ ID NO: 3427088 - RNA, 18 nt, Pseudomonas aeruginosa PA01
cgaugaucuccgcgccgg

SEQ ID NO: 3427089 - RNA, 13 nt, Pseudomonas aeruginosa PA01
cgaugaugccgcc

SEQ ID NO: 3427090 - RNA, 19 nt, Pseudomonas aeruginosa PA01
cgaugauggucaacaccag

SEQ ID NO: 3427091 - RNA, 21 nt, Pseudomonas aeruginosa PA01
cgaugauggucaacaccagcg

SEQ ID NO: 3427092 - RNA, 22 nt, Pseudomonas aeruginosa PA01
cgaugauggucaacaccagcgc

SEQ ID NO: 3427093 - RNA, 18 nt, Pseudomonas aeruginosa PA01
cgaugauggugcggugga

SEQ ID NO: 3427094 - RNA, 20 nt, Pseudomonas aeruginosa PA01
cgaugcccaauacccacagg

SEQ ID NO: 3427095 - RNA, 20 nt, Pseudomonas aeruginosa PA01
cgaugcccaccugaacgcgc

SEQ ID NO: 3427096 - RNA, 16 nt, Pseudomonas aeruginosa PA01
cgaugcccaggccgau

SEQ ID NO: 3427097 - RNA, 17 nt, Pseudomonas aeruginosa PA01
cgaugcccaggccgccg

SEQ ID NO: 3427098 - RNA, 18 nt, Pseudomonas aeruginosa PA01
cgaugcccaggccgccga

SEQ ID NO: 3427099 - RNA, 18 nt, Pseudomonas aeruginosa PA01
cgaugccccauccgacgc

SEQ ID NO: 3427100 - RNA, 19 nt, Pseudomonas aeruginosa PA01
cgaugccccauccgacgcc

SEQ ID NO: 3427101 - RNA, 19 nt, Pseudomonas aeruginosa PA01
cgaugcccgccagcaggcg

SEQ ID NO: 3427102 - RNA, 21 nt, Pseudomonas aeruginosa PA01
cgaugcccgccagcaggcgcc

SEQ ID NO: 3427103 - RNA, 12 nt, Pseudomonas aeruginosa PA01
cgaugcccgccu

SEQ ID NO: 3427104 - RNA, 18 nt, Pseudomonas aeruginosa PA01
cgaugcccucgcggcggc

SEQ ID NO: 3427105 - RNA, 20 nt, Pseudomonas aeruginosa PA01
cgaugcccucgcggcggcag

SEQ ID NO: 3427106 - RNA, 22 nt, Pseudomonas aeruginosa PA01
cgaugcccucgcggcggcaggc

SEQ ID NO: 3427107 - RNA, 18 nt, Pseudomonas aeruginosa PA01
cgaugcccuggccgcugc

SEQ ID NO: 3427108 - RNA, 19 nt, Pseudomonas aeruginosa PA01
cgaugcccuggccgcugcc

SEQ ID NO: 3427109 - RNA, 23 nt, Pseudomonas aeruginosa PA01
cgaugcccuggcuuuccagggcc

SEQ ID NO: 3427110 - RNA, 16 nt, Pseudomonas aeruginosa PA01
cgaugcccuuggccag

SEQ ID NO: 3427111 - RNA, 18 nt, Pseudomonas aeruginosa PA01
cgaugcccuuggccagcg

SEQ ID NO: 3427112 - RNA, 22 nt, Pseudomonas aeruginosa PA01
cgaugcccuuggccagcgcggc

SEQ ID NO: 3427113 - RNA, 22 nt, Pseudomonas aeruginosa PA01
cgaugccgaggaggaugccgau

SEQ ID NO: 3427114 - RNA, 19 nt, Pseudomonas aeruginosa PA01
cgaugccgaucucgcccag

SEQ ID NO: 3427115 - RNA, 14 nt, Pseudomonas aeruginosa PA01
cgaugccgcccagc

SEQ ID NO: 3427116 - RNA, 15 nt, Pseudomonas aeruginosa PA01
cgaugccgcccagca

SEQ ID NO: 3427117 - RNA, 16 nt, Pseudomonas aeruginosa PA01
cgaugccgcccagcac

SEQ ID NO: 3427118 - RNA, 13 nt, Pseudomonas aeruginosa PA01
cgaugccgcccgg

SEQ ID NO: 3427119 - RNA, 15 nt, Pseudomonas aeruginosa PA01
cgaugccgccgaccu

SEQ ID NO: 3427120 - RNA, 21 nt, Pseudomonas aeruginosa PA01
cgaugccgccgaccucggccg

SEQ ID NO: 3427121 - RNA, 23 nt, Pseudomonas aeruginosa PA01
cgaugccgccgaccucggccgcc

SEQ ID NO: 3427122 - RNA, 13 nt, Pseudomonas aeruginosa PA01
cgaugccgccgcc

SEQ ID NO: 3427123 - RNA, 15 nt, Pseudomonas aeruginosa PA01
cgaugccgccgccgc

SEQ ID NO: 3427124 - RNA, 21 nt, Pseudomonas aeruginosa PA01
cgaugccgccgccgccccagc

SEQ ID NO: 3427125 - RNA, 16 nt, Pseudomonas aeruginosa PA01
cgaugccgccgggcau

SEQ ID NO: 3427126 - RNA, 22 nt, Pseudomonas aeruginosa PA01
cgaugccgccgggcaucaugcc

SEQ ID NO: 3427127 - RNA, 15 nt, Pseudomonas aeruginosa PA01
cgaugccgcgccagg

SEQ ID NO: 3427128 - RNA, 17 nt, Pseudomonas aeruginosa PA01
cgaugccgcgccaggcg

SEQ ID NO: 3427129 - RNA, 19 nt, Pseudomonas aeruginosa PA01
cgaugccgcgccaggcgca

SEQ ID NO: 3427130 - RNA, 23 nt, Pseudomonas aeruginosa PA01
cgaugccgcgccaggcgcaguag

SEQ ID NO: 3427131 - RNA, 14 nt, Pseudomonas aeruginosa PA01
cgaugccgcgccgg

SEQ ID NO: 3427132 - RNA, 12 nt, Pseudomonas aeruginosa PA01
cgaugccgcgcg

SEQ ID NO: 3427133 - RNA, 14 nt, Pseudomonas aeruginosa PA01
cgaugccgcgcgcc

SEQ ID NO: 3427134 - RNA, 15 nt, Pseudomonas aeruginosa PA01
cgaugccgcgcgccu

SEQ ID NO: 3427135 - RNA, 16 nt, Pseudomonas aeruginosa PA01
cgaugccgcgcgccug

SEQ ID NO: 3427136 - RNA, 19 nt, Pseudomonas aeruginosa PA01
cgaugccgcgcgccuggcu

SEQ ID NO: 3427137 - RNA, 21 nt, Pseudomonas aeruginosa PA01
cgaugccgcgcgccuggcugg

SEQ ID NO: 3427138 - RNA, 22 nt, Pseudomonas aeruginosa PA01
cgaugccgcgcgccuggcuggc

SEQ ID NO: 3427139 - RNA, 21 nt, Pseudomonas aeruginosa PA01
cgaugccggaaagccuggccg

SEQ ID NO: 3427140 - RNA, 21 nt, Pseudomonas aeruginosa PA01
cgaugccggagagcagcacgg

SEQ ID NO: 3427141 - RNA, 22 nt, Pseudomonas aeruginosa PA01
cgaugccggagagcagcacggc

SEQ ID NO: 3427142 - RNA, 21 nt, Pseudomonas aeruginosa PA01
cgaugccggccggcagcgagc

SEQ ID NO: 3427143 - RNA, 15 nt, Pseudomonas aeruginosa PA01
cgaugccgggcaacg

SEQ ID NO: 3427144 - RNA, 21 nt, Pseudomonas aeruginosa PA01
cgaugccguuaccuuggccac

SEQ ID NO: 3427145 - RNA, 16 nt, Pseudomonas aeruginosa PA01
cgaugccguucaggcg

SEQ ID NO: 3427146 - RNA, 22 nt, Pseudomonas aeruginosa PA01
cgaugccguucucggugaccac

SEQ ID NO: 3427147 - RNA, 22 nt, Pseudomonas aeruginosa PA01
cgaugccguuguagcugaccac

SEQ ID NO: 3427148 - RNA, 17 nt, Pseudomonas aeruginosa PA01
cgaugccuucggcggcc

SEQ ID NO: 3427149 - RNA, 18 nt, Pseudomonas aeruginosa PA01
cgaugccuucggcggccg

SEQ ID NO: 3427150 - RNA, 20 nt, Pseudomonas aeruginosa PA01
cgaugccuucggcggccggg

SEQ ID NO: 3427151 - RNA, 15 nt, Pseudomonas aeruginosa PA01
cgaugccuugcggcc

SEQ ID NO: 3427152 - RNA, 12 nt, Pseudomonas aeruginosa PA01
cgaugcgcaacg

SEQ ID NO: 3427153 - RNA, 21 nt, Pseudomonas aeruginosa PA01
cgaugcgcaacgggcggcggg

SEQ ID NO: 3427154 - RNA, 13 nt, Pseudomonas aeruginosa PA01
cgaugcgcagcuu

SEQ ID NO: 3427155 - RNA, 13 nt, Pseudomonas aeruginosa PA01
cgaugcgcaggcc

SEQ ID NO: 3427156 - RNA, 14 nt, Pseudomonas aeruginosa PA01
cgaugcgcaggccg

SEQ ID NO: 3427157 - RNA, 12 nt, Pseudomonas aeruginosa PA01
cgaugcgcaugc

SEQ ID NO: 3427158 - RNA, 17 nt, Pseudomonas aeruginosa PA01
cgaugcgccccagcgcc

SEQ ID NO: 3427159 - RNA, 21 nt, Pseudomonas aeruginosa PA01
cgaugcgccccagcgccuggg

SEQ ID NO: 3427160 - RNA, 12 nt, Pseudomonas aeruginosa PA01
cgaugcgcccgc

SEQ ID NO: 3427161 - RNA, 19 nt, Pseudomonas aeruginosa PA01
cgaugcgcccgccgcgagc

SEQ ID NO: 3427162 - RNA, 15 nt, Pseudomonas aeruginosa PA01
cgaugcgccgacgcc

SEQ ID NO: 3427163 - RNA, 19 nt, Pseudomonas aeruginosa PA01
cgaugcgccgacgccacca

SEQ ID NO: 3427164 - RNA, 18 nt, Pseudomonas aeruginosa PA01
cgaugcgccggaucggcu

SEQ ID NO: 3427165 - RNA, 17 nt, Pseudomonas aeruginosa PA01
cgaugcgccucagcggc

SEQ ID NO: 3427166 - RNA, 18 nt, Pseudomonas aeruginosa PA01
cgaugcgccucagcggcc

SEQ ID NO: 3427167 - RNA, 23 nt, Pseudomonas aeruginosa PA01
cgaugcgcgcccugacgaugcag

SEQ ID NO: 3427168 - RNA, 14 nt, Pseudomonas aeruginosa PA01
cgaugcgcgcggcg

SEQ ID NO: 3427169 - RNA, 16 nt, Pseudomonas aeruginosa PA01
cgaugcgcgcggcgag

SEQ ID NO: 3427170 - RNA, 13 nt, Pseudomonas aeruginosa PA01
cgaugcggcccgc

SEQ ID NO: 3427171 - RNA, 15 nt, Pseudomonas aeruginosa PA01
cgaugcggcccgccg

SEQ ID NO: 3427172 - RNA, 19 nt, Pseudomonas aeruginosa PA01
cgaugcggcccgccggcga

SEQ ID NO: 3427173 - RNA, 18 nt, Pseudomonas aeruginosa PA01
cgaugcgguagucgcugc

SEQ ID NO: 3427174 - RNA, 22 nt, Pseudomonas aeruginosa PA01
cgaugcgguagucgcugcuggc

SEQ ID NO: 3427175 - RNA, 23 nt, Pseudomonas aeruginosa PA01
cgaugcgguagucgcugcuggcg

SEQ ID NO: 3427176 - RNA, 16 nt, Pseudomonas aeruginosa PA01
cgaugcguccgcgcag

SEQ ID NO: 3427177 - RNA, 18 nt, Pseudomonas aeruginosa PA01
cgaugcguccgcgcaggc

SEQ ID NO: 3427178 - RNA, 19 nt, Pseudomonas aeruginosa PA01
cgaugcguccgcgcaggcg

SEQ ID NO: 3427179 - RNA, 20 nt, Pseudomonas aeruginosa PA01
cgaugcguccgcgcaggcgg

SEQ ID NO: 3427180 - RNA, 16 nt, Pseudomonas aeruginosa PA01
cgaugcguuccagggc

SEQ ID NO: 3427181 - RNA, 19 nt, Pseudomonas aeruginosa PA01
cgaugcguuccagggcgaa

SEQ ID NO: 3427182 - RNA, 23 nt, Pseudomonas aeruginosa PA01
cgaugcguuugucgaccugcccc

SEQ ID NO: 3427183 - RNA, 17 nt, Pseudomonas aeruginosa PA01
cgaugcuaucgcguggc

SEQ ID NO: 3427184 - RNA, 17 nt, Pseudomonas aeruginosa PA01
cgaugcucagcgccggc

SEQ ID NO: 3427185 - RNA, 17 nt, Pseudomonas aeruginosa PA01
cgaugcucauccugccc

SEQ ID NO: 3427186 - RNA, 18 nt, Pseudomonas aeruginosa PA01
cgaugcucauccugcccg

SEQ ID NO: 3427187 - RNA, 13 nt, Pseudomonas aeruginosa PA01
cgaugcucgcgcc

SEQ ID NO: 3427188 - RNA, 18 nt, Pseudomonas aeruginosa PA01
cgaugcucgcgccagccc

SEQ ID NO: 3427189 - RNA, 20 nt, Pseudomonas aeruginosa PA01
cgaugcucgguugccaggcc

SEQ ID NO: 3427190 - RNA, 21 nt, Pseudomonas aeruginosa PA01
cgaugcugaaccuguugcuca

SEQ ID NO: 3427191 - RNA, 22 nt, Pseudomonas aeruginosa PA01
cgaugcugaucacccgcccgcc

SEQ ID NO: 3427192 - RNA, 20 nt, Pseudomonas aeruginosa PA01
cgaugcugccguagcgcuuc

SEQ ID NO: 3427193 - RNA, 20 nt, Pseudomonas aeruginosa PA01
cgaugcugcugaucaggagg

SEQ ID NO: 3427194 - RNA, 16 nt, Pseudomonas aeruginosa PA01
cgaugcuggcaacggc

SEQ ID NO: 3427195 - RNA, 20 nt, Pseudomonas aeruginosa PA01
cgaugcugucagcgcccggc

SEQ ID NO: 3427196 - RNA, 16 nt, Pseudomonas aeruginosa PA01
cgaugcuuagcccggg

SEQ ID NO: 3427197 - RNA, 15 nt, Pseudomonas aeruginosa PA01
cgauggaacgaagaa

SEQ ID NO: 3427198 - RNA, 14 nt, Pseudomonas aeruginosa PA01
cgauggacaucccg

SEQ ID NO: 3427199 - RNA, 20 nt, Pseudomonas aeruginosa PA01
cgauggagauguagucgacg

SEQ ID NO: 3427200 - RNA, 12 nt, Pseudomonas aeruginosa PA01
cgauggaugacc

SEQ ID NO: 3427201 - RNA, 20 nt, Pseudomonas aeruginosa PA01
cgauggaugacccgcucgcc

SEQ ID NO: 3427202 - RNA, 21 nt, Pseudomonas aeruginosa PA01
cgauggaugacccgcucgccg

SEQ ID NO: 3427203 - RNA, 12 nt, Pseudomonas aeruginosa PA01
cgauggccagcc

SEQ ID NO: 3427204 - RNA, 13 nt, Pseudomonas aeruginosa PA01
cgauggccagcgc

SEQ ID NO: 3427205 - RNA, 14 nt, Pseudomonas aeruginosa PA01
cgauggccagcgcg

SEQ ID NO: 3427206 - RNA, 15 nt, Pseudomonas aeruginosa PA01
cgauggccagcgcgu

SEQ ID NO: 3427207 - RNA, 13 nt, Pseudomonas aeruginosa PA01
cgauggccagggg

SEQ ID NO: 3427208 - RNA, 20 nt, Pseudomonas aeruginosa PA01
cgauggccagggggccuggc

SEQ ID NO: 3427209 - RNA, 23 nt, Pseudomonas aeruginosa PA01
cgauggccagggggccuggcucg

SEQ ID NO: 3427210 - RNA, 18 nt, Pseudomonas aeruginosa PA01
cgauggccaucagggucg

SEQ ID NO: 3427211 - RNA, 17 nt, Pseudomonas aeruginosa PA01
cgauggcccagaugauc

SEQ ID NO: 3427212 - RNA, 22 nt, Pseudomonas aeruginosa PA01
cgauggcccagaugaucaggcc

SEQ ID NO: 3427213 - RNA, 12 nt, Pseudomonas aeruginosa PA01
cgauggccccgg

SEQ ID NO: 3427214 - RNA, 15 nt, Pseudomonas aeruginosa PA01
cgauggccccggcga

SEQ ID NO: 3427215 - RNA, 17 nt, Pseudomonas aeruginosa PA01
cgauggccccggcgauc

SEQ ID NO: 3427216 - RNA, 19 nt, Pseudomonas aeruginosa PA01
cgauggccccggcgauccg

SEQ ID NO: 3427217 - RNA, 20 nt, Pseudomonas aeruginosa PA01
cgauggcccguuccaccgcc

SEQ ID NO: 3427218 - RNA, 21 nt, Pseudomonas aeruginosa PA01
cgauggcccguuccaccgccu

SEQ ID NO: 3427219 - RNA, 16 nt, Pseudomonas aeruginosa PA01
cgauggccgccagcag

SEQ ID NO: 3427220 - RNA, 17 nt, Pseudomonas aeruginosa PA01
cgauggccgccagcagg

SEQ ID NO: 3427221 - RNA, 20 nt, Pseudomonas aeruginosa PA01
cgauggccgccagcaggccg

SEQ ID NO: 3427222 - RNA, 22 nt, Pseudomonas aeruginosa PA01
cgauggccgccagcaggccgaa

SEQ ID NO: 3427223 - RNA, 12 nt, Pseudomonas aeruginosa PA01
cgauggccgccg

SEQ ID NO: 3427224 - RNA, 13 nt, Pseudomonas aeruginosa PA01
cgauggccgccgc

SEQ ID NO: 3427225 - RNA, 14 nt, Pseudomonas aeruginosa PA01
cgauggccgccgcc

SEQ ID NO: 3427226 - RNA, 15 nt, Pseudomonas aeruginosa PA01
cgauggccgccgccg

SEQ ID NO: 3427227 - RNA, 20 nt, Pseudomonas aeruginosa PA01
cgauggccgccgccgccguc

SEQ ID NO: 3427228 - RNA, 17 nt, Pseudomonas aeruginosa PA01
cgauggccggcaccagc

SEQ ID NO: 3427229 - RNA, 19 nt, Pseudomonas aeruginosa PA01
cgauggccggcaccagcag

SEQ ID NO: 3427230 - RNA, 15 nt, Pseudomonas aeruginosa PA01
cgauggccggcagca

SEQ ID NO: 3427231 - RNA, 17 nt, Pseudomonas aeruginosa PA01
cgauggccggcagcagc

SEQ ID NO: 3427232 - RNA, 19 nt, Pseudomonas aeruginosa PA01
cgauggccggcagcagcgc

SEQ ID NO: 3427233 - RNA, 20 nt, Pseudomonas aeruginosa PA01
cgauggccggcagcagcgcc

SEQ ID NO: 3427234 - RNA, 21 nt, Pseudomonas aeruginosa PA01
cgauggccggcagcagcgcca

SEQ ID NO: 3427235 - RNA, 23 nt, Pseudomonas aeruginosa PA01
cgauggccggcagcagcgccagg

SEQ ID NO: 3427236 - RNA, 14 nt, Pseudomonas aeruginosa PA01
cgauggccuggucg

SEQ ID NO: 3427237 - RNA, 19 nt, Pseudomonas aeruginosa PA01
cgauggccuggucggcgcg

SEQ ID NO: 3427238 - RNA, 22 nt, Pseudomonas aeruginosa PA01
cgauggccuggucggcgcggcg

SEQ ID NO: 3427239 - RNA, 22 nt, Pseudomonas aeruginosa PA01
cgauggcgaacaugaagccgcg

SEQ ID NO: 3427240 - RNA, 15 nt, Pseudomonas aeruginosa PA01
cgauggcgaagcgcu

SEQ ID NO: 3427241 - RNA, 14 nt, Pseudomonas aeruginosa PA01
cgauggcgaggaug

SEQ ID NO: 3427242 - RNA, 15 nt, Pseudomonas aeruginosa PA01
cgauggcgccgccga

SEQ ID NO: 3427243 - RNA, 23 nt, Pseudomonas aeruginosa PA01
cgauggcgccgccgagguugcgc

SEQ ID NO: 3427244 - RNA, 13 nt, Pseudomonas aeruginosa PA01
cgauggcgccgcg

SEQ ID NO: 3427245 - RNA, 13 nt, Pseudomonas aeruginosa PA01
cgauggcgcgcuu

SEQ ID NO: 3427246 - RNA, 19 nt, Pseudomonas aeruginosa PA01
cgauggcgcgcuuuccggc

SEQ ID NO: 3427247 - RNA, 21 nt, Pseudomonas aeruginosa PA01
cgauggcgcgcuuuccggcgc

SEQ ID NO: 3427248 - RNA, 12 nt, Pseudomonas aeruginosa PA01
cgauggcggccg

SEQ ID NO: 3427249 - RNA, 13 nt, Pseudomonas aeruginosa PA01
cgauggcggccgc

SEQ ID NO: 3427250 - RNA, 17 nt, Pseudomonas aeruginosa PA01
cgauggcggccgccauu

SEQ ID NO: 3427251 - RNA, 16 nt, Pseudomonas aeruginosa PA01
cgauggcguccaccgc

SEQ ID NO: 3427252 - RNA, 21 nt, Pseudomonas aeruginosa PA01
cgauggcgugaaguagccgcc

SEQ ID NO: 3427253 - RNA, 22 nt, Pseudomonas aeruginosa PA01
cgauggcgugaaguagccgccg

SEQ ID NO: 3427254 - RNA, 19 nt, Pseudomonas aeruginosa PA01
cgauggcguuauucgcccu

SEQ ID NO: 3427255 - RNA, 14 nt, Pseudomonas aeruginosa PA01
cgauggcucgcggc

SEQ ID NO: 3427256 - RNA, 16 nt, Pseudomonas aeruginosa PA01
cgauggcucgcggcgc

SEQ ID NO: 3427257 - RNA, 16 nt, Pseudomonas aeruginosa PA01
cgauggcugucggcgc

SEQ ID NO: 3427258 - RNA, 17 nt, Pseudomonas aeruginosa PA01
cgauggcugucggcgcc

SEQ ID NO: 3427259 - RNA, 19 nt, Pseudomonas aeruginosa PA01
cgaugggcgagcgacggug

SEQ ID NO: 3427260 - RNA, 16 nt, Pseudomonas aeruginosa PA01
cgaugggugccgcgca

SEQ ID NO: 3427261 - RNA, 20 nt, Pseudomonas aeruginosa PA01
cgaugggugccgcgcagguu

SEQ ID NO: 3427262 - RNA, 21 nt, Pseudomonas aeruginosa PA01
cgaugguaguccgcugcgagc

SEQ ID NO: 3427263 - RNA, 22 nt, Pseudomonas aeruginosa PA01
cgaugguauggcggucggccag

SEQ ID NO: 3427264 - RNA, 17 nt, Pseudomonas aeruginosa PA01
cgauggucacuggcgag

SEQ ID NO: 3427265 - RNA, 16 nt, Pseudomonas aeruginosa PA01
cgauggucaggaucac

SEQ ID NO: 3427266 - RNA, 18 nt, Pseudomonas aeruginosa PA01
cgauggucaggcuggccc

SEQ ID NO: 3427267 - RNA, 18 nt, Pseudomonas aeruginosa PA01
cgaugguccccggccccg

SEQ ID NO: 3427268 - RNA, 21 nt, Pseudomonas aeruginosa PA01
cgaugguccccggccccgcgg

SEQ ID NO: 3427269 - RNA, 15 nt, Pseudomonas aeruginosa PA01
cgauggucgccgcga

SEQ ID NO: 3427270 - RNA, 17 nt, Pseudomonas aeruginosa PA01
cgauggugacguugcgc

SEQ ID NO: 3427271 - RNA, 21 nt, Pseudomonas aeruginosa PA01
cgauggugacguugcgccgca

SEQ ID NO: 3427272 - RNA, 15 nt, Pseudomonas aeruginosa PA01
cgauggugaucacgu

SEQ ID NO: 3427273 - RNA, 20 nt, Pseudomonas aeruginosa PA01
cgauggugaucacgucggcg

SEQ ID NO: 3427274 - RNA, 18 nt, Pseudomonas aeruginosa PA01
cgauguacggcaccacca

SEQ ID NO: 3427275 - RNA, 19 nt, Pseudomonas aeruginosa PA01
cgauguaggucaccgcgcc

SEQ ID NO: 3427276 - RNA, 17 nt, Pseudomonas aeruginosa PA01
cgauguccccggccagc

SEQ ID NO: 3427277 - RNA, 18 nt, Pseudomonas aeruginosa PA01
cgauguccccggccagca

SEQ ID NO: 3427278 - RNA, 22 nt, Pseudomonas aeruginosa PA01
cgauguccccggccagcagcgc

SEQ ID NO: 3427279 - RNA, 23 nt, Pseudomonas aeruginosa PA01
cgauguccccggccagcagcgcc

SEQ ID NO: 3427280 - RNA, 15 nt, Pseudomonas aeruginosa PA01
cgauguccgggaugc

SEQ ID NO: 3427281 - RNA, 20 nt, Pseudomonas aeruginosa PA01
cgauguccuggaucggcagc

SEQ ID NO: 3427282 - RNA, 23 nt, Pseudomonas aeruginosa PA01
cgauguccugggccaccuggcuc

SEQ ID NO: 3427283 - RNA, 19 nt, Pseudomonas aeruginosa PA01
cgaugucgaaaguguugga

SEQ ID NO: 3427284 - RNA, 21 nt, Pseudomonas aeruginosa PA01
cgaugucgaacaacccgccag

SEQ ID NO: 3427285 - RNA, 22 nt, Pseudomonas aeruginosa PA01
cgaugucgaacaacccgccagc

SEQ ID NO: 3427286 - RNA, 15 nt, Pseudomonas aeruginosa PA01
cgaugucgcggcgcu

SEQ ID NO: 3427287 - RNA, 17 nt, Pseudomonas aeruginosa PA01
cgaugucgcgggcaugc

SEQ ID NO: 3427288 - RNA, 16 nt, Pseudomonas aeruginosa PA01
cgaugucguagccgcg

SEQ ID NO: 3427289 - RNA, 20 nt, Pseudomonas aeruginosa PA01
cgaugucguagccgcgcgcc

SEQ ID NO: 3427290 - RNA, 19 nt, Pseudomonas aeruginosa PA01
cgaugucguggucgccguc

SEQ ID NO: 3427291 - RNA, 13 nt, Pseudomonas aeruginosa PA01
cgaugugcacgcu

SEQ ID NO: 3427292 - RNA, 19 nt, Pseudomonas aeruginosa PA01
cgauguucaccgcggccuu

SEQ ID NO: 3427293 - RNA, 19 nt, Pseudomonas aeruginosa PA01
cgauguucgaggcgccgac

SEQ ID NO: 3427294 - RNA, 20 nt, Pseudomonas aeruginosa PA01
cgauguucgaggcgccgacc

SEQ ID NO: 3427295 - RNA, 13 nt, Pseudomonas aeruginosa PA01
cgauguucuccac

SEQ ID NO: 3427296 - RNA, 14 nt, Pseudomonas aeruginosa PA01
cgauguugaacagc

SEQ ID NO: 3427297 - RNA, 20 nt, Pseudomonas aeruginosa PA01
cgauguugaacagcgccgga

SEQ ID NO: 3427298 - RNA, 21 nt, Pseudomonas aeruginosa PA01
cgauguugaacagcgccggaa

SEQ ID NO: 3427299 - RNA, 21 nt, Pseudomonas aeruginosa PA01
cgauguuguugcccaccagcg

SEQ ID NO: 3427300 - RNA, 23 nt, Pseudomonas aeruginosa PA01
cgauuccugucuccgcaccuacc

SEQ ID NO: 3427301 - RNA, 14 nt, Pseudomonas aeruginosa PA01
cgauucgacgcagc

SEQ ID NO: 3427302 - RNA, 22 nt, Pseudomonas aeruginosa PA01
cgauucgacgcagcgcgcgccg

SEQ ID NO: 3427303 - RNA, 16 nt, Pseudomonas aeruginosa PA01
cgauucguucgagcag

SEQ ID NO: 3427304 - RNA, 18 nt, Pseudomonas aeruginosa PA01
cgauucguucgagcagcu

SEQ ID NO: 3427305 - RNA, 22 nt, Pseudomonas aeruginosa PA01
cgauugaccucccgcgccagcu

SEQ ID NO: 3427306 - RNA, 17 nt, Pseudomonas aeruginosa PA01
cgauugcagcuccuggu

SEQ ID NO: 3427307 - RNA, 17 nt, Pseudomonas aeruginosa PA01
cgauugcgcccucccgc

SEQ ID NO: 3427308 - RNA, 17 nt, Pseudomonas aeruginosa PA01
cgauugcuacagcaauu

SEQ ID NO: 3427309 - RNA, 15 nt, Pseudomonas aeruginosa PA01
cgauugcugggugcg

SEQ ID NO: 3427310 - RNA, 19 nt, Pseudomonas aeruginosa PA01
cgauuggagaugcucaggc

SEQ ID NO: 3427311 - RNA, 22 nt, Pseudomonas aeruginosa PA01
cgauuggagaugcucaggcgcu

SEQ ID NO: 3427312 - RNA, 13 nt, Pseudomonas aeruginosa PA01
cgauuguccaccg

SEQ ID NO: 3427313 - RNA, 22 nt, Pseudomonas aeruginosa PA01
cgauugugcagggccgcggcgg

SEQ ID NO: 3427314 - RNA, 20 nt, Pseudomonas aeruginosa PA01
cgauuuccaccggcacgcca

SEQ ID NO: 3427315 - RNA, 16 nt, Pseudomonas aeruginosa PA01
cgauuucccccggucc

SEQ ID NO: 3427316 - RNA, 14 nt, Pseudomonas aeruginosa PA01
cgauuucgcugcgc

SEQ ID NO: 3427317 - RNA, 16 nt, Pseudomonas aeruginosa PA01
cgauuuugggcucaga

SEQ ID NO: 3427318 - RNA, 21 nt, Pseudomonas aeruginosa PA01
cgcaaacccauuucccgcagu

SEQ ID NO: 3427319 - RNA, 17 nt, Pseudomonas aeruginosa PA01
cgcaaacccccugcgcg

SEQ ID NO: 3427320 - RNA, 18 nt, Pseudomonas aeruginosa PA01
cgcaaaccggcagcaucu

SEQ ID NO: 3427321 - RNA, 19 nt, Pseudomonas aeruginosa PA01
cgcaaacgccauccgccuu

SEQ ID NO: 3427322 - RNA, 20 nt, Pseudomonas aeruginosa PA01
cgcaaagcgagcgcccgccg

SEQ ID NO: 3427323 - RNA, 15 nt, Pseudomonas aeruginosa PA01
cgcaaaggucggcga

SEQ ID NO: 3427324 - RNA, 16 nt, Pseudomonas aeruginosa PA01
cgcaacaccuugcgca

SEQ ID NO: 3427325 - RNA, 19 nt, Pseudomonas aeruginosa PA01
cgcaacaccuugcgcaccg

SEQ ID NO: 3427326 - RNA, 13 nt, Pseudomonas aeruginosa PA01
cgcaacaggcgca

SEQ ID NO: 3427327 - RNA, 16 nt, Pseudomonas aeruginosa PA01
cgcaacaggcgcaugc

SEQ ID NO: 3427328 - RNA, 20 nt, Pseudomonas aeruginosa PA01
cgcaacaggcgcaugccauc

SEQ ID NO: 3427329 - RNA, 18 nt, Pseudomonas aeruginosa PA01
cgcaaccagaccagcagg

SEQ ID NO: 3427330 - RNA, 14 nt, Pseudomonas aeruginosa PA01
cgcaaccagcgcuc

SEQ ID NO: 3427331 - RNA, 21 nt, Pseudomonas aeruginosa PA01
cgcaaccagcgcucguagccg

SEQ ID NO: 3427332 - RNA, 23 nt, Pseudomonas aeruginosa PA01
cgcaaccagcgcucguagccggc

SEQ ID NO: 3427333 - RNA, 14 nt, Pseudomonas aeruginosa PA01
cgcaaccccuucgg

SEQ ID NO: 3427334 - RNA, 18 nt, Pseudomonas aeruginosa PA01
cgcaaccccuucggucgc

SEQ ID NO: 3427335 - RNA, 22 nt, Pseudomonas aeruginosa PA01
cgcaaccccuucggucgcgccc

SEQ ID NO: 3427336 - RNA, 16 nt, Pseudomonas aeruginosa PA01
cgcaacccgcccggcu

SEQ ID NO: 3427337 - RNA, 14 nt, Pseudomonas aeruginosa PA01
cgcaacccugccca

SEQ ID NO: 3427338 - RNA, 16 nt, Pseudomonas aeruginosa PA01
cgcaaccgguccucgc

SEQ ID NO: 3427339 - RNA, 20 nt, Pseudomonas aeruginosa PA01
cgcaaccguuccagcgccuc

SEQ ID NO: 3427340 - RNA, 21 nt, Pseudomonas aeruginosa PA01
cgcaacgaaaaagggcggcca

SEQ ID NO: 3427341 - RNA, 15 nt, Pseudomonas aeruginosa PA01
cgcaacgccgacggc

SEQ ID NO: 3427342 - RNA, 12 nt, Pseudomonas aeruginosa PA01
cgcaacgccggc

SEQ ID NO: 3427343 - RNA, 15 nt, Pseudomonas aeruginosa PA01
cgcaacgccggcagg

SEQ ID NO: 3427344 - RNA, 14 nt, Pseudomonas aeruginosa PA01
cgcaacgcgcgcag

SEQ ID NO: 3427345 - RNA, 22 nt, Pseudomonas aeruginosa PA01
cgcaacgcgguuauccgccgcu

SEQ ID NO: 3427346 - RNA, 17 nt, Pseudomonas aeruginosa PA01
cgcaacgcuuccagcac

SEQ ID NO: 3427347 - RNA, 13 nt, Pseudomonas aeruginosa PA01
cgcaacggcagcg

SEQ ID NO: 3427348 - RNA, 15 nt, Pseudomonas aeruginosa PA01
cgcaacgggcggcgg

SEQ ID NO: 3427349 - RNA, 12 nt, Pseudomonas aeruginosa PA01
cgcaacugccgg

SEQ ID NO: 3427350 - RNA, 15 nt, Pseudomonas aeruginosa PA01
cgcaacugccggucg

SEQ ID NO: 3427351 - RNA, 15 nt, Pseudomonas aeruginosa PA01
cgcaacugcgccagc

SEQ ID NO: 3427352 - RNA, 23 nt, Pseudomonas aeruginosa PA01
cgcaacugcgccagccgacuggc

SEQ ID NO: 3427353 - RNA, 13 nt, Pseudomonas aeruginosa PA01
cgcaagccagcca

SEQ ID NO: 3427354 - RNA, 20 nt, Pseudomonas aeruginosa PA01
cgcaagccagccaugugcuc

SEQ ID NO: 3427355 - RNA, 21 nt, Pseudomonas aeruginosa PA01
cgcaagccauuccaacuggcg

SEQ ID NO: 3427356 - RNA, 16 nt, Pseudomonas aeruginosa PA01
cgcaagcgcccggcga

SEQ ID NO: 3427357 - RNA, 19 nt, Pseudomonas aeruginosa PA01
cgcaagcgcccggcgaaca

SEQ ID NO: 3427358 - RNA, 16 nt, Pseudomonas aeruginosa PA01
cgcaagcgcucggccu

SEQ ID NO: 3427359 - RNA, 19 nt, Pseudomonas aeruginosa PA01
cgcaagcgcucggccugcg

SEQ ID NO: 3427360 - RNA, 17 nt, Pseudomonas aeruginosa PA01
cgcaagcggauaucccc

SEQ ID NO: 3427361 - RNA, 14 nt, Pseudomonas aeruginosa PA01
cgcaagcggcggcu

SEQ ID NO: 3427362 - RNA, 16 nt, Pseudomonas aeruginosa PA01
cgcaagcuccccgccg

SEQ ID NO: 3427363 - RNA, 17 nt, Pseudomonas aeruginosa PA01
cgcaagcuccccgccgc

SEQ ID NO: 3427364 - RNA, 19 nt, Pseudomonas aeruginosa PA01
cgcaagcuccccgccgcca

SEQ ID NO: 3427365 - RNA, 17 nt, Pseudomonas aeruginosa PA01
cgcaaggcagcguccga

SEQ ID NO: 3427366 - RNA, 16 nt, Pseudomonas aeruginosa PA01
cgcaaggccagcggca

SEQ ID NO: 3427367 - RNA, 12 nt, Pseudomonas aeruginosa PA01
cgcaaggccagg

SEQ ID NO: 3427368 - RNA, 16 nt, Pseudomonas aeruginosa PA01
cgcaaggccagggcgg

SEQ ID NO: 3427369 - RNA, 21 nt, Pseudomonas aeruginosa PA01
cgcaaggccagggcggcgccg

SEQ ID NO: 3427370 - RNA, 22 nt, Pseudomonas aeruginosa PA01
cgcaaggccagggcggcgccga

SEQ ID NO: 3427371 - RNA, 14 nt, Pseudomonas aeruginosa PA01
cgcaagggcgccgc

SEQ ID NO: 3427372 - RNA, 15 nt, Pseudomonas aeruginosa PA01
cgcaagggcgccgcc

SEQ ID NO: 3427373 - RNA, 16 nt, Pseudomonas aeruginosa PA01
cgcaaguaccgccggc

SEQ ID NO: 3427374 - RNA, 19 nt, Pseudomonas aeruginosa PA01
cgcaaguaccgccggcagu

SEQ ID NO: 3427375 - RNA, 12 nt, Pseudomonas aeruginosa PA01
cgcaagucggcc

SEQ ID NO: 3427376 - RNA, 19 nt, Pseudomonas aeruginosa PA01
cgcaagucggccugcacca

SEQ ID NO: 3427377 - RNA, 16 nt, Pseudomonas aeruginosa PA01
cgcaaguggcggcuga

SEQ ID NO: 3427378 - RNA, 15 nt, Pseudomonas aeruginosa PA01
cgcaauacaccgcug

SEQ ID NO: 3427379 - RNA, 20 nt, Pseudomonas aeruginosa PA01
cgcaauacaccgcugcgccg

SEQ ID NO: 3427380 - RNA, 16 nt, Pseudomonas aeruginosa PA01
cgcaauagugcagcuc

SEQ ID NO: 3427381 - RNA, 21 nt, Pseudomonas aeruginosa PA01
cgcaauagugcagcuccaccg

SEQ ID NO: 3427382 - RNA, 19 nt, Pseudomonas aeruginosa PA01
cgcaaucagggcugggcgc

SEQ ID NO: 3427383 - RNA, 15 nt, Pseudomonas aeruginosa PA01
cgcaauccgccgcuc

SEQ ID NO: 3427384 - RNA, 13 nt, Pseudomonas aeruginosa PA01
cgcaauccucggu

SEQ ID NO: 3427385 - RNA, 15 nt, Pseudomonas aeruginosa PA01
cgcaauccucggugc

SEQ ID NO: 3427386 - RNA, 20 nt, Pseudomonas aeruginosa PA01
cgcaaugaaagagccccucu

SEQ ID NO: 3427387 - RNA, 13 nt, Pseudomonas aeruginosa PA01
cgcaaugccgcgu

SEQ ID NO: 3427388 - RNA, 23 nt, Pseudomonas aeruginosa PA01
cgcaaugccgcgucgaagucgau

SEQ ID NO: 3427389 - RNA, 16 nt, Pseudomonas aeruginosa PA01
cgcaauggcgcagccg

SEQ ID NO: 3427390 - RNA, 15 nt, Pseudomonas aeruginosa PA01
cgcaauugcaccgcu

SEQ ID NO: 3427391 - RNA, 17 nt, Pseudomonas aeruginosa PA01
cgcacaaaaaagcccgc

SEQ ID NO: 3427392 - RNA, 20 nt, Pseudomonas aeruginosa PA01
cgcacaacgccuuccuuguc

SEQ ID NO: 3427393 - RNA, 21 nt, Pseudomonas aeruginosa PA01
cgcacaacgccuuccuugucg

SEQ ID NO: 3427394 - RNA, 12 nt, Pseudomonas aeruginosa PA01
cgcacaccgcgc

SEQ ID NO: 3427395 - RNA, 18 nt, Pseudomonas aeruginosa PA01
cgcacaccgcgcgcgccu

SEQ ID NO: 3427396 - RNA, 21 nt, Pseudomonas aeruginosa PA01
cgcacaccgucgaaccagccg

SEQ ID NO: 3427397 - RNA, 12 nt, Pseudomonas aeruginosa PA01
cgcacacggucg

SEQ ID NO: 3427398 - RNA, 12 nt, Pseudomonas aeruginosa PA01
cgcacagccagg

SEQ ID NO: 3427399 - RNA, 16 nt, Pseudomonas aeruginosa PA01
cgcacagccaggggca

SEQ ID NO: 3427400 - RNA, 19 nt, Pseudomonas aeruginosa PA01
cgcacagguagaggucgaa

SEQ ID NO: 3427401 - RNA, 18 nt, Pseudomonas aeruginosa PA01
cgcacaguacgccuugca

SEQ ID NO: 3427402 - RNA, 19 nt, Pseudomonas aeruginosa PA01
cgcacaguugcgcgccggc

SEQ ID NO: 3427403 - RNA, 14 nt, Pseudomonas aeruginosa PA01
cgcacaucacccgg

SEQ ID NO: 3427404 - RNA, 15 nt, Pseudomonas aeruginosa PA01
cgcacaucacccggu

SEQ ID NO: 3427405 - RNA, 19 nt, Pseudomonas aeruginosa PA01
cgcaccacccaucugccgg

SEQ ID NO: 3427406 - RNA, 20 nt, Pseudomonas aeruginosa PA01
cgcaccacccaucugccggc

SEQ ID NO: 3427407 - RNA, 12 nt, Pseudomonas aeruginosa PA01
cgcaccacccgc

SEQ ID NO: 3427408 - RNA, 14 nt, Pseudomonas aeruginosa PA01
cgcaccaccuggca

SEQ ID NO: 3427409 - RNA, 21 nt, Pseudomonas aeruginosa PA01
cgcaccaccuggcagguaucg

SEQ ID NO: 3427410 - RNA, 21 nt, Pseudomonas aeruginosa PA01
cgcaccacugcaacacuuccu

SEQ ID NO: 3427411 - RNA, 15 nt, Pseudomonas aeruginosa PA01
cgcaccagcacuucc

SEQ ID NO: 3427412 - RNA, 16 nt, Pseudomonas aeruginosa PA01
cgcaccagcaggccga

SEQ ID NO: 3427413 - RNA, 14 nt, Pseudomonas aeruginosa PA01
cgcaccagccggcc

SEQ ID NO: 3427414 - RNA, 15 nt, Pseudomonas aeruginosa PA01
cgcaccagccggccg

SEQ ID NO: 3427415 - RNA, 16 nt, Pseudomonas aeruginosa PA01
cgcaccagccggccgc

SEQ ID NO: 3427416 - RNA, 18 nt, Pseudomonas aeruginosa PA01
cgcaccagccggccgcgu

SEQ ID NO: 3427417 - RNA, 21 nt, Pseudomonas aeruginosa PA01
cgcaccagccuuccggcacca

SEQ ID NO: 3427418 - RNA, 17 nt, Pseudomonas aeruginosa PA01
cgcaccaggccaggcug

SEQ ID NO: 3427419 - RNA, 15 nt, Pseudomonas aeruginosa PA01
cgcaccaggccaggu

SEQ ID NO: 3427420 - RNA, 14 nt, Pseudomonas aeruginosa PA01
cgcaccaggccucc

SEQ ID NO: 3427421 - RNA, 23 nt, Pseudomonas aeruginosa PA01
cgcaccaggccucccagccgugg

SEQ ID NO: 3427422 - RNA, 21 nt, Pseudomonas aeruginosa PA01
cgcaccagggccaggagcauc

SEQ ID NO: 3427423 - RNA, 17 nt, Pseudomonas aeruginosa PA01
cgcaccagggucgggcc

SEQ ID NO: 3427424 - RNA, 19 nt, Pseudomonas aeruginosa PA01
cgcaccagggucgggccgc

SEQ ID NO: 3427425 - RNA, 22 nt, Pseudomonas aeruginosa PA01
cgcaccagggucgggccgcgcu

SEQ ID NO: 3427426 - RNA, 15 nt, Pseudomonas aeruginosa PA01
cgcaccaggucgcgc

SEQ ID NO: 3427427 - RNA, 18 nt, Pseudomonas aeruginosa PA01
cgcaccauagcgagccgc

SEQ ID NO: 3427428 - RNA, 23 nt, Pseudomonas aeruginosa PA01
cgcaccauagcgagccgcgcugc

SEQ ID NO: 3427429 - RNA, 15 nt, Pseudomonas aeruginosa PA01
cgcaccauccgccgc

SEQ ID NO: 3427430 - RNA, 18 nt, Pseudomonas aeruginosa PA01
cgcaccccauccucgccg

SEQ ID NO: 3427431 - RNA, 19 nt, Pseudomonas aeruginosa PA01
cgcaccccauccucgccgg

SEQ ID NO: 3427432 - RNA, 22 nt, Pseudomonas aeruginosa PA01
cgcacccgcgacucgagcacca

SEQ ID NO: 3427433 - RNA, 16 nt, Pseudomonas aeruginosa PA01
cgcacccgcucggccu

SEQ ID NO: 3427434 - RNA, 13 nt, Pseudomonas aeruginosa PA01
cgcaccgacgccg

SEQ ID NO: 3427435 - RNA, 14 nt, Pseudomonas aeruginosa PA01
cgcaccgacgccgc

SEQ ID NO: 3427436 - RNA, 18 nt, Pseudomonas aeruginosa PA01
cgcaccgacgccgccugc

SEQ ID NO: 3427437 - RNA, 16 nt, Pseudomonas aeruginosa PA01
cgcaccgagguagucc

SEQ ID NO: 3427438 - RNA, 13 nt, Pseudomonas aeruginosa PA01
cgcaccgccaagg

SEQ ID NO: 3427439 - RNA, 15 nt, Pseudomonas aeruginosa PA01
cgcaccgccagcagu

SEQ ID NO: 3427440 - RNA, 13 nt, Pseudomonas aeruginosa PA01
cgcaccgcccugc

SEQ ID NO: 3427441 - RNA, 23 nt, Pseudomonas aeruginosa PA01
cgcaccgccucgugcagcaagcc

SEQ ID NO: 3427442 - RNA, 18 nt, Pseudomonas aeruginosa PA01
cgcaccgccugcagcacc

SEQ ID NO: 3427443 - RNA, 22 nt, Pseudomonas aeruginosa PA01
cgcaccgccugcagcaccaccu

SEQ ID NO: 3427444 - RNA, 12 nt, Pseudomonas aeruginosa PA01
cgcaccgcgccg

SEQ ID NO: 3427445 - RNA, 13 nt, Pseudomonas aeruginosa PA01
cgcaccgcgccgg

SEQ ID NO: 3427446 - RNA, 14 nt, Pseudomonas aeruginosa PA01
cgcaccgcgccggg

SEQ ID NO: 3427447 - RNA, 13 nt, Pseudomonas aeruginosa PA01
cgcaccgcggcca

SEQ ID NO: 3427448 - RNA, 14 nt, Pseudomonas aeruginosa PA01
cgcaccgcggccag

SEQ ID NO: 3427449 - RNA, 22 nt, Pseudomonas aeruginosa PA01
cgcaccggcauguagcgcgccg

SEQ ID NO: 3427450 - RNA, 23 nt, Pseudomonas aeruginosa PA01
cgcaccggcauguagcgcgccga

SEQ ID NO: 3427451 - RNA, 20 nt, Pseudomonas aeruginosa PA01
cgcaccggcgauggccggca

SEQ ID NO: 3427452 - RNA, 13 nt, Pseudomonas aeruginosa PA01
cgcaccggcgcgc

SEQ ID NO: 3427453 - RNA, 14 nt, Pseudomonas aeruginosa PA01
cgcaccggcgcgcc

SEQ ID NO: 3427454 - RNA, 18 nt, Pseudomonas aeruginosa PA01
cgcaccggcgcgccggac

SEQ ID NO: 3427455 - RNA, 13 nt, Pseudomonas aeruginosa PA01
cgcaccggcuucu

SEQ ID NO: 3427456 - RNA, 21 nt, Pseudomonas aeruginosa PA01
cgcaccggcuucuggaaggcg

SEQ ID NO: 3427457 - RNA, 19 nt, Pseudomonas aeruginosa PA01
cgcaccgggaggcgccgcg

SEQ ID NO: 3427458 - RNA, 20 nt, Pseudomonas aeruginosa PA01
cgcaccgggaggcgccgcgc

SEQ ID NO: 3427459 - RNA, 21 nt, Pseudomonas aeruginosa PA01
cgcaccguagcggcugcggua

SEQ ID NO: 3427460 - RNA, 23 nt, Pseudomonas aeruginosa PA01
cgcaccuacccgagcaacugcuc

SEQ ID NO: 3427461 - RNA, 15 nt, Pseudomonas aeruginosa PA01
cgcaccuacuaccgc

SEQ ID NO: 3427462 - RNA, 14 nt, Pseudomonas aeruginosa PA01
cgcaccucgaccgc

SEQ ID NO: 3427463 - RNA, 16 nt, Pseudomonas aeruginosa PA01
cgcaccucgaccgcgc

SEQ ID NO: 3427464 - RNA, 18 nt, Pseudomonas aeruginosa PA01
cgcaccucgaccgcgccg

SEQ ID NO: 3427465 - RNA, 21 nt, Pseudomonas aeruginosa PA01
cgcaccucgaccgcgccggcg

SEQ ID NO: 3427466 - RNA, 22 nt, Pseudomonas aeruginosa PA01
cgcaccucgaccgcgccggcga

SEQ ID NO: 3427467 - RNA, 13 nt, Pseudomonas aeruginosa PA01
cgcaccucgucga

SEQ ID NO: 3427468 - RNA, 15 nt, Pseudomonas aeruginosa PA01
cgcaccucgucgagc

SEQ ID NO: 3427469 - RNA, 18 nt, Pseudomonas aeruginosa PA01
cgcaccuggcgguaggcg

SEQ ID NO: 3427470 - RNA, 22 nt, Pseudomonas aeruginosa PA01
cgcaccuggcggucgccgccgg

SEQ ID NO: 3427471 - RNA, 17 nt, Pseudomonas aeruginosa PA01
cgcaccugggcguuggc

SEQ ID NO: 3427472 - RNA, 22 nt, Pseudomonas aeruginosa PA01
cgcaccugggcguuggccagcg

SEQ ID NO: 3427473 - RNA, 20 nt, Pseudomonas aeruginosa PA01
cgcaccugguggacacccug

SEQ ID NO: 3427474 - RNA, 22 nt, Pseudomonas aeruginosa PA01
cgcaccugguggacacccugcu

SEQ ID NO: 3427475 - RNA, 13 nt, Pseudomonas aeruginosa PA01
cgcaccuguucca

SEQ ID NO: 3427476 - RNA, 21 nt, Pseudomonas aeruginosa PA01
cgcaccuguuccagcaacgcc

SEQ ID NO: 3427477 - RNA, 13 nt, Pseudomonas aeruginosa PA01
cgcaccuguuuca

SEQ ID NO: 3427478 - RNA, 17 nt, Pseudomonas aeruginosa PA01
cgcaccuugcccugcau

SEQ ID NO: 3427479 - RNA, 21 nt, Pseudomonas aeruginosa PA01
cgcacgaggauuuccgcgccc

SEQ ID NO: 3427480 - RNA, 19 nt, Pseudomonas aeruginosa PA01
cgcacgaggcgggcuggaa

SEQ ID NO: 3427481 - RNA, 15 nt, Pseudomonas aeruginosa PA01
cgcacgcaauggcgc

SEQ ID NO: 3427482 - RNA, 16 nt, Pseudomonas aeruginosa PA01
cgcacgcaauggcgca

SEQ ID NO: 3427483 - RNA, 17 nt, Pseudomonas aeruginosa PA01
cgcacgcaauggcgcag

SEQ ID NO: 3427484 - RNA, 20 nt, Pseudomonas aeruginosa PA01
cgcacgcaauggcgcagccg

SEQ ID NO: 3427485 - RNA, 21 nt, Pseudomonas aeruginosa PA01
cgcacgcaauggcgcagccgc

SEQ ID NO: 3427486 - RNA, 13 nt, Pseudomonas aeruginosa PA01
cgcacgcagcgcc

SEQ ID NO: 3427487 - RNA, 15 nt, Pseudomonas aeruginosa PA01
cgcacgcagcgccgc

SEQ ID NO: 3427488 - RNA, 16 nt, Pseudomonas aeruginosa PA01
cgcacgcagcgccgcg

SEQ ID NO: 3427489 - RNA, 17 nt, Pseudomonas aeruginosa PA01
cgcacgcagcgccgcgu

SEQ ID NO: 3427490 - RNA, 14 nt, Pseudomonas aeruginosa PA01
cgcacgccgcggaa

SEQ ID NO: 3427491 - RNA, 20 nt, Pseudomonas aeruginosa PA01
cgcacgccgcggaaggcccg

SEQ ID NO: 3427492 - RNA, 13 nt, Pseudomonas aeruginosa PA01
cgcacgccggccu

SEQ ID NO: 3427493 - RNA, 20 nt, Pseudomonas aeruginosa PA01
cgcacgcgcaguacgaucag

SEQ ID NO: 3427494 - RNA, 15 nt, Pseudomonas aeruginosa PA01
cgcacgcgccugcuu

SEQ ID NO: 3427495 - RNA, 14 nt, Pseudomonas aeruginosa PA01
cgcacgcuggugcc

SEQ ID NO: 3427496 - RNA, 17 nt, Pseudomonas aeruginosa PA01
cgcacgcuucuccucgg

SEQ ID NO: 3427497 - RNA, 14 nt, Pseudomonas aeruginosa PA01
cgcacggaggcgcu

SEQ ID NO: 3427498 - RNA, 16 nt, Pseudomonas aeruginosa PA01
cgcacggaucgcgcug

SEQ ID NO: 3427499 - RNA, 20 nt, Pseudomonas aeruginosa PA01
cgcacggaucgcgcugggcg

SEQ ID NO: 3427500 - RNA, 12 nt, Pseudomonas aeruginosa PA01
cgcacggccguc

SEQ ID NO: 3427501 - RNA, 13 nt, Pseudomonas aeruginosa PA01
cgcacggccguca

SEQ ID NO: 3427502 - RNA, 21 nt, Pseudomonas aeruginosa PA01
cgcacggccgucacggccucc

SEQ ID NO: 3427503 - RNA, 12 nt, Pseudomonas aeruginosa PA01
cgcacggccugc

SEQ ID NO: 3427504 - RNA, 21 nt, Pseudomonas aeruginosa PA01
cgcacggccugcaccugcucg

SEQ ID NO: 3427505 - RNA, 23 nt, Pseudomonas aeruginosa PA01
cgcacggccugcaccugcucggg

SEQ ID NO: 3427506 - RNA, 23 nt, Pseudomonas aeruginosa PA01
cgcacggcgaagaacagcggguc

SEQ ID NO: 3427507 - RNA, 14 nt, Pseudomonas aeruginosa PA01
cgcacggcgacgcu

SEQ ID NO: 3427508 - RNA, 14 nt, Pseudomonas aeruginosa PA01
cgcacggucuccgg

SEQ ID NO: 3427509 - RNA, 21 nt, Pseudomonas aeruginosa PA01
cgcacggucuuggcguugccg

SEQ ID NO: 3427510 - RNA, 22 nt, Pseudomonas aeruginosa PA01
cgcacgucaccguccuucggcc

SEQ ID NO: 3427511 - RNA, 23 nt, Pseudomonas aeruginosa PA01
cgcacgucaccguccuucggccg

SEQ ID NO: 3427512 - RNA, 22 nt, Pseudomonas aeruginosa PA01
cgcacgucgcggcggauaacgc

SEQ ID NO: 3427513 - RNA, 21 nt, Pseudomonas aeruginosa PA01
cgcacguugaggucgaagacc

SEQ ID NO: 3427514 - RNA, 18 nt, Pseudomonas aeruginosa PA01
cgcacuccgggcagacca

SEQ ID NO: 3427515 - RNA, 20 nt, Pseudomonas aeruginosa PA01
cgcacuccgggcagaccagc

SEQ ID NO: 3427516 - RNA, 14 nt, Pseudomonas aeruginosa PA01
cgcacucuuccugg

SEQ ID NO: 3427517 - RNA, 15 nt, Pseudomonas aeruginosa PA01
cgcacugagggucag

SEQ ID NO: 3427518 - RNA, 16 nt, Pseudomonas aeruginosa PA01
cgcacugccaggagca

SEQ ID NO: 3427519 - RNA, 20 nt, Pseudomonas aeruginosa PA01
cgcacugcguggguagccau

SEQ ID NO: 3427520 - RNA, 12 nt, Pseudomonas aeruginosa PA01
cgcacugcugcu

SEQ ID NO: 3427521 - RNA, 20 nt, Pseudomonas aeruginosa PA01
cgcacuggucggccaguucc

SEQ ID NO: 3427522 - RNA, 22 nt, Pseudomonas aeruginosa PA01
cgcacuggucggccaguuccuu

SEQ ID NO: 3427523 - RNA, 12 nt, Pseudomonas aeruginosa PA01
cgcacugguggc

SEQ ID NO: 3427524 - RNA, 14 nt, Pseudomonas aeruginosa PA01
cgcacugguggcga

SEQ ID NO: 3427525 - RNA, 13 nt, Pseudomonas aeruginosa PA01
cgcacuuccaggc

SEQ ID NO: 3427526 - RNA, 22 nt, Pseudomonas aeruginosa PA01
cgcacuuccggacugcccagcg

SEQ ID NO: 3427527 - RNA, 15 nt, Pseudomonas aeruginosa PA01
cgcacuuccucggcg

SEQ ID NO: 3427528 - RNA, 17 nt, Pseudomonas aeruginosa PA01
cgcacuuccucggcgac

SEQ ID NO: 3427529 - RNA, 21 nt, Pseudomonas aeruginosa PA01
cgcacuuccucggcgaccacc

SEQ ID NO: 3427530 - RNA, 18 nt, Pseudomonas aeruginosa PA01
cgcacuucguccgccacc

SEQ ID NO: 3427531 - RNA, 19 nt, Pseudomonas aeruginosa PA01
cgcacuucguccgccacca

SEQ ID NO: 3427532 - RNA, 20 nt, Pseudomonas aeruginosa PA01
cgcacuucguccgccaccac

SEQ ID NO: 3427533 - RNA, 17 nt, Pseudomonas aeruginosa PA01
cgcagaaccagacgcuc

SEQ ID NO: 3427534 - RNA, 16 nt, Pseudomonas aeruginosa PA01
cgcagaacgcggaaac

SEQ ID NO: 3427535 - RNA, 23 nt, Pseudomonas aeruginosa PA01
cgcagaaggcgcuuucguagggg

SEQ ID NO: 3427536 - RNA, 17 nt, Pseudomonas aeruginosa PA01
cgcagacaggccuccag

SEQ ID NO: 3427537 - RNA, 18 nt, Pseudomonas aeruginosa PA01
cgcagacaggccuccagc

SEQ ID NO: 3427538 - RNA, 22 nt, Pseudomonas aeruginosa PA01
cgcagacaggccuccagcaacg

SEQ ID NO: 3427539 - RNA, 19 nt, Pseudomonas aeruginosa PA01
cgcagacaucgccgagggc

SEQ ID NO: 3427540 - RNA, 16 nt, Pseudomonas aeruginosa PA01
cgcagaccagcgaacc

SEQ ID NO: 3427541 - RNA, 22 nt, Pseudomonas aeruginosa PA01
cgcagacgauugaccucccgcg

SEQ ID NO: 3427542 - RNA, 14 nt, Pseudomonas aeruginosa PA01
cgcagacggggccu

SEQ ID NO: 3427543 - RNA, 15 nt, Pseudomonas aeruginosa PA01
cgcagacggggccuc

SEQ ID NO: 3427544 - RNA, 16 nt, Pseudomonas aeruginosa PA01
cgcagacgggugcuga

SEQ ID NO: 3427545 - RNA, 21 nt, Pseudomonas aeruginosa PA01
cgcagacguggcauucgucgc

SEQ ID NO: 3427546 - RNA, 21 nt, Pseudomonas aeruginosa PA01
cgcagacuccggcgcagccca

SEQ ID NO: 3427547 - RNA, 15 nt, Pseudomonas aeruginosa PA01
cgcagagaucggcgg

SEQ ID NO: 3427548 - RNA, 16 nt, Pseudomonas aeruginosa PA01
cgcagagcaucacccg

SEQ ID NO: 3427549 - RNA, 15 nt, Pseudomonas aeruginosa PA01
cgcagagccagccgc

SEQ ID NO: 3427550 - RNA, 22 nt, Pseudomonas aeruginosa PA01
cgcagagccagccgcagcccgg

SEQ ID NO: 3427551 - RNA, 14 nt, Pseudomonas aeruginosa PA01
cgcagagcgccagc

SEQ ID NO: 3427552 - RNA, 18 nt, Pseudomonas aeruginosa PA01
cgcagagcgccagccagc

SEQ ID NO: 3427553 - RNA, 19 nt, Pseudomonas aeruginosa PA01
cgcagagcgccaugacccg

SEQ ID NO: 3427554 - RNA, 17 nt, Pseudomonas aeruginosa PA01
cgcagagcggcaggccg

SEQ ID NO: 3427555 - RNA, 18 nt, Pseudomonas aeruginosa PA01
cgcagagcggcaggccgc

SEQ ID NO: 3427556 - RNA, 16 nt, Pseudomonas aeruginosa PA01
cgcagagggcgaugcc

SEQ ID NO: 3427557 - RNA, 15 nt, Pseudomonas aeruginosa PA01
cgcagauagaggcgu

SEQ ID NO: 3427558 - RNA, 20 nt, Pseudomonas aeruginosa PA01
cgcagauagggcaucagccc

SEQ ID NO: 3427559 - RNA, 13 nt, Pseudomonas aeruginosa PA01
cgcagaucaucgc

SEQ ID NO: 3427560 - RNA, 16 nt, Pseudomonas aeruginosa PA01
cgcagaucgccgcgua

SEQ ID NO: 3427561 - RNA, 18 nt, Pseudomonas aeruginosa PA01
cgcagaucgcggcgcagg

SEQ ID NO: 3427562 - RNA, 14 nt, Pseudomonas aeruginosa PA01
cgcagaugaucgcc

SEQ ID NO: 3427563 - RNA, 16 nt, Pseudomonas aeruginosa PA01
cgcagaugaucgccac

SEQ ID NO: 3427564 - RNA, 17 nt, Pseudomonas aeruginosa PA01
cgcagaugaucgccacc

SEQ ID NO: 3427565 - RNA, 19 nt, Pseudomonas aeruginosa PA01
cgcagaugaucgccaccgg

SEQ ID NO: 3427566 - RNA, 20 nt, Pseudomonas aeruginosa PA01
cgcagaugcuccagggagcg

SEQ ID NO: 3427567 - RNA, 17 nt, Pseudomonas aeruginosa PA01
cgcagcaacgcgacgau

SEQ ID NO: 3427568 - RNA, 20 nt, Pseudomonas aeruginosa PA01
cgcagcaacggcgcaucguc

SEQ ID NO: 3427569 - RNA, 19 nt, Pseudomonas aeruginosa PA01
cgcagcaacuggucgccgc

SEQ ID NO: 3427570 - RNA, 23 nt, Pseudomonas aeruginosa PA01
cgcagcaacuggucgccgcaggu

SEQ ID NO: 3427571 - RNA, 19 nt, Pseudomonas aeruginosa PA01
cgcagcaacuguccgacca

SEQ ID NO: 3427572 - RNA, 13 nt, Pseudomonas aeruginosa PA01
cgcagcacagccc

SEQ ID NO: 3427573 - RNA, 14 nt, Pseudomonas aeruginosa PA01
cgcagcacagcccc

SEQ ID NO: 3427574 - RNA, 17 nt, Pseudomonas aeruginosa PA01
cgcagcacagccccagc

SEQ ID NO: 3427575 - RNA, 14 nt, Pseudomonas aeruginosa PA01
cgcagcaccggcuu

SEQ ID NO: 3427576 - RNA, 12 nt, Pseudomonas aeruginosa PA01
cgcagcacggcg

SEQ ID NO: 3427577 - RNA, 14 nt, Pseudomonas aeruginosa PA01
cgcagcacggcggc

SEQ ID NO: 3427578 - RNA, 22 nt, Pseudomonas aeruginosa PA01
cgcagcacggcggcuacccgcg

SEQ ID NO: 3427579 - RNA, 16 nt, Pseudomonas aeruginosa PA01
cgcagcacuuccugaa

SEQ ID NO: 3427580 - RNA, 14 nt, Pseudomonas aeruginosa PA01
cgcagcagcagguu

SEQ ID NO: 3427581 - RNA, 13 nt, Pseudomonas aeruginosa PA01
cgcagcagcgcca

SEQ ID NO: 3427582 - RNA, 18 nt, Pseudomonas aeruginosa PA01
cgcagcagcgccaguugg

SEQ ID NO: 3427583 - RNA, 18 nt, Pseudomonas aeruginosa PA01
cgcagcagcggcaaaggc

SEQ ID NO: 3427584 - RNA, 14 nt, Pseudomonas aeruginosa PA01
cgcagcagcggcga

SEQ ID NO: 3427585 - RNA, 21 nt, Pseudomonas aeruginosa PA01
cgcagcagcggcgacaccgcc

SEQ ID NO: 3427586 - RNA, 14 nt, Pseudomonas aeruginosa PA01
cgcagcagcucguc

SEQ ID NO: 3427587 - RNA, 17 nt, Pseudomonas aeruginosa PA01
cgcagcagcuucggcgc

SEQ ID NO: 3427588 - RNA, 18 nt, Pseudomonas aeruginosa PA01
cgcagcagcuucggcgcg

SEQ ID NO: 3427589 - RNA, 22 nt, Pseudomonas aeruginosa PA01
cgcagcagcuucggcgcgacgc

SEQ ID NO: 3427590 - RNA, 14 nt, Pseudomonas aeruginosa PA01
cgcagcaggccgcu

SEQ ID NO: 3427591 - RNA, 16 nt, Pseudomonas aeruginosa PA01
cgcagcaggccgcugg

SEQ ID NO: 3427592 - RNA, 18 nt, Pseudomonas aeruginosa PA01
cgcagcaggccgcuggcg

SEQ ID NO: 3427593 - RNA, 13 nt, Pseudomonas aeruginosa PA01
cgcagcaggcgac

SEQ ID NO: 3427594 - RNA, 22 nt, Pseudomonas aeruginosa PA01
cgcagcaggcgacggucaggcc

SEQ ID NO: 3427595 - RNA, 19 nt, Pseudomonas aeruginosa PA01
cgcagcaggcguucggcga

SEQ ID NO: 3427596 - RNA, 11 nt, Pseudomonas aeruginosa PA01
cgcagcagggc

SEQ ID NO: 3427597 - RNA, 13 nt, Pseudomonas aeruginosa PA01
cgcagcagggcgu

SEQ ID NO: 3427598 - RNA, 19 nt, Pseudomonas aeruginosa PA01
cgcagcagggcgucggcgu

SEQ ID NO: 3427599 - RNA, 21 nt, Pseudomonas aeruginosa PA01
cgcagcagggcgucggcgugc

SEQ ID NO: 3427600 - RNA, 19 nt, Pseudomonas aeruginosa PA01
cgcagcagguagugcggcg

SEQ ID NO: 3427601 - RNA, 20 nt, Pseudomonas aeruginosa PA01
cgcagcaggucuuccaccgc

SEQ ID NO: 3427602 - RNA, 16 nt, Pseudomonas aeruginosa PA01
cgcagcaucuucucgg

SEQ ID NO: 3427603 - RNA, 18 nt, Pseudomonas aeruginosa PA01
cgcagcaucuucucggcg

SEQ ID NO: 3427604 - RNA, 20 nt, Pseudomonas aeruginosa PA01
cgcagcaucuucucggcgau

SEQ ID NO: 3427605 - RNA, 16 nt, Pseudomonas aeruginosa PA01
cgcagcaugucgucga

SEQ ID NO: 3427606 - RNA, 12 nt, Pseudomonas aeruginosa PA01
cgcagccacccg

SEQ ID NO: 3427607 - RNA, 13 nt, Pseudomonas aeruginosa PA01
cgcagccacccgc

SEQ ID NO: 3427608 - RNA, 14 nt, Pseudomonas aeruginosa PA01
cgcagccacccgcg

SEQ ID NO: 3427609 - RNA, 14 nt, Pseudomonas aeruginosa PA01
cgcagccacuggcg

SEQ ID NO: 3427610 - RNA, 20 nt, Pseudomonas aeruginosa PA01
cgcagccagagcuccagggc

SEQ ID NO: 3427611 - RNA, 12 nt, Pseudomonas aeruginosa PA01
cgcagccaggcg

SEQ ID NO: 3427612 - RNA, 16 nt, Pseudomonas aeruginosa PA01
cgcagccaggcgagga

SEQ ID NO: 3427613 - RNA, 17 nt, Pseudomonas aeruginosa PA01
cgcagccauucgccgcg

SEQ ID NO: 3427614 - RNA, 24 nt, Pseudomonas aeruginosa PA01
cgcagccauucgccgcgacgcucc

SEQ ID NO: 3427615 - RNA, 20 nt, Pseudomonas aeruginosa PA01
cgcagccccgccggaagacg

SEQ ID NO: 3427616 - RNA, 20 nt, Pseudomonas aeruginosa PA01
cgcagcccgguccguccagc

SEQ ID NO: 3427617 - RNA, 13 nt, Pseudomonas aeruginosa PA01
cgcagcccuugca

SEQ ID NO: 3427618 - RNA, 18 nt, Pseudomonas aeruginosa PA01
cgcagcccuugcaaccgc

SEQ ID NO: 3427619 - RNA, 22 nt, Pseudomonas aeruginosa PA01
cgcagcccuugcaaccgccgcc

SEQ ID NO: 3427620 - RNA, 16 nt, Pseudomonas aeruginosa PA01
cgcagccgcaaggcca

SEQ ID NO: 3427621 - RNA, 19 nt, Pseudomonas aeruginosa PA01
cgcagccgcaaggccaggg

SEQ ID NO: 3427622 - RNA, 23 nt, Pseudomonas aeruginosa PA01
cgcagccgcaaggccagggcggc

SEQ ID NO: 3427623 - RNA, 12 nt, Pseudomonas aeruginosa PA01
cgcagccgcgca

SEQ ID NO: 3427624 - RNA, 15 nt, Pseudomonas aeruginosa PA01
cgcagccgcgcaacc

SEQ ID NO: 3427625 - RNA, 21 nt, Pseudomonas aeruginosa PA01
cgcagccgcgcaaccguucca

SEQ ID NO: 3427626 - RNA, 12 nt, Pseudomonas aeruginosa PA01
cgcagccgcgcu

SEQ ID NO: 3427627 - RNA, 15 nt, Pseudomonas aeruginosa PA01
cgcagccgcgcucgg

SEQ ID NO: 3427628 - RNA, 19 nt, Pseudomonas aeruginosa PA01
cgcagccgcgcucggccag

SEQ ID NO: 3427629 - RNA, 20 nt, Pseudomonas aeruginosa PA01
cgcagccgcgcucggccagu

SEQ ID NO: 3427630 - RNA, 15 nt, Pseudomonas aeruginosa PA01
cgcagccgcgugcgc

SEQ ID NO: 3427631 - RNA, 22 nt, Pseudomonas aeruginosa PA01
cgcagccgcgugcgcgccgccg

SEQ ID NO: 3427632 - RNA, 13 nt, Pseudomonas aeruginosa PA01
cgcagccgcucgg

SEQ ID NO: 3427633 - RNA, 15 nt, Pseudomonas aeruginosa PA01
cgcagccgcucggcc

SEQ ID NO: 3427634 - RNA, 11 nt, Pseudomonas aeruginosa PA01
cgcagccgcug

SEQ ID NO: 3427635 - RNA, 12 nt, Pseudomonas aeruginosa PA01
cgcagccgcugc

SEQ ID NO: 3427636 - RNA, 13 nt, Pseudomonas aeruginosa PA01
cgcagccgcugcu

SEQ ID NO: 3427637 - RNA, 18 nt, Pseudomonas aeruginosa PA01
cgcagccggcgaacaggu

SEQ ID NO: 3427638 - RNA, 12 nt, Pseudomonas aeruginosa PA01
cgcagccggcgg

SEQ ID NO: 3427639 - RNA, 13 nt, Pseudomonas aeruginosa PA01
cgcagccggcggc

SEQ ID NO: 3427640 - RNA, 14 nt, Pseudomonas aeruginosa PA01
cgcagccggcggcg

SEQ ID NO: 3427641 - RNA, 14 nt, Pseudomonas aeruginosa PA01
cgcagccgggccgc

SEQ ID NO: 3427642 - RNA, 18 nt, Pseudomonas aeruginosa PA01
cgcagccgggccgcagcg

SEQ ID NO: 3427643 - RNA, 12 nt, Pseudomonas aeruginosa PA01
cgcagccggugg

SEQ ID NO: 3427644 - RNA, 22 nt, Pseudomonas aeruginosa PA01
cgcagccgguggucuucagcac

SEQ ID NO: 3427645 - RNA, 14 nt, Pseudomonas aeruginosa PA01
cgcagccguccauc

SEQ ID NO: 3427646 - RNA, 14 nt, Pseudomonas aeruginosa PA01
cgcagccguggcgc

SEQ ID NO: 3427647 - RNA, 16 nt, Pseudomonas aeruginosa PA01
cgcagccguggcgcga

SEQ ID NO: 3427648 - RNA, 18 nt, Pseudomonas aeruginosa PA01
cgcagccguuggccagca

SEQ ID NO: 3427649 - RNA, 20 nt, Pseudomonas aeruginosa PA01
cgcagccguuggccagcagg

SEQ ID NO: 3427650 - RNA, 21 nt, Pseudomonas aeruginosa PA01
cgcagccguuggccagcaggc

SEQ ID NO: 3427651 - RNA, 20 nt, Pseudomonas aeruginosa PA01
cgcagccucgcgcucggcgg

SEQ ID NO: 3427652 - RNA, 21 nt, Pseudomonas aeruginosa PA01
cgcagccucgcgcucggcggc

SEQ ID NO: 3427653 - RNA, 23 nt, Pseudomonas aeruginosa PA01
cgcagccucgcgcucggcggccu

SEQ ID NO: 3427654 - RNA, 13 nt, Pseudomonas aeruginosa PA01
cgcagccugcugg

SEQ ID NO: 3427655 - RNA, 13 nt, Pseudomonas aeruginosa PA01
cgcagccuuggca

SEQ ID NO: 3427656 - RNA, 13 nt, Pseudomonas aeruginosa PA01
cgcagcgaacggg

SEQ ID NO: 3427657 - RNA, 15 nt, Pseudomonas aeruginosa PA01
cgcagcgaagaucuu

SEQ ID NO: 3427658 - RNA, 13 nt, Pseudomonas aeruginosa PA01
cgcagcgaucagc

SEQ ID NO: 3427659 - RNA, 14 nt, Pseudomonas aeruginosa PA01
cgcagcgaucagca

SEQ ID NO: 3427660 - RNA, 20 nt, Pseudomonas aeruginosa PA01
cgcagcgaucagcaccagcg

SEQ ID NO: 3427661 - RNA, 19 nt, Pseudomonas aeruginosa PA01
cgcagcgcaagucggccug

SEQ ID NO: 3427662 - RNA, 14 nt, Pseudomonas aeruginosa PA01
cgcagcgccaccag

SEQ ID NO: 3427663 - RNA, 15 nt, Pseudomonas aeruginosa PA01
cgcagcgccaccagg

SEQ ID NO: 3427664 - RNA, 13 nt, Pseudomonas aeruginosa PA01
cgcagcgccgccg

SEQ ID NO: 3427665 - RNA, 13 nt, Pseudomonas aeruginosa PA01
cgcagcgccgcgu

SEQ ID NO: 3427666 - RNA, 13 nt, Pseudomonas aeruginosa PA01
cgcagcgccucca

SEQ ID NO: 3427667 - RNA, 19 nt, Pseudomonas aeruginosa PA01
cgcagcgccucccgggccu

SEQ ID NO: 3427668 - RNA, 15 nt, Pseudomonas aeruginosa PA01
cgcagcgcgcgccga

SEQ ID NO: 3427669 - RNA, 17 nt, Pseudomonas aeruginosa PA01
cgcagcgcgcgccgagc

SEQ ID NO: 3427670 - RNA, 16 nt, Pseudomonas aeruginosa PA01
cgcagcgcgcgucggc

SEQ ID NO: 3427671 - RNA, 19 nt, Pseudomonas aeruginosa PA01
cgcagcgcgcgucggcgaa

SEQ ID NO: 3427672 - RNA, 13 nt, Pseudomonas aeruginosa PA01
cgcagcgcggggg

SEQ ID NO: 3427673 - RNA, 14 nt, Pseudomonas aeruginosa PA01
cgcagcgcgggggc

SEQ ID NO: 3427674 - RNA, 17 nt, Pseudomonas aeruginosa PA01
cgcagcgcggucauccg

SEQ ID NO: 3427675 - RNA, 20 nt, Pseudomonas aeruginosa PA01
cgcagcgcuccuuucccagc

SEQ ID NO: 3427676 - RNA, 21 nt, Pseudomonas aeruginosa PA01
cgcagcggaggauucagcagg

SEQ ID NO: 3427677 - RNA, 11 nt, Pseudomonas aeruginosa PA01
cgcagcggcag

SEQ ID NO: 3427678 - RNA, 12 nt, Pseudomonas aeruginosa PA01
cgcagcggcagc

SEQ ID NO: 3427679 - RNA, 13 nt, Pseudomonas aeruginosa PA01
cgcagcggcagcg

SEQ ID NO: 3427680 - RNA, 15 nt, Pseudomonas aeruginosa PA01
cgcagcggcagcgcc

SEQ ID NO: 3427681 - RNA, 16 nt, Pseudomonas aeruginosa PA01
cgcagcggcagcgcca

SEQ ID NO: 3427682 - RNA, 17 nt, Pseudomonas aeruginosa PA01
cgcagcggcagcgccag

SEQ ID NO: 3427683 - RNA, 18 nt, Pseudomonas aeruginosa PA01
cgcagcggcagcgccagg

SEQ ID NO: 3427684 - RNA, 22 nt, Pseudomonas aeruginosa PA01
cgcagcggcaggccacggccgc

SEQ ID NO: 3427685 - RNA, 16 nt, Pseudomonas aeruginosa PA01
cgcagcggcaugcccu

SEQ ID NO: 3427686 - RNA, 13 nt, Pseudomonas aeruginosa PA01
cgcagcggccccg

SEQ ID NO: 3427687 - RNA, 17 nt, Pseudomonas aeruginosa PA01
cgcagcggccguagcag

SEQ ID NO: 3427688 - RNA, 14 nt, Pseudomonas aeruginosa PA01
cgcagcggcgccga

SEQ ID NO: 3427689 - RNA, 17 nt, Pseudomonas aeruginosa PA01
cgcagcggcgcgucgcu

SEQ ID NO: 3427690 - RNA, 13 nt, Pseudomonas aeruginosa PA01
cgcagcggcgcua

SEQ ID NO: 3427691 - RNA, 13 nt, Pseudomonas aeruginosa PA01
cgcagcggcgucu

SEQ ID NO: 3427692 - RNA, 21 nt, Pseudomonas aeruginosa PA01
cgcagcggcucgugucgacuc

SEQ ID NO: 3427693 - RNA, 13 nt, Pseudomonas aeruginosa PA01
cgcagcgggcuga

SEQ ID NO: 3427694 - RNA, 22 nt, Pseudomonas aeruginosa PA01
cgcagcggguccuggguggcga

SEQ ID NO: 3427695 - RNA, 20 nt, Pseudomonas aeruginosa PA01
cgcagcgggucgaucaggcg

SEQ ID NO: 3427696 - RNA, 17 nt, Pseudomonas aeruginosa PA01
cgcagcgguacaggcgg

SEQ ID NO: 3427697 - RNA, 18 nt, Pseudomonas aeruginosa PA01
cgcagcgguaguucaguc

SEQ ID NO: 3427698 - RNA, 13 nt, Pseudomonas aeruginosa PA01
cgcagcgucaccg

SEQ ID NO: 3427699 - RNA, 20 nt, Pseudomonas aeruginosa PA01
cgcagcgucaccgcgucggg

SEQ ID NO: 3427700 - RNA, 21 nt, Pseudomonas aeruginosa PA01
cgcagcgucaccgcgucggga

SEQ ID NO: 3427701 - RNA, 13 nt, Pseudomonas aeruginosa PA01
cgcagcguccugc

SEQ ID NO: 3427702 - RNA, 16 nt, Pseudomonas aeruginosa PA01
cgcagcguccugcccu

SEQ ID NO: 3427703 - RNA, 16 nt, Pseudomonas aeruginosa PA01
cgcagcguuccagcgc

SEQ ID NO: 3427704 - RNA, 17 nt, Pseudomonas aeruginosa PA01
cgcagcguuccagcgcu

SEQ ID NO: 3427705 - RNA, 18 nt, Pseudomonas aeruginosa PA01
cgcagcguuccagcgcug

SEQ ID NO: 3427706 - RNA, 12 nt, Pseudomonas aeruginosa PA01
cgcagcuccagc

SEQ ID NO: 3427707 - RNA, 14 nt, Pseudomonas aeruginosa PA01
cgcagcuccagcgg

SEQ ID NO: 3427708 - RNA, 15 nt, Pseudomonas aeruginosa PA01
cgcagcuccagcgga

SEQ ID NO: 3427709 - RNA, 15 nt, Pseudomonas aeruginosa PA01
cgcagcuccggcagc

SEQ ID NO: 3427710 - RNA, 22 nt, Pseudomonas aeruginosa PA01
cgcagcuccggcagcaggguca

SEQ ID NO: 3427711 - RNA, 17 nt, Pseudomonas aeruginosa PA01
cgcagcuccucggcgug

SEQ ID NO: 3427712 - RNA, 19 nt, Pseudomonas aeruginosa PA01
cgcagcuccucggcguggc

SEQ ID NO: 3427713 - RNA, 20 nt, Pseudomonas aeruginosa PA01
cgcagcuccucggcguggcu

SEQ ID NO: 3427714 - RNA, 14 nt, Pseudomonas aeruginosa PA01
cgcagcucggugag

SEQ ID NO: 3427715 - RNA, 18 nt, Pseudomonas aeruginosa PA01
cgcagcucggugagcagg

SEQ ID NO: 3427716 - RNA, 20 nt, Pseudomonas aeruginosa PA01
cgcagcucggugagcaggcg

SEQ ID NO: 3427717 - RNA, 22 nt, Pseudomonas aeruginosa PA01
cgcagcucggugagcaggcgcc

SEQ ID NO: 3427718 - RNA, 22 nt, Pseudomonas aeruginosa PA01
cgcagcucugcgaucagggccu

SEQ ID NO: 3427719 - RNA, 20 nt, Pseudomonas aeruginosa PA01
cgcagcuguucacaaaggcg

SEQ ID NO: 3427720 - RNA, 17 nt, Pseudomonas aeruginosa PA01
cgcagcuucuccaccgg

SEQ ID NO: 3427721 - RNA, 16 nt, Pseudomonas aeruginosa PA01
cgcagcuucugcaggg

SEQ ID NO: 3427722 - RNA, 18 nt, Pseudomonas aeruginosa PA01
cgcagcuucugcagggcg

SEQ ID NO: 3427723 - RNA, 20 nt, Pseudomonas aeruginosa PA01
cgcagcuucugcagggcggc

SEQ ID NO: 3427724 - RNA, 21 nt, Pseudomonas aeruginosa PA01
cgcagcuucugcagggcggcu

SEQ ID NO: 3427725 - RNA, 16 nt, Pseudomonas aeruginosa PA01
cgcagcuugccuucca

SEQ ID NO: 3427726 - RNA, 20 nt, Pseudomonas aeruginosa PA01
cgcaggaaaccccucggcua

SEQ ID NO: 3427727 - RNA, 23 nt, Pseudomonas aeruginosa PA01
cgcaggaacagcuccuccagcgu

SEQ ID NO: 3427728 - RNA, 19 nt, Pseudomonas aeruginosa PA01
cgcaggaaccgacgcgcag

SEQ ID NO: 3427729 - RNA, 12 nt, Pseudomonas aeruginosa PA01
cgcaggaacugg

SEQ ID NO: 3427730 - RNA, 21 nt, Pseudomonas aeruginosa PA01
cgcaggaacuggucgauccgc

SEQ ID NO: 3427731 - RNA, 17 nt, Pseudomonas aeruginosa PA01
cgcaggaagaaggcguc

SEQ ID NO: 3427732 - RNA, 20 nt, Pseudomonas aeruginosa PA01
cgcaggaagcugcgcucgga

SEQ ID NO: 3427733 - RNA, 14 nt, Pseudomonas aeruginosa PA01
cgcaggaaggcgaa

SEQ ID NO: 3427734 - RNA, 18 nt, Pseudomonas aeruginosa PA01
cgcaggaaggcgaagccg

SEQ ID NO: 3427735 - RNA, 15 nt, Pseudomonas aeruginosa PA01
cgcaggaccacgcug

SEQ ID NO: 3427736 - RNA, 12 nt, Pseudomonas aeruginosa PA01
cgcaggaccaga

SEQ ID NO: 3427737 - RNA, 23 nt, Pseudomonas aeruginosa PA01
cgcaggaccagacgcggauuggc

SEQ ID NO: 3427738 - RNA, 18 nt, Pseudomonas aeruginosa PA01
cgcaggacgaggaaggcg

SEQ ID NO: 3427739 - RNA, 21 nt, Pseudomonas aeruginosa PA01
cgcaggacggauaacggcagc

SEQ ID NO: 3427740 - RNA, 23 nt, Pseudomonas aeruginosa PA01
cgcaggacggauaacggcagccg

SEQ ID NO: 3427741 - RNA, 15 nt, Pseudomonas aeruginosa PA01
cgcaggagucgacga

SEQ ID NO: 3427742 - RNA, 21 nt, Pseudomonas aeruginosa PA01
cgcaggagugugggacaggaa

SEQ ID NO: 3427743 - RNA, 23 nt, Pseudomonas aeruginosa PA01
cgcaggaugccgccugcgucagc

SEQ ID NO: 3427744 - RNA, 13 nt, Pseudomonas aeruginosa PA01
cgcaggcagaacg

SEQ ID NO: 3427745 - RNA, 12 nt, Pseudomonas aeruginosa PA01
cgcaggcagcgc

SEQ ID NO: 3427746 - RNA, 13 nt, Pseudomonas aeruginosa PA01
cgcaggcagcgcg

SEQ ID NO: 3427747 - RNA, 14 nt, Pseudomonas aeruginosa PA01
cgcaggcagcgcgc

SEQ ID NO: 3427748 - RNA, 15 nt, Pseudomonas aeruginosa PA01
cgcaggcagcgcgcg

SEQ ID NO: 3427749 - RNA, 17 nt, Pseudomonas aeruginosa PA01
cgcaggcagcgcgcguc

SEQ ID NO: 3427750 - RNA, 21 nt, Pseudomonas aeruginosa PA01
cgcaggcaggucaucaggauc

SEQ ID NO: 3427751 - RNA, 14 nt, Pseudomonas aeruginosa PA01
cgcaggcaggucgc

SEQ ID NO: 3427752 - RNA, 17 nt, Pseudomonas aeruginosa PA01
cgcaggcaguggcgcca

SEQ ID NO: 3427753 - RNA, 19 nt, Pseudomonas aeruginosa PA01
cgcaggcaguggcgccagc

SEQ ID NO: 3427754 - RNA, 22 nt, Pseudomonas aeruginosa PA01
cgcaggcaguggcgccagccag

SEQ ID NO: 3427755 - RNA, 23 nt, Pseudomonas aeruginosa PA01
cgcaggcaguggcgccagccagc

SEQ ID NO: 3427756 - RNA, 11 nt, Pseudomonas aeruginosa PA01
cgcaggccagc

SEQ ID NO: 3427757 - RNA, 13 nt, Pseudomonas aeruginosa PA01
cgcaggccagcgc

SEQ ID NO: 3427758 - RNA, 14 nt, Pseudomonas aeruginosa PA01
cgcaggccagcgcc

SEQ ID NO: 3427759 - RNA, 15 nt, Pseudomonas aeruginosa PA01
cgcaggccagcgcca

SEQ ID NO: 3427760 - RNA, 16 nt, Pseudomonas aeruginosa PA01
cgcaggccagcgccag

SEQ ID NO: 3427761 - RNA, 17 nt, Pseudomonas aeruginosa PA01
cgcaggccagcgccagg

SEQ ID NO: 3427762 - RNA, 18 nt, Pseudomonas aeruginosa PA01
cgcaggccagcgccaggg

SEQ ID NO: 3427763 - RNA, 12 nt, Pseudomonas aeruginosa PA01
cgcaggccaggc

SEQ ID NO: 3427764 - RNA, 14 nt, Pseudomonas aeruginosa PA01
cgcaggccaggccc

SEQ ID NO: 3427765 - RNA, 13 nt, Pseudomonas aeruginosa PA01
cgcaggccaggcg

SEQ ID NO: 3427766 - RNA, 15 nt, Pseudomonas aeruginosa PA01
cgcaggcccuugagg

SEQ ID NO: 3427767 - RNA, 16 nt, Pseudomonas aeruginosa PA01
cgcaggccgaccucgg

SEQ ID NO: 3427768 - RNA, 22 nt, Pseudomonas aeruginosa PA01
cgcaggccgaucucgugggcca

SEQ ID NO: 3427769 - RNA, 14 nt, Pseudomonas aeruginosa PA01
cgcaggccgccggc

SEQ ID NO: 3427770 - RNA, 17 nt, Pseudomonas aeruginosa PA01
cgcaggccgccggcggc

SEQ ID NO: 3427771 - RNA, 15 nt, Pseudomonas aeruginosa PA01
cgcaggccgcggccg

SEQ ID NO: 3427772 - RNA, 16 nt, Pseudomonas aeruginosa PA01
cgcaggccgcggccga

SEQ ID NO: 3427773 - RNA, 14 nt, Pseudomonas aeruginosa PA01
cgcaggccgcugcc

SEQ ID NO: 3427774 - RNA, 15 nt, Pseudomonas aeruginosa PA01
cgcaggccgcugccu

SEQ ID NO: 3427775 - RNA, 18 nt, Pseudomonas aeruginosa PA01
cgcaggccgcugccuguc

SEQ ID NO: 3427776 - RNA, 12 nt, Pseudomonas aeruginosa PA01
cgcaggccggcc

SEQ ID NO: 3427777 - RNA, 16 nt, Pseudomonas aeruginosa PA01
cgcaggccggccaggg

SEQ ID NO: 3427778 - RNA, 16 nt, Pseudomonas aeruginosa PA01
cgcaggccgggaaugg

SEQ ID NO: 3427779 - RNA, 19 nt, Pseudomonas aeruginosa PA01
cgcaggccgggcggacgcu

SEQ ID NO: 3427780 - RNA, 15 nt, Pseudomonas aeruginosa PA01
cgcaggccugguagg

SEQ ID NO: 3427781 - RNA, 13 nt, Pseudomonas aeruginosa PA01
cgcaggccuucga

SEQ ID NO: 3427782 - RNA, 21 nt, Pseudomonas aeruginosa PA01
cgcaggccuucgacuucgacg

SEQ ID NO: 3427783 - RNA, 19 nt, Pseudomonas aeruginosa PA01
cgcaggcgaaaaaaagccc

SEQ ID NO: 3427784 - RNA, 19 nt, Pseudomonas aeruginosa PA01
cgcaggcgaacugccgacg

SEQ ID NO: 3427785 - RNA, 20 nt, Pseudomonas aeruginosa PA01
cgcaggcgaacugccgacgg

SEQ ID NO: 3427786 - RNA, 23 nt, Pseudomonas aeruginosa PA01
cgcaggcgaacugccgacggcgg

SEQ ID NO: 3427787 - RNA, 21 nt, Pseudomonas aeruginosa PA01
cgcaggcgaggauggccgucc

SEQ ID NO: 3427788 - RNA, 14 nt, Pseudomonas aeruginosa PA01
cgcaggcgaugccg

SEQ ID NO: 3427789 - RNA, 17 nt, Pseudomonas aeruginosa PA01
cgcaggcgaugccgacg

SEQ ID NO: 3427790 - RNA, 18 nt, Pseudomonas aeruginosa PA01
cgcaggcgaugccgacgc

SEQ ID NO: 3427791 - RNA, 15 nt, Pseudomonas aeruginosa PA01
cgcaggcgcauggcg

SEQ ID NO: 3427792 - RNA, 17 nt, Pseudomonas aeruginosa PA01
cgcaggcgcuauccgcc

SEQ ID NO: 3427793 - RNA, 15 nt, Pseudomonas aeruginosa PA01
cgcaggcgcucgcgg

SEQ ID NO: 3427794 - RNA, 19 nt, Pseudomonas aeruginosa PA01
cgcaggcgcucgcgggccg

SEQ ID NO: 3427795 - RNA, 15 nt, Pseudomonas aeruginosa PA01
cgcaggcgcuggcgg

SEQ ID NO: 3427796 - RNA, 20 nt, Pseudomonas aeruginosa PA01
cgcaggcgcuggcgggcgcu

SEQ ID NO: 3427797 - RNA, 18 nt, Pseudomonas aeruginosa PA01
cgcaggcgcuucagcgcc

SEQ ID NO: 3427798 - RNA, 21 nt, Pseudomonas aeruginosa PA01
cgcaggcgcuucagcgccucg

SEQ ID NO: 3427799 - RNA, 21 nt, Pseudomonas aeruginosa PA01
cgcaggcggaaauacggcucc

SEQ ID NO: 3427800 - RNA, 23 nt, Pseudomonas aeruginosa PA01
cgcaggcggaaauacggcuccgg

SEQ ID NO: 3427801 - RNA, 21 nt, Pseudomonas aeruginosa PA01
cgcaggcggacacgcaggcgc

SEQ ID NO: 3427802 - RNA, 23 nt, Pseudomonas aeruginosa PA01
cgcaggcggacacgcaggcgccg

SEQ ID NO: 3427803 - RNA, 15 nt, Pseudomonas aeruginosa PA01
cgcaggcggaucgcc

SEQ ID NO: 3427804 - RNA, 19 nt, Pseudomonas aeruginosa PA01
cgcaggcggaucgcccggc

SEQ ID NO: 3427805 - RNA, 20 nt, Pseudomonas aeruginosa PA01
cgcaggcggaucgcccggcg

SEQ ID NO: 3427806 - RNA, 12 nt, Pseudomonas aeruginosa PA01
cgcaggcggcgc

SEQ ID NO: 3427807 - RNA, 13 nt, Pseudomonas aeruginosa PA01
cgcaggcggcgcu

SEQ ID NO: 3427808 - RNA, 16 nt, Pseudomonas aeruginosa PA01
cgcaggcggcuggcgc

SEQ ID NO: 3427809 - RNA, 14 nt, Pseudomonas aeruginosa PA01
cgcaggcgggcggc

SEQ ID NO: 3427810 - RNA, 15 nt, Pseudomonas aeruginosa PA01
cgcaggcgggcggcg

SEQ ID NO: 3427811 - RNA, 19 nt, Pseudomonas aeruginosa PA01
cgcaggcgguaggugagcg

SEQ ID NO: 3427812 - RNA, 12 nt, Pseudomonas aeruginosa PA01
cgcaggcggucg

SEQ ID NO: 3427813 - RNA, 18 nt, Pseudomonas aeruginosa PA01
cgcaggcggucgccgaac

SEQ ID NO: 3427814 - RNA, 21 nt, Pseudomonas aeruginosa PA01
cgcaggcggucgccgaacagc

SEQ ID NO: 3427815 - RNA, 16 nt, Pseudomonas aeruginosa PA01
cgcaggcggucggaaa

SEQ ID NO: 3427816 - RNA, 20 nt, Pseudomonas aeruginosa PA01
cgcaggcggucggaaagcag

SEQ ID NO: 3427817 - RNA, 17 nt, Pseudomonas aeruginosa PA01
cgcaggcgguggagcac

SEQ ID NO: 3427818 - RNA, 18 nt, Pseudomonas aeruginosa PA01
cgcaggcgguggagcacg

SEQ ID NO: 3427819 - RNA, 22 nt, Pseudomonas aeruginosa PA01
cgcaggcgguggagcacgucga

SEQ ID NO: 3427820 - RNA, 20 nt, Pseudomonas aeruginosa PA01
cgcaggcguuccucgacgaa

SEQ ID NO: 3427821 - RNA, 18 nt, Pseudomonas aeruginosa PA01
cgcaggcucaguucggcc

SEQ ID NO: 3427822 - RNA, 19 nt, Pseudomonas aeruginosa PA01
cgcaggcucaguucggcca

SEQ ID NO: 3427823 - RNA, 20 nt, Pseudomonas aeruginosa PA01
cgcaggcucaguucggccag

SEQ ID NO: 3427824 - RNA, 21 nt, Pseudomonas aeruginosa PA01
cgcaggcucaguucggccagc

SEQ ID NO: 3427825 - RNA, 21 nt, Pseudomonas aeruginosa PA01
cgcaggcugccguccaggcgc

SEQ ID NO: 3427826 - RNA, 22 nt, Pseudomonas aeruginosa PA01
cgcaggcugccguccaggcgcg

SEQ ID NO: 3427827 - RNA, 18 nt, Pseudomonas aeruginosa PA01
cgcaggcuggccgagcgc

SEQ ID NO: 3427828 - RNA, 22 nt, Pseudomonas aeruginosa PA01
cgcaggcuggccgagcgccgcc

SEQ ID NO: 3427829 - RNA, 19 nt, Pseudomonas aeruginosa PA01
cgcaggcugguaugcagca

SEQ ID NO: 3427830 - RNA, 20 nt, Pseudomonas aeruginosa PA01
cgcaggcugguaugcagcaa

SEQ ID NO: 3427831 - RNA, 24 nt, Pseudomonas aeruginosa PA01
cgcaggcugguaugcagcaacccg

SEQ ID NO: 3427832 - RNA, 13 nt, Pseudomonas aeruginosa PA01
cgcaggcugucgg

SEQ ID NO: 3427833 - RNA, 16 nt, Pseudomonas aeruginosa PA01
cgcaggcugucggcca

SEQ ID NO: 3427834 - RNA, 18 nt, Pseudomonas aeruginosa PA01
cgcaggcugucggccagc

SEQ ID NO: 3427835 - RNA, 19 nt, Pseudomonas aeruginosa PA01
cgcaggcugucggccagcc

SEQ ID NO: 3427836 - RNA, 18 nt, Pseudomonas aeruginosa PA01
cgcaggcuuuccagcccg

SEQ ID NO: 3427837 - RNA, 22 nt, Pseudomonas aeruginosa PA01
cgcaggcuuucguaggcaggcg

SEQ ID NO: 3427838 - RNA, 23 nt, Pseudomonas aeruginosa PA01
cgcaggcuuucguaggcaggcgc

SEQ ID NO: 3427839 - RNA, 13 nt, Pseudomonas aeruginosa PA01
cgcagggagaacg

SEQ ID NO: 3427840 - RNA, 14 nt, Pseudomonas aeruginosa PA01
cgcagggcagcgcg

SEQ ID NO: 3427841 - RNA, 13 nt, Pseudomonas aeruginosa PA01
cgcagggcaucga

SEQ ID NO: 3427842 - RNA, 22 nt, Pseudomonas aeruginosa PA01
cgcagggcaucgaugaccuucg

SEQ ID NO: 3427843 - RNA, 13 nt, Pseudomonas aeruginosa PA01
cgcagggccaggg

SEQ ID NO: 3427844 - RNA, 22 nt, Pseudomonas aeruginosa PA01
cgcagggccucuucgcaacggc

SEQ ID NO: 3427845 - RNA, 16 nt, Pseudomonas aeruginosa PA01
cgcagggcgccgucgg

SEQ ID NO: 3427846 - RNA, 17 nt, Pseudomonas aeruginosa PA01
cgcagggcgccgucggg

SEQ ID NO: 3427847 - RNA, 13 nt, Pseudomonas aeruginosa PA01
cgcagggcggcgc

SEQ ID NO: 3427848 - RNA, 15 nt, Pseudomonas aeruginosa PA01
cgcagggcggcgccu

SEQ ID NO: 3427849 - RNA, 13 nt, Pseudomonas aeruginosa PA01
cgcagggcgucga

SEQ ID NO: 3427850 - RNA, 22 nt, Pseudomonas aeruginosa PA01
cgcagggcgucgaaggcggcgc

SEQ ID NO: 3427851 - RNA, 22 nt, Pseudomonas aeruginosa PA01
cgcagggcguucuucacccgca

SEQ ID NO: 3427852 - RNA, 14 nt, Pseudomonas aeruginosa PA01
cgcagggcucgugc

SEQ ID NO: 3427853 - RNA, 20 nt, Pseudomonas aeruginosa PA01
cgcagggcuuccuuggcggg

SEQ ID NO: 3427854 - RNA, 14 nt, Pseudomonas aeruginosa PA01
cgcaggggcaccgg

SEQ ID NO: 3427855 - RNA, 18 nt, Pseudomonas aeruginosa PA01
cgcaggggcaccggcgga

SEQ ID NO: 3427856 - RNA, 20 nt, Pseudomonas aeruginosa PA01
cgcaggggcaccggcggauu

SEQ ID NO: 3427857 - RNA, 15 nt, Pseudomonas aeruginosa PA01
cgcaggggcgcggcg

SEQ ID NO: 3427858 - RNA, 15 nt, Pseudomonas aeruginosa PA01
cgcagggucaggccc

SEQ ID NO: 3427859 - RNA, 22 nt, Pseudomonas aeruginosa PA01
cgcagggucgcguuggcgugcu

SEQ ID NO: 3427860 - RNA, 22 nt, Pseudomonas aeruginosa PA01
cgcagggugagcauggcguuga

SEQ ID NO: 3427861 - RNA, 21 nt, Pseudomonas aeruginosa PA01
cgcaggguucggggaacagcg

SEQ ID NO: 3427862 - RNA, 22 nt, Pseudomonas aeruginosa PA01
cgcaggguucggggaacagcgc

SEQ ID NO: 3427863 - RNA, 23 nt, Pseudomonas aeruginosa PA01
cgcaggguucggggaacagcgcc

SEQ ID NO: 3427864 - RNA, 15 nt, Pseudomonas aeruginosa PA01
cgcagguaacccgcg

SEQ ID NO: 3427865 - RNA, 21 nt, Pseudomonas aeruginosa PA01
cgcagguaacccgcggcgagg

SEQ ID NO: 3427866 - RNA, 16 nt, Pseudomonas aeruginosa PA01
cgcagguacucgccgg

SEQ ID NO: 3427867 - RNA, 17 nt, Pseudomonas aeruginosa PA01
cgcagguacucgccggc

SEQ ID NO: 3427868 - RNA, 18 nt, Pseudomonas aeruginosa PA01
cgcagguacucgccggcg

SEQ ID NO: 3427869 - RNA, 19 nt, Pseudomonas aeruginosa PA01
cgcagguacucgccggcga

SEQ ID NO: 3427870 - RNA, 20 nt, Pseudomonas aeruginosa PA01
cgcagguagaaggugcccag

SEQ ID NO: 3427871 - RNA, 23 nt, Pseudomonas aeruginosa PA01
cgcagguagcugagcaggccgac

SEQ ID NO: 3427872 - RNA, 14 nt, Pseudomonas aeruginosa PA01
cgcagguagucgcu

SEQ ID NO: 3427873 - RNA, 16 nt, Pseudomonas aeruginosa PA01
cgcagguagucgcuca

SEQ ID NO: 3427874 - RNA, 20 nt, Pseudomonas aeruginosa PA01
cgcagguagucgcucauggc

SEQ ID NO: 3427875 - RNA, 19 nt, Pseudomonas aeruginosa PA01
cgcaggucgcgacagguuc

SEQ ID NO: 3427876 - RNA, 20 nt, Pseudomonas aeruginosa PA01
cgcaggucgcuggcgucgac

SEQ ID NO: 3427877 - RNA, 22 nt, Pseudomonas aeruginosa PA01
cgcaggucgcuggcgucgaccg

SEQ ID NO: 3427878 - RNA, 17 nt, Pseudomonas aeruginosa PA01
cgcaggucggccucggc

SEQ ID NO: 3427879 - RNA, 18 nt, Pseudomonas aeruginosa PA01
cgcaggucggccucggcg

SEQ ID NO: 3427880 - RNA, 22 nt, Pseudomonas aeruginosa PA01
cgcaggucggccucggcgagga

SEQ ID NO: 3427881 - RNA, 14 nt, Pseudomonas aeruginosa PA01
cgcaggucggcguc

SEQ ID NO: 3427882 - RNA, 15 nt, Pseudomonas aeruginosa PA01
cgcaggucggcgucu

SEQ ID NO: 3427883 - RNA, 14 nt, Pseudomonas aeruginosa PA01
cgcaggugaagcuu

SEQ ID NO: 3427884 - RNA, 14 nt, Pseudomonas aeruginosa PA01
cgcaggugcaccgc

SEQ ID NO: 3427885 - RNA, 21 nt, Pseudomonas aeruginosa PA01
cgcaggugcccuggcagacgc

SEQ ID NO: 3427886 - RNA, 17 nt, Pseudomonas aeruginosa PA01
cgcaggugcuuggcacc

SEQ ID NO: 3427887 - RNA, 21 nt, Pseudomonas aeruginosa PA01
cgcaggugcuuggcaccgcgc

SEQ ID NO: 3427888 - RNA, 17 nt, Pseudomonas aeruginosa PA01
cgcagguucaucgccgc

SEQ ID NO: 3427889 - RNA, 18 nt, Pseudomonas aeruginosa PA01
cgcagguucaucgccgcc

SEQ ID NO: 3427890 - RNA, 18 nt, Pseudomonas aeruginosa PA01
cgcagguugcgcuggcgc

SEQ ID NO: 3427891 - RNA, 22 nt, Pseudomonas aeruginosa PA01
cgcagguugcgcuggcgcagca

SEQ ID NO: 3427892 - RNA, 17 nt, Pseudomonas aeruginosa PA01
cgcagguuggccccgcc

SEQ ID NO: 3427893 - RNA, 18 nt, Pseudomonas aeruginosa PA01
cgcagguuggccccgccg

SEQ ID NO: 3427894 - RNA, 19 nt, Pseudomonas aeruginosa PA01
cgcagguuggccccgccga

SEQ ID NO: 3427895 - RNA, 20 nt, Pseudomonas aeruginosa PA01
cgcagguuggccccgccgag

SEQ ID NO: 3427896 - RNA, 21 nt, Pseudomonas aeruginosa PA01
cgcagguuggccccgccgagg

SEQ ID NO: 3427897 - RNA, 22 nt, Pseudomonas aeruginosa PA01
cgcagguuggccccgccgagga

SEQ ID NO: 3427898 - RNA, 13 nt, Pseudomonas aeruginosa PA01
cgcaguacagcuc

SEQ ID NO: 3427899 - RNA, 14 nt, Pseudomonas aeruginosa PA01
cgcaguacccggcc

SEQ ID NO: 3427900 - RNA, 15 nt, Pseudomonas aeruginosa PA01
cgcaguacccggccg

SEQ ID NO: 3427901 - RNA, 18 nt, Pseudomonas aeruginosa PA01
cgcaguacccggccgccu

SEQ ID NO: 3427902 - RNA, 21 nt, Pseudomonas aeruginosa PA01
cgcaguacgaucagccagggc

SEQ ID NO: 3427903 - RNA, 14 nt, Pseudomonas aeruginosa PA01
cgcaguagaagcag

SEQ ID NO: 3427904 - RNA, 18 nt, Pseudomonas aeruginosa PA01
cgcaguagaugccgcguc

SEQ ID NO: 3427905 - RNA, 23 nt, Pseudomonas aeruginosa PA01
cgcaguagaugccgcgucggcuc

SEQ ID NO: 3427906 - RNA, 18 nt, Pseudomonas aeruginosa PA01
cgcaguagcucgccgagg

SEQ ID NO: 3427907 - RNA, 16 nt, Pseudomonas aeruginosa PA01
cgcaguagcuggaucu

SEQ ID NO: 3427908 - RNA, 15 nt, Pseudomonas aeruginosa PA01
cgcaguaggccuggu

SEQ ID NO: 3427909 - RNA, 16 nt, Pseudomonas aeruginosa PA01
cgcaguaggcgcugcc

SEQ ID NO: 3427910 - RNA, 17 nt, Pseudomonas aeruginosa PA01
cgcaguaggcgcugccg

SEQ ID NO: 3427911 - RNA, 15 nt, Pseudomonas aeruginosa PA01
cgcaguagucgaccg

SEQ ID NO: 3427912 - RNA, 15 nt, Pseudomonas aeruginosa PA01
cgcaguccagggcga

SEQ ID NO: 3427913 - RNA, 16 nt, Pseudomonas aeruginosa PA01
cgcagucccgcgcggc

SEQ ID NO: 3427914 - RNA, 20 nt, Pseudomonas aeruginosa PA01
cgcaguccgguagcgcgccu

SEQ ID NO: 3427915 - RNA, 23 nt, Pseudomonas aeruginosa PA01
cgcaguccgguagcgcgccugcu

SEQ ID NO: 3427916 - RNA, 19 nt, Pseudomonas aeruginosa PA01
cgcagucgcuuccgcgcgg

SEQ ID NO: 3427917 - RNA, 14 nt, Pseudomonas aeruginosa PA01
cgcagucguagcgc

SEQ ID NO: 3427918 - RNA, 16 nt, Pseudomonas aeruginosa PA01
cgcagucguagcgcag

SEQ ID NO: 3427919 - RNA, 14 nt, Pseudomonas aeruginosa PA01
cgcagucuucucgg

SEQ ID NO: 3427920 - RNA, 22 nt, Pseudomonas aeruginosa PA01
cgcagugucgcgaacucggcgc

SEQ ID NO: 3427921 - RNA, 23 nt, Pseudomonas aeruginosa PA01
cgcagugucgcgaacucggcgcc

SEQ ID NO: 3427922 - RNA, 18 nt, Pseudomonas aeruginosa PA01
cgcaguuccucgccgcug

SEQ ID NO: 3427923 - RNA, 20 nt, Pseudomonas aeruginosa PA01
cgcaguuccuugggcaucga

SEQ ID NO: 3427924 - RNA, 22 nt, Pseudomonas aeruginosa PA01
cgcaguuccuugggcaucgaga

SEQ ID NO: 3427925 - RNA, 14 nt, Pseudomonas aeruginosa PA01
cgcaguucgccccg

SEQ ID NO: 3427926 - RNA, 16 nt, Pseudomonas aeruginosa PA01
cgcaguucgccccgcc

SEQ ID NO: 3427927 - RNA, 14 nt, Pseudomonas aeruginosa PA01
cgcaguucgccgcc

SEQ ID NO: 3427928 - RNA, 15 nt, Pseudomonas aeruginosa PA01
cgcaguucgccgccg

SEQ ID NO: 3427929 - RNA, 16 nt, Pseudomonas aeruginosa PA01
cgcaguucgccgccga

SEQ ID NO: 3427930 - RNA, 22 nt, Pseudomonas aeruginosa PA01
cgcaguucgcgggccgcggcga

SEQ ID NO: 3427931 - RNA, 14 nt, Pseudomonas aeruginosa PA01
cgcaguucgucgcc

SEQ ID NO: 3427932 - RNA, 15 nt, Pseudomonas aeruginosa PA01
cgcaguucgucgccc

SEQ ID NO: 3427933 - RNA, 19 nt, Pseudomonas aeruginosa PA01
cgcauagcaggccuggagc

SEQ ID NO: 3427934 - RNA, 13 nt, Pseudomonas aeruginosa PA01
cgcauagccaccg

SEQ ID NO: 3427935 - RNA, 14 nt, Pseudomonas aeruginosa PA01
cgcauagccaccgc

SEQ ID NO: 3427936 - RNA, 19 nt, Pseudomonas aeruginosa PA01
cgcauagccaccgccgaca

SEQ ID NO: 3427937 - RNA, 21 nt, Pseudomonas aeruginosa PA01
cgcauagccaccgccgacauc

SEQ ID NO: 3427938 - RNA, 13 nt, Pseudomonas aeruginosa PA01
cgcauagccggcg

SEQ ID NO: 3427939 - RNA, 16 nt, Pseudomonas aeruginosa PA01
cgcauagccggcgcgc

SEQ ID NO: 3427940 - RNA, 18 nt, Pseudomonas aeruginosa PA01
cgcauagccggcgcgccc

SEQ ID NO: 3427941 - RNA, 21 nt, Pseudomonas aeruginosa PA01
cgcauagccggcgcgcccggc

SEQ ID NO: 3427942 - RNA, 22 nt, Pseudomonas aeruginosa PA01
cgcauagccggcgcgcccggcg

SEQ ID NO: 3427943 - RNA, 19 nt, Pseudomonas aeruginosa PA01
cgcauagcugaucucggcg

SEQ ID NO: 3427944 - RNA, 22 nt, Pseudomonas aeruginosa PA01
cgcauaggaggcgcuuucccgc

SEQ ID NO: 3427945 - RNA, 12 nt, Pseudomonas aeruginosa PA01
cgcauaggcggc

SEQ ID NO: 3427946 - RNA, 20 nt, Pseudomonas aeruginosa PA01
cgcauaggucaugcccaggc

SEQ ID NO: 3427947 - RNA, 22 nt, Pseudomonas aeruginosa PA01
cgcauaggugggaacgaaacgc

SEQ ID NO: 3427948 - RNA, 13 nt, Pseudomonas aeruginosa PA01
cgcauagucgcga

SEQ ID NO: 3427949 - RNA, 22 nt, Pseudomonas aeruginosa PA01
cgcaucagcgccgguucguuga

SEQ ID NO: 3427950 - RNA, 16 nt, Pseudomonas aeruginosa PA01
cgcaucaggccaaagc

SEQ ID NO: 3427951 - RNA, 17 nt, Pseudomonas aeruginosa PA01
cgcaucaggccaaagcc

SEQ ID NO: 3427952 - RNA, 22 nt, Pseudomonas aeruginosa PA01
cgcaucaggccaaagccgcaau

SEQ ID NO: 3427953 - RNA, 22 nt, Pseudomonas aeruginosa PA01
cgcaucaggucggucuggcggc

SEQ ID NO: 3427954 - RNA, 23 nt, Pseudomonas aeruginosa PA01
cgcaucccaguagccggucaggc

SEQ ID NO: 3427955 - RNA, 20 nt, Pseudomonas aeruginosa PA01
cgcauccgcccgaucgccuc

SEQ ID NO: 3427956 - RNA, 21 nt, Pseudomonas aeruginosa PA01
cgcauccguaaaauggcgcgc

SEQ ID NO: 3427957 - RNA, 23 nt, Pseudomonas aeruginosa PA01
cgcauccguaaaauggcgcgccu

SEQ ID NO: 3427958 - RNA, 15 nt, Pseudomonas aeruginosa PA01
cgcauccuccacccc

SEQ ID NO: 3427959 - RNA, 15 nt, Pseudomonas aeruginosa PA01
cgcauccucggcauc

SEQ ID NO: 3427960 - RNA, 20 nt, Pseudomonas aeruginosa PA01
cgcaucgaagcgcaccaggg

SEQ ID NO: 3427961 - RNA, 12 nt, Pseudomonas aeruginosa PA01
cgcaucgaaggc

SEQ ID NO: 3427962 - RNA, 13 nt, Pseudomonas aeruginosa PA01
cgcaucgaaggcg

SEQ ID NO: 3427963 - RNA, 17 nt, Pseudomonas aeruginosa PA01
cgcaucgaaggcgccgg

SEQ ID NO: 3427964 - RNA, 20 nt, Pseudomonas aeruginosa PA01
cgcaucgaaggcgccggcau

SEQ ID NO: 3427965 - RNA, 16 nt, Pseudomonas aeruginosa PA01
cgcaucgaccuugccc

SEQ ID NO: 3427966 - RNA, 20 nt, Pseudomonas aeruginosa PA01
cgcaucgaccuugcccucgg

SEQ ID NO: 3427967 - RNA, 13 nt, Pseudomonas aeruginosa PA01
cgcaucgaggccg

SEQ ID NO: 3427968 - RNA, 19 nt, Pseudomonas aeruginosa PA01
cgcaucgaggccgcccagc

SEQ ID NO: 3427969 - RNA, 20 nt, Pseudomonas aeruginosa PA01
cgcaucgaggccgcccagcg

SEQ ID NO: 3427970 - RNA, 21 nt, Pseudomonas aeruginosa PA01
cgcaucgaugccuugcggccc

SEQ ID NO: 3427971 - RNA, 13 nt, Pseudomonas aeruginosa PA01
cgcaucgccaccg

SEQ ID NO: 3427972 - RNA, 19 nt, Pseudomonas aeruginosa PA01
cgcaucgccugggccggcg

SEQ ID NO: 3427973 - RNA, 20 nt, Pseudomonas aeruginosa PA01
cgcaucgccugggccggcgu

SEQ ID NO: 3427974 - RNA, 17 nt, Pseudomonas aeruginosa PA01
cgcaucgcgcacaugcc

SEQ ID NO: 3427975 - RNA, 20 nt, Pseudomonas aeruginosa PA01
cgcaucgcgcacaugccgag

SEQ ID NO: 3427976 - RNA, 22 nt, Pseudomonas aeruginosa PA01
cgcaucgcggacaccgcggugu

SEQ ID NO: 3427977 - RNA, 14 nt, Pseudomonas aeruginosa PA01
cgcaucgcgggcgu

SEQ ID NO: 3427978 - RNA, 18 nt, Pseudomonas aeruginosa PA01
cgcaucgcgggcgugcuc

SEQ ID NO: 3427979 - RNA, 21 nt, Pseudomonas aeruginosa PA01
cgcaucgcgggcgugcuccag

SEQ ID NO: 3427980 - RNA, 21 nt, Pseudomonas aeruginosa PA01
cgcaucgcgguuauccgccgg

SEQ ID NO: 3427981 - RNA, 14 nt, Pseudomonas aeruginosa PA01
cgcaucggccaccu

SEQ ID NO: 3427982 - RNA, 21 nt, Pseudomonas aeruginosa PA01
cgcaucggccaccuucgcccg

SEQ ID NO: 3427983 - RNA, 21 nt, Pseudomonas aeruginosa PA01
cgcaucggccgacagagcggc

SEQ ID NO: 3427984 - RNA, 16 nt, Pseudomonas aeruginosa PA01
cgcaucggcgccuccc

SEQ ID NO: 3427985 - RNA, 12 nt, Pseudomonas aeruginosa PA01
cgcaucggcgga

SEQ ID NO: 3427986 - RNA, 21 nt, Pseudomonas aeruginosa PA01
cgcaucgucgaaacgcuggcg

SEQ ID NO: 3427987 - RNA, 20 nt, Pseudomonas aeruginosa PA01
cgcaucgucgaugcguccgc

SEQ ID NO: 3427988 - RNA, 23 nt, Pseudomonas aeruginosa PA01
cgcaucgugcagccagacccagu

SEQ ID NO: 3427989 - RNA, 20 nt, Pseudomonas aeruginosa PA01
cgcaucguuggcgccguccu

SEQ ID NO: 3427990 - RNA, 23 nt, Pseudomonas aeruginosa PA01
cgcaucguuggcgccguccugca

SEQ ID NO: 3427991 - RNA, 23 nt, Pseudomonas aeruginosa PA01
cgcaucugcgcguagcgguccuc

SEQ ID NO: 3427992 - RNA, 16 nt, Pseudomonas aeruginosa PA01
cgcaucuggcugcgcg

SEQ ID NO: 3427993 - RNA, 18 nt, Pseudomonas aeruginosa PA01
cgcaucuggugcgcgucc

SEQ ID NO: 3427994 - RNA, 22 nt, Pseudomonas aeruginosa PA01
cgcaucuggugcgcguccaucc

SEQ ID NO: 3427995 - RNA, 19 nt, Pseudomonas aeruginosa PA01
cgcaugaaaaagccgccca

SEQ ID NO: 3427996 - RNA, 18 nt, Pseudomonas aeruginosa PA01
cgcaugaacgccucgcca

SEQ ID NO: 3427997 - RNA, 23 nt, Pseudomonas aeruginosa PA01
cgcaugaccuucagcaccugcgc

SEQ ID NO: 3427998 - RNA, 16 nt, Pseudomonas aeruginosa PA01
cgcaugaucgccucgg

SEQ ID NO: 3427999 - RNA, 16 nt, Pseudomonas aeruginosa PA01
cgcaugcaguggaagg

SEQ ID NO: 3428000 - RNA, 13 nt, Pseudomonas aeruginosa PA01
cgcaugcccaggg

SEQ ID NO: 3428001 - RNA, 18 nt, Pseudomonas aeruginosa PA01
cgcaugccguuggccgag

SEQ ID NO: 3428002 - RNA, 20 nt, Pseudomonas aeruginosa PA01
cgcaugccguuggccgagcg

SEQ ID NO: 3428003 - RNA, 13 nt, Pseudomonas aeruginosa PA01
cgcaugcgccggc

SEQ ID NO: 3428004 - RNA, 13 nt, Pseudomonas aeruginosa PA01
cgcaugcgcggcg

SEQ ID NO: 3428005 - RNA, 14 nt, Pseudomonas aeruginosa PA01
cgcaugcgcggcgu

SEQ ID NO: 3428006 - RNA, 17 nt, Pseudomonas aeruginosa PA01
cgcaugcggaaggcuuc

SEQ ID NO: 3428007 - RNA, 15 nt, Pseudomonas aeruginosa PA01
cgcauggacaggucg

SEQ ID NO: 3428008 - RNA, 18 nt, Pseudomonas aeruginosa PA01
cgcauggacaggucgacg

SEQ ID NO: 3428009 - RNA, 18 nt, Pseudomonas aeruginosa PA01
cgcauggagacggcccgc

SEQ ID NO: 3428010 - RNA, 22 nt, Pseudomonas aeruginosa PA01
cgcauggagacggcccgccccg

SEQ ID NO: 3428011 - RNA, 17 nt, Pseudomonas aeruginosa PA01
cgcauggaucaugggug

SEQ ID NO: 3428012 - RNA, 15 nt, Pseudomonas aeruginosa PA01
cgcauggcggcgacc

SEQ ID NO: 3428013 - RNA, 17 nt, Pseudomonas aeruginosa PA01
cgcauggcguucugcga

SEQ ID NO: 3428014 - RNA, 20 nt, Pseudomonas aeruginosa PA01
cgcauggcguucugcgacau

SEQ ID NO: 3428015 - RNA, 20 nt, Pseudomonas aeruginosa PA01
cgcaugggggaacuccugau

SEQ ID NO: 3428016 - RNA, 13 nt, Pseudomonas aeruginosa PA01
cgcauggucgcgc

SEQ ID NO: 3428017 - RNA, 16 nt, Pseudomonas aeruginosa PA01
cgcauguccagccagu

SEQ ID NO: 3428018 - RNA, 12 nt, Pseudomonas aeruginosa PA01
cgcaugucgcga

SEQ ID NO: 3428019 - RNA, 20 nt, Pseudomonas aeruginosa PA01
cgcauugaaaaacccaugcg

SEQ ID NO: 3428020 - RNA, 14 nt, Pseudomonas aeruginosa PA01
cgcauugacccggg

SEQ ID NO: 3428021 - RNA, 14 nt, Pseudomonas aeruginosa PA01
cgcauuggccaggc

SEQ ID NO: 3428022 - RNA, 19 nt, Pseudomonas aeruginosa PA01
cgcauuggccaggccccag

SEQ ID NO: 3428023 - RNA, 23 nt, Pseudomonas aeruginosa PA01
cgcauuggccaggccccaggccg

SEQ ID NO: 3428024 - RNA, 16 nt, Pseudomonas aeruginosa PA01
cgcauuugcacgucgg

SEQ ID NO: 3428025 - RNA, 15 nt, Pseudomonas aeruginosa PA01
cgcauuuugccggag

SEQ ID NO: 3428026 - RNA, 18 nt, Pseudomonas aeruginosa PA01
cgccaaaaaaagccccgg

SEQ ID NO: 3428027 - RNA, 20 nt, Pseudomonas aeruginosa PA01
cgccaaaaagcaggacggcg

SEQ ID NO: 3428028 - RNA, 22 nt, Pseudomonas aeruginosa PA01
cgccaaaguucaguagcggcag

SEQ ID NO: 3428029 - RNA, 21 nt, Pseudomonas aeruginosa PA01
cgccaaccaugguuuccgccg

SEQ ID NO: 3428030 - RNA, 14 nt, Pseudomonas aeruginosa PA01
cgccaacgccaccg

SEQ ID NO: 3428031 - RNA, 18 nt, Pseudomonas aeruginosa PA01
cgccaacgccaccgcgcg

SEQ ID NO: 3428032 - RNA, 12 nt, Pseudomonas aeruginosa PA01
cgccaacgcgcc

SEQ ID NO: 3428033 - RNA, 16 nt, Pseudomonas aeruginosa PA01
cgccaacgcgccgucg

SEQ ID NO: 3428034 - RNA, 19 nt, Pseudomonas aeruginosa PA01
cgccaacgcgccgucgcga

SEQ ID NO: 3428035 - RNA, 21 nt, Pseudomonas aeruginosa PA01
cgccaacgcgccgucgcgacc

SEQ ID NO: 3428036 - RNA, 20 nt, Pseudomonas aeruginosa PA01
cgccaacggcguuauccgcc

SEQ ID NO: 3428037 - RNA, 21 nt, Pseudomonas aeruginosa PA01
cgccaacggcguuauccgccg

SEQ ID NO: 3428038 - RNA, 13 nt, Pseudomonas aeruginosa PA01
cgccaacguccuc

SEQ ID NO: 3428039 - RNA, 14 nt, Pseudomonas aeruginosa PA01
cgccaacguccucg

SEQ ID NO: 3428040 - RNA, 19 nt, Pseudomonas aeruginosa PA01
cgccaacuggcgcaacugc

SEQ ID NO: 3428041 - RNA, 19 nt, Pseudomonas aeruginosa PA01
cgccaacuggcugucgagc

SEQ ID NO: 3428042 - RNA, 20 nt, Pseudomonas aeruginosa PA01
cgccaacuggcugucgagcg

SEQ ID NO: 3428043 - RNA, 13 nt, Pseudomonas aeruginosa PA01
cgccaagcccggc

SEQ ID NO: 3428044 - RNA, 14 nt, Pseudomonas aeruginosa PA01
cgccaagcccggcg

SEQ ID NO: 3428045 - RNA, 15 nt, Pseudomonas aeruginosa PA01
cgccaagcccggcga

SEQ ID NO: 3428046 - RNA, 23 nt, Pseudomonas aeruginosa PA01
cgccaagcuggcgaucgaccugc

SEQ ID NO: 3428047 - RNA, 20 nt, Pseudomonas aeruginosa PA01
cgccaaggcccgcaaucagc

SEQ ID NO: 3428048 - RNA, 12 nt, Pseudomonas aeruginosa PA01
cgccaaggccgc

SEQ ID NO: 3428049 - RNA, 20 nt, Pseudomonas aeruginosa PA01
cgccaaggccgccaggccuc

SEQ ID NO: 3428050 - RNA, 11 nt, Pseudomonas aeruginosa PA01
cgccaaggcgg

SEQ ID NO: 3428051 - RNA, 14 nt, Pseudomonas aeruginosa PA01
cgccaaggcggggc

SEQ ID NO: 3428052 - RNA, 16 nt, Pseudomonas aeruginosa PA01
cgccaagggcgccgcc

SEQ ID NO: 3428053 - RNA, 17 nt, Pseudomonas aeruginosa PA01
cgccaagggcgccgccg

SEQ ID NO: 3428054 - RNA, 21 nt, Pseudomonas aeruginosa PA01
cgccaagggcgccgccgagga

SEQ ID NO: 3428055 - RNA, 21 nt, Pseudomonas aeruginosa PA01
cgccaauaaauccgucauaca

SEQ ID NO: 3428056 - RNA, 14 nt, Pseudomonas aeruginosa PA01
cgccacacauccag

SEQ ID NO: 3428057 - RNA, 22 nt, Pseudomonas aeruginosa PA01
cgccacacggcuaucaggugag

SEQ ID NO: 3428058 - RNA, 14 nt, Pseudomonas aeruginosa PA01
cgccacagaucgcc

SEQ ID NO: 3428059 - RNA, 15 nt, Pseudomonas aeruginosa PA01
cgccacagaucgcca

SEQ ID NO: 3428060 - RNA, 20 nt, Pseudomonas aeruginosa PA01
cgccacagaucgccagcucg

SEQ ID NO: 3428061 - RNA, 22 nt, Pseudomonas aeruginosa PA01
cgccacaggcguuauccgccga

SEQ ID NO: 3428062 - RNA, 22 nt, Pseudomonas aeruginosa PA01
cgccaccaaccacaaccagcca

SEQ ID NO: 3428063 - RNA, 23 nt, Pseudomonas aeruginosa PA01
cgccaccaaccacaaccagccau

SEQ ID NO: 3428064 - RNA, 19 nt, Pseudomonas aeruginosa PA01
cgccaccaccgucacggcg

SEQ ID NO: 3428065 - RNA, 20 nt, Pseudomonas aeruginosa PA01
cgccaccacgaucaggcccu

SEQ ID NO: 3428066 - RNA, 16 nt, Pseudomonas aeruginosa PA01
cgccaccacggcgaag

SEQ ID NO: 3428067 - RNA, 18 nt, Pseudomonas aeruginosa PA01
cgccaccacggcgaagcc

SEQ ID NO: 3428068 - RNA, 13 nt, Pseudomonas aeruginosa PA01
cgccaccagcagg

SEQ ID NO: 3428069 - RNA, 17 nt, Pseudomonas aeruginosa PA01
cgccaccagcaggaagc

SEQ ID NO: 3428070 - RNA, 20 nt, Pseudomonas aeruginosa PA01
cgccaccagcagggccaggc

SEQ ID NO: 3428071 - RNA, 21 nt, Pseudomonas aeruginosa PA01
cgccaccagcagggccaggcc

SEQ ID NO: 3428072 - RNA, 13 nt, Pseudomonas aeruginosa PA01
cgccaccagcaug

SEQ ID NO: 3428073 - RNA, 20 nt, Pseudomonas aeruginosa PA01
cgccaccagcaugcccagcg

SEQ ID NO: 3428074 - RNA, 13 nt, Pseudomonas aeruginosa PA01
cgccaccagccag

SEQ ID NO: 3428075 - RNA, 12 nt, Pseudomonas aeruginosa PA01
cgccaccagcga

SEQ ID NO: 3428076 - RNA, 17 nt, Pseudomonas aeruginosa PA01
cgccaccagcguggcgc

SEQ ID NO: 3428077 - RNA, 22 nt, Pseudomonas aeruginosa PA01
cgccaccagcguggcgcgcauc

SEQ ID NO: 3428078 - RNA, 14 nt, Pseudomonas aeruginosa PA01
cgccaccaggccgc

SEQ ID NO: 3428079 - RNA, 17 nt, Pseudomonas aeruginosa PA01
cgccaccaggccgcugc

SEQ ID NO: 3428080 - RNA, 19 nt, Pseudomonas aeruginosa PA01
cgccaccaggccgcugccg

SEQ ID NO: 3428081 - RNA, 14 nt, Pseudomonas aeruginosa PA01
cgccaccagggccu

SEQ ID NO: 3428082 - RNA, 24 nt, Pseudomonas aeruginosa PA01
cgccaccagggccuugccgcgacc

SEQ ID NO: 3428083 - RNA, 13 nt, Pseudomonas aeruginosa PA01
cgccaccccgccg

SEQ ID NO: 3428084 - RNA, 14 nt, Pseudomonas aeruginosa PA01
cgccaccccgccgc

SEQ ID NO: 3428085 - RNA, 15 nt, Pseudomonas aeruginosa PA01
cgccaccccgccgcg

SEQ ID NO: 3428086 - RNA, 17 nt, Pseudomonas aeruginosa PA01
cgccaccccgccgcugg

SEQ ID NO: 3428087 - RNA, 19 nt, Pseudomonas aeruginosa PA01
cgccaccccgccgcuggcg

SEQ ID NO: 3428088 - RNA, 20 nt, Pseudomonas aeruginosa PA01
cgccaccccgccgcuggcgg

SEQ ID NO: 3428089 - RNA, 21 nt, Pseudomonas aeruginosa PA01
cgccaccccgccgcuggcggc

SEQ ID NO: 3428090 - RNA, 22 nt, Pseudomonas aeruginosa PA01
cgccaccccgccgcuggcggca

SEQ ID NO: 3428091 - RNA, 15 nt, Pseudomonas aeruginosa PA01
cgccaccccgccggc

SEQ ID NO: 3428092 - RNA, 16 nt, Pseudomonas aeruginosa PA01
cgccaccccgccggcg

SEQ ID NO: 3428093 - RNA, 17 nt, Pseudomonas aeruginosa PA01
cgccaccccgccggcgu

SEQ ID NO: 3428094 - RNA, 14 nt, Pseudomonas aeruginosa PA01
cgccaccccgcucc

SEQ ID NO: 3428095 - RNA, 20 nt, Pseudomonas aeruginosa PA01
cgccaccccgcuccgcucag

SEQ ID NO: 3428096 - RNA, 12 nt, Pseudomonas aeruginosa PA01
cgccacccgcau

SEQ ID NO: 3428097 - RNA, 14 nt, Pseudomonas aeruginosa PA01
cgccacccgcaucg

SEQ ID NO: 3428098 - RNA, 16 nt, Pseudomonas aeruginosa PA01
cgccacccgcuccggc

SEQ ID NO: 3428099 - RNA, 18 nt, Pseudomonas aeruginosa PA01
cgccacccguuccuugcg

SEQ ID NO: 3428100 - RNA, 23 nt, Pseudomonas aeruginosa PA01
cgccacccguuccuugcgcggca

SEQ ID NO: 3428101 - RNA, 18 nt, Pseudomonas aeruginosa PA01
cgccacccucggcuucgu

SEQ ID NO: 3428102 - RNA, 21 nt, Pseudomonas aeruginosa PA01
cgccacccucggcuucguccu

SEQ ID NO: 3428103 - RNA, 18 nt, Pseudomonas aeruginosa PA01
cgccaccgacccucggcg

SEQ ID NO: 3428104 - RNA, 14 nt, Pseudomonas aeruginosa PA01
cgccaccgauagcg

SEQ ID NO: 3428105 - RNA, 17 nt, Pseudomonas aeruginosa PA01
cgccaccgauucgccgg

SEQ ID NO: 3428106 - RNA, 18 nt, Pseudomonas aeruginosa PA01
cgccaccgauucgccggc

SEQ ID NO: 3428107 - RNA, 18 nt, Pseudomonas aeruginosa PA01
cgccaccgccaccgccgg

SEQ ID NO: 3428108 - RNA, 16 nt, Pseudomonas aeruginosa PA01
cgccaccgccuggucg

SEQ ID NO: 3428109 - RNA, 20 nt, Pseudomonas aeruginosa PA01
cgccaccgccuggucgccgg

SEQ ID NO: 3428110 - RNA, 16 nt, Pseudomonas aeruginosa PA01
cgccaccgcgacgcgc

SEQ ID NO: 3428111 - RNA, 16 nt, Pseudomonas aeruginosa PA01
cgccaccgcgcgcccu

SEQ ID NO: 3428112 - RNA, 13 nt, Pseudomonas aeruginosa PA01
cgccaccgcggau

SEQ ID NO: 3428113 - RNA, 15 nt, Pseudomonas aeruginosa PA01
cgccaccgcggaucc

SEQ ID NO: 3428114 - RNA, 21 nt, Pseudomonas aeruginosa PA01
cgccaccgcggauccacgccu

SEQ ID NO: 3428115 - RNA, 20 nt, Pseudomonas aeruginosa PA01
cgccaccgcguugaccguga

SEQ ID NO: 3428116 - RNA, 20 nt, Pseudomonas aeruginosa PA01
cgccaccgguacgcucacca

SEQ ID NO: 3428117 - RNA, 23 nt, Pseudomonas aeruginosa PA01
cgccaccgguacgcucaccacca

SEQ ID NO: 3428118 - RNA, 19 nt, Pseudomonas aeruginosa PA01
cgccaccugagcgacgugg

SEQ ID NO: 3428119 - RNA, 14 nt, Pseudomonas aeruginosa PA01
cgccaccugccccg

SEQ ID NO: 3428120 - RNA, 16 nt, Pseudomonas aeruginosa PA01
cgccaccugccccggg

SEQ ID NO: 3428121 - RNA, 18 nt, Pseudomonas aeruginosa PA01
cgccaccugccccgggcg

SEQ ID NO: 3428122 - RNA, 19 nt, Pseudomonas aeruginosa PA01
cgccaccuguuccacgaga

SEQ ID NO: 3428123 - RNA, 14 nt, Pseudomonas aeruginosa PA01
cgccacgaucaugg

SEQ ID NO: 3428124 - RNA, 21 nt, Pseudomonas aeruginosa PA01
cgccacgcaggaacagcuccu

SEQ ID NO: 3428125 - RNA, 14 nt, Pseudomonas aeruginosa PA01
cgccacgcaguucg

SEQ ID NO: 3428126 - RNA, 17 nt, Pseudomonas aeruginosa PA01
cgccacgcaguucgcgg

SEQ ID NO: 3428127 - RNA, 22 nt, Pseudomonas aeruginosa PA01
cgccacgcaguucgcgggccgc

SEQ ID NO: 3428128 - RNA, 12 nt, Pseudomonas aeruginosa PA01
cgccacgccgcu

SEQ ID NO: 3428129 - RNA, 14 nt, Pseudomonas aeruginosa PA01
cgccacgccgcugu

SEQ ID NO: 3428130 - RNA, 13 nt, Pseudomonas aeruginosa PA01
cgccacgccggcg

SEQ ID NO: 3428131 - RNA, 15 nt, Pseudomonas aeruginosa PA01
cgccacgccggcgcu

SEQ ID NO: 3428132 - RNA, 19 nt, Pseudomonas aeruginosa PA01
cgccacgccggcgcuccuc

SEQ ID NO: 3428133 - RNA, 21 nt, Pseudomonas aeruginosa PA01
cgccacgcgagaagccgccca

SEQ ID NO: 3428134 - RNA, 22 nt, Pseudomonas aeruginosa PA01
cgccacgcgagaagccgcccac

SEQ ID NO: 3428135 - RNA, 15 nt, Pseudomonas aeruginosa PA01
cgccacgcgcaucgu

SEQ ID NO: 3428136 - RNA, 14 nt, Pseudomonas aeruginosa PA01
cgccacgcucaccg

SEQ ID NO: 3428137 - RNA, 15 nt, Pseudomonas aeruginosa PA01
cgccacgcucaccgg

SEQ ID NO: 3428138 - RNA, 19 nt, Pseudomonas aeruginosa PA01
cgccacgcucaccggucga

SEQ ID NO: 3428139 - RNA, 14 nt, Pseudomonas aeruginosa PA01
cgccacgcucuccg

SEQ ID NO: 3428140 - RNA, 15 nt, Pseudomonas aeruginosa PA01
cgccacgcugaucau

SEQ ID NO: 3428141 - RNA, 12 nt, Pseudomonas aeruginosa PA01
cgccacgcugcu

SEQ ID NO: 3428142 - RNA, 13 nt, Pseudomonas aeruginosa PA01
cgccacgcugcug

SEQ ID NO: 3428143 - RNA, 18 nt, Pseudomonas aeruginosa PA01
cgccacgcugcugccggc

SEQ ID NO: 3428144 - RNA, 19 nt, Pseudomonas aeruginosa PA01
cgccacgcugcugccggcc

SEQ ID NO: 3428145 - RNA, 19 nt, Pseudomonas aeruginosa PA01
cgccacggaaggccacgcc

SEQ ID NO: 3428146 - RNA, 16 nt, Pseudomonas aeruginosa PA01
cgccacggccagcagg

SEQ ID NO: 3428147 - RNA, 16 nt, Pseudomonas aeruginosa PA01
cgccacggcgaucgcc

SEQ ID NO: 3428148 - RNA, 19 nt, Pseudomonas aeruginosa PA01
cgccacggcgaucgccggg

SEQ ID NO: 3428149 - RNA, 22 nt, Pseudomonas aeruginosa PA01
cgccacggcgcgcuccggcgcg

SEQ ID NO: 3428150 - RNA, 15 nt, Pseudomonas aeruginosa PA01
cgccacggguaacgg

SEQ ID NO: 3428151 - RNA, 15 nt, Pseudomonas aeruginosa PA01
cgccacgugcacgcc

SEQ ID NO: 3428152 - RNA, 19 nt, Pseudomonas aeruginosa PA01
cgccacgugcacgccgugc

SEQ ID NO: 3428153 - RNA, 20 nt, Pseudomonas aeruginosa PA01
cgccacgugcacgccgugca

SEQ ID NO: 3428154 - RNA, 14 nt, Pseudomonas aeruginosa PA01
cgccacucgcgacg

SEQ ID NO: 3428155 - RNA, 12 nt, Pseudomonas aeruginosa PA01
cgccacucggcg

SEQ ID NO: 3428156 - RNA, 16 nt, Pseudomonas aeruginosa PA01
cgccacucggcgugcc

SEQ ID NO: 3428157 - RNA, 22 nt, Pseudomonas aeruginosa PA01
cgccacugaacuggaucggccc

SEQ ID NO: 3428158 - RNA, 20 nt, Pseudomonas aeruginosa PA01
cgccacugauaccgcuggcc

SEQ ID NO: 3428159 - RNA, 23 nt, Pseudomonas aeruginosa PA01
cgccacugcucccaugagcgacc

SEQ ID NO: 3428160 - RNA, 13 nt, Pseudomonas aeruginosa PA01
cgccacuuccagc

SEQ ID NO: 3428161 - RNA, 16 nt, Pseudomonas aeruginosa PA01
cgccacuuccagcacg

SEQ ID NO: 3428162 - RNA, 17 nt, Pseudomonas aeruginosa PA01
cgccacuuccagcacgc

SEQ ID NO: 3428163 - RNA, 19 nt, Pseudomonas aeruginosa PA01
cgccacuuccagcacgccg

SEQ ID NO: 3428164 - RNA, 19 nt, Pseudomonas aeruginosa PA01
cgccagaaagccucaggcg

SEQ ID NO: 3428165 - RNA, 19 nt, Pseudomonas aeruginosa PA01
cgccagaagcgacugucca

SEQ ID NO: 3428166 - RNA, 18 nt, Pseudomonas aeruginosa PA01
cgccagaagcggccgacc

SEQ ID NO: 3428167 - RNA, 15 nt, Pseudomonas aeruginosa PA01
cgccagacaggccag

SEQ ID NO: 3428168 - RNA, 18 nt, Pseudomonas aeruginosa PA01
cgccagacaggccagcuc

SEQ ID NO: 3428169 - RNA, 20 nt, Pseudomonas aeruginosa PA01
cgccagacaggccagcucgc

SEQ ID NO: 3428170 - RNA, 21 nt, Pseudomonas aeruginosa PA01
cgccagagaucgcccagcggc

SEQ ID NO: 3428171 - RNA, 17 nt, Pseudomonas aeruginosa PA01
cgccagagcaggcggau

SEQ ID NO: 3428172 - RNA, 21 nt, Pseudomonas aeruginosa PA01
cgccagagcaggcggaucgcc

SEQ ID NO: 3428173 - RNA, 22 nt, Pseudomonas aeruginosa PA01
cgccagagcaggcggaucgccg

SEQ ID NO: 3428174 - RNA, 15 nt, Pseudomonas aeruginosa PA01
cgccagagcgcgcua

SEQ ID NO: 3428175 - RNA, 19 nt, Pseudomonas aeruginosa PA01
cgccagaugacgauggccg

SEQ ID NO: 3428176 - RNA, 20 nt, Pseudomonas aeruginosa PA01
cgccagaugacgauggccgc

SEQ ID NO: 3428177 - RNA, 14 nt, Pseudomonas aeruginosa PA01
cgccagaugcgcgu

SEQ ID NO: 3428178 - RNA, 15 nt, Pseudomonas aeruginosa PA01
cgccagaugcgcguc

SEQ ID NO: 3428179 - RNA, 23 nt, Pseudomonas aeruginosa PA01
cgccagaugcgcgucgccgaacg

SEQ ID NO: 3428180 - RNA, 13 nt, Pseudomonas aeruginosa PA01
cgccagcaacagu

SEQ ID NO: 3428181 - RNA, 19 nt, Pseudomonas aeruginosa PA01
cgccagcaacaguugccgc

SEQ ID NO: 3428182 - RNA, 20 nt, Pseudomonas aeruginosa PA01
cgccagcaacaguugccgca

SEQ ID NO: 3428183 - RNA, 22 nt, Pseudomonas aeruginosa PA01
cgccagcaacaguugccgcagc

SEQ ID NO: 3428184 - RNA, 16 nt, Pseudomonas aeruginosa PA01
cgccagcaacccgccc

SEQ ID NO: 3428185 - RNA, 13 nt, Pseudomonas aeruginosa PA01
cgccagcaacggc

SEQ ID NO: 3428186 - RNA, 14 nt, Pseudomonas aeruginosa PA01
cgccagcaacggcu

SEQ ID NO: 3428187 - RNA, 16 nt, Pseudomonas aeruginosa PA01
cgccagcaacggcucc

SEQ ID NO: 3428188 - RNA, 18 nt, Pseudomonas aeruginosa PA01
cgccagcaauugccgcug

SEQ ID NO: 3428189 - RNA, 20 nt, Pseudomonas aeruginosa PA01
cgccagcaauugccgcugca

SEQ ID NO: 3428190 - RNA, 20 nt, Pseudomonas aeruginosa PA01
cgccagcaccacccggccgc

SEQ ID NO: 3428191 - RNA, 23 nt, Pseudomonas aeruginosa PA01
cgccagcaccacccggccgcgcu

SEQ ID NO: 3428192 - RNA, 13 nt, Pseudomonas aeruginosa PA01
cgccagcaccagc

SEQ ID NO: 3428193 - RNA, 16 nt, Pseudomonas aeruginosa PA01
cgccagcaccagcagg

SEQ ID NO: 3428194 - RNA, 22 nt, Pseudomonas aeruginosa PA01
cgccagcacccagucuucgcug

SEQ ID NO: 3428195 - RNA, 14 nt, Pseudomonas aeruginosa PA01
cgccagcaccgugg

SEQ ID NO: 3428196 - RNA, 22 nt, Pseudomonas aeruginosa PA01
cgccagcaccguggucagcacc

SEQ ID NO: 3428197 - RNA, 20 nt, Pseudomonas aeruginosa PA01
cgccagcaccucguaggccg

SEQ ID NO: 3428198 - RNA, 23 nt, Pseudomonas aeruginosa PA01
cgccagcaccucguaggccgacu

SEQ ID NO: 3428199 - RNA, 14 nt, Pseudomonas aeruginosa PA01
cgccagcacggcgc

SEQ ID NO: 3428200 - RNA, 18 nt, Pseudomonas aeruginosa PA01
cgccagcagacggcacga

SEQ ID NO: 3428201 - RNA, 21 nt, Pseudomonas aeruginosa PA01
cgccagcagacggcacgacgc

SEQ ID NO: 3428202 - RNA, 13 nt, Pseudomonas aeruginosa PA01
cgccagcaggccg

SEQ ID NO: 3428203 - RNA, 14 nt, Pseudomonas aeruginosa PA01
cgccagcaggccga

SEQ ID NO: 3428204 - RNA, 21 nt, Pseudomonas aeruginosa PA01
cgccagcaggccgaaggccag

SEQ ID NO: 3428205 - RNA, 23 nt, Pseudomonas aeruginosa PA01
cgccagcaggccgaaggccagga

SEQ ID NO: 3428206 - RNA, 14 nt, Pseudomonas aeruginosa PA01
cgccagcaggcgau

SEQ ID NO: 3428207 - RNA, 13 nt, Pseudomonas aeruginosa PA01
cgccagcaggcgc

SEQ ID NO: 3428208 - RNA, 20 nt, Pseudomonas aeruginosa PA01
cgccagcaggcgcagcagcg

SEQ ID NO: 3428209 - RNA, 21 nt, Pseudomonas aeruginosa PA01
cgccagcaggcgcagcagcga

SEQ ID NO: 3428210 - RNA, 18 nt, Pseudomonas aeruginosa PA01
cgccagcaggcgcagguc

SEQ ID NO: 3428211 - RNA, 15 nt, Pseudomonas aeruginosa PA01
cgccagcaggcgccg

SEQ ID NO: 3428212 - RNA, 18 nt, Pseudomonas aeruginosa PA01
cgccagcaggcgccggcg

SEQ ID NO: 3428213 - RNA, 20 nt, Pseudomonas aeruginosa PA01
cgccagcaggcgccggcgga

SEQ ID NO: 3428214 - RNA, 14 nt, Pseudomonas aeruginosa PA01
cgccagcaggcgcg

SEQ ID NO: 3428215 - RNA, 14 nt, Pseudomonas aeruginosa PA01
cgccagcaggcugu

SEQ ID NO: 3428216 - RNA, 12 nt, Pseudomonas aeruginosa PA01
cgccagcagguc

SEQ ID NO: 3428217 - RNA, 18 nt, Pseudomonas aeruginosa PA01
cgccagcaggucgcgcug

SEQ ID NO: 3428218 - RNA, 16 nt, Pseudomonas aeruginosa PA01
cgccagcaggucggcc

SEQ ID NO: 3428219 - RNA, 19 nt, Pseudomonas aeruginosa PA01
cgccagcaggucggccugc

SEQ ID NO: 3428220 - RNA, 22 nt, Pseudomonas aeruginosa PA01
cgccagcagguggucgaugggc

SEQ ID NO: 3428221 - RNA, 21 nt, Pseudomonas aeruginosa PA01
cgccagcaguugcaacagcgc

SEQ ID NO: 3428222 - RNA, 22 nt, Pseudomonas aeruginosa PA01
cgccagcaguugcaacagcgcg

SEQ ID NO: 3428223 - RNA, 22 nt, Pseudomonas aeruginosa PA01
cgccagcaucgcaucggcgacc

SEQ ID NO: 3428224 - RNA, 23 nt, Pseudomonas aeruginosa PA01
cgccagcaucgcaucggcgaccu

SEQ ID NO: 3428225 - RNA, 19 nt, Pseudomonas aeruginosa PA01
cgccagccacucccggccc

SEQ ID NO: 3428226 - RNA, 20 nt, Pseudomonas aeruginosa PA01
cgccagccacucccggcccu

SEQ ID NO: 3428227 - RNA, 20 nt, Pseudomonas aeruginosa PA01
cgccagccagagcagcgucg

SEQ ID NO: 3428228 - RNA, 15 nt, Pseudomonas aeruginosa PA01
cgccagccagcccgg

SEQ ID NO: 3428229 - RNA, 22 nt, Pseudomonas aeruginosa PA01
cgccagccagcccggcggugau

SEQ ID NO: 3428230 - RNA, 14 nt, Pseudomonas aeruginosa PA01
cgccagccagccgc

SEQ ID NO: 3428231 - RNA, 15 nt, Pseudomonas aeruginosa PA01
cgccagccagcgcgg

SEQ ID NO: 3428232 - RNA, 18 nt, Pseudomonas aeruginosa PA01
cgccagccagcgcggcuc

SEQ ID NO: 3428233 - RNA, 20 nt, Pseudomonas aeruginosa PA01
cgccagccccaggccgcccu

SEQ ID NO: 3428234 - RNA, 21 nt, Pseudomonas aeruginosa PA01
cgccagccccaggccgcccuu

SEQ ID NO: 3428235 - RNA, 23 nt, Pseudomonas aeruginosa PA01
cgccagccccaggccgcccuuga

SEQ ID NO: 3428236 - RNA, 17 nt, Pseudomonas aeruginosa PA01
cgccagccccaggcgcg

SEQ ID NO: 3428237 - RNA, 20 nt, Pseudomonas aeruginosa PA01
cgccagccccaggcgcggcg

SEQ ID NO: 3428238 - RNA, 15 nt, Pseudomonas aeruginosa PA01
cgccagcccgccacc

SEQ ID NO: 3428239 - RNA, 13 nt, Pseudomonas aeruginosa PA01
cgccagcccggca

SEQ ID NO: 3428240 - RNA, 18 nt, Pseudomonas aeruginosa PA01
cgccagcccggcaggucg

SEQ ID NO: 3428241 - RNA, 20 nt, Pseudomonas aeruginosa PA01
cgccagcccggcaggucgag

SEQ ID NO: 3428242 - RNA, 16 nt, Pseudomonas aeruginosa PA01
cgccagcccgguucag

SEQ ID NO: 3428243 - RNA, 19 nt, Pseudomonas aeruginosa PA01
cgccagcccgguucagcgg

SEQ ID NO: 3428244 - RNA, 12 nt, Pseudomonas aeruginosa PA01
cgccagccgcca

SEQ ID NO: 3428245 - RNA, 15 nt, Pseudomonas aeruginosa PA01
cgccagccgccagga

SEQ ID NO: 3428246 - RNA, 14 nt, Pseudomonas aeruginosa PA01
cgccagccgccauc

SEQ ID NO: 3428247 - RNA, 15 nt, Pseudomonas aeruginosa PA01
cgccagccgcccugg

SEQ ID NO: 3428248 - RNA, 22 nt, Pseudomonas aeruginosa PA01
cgccagccgcccuggcucuggg

SEQ ID NO: 3428249 - RNA, 17 nt, Pseudomonas aeruginosa PA01
cgccagccuacugggcg

SEQ ID NO: 3428250 - RNA, 11 nt, Pseudomonas aeruginosa PA01
cgccagccucg

SEQ ID NO: 3428251 - RNA, 17 nt, Pseudomonas aeruginosa PA01
cgccagccucggcgaag

SEQ ID NO: 3428252 - RNA, 20 nt, Pseudomonas aeruginosa PA01
cgccagccucggcgaagucg

SEQ ID NO: 3428253 - RNA, 22 nt, Pseudomonas aeruginosa PA01
cgccagccucggcgaagucguu

SEQ ID NO: 3428254 - RNA, 12 nt, Pseudomonas aeruginosa PA01
cgccagcgcacc

SEQ ID NO: 3428255 - RNA, 13 nt, Pseudomonas aeruginosa PA01
cgccagcgcaccu

SEQ ID NO: 3428256 - RNA, 16 nt, Pseudomonas aeruginosa PA01
cgccagcgccacggcg

SEQ ID NO: 3428257 - RNA, 18 nt, Pseudomonas aeruginosa PA01
cgccagcgccacggcgau

SEQ ID NO: 3428258 - RNA, 20 nt, Pseudomonas aeruginosa PA01
cgccagcgccacggcgaucg

SEQ ID NO: 3428259 - RNA, 21 nt, Pseudomonas aeruginosa PA01
cgccagcgccacggcgaucgc

SEQ ID NO: 3428260 - RNA, 18 nt, Pseudomonas aeruginosa PA01
cgccagcgccagcaggua

SEQ ID NO: 3428261 - RNA, 16 nt, Pseudomonas aeruginosa PA01
cgccagcgccgccagu

SEQ ID NO: 3428262 - RNA, 13 nt, Pseudomonas aeruginosa PA01
cgccagcgccggc

SEQ ID NO: 3428263 - RNA, 23 nt, Pseudomonas aeruginosa PA01
cgccagcgccggccauugccgcc

SEQ ID NO: 3428264 - RNA, 13 nt, Pseudomonas aeruginosa PA01
cgccagcgcgcgc

SEQ ID NO: 3428265 - RNA, 18 nt, Pseudomonas aeruginosa PA01
cgccagcgcgcgccgaca

SEQ ID NO: 3428266 - RNA, 13 nt, Pseudomonas aeruginosa PA01
cgccagcggccag

SEQ ID NO: 3428267 - RNA, 14 nt, Pseudomonas aeruginosa PA01
cgccagcggccagg

SEQ ID NO: 3428268 - RNA, 15 nt, Pseudomonas aeruginosa PA01
cgccagcggcccggc

SEQ ID NO: 3428269 - RNA, 13 nt, Pseudomonas aeruginosa PA01
cgccagcggcgau

SEQ ID NO: 3428270 - RNA, 17 nt, Pseudomonas aeruginosa PA01
cgccagcggcgaucgcc

SEQ ID NO: 3428271 - RNA, 13 nt, Pseudomonas aeruginosa PA01
cgccagcgggacg

SEQ ID NO: 3428272 - RNA, 19 nt, Pseudomonas aeruginosa PA01
cgccagcgggacgaugccg

SEQ ID NO: 3428273 - RNA, 17 nt, Pseudomonas aeruginosa PA01
cgccagcgguacccgcc

SEQ ID NO: 3428274 - RNA, 18 nt, Pseudomonas aeruginosa PA01
cgccagcgguacccgccg

SEQ ID NO: 3428275 - RNA, 20 nt, Pseudomonas aeruginosa PA01
cgccagcgguacccgccggc

SEQ ID NO: 3428276 - RNA, 21 nt, Pseudomonas aeruginosa PA01
cgccagcgguacccgccggcc

SEQ ID NO: 3428277 - RNA, 23 nt, Pseudomonas aeruginosa PA01
cgccagcgguacccgccggccau

SEQ ID NO: 3428278 - RNA, 14 nt, Pseudomonas aeruginosa PA01
cgccagcgucgccg

SEQ ID NO: 3428279 - RNA, 17 nt, Pseudomonas aeruginosa PA01
cgccagcgucgccgccg

SEQ ID NO: 3428280 - RNA, 19 nt, Pseudomonas aeruginosa PA01
cgccagcguuucgaagccg

SEQ ID NO: 3428281 - RNA, 23 nt, Pseudomonas aeruginosa PA01
cgccagcguuucgaagccgccgc

SEQ ID NO: 3428282 - RNA, 17 nt, Pseudomonas aeruginosa PA01
cgccagcuaccggcagg

SEQ ID NO: 3428283 - RNA, 20 nt, Pseudomonas aeruginosa PA01
cgccagcuaccggcaggguc

SEQ ID NO: 3428284 - RNA, 13 nt, Pseudomonas aeruginosa PA01
cgccagcucaugg

SEQ ID NO: 3428285 - RNA, 18 nt, Pseudomonas aeruginosa PA01
cgccagcuccagcgccca

SEQ ID NO: 3428286 - RNA, 22 nt, Pseudomonas aeruginosa PA01
cgccagcuccagcgcccaggug

SEQ ID NO: 3428287 - RNA, 15 nt, Pseudomonas aeruginosa PA01
cgccagcucgaacag

SEQ ID NO: 3428288 - RNA, 19 nt, Pseudomonas aeruginosa PA01
cgccagcucgaacagcacc

SEQ ID NO: 3428289 - RNA, 22 nt, Pseudomonas aeruginosa PA01
cgccagcucgaacagcaccgag

SEQ ID NO: 3428290 - RNA, 23 nt, Pseudomonas aeruginosa PA01
cgccagcucgaacagcaccgagc

SEQ ID NO: 3428291 - RNA, 15 nt, Pseudomonas aeruginosa PA01
cgccagcucgccgcg

SEQ ID NO: 3428292 - RNA, 16 nt, Pseudomonas aeruginosa PA01
cgccagcucgccgcgc

SEQ ID NO: 3428293 - RNA, 16 nt, Pseudomonas aeruginosa PA01
cgccagcucgcugucc

SEQ ID NO: 3428294 - RNA, 21 nt, Pseudomonas aeruginosa PA01
cgccagcucgcuguccagcac

SEQ ID NO: 3428295 - RNA, 23 nt, Pseudomonas aeruginosa PA01
cgccagcucgcuguccagcacca

SEQ ID NO: 3428296 - RNA, 11 nt, Pseudomonas aeruginosa PA01
cgccagcucgg

SEQ ID NO: 3428297 - RNA, 15 nt, Pseudomonas aeruginosa PA01
cgccagcucggccgg

SEQ ID NO: 3428298 - RNA, 16 nt, Pseudomonas aeruginosa PA01
cgccagcucggccggc

SEQ ID NO: 3428299 - RNA, 17 nt, Pseudomonas aeruginosa PA01
cgccagcucggccggca

SEQ ID NO: 3428300 - RNA, 23 nt, Pseudomonas aeruginosa PA01
cgccagcucggccggcaggcugu

SEQ ID NO: 3428301 - RNA, 15 nt, Pseudomonas aeruginosa PA01
cgccagcucggccug

SEQ ID NO: 3428302 - RNA, 18 nt, Pseudomonas aeruginosa PA01
cgccaggaacgccucugc

SEQ ID NO: 3428303 - RNA, 20 nt, Pseudomonas aeruginosa PA01
cgccaggaagccgcgcccca

SEQ ID NO: 3428304 - RNA, 21 nt, Pseudomonas aeruginosa PA01
cgccaggaagccgcgccccag

SEQ ID NO: 3428305 - RNA, 22 nt, Pseudomonas aeruginosa PA01
cgccaggaagccgcgccccagc

SEQ ID NO: 3428306 - RNA, 14 nt, Pseudomonas aeruginosa PA01
cgccaggaccuccu

SEQ ID NO: 3428307 - RNA, 16 nt, Pseudomonas aeruginosa PA01
cgccaggaccuccugc

SEQ ID NO: 3428308 - RNA, 17 nt, Pseudomonas aeruginosa PA01
cgccaggaccuccugca

SEQ ID NO: 3428309 - RNA, 16 nt, Pseudomonas aeruginosa PA01
cgccaggacggcaggg

SEQ ID NO: 3428310 - RNA, 18 nt, Pseudomonas aeruginosa PA01
cgccaggacggcaggguc

SEQ ID NO: 3428311 - RNA, 20 nt, Pseudomonas aeruginosa PA01
cgccaggacggcagggucag

SEQ ID NO: 3428312 - RNA, 17 nt, Pseudomonas aeruginosa PA01
cgccaggacucgccauc

SEQ ID NO: 3428313 - RNA, 18 nt, Pseudomonas aeruginosa PA01
cgccaggacucgccaucg

SEQ ID NO: 3428314 - RNA, 14 nt, Pseudomonas aeruginosa PA01
cgccaggagcaggg

SEQ ID NO: 3428315 - RNA, 17 nt, Pseudomonas aeruginosa PA01
cgccaggagcagggcgc

SEQ ID NO: 3428316 - RNA, 20 nt, Pseudomonas aeruginosa PA01
cgccaggagcagggcgccga

SEQ ID NO: 3428317 - RNA, 13 nt, Pseudomonas aeruginosa PA01
cgccaggaucggc

SEQ ID NO: 3428318 - RNA, 14 nt, Pseudomonas aeruginosa PA01
cgccaggaucggca

SEQ ID NO: 3428319 - RNA, 19 nt, Pseudomonas aeruginosa PA01
cgccaggcagaccaggccg

SEQ ID NO: 3428320 - RNA, 16 nt, Pseudomonas aeruginosa PA01
cgccaggcagaccugc

SEQ ID NO: 3428321 - RNA, 17 nt, Pseudomonas aeruginosa PA01
cgccaggcagaccugca

SEQ ID NO: 3428322 - RNA, 19 nt, Pseudomonas aeruginosa PA01
cgccaggcagaccugcagc

SEQ ID NO: 3428323 - RNA, 13 nt, Pseudomonas aeruginosa PA01
cgccaggcaggcc

SEQ ID NO: 3428324 - RNA, 14 nt, Pseudomonas aeruginosa PA01
cgccaggcaggccg

SEQ ID NO: 3428325 - RNA, 16 nt, Pseudomonas aeruginosa PA01
cgccaggcaggccggg

SEQ ID NO: 3428326 - RNA, 17 nt, Pseudomonas aeruginosa PA01
cgccaggcaggcgguca

SEQ ID NO: 3428327 - RNA, 22 nt, Pseudomonas aeruginosa PA01
cgccaggcaggcggucagcgcg

SEQ ID NO: 3428328 - RNA, 13 nt, Pseudomonas aeruginosa PA01
cgccaggcagucg

SEQ ID NO: 3428329 - RNA, 23 nt, Pseudomonas aeruginosa PA01
cgccaggcagucguaggucugcc

SEQ ID NO: 3428330 - RNA, 17 nt, Pseudomonas aeruginosa PA01
cgccaggcccacgccca

SEQ ID NO: 3428331 - RNA, 12 nt, Pseudomonas aeruginosa PA01
cgccaggcccgg

SEQ ID NO: 3428332 - RNA, 14 nt, Pseudomonas aeruginosa PA01
cgccaggcccggcg

SEQ ID NO: 3428333 - RNA, 18 nt, Pseudomonas aeruginosa PA01
cgccaggcccggcgcugc

SEQ ID NO: 3428334 - RNA, 20 nt, Pseudomonas aeruginosa PA01
cgccaggcccggcgcugcuu

SEQ ID NO: 3428335 - RNA, 12 nt, Pseudomonas aeruginosa PA01
cgccaggcccuc

SEQ ID NO: 3428336 - RNA, 16 nt, Pseudomonas aeruginosa PA01
cgccaggcccugggcg

SEQ ID NO: 3428337 - RNA, 18 nt, Pseudomonas aeruginosa PA01
cgccaggcccugggcggc

SEQ ID NO: 3428338 - RNA, 19 nt, Pseudomonas aeruginosa PA01
cgccaggcccugggcggcg

SEQ ID NO: 3428339 - RNA, 20 nt, Pseudomonas aeruginosa PA01
cgccaggcccugggcggcgg

SEQ ID NO: 3428340 - RNA, 20 nt, Pseudomonas aeruginosa PA01
cgccaggccgaucagcgccu

SEQ ID NO: 3428341 - RNA, 14 nt, Pseudomonas aeruginosa PA01
cgccaggccgccga

SEQ ID NO: 3428342 - RNA, 19 nt, Pseudomonas aeruginosa PA01
cgccaggccgccgaagaac

SEQ ID NO: 3428343 - RNA, 12 nt, Pseudomonas aeruginosa PA01
cgccaggccgcg

SEQ ID NO: 3428344 - RNA, 13 nt, Pseudomonas aeruginosa PA01
cgccaggccgcgc

SEQ ID NO: 3428345 - RNA, 15 nt, Pseudomonas aeruginosa PA01
cgccaggccgcgcag

SEQ ID NO: 3428346 - RNA, 19 nt, Pseudomonas aeruginosa PA01
cgccaggccgcgcaguccc

SEQ ID NO: 3428347 - RNA, 22 nt, Pseudomonas aeruginosa PA01
cgccaggccgcuuuccacccga

SEQ ID NO: 3428348 - RNA, 16 nt, Pseudomonas aeruginosa PA01
cgccaggccggagccg

SEQ ID NO: 3428349 - RNA, 18 nt, Pseudomonas aeruginosa PA01
cgccaggccggcgagggc

SEQ ID NO: 3428350 - RNA, 23 nt, Pseudomonas aeruginosa PA01
cgccaggccggcgagggcggcga

SEQ ID NO: 3428351 - RNA, 16 nt, Pseudomonas aeruginosa PA01
cgccaggccggugcag

SEQ ID NO: 3428352 - RNA, 17 nt, Pseudomonas aeruginosa PA01
cgccaggccggugcaga

SEQ ID NO: 3428353 - RNA, 23 nt, Pseudomonas aeruginosa PA01
cgccaggccguagaccaccagca

SEQ ID NO: 3428354 - RNA, 23 nt, Pseudomonas aeruginosa PA01
cgccaggccucagaacugcucgg

SEQ ID NO: 3428355 - RNA, 15 nt, Pseudomonas aeruginosa PA01
cgccaggccucggcg

SEQ ID NO: 3428356 - RNA, 16 nt, Pseudomonas aeruginosa PA01
cgccaggccucggcgc

SEQ ID NO: 3428357 - RNA, 18 nt, Pseudomonas aeruginosa PA01
cgccaggccucggcgcgg

SEQ ID NO: 3428358 - RNA, 17 nt, Pseudomonas aeruginosa PA01
cgccaggccuugcagca

SEQ ID NO: 3428359 - RNA, 18 nt, Pseudomonas aeruginosa PA01
cgccaggccuugcagcaa

SEQ ID NO: 3428360 - RNA, 12 nt, Pseudomonas aeruginosa PA01
cgccaggcgaag

SEQ ID NO: 3428361 - RNA, 23 nt, Pseudomonas aeruginosa PA01
cgccaggcgaagaaagccccugc

SEQ ID NO: 3428362 - RNA, 13 nt, Pseudomonas aeruginosa PA01
cgccaggcgaucc

SEQ ID NO: 3428363 - RNA, 16 nt, Pseudomonas aeruginosa PA01
cgccaggcgauccagc

SEQ ID NO: 3428364 - RNA, 13 nt, Pseudomonas aeruginosa PA01
cgccaggcgcaag

SEQ ID NO: 3428365 - RNA, 13 nt, Pseudomonas aeruginosa PA01
cgccaggcgccga

SEQ ID NO: 3428366 - RNA, 15 nt, Pseudomonas aeruginosa PA01
cgccaggcgccgauc

SEQ ID NO: 3428367 - RNA, 22 nt, Pseudomonas aeruginosa PA01
cgccaggcgcgguugccgcugc

SEQ ID NO: 3428368 - RNA, 23 nt, Pseudomonas aeruginosa PA01
cgccaggcgcgguugccgcugcg

SEQ ID NO: 3428369 - RNA, 13 nt, Pseudomonas aeruginosa PA01
cgccaggcgcguc

SEQ ID NO: 3428370 - RNA, 17 nt, Pseudomonas aeruginosa PA01
cgccaggcgcgucgcgg

SEQ ID NO: 3428371 - RNA, 23 nt, Pseudomonas aeruginosa PA01
cgccaggcgcgucuccagcucgg

SEQ ID NO: 3428372 - RNA, 11 nt, Pseudomonas aeruginosa PA01
cgccaggcgcu

SEQ ID NO: 3428373 - RNA, 18 nt, Pseudomonas aeruginosa PA01
cgccaggcggagcauggu

SEQ ID NO: 3428374 - RNA, 14 nt, Pseudomonas aeruginosa PA01
cgccaggcggccga

SEQ ID NO: 3428375 - RNA, 17 nt, Pseudomonas aeruginosa PA01
cgccaggcggccgaaga

SEQ ID NO: 3428376 - RNA, 15 nt, Pseudomonas aeruginosa PA01
cgccaggcggccgcu

SEQ ID NO: 3428377 - RNA, 16 nt, Pseudomonas aeruginosa PA01
cgccaggcggccgcug

SEQ ID NO: 3428378 - RNA, 20 nt, Pseudomonas aeruginosa PA01
cgccaggcgucccguuccgc

SEQ ID NO: 3428379 - RNA, 14 nt, Pseudomonas aeruginosa PA01
cgccaggcgugcag

SEQ ID NO: 3428380 - RNA, 15 nt, Pseudomonas aeruginosa PA01
cgccaggcgugcaga

SEQ ID NO: 3428381 - RNA, 18 nt, Pseudomonas aeruginosa PA01
cgccaggcgugcagaccg

SEQ ID NO: 3428382 - RNA, 14 nt, Pseudomonas aeruginosa PA01
cgccaggcugaucc

SEQ ID NO: 3428383 - RNA, 17 nt, Pseudomonas aeruginosa PA01
cgccaggcugauccgcg

SEQ ID NO: 3428384 - RNA, 18 nt, Pseudomonas aeruginosa PA01
cgccaggcuuuccgccga

SEQ ID NO: 3428385 - RNA, 20 nt, Pseudomonas aeruginosa PA01
cgccaggcuuuccgccgagc

SEQ ID NO: 3428386 - RNA, 16 nt, Pseudomonas aeruginosa PA01
cgccagggacgcgcag

SEQ ID NO: 3428387 - RNA, 15 nt, Pseudomonas aeruginosa PA01
cgccagggagcagga

SEQ ID NO: 3428388 - RNA, 18 nt, Pseudomonas aeruginosa PA01
cgccagggagcaggacgc

SEQ ID NO: 3428389 - RNA, 23 nt, Pseudomonas aeruginosa PA01
cgccagggagcaggacgccgaac

SEQ ID NO: 3428390 - RNA, 21 nt, Pseudomonas aeruginosa PA01
cgccagggccagggaaaucag

SEQ ID NO: 3428391 - RNA, 22 nt, Pseudomonas aeruginosa PA01
cgccagggcccacagugccagg

SEQ ID NO: 3428392 - RNA, 13 nt, Pseudomonas aeruginosa PA01
cgccagggccggg

SEQ ID NO: 3428393 - RNA, 20 nt, Pseudomonas aeruginosa PA01
cgccagggcgcucaccgagg

SEQ ID NO: 3428394 - RNA, 18 nt, Pseudomonas aeruginosa PA01
cgccagggggaucgcgaa

SEQ ID NO: 3428395 - RNA, 20 nt, Pseudomonas aeruginosa PA01
cgccagggggaucgcgaaga

SEQ ID NO: 3428396 - RNA, 22 nt, Pseudomonas aeruginosa PA01
cgccagggggaucgcgaagaac

SEQ ID NO: 3428397 - RNA, 17 nt, Pseudomonas aeruginosa PA01
cgccaggggugccuugc

SEQ ID NO: 3428398 - RNA, 20 nt, Pseudomonas aeruginosa PA01
cgccagggucagcucgacag

SEQ ID NO: 3428399 - RNA, 17 nt, Pseudomonas aeruginosa PA01
cgccagggugcugccca

SEQ ID NO: 3428400 - RNA, 23 nt, Pseudomonas aeruginosa PA01
cgccagggugcugcccagggccc

SEQ ID NO: 3428401 - RNA, 19 nt, Pseudomonas aeruginosa PA01
cgccaggguguuguucgcc

SEQ ID NO: 3428402 - RNA, 23 nt, Pseudomonas aeruginosa PA01
cgccaggguguuguucgccagca

SEQ ID NO: 3428403 - RNA, 23 nt, Pseudomonas aeruginosa PA01
cgccagguaauagccguugaggc

SEQ ID NO: 3428404 - RNA, 14 nt, Pseudomonas aeruginosa PA01
cgccagguagccug

SEQ ID NO: 3428405 - RNA, 18 nt, Pseudomonas aeruginosa PA01
cgccagguagccuggaua

SEQ ID NO: 3428406 - RNA, 23 nt, Pseudomonas aeruginosa PA01
cgccagguagccuggauacgggc

SEQ ID NO: 3428407 - RNA, 16 nt, Pseudomonas aeruginosa PA01
cgccagguagugccgc

SEQ ID NO: 3428408 - RNA, 20 nt, Pseudomonas aeruginosa PA01
cgccagguagugccgcccuu

SEQ ID NO: 3428409 - RNA, 22 nt, Pseudomonas aeruginosa PA01
cgccagguagugccgcccuugc

SEQ ID NO: 3428410 - RNA, 23 nt, Pseudomonas aeruginosa PA01
cgccagguccaggcucagcucuc

SEQ ID NO: 3428411 - RNA, 23 nt, Pseudomonas aeruginosa PA01
cgccagguccgccugguccagca

SEQ ID NO: 3428412 - RNA, 15 nt, Pseudomonas aeruginosa PA01
cgccaggucgagggc

SEQ ID NO: 3428413 - RNA, 14 nt, Pseudomonas aeruginosa PA01
cgccaggucgaucc

SEQ ID NO: 3428414 - RNA, 22 nt, Pseudomonas aeruginosa PA01
cgccaggugcaggaagcgccgg

SEQ ID NO: 3428415 - RNA, 20 nt, Pseudomonas aeruginosa PA01
cgccagguggaagcgcgcgu

SEQ ID NO: 3428416 - RNA, 17 nt, Pseudomonas aeruginosa PA01
cgccagguguacaucgg

SEQ ID NO: 3428417 - RNA, 18 nt, Pseudomonas aeruginosa PA01
cgccagguguacaucggg

SEQ ID NO: 3428418 - RNA, 23 nt, Pseudomonas aeruginosa PA01
cgccagguucaauccuuccgucg

SEQ ID NO: 3428419 - RNA, 17 nt, Pseudomonas aeruginosa PA01
cgccagguugcgcaacc

SEQ ID NO: 3428420 - RNA, 22 nt, Pseudomonas aeruginosa PA01
cgccagguugcgcaaccagcgc

SEQ ID NO: 3428421 - RNA, 23 nt, Pseudomonas aeruginosa PA01
cgccagguugcgcaaccagcgcu

SEQ ID NO: 3428422 - RNA, 22 nt, Pseudomonas aeruginosa PA01
cgccagguugcguuccaacugg

SEQ ID NO: 3428423 - RNA, 19 nt, Pseudomonas aeruginosa PA01
cgccagguuggccuggccc

SEQ ID NO: 3428424 - RNA, 21 nt, Pseudomonas aeruginosa PA01
cgccagguuggccuggcccgg

SEQ ID NO: 3428425 - RNA, 23 nt, Pseudomonas aeruginosa PA01
cgccagguuggccuggcccggcg

SEQ ID NO: 3428426 - RNA, 15 nt, Pseudomonas aeruginosa PA01
cgccaguacuccgag

SEQ ID NO: 3428427 - RNA, 20 nt, Pseudomonas aeruginosa PA01
cgccaguacuccgagggccg

SEQ ID NO: 3428428 - RNA, 22 nt, Pseudomonas aeruginosa PA01
cgccaguacuccgagggccgcg

SEQ ID NO: 3428429 - RNA, 15 nt, Pseudomonas aeruginosa PA01
cgccagucauugcgc

SEQ ID NO: 3428430 - RNA, 17 nt, Pseudomonas aeruginosa PA01
cgccaguccacgacgaa

SEQ ID NO: 3428431 - RNA, 13 nt, Pseudomonas aeruginosa PA01
cgccagucggccu

SEQ ID NO: 3428432 - RNA, 14 nt, Pseudomonas aeruginosa PA01
cgccagucggccug

SEQ ID NO: 3428433 - RNA, 15 nt, Pseudomonas aeruginosa PA01
cgccagucggccugg

SEQ ID NO: 3428434 - RNA, 16 nt, Pseudomonas aeruginosa PA01
cgccagucggccuggc

SEQ ID NO: 3428435 - RNA, 19 nt, Pseudomonas aeruginosa PA01
cgccagugcagccguugcc

SEQ ID NO: 3428436 - RNA, 21 nt, Pseudomonas aeruginosa PA01
cgccagugcaugcguucgccg

SEQ ID NO: 3428437 - RNA, 17 nt, Pseudomonas aeruginosa PA01
cgccagugccugcacca

SEQ ID NO: 3428438 - RNA, 20 nt, Pseudomonas aeruginosa PA01
cgccagugccugcaccacgc

SEQ ID NO: 3428439 - RNA, 24 nt, Pseudomonas aeruginosa PA01
cgccagugccugcaccacgcaggc

SEQ ID NO: 3428440 - RNA, 23 nt, Pseudomonas aeruginosa PA01
cgccaguuccggggucagcgccu

SEQ ID NO: 3428441 - RNA, 17 nt, Pseudomonas aeruginosa PA01
cgccaguuccgugucga

SEQ ID NO: 3428442 - RNA, 20 nt, Pseudomonas aeruginosa PA01
cgccaguuccgugucgaggg

SEQ ID NO: 3428443 - RNA, 21 nt, Pseudomonas aeruginosa PA01
cgccaguuccgugucgagggc

SEQ ID NO: 3428444 - RNA, 22 nt, Pseudomonas aeruginosa PA01
cgccaguuccuucgccgaaagc

SEQ ID NO: 3428445 - RNA, 14 nt, Pseudomonas aeruginosa PA01
cgccaguucgccgg

SEQ ID NO: 3428446 - RNA, 17 nt, Pseudomonas aeruginosa PA01
cgccaguucgccgguga

SEQ ID NO: 3428447 - RNA, 23 nt, Pseudomonas aeruginosa PA01
cgccaguucgccggugacgcugc

SEQ ID NO: 3428448 - RNA, 15 nt, Pseudomonas aeruginosa PA01
cgccaguucgcgcag

SEQ ID NO: 3428449 - RNA, 20 nt, Pseudomonas aeruginosa PA01
cgccaguucggccaucagca

SEQ ID NO: 3428450 - RNA, 21 nt, Pseudomonas aeruginosa PA01
cgccaguucggccaucagcac

SEQ ID NO: 3428451 - RNA, 22 nt, Pseudomonas aeruginosa PA01
cgccaguucggccaucagcacg

SEQ ID NO: 3428452 - RNA, 13 nt, Pseudomonas aeruginosa PA01
cgccaguucucgc

SEQ ID NO: 3428453 - RNA, 16 nt, Pseudomonas aeruginosa PA01
cgccaguucucgcagc

SEQ ID NO: 3428454 - RNA, 18 nt, Pseudomonas aeruginosa PA01
cgccaguucucgcagcag

SEQ ID NO: 3428455 - RNA, 21 nt, Pseudomonas aeruginosa PA01
cgccaguucucgcagcaggcg

SEQ ID NO: 3428456 - RNA, 21 nt, Pseudomonas aeruginosa PA01
cgccaguugcuugaucgccag

SEQ ID NO: 3428457 - RNA, 15 nt, Pseudomonas aeruginosa PA01
cgccaguuggacgcg

SEQ ID NO: 3428458 - RNA, 17 nt, Pseudomonas aeruginosa PA01
cgccaguuggacgcggc

SEQ ID NO: 3428459 - RNA, 20 nt, Pseudomonas aeruginosa PA01
cgccaguuggacgcggccug

SEQ ID NO: 3428460 - RNA, 21 nt, Pseudomonas aeruginosa PA01
cgccaguuggacgcggccugg

SEQ ID NO: 3428461 - RNA, 15 nt, Pseudomonas aeruginosa PA01
cgccauaccccacgg

SEQ ID NO: 3428462 - RNA, 16 nt, Pseudomonas aeruginosa PA01
cgccauacugggcggc

SEQ ID NO: 3428463 - RNA, 13 nt, Pseudomonas aeruginosa PA01
cgccauaggccag

SEQ ID NO: 3428464 - RNA, 18 nt, Pseudomonas aeruginosa PA01
cgccauaggccagcaccu

SEQ ID NO: 3428465 - RNA, 18 nt, Pseudomonas aeruginosa PA01
cgccauaggcggcgcaga

SEQ ID NO: 3428466 - RNA, 14 nt, Pseudomonas aeruginosa PA01
cgccauagggcacc

SEQ ID NO: 3428467 - RNA, 17 nt, Pseudomonas aeruginosa PA01
cgccauagggcacccgg

SEQ ID NO: 3428468 - RNA, 15 nt, Pseudomonas aeruginosa PA01
cgccauauagcgcug

SEQ ID NO: 3428469 - RNA, 20 nt, Pseudomonas aeruginosa PA01
cgccaucaacggauaucccc

SEQ ID NO: 3428470 - RNA, 17 nt, Pseudomonas aeruginosa PA01
cgccaucaccagcggcg

SEQ ID NO: 3428471 - RNA, 18 nt, Pseudomonas aeruginosa PA01
cgccaucaccagcggcga

SEQ ID NO: 3428472 - RNA, 20 nt, Pseudomonas aeruginosa PA01
cgccaucaccagcggcgagc

SEQ ID NO: 3428473 - RNA, 22 nt, Pseudomonas aeruginosa PA01
cgccaucaccagcggcgagcag

SEQ ID NO: 3428474 - RNA, 16 nt, Pseudomonas aeruginosa PA01
cgccaucagcacgaaa

SEQ ID NO: 3428475 - RNA, 15 nt, Pseudomonas aeruginosa PA01
cgccaucaggcccuu

SEQ ID NO: 3428476 - RNA, 16 nt, Pseudomonas aeruginosa PA01
cgccaucaguuccucg

SEQ ID NO: 3428477 - RNA, 18 nt, Pseudomonas aeruginosa PA01
cgccaucaguuccucgcg

SEQ ID NO: 3428478 - RNA, 12 nt, Pseudomonas aeruginosa PA01
cgccauccgccu

SEQ ID NO: 3428479 - RNA, 13 nt, Pseudomonas aeruginosa PA01
cgccauccgccuu

SEQ ID NO: 3428480 - RNA, 14 nt, Pseudomonas aeruginosa PA01
cgccauccgccuuc

SEQ ID NO: 3428481 - RNA, 16 nt, Pseudomonas aeruginosa PA01
cgccauccuccagcgc

SEQ ID NO: 3428482 - RNA, 21 nt, Pseudomonas aeruginosa PA01
cgccauccuccagcgccgcau

SEQ ID NO: 3428483 - RNA, 15 nt, Pseudomonas aeruginosa PA01
cgccauccuucggcg

SEQ ID NO: 3428484 - RNA, 16 nt, Pseudomonas aeruginosa PA01
cgccaucgaucagcag

SEQ ID NO: 3428485 - RNA, 21 nt, Pseudomonas aeruginosa PA01
cgccaucgauggucacuggcg

SEQ ID NO: 3428486 - RNA, 16 nt, Pseudomonas aeruginosa PA01
cgccaucgauggucag

SEQ ID NO: 3428487 - RNA, 19 nt, Pseudomonas aeruginosa PA01
cgccaucgauggucaggcu

SEQ ID NO: 3428488 - RNA, 19 nt, Pseudomonas aeruginosa PA01
cgccaucgcccgguugccu

SEQ ID NO: 3428489 - RNA, 17 nt, Pseudomonas aeruginosa PA01
cgccaucgccucgccgg

SEQ ID NO: 3428490 - RNA, 18 nt, Pseudomonas aeruginosa PA01
cgccaucgccucgccggc

SEQ ID NO: 3428491 - RNA, 19 nt, Pseudomonas aeruginosa PA01
cgccaucgccucgccggcc

SEQ ID NO: 3428492 - RNA, 15 nt, Pseudomonas aeruginosa PA01
cgccaucgcucaccg

SEQ ID NO: 3428493 - RNA, 16 nt, Pseudomonas aeruginosa PA01
cgccaucgcucaccgg

SEQ ID NO: 3428494 - RNA, 17 nt, Pseudomonas aeruginosa PA01
cgccaucgcucaccgga

SEQ ID NO: 3428495 - RNA, 20 nt, Pseudomonas aeruginosa PA01
cgccaucgcuuuccuggccg

SEQ ID NO: 3428496 - RNA, 23 nt, Pseudomonas aeruginosa PA01
cgccaucgcuuuccuggccgacc

SEQ ID NO: 3428497 - RNA, 19 nt, Pseudomonas aeruginosa PA01
cgccaucggccuggggcuc

SEQ ID NO: 3428498 - RNA, 15 nt, Pseudomonas aeruginosa PA01
cgccaucggcgguac

SEQ ID NO: 3428499 - RNA, 13 nt, Pseudomonas aeruginosa PA01
cgccaucggucgc

SEQ ID NO: 3428500 - RNA, 18 nt, Pseudomonas aeruginosa PA01
cgccaucggucgcgcccc

SEQ ID NO: 3428501 - RNA, 13 nt, Pseudomonas aeruginosa PA01
cgccaucuccucg

SEQ ID NO: 3428502 - RNA, 15 nt, Pseudomonas aeruginosa PA01
cgccaucuccucgcu

SEQ ID NO: 3428503 - RNA, 17 nt, Pseudomonas aeruginosa PA01
cgccaucuccucgcuga

SEQ ID NO: 3428504 - RNA, 18 nt, Pseudomonas aeruginosa PA01
cgccaugcaagaacgccg

SEQ ID NO: 3428505 - RNA, 20 nt, Pseudomonas aeruginosa PA01
cgccaugcaagaacgccgac

SEQ ID NO: 3428506 - RNA, 14 nt, Pseudomonas aeruginosa PA01
cgccaugccggcgc

SEQ ID NO: 3428507 - RNA, 16 nt, Pseudomonas aeruginosa PA01
cgccaugccggcgccg

SEQ ID NO: 3428508 - RNA, 17 nt, Pseudomonas aeruginosa PA01
cgccaugccggcgccga

SEQ ID NO: 3428509 - RNA, 23 nt, Pseudomonas aeruginosa PA01
cgccaugccguucaggccggcgc

SEQ ID NO: 3428510 - RNA, 18 nt, Pseudomonas aeruginosa PA01
cgccaugcgcccgcugaa

SEQ ID NO: 3428511 - RNA, 16 nt, Pseudomonas aeruginosa PA01
cgccaugcggcaggcc

SEQ ID NO: 3428512 - RNA, 18 nt, Pseudomonas aeruginosa PA01
cgccaugcggcaggccuu

SEQ ID NO: 3428513 - RNA, 23 nt, Pseudomonas aeruginosa PA01
cgccaugcggcaggccuuccacg

SEQ ID NO: 3428514 - RNA, 16 nt, Pseudomonas aeruginosa PA01
cgccaugcucggccag

SEQ ID NO: 3428515 - RNA, 17 nt, Pseudomonas aeruginosa PA01
cgccaugcucggccagc

SEQ ID NO: 3428516 - RNA, 19 nt, Pseudomonas aeruginosa PA01
cgccaugcucggccagcuc

SEQ ID NO: 3428517 - RNA, 20 nt, Pseudomonas aeruginosa PA01
cgccaugcucggccagcucg

SEQ ID NO: 3428518 - RNA, 22 nt, Pseudomonas aeruginosa PA01
cgccaugcucggccagcucgcc

SEQ ID NO: 3428519 - RNA, 23 nt, Pseudomonas aeruginosa PA01
cgccaugcucuucaggcugucgg

SEQ ID NO: 3428520 - RNA, 21 nt, Pseudomonas aeruginosa PA01
cgccaugcuguugccguggcg

SEQ ID NO: 3428521 - RNA, 22 nt, Pseudomonas aeruginosa PA01
cgccaugcuguugccguggcgg

SEQ ID NO: 3428522 - RNA, 13 nt, Pseudomonas aeruginosa PA01
cgccauggccgcu

SEQ ID NO: 3428523 - RNA, 15 nt, Pseudomonas aeruginosa PA01
cgccauggccgcuga

SEQ ID NO: 3428524 - RNA, 19 nt, Pseudomonas aeruginosa PA01
cgccauggccuggaaaugg

SEQ ID NO: 3428525 - RNA, 17 nt, Pseudomonas aeruginosa PA01
cgccauggggaucaccg

SEQ ID NO: 3428526 - RNA, 18 nt, Pseudomonas aeruginosa PA01
cgccauggggaucaccgg

SEQ ID NO: 3428527 - RNA, 21 nt, Pseudomonas aeruginosa PA01
cgccauggguggaacccgcuu

SEQ ID NO: 3428528 - RNA, 20 nt, Pseudomonas aeruginosa PA01
cgccauggucguucagcggc

SEQ ID NO: 3428529 - RNA, 20 nt, Pseudomonas aeruginosa PA01
cgccauguuccacaugcgcu

SEQ ID NO: 3428530 - RNA, 23 nt, Pseudomonas aeruginosa PA01
cgccauguuccacaugcgcucgu

SEQ ID NO: 3428531 - RNA, 14 nt, Pseudomonas aeruginosa PA01
cgccauucaggcgg

SEQ ID NO: 3428532 - RNA, 13 nt, Pseudomonas aeruginosa PA01
cgccauuccgcgg

SEQ ID NO: 3428533 - RNA, 20 nt, Pseudomonas aeruginosa PA01
cgccauucgaauggcgccgg

SEQ ID NO: 3428534 - RNA, 21 nt, Pseudomonas aeruginosa PA01
cgccauucgaauggcgccggc

SEQ ID NO: 3428535 - RNA, 15 nt, Pseudomonas aeruginosa PA01
cgccauucggcgacg

SEQ ID NO: 3428536 - RNA, 17 nt, Pseudomonas aeruginosa PA01
cgccauucggcgacggg

SEQ ID NO: 3428537 - RNA, 18 nt, Pseudomonas aeruginosa PA01
cgccauuggccaggguca

SEQ ID NO: 3428538 - RNA, 23 nt, Pseudomonas aeruginosa PA01
cgccauuggccagggucacgcca

SEQ ID NO: 3428539 - RNA, 20 nt, Pseudomonas aeruginosa PA01
cgccauugugcgcgcgcaga

SEQ ID NO: 3428540 - RNA, 15 nt, Pseudomonas aeruginosa PA01
cgccauuucaaggcg

SEQ ID NO: 3428541 - RNA, 14 nt, Pseudomonas aeruginosa PA01
cgcccaacccccug

SEQ ID NO: 3428542 - RNA, 15 nt, Pseudomonas aeruginosa PA01
cgcccaacccccugu

SEQ ID NO: 3428543 - RNA, 21 nt, Pseudomonas aeruginosa PA01
cgcccaacgucuucaggcgcu

SEQ ID NO: 3428544 - RNA, 22 nt, Pseudomonas aeruginosa PA01
cgcccaacgucuucaggcgcuc

SEQ ID NO: 3428545 - RNA, 18 nt, Pseudomonas aeruginosa PA01
cgcccaaugcaucggccg

SEQ ID NO: 3428546 - RNA, 14 nt, Pseudomonas aeruginosa PA01
cgcccacaaccugc

SEQ ID NO: 3428547 - RNA, 21 nt, Pseudomonas aeruginosa PA01
cgcccacaaccugccgaucgc

SEQ ID NO: 3428548 - RNA, 22 nt, Pseudomonas aeruginosa PA01
cgcccacaaccugccgaucgcc

SEQ ID NO: 3428549 - RNA, 16 nt, Pseudomonas aeruginosa PA01
cgcccaccaggucgcc

SEQ ID NO: 3428550 - RNA, 15 nt, Pseudomonas aeruginosa PA01
cgcccacccugcgcg

SEQ ID NO: 3428551 - RNA, 17 nt, Pseudomonas aeruginosa PA01
cgcccacccugcgcgag

SEQ ID NO: 3428552 - RNA, 12 nt, Pseudomonas aeruginosa PA01
cgcccaccgcgg

SEQ ID NO: 3428553 - RNA, 13 nt, Pseudomonas aeruginosa PA01
cgcccaccuugcg

SEQ ID NO: 3428554 - RNA, 14 nt, Pseudomonas aeruginosa PA01
cgcccacgccuugc

SEQ ID NO: 3428555 - RNA, 21 nt, Pseudomonas aeruginosa PA01
cgcccacgccuugcagcaccg

SEQ ID NO: 3428556 - RNA, 14 nt, Pseudomonas aeruginosa PA01
cgcccacgggcggc

SEQ ID NO: 3428557 - RNA, 12 nt, Pseudomonas aeruginosa PA01
cgcccacuccaa

SEQ ID NO: 3428558 - RNA, 14 nt, Pseudomonas aeruginosa PA01
cgcccacuccuccg

SEQ ID NO: 3428559 - RNA, 21 nt, Pseudomonas aeruginosa PA01
cgcccagacacgccucaaggc

SEQ ID NO: 3428560 - RNA, 12 nt, Pseudomonas aeruginosa PA01
cgcccagaccug

SEQ ID NO: 3428561 - RNA, 18 nt, Pseudomonas aeruginosa PA01
cgcccagaguucgcccag

SEQ ID NO: 3428562 - RNA, 22 nt, Pseudomonas aeruginosa PA01
cgcccagaguucgcccagcucg

SEQ ID NO: 3428563 - RNA, 12 nt, Pseudomonas aeruginosa PA01
cgcccagcacca

SEQ ID NO: 3428564 - RNA, 14 nt, Pseudomonas aeruginosa PA01
cgcccagcaccaca

SEQ ID NO: 3428565 - RNA, 12 nt, Pseudomonas aeruginosa PA01
cgcccagcaccg

SEQ ID NO: 3428566 - RNA, 15 nt, Pseudomonas aeruginosa PA01
cgcccagcaccgagc

SEQ ID NO: 3428567 - RNA, 11 nt, Pseudomonas aeruginosa PA01
cgcccagcagc

SEQ ID NO: 3428568 - RNA, 15 nt, Pseudomonas aeruginosa PA01
cgcccagcagcacca

SEQ ID NO: 3428569 - RNA, 20 nt, Pseudomonas aeruginosa PA01
cgcccagcagcaggccggcg

SEQ ID NO: 3428570 - RNA, 21 nt, Pseudomonas aeruginosa PA01
cgcccagcagcaggccggcga

SEQ ID NO: 3428571 - RNA, 14 nt, Pseudomonas aeruginosa PA01
cgcccagcagcggc

SEQ ID NO: 3428572 - RNA, 15 nt, Pseudomonas aeruginosa PA01
cgcccagcagcggca

SEQ ID NO: 3428573 - RNA, 15 nt, Pseudomonas aeruginosa PA01
cgcccagcaggcgcg

SEQ ID NO: 3428574 - RNA, 19 nt, Pseudomonas aeruginosa PA01
cgcccagcaggcgcgcccu

SEQ ID NO: 3428575 - RNA, 17 nt, Pseudomonas aeruginosa PA01
cgcccagcagggccagc

SEQ ID NO: 3428576 - RNA, 19 nt, Pseudomonas aeruginosa PA01
cgcccagcagggccagcca

SEQ ID NO: 3428577 - RNA, 22 nt, Pseudomonas aeruginosa PA01
cgcccagcagggccagccagag

SEQ ID NO: 3428578 - RNA, 12 nt, Pseudomonas aeruginosa PA01
cgcccagccaga

SEQ ID NO: 3428579 - RNA, 14 nt, Pseudomonas aeruginosa PA01
cgcccagccagagc

SEQ ID NO: 3428580 - RNA, 12 nt, Pseudomonas aeruginosa PA01
cgcccagccgag

SEQ ID NO: 3428581 - RNA, 13 nt, Pseudomonas aeruginosa PA01
cgcccagccgagg

SEQ ID NO: 3428582 - RNA, 12 nt, Pseudomonas aeruginosa PA01
cgcccagcgcag

SEQ ID NO: 3428583 - RNA, 13 nt, Pseudomonas aeruginosa PA01
cgcccagcgcagc

SEQ ID NO: 3428584 - RNA, 19 nt, Pseudomonas aeruginosa PA01
cgcccagcgcagccugcug

SEQ ID NO: 3428585 - RNA, 13 nt, Pseudomonas aeruginosa PA01
cgcccagcgccug

SEQ ID NO: 3428586 - RNA, 14 nt, Pseudomonas aeruginosa PA01
cgcccagcgccugu

SEQ ID NO: 3428587 - RNA, 17 nt, Pseudomonas aeruginosa PA01
cgcccagcggcuggcgg

SEQ ID NO: 3428588 - RNA, 21 nt, Pseudomonas aeruginosa PA01
cgcccagcggcuggcgggcga

SEQ ID NO: 3428589 - RNA, 24 nt, Pseudomonas aeruginosa PA01
cgcccagcggcuggcgggcgaccg

SEQ ID NO: 3428590 - RNA, 23 nt, Pseudomonas aeruginosa PA01
cgcccaggacaacgacagccccg

SEQ ID NO: 3428591 - RNA, 14 nt, Pseudomonas aeruginosa PA01
cgcccaggcagcag

SEQ ID NO: 3428592 - RNA, 15 nt, Pseudomonas aeruginosa PA01
cgcccaggcagcaga

SEQ ID NO: 3428593 - RNA, 16 nt, Pseudomonas aeruginosa PA01
cgcccaggcagcagag

SEQ ID NO: 3428594 - RNA, 14 nt, Pseudomonas aeruginosa PA01
cgcccaggcaggcg

SEQ ID NO: 3428595 - RNA, 14 nt, Pseudomonas aeruginosa PA01
cgcccaggcccagc

SEQ ID NO: 3428596 - RNA, 15 nt, Pseudomonas aeruginosa PA01
cgcccaggccgcugg

SEQ ID NO: 3428597 - RNA, 17 nt, Pseudomonas aeruginosa PA01
cgcccaggccgcuggcg

SEQ ID NO: 3428598 - RNA, 19 nt, Pseudomonas aeruginosa PA01
cgcccaggccgcuggcggc

SEQ ID NO: 3428599 - RNA, 23 nt, Pseudomonas aeruginosa PA01
cgcccaggccgcuggcggcgacg

SEQ ID NO: 3428600 - RNA, 12 nt, Pseudomonas aeruginosa PA01
cgcccaggccgg

SEQ ID NO: 3428601 - RNA, 13 nt, Pseudomonas aeruginosa PA01
cgcccaggccggg

SEQ ID NO: 3428602 - RNA, 14 nt, Pseudomonas aeruginosa PA01
cgcccaggcgcacc

SEQ ID NO: 3428603 - RNA, 15 nt, Pseudomonas aeruginosa PA01
cgcccaggcgcaccu

SEQ ID NO: 3428604 - RNA, 12 nt, Pseudomonas aeruginosa PA01
cgcccaggcgcu

SEQ ID NO: 3428605 - RNA, 13 nt, Pseudomonas aeruginosa PA01
cgcccaggcgcuc

SEQ ID NO: 3428606 - RNA, 17 nt, Pseudomonas aeruginosa PA01
cgcccaggcgcucggcg

SEQ ID NO: 3428607 - RNA, 20 nt, Pseudomonas aeruginosa PA01
cgcccaggcgcucggcgacc

SEQ ID NO: 3428608 - RNA, 11 nt, Pseudomonas aeruginosa PA01
cgcccaggcug

SEQ ID NO: 3428609 - RNA, 16 nt, Pseudomonas aeruginosa PA01
cgcccaggcugccgcc

SEQ ID NO: 3428610 - RNA, 18 nt, Pseudomonas aeruginosa PA01
cgcccaggcugccgccgc

SEQ ID NO: 3428611 - RNA, 20 nt, Pseudomonas aeruginosa PA01
cgcccaggcugccggccagg

SEQ ID NO: 3428612 - RNA, 17 nt, Pseudomonas aeruginosa PA01
cgcccagggccagcggg

SEQ ID NO: 3428613 - RNA, 16 nt, Pseudomonas aeruginosa PA01
cgcccagggcgugguc

SEQ ID NO: 3428614 - RNA, 18 nt, Pseudomonas aeruginosa PA01
cgcccagggcguggucgg

SEQ ID NO: 3428615 - RNA, 22 nt, Pseudomonas aeruginosa PA01
cgcccagggcguggucggcggc

SEQ ID NO: 3428616 - RNA, 16 nt, Pseudomonas aeruginosa PA01
cgcccagggcuucgcg

SEQ ID NO: 3428617 - RNA, 14 nt, Pseudomonas aeruginosa PA01
cgcccagggggccg

SEQ ID NO: 3428618 - RNA, 18 nt, Pseudomonas aeruginosa PA01
cgcccagggggccgggcc

SEQ ID NO: 3428619 - RNA, 20 nt, Pseudomonas aeruginosa PA01
cgcccagggggccgggccga

SEQ ID NO: 3428620 - RNA, 19 nt, Pseudomonas aeruginosa PA01
cgcccagguaggagagggu

SEQ ID NO: 3428621 - RNA, 14 nt, Pseudomonas aeruginosa PA01
cgcccagguaggcg

SEQ ID NO: 3428622 - RNA, 17 nt, Pseudomonas aeruginosa PA01
cgcccaguaccgccacg

SEQ ID NO: 3428623 - RNA, 15 nt, Pseudomonas aeruginosa PA01
cgcccaguccugggu

SEQ ID NO: 3428624 - RNA, 19 nt, Pseudomonas aeruginosa PA01
cgcccaguccugggugucg

SEQ ID NO: 3428625 - RNA, 17 nt, Pseudomonas aeruginosa PA01
cgcccagugguuccagg

SEQ ID NO: 3428626 - RNA, 18 nt, Pseudomonas aeruginosa PA01
cgcccagugguuccagga

SEQ ID NO: 3428627 - RNA, 15 nt, Pseudomonas aeruginosa PA01
cgcccaguucgccgg

SEQ ID NO: 3428628 - RNA, 16 nt, Pseudomonas aeruginosa PA01
cgcccaguucgccggc

SEQ ID NO: 3428629 - RNA, 17 nt, Pseudomonas aeruginosa PA01
cgcccaguucgccggcc

SEQ ID NO: 3428630 - RNA, 19 nt, Pseudomonas aeruginosa PA01
cgcccaguucgccggccag

SEQ ID NO: 3428631 - RNA, 17 nt, Pseudomonas aeruginosa PA01
cgcccaguucgcgcgga

SEQ ID NO: 3428632 - RNA, 16 nt, Pseudomonas aeruginosa PA01
cgcccaguucuucgcc

SEQ ID NO: 3428633 - RNA, 17 nt, Pseudomonas aeruginosa PA01
cgcccaguucuucgccg

SEQ ID NO: 3428634 - RNA, 19 nt, Pseudomonas aeruginosa PA01
cgcccaguucuucgccgcc

SEQ ID NO: 3428635 - RNA, 20 nt, Pseudomonas aeruginosa PA01
cgcccaguucuucgccgccc

SEQ ID NO: 3428636 - RNA, 21 nt, Pseudomonas aeruginosa PA01
cgcccaguucuucgccgcccg

SEQ ID NO: 3428637 - RNA, 22 nt, Pseudomonas aeruginosa PA01
cgcccaguucuucgccgcccgc

SEQ ID NO: 3428638 - RNA, 23 nt, Pseudomonas aeruginosa PA01
cgcccaguucuucgccgcccgcg

SEQ ID NO: 3428639 - RNA, 19 nt, Pseudomonas aeruginosa PA01
cgcccaguugcgccgccug

SEQ ID NO: 3428640 - RNA, 20 nt, Pseudomonas aeruginosa PA01
cgcccaguugcgccgccugc

SEQ ID NO: 3428641 - RNA, 23 nt, Pseudomonas aeruginosa PA01
cgcccaguugcgccgccugcggc

SEQ ID NO: 3428642 - RNA, 21 nt, Pseudomonas aeruginosa PA01
cgcccaguugguaaucguaga

SEQ ID NO: 3428643 - RNA, 23 nt, Pseudomonas aeruginosa PA01
cgcccauagcgaguaggcgaagc

SEQ ID NO: 3428644 - RNA, 19 nt, Pseudomonas aeruginosa PA01
cgcccaucaacgagccgag

SEQ ID NO: 3428645 - RNA, 20 nt, Pseudomonas aeruginosa PA01
cgcccaucaacgagccgagc

SEQ ID NO: 3428646 - RNA, 17 nt, Pseudomonas aeruginosa PA01
cgcccaucgccaccagc

SEQ ID NO: 3428647 - RNA, 13 nt, Pseudomonas aeruginosa PA01
cgcccaucgccag

SEQ ID NO: 3428648 - RNA, 14 nt, Pseudomonas aeruginosa PA01
cgcccaucgccagg

SEQ ID NO: 3428649 - RNA, 16 nt, Pseudomonas aeruginosa PA01
cgcccaucgccagggu

SEQ ID NO: 3428650 - RNA, 17 nt, Pseudomonas aeruginosa PA01
cgcccaucggcgucggc

SEQ ID NO: 3428651 - RNA, 17 nt, Pseudomonas aeruginosa PA01
cgcccaucugcgcauug

SEQ ID NO: 3428652 - RNA, 15 nt, Pseudomonas aeruginosa PA01
cgcccaucuucaggc

SEQ ID NO: 3428653 - RNA, 22 nt, Pseudomonas aeruginosa PA01
cgcccaucuucaggccguucag

SEQ ID NO: 3428654 - RNA, 20 nt, Pseudomonas aeruginosa PA01
cgcccaugaaaaagccccgc

SEQ ID NO: 3428655 - RNA, 20 nt, Pseudomonas aeruginosa PA01
cgcccaugaaaaauggccgc

SEQ ID NO: 3428656 - RNA, 22 nt, Pseudomonas aeruginosa PA01
cgcccaugaaaaauggccgcuu

SEQ ID NO: 3428657 - RNA, 23 nt, Pseudomonas aeruginosa PA01
cgcccaugaaaaauggccgcuuc

SEQ ID NO: 3428658 - RNA, 14 nt, Pseudomonas aeruginosa PA01
cgcccaugccgccc

SEQ ID NO: 3428659 - RNA, 17 nt, Pseudomonas aeruginosa PA01
cgcccaugccgcccggc

SEQ ID NO: 3428660 - RNA, 19 nt, Pseudomonas aeruginosa PA01
cgcccaugccuugcagcgc

SEQ ID NO: 3428661 - RNA, 13 nt, Pseudomonas aeruginosa PA01
cgcccaugcgcgg

SEQ ID NO: 3428662 - RNA, 16 nt, Pseudomonas aeruginosa PA01
cgcccaugcgcggcga

SEQ ID NO: 3428663 - RNA, 20 nt, Pseudomonas aeruginosa PA01
cgcccauggcacgcagggcu

SEQ ID NO: 3428664 - RNA, 15 nt, Pseudomonas aeruginosa PA01
cgcccauggcgguga

SEQ ID NO: 3428665 - RNA, 16 nt, Pseudomonas aeruginosa PA01
cgcccauggcggugag

SEQ ID NO: 3428666 - RNA, 22 nt, Pseudomonas aeruginosa PA01
cgcccauggcggugagcugauc

SEQ ID NO: 3428667 - RNA, 19 nt, Pseudomonas aeruginosa PA01
cgcccauguagaccaccag

SEQ ID NO: 3428668 - RNA, 20 nt, Pseudomonas aeruginosa PA01
cgcccaugugcuugaccgcc

SEQ ID NO: 3428669 - RNA, 14 nt, Pseudomonas aeruginosa PA01
cgcccauugcccgg

SEQ ID NO: 3428670 - RNA, 21 nt, Pseudomonas aeruginosa PA01
cgcccauugcccggccaggcg

SEQ ID NO: 3428671 - RNA, 23 nt, Pseudomonas aeruginosa PA01
cgcccauugcccggccaggcgcg

SEQ ID NO: 3428672 - RNA, 15 nt, Pseudomonas aeruginosa PA01
cgcccauugccgggc

SEQ ID NO: 3428673 - RNA, 17 nt, Pseudomonas aeruginosa PA01
cgcccauugccgggcuu

SEQ ID NO: 3428674 - RNA, 12 nt, Pseudomonas aeruginosa PA01
cgccccacagcg

SEQ ID NO: 3428675 - RNA, 14 nt, Pseudomonas aeruginosa PA01
cgccccacagcggu

SEQ ID NO: 3428676 - RNA, 19 nt, Pseudomonas aeruginosa PA01
cgccccaccaccaucgccg

SEQ ID NO: 3428677 - RNA, 15 nt, Pseudomonas aeruginosa PA01
cgccccaccaggcuc

SEQ ID NO: 3428678 - RNA, 16 nt, Pseudomonas aeruginosa PA01
cgccccaccccagggu

SEQ ID NO: 3428679 - RNA, 20 nt, Pseudomonas aeruginosa PA01
cgccccagaagccccagagc

SEQ ID NO: 3428680 - RNA, 13 nt, Pseudomonas aeruginosa PA01
cgccccagcaccu

SEQ ID NO: 3428681 - RNA, 21 nt, Pseudomonas aeruginosa PA01
cgccccagcaccucgccgucg

SEQ ID NO: 3428682 - RNA, 15 nt, Pseudomonas aeruginosa PA01
cgccccagccucggc

SEQ ID NO: 3428683 - RNA, 19 nt, Pseudomonas aeruginosa PA01
cgccccagccucggcaggg

SEQ ID NO: 3428684 - RNA, 12 nt, Pseudomonas aeruginosa PA01
cgccccagcgca

SEQ ID NO: 3428685 - RNA, 14 nt, Pseudomonas aeruginosa PA01
cgccccagcgccug

SEQ ID NO: 3428686 - RNA, 20 nt, Pseudomonas aeruginosa PA01
cgccccagcgccugggccgc

SEQ ID NO: 3428687 - RNA, 22 nt, Pseudomonas aeruginosa PA01
cgccccagcgccugggccgcgc

SEQ ID NO: 3428688 - RNA, 17 nt, Pseudomonas aeruginosa PA01
cgccccagcggcaggca

SEQ ID NO: 3428689 - RNA, 14 nt, Pseudomonas aeruginosa PA01
cgccccagcggucg

SEQ ID NO: 3428690 - RNA, 13 nt, Pseudomonas aeruginosa PA01
cgccccagcucag

SEQ ID NO: 3428691 - RNA, 11 nt, Pseudomonas aeruginosa PA01
cgccccaggcg

SEQ ID NO: 3428692 - RNA, 18 nt, Pseudomonas aeruginosa PA01
cgccccaggcgcccaggc

SEQ ID NO: 3428693 - RNA, 15 nt, Pseudomonas aeruginosa PA01
cgccccaggcgggca

SEQ ID NO: 3428694 - RNA, 23 nt, Pseudomonas aeruginosa PA01
cgccccagggaaucgucacggcg

SEQ ID NO: 3428695 - RNA, 12 nt, Pseudomonas aeruginosa PA01
cgccccaggugc

SEQ ID NO: 3428696 - RNA, 16 nt, Pseudomonas aeruginosa PA01
cgccccaggugcagcg

SEQ ID NO: 3428697 - RNA, 22 nt, Pseudomonas aeruginosa PA01
cgccccaggugcagcgagggga

SEQ ID NO: 3428698 - RNA, 18 nt, Pseudomonas aeruginosa PA01
cgccccauccgggcggcg

SEQ ID NO: 3428699 - RNA, 23 nt, Pseudomonas aeruginosa PA01
cgcccccaacggaaaaaggcgcc

SEQ ID NO: 3428700 - RNA, 20 nt, Pseudomonas aeruginosa PA01
cgcccccagcgcccgcacca

SEQ ID NO: 3428701 - RNA, 19 nt, Pseudomonas aeruginosa PA01
cgcccccagcgcgccgccg

SEQ ID NO: 3428702 - RNA, 20 nt, Pseudomonas aeruginosa PA01
cgcccccagcgcgccgccga

SEQ ID NO: 3428703 - RNA, 22 nt, Pseudomonas aeruginosa PA01
cgcccccagcgcgccgccgagg

SEQ ID NO: 3428704 - RNA, 14 nt, Pseudomonas aeruginosa PA01
cgcccccggcgcca

SEQ ID NO: 3428705 - RNA, 16 nt, Pseudomonas aeruginosa PA01
cgcccccggcgccacc

SEQ ID NO: 3428706 - RNA, 15 nt, Pseudomonas aeruginosa PA01
cgcccccuccccugu

SEQ ID NO: 3428707 - RNA, 13 nt, Pseudomonas aeruginosa PA01
cgcccccuggccg

SEQ ID NO: 3428708 - RNA, 23 nt, Pseudomonas aeruginosa PA01
cgcccccuggccguugaccagcg

SEQ ID NO: 3428709 - RNA, 22 nt, Pseudomonas aeruginosa PA01
cgccccgaaaaaaaaggccgca

SEQ ID NO: 3428710 - RNA, 15 nt, Pseudomonas aeruginosa PA01
cgccccgcaaggugc

SEQ ID NO: 3428711 - RNA, 18 nt, Pseudomonas aeruginosa PA01
cgccccgcaccagccagc

SEQ ID NO: 3428712 - RNA, 12 nt, Pseudomonas aeruginosa PA01
cgccccgccgcc

SEQ ID NO: 3428713 - RNA, 13 nt, Pseudomonas aeruginosa PA01
cgccccgccggga

SEQ ID NO: 3428714 - RNA, 24 nt, Pseudomonas aeruginosa PA01
cgccccgccgggagcggccgugca

SEQ ID NO: 3428715 - RNA, 13 nt, Pseudomonas aeruginosa PA01
cgccccgccgggg

SEQ ID NO: 3428716 - RNA, 13 nt, Pseudomonas aeruginosa PA01
cgccccgccuacc

SEQ ID NO: 3428717 - RNA, 18 nt, Pseudomonas aeruginosa PA01
cgccccgcuacccugccc

SEQ ID NO: 3428718 - RNA, 18 nt, Pseudomonas aeruginosa PA01
cgccccgcuugccgucga

SEQ ID NO: 3428719 - RNA, 17 nt, Pseudomonas aeruginosa PA01
cgccccggcaagcgccg

SEQ ID NO: 3428720 - RNA, 22 nt, Pseudomonas aeruginosa PA01
cgccccggcaagcgccggcaac

SEQ ID NO: 3428721 - RNA, 12 nt, Pseudomonas aeruginosa PA01
cgccccggcagc

SEQ ID NO: 3428722 - RNA, 12 nt, Pseudomonas aeruginosa PA01
cgccccggccca

SEQ ID NO: 3428723 - RNA, 14 nt, Pseudomonas aeruginosa PA01
cgccccggccgcgc

SEQ ID NO: 3428724 - RNA, 18 nt, Pseudomonas aeruginosa PA01
cgccccggccgcgccagc

SEQ ID NO: 3428725 - RNA, 12 nt, Pseudomonas aeruginosa PA01
cgccccggcggc

SEQ ID NO: 3428726 - RNA, 13 nt, Pseudomonas aeruginosa PA01
cgccccggcggcg

SEQ ID NO: 3428727 - RNA, 18 nt, Pseudomonas aeruginosa PA01
cgccccgggucgcugcuc

SEQ ID NO: 3428728 - RNA, 19 nt, Pseudomonas aeruginosa PA01
cgccccgggucgcugcuca

SEQ ID NO: 3428729 - RNA, 20 nt, Pseudomonas aeruginosa PA01
cgccccgggucgcugcucag

SEQ ID NO: 3428730 - RNA, 19 nt, Pseudomonas aeruginosa PA01
cgccccggucucgcgcagc

SEQ ID NO: 3428731 - RNA, 20 nt, Pseudomonas aeruginosa PA01
cgccccggucucgcgcagcg

SEQ ID NO: 3428732 - RNA, 22 nt, Pseudomonas aeruginosa PA01
cgccccggucucgcgcagcggc

SEQ ID NO: 3428733 - RNA, 13 nt, Pseudomonas aeruginosa PA01
cgccccgucgacg

SEQ ID NO: 3428734 - RNA, 20 nt, Pseudomonas aeruginosa PA01
cgccccgucuucacgacgaa

SEQ ID NO: 3428735 - RNA, 17 nt, Pseudomonas aeruginosa PA01
cgccccguuggcgcggg

SEQ ID NO: 3428736 - RNA, 19 nt, Pseudomonas aeruginosa PA01
cgccccguuggcgcgggcg

SEQ ID NO: 3428737 - RNA, 19 nt, Pseudomonas aeruginosa PA01
cgccccguuugccgucggc

SEQ ID NO: 3428738 - RNA, 21 nt, Pseudomonas aeruginosa PA01
cgccccguuugccgucggcgc

SEQ ID NO: 3428739 - RNA, 19 nt, Pseudomonas aeruginosa PA01
cgccccuccaguuccugcu

SEQ ID NO: 3428740 - RNA, 15 nt, Pseudomonas aeruginosa PA01
cgccccucccagcca

SEQ ID NO: 3428741 - RNA, 15 nt, Pseudomonas aeruginosa PA01
cgccccuccuucgag

SEQ ID NO: 3428742 - RNA, 13 nt, Pseudomonas aeruginosa PA01
cgccccucuucca

SEQ ID NO: 3428743 - RNA, 11 nt, Pseudomonas aeruginosa PA01
cgccccugcgg

SEQ ID NO: 3428744 - RNA, 15 nt, Pseudomonas aeruginosa PA01
cgccccugcuccucg

SEQ ID NO: 3428745 - RNA, 16 nt, Pseudomonas aeruginosa PA01
cgccccuuuccgccgg

SEQ ID NO: 3428746 - RNA, 18 nt, Pseudomonas aeruginosa PA01
cgcccgaacgccgaccga

SEQ ID NO: 3428747 - RNA, 17 nt, Pseudomonas aeruginosa PA01
cgcccgaccccacgccg

SEQ ID NO: 3428748 - RNA, 20 nt, Pseudomonas aeruginosa PA01
cgcccgaccccacgccggcc

SEQ ID NO: 3428749 - RNA, 12 nt, Pseudomonas aeruginosa PA01
cgcccgacggcu

SEQ ID NO: 3428750 - RNA, 15 nt, Pseudomonas aeruginosa PA01
cgcccgacggcucga

SEQ ID NO: 3428751 - RNA, 15 nt, Pseudomonas aeruginosa PA01
cgcccgagccgcugc

SEQ ID NO: 3428752 - RNA, 19 nt, Pseudomonas aeruginosa PA01
cgcccgagcuuugcgcagc

SEQ ID NO: 3428753 - RNA, 21 nt, Pseudomonas aeruginosa PA01
cgcccgagcuuugcgcagcca

SEQ ID NO: 3428754 - RNA, 17 nt, Pseudomonas aeruginosa PA01
cgcccgaggcgaccuug

SEQ ID NO: 3428755 - RNA, 22 nt, Pseudomonas aeruginosa PA01
cgcccgaggcguuauccgccga

SEQ ID NO: 3428756 - RNA, 17 nt, Pseudomonas aeruginosa PA01
cgcccgauaggcgccgg

SEQ ID NO: 3428757 - RNA, 18 nt, Pseudomonas aeruginosa PA01
cgcccgauaggcgccggc

SEQ ID NO: 3428758 - RNA, 20 nt, Pseudomonas aeruginosa PA01
cgcccgauaggcgccggcgc

SEQ ID NO: 3428759 - RNA, 22 nt, Pseudomonas aeruginosa PA01
cgcccgauaggcgccggcgcgc

SEQ ID NO: 3428760 - RNA, 13 nt, Pseudomonas aeruginosa PA01
cgcccgaucgccu

SEQ ID NO: 3428761 - RNA, 18 nt, Pseudomonas aeruginosa PA01
cgcccgaucgccucgucg

SEQ ID NO: 3428762 - RNA, 19 nt, Pseudomonas aeruginosa PA01
cgcccgaucgccucgucga

SEQ ID NO: 3428763 - RNA, 20 nt, Pseudomonas aeruginosa PA01
cgcccgaucgccucgucgag

SEQ ID NO: 3428764 - RNA, 21 nt, Pseudomonas aeruginosa PA01
cgcccgaucgccucgucgagc

SEQ ID NO: 3428765 - RNA, 23 nt, Pseudomonas aeruginosa PA01
cgcccgaucgccucgucgagcgc

SEQ ID NO: 3428766 - RNA, 18 nt, Pseudomonas aeruginosa PA01
cgcccgaugaucgagcgc

SEQ ID NO: 3428767 - RNA, 16 nt, Pseudomonas aeruginosa PA01
cgcccgcaccacccgc

SEQ ID NO: 3428768 - RNA, 19 nt, Pseudomonas aeruginosa PA01
cgcccgcaccacccgcugc

SEQ ID NO: 3428769 - RNA, 11 nt, Pseudomonas aeruginosa PA01
cgcccgcagcc

SEQ ID NO: 3428770 - RNA, 15 nt, Pseudomonas aeruginosa PA01
cgcccgcagccacag

SEQ ID NO: 3428771 - RNA, 18 nt, Pseudomonas aeruginosa PA01
cgcccgcagccacaggcg

SEQ ID NO: 3428772 - RNA, 21 nt, Pseudomonas aeruginosa PA01
cgcccgcagccacaggcgcca

SEQ ID NO: 3428773 - RNA, 17 nt, Pseudomonas aeruginosa PA01
cgcccgcagccagccuc

SEQ ID NO: 3428774 - RNA, 23 nt, Pseudomonas aeruginosa PA01
cgcccgcaguuccucgccgcugc

SEQ ID NO: 3428775 - RNA, 22 nt, Pseudomonas aeruginosa PA01
cgcccgcaugccagggccuugc

SEQ ID NO: 3428776 - RNA, 16 nt, Pseudomonas aeruginosa PA01
cgcccgccaagggcgc

SEQ ID NO: 3428777 - RNA, 21 nt, Pseudomonas aeruginosa PA01
cgcccgccaagggcgccgccg

SEQ ID NO: 3428778 - RNA, 24 nt, Pseudomonas aeruginosa PA01
cgcccgccaagggcgccgccgagg

SEQ ID NO: 3428779 - RNA, 18 nt, Pseudomonas aeruginosa PA01
cgcccgccacggcgcgcu

SEQ ID NO: 3428780 - RNA, 14 nt, Pseudomonas aeruginosa PA01
cgcccgccaggucg

SEQ ID NO: 3428781 - RNA, 20 nt, Pseudomonas aeruginosa PA01
cgcccgccaggucgagggca

SEQ ID NO: 3428782 - RNA, 17 nt, Pseudomonas aeruginosa PA01
cgcccgccauguuggcc

SEQ ID NO: 3428783 - RNA, 16 nt, Pseudomonas aeruginosa PA01
cgcccgcccggcacca

SEQ ID NO: 3428784 - RNA, 13 nt, Pseudomonas aeruginosa PA01
cgcccgcccucgu

SEQ ID NO: 3428785 - RNA, 15 nt, Pseudomonas aeruginosa PA01
cgcccgcccucgucg

SEQ ID NO: 3428786 - RNA, 18 nt, Pseudomonas aeruginosa PA01
cgcccgcccucgucgcac

SEQ ID NO: 3428787 - RNA, 13 nt, Pseudomonas aeruginosa PA01
cgcccgccgccug

SEQ ID NO: 3428788 - RNA, 16 nt, Pseudomonas aeruginosa PA01
cgcccgccgccuggug

SEQ ID NO: 3428789 - RNA, 13 nt, Pseudomonas aeruginosa PA01
cgcccgccgcgag

SEQ ID NO: 3428790 - RNA, 21 nt, Pseudomonas aeruginosa PA01
cgcccgccgcgagcgccgccg

SEQ ID NO: 3428791 - RNA, 12 nt, Pseudomonas aeruginosa PA01
cgcccgccggcc

SEQ ID NO: 3428792 - RNA, 14 nt, Pseudomonas aeruginosa PA01
cgcccgccggccgu

SEQ ID NO: 3428793 - RNA, 13 nt, Pseudomonas aeruginosa PA01
cgcccgccggcgu

SEQ ID NO: 3428794 - RNA, 15 nt, Pseudomonas aeruginosa PA01
cgcccgccggcgugc

SEQ ID NO: 3428795 - RNA, 18 nt, Pseudomonas aeruginosa PA01
cgcccgccguccuccagc

SEQ ID NO: 3428796 - RNA, 14 nt, Pseudomonas aeruginosa PA01
cgcccgccgucgcc

SEQ ID NO: 3428797 - RNA, 15 nt, Pseudomonas aeruginosa PA01
cgcccgccgucgccc

SEQ ID NO: 3428798 - RNA, 14 nt, Pseudomonas aeruginosa PA01
cgcccgccguggcg

SEQ ID NO: 3428799 - RNA, 15 nt, Pseudomonas aeruginosa PA01
cgcccgccucaggcc

SEQ ID NO: 3428800 - RNA, 19 nt, Pseudomonas aeruginosa PA01
cgcccgccucaggccggga

SEQ ID NO: 3428801 - RNA, 21 nt, Pseudomonas aeruginosa PA01
cgcccgccuuguucgccagca

SEQ ID NO: 3428802 - RNA, 19 nt, Pseudomonas aeruginosa PA01
cgcccgcgagccguccugc

SEQ ID NO: 3428803 - RNA, 20 nt, Pseudomonas aeruginosa PA01
cgcccgcgcauggagacggc

SEQ ID NO: 3428804 - RNA, 15 nt, Pseudomonas aeruginosa PA01
cgcccgcgccuccag

SEQ ID NO: 3428805 - RNA, 16 nt, Pseudomonas aeruginosa PA01
cgcccgcgccuccagg

SEQ ID NO: 3428806 - RNA, 18 nt, Pseudomonas aeruginosa PA01
cgcccgcggaccgggcgg

SEQ ID NO: 3428807 - RNA, 19 nt, Pseudomonas aeruginosa PA01
cgcccgcggaccgggcggc

SEQ ID NO: 3428808 - RNA, 21 nt, Pseudomonas aeruginosa PA01
cgcccgcggaccgggcggcgc

SEQ ID NO: 3428809 - RNA, 23 nt, Pseudomonas aeruginosa PA01
cgcccgcggaccgggcggcgcgg

SEQ ID NO: 3428810 - RNA, 13 nt, Pseudomonas aeruginosa PA01
cgcccgcggcagc

SEQ ID NO: 3428811 - RNA, 16 nt, Pseudomonas aeruginosa PA01
cgcccgcggcagcagc

SEQ ID NO: 3428812 - RNA, 18 nt, Pseudomonas aeruginosa PA01
cgcccgcggcagcagcca

SEQ ID NO: 3428813 - RNA, 13 nt, Pseudomonas aeruginosa PA01
cgcccgcggcggc

SEQ ID NO: 3428814 - RNA, 16 nt, Pseudomonas aeruginosa PA01
cgcccgcggcggcgac

SEQ ID NO: 3428815 - RNA, 18 nt, Pseudomonas aeruginosa PA01
cgcccgcggcggcgacgc

SEQ ID NO: 3428816 - RNA, 19 nt, Pseudomonas aeruginosa PA01
cgcccgcggcggcgacgcu

SEQ ID NO: 3428817 - RNA, 12 nt, Pseudomonas aeruginosa PA01
cgcccgcggcgu

SEQ ID NO: 3428818 - RNA, 15 nt, Pseudomonas aeruginosa PA01
cgcccgcgggcagcu

SEQ ID NO: 3428819 - RNA, 13 nt, Pseudomonas aeruginosa PA01
cgcccgcgggcgc

SEQ ID NO: 3428820 - RNA, 21 nt, Pseudomonas aeruginosa PA01
cgcccgcugaaggacugugcc

SEQ ID NO: 3428821 - RNA, 14 nt, Pseudomonas aeruginosa PA01
cgcccgcugcgcug

SEQ ID NO: 3428822 - RNA, 17 nt, Pseudomonas aeruginosa PA01
cgcccgcugcgcugcca

SEQ ID NO: 3428823 - RNA, 14 nt, Pseudomonas aeruginosa PA01
cgcccgcugugcgg

SEQ ID NO: 3428824 - RNA, 13 nt, Pseudomonas aeruginosa PA01
cgcccgcuucgcc

SEQ ID NO: 3428825 - RNA, 13 nt, Pseudomonas aeruginosa PA01
cgcccgcuugcgc

SEQ ID NO: 3428826 - RNA, 15 nt, Pseudomonas aeruginosa PA01
cgcccgcuugcgccg

SEQ ID NO: 3428827 - RNA, 19 nt, Pseudomonas aeruginosa PA01
cgcccgcuugcgccgccuc

SEQ ID NO: 3428828 - RNA, 24 nt, Pseudomonas aeruginosa PA01
cgcccgcuugcgccgccucgcgca

SEQ ID NO: 3428829 - RNA, 24 nt, Pseudomonas aeruginosa PA01
cgcccggaaaaaaaagcccgcacg

SEQ ID NO: 3428830 - RNA, 16 nt, Pseudomonas aeruginosa PA01
cgcccggaaccaccgg

SEQ ID NO: 3428831 - RNA, 19 nt, Pseudomonas aeruginosa PA01
cgcccggaaccaccgguca

SEQ ID NO: 3428832 - RNA, 20 nt, Pseudomonas aeruginosa PA01
cgcccggaaccaccggucaa

SEQ ID NO: 3428833 - RNA, 14 nt, Pseudomonas aeruginosa PA01
cgcccggaccgauc

SEQ ID NO: 3428834 - RNA, 21 nt, Pseudomonas aeruginosa PA01
cgcccggagcgcgaaagcgcc

SEQ ID NO: 3428835 - RNA, 22 nt, Pseudomonas aeruginosa PA01
cgcccggagcuuugcagggcga

SEQ ID NO: 3428836 - RNA, 16 nt, Pseudomonas aeruginosa PA01
cgcccggcaaucaggc

SEQ ID NO: 3428837 - RNA, 19 nt, Pseudomonas aeruginosa PA01
cgcccggcaaucaggcgcg

SEQ ID NO: 3428838 - RNA, 14 nt, Pseudomonas aeruginosa PA01
cgcccggcacgcuc

SEQ ID NO: 3428839 - RNA, 17 nt, Pseudomonas aeruginosa PA01
cgcccggcacucgccgg

SEQ ID NO: 3428840 - RNA, 12 nt, Pseudomonas aeruginosa PA01
cgcccggcagau

SEQ ID NO: 3428841 - RNA, 15 nt, Pseudomonas aeruginosa PA01
cgcccggcagcaggc

SEQ ID NO: 3428842 - RNA, 18 nt, Pseudomonas aeruginosa PA01
cgcccggcagcaggccgc

SEQ ID NO: 3428843 - RNA, 19 nt, Pseudomonas aeruginosa PA01
cgcccggcagcaggccgcc

SEQ ID NO: 3428844 - RNA, 22 nt, Pseudomonas aeruginosa PA01
cgcccggcagcaggccgccgcg

SEQ ID NO: 3428845 - RNA, 14 nt, Pseudomonas aeruginosa PA01
cgcccggcagcggc

SEQ ID NO: 3428846 - RNA, 19 nt, Pseudomonas aeruginosa PA01
cgcccggcagcggcuggcc

SEQ ID NO: 3428847 - RNA, 21 nt, Pseudomonas aeruginosa PA01
cgcccggcagcggcuggccgu

SEQ ID NO: 3428848 - RNA, 18 nt, Pseudomonas aeruginosa PA01
cgcccggcaucugccggg

SEQ ID NO: 3428849 - RNA, 18 nt, Pseudomonas aeruginosa PA01
cgcccggccaggccgccc

SEQ ID NO: 3428850 - RNA, 14 nt, Pseudomonas aeruginosa PA01
cgcccggccgcugg

SEQ ID NO: 3428851 - RNA, 12 nt, Pseudomonas aeruginosa PA01
cgcccggccucc

SEQ ID NO: 3428852 - RNA, 23 nt, Pseudomonas aeruginosa PA01
cgcccggccuccccggcccgcgc

SEQ ID NO: 3428853 - RNA, 19 nt, Pseudomonas aeruginosa PA01
cgcccggccuucaccgcgc

SEQ ID NO: 3428854 - RNA, 21 nt, Pseudomonas aeruginosa PA01
cgcccggcgaacagcgcuucc

SEQ ID NO: 3428855 - RNA, 13 nt, Pseudomonas aeruginosa PA01
cgcccggcgcaga

SEQ ID NO: 3428856 - RNA, 12 nt, Pseudomonas aeruginosa PA01
cgcccggcgcca

SEQ ID NO: 3428857 - RNA, 20 nt, Pseudomonas aeruginosa PA01
cgcccggcgccaccccgccg

SEQ ID NO: 3428858 - RNA, 24 nt, Pseudomonas aeruginosa PA01
cgcccggcgccaccccgccgcgca

SEQ ID NO: 3428859 - RNA, 14 nt, Pseudomonas aeruginosa PA01
cgcccggcgccagg

SEQ ID NO: 3428860 - RNA, 13 nt, Pseudomonas aeruginosa PA01
cgcccggcgcccu

SEQ ID NO: 3428861 - RNA, 14 nt, Pseudomonas aeruginosa PA01
cgcccggcgcgacc

SEQ ID NO: 3428862 - RNA, 21 nt, Pseudomonas aeruginosa PA01
cgcccggcgcgaccgucggcc

SEQ ID NO: 3428863 - RNA, 17 nt, Pseudomonas aeruginosa PA01
cgcccggcucgaccuug

SEQ ID NO: 3428864 - RNA, 12 nt, Pseudomonas aeruginosa PA01
cgcccggcucgc

SEQ ID NO: 3428865 - RNA, 21 nt, Pseudomonas aeruginosa PA01
cgcccggcucgccgccgggcg

SEQ ID NO: 3428866 - RNA, 17 nt, Pseudomonas aeruginosa PA01
cgcccggcucggccgug

SEQ ID NO: 3428867 - RNA, 14 nt, Pseudomonas aeruginosa PA01
cgcccggcuggcca

SEQ ID NO: 3428868 - RNA, 12 nt, Pseudomonas aeruginosa PA01
cgcccggcuucg

SEQ ID NO: 3428869 - RNA, 15 nt, Pseudomonas aeruginosa PA01
cgcccggcuucggcg

SEQ ID NO: 3428870 - RNA, 17 nt, Pseudomonas aeruginosa PA01
cgcccggcuucggcggc

SEQ ID NO: 3428871 - RNA, 18 nt, Pseudomonas aeruginosa PA01
cgcccggcuucggcggcg

SEQ ID NO: 3428872 - RNA, 17 nt, Pseudomonas aeruginosa PA01
cgcccggcuuuccucgg

SEQ ID NO: 3428873 - RNA, 23 nt, Pseudomonas aeruginosa PA01
cgcccgggccgggggcggcgccu

SEQ ID NO: 3428874 - RNA, 17 nt, Pseudomonas aeruginosa PA01
cgcccgggcgccaccga

SEQ ID NO: 3428875 - RNA, 19 nt, Pseudomonas aeruginosa PA01
cgcccggguugccguagcg

SEQ ID NO: 3428876 - RNA, 17 nt, Pseudomonas aeruginosa PA01
cgcccggucuagcgccc

SEQ ID NO: 3428877 - RNA, 21 nt, Pseudomonas aeruginosa PA01
cgcccggucuagcgccccggc

SEQ ID NO: 3428878 - RNA, 18 nt, Pseudomonas aeruginosa PA01
cgcccggucucagccggc

SEQ ID NO: 3428879 - RNA, 21 nt, Pseudomonas aeruginosa PA01
cgcccggucucagccggcgcu

SEQ ID NO: 3428880 - RNA, 16 nt, Pseudomonas aeruginosa PA01
cgcccgguguucaccg

SEQ ID NO: 3428881 - RNA, 15 nt, Pseudomonas aeruginosa PA01
cgcccgguucguaga

SEQ ID NO: 3428882 - RNA, 16 nt, Pseudomonas aeruginosa PA01
cgcccgguucguagag

SEQ ID NO: 3428883 - RNA, 14 nt, Pseudomonas aeruginosa PA01
cgcccguagcacau

SEQ ID NO: 3428884 - RNA, 23 nt, Pseudomonas aeruginosa PA01
cgcccgucacuucacgacaggcg

SEQ ID NO: 3428885 - RNA, 21 nt, Pseudomonas aeruginosa PA01
cgcccgucgccauucggcgac

SEQ ID NO: 3428886 - RNA, 12 nt, Pseudomonas aeruginosa PA01
cgcccgucgcgc

SEQ ID NO: 3428887 - RNA, 19 nt, Pseudomonas aeruginosa PA01
cgcccgucgcgccggccau

SEQ ID NO: 3428888 - RNA, 21 nt, Pseudomonas aeruginosa PA01
cgcccgucgcgccggccauuc

SEQ ID NO: 3428889 - RNA, 17 nt, Pseudomonas aeruginosa PA01
cgcccgucgucguggcg

SEQ ID NO: 3428890 - RNA, 15 nt, Pseudomonas aeruginosa PA01
cgcccgugccucggc

SEQ ID NO: 3428891 - RNA, 23 nt, Pseudomonas aeruginosa PA01
cgcccgugccucggcggacagcc

SEQ ID NO: 3428892 - RNA, 23 nt, Pseudomonas aeruginosa PA01
cgcccgugggguauuccaggcga

SEQ ID NO: 3428893 - RNA, 15 nt, Pseudomonas aeruginosa PA01
cgcccuaccccaggg

SEQ ID NO: 3428894 - RNA, 12 nt, Pseudomonas aeruginosa PA01
cgcccuacccga

SEQ ID NO: 3428895 - RNA, 16 nt, Pseudomonas aeruginosa PA01
cgcccuacccgacagg

SEQ ID NO: 3428896 - RNA, 15 nt, Pseudomonas aeruginosa PA01
cgcccuaccguccgc

SEQ ID NO: 3428897 - RNA, 21 nt, Pseudomonas aeruginosa PA01
cgcccuacgccaccugagcga

SEQ ID NO: 3428898 - RNA, 22 nt, Pseudomonas aeruginosa PA01
cgcccuacggaccggugccccg

SEQ ID NO: 3428899 - RNA, 18 nt, Pseudomonas aeruginosa PA01
cgcccuacggccccaggc

SEQ ID NO: 3428900 - RNA, 23 nt, Pseudomonas aeruginosa PA01
cgcccuacgggggcgugucgagg

SEQ ID NO: 3428901 - RNA, 16 nt, Pseudomonas aeruginosa PA01
cgcccuacuccagggg

SEQ ID NO: 3428902 - RNA, 19 nt, Pseudomonas aeruginosa PA01
cgcccucaagucuccagcg

SEQ ID NO: 3428903 - RNA, 20 nt, Pseudomonas aeruginosa PA01
cgcccucaagucuccagcga

SEQ ID NO: 3428904 - RNA, 14 nt, Pseudomonas aeruginosa PA01
cgcccucagcagcg

SEQ ID NO: 3428905 - RNA, 19 nt, Pseudomonas aeruginosa PA01
cgcccucagcagcgccgcc

SEQ ID NO: 3428906 - RNA, 20 nt, Pseudomonas aeruginosa PA01
cgcccucagcagcgccgccc

SEQ ID NO: 3428907 - RNA, 21 nt, Pseudomonas aeruginosa PA01
cgcccucagcagcgccgcccu

SEQ ID NO: 3428908 - RNA, 13 nt, Pseudomonas aeruginosa PA01
cgcccuccagcac

SEQ ID NO: 3428909 - RNA, 15 nt, Pseudomonas aeruginosa PA01
cgcccuccagcaccg

SEQ ID NO: 3428910 - RNA, 17 nt, Pseudomonas aeruginosa PA01
cgcccuccagcaccgcc

SEQ ID NO: 3428911 - RNA, 12 nt, Pseudomonas aeruginosa PA01
cgcccuccauca

SEQ ID NO: 3428912 - RNA, 14 nt, Pseudomonas aeruginosa PA01
cgcccucccgcgau

SEQ ID NO: 3428913 - RNA, 14 nt, Pseudomonas aeruginosa PA01
cgcccucgaagccc

SEQ ID NO: 3428914 - RNA, 16 nt, Pseudomonas aeruginosa PA01
cgcccucgaagcccug

SEQ ID NO: 3428915 - RNA, 19 nt, Pseudomonas aeruginosa PA01
cgcccucgcuccaacgcag

SEQ ID NO: 3428916 - RNA, 18 nt, Pseudomonas aeruginosa PA01
cgcccucgcucguuccgc

SEQ ID NO: 3428917 - RNA, 14 nt, Pseudomonas aeruginosa PA01
cgcccucggccagg

SEQ ID NO: 3428918 - RNA, 15 nt, Pseudomonas aeruginosa PA01
cgcccucggccaggc

SEQ ID NO: 3428919 - RNA, 16 nt, Pseudomonas aeruginosa PA01
cgcccucggccaggca

SEQ ID NO: 3428920 - RNA, 17 nt, Pseudomonas aeruginosa PA01
cgcccucggccaggcau

SEQ ID NO: 3428921 - RNA, 13 nt, Pseudomonas aeruginosa PA01
cgcccucggcgac

SEQ ID NO: 3428922 - RNA, 14 nt, Pseudomonas aeruginosa PA01
cgcccucggcgacg

SEQ ID NO: 3428923 - RNA, 15 nt, Pseudomonas aeruginosa PA01
cgcccucggcgacga

SEQ ID NO: 3428924 - RNA, 13 nt, Pseudomonas aeruginosa PA01
cgcccucggcgcu

SEQ ID NO: 3428925 - RNA, 16 nt, Pseudomonas aeruginosa PA01
cgcccucggcgcuggc

SEQ ID NO: 3428926 - RNA, 17 nt, Pseudomonas aeruginosa PA01
cgcccucggcgcuggcc

SEQ ID NO: 3428927 - RNA, 18 nt, Pseudomonas aeruginosa PA01
cgcccucggcgcuggcca

SEQ ID NO: 3428928 - RNA, 19 nt, Pseudomonas aeruginosa PA01
cgcccucggcgcuggccag

SEQ ID NO: 3428929 - RNA, 17 nt, Pseudomonas aeruginosa PA01
cgcccucgggccgcagg

SEQ ID NO: 3428930 - RNA, 16 nt, Pseudomonas aeruginosa PA01
cgcccucggggccgag

SEQ ID NO: 3428931 - RNA, 22 nt, Pseudomonas aeruginosa PA01
cgcccucggugauaccgccggc

SEQ ID NO: 3428932 - RNA, 14 nt, Pseudomonas aeruginosa PA01
cgcccucgucgcac

SEQ ID NO: 3428933 - RNA, 15 nt, Pseudomonas aeruginosa PA01
cgcccucgucgcacc

SEQ ID NO: 3428934 - RNA, 17 nt, Pseudomonas aeruginosa PA01
cgcccucgucgcaccug

SEQ ID NO: 3428935 - RNA, 22 nt, Pseudomonas aeruginosa PA01
cgcccucucaggagcgccgcgc

SEQ ID NO: 3428936 - RNA, 16 nt, Pseudomonas aeruginosa PA01
cgcccucugccggucg

SEQ ID NO: 3428937 - RNA, 20 nt, Pseudomonas aeruginosa PA01
cgcccugacccgcaccggca

SEQ ID NO: 3428938 - RNA, 22 nt, Pseudomonas aeruginosa PA01
cgcccugaggcuuuccugcgcc

SEQ ID NO: 3428939 - RNA, 20 nt, Pseudomonas aeruginosa PA01
cgcccugcaacacguagcgc

SEQ ID NO: 3428940 - RNA, 16 nt, Pseudomonas aeruginosa PA01
cgcccugcaccuuggg

SEQ ID NO: 3428941 - RNA, 15 nt, Pseudomonas aeruginosa PA01
cgcccugcagcgcgc

SEQ ID NO: 3428942 - RNA, 23 nt, Pseudomonas aeruginosa PA01
cgcccugcagcgcgcgcuggucg

SEQ ID NO: 3428943 - RNA, 14 nt, Pseudomonas aeruginosa PA01
cgcccugcaggccg

SEQ ID NO: 3428944 - RNA, 15 nt, Pseudomonas aeruginosa PA01
cgcccugcaggccga

SEQ ID NO: 3428945 - RNA, 16 nt, Pseudomonas aeruginosa PA01
cgcccugcaggccgaa

SEQ ID NO: 3428946 - RNA, 20 nt, Pseudomonas aeruginosa PA01
cgcccugccccuucggcugc

SEQ ID NO: 3428947 - RNA, 16 nt, Pseudomonas aeruginosa PA01
cgcccugcccgguggg

SEQ ID NO: 3428948 - RNA, 12 nt, Pseudomonas aeruginosa PA01
cgcccugccggg

SEQ ID NO: 3428949 - RNA, 22 nt, Pseudomonas aeruginosa PA01
cgcccugccgggcucuucggag

SEQ ID NO: 3428950 - RNA, 21 nt, Pseudomonas aeruginosa PA01
cgcccugcgcagcuaggcgag

SEQ ID NO: 3428951 - RNA, 15 nt, Pseudomonas aeruginosa PA01
cgcccugcgccagca

SEQ ID NO: 3428952 - RNA, 22 nt, Pseudomonas aeruginosa PA01
cgcccugcgccagcaucgcauc

SEQ ID NO: 3428953 - RNA, 16 nt, Pseudomonas aeruginosa PA01
cgcccugcgcgauccc

SEQ ID NO: 3428954 - RNA, 20 nt, Pseudomonas aeruginosa PA01
cgcccugcggauggcgcggg

SEQ ID NO: 3428955 - RNA, 14 nt, Pseudomonas aeruginosa PA01
cgcccugcggcagg

SEQ ID NO: 3428956 - RNA, 22 nt, Pseudomonas aeruginosa PA01
cgcccugcggcaggcgccaacc

SEQ ID NO: 3428957 - RNA, 13 nt, Pseudomonas aeruginosa PA01
cgcccugcgggau

SEQ ID NO: 3428958 - RNA, 17 nt, Pseudomonas aeruginosa PA01
cgcccugcgucgcagag

SEQ ID NO: 3428959 - RNA, 21 nt, Pseudomonas aeruginosa PA01
cgcccugcguggaaccgcggc

SEQ ID NO: 3428960 - RNA, 22 nt, Pseudomonas aeruginosa PA01
cgcccugcguggaaccgcggcg

SEQ ID NO: 3428961 - RNA, 24 nt, Pseudomonas aeruginosa PA01
cgcccugcguggaaccgcggcgcc

SEQ ID NO: 3428962 - RNA, 12 nt, Pseudomonas aeruginosa PA01
cgcccugcucug

SEQ ID NO: 3428963 - RNA, 15 nt, Pseudomonas aeruginosa PA01
cgcccugcucuugcc

SEQ ID NO: 3428964 - RNA, 14 nt, Pseudomonas aeruginosa PA01
cgcccuggaugauc

SEQ ID NO: 3428965 - RNA, 20 nt, Pseudomonas aeruginosa PA01
cgcccuggaugaucucgcag

SEQ ID NO: 3428966 - RNA, 15 nt, Pseudomonas aeruginosa PA01
cgcccuggccgagcg

SEQ ID NO: 3428967 - RNA, 13 nt, Pseudomonas aeruginosa PA01
cgcccuggccgau

SEQ ID NO: 3428968 - RNA, 17 nt, Pseudomonas aeruginosa PA01
cgcccuggccgaucagc

SEQ ID NO: 3428969 - RNA, 23 nt, Pseudomonas aeruginosa PA01
cgcccuggccgaucagcuuggcc

SEQ ID NO: 3428970 - RNA, 13 nt, Pseudomonas aeruginosa PA01
cgcccuggccucg

SEQ ID NO: 3428971 - RNA, 18 nt, Pseudomonas aeruginosa PA01
cgcccuggccucggcguc

SEQ ID NO: 3428972 - RNA, 12 nt, Pseudomonas aeruginosa PA01
cgcccuggcgcc

SEQ ID NO: 3428973 - RNA, 15 nt, Pseudomonas aeruginosa PA01
cgcccuggcgccagc

SEQ ID NO: 3428974 - RNA, 19 nt, Pseudomonas aeruginosa PA01
cgcccuggcucugggccau

SEQ ID NO: 3428975 - RNA, 17 nt, Pseudomonas aeruginosa PA01
cgcccuggcucuugccg

SEQ ID NO: 3428976 - RNA, 19 nt, Pseudomonas aeruginosa PA01
cgcccuggcucuugccgcg

SEQ ID NO: 3428977 - RNA, 22 nt, Pseudomonas aeruginosa PA01
cgcccuggcucuugccgcgagc

SEQ ID NO: 3428978 - RNA, 14 nt, Pseudomonas aeruginosa PA01
cgcccugggacagg

SEQ ID NO: 3428979 - RNA, 18 nt, Pseudomonas aeruginosa PA01
cgcccugggcgacgcgga

SEQ ID NO: 3428980 - RNA, 20 nt, Pseudomonas aeruginosa PA01
cgcccugggcgacgcggaca

SEQ ID NO: 3428981 - RNA, 21 nt, Pseudomonas aeruginosa PA01
cgcccugggguuucugcuggc

SEQ ID NO: 3428982 - RNA, 22 nt, Pseudomonas aeruginosa PA01
cgcccugggguuucugcuggcc

SEQ ID NO: 3428983 - RNA, 22 nt, Pseudomonas aeruginosa PA01
cgcccuggguggucugcacggc

SEQ ID NO: 3428984 - RNA, 17 nt, Pseudomonas aeruginosa PA01
cgcccugguccaaccgg

SEQ ID NO: 3428985 - RNA, 18 nt, Pseudomonas aeruginosa PA01
cgcccugguccaaccggg

SEQ ID NO: 3428986 - RNA, 16 nt, Pseudomonas aeruginosa PA01
cgcccuggugcacggc

SEQ ID NO: 3428987 - RNA, 17 nt, Pseudomonas aeruginosa PA01
cgcccuggugcacggcg

SEQ ID NO: 3428988 - RNA, 20 nt, Pseudomonas aeruginosa PA01
cgcccuggugcacggcgacc

SEQ ID NO: 3428989 - RNA, 20 nt, Pseudomonas aeruginosa PA01
cgcccuguuucggguccagg

SEQ ID NO: 3428990 - RNA, 15 nt, Pseudomonas aeruginosa PA01
cgcccuucagcgccu

SEQ ID NO: 3428991 - RNA, 18 nt, Pseudomonas aeruginosa PA01
cgcccuucagcgccucga

SEQ ID NO: 3428992 - RNA, 22 nt, Pseudomonas aeruginosa PA01
cgcccuucagcgccucgaggau

SEQ ID NO: 3428993 - RNA, 16 nt, Pseudomonas aeruginosa PA01
cgcccuugaacuugua

SEQ ID NO: 3428994 - RNA, 23 nt, Pseudomonas aeruginosa PA01
cgcccuugaacuuguagcuggug

SEQ ID NO: 3428995 - RNA, 19 nt, Pseudomonas aeruginosa PA01
cgcccuugaccccaccggu

SEQ ID NO: 3428996 - RNA, 22 nt, Pseudomonas aeruginosa PA01
cgcccuugacccgguacagcgc

SEQ ID NO: 3428997 - RNA, 20 nt, Pseudomonas aeruginosa PA01
cgcccuugacguucaggcug

SEQ ID NO: 3428998 - RNA, 15 nt, Pseudomonas aeruginosa PA01
cgcccuugagcacgu

SEQ ID NO: 3428999 - RNA, 22 nt, Pseudomonas aeruginosa PA01
cgcccuugaggauuuucuccgg

SEQ ID NO: 3429000 - RNA, 19 nt, Pseudomonas aeruginosa PA01
cgcccuugccauccuccag

SEQ ID NO: 3429001 - RNA, 20 nt, Pseudomonas aeruginosa PA01
cgcccuugccauccuccagc

SEQ ID NO: 3429002 - RNA, 22 nt, Pseudomonas aeruginosa PA01
cgcccuugccauccuccagcac

SEQ ID NO: 3429003 - RNA, 14 nt, Pseudomonas aeruginosa PA01
cgcccuugccuguc

SEQ ID NO: 3429004 - RNA, 18 nt, Pseudomonas aeruginosa PA01
cgcccuugcgccgcgguu

SEQ ID NO: 3429005 - RNA, 16 nt, Pseudomonas aeruginosa PA01
cgcccuugcggcccgc

SEQ ID NO: 3429006 - RNA, 17 nt, Pseudomonas aeruginosa PA01
cgcccuugcggcgcggc

SEQ ID NO: 3429007 - RNA, 19 nt, Pseudomonas aeruginosa PA01
cgcccuugcggcgcggccc

SEQ ID NO: 3429008 - RNA, 21 nt, Pseudomonas aeruginosa PA01
cgcccuugcggcgcggcccgu

SEQ ID NO: 3429009 - RNA, 16 nt, Pseudomonas aeruginosa PA01
cgcccuugcucgcggc

SEQ ID NO: 3429010 - RNA, 15 nt, Pseudomonas aeruginosa PA01
cgcccuugcugccca

SEQ ID NO: 3429011 - RNA, 14 nt, Pseudomonas aeruginosa PA01
cgcccuuggcggcg

SEQ ID NO: 3429012 - RNA, 17 nt, Pseudomonas aeruginosa PA01
cgcccuuggcggcgcca

SEQ ID NO: 3429013 - RNA, 19 nt, Pseudomonas aeruginosa PA01
cgcccuuuuucgucgccag

SEQ ID NO: 3429014 - RNA, 20 nt, Pseudomonas aeruginosa PA01
cgcccuuuuucgucgccagc

SEQ ID NO: 3429015 - RNA, 22 nt, Pseudomonas aeruginosa PA01
cgcccuuuuucgucgccagccc

SEQ ID NO: 3429016 - RNA, 23 nt, Pseudomonas aeruginosa PA01
cgcccuuuuucgucgccagcccg

SEQ ID NO: 3429017 - RNA, 22 nt, Pseudomonas aeruginosa PA01
cgccgaaaaaaaggggcccgaa

SEQ ID NO: 3429018 - RNA, 15 nt, Pseudomonas aeruginosa PA01
cgccgaaaaauucag

SEQ ID NO: 3429019 - RNA, 18 nt, Pseudomonas aeruginosa PA01
cgccgaaaaauucagcgc

SEQ ID NO: 3429020 - RNA, 20 nt, Pseudomonas aeruginosa PA01
cgccgaaaaauucagcgcag

SEQ ID NO: 3429021 - RNA, 19 nt, Pseudomonas aeruginosa PA01
cgccgaaagcacgcgcauc

SEQ ID NO: 3429022 - RNA, 21 nt, Pseudomonas aeruginosa PA01
cgccgaaauagcgcgcccagu

SEQ ID NO: 3429023 - RNA, 23 nt, Pseudomonas aeruginosa PA01
cgccgaacagcaacaccgcgcag

SEQ ID NO: 3429024 - RNA, 14 nt, Pseudomonas aeruginosa PA01
cgccgaacagccgc

SEQ ID NO: 3429025 - RNA, 16 nt, Pseudomonas aeruginosa PA01
cgccgaacagccgccc

SEQ ID NO: 3429026 - RNA, 22 nt, Pseudomonas aeruginosa PA01
cgccgaacagccgccccaccac

SEQ ID NO: 3429027 - RNA, 22 nt, Pseudomonas aeruginosa PA01
cgccgaacaugccgaagagcuu

SEQ ID NO: 3429028 - RNA, 13 nt, Pseudomonas aeruginosa PA01
cgccgaacccgcc

SEQ ID NO: 3429029 - RNA, 16 nt, Pseudomonas aeruginosa PA01
cgccgaacgccaccag

SEQ ID NO: 3429030 - RNA, 22 nt, Pseudomonas aeruginosa PA01
cgccgaacgccaccagggccuu

SEQ ID NO: 3429031 - RNA, 15 nt, Pseudomonas aeruginosa PA01
cgccgaacggaucgc

SEQ ID NO: 3429032 - RNA, 22 nt, Pseudomonas aeruginosa PA01
cgccgaacggaucgcgucgcag

SEQ ID NO: 3429033 - RNA, 14 nt, Pseudomonas aeruginosa PA01
cgccgaacggcagc

SEQ ID NO: 3429034 - RNA, 19 nt, Pseudomonas aeruginosa PA01
cgccgaacuccgagcagga

SEQ ID NO: 3429035 - RNA, 20 nt, Pseudomonas aeruginosa PA01
cgccgaagaacucggcgcug

SEQ ID NO: 3429036 - RNA, 22 nt, Pseudomonas aeruginosa PA01
cgccgaagauccgcuccaggcu

SEQ ID NO: 3429037 - RNA, 15 nt, Pseudomonas aeruginosa PA01
cgccgaagcccuugg

SEQ ID NO: 3429038 - RNA, 13 nt, Pseudomonas aeruginosa PA01
cgccgaagccgac

SEQ ID NO: 3429039 - RNA, 14 nt, Pseudomonas aeruginosa PA01
cgccgaagccgacg

SEQ ID NO: 3429040 - RNA, 17 nt, Pseudomonas aeruginosa PA01
cgccgaagccgacgccg

SEQ ID NO: 3429041 - RNA, 19 nt, Pseudomonas aeruginosa PA01
cgccgaagccgacgccgag

SEQ ID NO: 3429042 - RNA, 21 nt, Pseudomonas aeruginosa PA01
cgccgaagccgacgccgagca

SEQ ID NO: 3429043 - RNA, 23 nt, Pseudomonas aeruginosa PA01
cgccgaagccgacgccgagcagc

SEQ ID NO: 3429044 - RNA, 12 nt, Pseudomonas aeruginosa PA01
cgccgaagccgc

SEQ ID NO: 3429045 - RNA, 22 nt, Pseudomonas aeruginosa PA01
cgccgaagcggggcuuuuucca

SEQ ID NO: 3429046 - RNA, 15 nt, Pseudomonas aeruginosa PA01
cgccgaaggacaggc

SEQ ID NO: 3429047 - RNA, 20 nt, Pseudomonas aeruginosa PA01
cgccgaaggacaggccguag

SEQ ID NO: 3429048 - RNA, 15 nt, Pseudomonas aeruginosa PA01
cgccgaaggccagcu

SEQ ID NO: 3429049 - RNA, 22 nt, Pseudomonas aeruginosa PA01
cgccgaaggcgauauggccgau

SEQ ID NO: 3429050 - RNA, 22 nt, Pseudomonas aeruginosa PA01
cgccgaaggcgucaguuccgca

SEQ ID NO: 3429051 - RNA, 13 nt, Pseudomonas aeruginosa PA01
cgccgaaggugaa

SEQ ID NO: 3429052 - RNA, 20 nt, Pseudomonas aeruginosa PA01
cgccgaaggugaaguccggc

SEQ ID NO: 3429053 - RNA, 18 nt, Pseudomonas aeruginosa PA01
cgccgaaggugcaggccg

SEQ ID NO: 3429054 - RNA, 20 nt, Pseudomonas aeruginosa PA01
cgccgaaggugcaggccgcg

SEQ ID NO: 3429055 - RNA, 21 nt, Pseudomonas aeruginosa PA01
cgccgaaggugcaggccgcgc

SEQ ID NO: 3429056 - RNA, 23 nt, Pseudomonas aeruginosa PA01
cgccgaaggugcaggccgcgcga

SEQ ID NO: 3429057 - RNA, 13 nt, Pseudomonas aeruginosa PA01
cgccgaaguccug

SEQ ID NO: 3429058 - RNA, 21 nt, Pseudomonas aeruginosa PA01
cgccgaaguccugcaacaggg

SEQ ID NO: 3429059 - RNA, 17 nt, Pseudomonas aeruginosa PA01
cgccgaagucggcgagc

SEQ ID NO: 3429060 - RNA, 21 nt, Pseudomonas aeruginosa PA01
cgccgaagucggcgagccggc

SEQ ID NO: 3429061 - RNA, 14 nt, Pseudomonas aeruginosa PA01
cgccgaagugaucu

SEQ ID NO: 3429062 - RNA, 19 nt, Pseudomonas aeruginosa PA01
cgccgaagugaucuggcau

SEQ ID NO: 3429063 - RNA, 22 nt, Pseudomonas aeruginosa PA01
cgccgaagugaucuggcauacc

SEQ ID NO: 3429064 - RNA, 15 nt, Pseudomonas aeruginosa PA01
cgccgaaguucuuca

SEQ ID NO: 3429065 - RNA, 20 nt, Pseudomonas aeruginosa PA01
cgccgaaguucuucagcagc

SEQ ID NO: 3429066 - RNA, 19 nt, Pseudomonas aeruginosa PA01
cgccgaauccaggccgacg

SEQ ID NO: 3429067 - RNA, 22 nt, Pseudomonas aeruginosa PA01
cgccgaauccaggccgacgaag

SEQ ID NO: 3429068 - RNA, 22 nt, Pseudomonas aeruginosa PA01
cgccgacaacgaaaagagccgc

SEQ ID NO: 3429069 - RNA, 13 nt, Pseudomonas aeruginosa PA01
cgccgacacccgc

SEQ ID NO: 3429070 - RNA, 20 nt, Pseudomonas aeruginosa PA01
cgccgacacccgcgccgccg

SEQ ID NO: 3429071 - RNA, 21 nt, Pseudomonas aeruginosa PA01
cgccgacacgggugccggaga

SEQ ID NO: 3429072 - RNA, 21 nt, Pseudomonas aeruginosa PA01
cgccgacagauuguucgguac

SEQ ID NO: 3429073 - RNA, 18 nt, Pseudomonas aeruginosa PA01
cgccgacagcacgauggc

SEQ ID NO: 3429074 - RNA, 19 nt, Pseudomonas aeruginosa PA01
cgccgacagcacgauggcg

SEQ ID NO: 3429075 - RNA, 22 nt, Pseudomonas aeruginosa PA01
cgccgacaggcaucgcucgcaa

SEQ ID NO: 3429076 - RNA, 14 nt, Pseudomonas aeruginosa PA01
cgccgacaggccgg

SEQ ID NO: 3429077 - RNA, 15 nt, Pseudomonas aeruginosa PA01
cgccgacaggccggu

SEQ ID NO: 3429078 - RNA, 13 nt, Pseudomonas aeruginosa PA01
cgccgacaggucg

SEQ ID NO: 3429079 - RNA, 14 nt, Pseudomonas aeruginosa PA01
cgccgacaggucgg

SEQ ID NO: 3429080 - RNA, 17 nt, Pseudomonas aeruginosa PA01
cgccgacaggucggccg

SEQ ID NO: 3429081 - RNA, 19 nt, Pseudomonas aeruginosa PA01
cgccgacaggucggccggc

SEQ ID NO: 3429082 - RNA, 21 nt, Pseudomonas aeruginosa PA01
cgccgacaggucggccggcag

SEQ ID NO: 3429083 - RNA, 22 nt, Pseudomonas aeruginosa PA01
cgccgacaggucggccggcagc

SEQ ID NO: 3429084 - RNA, 13 nt, Pseudomonas aeruginosa PA01
cgccgaccacgac

SEQ ID NO: 3429085 - RNA, 13 nt, Pseudomonas aeruginosa PA01
cgccgaccagcac

SEQ ID NO: 3429086 - RNA, 14 nt, Pseudomonas aeruginosa PA01
cgccgaccagcacg

SEQ ID NO: 3429087 - RNA, 20 nt, Pseudomonas aeruginosa PA01
cgccgaccagcacggcgaau

SEQ ID NO: 3429088 - RNA, 19 nt, Pseudomonas aeruginosa PA01
cgccgaccagcuugggcac

SEQ ID NO: 3429089 - RNA, 16 nt, Pseudomonas aeruginosa PA01
cgccgaccaggcggcc

SEQ ID NO: 3429090 - RNA, 20 nt, Pseudomonas aeruginosa PA01
cgccgaccaggcggccgucg

SEQ ID NO: 3429091 - RNA, 15 nt, Pseudomonas aeruginosa PA01
cgccgacccagagcg

SEQ ID NO: 3429092 - RNA, 16 nt, Pseudomonas aeruginosa PA01
cgccgacccagagcgc

SEQ ID NO: 3429093 - RNA, 19 nt, Pseudomonas aeruginosa PA01
cgccgacccagagcgcgcc

SEQ ID NO: 3429094 - RNA, 21 nt, Pseudomonas aeruginosa PA01
cgccgacccagagcgcgcccu

SEQ ID NO: 3429095 - RNA, 21 nt, Pseudomonas aeruginosa PA01
cgccgacccuagggucggcgu

SEQ ID NO: 3429096 - RNA, 14 nt, Pseudomonas aeruginosa PA01
cgccgacccugcac

SEQ ID NO: 3429097 - RNA, 14 nt, Pseudomonas aeruginosa PA01
cgccgaccgacugg

SEQ ID NO: 3429098 - RNA, 20 nt, Pseudomonas aeruginosa PA01
cgccgaccgcaccgccagcg

SEQ ID NO: 3429099 - RNA, 22 nt, Pseudomonas aeruginosa PA01
cgccgaccgcaccgccagcguc

SEQ ID NO: 3429100 - RNA, 19 nt, Pseudomonas aeruginosa PA01
cgccgaccgccaaggucgg

SEQ ID NO: 3429101 - RNA, 12 nt, Pseudomonas aeruginosa PA01
cgccgaccgcgc

SEQ ID NO: 3429102 - RNA, 14 nt, Pseudomonas aeruginosa PA01
cgccgaccgcgcgc

SEQ ID NO: 3429103 - RNA, 15 nt, Pseudomonas aeruginosa PA01
cgccgaccgcgcgcc

SEQ ID NO: 3429104 - RNA, 18 nt, Pseudomonas aeruginosa PA01
cgccgaccgcgcgccugc

SEQ ID NO: 3429105 - RNA, 17 nt, Pseudomonas aeruginosa PA01
cgccgaccggacuccgc

SEQ ID NO: 3429106 - RNA, 21 nt, Pseudomonas aeruginosa PA01
cgccgaccggacuccgcggag

SEQ ID NO: 3429107 - RNA, 22 nt, Pseudomonas aeruginosa PA01
cgccgaccggacuccgcggaga

SEQ ID NO: 3429108 - RNA, 14 nt, Pseudomonas aeruginosa PA01
cgccgaccgggcgg

SEQ ID NO: 3429109 - RNA, 23 nt, Pseudomonas aeruginosa PA01
cgccgaccguggcgacaggcgau

SEQ ID NO: 3429110 - RNA, 17 nt, Pseudomonas aeruginosa PA01
cgccgaccucggccgcc

SEQ ID NO: 3429111 - RNA, 14 nt, Pseudomonas aeruginosa PA01
cgccgacgacccgg

SEQ ID NO: 3429112 - RNA, 23 nt, Pseudomonas aeruginosa PA01
cgccgacgacccggauaccccgg

SEQ ID NO: 3429113 - RNA, 15 nt, Pseudomonas aeruginosa PA01
cgccgacgccaccag

SEQ ID NO: 3429114 - RNA, 16 nt, Pseudomonas aeruginosa PA01
cgccgacgccaccagc

SEQ ID NO: 3429115 - RNA, 22 nt, Pseudomonas aeruginosa PA01
cgccgacgccaccagccaggcg

SEQ ID NO: 3429116 - RNA, 13 nt, Pseudomonas aeruginosa PA01
cgccgacgccgag

SEQ ID NO: 3429117 - RNA, 13 nt, Pseudomonas aeruginosa PA01
cgccgacgccgga

SEQ ID NO: 3429118 - RNA, 18 nt, Pseudomonas aeruginosa PA01
cgccgacgccggacgagc

SEQ ID NO: 3429119 - RNA, 12 nt, Pseudomonas aeruginosa PA01
cgccgacggcgu

SEQ ID NO: 3429120 - RNA, 14 nt, Pseudomonas aeruginosa PA01
cgccgacggcgugc

SEQ ID NO: 3429121 - RNA, 20 nt, Pseudomonas aeruginosa PA01
cgccgacggcuucgaccacg

SEQ ID NO: 3429122 - RNA, 22 nt, Pseudomonas aeruginosa PA01
cgccgacggcuucgaccacgac

SEQ ID NO: 3429123 - RNA, 22 nt, Pseudomonas aeruginosa PA01
cgccgacgucacggauaggcgg

SEQ ID NO: 3429124 - RNA, 22 nt, Pseudomonas aeruginosa PA01
cgccgacgucguggauaggcgg

SEQ ID NO: 3429125 - RNA, 17 nt, Pseudomonas aeruginosa PA01
cgccgacuggcagcgau

SEQ ID NO: 3429126 - RNA, 14 nt, Pseudomonas aeruginosa PA01
cgccgacuuccagg

SEQ ID NO: 3429127 - RNA, 15 nt, Pseudomonas aeruginosa PA01
cgccgacuuccaggc

SEQ ID NO: 3429128 - RNA, 17 nt, Pseudomonas aeruginosa PA01
cgccgacuuccaggcgc

SEQ ID NO: 3429129 - RNA, 18 nt, Pseudomonas aeruginosa PA01
cgccgacuuccaggcgca

SEQ ID NO: 3429130 - RNA, 19 nt, Pseudomonas aeruginosa PA01
cgccgacuuccaggcgcag

SEQ ID NO: 3429131 - RNA, 22 nt, Pseudomonas aeruginosa PA01
cgccgacuuccaggcgcaggcg

SEQ ID NO: 3429132 - RNA, 14 nt, Pseudomonas aeruginosa PA01
cgccgacuucggca

SEQ ID NO: 3429133 - RNA, 19 nt, Pseudomonas aeruginosa PA01
cgccgacuugcucaucgcg

SEQ ID NO: 3429134 - RNA, 15 nt, Pseudomonas aeruginosa PA01
cgccgagaacccggc

SEQ ID NO: 3429135 - RNA, 19 nt, Pseudomonas aeruginosa PA01
cgccgagaacccggccagg

SEQ ID NO: 3429136 - RNA, 15 nt, Pseudomonas aeruginosa PA01
cgccgagaacgcggc

SEQ ID NO: 3429137 - RNA, 17 nt, Pseudomonas aeruginosa PA01
cgccgagaacgcggcga

SEQ ID NO: 3429138 - RNA, 19 nt, Pseudomonas aeruginosa PA01
cgccgagaacgcggcgaag

SEQ ID NO: 3429139 - RNA, 17 nt, Pseudomonas aeruginosa PA01
cgccgagacgaucagca

SEQ ID NO: 3429140 - RNA, 19 nt, Pseudomonas aeruginosa PA01
cgccgagacgaucagcagg

SEQ ID NO: 3429141 - RNA, 22 nt, Pseudomonas aeruginosa PA01
cgccgagauagcggcaacgcgc

SEQ ID NO: 3429142 - RNA, 15 nt, Pseudomonas aeruginosa PA01
cgccgagcaaccgcg

SEQ ID NO: 3429143 - RNA, 20 nt, Pseudomonas aeruginosa PA01
cgccgagcaaccgcgauggc

SEQ ID NO: 3429144 - RNA, 21 nt, Pseudomonas aeruginosa PA01
cgccgagcaaccgcgauggcg

SEQ ID NO: 3429145 - RNA, 13 nt, Pseudomonas aeruginosa PA01
cgccgagcaacgg

SEQ ID NO: 3429146 - RNA, 15 nt, Pseudomonas aeruginosa PA01
cgccgagcaacggca

SEQ ID NO: 3429147 - RNA, 17 nt, Pseudomonas aeruginosa PA01
cgccgagcaagccuucc

SEQ ID NO: 3429148 - RNA, 12 nt, Pseudomonas aeruginosa PA01
cgccgagcaccc

SEQ ID NO: 3429149 - RNA, 14 nt, Pseudomonas aeruginosa PA01
cgccgagcaccccg

SEQ ID NO: 3429150 - RNA, 14 nt, Pseudomonas aeruginosa PA01
cgccgagcagcacc

SEQ ID NO: 3429151 - RNA, 18 nt, Pseudomonas aeruginosa PA01
cgccgagcagcaccaggc

SEQ ID NO: 3429152 - RNA, 19 nt, Pseudomonas aeruginosa PA01
cgccgagcagcaccaggcu

SEQ ID NO: 3429153 - RNA, 12 nt, Pseudomonas aeruginosa PA01
cgccgagcagcg

SEQ ID NO: 3429154 - RNA, 18 nt, Pseudomonas aeruginosa PA01
cgccgagcagcggcgcgc

SEQ ID NO: 3429155 - RNA, 14 nt, Pseudomonas aeruginosa PA01
cgccgagcauccag

SEQ ID NO: 3429156 - RNA, 21 nt, Pseudomonas aeruginosa PA01
cgccgagcaugaugcaggcag

SEQ ID NO: 3429157 - RNA, 18 nt, Pseudomonas aeruginosa PA01
cgccgagcaugcgggcga

SEQ ID NO: 3429158 - RNA, 14 nt, Pseudomonas aeruginosa PA01
cgccgagccagccg

SEQ ID NO: 3429159 - RNA, 15 nt, Pseudomonas aeruginosa PA01
cgccgagccagccgc

SEQ ID NO: 3429160 - RNA, 17 nt, Pseudomonas aeruginosa PA01
cgccgagccagguacgg

SEQ ID NO: 3429161 - RNA, 12 nt, Pseudomonas aeruginosa PA01
cgccgagccccc

SEQ ID NO: 3429162 - RNA, 22 nt, Pseudomonas aeruginosa PA01
cgccgagcccccggcgcccaga

SEQ ID NO: 3429163 - RNA, 12 nt, Pseudomonas aeruginosa PA01
cgccgagccggc

SEQ ID NO: 3429164 - RNA, 13 nt, Pseudomonas aeruginosa PA01
cgccgagccggcu

SEQ ID NO: 3429165 - RNA, 14 nt, Pseudomonas aeruginosa PA01
cgccgagccggcug

SEQ ID NO: 3429166 - RNA, 14 nt, Pseudomonas aeruginosa PA01
cgccgagcgccgcc

SEQ ID NO: 3429167 - RNA, 15 nt, Pseudomonas aeruginosa PA01
cgccgagcgccgcca

SEQ ID NO: 3429168 - RNA, 17 nt, Pseudomonas aeruginosa PA01
cgccgagcgccgccagg

SEQ ID NO: 3429169 - RNA, 18 nt, Pseudomonas aeruginosa PA01
cgccgagcgccgccaggc

SEQ ID NO: 3429170 - RNA, 19 nt, Pseudomonas aeruginosa PA01
cgccgagcgccgccaggca

SEQ ID NO: 3429171 - RNA, 23 nt, Pseudomonas aeruginosa PA01
cgccgagcgccgccaggcaggcc

SEQ ID NO: 3429172 - RNA, 14 nt, Pseudomonas aeruginosa PA01
cgccgagcgccugg

SEQ ID NO: 3429173 - RNA, 16 nt, Pseudomonas aeruginosa PA01
cgccgagcgccuggca

SEQ ID NO: 3429174 - RNA, 14 nt, Pseudomonas aeruginosa PA01
cgccgagcgcucgc

SEQ ID NO: 3429175 - RNA, 21 nt, Pseudomonas aeruginosa PA01
cgccgagcgcucgccgucauc

SEQ ID NO: 3429176 - RNA, 17 nt, Pseudomonas aeruginosa PA01
cgccgagcugaccacca

SEQ ID NO: 3429177 - RNA, 18 nt, Pseudomonas aeruginosa PA01
cgccgagcugaccaccag

SEQ ID NO: 3429178 - RNA, 19 nt, Pseudomonas aeruginosa PA01
cgccgagcugaccaccagg

SEQ ID NO: 3429179 - RNA, 23 nt, Pseudomonas aeruginosa PA01
cgccgagcugaccaccagggcga

SEQ ID NO: 3429180 - RNA, 22 nt, Pseudomonas aeruginosa PA01
cgccgagcugauugagggucag

SEQ ID NO: 3429181 - RNA, 20 nt, Pseudomonas aeruginosa PA01
cgccgaggaacauccgcggc

SEQ ID NO: 3429182 - RNA, 23 nt, Pseudomonas aeruginosa PA01
cgccgaggaacuucaugaugcgc

SEQ ID NO: 3429183 - RNA, 17 nt, Pseudomonas aeruginosa PA01
cgccgaggaagccgacc

SEQ ID NO: 3429184 - RNA, 18 nt, Pseudomonas aeruginosa PA01
cgccgaggaagccgaccg

SEQ ID NO: 3429185 - RNA, 20 nt, Pseudomonas aeruginosa PA01
cgccgaggaagccgaccggc

SEQ ID NO: 3429186 - RNA, 21 nt, Pseudomonas aeruginosa PA01
cgccgaggaagccgaccggcg

SEQ ID NO: 3429187 - RNA, 22 nt, Pseudomonas aeruginosa PA01
cgccgaggaagccgaccggcgc

SEQ ID NO: 3429188 - RNA, 17 nt, Pseudomonas aeruginosa PA01
cgccgaggagacgcggc

SEQ ID NO: 3429189 - RNA, 18 nt, Pseudomonas aeruginosa PA01
cgccgaggagacgcggca

SEQ ID NO: 3429190 - RNA, 22 nt, Pseudomonas aeruginosa PA01
cgccgaggaggaucucgcgccc

SEQ ID NO: 3429191 - RNA, 13 nt, Pseudomonas aeruginosa PA01
cgccgaggauacg

SEQ ID NO: 3429192 - RNA, 15 nt, Pseudomonas aeruginosa PA01
cgccgaggauacgcu

SEQ ID NO: 3429193 - RNA, 19 nt, Pseudomonas aeruginosa PA01
cgccgaggauacgcucagg

SEQ ID NO: 3429194 - RNA, 11 nt, Pseudomonas aeruginosa PA01
cgccgaggccc

SEQ ID NO: 3429195 - RNA, 13 nt, Pseudomonas aeruginosa PA01
cgccgaggcccag

SEQ ID NO: 3429196 - RNA, 15 nt, Pseudomonas aeruginosa PA01
cgccgaggcccagcg

SEQ ID NO: 3429197 - RNA, 12 nt, Pseudomonas aeruginosa PA01
cgccgaggcgcg

SEQ ID NO: 3429198 - RNA, 15 nt, Pseudomonas aeruginosa PA01
cgccgaggcgcgcca

SEQ ID NO: 3429199 - RNA, 17 nt, Pseudomonas aeruginosa PA01
cgccgaggcggaagacg

SEQ ID NO: 3429200 - RNA, 21 nt, Pseudomonas aeruginosa PA01
cgccgaggcggaagacgaucu

SEQ ID NO: 3429201 - RNA, 15 nt, Pseudomonas aeruginosa PA01
cgccgaggcggcgca

SEQ ID NO: 3429202 - RNA, 14 nt, Pseudomonas aeruginosa PA01
cgccgaggcgucga

SEQ ID NO: 3429203 - RNA, 15 nt, Pseudomonas aeruginosa PA01
cgccgaggcugcggg

SEQ ID NO: 3429204 - RNA, 17 nt, Pseudomonas aeruginosa PA01
cgccgagggcaccgacg

SEQ ID NO: 3429205 - RNA, 23 nt, Pseudomonas aeruginosa PA01
cgccgagggcaccgacgaugggc

SEQ ID NO: 3429206 - RNA, 14 nt, Pseudomonas aeruginosa PA01
cgccgagggcgcca

SEQ ID NO: 3429207 - RNA, 16 nt, Pseudomonas aeruginosa PA01
cgccgagggcgccagg

SEQ ID NO: 3429208 - RNA, 17 nt, Pseudomonas aeruginosa PA01
cgccgagggcgccaggu

SEQ ID NO: 3429209 - RNA, 14 nt, Pseudomonas aeruginosa PA01
cgccgagggcgcgg

SEQ ID NO: 3429210 - RNA, 17 nt, Pseudomonas aeruginosa PA01
cgccgagggcgcggcgc

SEQ ID NO: 3429211 - RNA, 20 nt, Pseudomonas aeruginosa PA01
cgccgagggcgcggcgccag

SEQ ID NO: 3429212 - RNA, 23 nt, Pseudomonas aeruginosa PA01
cgccgagggcuguaaucgccgcu

SEQ ID NO: 3429213 - RNA, 13 nt, Pseudomonas aeruginosa PA01
cgccgaggggcgg

SEQ ID NO: 3429214 - RNA, 15 nt, Pseudomonas aeruginosa PA01
cgccgaggggcggga

SEQ ID NO: 3429215 - RNA, 17 nt, Pseudomonas aeruginosa PA01
cgccgaggucaguucgg

SEQ ID NO: 3429216 - RNA, 20 nt, Pseudomonas aeruginosa PA01
cgccgaggucuuggccagcc

SEQ ID NO: 3429217 - RNA, 21 nt, Pseudomonas aeruginosa PA01
cgccgaggucuuggccagccg

SEQ ID NO: 3429218 - RNA, 14 nt, Pseudomonas aeruginosa PA01
cgccgagguugcgc

SEQ ID NO: 3429219 - RNA, 18 nt, Pseudomonas aeruginosa PA01
cgccgagguugcgcagga

SEQ ID NO: 3429220 - RNA, 16 nt, Pseudomonas aeruginosa PA01
cgccgaguggccgcug

SEQ ID NO: 3429221 - RNA, 14 nt, Pseudomonas aeruginosa PA01
cgccgagugugccg

SEQ ID NO: 3429222 - RNA, 17 nt, Pseudomonas aeruginosa PA01
cgccgagugugccggcc

SEQ ID NO: 3429223 - RNA, 23 nt, Pseudomonas aeruginosa PA01
cgccgaguucgccgcgagcacca

SEQ ID NO: 3429224 - RNA, 16 nt, Pseudomonas aeruginosa PA01
cgccgaguuggcccaa

SEQ ID NO: 3429225 - RNA, 16 nt, Pseudomonas aeruginosa PA01
cgccgauacaccacca

SEQ ID NO: 3429226 - RNA, 22 nt, Pseudomonas aeruginosa PA01
cgccgauacaccaccauaccga

SEQ ID NO: 3429227 - RNA, 14 nt, Pseudomonas aeruginosa PA01
cgccgauacagcgc

SEQ ID NO: 3429228 - RNA, 15 nt, Pseudomonas aeruginosa PA01
cgccgauacagcgcg

SEQ ID NO: 3429229 - RNA, 16 nt, Pseudomonas aeruginosa PA01
cgccgauacagcgcgc

SEQ ID NO: 3429230 - RNA, 20 nt, Pseudomonas aeruginosa PA01
cgccgaucaccaggaucgcc

SEQ ID NO: 3429231 - RNA, 13 nt, Pseudomonas aeruginosa PA01
cgccgaucacccc

SEQ ID NO: 3429232 - RNA, 14 nt, Pseudomonas aeruginosa PA01
cgccgaucaccccg

SEQ ID NO: 3429233 - RNA, 15 nt, Pseudomonas aeruginosa PA01
cgccgaucaccccgc

SEQ ID NO: 3429234 - RNA, 17 nt, Pseudomonas aeruginosa PA01
cgccgaucaccccgccc

SEQ ID NO: 3429235 - RNA, 19 nt, Pseudomonas aeruginosa PA01
cgccgaucaccccgcccag

SEQ ID NO: 3429236 - RNA, 13 nt, Pseudomonas aeruginosa PA01
cgccgaucaggcg

SEQ ID NO: 3429237 - RNA, 21 nt, Pseudomonas aeruginosa PA01
cgccgauccaggaaccggcca

SEQ ID NO: 3429238 - RNA, 23 nt, Pseudomonas aeruginosa PA01
cgccgauccaggaaccggccauu

SEQ ID NO: 3429239 - RNA, 23 nt, Pseudomonas aeruginosa PA01
cgccgaucccgacgcccuccagc

SEQ ID NO: 3429240 - RNA, 17 nt, Pseudomonas aeruginosa PA01
cgccgaucccgaucggc

SEQ ID NO: 3429241 - RNA, 20 nt, Pseudomonas aeruginosa PA01
cgccgaucccgaucggcaag

SEQ ID NO: 3429242 - RNA, 21 nt, Pseudomonas aeruginosa PA01
cgccgaucccgaucggcaagc

SEQ ID NO: 3429243 - RNA, 13 nt, Pseudomonas aeruginosa PA01
cgccgaucccggc

SEQ ID NO: 3429244 - RNA, 14 nt, Pseudomonas aeruginosa PA01
cgccgaucccggcg

SEQ ID NO: 3429245 - RNA, 16 nt, Pseudomonas aeruginosa PA01
cgccgaucccggcggc

SEQ ID NO: 3429246 - RNA, 17 nt, Pseudomonas aeruginosa PA01
cgccgaucccggcggcg

SEQ ID NO: 3429247 - RNA, 20 nt, Pseudomonas aeruginosa PA01
cgccgaucccggcggcgacc

SEQ ID NO: 3429248 - RNA, 17 nt, Pseudomonas aeruginosa PA01
cgccgaucuccuccgcc

SEQ ID NO: 3429249 - RNA, 21 nt, Pseudomonas aeruginosa PA01
cgccgaucuccuccgccccgg

SEQ ID NO: 3429250 - RNA, 23 nt, Pseudomonas aeruginosa PA01
cgccgaucuccuccgccccggca

SEQ ID NO: 3429251 - RNA, 14 nt, Pseudomonas aeruginosa PA01
cgccgaucugcagg

SEQ ID NO: 3429252 - RNA, 17 nt, Pseudomonas aeruginosa PA01
cgccgaugaaagagccc

SEQ ID NO: 3429253 - RNA, 20 nt, Pseudomonas aeruginosa PA01
cgccgaugaaagagcccgcg

SEQ ID NO: 3429254 - RNA, 18 nt, Pseudomonas aeruginosa PA01
cgccgaugcccaggccga

SEQ ID NO: 3429255 - RNA, 19 nt, Pseudomonas aeruginosa PA01
cgccgaugcccaggccgau

SEQ ID NO: 3429256 - RNA, 12 nt, Pseudomonas aeruginosa PA01
cgccgaugcccg

SEQ ID NO: 3429257 - RNA, 18 nt, Pseudomonas aeruginosa PA01
cgccgaugccgacgucga

SEQ ID NO: 3429258 - RNA, 19 nt, Pseudomonas aeruginosa PA01
cgccgaugccgacgucgac

SEQ ID NO: 3429259 - RNA, 17 nt, Pseudomonas aeruginosa PA01
cgccgaugccggccggc

SEQ ID NO: 3429260 - RNA, 21 nt, Pseudomonas aeruginosa PA01
cgccgaugccggccggcagcg

SEQ ID NO: 3429261 - RNA, 19 nt, Pseudomonas aeruginosa PA01
cgccgaugcgccgacgcca

SEQ ID NO: 3429262 - RNA, 17 nt, Pseudomonas aeruginosa PA01
cgccgaugcgcuacggc

SEQ ID NO: 3429263 - RNA, 21 nt, Pseudomonas aeruginosa PA01
cgccgaugcgcuacggcauca

SEQ ID NO: 3429264 - RNA, 23 nt, Pseudomonas aeruginosa PA01
cgccgaugcucggugugaucacc

SEQ ID NO: 3429265 - RNA, 12 nt, Pseudomonas aeruginosa PA01
cgccgaugcugu

SEQ ID NO: 3429266 - RNA, 22 nt, Pseudomonas aeruginosa PA01
cgccgauguacggcaccaccac

SEQ ID NO: 3429267 - RNA, 23 nt, Pseudomonas aeruginosa PA01
cgccgauguacggcaccaccacc

SEQ ID NO: 3429268 - RNA, 21 nt, Pseudomonas aeruginosa PA01
cgccgaugucguagccgcgcg

SEQ ID NO: 3429269 - RNA, 16 nt, Pseudomonas aeruginosa PA01
cgccgauugugcaggg

SEQ ID NO: 3429270 - RNA, 18 nt, Pseudomonas aeruginosa PA01
cgccgauugugcagggcc

SEQ ID NO: 3429271 - RNA, 15 nt, Pseudomonas aeruginosa PA01
cgccgcaaccgcccg

SEQ ID NO: 3429272 - RNA, 17 nt, Pseudomonas aeruginosa PA01
cgccgcaaccgcccgag

SEQ ID NO: 3429273 - RNA, 18 nt, Pseudomonas aeruginosa PA01
cgccgcaagggcgucgcu

SEQ ID NO: 3429274 - RNA, 16 nt, Pseudomonas aeruginosa PA01
cgccgcaaguggcggc

SEQ ID NO: 3429275 - RNA, 20 nt, Pseudomonas aeruginosa PA01
cgccgcaaguggcggcugaa

SEQ ID NO: 3429276 - RNA, 21 nt, Pseudomonas aeruginosa PA01
cgccgcaaguggcggcugaag

SEQ ID NO: 3429277 - RNA, 17 nt, Pseudomonas aeruginosa PA01
cgccgcacaccgcgcgc

SEQ ID NO: 3429278 - RNA, 18 nt, Pseudomonas aeruginosa PA01
cgccgcacaccgcgcgcg

SEQ ID NO: 3429279 - RNA, 19 nt, Pseudomonas aeruginosa PA01
cgccgcacaccgcgcgcgc

SEQ ID NO: 3429280 - RNA, 23 nt, Pseudomonas aeruginosa PA01
cgccgcacaccgcgcgcgccugc

SEQ ID NO: 3429281 - RNA, 21 nt, Pseudomonas aeruginosa PA01
cgccgcaccacguagccggcg

SEQ ID NO: 3429282 - RNA, 16 nt, Pseudomonas aeruginosa PA01
cgccgcaccggcgaug

SEQ ID NO: 3429283 - RNA, 18 nt, Pseudomonas aeruginosa PA01
cgccgcaccggcgauggc

SEQ ID NO: 3429284 - RNA, 19 nt, Pseudomonas aeruginosa PA01
cgccgcaccggcgauggcc

SEQ ID NO: 3429285 - RNA, 12 nt, Pseudomonas aeruginosa PA01
cgccgcagacca

SEQ ID NO: 3429286 - RNA, 14 nt, Pseudomonas aeruginosa PA01
cgccgcagaccagc

SEQ ID NO: 3429287 - RNA, 19 nt, Pseudomonas aeruginosa PA01
cgccgcagagccagccgca

SEQ ID NO: 3429288 - RNA, 20 nt, Pseudomonas aeruginosa PA01
cgccgcagagccagccgcag

SEQ ID NO: 3429289 - RNA, 19 nt, Pseudomonas aeruginosa PA01
cgccgcagcccuaggcgac

SEQ ID NO: 3429290 - RNA, 12 nt, Pseudomonas aeruginosa PA01
cgccgcagccgu

SEQ ID NO: 3429291 - RNA, 17 nt, Pseudomonas aeruginosa PA01
cgccgcagccguggcgc

SEQ ID NO: 3429292 - RNA, 17 nt, Pseudomonas aeruginosa PA01
cgccgcagcgcaagucg

SEQ ID NO: 3429293 - RNA, 23 nt, Pseudomonas aeruginosa PA01
cgccgcagcgcaagucggccugc

SEQ ID NO: 3429294 - RNA, 16 nt, Pseudomonas aeruginosa PA01
cgccgcagcggccagg

SEQ ID NO: 3429295 - RNA, 23 nt, Pseudomonas aeruginosa PA01
cgccgcagcggcgucugccgcuc

SEQ ID NO: 3429296 - RNA, 14 nt, Pseudomonas aeruginosa PA01
cgccgcagcgguuc

SEQ ID NO: 3429297 - RNA, 12 nt, Pseudomonas aeruginosa PA01
cgccgcagcucg

SEQ ID NO: 3429298 - RNA, 14 nt, Pseudomonas aeruginosa PA01
cgccgcagcucggc

SEQ ID NO: 3429299 - RNA, 16 nt, Pseudomonas aeruginosa PA01
cgccgcagcucggccu

SEQ ID NO: 3429300 - RNA, 13 nt, Pseudomonas aeruginosa PA01
cgccgcaggaagg

SEQ ID NO: 3429301 - RNA, 19 nt, Pseudomonas aeruginosa PA01
cgccgcaggaaggcgaagc

SEQ ID NO: 3429302 - RNA, 13 nt, Pseudomonas aeruginosa PA01
cgccgcaggcgcu

SEQ ID NO: 3429303 - RNA, 19 nt, Pseudomonas aeruginosa PA01
cgccgcagggugcggcugc

SEQ ID NO: 3429304 - RNA, 13 nt, Pseudomonas aeruginosa PA01
cgccgcagguccg

SEQ ID NO: 3429305 - RNA, 12 nt, Pseudomonas aeruginosa PA01
cgccgcaggucg

SEQ ID NO: 3429306 - RNA, 17 nt, Pseudomonas aeruginosa PA01
cgccgcaggucggcguc

SEQ ID NO: 3429307 - RNA, 20 nt, Pseudomonas aeruginosa PA01
cgccgcagguugcacuugaa

SEQ ID NO: 3429308 - RNA, 18 nt, Pseudomonas aeruginosa PA01
cgccgcaguuguuccucg

SEQ ID NO: 3429309 - RNA, 22 nt, Pseudomonas aeruginosa PA01
cgccgcaguuguuccucgcggc

SEQ ID NO: 3429310 - RNA, 12 nt, Pseudomonas aeruginosa PA01
cgccgcaucgcu

SEQ ID NO: 3429311 - RNA, 15 nt, Pseudomonas aeruginosa PA01
cgccgcaucgcugac

SEQ ID NO: 3429312 - RNA, 17 nt, Pseudomonas aeruginosa PA01
cgccgcaucgcugaccu

SEQ ID NO: 3429313 - RNA, 16 nt, Pseudomonas aeruginosa PA01
cgccgcauuggccagg

SEQ ID NO: 3429314 - RNA, 19 nt, Pseudomonas aeruginosa PA01
cgccgcauuggccaggccc

SEQ ID NO: 3429315 - RNA, 13 nt, Pseudomonas aeruginosa PA01
cgccgccaaccac

SEQ ID NO: 3429316 - RNA, 19 nt, Pseudomonas aeruginosa PA01
cgccgccaaccacuccgcc

SEQ ID NO: 3429317 - RNA, 12 nt, Pseudomonas aeruginosa PA01
cgccgccaacug

SEQ ID NO: 3429318 - RNA, 17 nt, Pseudomonas aeruginosa PA01
cgccgccaacuggcugu

SEQ ID NO: 3429319 - RNA, 20 nt, Pseudomonas aeruginosa PA01
cgccgccaacuggcugucga

SEQ ID NO: 3429320 - RNA, 18 nt, Pseudomonas aeruginosa PA01
cgccgccaccacgaucag

SEQ ID NO: 3429321 - RNA, 19 nt, Pseudomonas aeruginosa PA01
cgccgccaccacgaucagg

SEQ ID NO: 3429322 - RNA, 19 nt, Pseudomonas aeruginosa PA01
cgccgccacgugcacgccg

SEQ ID NO: 3429323 - RNA, 22 nt, Pseudomonas aeruginosa PA01
cgccgccacgugcacgccgugc

SEQ ID NO: 3429324 - RNA, 11 nt, Pseudomonas aeruginosa PA01
cgccgccagca

SEQ ID NO: 3429325 - RNA, 14 nt, Pseudomonas aeruginosa PA01
cgccgccagcaaca

SEQ ID NO: 3429326 - RNA, 14 nt, Pseudomonas aeruginosa PA01
cgccgccagcaacg

SEQ ID NO: 3429327 - RNA, 16 nt, Pseudomonas aeruginosa PA01
cgccgccagcaacggc

SEQ ID NO: 3429328 - RNA, 14 nt, Pseudomonas aeruginosa PA01
cgccgccagcagga

SEQ ID NO: 3429329 - RNA, 16 nt, Pseudomonas aeruginosa PA01
cgccgccagcaggauc

SEQ ID NO: 3429330 - RNA, 16 nt, Pseudomonas aeruginosa PA01
cgccgccagcauggcg

SEQ ID NO: 3429331 - RNA, 17 nt, Pseudomonas aeruginosa PA01
cgccgccagccagagca

SEQ ID NO: 3429332 - RNA, 13 nt, Pseudomonas aeruginosa PA01
cgccgccagcgcc

SEQ ID NO: 3429333 - RNA, 19 nt, Pseudomonas aeruginosa PA01
cgccgccagcuaccggcag

SEQ ID NO: 3429334 - RNA, 20 nt, Pseudomonas aeruginosa PA01
cgccgccagcuaccggcagg

SEQ ID NO: 3429335 - RNA, 13 nt, Pseudomonas aeruginosa PA01
cgccgccaggcag

SEQ ID NO: 3429336 - RNA, 18 nt, Pseudomonas aeruginosa PA01
cgccgccaggcagaccug

SEQ ID NO: 3429337 - RNA, 20 nt, Pseudomonas aeruginosa PA01
cgccgccaggcagaccugca

SEQ ID NO: 3429338 - RNA, 16 nt, Pseudomonas aeruginosa PA01
cgccgccaggcaggcc

SEQ ID NO: 3429339 - RNA, 18 nt, Pseudomonas aeruginosa PA01
cgccgccaggcaggccgg

SEQ ID NO: 3429340 - RNA, 19 nt, Pseudomonas aeruginosa PA01
cgccgccaggcaggccggg

SEQ ID NO: 3429341 - RNA, 13 nt, Pseudomonas aeruginosa PA01
cgccgccaggccc

SEQ ID NO: 3429342 - RNA, 21 nt, Pseudomonas aeruginosa PA01
cgccgccaggcccugggcggc

SEQ ID NO: 3429343 - RNA, 14 nt, Pseudomonas aeruginosa PA01
cgccgccaggcgcg

SEQ ID NO: 3429344 - RNA, 14 nt, Pseudomonas aeruginosa PA01
cgccgccaggcgcu

SEQ ID NO: 3429345 - RNA, 20 nt, Pseudomonas aeruginosa PA01
cgccgccaggcgcuggcgaa

SEQ ID NO: 3429346 - RNA, 14 nt, Pseudomonas aeruginosa PA01
cgccgccaggcggc

SEQ ID NO: 3429347 - RNA, 23 nt, Pseudomonas aeruginosa PA01
cgccgccaugguuuaccaggacc

SEQ ID NO: 3429348 - RNA, 18 nt, Pseudomonas aeruginosa PA01
cgccgccauugacgaaau

SEQ ID NO: 3429349 - RNA, 13 nt, Pseudomonas aeruginosa PA01
cgccgcccacgcc

SEQ ID NO: 3429350 - RNA, 21 nt, Pseudomonas aeruginosa PA01
cgccgcccacgccuugcagca

SEQ ID NO: 3429351 - RNA, 12 nt, Pseudomonas aeruginosa PA01
cgccgcccagca

SEQ ID NO: 3429352 - RNA, 13 nt, Pseudomonas aeruginosa PA01
cgccgcccagcag

SEQ ID NO: 3429353 - RNA, 15 nt, Pseudomonas aeruginosa PA01
cgccgcccagcagca

SEQ ID NO: 3429354 - RNA, 23 nt, Pseudomonas aeruginosa PA01
cgccgcccagcagcaccaucagc

SEQ ID NO: 3429355 - RNA, 13 nt, Pseudomonas aeruginosa PA01
cgccgccccagca

SEQ ID NO: 3429356 - RNA, 15 nt, Pseudomonas aeruginosa PA01
cgccgccccagcaac

SEQ ID NO: 3429357 - RNA, 19 nt, Pseudomonas aeruginosa PA01
cgccgccccagccucggca

SEQ ID NO: 3429358 - RNA, 20 nt, Pseudomonas aeruginosa PA01
cgccgccccagccucggcag

SEQ ID NO: 3429359 - RNA, 14 nt, Pseudomonas aeruginosa PA01
cgccgcccccagcg

SEQ ID NO: 3429360 - RNA, 15 nt, Pseudomonas aeruginosa PA01
cgccgcccccagcgc

SEQ ID NO: 3429361 - RNA, 16 nt, Pseudomonas aeruginosa PA01
cgccgcccccagcgcg

SEQ ID NO: 3429362 - RNA, 19 nt, Pseudomonas aeruginosa PA01
cgccgcccccagcgcgccg

SEQ ID NO: 3429363 - RNA, 21 nt, Pseudomonas aeruginosa PA01
cgccgcccccagcgcgccgcc

SEQ ID NO: 3429364 - RNA, 15 nt, Pseudomonas aeruginosa PA01
cgccgcccccggccc

SEQ ID NO: 3429365 - RNA, 18 nt, Pseudomonas aeruginosa PA01
cgccgcccccggcccggg

SEQ ID NO: 3429366 - RNA, 16 nt, Pseudomonas aeruginosa PA01
cgccgcccgaggcgac

SEQ ID NO: 3429367 - RNA, 14 nt, Pseudomonas aeruginosa PA01
cgccgcccgcgccu

SEQ ID NO: 3429368 - RNA, 15 nt, Pseudomonas aeruginosa PA01
cgccgcccgcgccuc

SEQ ID NO: 3429369 - RNA, 13 nt, Pseudomonas aeruginosa PA01
cgccgcccggcac

SEQ ID NO: 3429370 - RNA, 15 nt, Pseudomonas aeruginosa PA01
cgccgcccggcagcg

SEQ ID NO: 3429371 - RNA, 17 nt, Pseudomonas aeruginosa PA01
cgccgcccggcagcggc

SEQ ID NO: 3429372 - RNA, 15 nt, Pseudomonas aeruginosa PA01
cgccgcccggcucgc

SEQ ID NO: 3429373 - RNA, 13 nt, Pseudomonas aeruginosa PA01
cgccgcccucgca

SEQ ID NO: 3429374 - RNA, 14 nt, Pseudomonas aeruginosa PA01
cgccgcccuggccg

SEQ ID NO: 3429375 - RNA, 14 nt, Pseudomonas aeruginosa PA01
cgccgcccuguucg

SEQ ID NO: 3429376 - RNA, 17 nt, Pseudomonas aeruginosa PA01
cgccgcccuguucgucu

SEQ ID NO: 3429377 - RNA, 17 nt, Pseudomonas aeruginosa PA01
cgccgccgaacaugccg

SEQ ID NO: 3429378 - RNA, 13 nt, Pseudomonas aeruginosa PA01
cgccgccgaagcc

SEQ ID NO: 3429379 - RNA, 14 nt, Pseudomonas aeruginosa PA01
cgccgccgaagccg

SEQ ID NO: 3429380 - RNA, 21 nt, Pseudomonas aeruginosa PA01
cgccgccgaagccgacgccga

SEQ ID NO: 3429381 - RNA, 15 nt, Pseudomonas aeruginosa PA01
cgccgccgaccgggc

SEQ ID NO: 3429382 - RNA, 21 nt, Pseudomonas aeruginosa PA01
cgccgccgacgccaugggugg

SEQ ID NO: 3429383 - RNA, 12 nt, Pseudomonas aeruginosa PA01
cgccgccgacgu

SEQ ID NO: 3429384 - RNA, 19 nt, Pseudomonas aeruginosa PA01
cgccgccgagaacccggcc

SEQ ID NO: 3429385 - RNA, 15 nt, Pseudomonas aeruginosa PA01
cgccgccgagcaggc

SEQ ID NO: 3429386 - RNA, 16 nt, Pseudomonas aeruginosa PA01
cgccgccgagcgccug

SEQ ID NO: 3429387 - RNA, 15 nt, Pseudomonas aeruginosa PA01
cgccgccgaggagga

SEQ ID NO: 3429388 - RNA, 22 nt, Pseudomonas aeruginosa PA01
cgccgccgaggauagcguccag

SEQ ID NO: 3429389 - RNA, 13 nt, Pseudomonas aeruginosa PA01
cgccgccgaggcg

SEQ ID NO: 3429390 - RNA, 18 nt, Pseudomonas aeruginosa PA01
cgccgccgaggcgcgcca

SEQ ID NO: 3429391 - RNA, 14 nt, Pseudomonas aeruginosa PA01
cgccgccgagggca

SEQ ID NO: 3429392 - RNA, 19 nt, Pseudomonas aeruginosa PA01
cgccgccgagguugcgcag

SEQ ID NO: 3429393 - RNA, 14 nt, Pseudomonas aeruginosa PA01
cgccgccgaucugc

SEQ ID NO: 3429394 - RNA, 13 nt, Pseudomonas aeruginosa PA01
cgccgccgcaacc

SEQ ID NO: 3429395 - RNA, 14 nt, Pseudomonas aeruginosa PA01
cgccgccgccggga

SEQ ID NO: 3429396 - RNA, 13 nt, Pseudomonas aeruginosa PA01
cgccgccgcgccg

SEQ ID NO: 3429397 - RNA, 16 nt, Pseudomonas aeruginosa PA01
cgccgccgcgccggcg

SEQ ID NO: 3429398 - RNA, 14 nt, Pseudomonas aeruginosa PA01
cgccgccgcgccuu

SEQ ID NO: 3429399 - RNA, 13 nt, Pseudomonas aeruginosa PA01
cgccgccgcgcgc

SEQ ID NO: 3429400 - RNA, 14 nt, Pseudomonas aeruginosa PA01
cgccgccgcgcgcg

SEQ ID NO: 3429401 - RNA, 15 nt, Pseudomonas aeruginosa PA01
cgccgccgcgcgcgc

SEQ ID NO: 3429402 - RNA, 14 nt, Pseudomonas aeruginosa PA01
cgccgccgcggcca

SEQ ID NO: 3429403 - RNA, 14 nt, Pseudomonas aeruginosa PA01
cgccgccgcggcgc

SEQ ID NO: 3429404 - RNA, 12 nt, Pseudomonas aeruginosa PA01
cgccgccgcggg

SEQ ID NO: 3429405 - RNA, 15 nt, Pseudomonas aeruginosa PA01
cgccgccgcugcguc

SEQ ID NO: 3429406 - RNA, 15 nt, Pseudomonas aeruginosa PA01
cgccgccgcuggcga

SEQ ID NO: 3429407 - RNA, 11 nt, Pseudomonas aeruginosa PA01
cgccgccggag

SEQ ID NO: 3429408 - RNA, 13 nt, Pseudomonas aeruginosa PA01
cgccgccggaggg

SEQ ID NO: 3429409 - RNA, 22 nt, Pseudomonas aeruginosa PA01
cgccgccggauuagcucagucg

SEQ ID NO: 3429410 - RNA, 14 nt, Pseudomonas aeruginosa PA01
cgccgccggccagc

SEQ ID NO: 3429411 - RNA, 20 nt, Pseudomonas aeruginosa PA01
cgccgccggccagccgcgcc

SEQ ID NO: 3429412 - RNA, 13 nt, Pseudomonas aeruginosa PA01
cgccgccggcgaa

SEQ ID NO: 3429413 - RNA, 20 nt, Pseudomonas aeruginosa PA01
cgccgccggcgaacagccag

SEQ ID NO: 3429414 - RNA, 21 nt, Pseudomonas aeruginosa PA01
cgccgccggcgaacagccagc

SEQ ID NO: 3429415 - RNA, 13 nt, Pseudomonas aeruginosa PA01
cgccgccggcgag

SEQ ID NO: 3429416 - RNA, 14 nt, Pseudomonas aeruginosa PA01
cgccgccggcgagg

SEQ ID NO: 3429417 - RNA, 16 nt, Pseudomonas aeruginosa PA01
cgccgccggcgaggau

SEQ ID NO: 3429418 - RNA, 12 nt, Pseudomonas aeruginosa PA01
cgccgccggcgu

SEQ ID NO: 3429419 - RNA, 21 nt, Pseudomonas aeruginosa PA01
cgccgccggcguuauccgccg

SEQ ID NO: 3429420 - RNA, 18 nt, Pseudomonas aeruginosa PA01
cgccgccggcuccuugcg

SEQ ID NO: 3429421 - RNA, 13 nt, Pseudomonas aeruginosa PA01
cgccgccgggcgc

SEQ ID NO: 3429422 - RNA, 21 nt, Pseudomonas aeruginosa PA01
cgccgccgggcgcccggccgg

SEQ ID NO: 3429423 - RNA, 14 nt, Pseudomonas aeruginosa PA01
cgccgccgggcgcg

SEQ ID NO: 3429424 - RNA, 19 nt, Pseudomonas aeruginosa PA01
cgccgccgggcgcgcgccu

SEQ ID NO: 3429425 - RNA, 13 nt, Pseudomonas aeruginosa PA01
cgccgccgggcgu

SEQ ID NO: 3429426 - RNA, 13 nt, Pseudomonas aeruginosa PA01
cgccgccgggcuu

SEQ ID NO: 3429427 - RNA, 21 nt, Pseudomonas aeruginosa PA01
cgccgccggggaucagcgaga

SEQ ID NO: 3429428 - RNA, 15 nt, Pseudomonas aeruginosa PA01
cgccgccgguagccg

SEQ ID NO: 3429429 - RNA, 20 nt, Pseudomonas aeruginosa PA01
cgccgccggugcaccaggcg

SEQ ID NO: 3429430 - RNA, 16 nt, Pseudomonas aeruginosa PA01
cgccgccgucuuccuc

SEQ ID NO: 3429431 - RNA, 19 nt, Pseudomonas aeruginosa PA01
cgccgccgucuugccgcug

SEQ ID NO: 3429432 - RNA, 17 nt, Pseudomonas aeruginosa PA01
cgccgccguggcugugc

SEQ ID NO: 3429433 - RNA, 21 nt, Pseudomonas aeruginosa PA01
cgccgccguggcugugcuggc

SEQ ID NO: 3429434 - RNA, 17 nt, Pseudomonas aeruginosa PA01
cgccgccguugaggaag

SEQ ID NO: 3429435 - RNA, 23 nt, Pseudomonas aeruginosa PA01
cgccgccuauccacgacgucggc

SEQ ID NO: 3429436 - RNA, 23 nt, Pseudomonas aeruginosa PA01
cgccgccuauccgugacgucggc

SEQ ID NO: 3429437 - RNA, 16 nt, Pseudomonas aeruginosa PA01
cgccgccucgaaggcc

SEQ ID NO: 3429438 - RNA, 18 nt, Pseudomonas aeruginosa PA01
cgccgccucgaaggccgg

SEQ ID NO: 3429439 - RNA, 16 nt, Pseudomonas aeruginosa PA01
cgccgccucgauggcg

SEQ ID NO: 3429440 - RNA, 18 nt, Pseudomonas aeruginosa PA01
cgccgccucgauggcggc

SEQ ID NO: 3429441 - RNA, 22 nt, Pseudomonas aeruginosa PA01
cgccgccucgcgcaacgccuug

SEQ ID NO: 3429442 - RNA, 21 nt, Pseudomonas aeruginosa PA01
cgccgccucgcugggcgggcg

SEQ ID NO: 3429443 - RNA, 22 nt, Pseudomonas aeruginosa PA01
cgccgccucgcugggcgggcgu

SEQ ID NO: 3429444 - RNA, 16 nt, Pseudomonas aeruginosa PA01
cgccgccucgggcagc

SEQ ID NO: 3429445 - RNA, 18 nt, Pseudomonas aeruginosa PA01
cgccgccugcgccucggc

SEQ ID NO: 3429446 - RNA, 14 nt, Pseudomonas aeruginosa PA01
cgccgccugcggcu

SEQ ID NO: 3429447 - RNA, 16 nt, Pseudomonas aeruginosa PA01
cgccgccugcucgccg

SEQ ID NO: 3429448 - RNA, 19 nt, Pseudomonas aeruginosa PA01
cgccgccuggguggcgacg

SEQ ID NO: 3429449 - RNA, 21 nt, Pseudomonas aeruginosa PA01
cgccgccuggguggcgacgaa

SEQ ID NO: 3429450 - RNA, 22 nt, Pseudomonas aeruginosa PA01
cgccgccuggguggcgacgaag

SEQ ID NO: 3429451 - RNA, 16 nt, Pseudomonas aeruginosa PA01
cgccgccuggugcccg

SEQ ID NO: 3429452 - RNA, 17 nt, Pseudomonas aeruginosa PA01
cgccgccuggugcccga

SEQ ID NO: 3429453 - RNA, 22 nt, Pseudomonas aeruginosa PA01
cgccgccuggugcccgaugccg

SEQ ID NO: 3429454 - RNA, 14 nt, Pseudomonas aeruginosa PA01
cgccgccuucggca

SEQ ID NO: 3429455 - RNA, 15 nt, Pseudomonas aeruginosa PA01
cgccgccuucggcag

SEQ ID NO: 3429456 - RNA, 16 nt, Pseudomonas aeruginosa PA01
cgccgccuucggcagg

SEQ ID NO: 3429457 - RNA, 16 nt, Pseudomonas aeruginosa PA01
cgccgccuugagcggc

SEQ ID NO: 3429458 - RNA, 17 nt, Pseudomonas aeruginosa PA01
cgccgccuugagcggcg

SEQ ID NO: 3429459 - RNA, 22 nt, Pseudomonas aeruginosa PA01
cgccgccuugagcggcgcccug

SEQ ID NO: 3429460 - RNA, 23 nt, Pseudomonas aeruginosa PA01
cgccgccuugagcggcgcccugg

SEQ ID NO: 3429461 - RNA, 22 nt, Pseudomonas aeruginosa PA01
cgccgccuugcguaccagcgcg

SEQ ID NO: 3429462 - RNA, 15 nt, Pseudomonas aeruginosa PA01
cgccgccuuggcauc

SEQ ID NO: 3429463 - RNA, 17 nt, Pseudomonas aeruginosa PA01
cgccgccuuucugcccg

SEQ ID NO: 3429464 - RNA, 21 nt, Pseudomonas aeruginosa PA01
cgccgccuuucugcccggcuu

SEQ ID NO: 3429465 - RNA, 21 nt, Pseudomonas aeruginosa PA01
cgccgcgaacacacccugcgc

SEQ ID NO: 3429466 - RNA, 22 nt, Pseudomonas aeruginosa PA01
cgccgcgaacacacccugcgca

SEQ ID NO: 3429467 - RNA, 19 nt, Pseudomonas aeruginosa PA01
cgccgcgaagcccagcgcc

SEQ ID NO: 3429468 - RNA, 20 nt, Pseudomonas aeruginosa PA01
cgccgcgaagcccagcgccg

SEQ ID NO: 3429469 - RNA, 13 nt, Pseudomonas aeruginosa PA01
cgccgcgaccucg

SEQ ID NO: 3429470 - RNA, 23 nt, Pseudomonas aeruginosa PA01
cgccgcgaccucguugcaggcac

SEQ ID NO: 3429471 - RNA, 16 nt, Pseudomonas aeruginosa PA01
cgccgcgaccugcucg

SEQ ID NO: 3429472 - RNA, 21 nt, Pseudomonas aeruginosa PA01
cgccgcgacgcuccagcggca

SEQ ID NO: 3429473 - RNA, 15 nt, Pseudomonas aeruginosa PA01
cgccgcgagcaccau

SEQ ID NO: 3429474 - RNA, 23 nt, Pseudomonas aeruginosa PA01
cgccgcgagcaccaugcagcggc

SEQ ID NO: 3429475 - RNA, 20 nt, Pseudomonas aeruginosa PA01
cgccgcgagcgaaacggcgc

SEQ ID NO: 3429476 - RNA, 21 nt, Pseudomonas aeruginosa PA01
cgccgcgagcgaaacggcgcu

SEQ ID NO: 3429477 - RNA, 22 nt, Pseudomonas aeruginosa PA01
cgccgcgagcgaaacggcgcug

SEQ ID NO: 3429478 - RNA, 15 nt, Pseudomonas aeruginosa PA01
cgccgcgauauucgc

SEQ ID NO: 3429479 - RNA, 18 nt, Pseudomonas aeruginosa PA01
cgccgcgauggcucgcgg

SEQ ID NO: 3429480 - RNA, 13 nt, Pseudomonas aeruginosa PA01
cgccgcgauggua

SEQ ID NO: 3429481 - RNA, 23 nt, Pseudomonas aeruginosa PA01
cgccgcgcaagcucgucacccgc

SEQ ID NO: 3429482 - RNA, 14 nt, Pseudomonas aeruginosa PA01
cgccgcgcaccagc

SEQ ID NO: 3429483 - RNA, 19 nt, Pseudomonas aeruginosa PA01
cgccgcgcaccucgaccgc

SEQ ID NO: 3429484 - RNA, 20 nt, Pseudomonas aeruginosa PA01
cgccgcgcaccucgaccgcg

SEQ ID NO: 3429485 - RNA, 22 nt, Pseudomonas aeruginosa PA01
cgccgcgcaccucgaccgcgcc

SEQ ID NO: 3429486 - RNA, 23 nt, Pseudomonas aeruginosa PA01
cgccgcgcaccucgaccgcgccg

SEQ ID NO: 3429487 - RNA, 13 nt, Pseudomonas aeruginosa PA01
cgccgcgcacguc

SEQ ID NO: 3429488 - RNA, 17 nt, Pseudomonas aeruginosa PA01
cgccgcgcacgucgagg

SEQ ID NO: 3429489 - RNA, 13 nt, Pseudomonas aeruginosa PA01
cgccgcgcagcgc

SEQ ID NO: 3429490 - RNA, 14 nt, Pseudomonas aeruginosa PA01
cgccgcgcagcgcg

SEQ ID NO: 3429491 - RNA, 15 nt, Pseudomonas aeruginosa PA01
cgccgcgcagcgcgg

SEQ ID NO: 3429492 - RNA, 22 nt, Pseudomonas aeruginosa PA01
cgccgcgcagcgcggcgcuggg

SEQ ID NO: 3429493 - RNA, 14 nt, Pseudomonas aeruginosa PA01
cgccgcgcaggcgg

SEQ ID NO: 3429494 - RNA, 20 nt, Pseudomonas aeruginosa PA01
cgccgcgcaguucguccauc

SEQ ID NO: 3429495 - RNA, 13 nt, Pseudomonas aeruginosa PA01
cgccgcgcaucac

SEQ ID NO: 3429496 - RNA, 15 nt, Pseudomonas aeruginosa PA01
cgccgcgcauccucg

SEQ ID NO: 3429497 - RNA, 19 nt, Pseudomonas aeruginosa PA01
cgccgcgcauccucggcau

SEQ ID NO: 3429498 - RNA, 23 nt, Pseudomonas aeruginosa PA01
cgccgcgcaugaaaaagccgccc

SEQ ID NO: 3429499 - RNA, 20 nt, Pseudomonas aeruginosa PA01
cgccgcgccaacuggcgcaa

SEQ ID NO: 3429500 - RNA, 15 nt, Pseudomonas aeruginosa PA01
cgccgcgccagcagg

SEQ ID NO: 3429501 - RNA, 14 nt, Pseudomonas aeruginosa PA01
cgccgcgccgccga

SEQ ID NO: 3429502 - RNA, 13 nt, Pseudomonas aeruginosa PA01
cgccgcgccgcuc

SEQ ID NO: 3429503 - RNA, 13 nt, Pseudomonas aeruginosa PA01
cgccgcgccggcg

SEQ ID NO: 3429504 - RNA, 14 nt, Pseudomonas aeruginosa PA01
cgccgcgccggcga

SEQ ID NO: 3429505 - RNA, 16 nt, Pseudomonas aeruginosa PA01
cgccgcgccggcgauc

SEQ ID NO: 3429506 - RNA, 16 nt, Pseudomonas aeruginosa PA01
cgccgcgccucgucgc

SEQ ID NO: 3429507 - RNA, 17 nt, Pseudomonas aeruginosa PA01
cgccgcgccucgucgcg

SEQ ID NO: 3429508 - RNA, 18 nt, Pseudomonas aeruginosa PA01
cgccgcgccucgucgcgc

SEQ ID NO: 3429509 - RNA, 22 nt, Pseudomonas aeruginosa PA01
cgccgcgccucgucgcgccagg

SEQ ID NO: 3429510 - RNA, 15 nt, Pseudomonas aeruginosa PA01
cgccgcgccugcugc

SEQ ID NO: 3429511 - RNA, 22 nt, Pseudomonas aeruginosa PA01
cgccgcgccuucugcaccuugg

SEQ ID NO: 3429512 - RNA, 22 nt, Pseudomonas aeruginosa PA01
cgccgcgccuugaaaccggcga

SEQ ID NO: 3429513 - RNA, 12 nt, Pseudomonas aeruginosa PA01
cgccgcgcgcca

SEQ ID NO: 3429514 - RNA, 13 nt, Pseudomonas aeruginosa PA01
cgccgcgcgccau

SEQ ID NO: 3429515 - RNA, 14 nt, Pseudomonas aeruginosa PA01
cgccgcgcgcgcgg

SEQ ID NO: 3429516 - RNA, 22 nt, Pseudomonas aeruginosa PA01
cgccgcgcgcgcggucgagcag

SEQ ID NO: 3429517 - RNA, 16 nt, Pseudomonas aeruginosa PA01
cgccgcgcggucgagc

SEQ ID NO: 3429518 - RNA, 18 nt, Pseudomonas aeruginosa PA01
cgccgcgcguucgcgcga

SEQ ID NO: 3429519 - RNA, 12 nt, Pseudomonas aeruginosa PA01
cgccgcgcucgc

SEQ ID NO: 3429520 - RNA, 16 nt, Pseudomonas aeruginosa PA01
cgccgcgcucgcgcau

SEQ ID NO: 3429521 - RNA, 15 nt, Pseudomonas aeruginosa PA01
cgccgcgcugcaagg

SEQ ID NO: 3429522 - RNA, 16 nt, Pseudomonas aeruginosa PA01
cgccgcgcugcaggcg

SEQ ID NO: 3429523 - RNA, 17 nt, Pseudomonas aeruginosa PA01
cgccgcgcugcgccagg

SEQ ID NO: 3429524 - RNA, 18 nt, Pseudomonas aeruginosa PA01
cgccgcgcugcgccaggc

SEQ ID NO: 3429525 - RNA, 14 nt, Pseudomonas aeruginosa PA01
cgccgcgcuucagg

SEQ ID NO: 3429526 - RNA, 13 nt, Pseudomonas aeruginosa PA01
cgccgcgcuuggc

SEQ ID NO: 3429527 - RNA, 20 nt, Pseudomonas aeruginosa PA01
cgccgcgcuuggccuugccg

SEQ ID NO: 3429528 - RNA, 18 nt, Pseudomonas aeruginosa PA01
cgccgcggaaggcccgcg

SEQ ID NO: 3429529 - RNA, 21 nt, Pseudomonas aeruginosa PA01
cgccgcggaaucgcguagcgc

SEQ ID NO: 3429530 - RNA, 19 nt, Pseudomonas aeruginosa PA01
cgccgcggcaaugcggcga

SEQ ID NO: 3429531 - RNA, 21 nt, Pseudomonas aeruginosa PA01
cgccgcggcaaugcggcgaug

SEQ ID NO: 3429532 - RNA, 14 nt, Pseudomonas aeruginosa PA01
cgccgcggcaccgg

SEQ ID NO: 3429533 - RNA, 18 nt, Pseudomonas aeruginosa PA01
cgccgcggcaccggcgac

SEQ ID NO: 3429534 - RNA, 19 nt, Pseudomonas aeruginosa PA01
cgccgcggcaccggcgacg

SEQ ID NO: 3429535 - RNA, 22 nt, Pseudomonas aeruginosa PA01
cgccgcggcagaucccaucgcc

SEQ ID NO: 3429536 - RNA, 18 nt, Pseudomonas aeruginosa PA01
cgccgcggccagcccccu

SEQ ID NO: 3429537 - RNA, 13 nt, Pseudomonas aeruginosa PA01
cgccgcggcccgg

SEQ ID NO: 3429538 - RNA, 15 nt, Pseudomonas aeruginosa PA01
cgccgcggcccggcg

SEQ ID NO: 3429539 - RNA, 13 nt, Pseudomonas aeruginosa PA01
cgccgcggccggc

SEQ ID NO: 3429540 - RNA, 15 nt, Pseudomonas aeruginosa PA01
cgccgcggccggcga

SEQ ID NO: 3429541 - RNA, 22 nt, Pseudomonas aeruginosa PA01
cgccgcggccggcgaccuuguc

SEQ ID NO: 3429542 - RNA, 15 nt, Pseudomonas aeruginosa PA01
cgccgcggcgaagcg

SEQ ID NO: 3429543 - RNA, 23 nt, Pseudomonas aeruginosa PA01
cgccgcggcgaccagcgcggucu

SEQ ID NO: 3429544 - RNA, 13 nt, Pseudomonas aeruginosa PA01
cgccgcggcgagc

SEQ ID NO: 3429545 - RNA, 15 nt, Pseudomonas aeruginosa PA01
cgccgcggcgagcau

SEQ ID NO: 3429546 - RNA, 13 nt, Pseudomonas aeruginosa PA01
cgccgcggcgcgg

SEQ ID NO: 3429547 - RNA, 16 nt, Pseudomonas aeruginosa PA01
cgccgcggcgcggaga

SEQ ID NO: 3429548 - RNA, 13 nt, Pseudomonas aeruginosa PA01
cgccgcggcggcg

SEQ ID NO: 3429549 - RNA, 22 nt, Pseudomonas aeruginosa PA01
cgccgcggcggcggacagcgga

SEQ ID NO: 3429550 - RNA, 14 nt, Pseudomonas aeruginosa PA01
cgccgcggcggcgu

SEQ ID NO: 3429551 - RNA, 22 nt, Pseudomonas aeruginosa PA01
cgccgcggcggcgugcaggccg

SEQ ID NO: 3429552 - RNA, 13 nt, Pseudomonas aeruginosa PA01
cgccgcggcguag

SEQ ID NO: 3429553 - RNA, 16 nt, Pseudomonas aeruginosa PA01
cgccgcggcguaggcg

SEQ ID NO: 3429554 - RNA, 23 nt, Pseudomonas aeruginosa PA01
cgccgcggcguuagccgccugcg

SEQ ID NO: 3429555 - RNA, 16 nt, Pseudomonas aeruginosa PA01
cgccgcggcguugcgc

SEQ ID NO: 3429556 - RNA, 18 nt, Pseudomonas aeruginosa PA01
cgccgcgggacgccgcag

SEQ ID NO: 3429557 - RNA, 15 nt, Pseudomonas aeruginosa PA01
cgccgcgggcaaccg

SEQ ID NO: 3429558 - RNA, 16 nt, Pseudomonas aeruginosa PA01
cgccgcgggcaaccgc

SEQ ID NO: 3429559 - RNA, 17 nt, Pseudomonas aeruginosa PA01
cgccgcgggcaaccgcg

SEQ ID NO: 3429560 - RNA, 22 nt, Pseudomonas aeruginosa PA01
cgccgcgggcaaccgcggcggc

SEQ ID NO: 3429561 - RNA, 16 nt, Pseudomonas aeruginosa PA01
cgccgcgggccagccg

SEQ ID NO: 3429562 - RNA, 15 nt, Pseudomonas aeruginosa PA01
cgccgcgggcgaacg

SEQ ID NO: 3429563 - RNA, 17 nt, Pseudomonas aeruginosa PA01
cgccgcgggcgaacggc

SEQ ID NO: 3429564 - RNA, 21 nt, Pseudomonas aeruginosa PA01
cgccgcgggcgaacggcagcg

SEQ ID NO: 3429565 - RNA, 12 nt, Pseudomonas aeruginosa PA01
cgccgcgggcgc

SEQ ID NO: 3429566 - RNA, 14 nt, Pseudomonas aeruginosa PA01
cgccgcgggcgcua

SEQ ID NO: 3429567 - RNA, 12 nt, Pseudomonas aeruginosa PA01
cgccgcgggcgu

SEQ ID NO: 3429568 - RNA, 17 nt, Pseudomonas aeruginosa PA01
cgccgcgggcguugcgc

SEQ ID NO: 3429569 - RNA, 15 nt, Pseudomonas aeruginosa PA01
cgccgcgggucacca

SEQ ID NO: 3429570 - RNA, 17 nt, Pseudomonas aeruginosa PA01
cgccgcgggucaccagc

SEQ ID NO: 3429571 - RNA, 18 nt, Pseudomonas aeruginosa PA01
cgccgcgggucaccagcg

SEQ ID NO: 3429572 - RNA, 23 nt, Pseudomonas aeruginosa PA01
cgccgcgggucaccagcgccggg

SEQ ID NO: 3429573 - RNA, 15 nt, Pseudomonas aeruginosa PA01
cgccgcgggucugcu

SEQ ID NO: 3429574 - RNA, 17 nt, Pseudomonas aeruginosa PA01
cgccgcgggucugcucg

SEQ ID NO: 3429575 - RNA, 17 nt, Pseudomonas aeruginosa PA01
cgccgcggucgaugucg

SEQ ID NO: 3429576 - RNA, 22 nt, Pseudomonas aeruginosa PA01
cgccgcggucuucgcguuggcg

SEQ ID NO: 3429577 - RNA, 20 nt, Pseudomonas aeruginosa PA01
cgccgcgucccugcacaggg

SEQ ID NO: 3429578 - RNA, 19 nt, Pseudomonas aeruginosa PA01
cgccgcgucgaagcugucg

SEQ ID NO: 3429579 - RNA, 21 nt, Pseudomonas aeruginosa PA01
cgccgcgucgaagcugucggc

SEQ ID NO: 3429580 - RNA, 22 nt, Pseudomonas aeruginosa PA01
cgccgcgucgaagcugucggcc

SEQ ID NO: 3429581 - RNA, 15 nt, Pseudomonas aeruginosa PA01
cgccgcgucgccgcc

SEQ ID NO: 3429582 - RNA, 16 nt, Pseudomonas aeruginosa PA01
cgccgcgucgccgcca

SEQ ID NO: 3429583 - RNA, 18 nt, Pseudomonas aeruginosa PA01
cgccgcgucgccgccagc

SEQ ID NO: 3429584 - RNA, 14 nt, Pseudomonas aeruginosa PA01
cgccgcgucgucgg

SEQ ID NO: 3429585 - RNA, 18 nt, Pseudomonas aeruginosa PA01
cgccgcgucgucggcgac

SEQ ID NO: 3429586 - RNA, 16 nt, Pseudomonas aeruginosa PA01
cgccgcgugccgccgg

SEQ ID NO: 3429587 - RNA, 19 nt, Pseudomonas aeruginosa PA01
cgccgcgugccgccggacc

SEQ ID NO: 3429588 - RNA, 18 nt, Pseudomonas aeruginosa PA01
cgccgcgugggcuucgcc

SEQ ID NO: 3429589 - RNA, 21 nt, Pseudomonas aeruginosa PA01
cgccgcgugggcuucgccgcc

SEQ ID NO: 3429590 - RNA, 23 nt, Pseudomonas aeruginosa PA01
cgccgcgugggcuucgccgccgc

SEQ ID NO: 3429591 - RNA, 15 nt, Pseudomonas aeruginosa PA01
cgccgcguucgccga

SEQ ID NO: 3429592 - RNA, 17 nt, Pseudomonas aeruginosa PA01
cgccgcguucgccgagc

SEQ ID NO: 3429593 - RNA, 16 nt, Pseudomonas aeruginosa PA01
cgccgcuacugcgcgg

SEQ ID NO: 3429594 - RNA, 15 nt, Pseudomonas aeruginosa PA01
cgccgcuagggcgcc

SEQ ID NO: 3429595 - RNA, 20 nt, Pseudomonas aeruginosa PA01
cgccgcuagggcgcccucgc

SEQ ID NO: 3429596 - RNA, 15 nt, Pseudomonas aeruginosa PA01
cgccgcuaucgccgc

SEQ ID NO: 3429597 - RNA, 17 nt, Pseudomonas aeruginosa PA01
cgccgcuaucgccgccg

SEQ ID NO: 3429598 - RNA, 18 nt, Pseudomonas aeruginosa PA01
cgccgcuaucgccgccgc

SEQ ID NO: 3429599 - RNA, 20 nt, Pseudomonas aeruginosa PA01
cgccgcuaucgccgccgcag

SEQ ID NO: 3429600 - RNA, 18 nt, Pseudomonas aeruginosa PA01
cgccgcuaugggcaccgc

SEQ ID NO: 3429601 - RNA, 20 nt, Pseudomonas aeruginosa PA01
cgccgcuaugggcaccgcgc

SEQ ID NO: 3429602 - RNA, 14 nt, Pseudomonas aeruginosa PA01
cgccgcucacccug

SEQ ID NO: 3429603 - RNA, 16 nt, Pseudomonas aeruginosa PA01
cgccgcucaggcgucc

SEQ ID NO: 3429604 - RNA, 14 nt, Pseudomonas aeruginosa PA01
cgccgcucauccgc

SEQ ID NO: 3429605 - RNA, 16 nt, Pseudomonas aeruginosa PA01
cgccgcucauccgcug

SEQ ID NO: 3429606 - RNA, 19 nt, Pseudomonas aeruginosa PA01
cgccgcucauccgcuggua

SEQ ID NO: 3429607 - RNA, 21 nt, Pseudomonas aeruginosa PA01
cgccgcuccacacccggucgc

SEQ ID NO: 3429608 - RNA, 23 nt, Pseudomonas aeruginosa PA01
cgccgcuccacacccggucgcgc

SEQ ID NO: 3429609 - RNA, 23 nt, Pseudomonas aeruginosa PA01
cgccgcucccggcuugcugacga

SEQ ID NO: 3429610 - RNA, 11 nt, Pseudomonas aeruginosa PA01
cgccgcuccgc

SEQ ID NO: 3429611 - RNA, 15 nt, Pseudomonas aeruginosa PA01
cgccgcuccgcgcca

SEQ ID NO: 3429612 - RNA, 17 nt, Pseudomonas aeruginosa PA01
cgccgcuccgcgccacg

SEQ ID NO: 3429613 - RNA, 15 nt, Pseudomonas aeruginosa PA01
cgccgcuccggcugc

SEQ ID NO: 3429614 - RNA, 14 nt, Pseudomonas aeruginosa PA01
cgccgcuccuccuc

SEQ ID NO: 3429615 - RNA, 18 nt, Pseudomonas aeruginosa PA01
cgccgcuccuccucgcuc

SEQ ID NO: 3429616 - RNA, 21 nt, Pseudomonas aeruginosa PA01
cgccgcuccuccucgcucugc

SEQ ID NO: 3429617 - RNA, 17 nt, Pseudomonas aeruginosa PA01
cgccgcuccuggcaggc

SEQ ID NO: 3429618 - RNA, 18 nt, Pseudomonas aeruginosa PA01
cgccgcuccuggcaggcu

SEQ ID NO: 3429619 - RNA, 19 nt, Pseudomonas aeruginosa PA01
cgccgcucgaugcccgcca

SEQ ID NO: 3429620 - RNA, 14 nt, Pseudomonas aeruginosa PA01
cgccgcucgcgcac

SEQ ID NO: 3429621 - RNA, 15 nt, Pseudomonas aeruginosa PA01
cgccgcucgcgcacg

SEQ ID NO: 3429622 - RNA, 13 nt, Pseudomonas aeruginosa PA01
cgccgcucggcga

SEQ ID NO: 3429623 - RNA, 14 nt, Pseudomonas aeruginosa PA01
cgccgcucggcgag

SEQ ID NO: 3429624 - RNA, 16 nt, Pseudomonas aeruginosa PA01
cgccgcucggcgagcc

SEQ ID NO: 3429625 - RNA, 18 nt, Pseudomonas aeruginosa PA01
cgccgcucggcgagccgc

SEQ ID NO: 3429626 - RNA, 22 nt, Pseudomonas aeruginosa PA01
cgccgcucggcgagccgccggg

SEQ ID NO: 3429627 - RNA, 19 nt, Pseudomonas aeruginosa PA01
cgccgcucuaucagggucu

SEQ ID NO: 3429628 - RNA, 13 nt, Pseudomonas aeruginosa PA01
cgccgcucugccc

SEQ ID NO: 3429629 - RNA, 17 nt, Pseudomonas aeruginosa PA01
cgccgcucugcccgacc

SEQ ID NO: 3429630 - RNA, 18 nt, Pseudomonas aeruginosa PA01
cgccgcucugcccgaccg

SEQ ID NO: 3429631 - RNA, 14 nt, Pseudomonas aeruginosa PA01
cgccgcucugcugg

SEQ ID NO: 3429632 - RNA, 15 nt, Pseudomonas aeruginosa PA01
cgccgcucugcuggc

SEQ ID NO: 3429633 - RNA, 18 nt, Pseudomonas aeruginosa PA01
cgccgcucugcuggccgc

SEQ ID NO: 3429634 - RNA, 22 nt, Pseudomonas aeruginosa PA01
cgccgcucugcuggccgcccuu

SEQ ID NO: 3429635 - RNA, 23 nt, Pseudomonas aeruginosa PA01
cgccgcugaauaccaccgggccg

SEQ ID NO: 3429636 - RNA, 16 nt, Pseudomonas aeruginosa PA01
cgccgcugaggcucgc

SEQ ID NO: 3429637 - RNA, 18 nt, Pseudomonas aeruginosa PA01
cgccgcugaggcucgccg

SEQ ID NO: 3429638 - RNA, 20 nt, Pseudomonas aeruginosa PA01
cgccgcugaucaguaccggc

SEQ ID NO: 3429639 - RNA, 13 nt, Pseudomonas aeruginosa PA01
cgccgcugcaccg

SEQ ID NO: 3429640 - RNA, 17 nt, Pseudomonas aeruginosa PA01
cgccgcugcaccgaacg

SEQ ID NO: 3429641 - RNA, 19 nt, Pseudomonas aeruginosa PA01
cgccgcugcgucgucgcgg

SEQ ID NO: 3429642 - RNA, 22 nt, Pseudomonas aeruginosa PA01
cgccgcugcgucgucgcggcgc

SEQ ID NO: 3429643 - RNA, 22 nt, Pseudomonas aeruginosa PA01
cgccgcugcuggcaucggugac

SEQ ID NO: 3429644 - RNA, 19 nt, Pseudomonas aeruginosa PA01
cgccgcuggaaccggccgg

SEQ ID NO: 3429645 - RNA, 13 nt, Pseudomonas aeruginosa PA01
cgccgcuggacga

SEQ ID NO: 3429646 - RNA, 17 nt, Pseudomonas aeruginosa PA01
cgccgcuggccuggcca

SEQ ID NO: 3429647 - RNA, 20 nt, Pseudomonas aeruginosa PA01
cgccgcuggccuggccaccc

SEQ ID NO: 3429648 - RNA, 21 nt, Pseudomonas aeruginosa PA01
cgccgcuggccuggccacccu

SEQ ID NO: 3429649 - RNA, 14 nt, Pseudomonas aeruginosa PA01
cgccgcuggcgcug

SEQ ID NO: 3429650 - RNA, 17 nt, Pseudomonas aeruginosa PA01
cgccgcuggcgcugacc

SEQ ID NO: 3429651 - RNA, 14 nt, Pseudomonas aeruginosa PA01
cgccgcuggcggca

SEQ ID NO: 3429652 - RNA, 17 nt, Pseudomonas aeruginosa PA01
cgccgcuggcggcaugc

SEQ ID NO: 3429653 - RNA, 16 nt, Pseudomonas aeruginosa PA01
cgccgcuggcggcgcu

SEQ ID NO: 3429654 - RNA, 18 nt, Pseudomonas aeruginosa PA01
cgccgcuggcggcgcuca

SEQ ID NO: 3429655 - RNA, 12 nt, Pseudomonas aeruginosa PA01
cgccgcuggcgu

SEQ ID NO: 3429656 - RNA, 14 nt, Pseudomonas aeruginosa PA01
cgccgcugggcagc

SEQ ID NO: 3429657 - RNA, 15 nt, Pseudomonas aeruginosa PA01
cgccgcugggcagca

SEQ ID NO: 3429658 - RNA, 23 nt, Pseudomonas aeruginosa PA01
cgccgcugggcagcacgcuggcg

SEQ ID NO: 3429659 - RNA, 21 nt, Pseudomonas aeruginosa PA01
cgccgcuggggaccgcaccug

SEQ ID NO: 3429660 - RNA, 18 nt, Pseudomonas aeruginosa PA01
cgccgcugucguccagcg

SEQ ID NO: 3429661 - RNA, 21 nt, Pseudomonas aeruginosa PA01
cgccgcugucuaucugcgccg

SEQ ID NO: 3429662 - RNA, 12 nt, Pseudomonas aeruginosa PA01
cgccgcugugca

SEQ ID NO: 3429663 - RNA, 12 nt, Pseudomonas aeruginosa PA01
cgccgcuuccgc

SEQ ID NO: 3429664 - RNA, 16 nt, Pseudomonas aeruginosa PA01
cgccgcuuccgccagg

SEQ ID NO: 3429665 - RNA, 18 nt, Pseudomonas aeruginosa PA01
cgccgcuuccgccaggcg

SEQ ID NO: 3429666 - RNA, 15 nt, Pseudomonas aeruginosa PA01
cgccgcuuccgccgg

SEQ ID NO: 3429667 - RNA, 16 nt, Pseudomonas aeruginosa PA01
cgccgcuuccgccggc

SEQ ID NO: 3429668 - RNA, 17 nt, Pseudomonas aeruginosa PA01
cgccgcuuccgccggcg

SEQ ID NO: 3429669 - RNA, 18 nt, Pseudomonas aeruginosa PA01
cgccgcuuccgccggcgc

SEQ ID NO: 3429670 - RNA, 20 nt, Pseudomonas aeruginosa PA01
cgccgcuuccgccggcgccg

SEQ ID NO: 3429671 - RNA, 13 nt, Pseudomonas aeruginosa PA01
cgccgcuucgcgg

SEQ ID NO: 3429672 - RNA, 18 nt, Pseudomonas aeruginosa PA01
cgccgcuugagaccuucg

SEQ ID NO: 3429673 - RNA, 21 nt, Pseudomonas aeruginosa PA01
cgccgcuugagaccuucgcgg

SEQ ID NO: 3429674 - RNA, 16 nt, Pseudomonas aeruginosa PA01
cgccggaaccugcaug

SEQ ID NO: 3429675 - RNA, 21 nt, Pseudomonas aeruginosa PA01
cgccggaaccugcaugucacc

SEQ ID NO: 3429676 - RNA, 23 nt, Pseudomonas aeruginosa PA01
cgccggaaccuguccgaacaggg

SEQ ID NO: 3429677 - RNA, 21 nt, Pseudomonas aeruginosa PA01
cgccggaagcuucaggcucgg

SEQ ID NO: 3429678 - RNA, 18 nt, Pseudomonas aeruginosa PA01
cgccggaaguggcagcgc

SEQ ID NO: 3429679 - RNA, 20 nt, Pseudomonas aeruginosa PA01
cgccggaaguggcagcgccg

SEQ ID NO: 3429680 - RNA, 17 nt, Pseudomonas aeruginosa PA01
cgccggaaugacgagcc

SEQ ID NO: 3429681 - RNA, 19 nt, Pseudomonas aeruginosa PA01
cgccggaaugacgagccgc

SEQ ID NO: 3429682 - RNA, 20 nt, Pseudomonas aeruginosa PA01
cgccggaaugacgagccgca

SEQ ID NO: 3429683 - RNA, 18 nt, Pseudomonas aeruginosa PA01
cgccggaauguugcggcg

SEQ ID NO: 3429684 - RNA, 22 nt, Pseudomonas aeruginosa PA01
cgccggacaggccacccgccuc

SEQ ID NO: 3429685 - RNA, 17 nt, Pseudomonas aeruginosa PA01
cgccggaccagaucggc

SEQ ID NO: 3429686 - RNA, 18 nt, Pseudomonas aeruginosa PA01
cgccggaccagccggucc

SEQ ID NO: 3429687 - RNA, 14 nt, Pseudomonas aeruginosa PA01
cgccggacccugcc

SEQ ID NO: 3429688 - RNA, 16 nt, Pseudomonas aeruginosa PA01
cgccggacccugccgu

SEQ ID NO: 3429689 - RNA, 17 nt, Pseudomonas aeruginosa PA01
cgccggacgcaccagca

SEQ ID NO: 3429690 - RNA, 18 nt, Pseudomonas aeruginosa PA01
cgccggacgcaccagcag

SEQ ID NO: 3429691 - RNA, 22 nt, Pseudomonas aeruginosa PA01
cgccggacgcaccagcaggccg

SEQ ID NO: 3429692 - RNA, 20 nt, Pseudomonas aeruginosa PA01
cgccggagacuucagcgcau

SEQ ID NO: 3429693 - RNA, 14 nt, Pseudomonas aeruginosa PA01
cgccggagccaccg

SEQ ID NO: 3429694 - RNA, 19 nt, Pseudomonas aeruginosa PA01
cgccggaggggcggccgcc

SEQ ID NO: 3429695 - RNA, 19 nt, Pseudomonas aeruginosa PA01
cgccggagucguagcgcgc

SEQ ID NO: 3429696 - RNA, 22 nt, Pseudomonas aeruginosa PA01
cgccggagucguagcgcgcggc

SEQ ID NO: 3429697 - RNA, 13 nt, Pseudomonas aeruginosa PA01
cgccggaucggcu

SEQ ID NO: 3429698 - RNA, 22 nt, Pseudomonas aeruginosa PA01
cgccggaucggcugaccggcau

SEQ ID NO: 3429699 - RNA, 16 nt, Pseudomonas aeruginosa PA01
cgccggaugggcgagc

SEQ ID NO: 3429700 - RNA, 17 nt, Pseudomonas aeruginosa PA01
cgccggaugggcgagcu

SEQ ID NO: 3429701 - RNA, 23 nt, Pseudomonas aeruginosa PA01
cgccggauuagcucagucgguag

SEQ ID NO: 3429702 - RNA, 19 nt, Pseudomonas aeruginosa PA01
cgccggauuucacggcgga

SEQ ID NO: 3429703 - RNA, 20 nt, Pseudomonas aeruginosa PA01
cgccggauuucacggcggau

SEQ ID NO: 3429704 - RNA, 17 nt, Pseudomonas aeruginosa PA01
cgccggcaccgucgagc

SEQ ID NO: 3429705 - RNA, 20 nt, Pseudomonas aeruginosa PA01
cgccggcacuguuccucagc

SEQ ID NO: 3429706 - RNA, 21 nt, Pseudomonas aeruginosa PA01
cgccggcacuguuccucagcc

SEQ ID NO: 3429707 - RNA, 16 nt, Pseudomonas aeruginosa PA01
cgccggcagcgccgcg

SEQ ID NO: 3429708 - RNA, 17 nt, Pseudomonas aeruginosa PA01
cgccggcagcgccgcgc

SEQ ID NO: 3429709 - RNA, 13 nt, Pseudomonas aeruginosa PA01
cgccggcagcucg

SEQ ID NO: 3429710 - RNA, 16 nt, Pseudomonas aeruginosa PA01
cgccggcagcucggcc

SEQ ID NO: 3429711 - RNA, 19 nt, Pseudomonas aeruginosa PA01
cgccggcagcucggccgag

SEQ ID NO: 3429712 - RNA, 23 nt, Pseudomonas aeruginosa PA01
cgccggcagcucggccgagggca

SEQ ID NO: 3429713 - RNA, 19 nt, Pseudomonas aeruginosa PA01
cgccggcaggaacgcccgc

SEQ ID NO: 3429714 - RNA, 23 nt, Pseudomonas aeruginosa PA01
cgccggcaggaacgcccgcggca

SEQ ID NO: 3429715 - RNA, 15 nt, Pseudomonas aeruginosa PA01
cgccggcaggccuuc

SEQ ID NO: 3429716 - RNA, 21 nt, Pseudomonas aeruginosa PA01
cgccggcaggccuucggcgcc

SEQ ID NO: 3429717 - RNA, 22 nt, Pseudomonas aeruginosa PA01
cgccggcaggccuucggcgccg

SEQ ID NO: 3429718 - RNA, 13 nt, Pseudomonas aeruginosa PA01
cgccggcagguag

SEQ ID NO: 3429719 - RNA, 19 nt, Pseudomonas aeruginosa PA01
cgccggcagguagaccucg

SEQ ID NO: 3429720 - RNA, 18 nt, Pseudomonas aeruginosa PA01
cgccggcagugugccgcc

SEQ ID NO: 3429721 - RNA, 22 nt, Pseudomonas aeruginosa PA01
cgccggcagugugccgcccugc

SEQ ID NO: 3429722 - RNA, 11 nt, Pseudomonas aeruginosa PA01
cgccggcaucc

SEQ ID NO: 3429723 - RNA, 17 nt, Pseudomonas aeruginosa PA01
cgccggcaucguggcca

SEQ ID NO: 3429724 - RNA, 22 nt, Pseudomonas aeruginosa PA01
cgccggcaucguggccaugggu

SEQ ID NO: 3429725 - RNA, 23 nt, Pseudomonas aeruginosa PA01
cgccggcauugccgacuuccucg

SEQ ID NO: 3429726 - RNA, 15 nt, Pseudomonas aeruginosa PA01
cgccggcauuggcac

SEQ ID NO: 3429727 - RNA, 16 nt, Pseudomonas aeruginosa PA01
cgccggcauuggcacc

SEQ ID NO: 3429728 - RNA, 19 nt, Pseudomonas aeruginosa PA01
cgccggcauuggcacccug

SEQ ID NO: 3429729 - RNA, 23 nt, Pseudomonas aeruginosa PA01
cgccggcauuggcacccuggacc

SEQ ID NO: 3429730 - RNA, 12 nt, Pseudomonas aeruginosa PA01
cgccggccagag

SEQ ID NO: 3429731 - RNA, 14 nt, Pseudomonas aeruginosa PA01
cgccggccagcacc

SEQ ID NO: 3429732 - RNA, 15 nt, Pseudomonas aeruginosa PA01
cgccggccagcaccu

SEQ ID NO: 3429733 - RNA, 15 nt, Pseudomonas aeruginosa PA01
cgccggccagccgcg

SEQ ID NO: 3429734 - RNA, 16 nt, Pseudomonas aeruginosa PA01
cgccggccagccgcgc

SEQ ID NO: 3429735 - RNA, 14 nt, Pseudomonas aeruginosa PA01
cgccggccaggggc

SEQ ID NO: 3429736 - RNA, 19 nt, Pseudomonas aeruginosa PA01
cgccggccagguagcggcg

SEQ ID NO: 3429737 - RNA, 20 nt, Pseudomonas aeruginosa PA01
cgccggccagguagcggcgu

SEQ ID NO: 3429738 - RNA, 14 nt, Pseudomonas aeruginosa PA01
cgccggccaggugg

SEQ ID NO: 3429739 - RNA, 22 nt, Pseudomonas aeruginosa PA01
cgccggccaguuggugcacgcg

SEQ ID NO: 3429740 - RNA, 14 nt, Pseudomonas aeruginosa PA01
cgccggccaugccg

SEQ ID NO: 3429741 - RNA, 22 nt, Pseudomonas aeruginosa PA01
cgccggccauucgcugucgagc

SEQ ID NO: 3429742 - RNA, 15 nt, Pseudomonas aeruginosa PA01
cgccggcccagcagg

SEQ ID NO: 3429743 - RNA, 17 nt, Pseudomonas aeruginosa PA01
cgccggcccagcaggcc

SEQ ID NO: 3429744 - RNA, 18 nt, Pseudomonas aeruginosa PA01
cgccggcccagcaggccg

SEQ ID NO: 3429745 - RNA, 22 nt, Pseudomonas aeruginosa PA01
cgccggcccagcaggccggcca

SEQ ID NO: 3429746 - RNA, 17 nt, Pseudomonas aeruginosa PA01
cgccggcccgcgcggca

SEQ ID NO: 3429747 - RNA, 20 nt, Pseudomonas aeruginosa PA01
cgccggcccgcgcggcaacg

SEQ ID NO: 3429748 - RNA, 22 nt, Pseudomonas aeruginosa PA01
cgccggcccgggucacggucag

SEQ ID NO: 3429749 - RNA, 23 nt, Pseudomonas aeruginosa PA01
cgccggccggcucagcgcuucgg

SEQ ID NO: 3429750 - RNA, 13 nt, Pseudomonas aeruginosa PA01
cgccggccgggcu

SEQ ID NO: 3429751 - RNA, 13 nt, Pseudomonas aeruginosa PA01
cgccggccggggc

SEQ ID NO: 3429752 - RNA, 19 nt, Pseudomonas aeruginosa PA01
cgccggccggggcgcgccc

SEQ ID NO: 3429753 - RNA, 21 nt, Pseudomonas aeruginosa PA01
cgccggccggggcgcgcccgc

SEQ ID NO: 3429754 - RNA, 11 nt, Pseudomonas aeruginosa PA01
cgccggccucc

SEQ ID NO: 3429755 - RNA, 19 nt, Pseudomonas aeruginosa PA01
cgccggccuccagcacucg

SEQ ID NO: 3429756 - RNA, 13 nt, Pseudomonas aeruginosa PA01
cgccggccucgca

SEQ ID NO: 3429757 - RNA, 13 nt, Pseudomonas aeruginosa PA01
cgccggccucgcg

SEQ ID NO: 3429758 - RNA, 18 nt, Pseudomonas aeruginosa PA01
cgccggccucgcgcaacu

SEQ ID NO: 3429759 - RNA, 17 nt, Pseudomonas aeruginosa PA01
cgccggccucgcugccg

SEQ ID NO: 3429760 - RNA, 19 nt, Pseudomonas aeruginosa PA01
cgccggccucgcugccgcc

SEQ ID NO: 3429761 - RNA, 21 nt, Pseudomonas aeruginosa PA01
cgccggccucgcugccgccgc

SEQ ID NO: 3429762 - RNA, 22 nt, Pseudomonas aeruginosa PA01
cgccggccucgcugccgccgca

SEQ ID NO: 3429763 - RNA, 11 nt, Pseudomonas aeruginosa PA01
cgccggccucu

SEQ ID NO: 3429764 - RNA, 12 nt, Pseudomonas aeruginosa PA01
cgccggccugcg

SEQ ID NO: 3429765 - RNA, 14 nt, Pseudomonas aeruginosa PA01
cgccggccugcgcg

SEQ ID NO: 3429766 - RNA, 15 nt, Pseudomonas aeruginosa PA01
cgccggccugcgcgc

SEQ ID NO: 3429767 - RNA, 16 nt, Pseudomonas aeruginosa PA01
cgccggccugcgcgca

SEQ ID NO: 3429768 - RNA, 20 nt, Pseudomonas aeruginosa PA01
cgccggcgaacagccagcgg

SEQ ID NO: 3429769 - RNA, 12 nt, Pseudomonas aeruginosa PA01
cgccggcgaacu

SEQ ID NO: 3429770 - RNA, 18 nt, Pseudomonas aeruginosa PA01
cgccggcgaacucguaga

SEQ ID NO: 3429771 - RNA, 17 nt, Pseudomonas aeruginosa PA01
cgccggcgaccgcgcgc

SEQ ID NO: 3429772 - RNA, 18 nt, Pseudomonas aeruginosa PA01
cgccggcgaccgcgcgca

SEQ ID NO: 3429773 - RNA, 21 nt, Pseudomonas aeruginosa PA01
cgccggcgaccgcgcgcaugg

SEQ ID NO: 3429774 - RNA, 22 nt, Pseudomonas aeruginosa PA01
cgccggcgacgacgaucccggc

SEQ ID NO: 3429775 - RNA, 14 nt, Pseudomonas aeruginosa PA01
cgccggcgagccgc

SEQ ID NO: 3429776 - RNA, 19 nt, Pseudomonas aeruginosa PA01
cgccggcgagccgcuggca

SEQ ID NO: 3429777 - RNA, 13 nt, Pseudomonas aeruginosa PA01
cgccggcgaucgc

SEQ ID NO: 3429778 - RNA, 14 nt, Pseudomonas aeruginosa PA01
cgccggcgaucgcc

SEQ ID NO: 3429779 - RNA, 16 nt, Pseudomonas aeruginosa PA01
cgccggcgaucgccag

SEQ ID NO: 3429780 - RNA, 21 nt, Pseudomonas aeruginosa PA01
cgccggcgaucgccaggcgau

SEQ ID NO: 3429781 - RNA, 17 nt, Pseudomonas aeruginosa PA01
cgccggcgaucgccggc

SEQ ID NO: 3429782 - RNA, 13 nt, Pseudomonas aeruginosa PA01
cgccggcgaugcc

SEQ ID NO: 3429783 - RNA, 17 nt, Pseudomonas aeruginosa PA01
cgccggcgaugcccagg

SEQ ID NO: 3429784 - RNA, 14 nt, Pseudomonas aeruginosa PA01
cgccggcgaugcgc

SEQ ID NO: 3429785 - RNA, 14 nt, Pseudomonas aeruginosa PA01
cgccggcgcccugc

SEQ ID NO: 3429786 - RNA, 13 nt, Pseudomonas aeruginosa PA01
cgccggcgccgau

SEQ ID NO: 3429787 - RNA, 14 nt, Pseudomonas aeruginosa PA01
cgccggcgccgauu

SEQ ID NO: 3429788 - RNA, 14 nt, Pseudomonas aeruginosa PA01
cgccggcgccgccu

SEQ ID NO: 3429789 - RNA, 15 nt, Pseudomonas aeruginosa PA01
cgccggcgccgccuc

SEQ ID NO: 3429790 - RNA, 21 nt, Pseudomonas aeruginosa PA01
cgccggcgccgccucgggcag

SEQ ID NO: 3429791 - RNA, 11 nt, Pseudomonas aeruginosa PA01
cgccggcgcgc

SEQ ID NO: 3429792 - RNA, 13 nt, Pseudomonas aeruginosa PA01
cgccggcgcgcac

SEQ ID NO: 3429793 - RNA, 17 nt, Pseudomonas aeruginosa PA01
cgccggcgcgcagggug

SEQ ID NO: 3429794 - RNA, 17 nt, Pseudomonas aeruginosa PA01
cgccggcgcgcccaggc

SEQ ID NO: 3429795 - RNA, 13 nt, Pseudomonas aeruginosa PA01
cgccggcgcgcgg

SEQ ID NO: 3429796 - RNA, 15 nt, Pseudomonas aeruginosa PA01
cgccggcgcgcggcg

SEQ ID NO: 3429797 - RNA, 17 nt, Pseudomonas aeruginosa PA01
cgccggcgcgcggcggg

SEQ ID NO: 3429798 - RNA, 20 nt, Pseudomonas aeruginosa PA01
cgccggcgcgcggcggguag

SEQ ID NO: 3429799 - RNA, 12 nt, Pseudomonas aeruginosa PA01
cgccggcgcgcu

SEQ ID NO: 3429800 - RNA, 20 nt, Pseudomonas aeruginosa PA01
cgccggcgcgcuugccgcug

SEQ ID NO: 3429801 - RNA, 13 nt, Pseudomonas aeruginosa PA01
cgccggcgcgggc

SEQ ID NO: 3429802 - RNA, 17 nt, Pseudomonas aeruginosa PA01
cgccggcgcggucucgc

SEQ ID NO: 3429803 - RNA, 14 nt, Pseudomonas aeruginosa PA01
cgccggcgcguagg

SEQ ID NO: 3429804 - RNA, 16 nt, Pseudomonas aeruginosa PA01
cgccggcgcguaggug

SEQ ID NO: 3429805 - RNA, 23 nt, Pseudomonas aeruginosa PA01
cgccggcgcguucucugucggag

SEQ ID NO: 3429806 - RNA, 16 nt, Pseudomonas aeruginosa PA01
cgccggcgcuccuccu

SEQ ID NO: 3429807 - RNA, 12 nt, Pseudomonas aeruginosa PA01
cgccggcgcugc

SEQ ID NO: 3429808 - RNA, 16 nt, Pseudomonas aeruginosa PA01
cgccggcgcugcgagc

SEQ ID NO: 3429809 - RNA, 23 nt, Pseudomonas aeruginosa PA01
cgccggcggaucacaggcucuuc

SEQ ID NO: 3429810 - RNA, 20 nt, Pseudomonas aeruginosa PA01
cgccggcggaucagcccgcu

SEQ ID NO: 3429811 - RNA, 13 nt, Pseudomonas aeruginosa PA01
cgccggcggccag

SEQ ID NO: 3429812 - RNA, 14 nt, Pseudomonas aeruginosa PA01
cgccggcggccagg

SEQ ID NO: 3429813 - RNA, 17 nt, Pseudomonas aeruginosa PA01
cgccggcggccagggcg

SEQ ID NO: 3429814 - RNA, 17 nt, Pseudomonas aeruginosa PA01
cgccggcggccggcgca

SEQ ID NO: 3429815 - RNA, 16 nt, Pseudomonas aeruginosa PA01
cgccggcggccugccc

SEQ ID NO: 3429816 - RNA, 12 nt, Pseudomonas aeruginosa PA01
cgccggcggcga

SEQ ID NO: 3429817 - RNA, 13 nt, Pseudomonas aeruginosa PA01
cgccggcggcgau

SEQ ID NO: 3429818 - RNA, 17 nt, Pseudomonas aeruginosa PA01
cgccggcguuauccgcc

SEQ ID NO: 3429819 - RNA, 20 nt, Pseudomonas aeruginosa PA01
cgccggcguuauccgccgau

SEQ ID NO: 3429820 - RNA, 17 nt, Pseudomonas aeruginosa PA01
cgccggcguucgacgcc

SEQ ID NO: 3429821 - RNA, 23 nt, Pseudomonas aeruginosa PA01
cgccggcguucgacgccuugccc

SEQ ID NO: 3429822 - RNA, 11 nt, Pseudomonas aeruginosa PA01
cgccggcucgc

SEQ ID NO: 3429823 - RNA, 21 nt, Pseudomonas aeruginosa PA01
cgccggcucgcccagcaggcg

SEQ ID NO: 3429824 - RNA, 18 nt, Pseudomonas aeruginosa PA01
cgccggcugacgcuggcg

SEQ ID NO: 3429825 - RNA, 19 nt, Pseudomonas aeruginosa PA01
cgccggcugacgcuggcga

SEQ ID NO: 3429826 - RNA, 16 nt, Pseudomonas aeruginosa PA01
cgccggcugccgcgcg

SEQ ID NO: 3429827 - RNA, 17 nt, Pseudomonas aeruginosa PA01
cgccggcugccgcgcgu

SEQ ID NO: 3429828 - RNA, 21 nt, Pseudomonas aeruginosa PA01
cgccggcugugcagggcagcg

SEQ ID NO: 3429829 - RNA, 23 nt, Pseudomonas aeruginosa PA01
cgccggcugugcagggcagcggc

SEQ ID NO: 3429830 - RNA, 17 nt, Pseudomonas aeruginosa PA01
cgccgggaaacagggcg

SEQ ID NO: 3429831 - RNA, 20 nt, Pseudomonas aeruginosa PA01
cgccgggaaacagggcgacg

SEQ ID NO: 3429832 - RNA, 17 nt, Pseudomonas aeruginosa PA01
cgccgggaagcaccgac

SEQ ID NO: 3429833 - RNA, 23 nt, Pseudomonas aeruginosa PA01
cgccgggaagcaccgacucgccc

SEQ ID NO: 3429834 - RNA, 20 nt, Pseudomonas aeruginosa PA01
cgccgggaauccccaguagc

SEQ ID NO: 3429835 - RNA, 16 nt, Pseudomonas aeruginosa PA01
cgccgggaaucgccag

SEQ ID NO: 3429836 - RNA, 18 nt, Pseudomonas aeruginosa PA01
cgccgggaaucgccagca

SEQ ID NO: 3429837 - RNA, 19 nt, Pseudomonas aeruginosa PA01
cgccgggaaucgccagcag

SEQ ID NO: 3429838 - RNA, 19 nt, Pseudomonas aeruginosa PA01
cgccgggaaucuggccgau

SEQ ID NO: 3429839 - RNA, 18 nt, Pseudomonas aeruginosa PA01
cgccgggacccugguagu

SEQ ID NO: 3429840 - RNA, 22 nt, Pseudomonas aeruginosa PA01
cgccgggacccugguaguccag

SEQ ID NO: 3429841 - RNA, 17 nt, Pseudomonas aeruginosa PA01
cgccgggagcggccgug

SEQ ID NO: 3429842 - RNA, 18 nt, Pseudomonas aeruginosa PA01
cgccgggagcggccgugc

SEQ ID NO: 3429843 - RNA, 20 nt, Pseudomonas aeruginosa PA01
cgccgggaugcucaccgcgc

SEQ ID NO: 3429844 - RNA, 21 nt, Pseudomonas aeruginosa PA01
cgccgggauuguugcggcggg

SEQ ID NO: 3429845 - RNA, 13 nt, Pseudomonas aeruginosa PA01
cgccgggcaacgc

SEQ ID NO: 3429846 - RNA, 15 nt, Pseudomonas aeruginosa PA01
cgccgggcaacgcca

SEQ ID NO: 3429847 - RNA, 20 nt, Pseudomonas aeruginosa PA01
cgccgggcaacgccaggccg

SEQ ID NO: 3429848 - RNA, 22 nt, Pseudomonas aeruginosa PA01
cgccgggcaacgccaggccgcu

SEQ ID NO: 3429849 - RNA, 19 nt, Pseudomonas aeruginosa PA01
cgccgggcaucaugccgag

SEQ ID NO: 3429850 - RNA, 22 nt, Pseudomonas aeruginosa PA01
cgccgggcauucgcagcggccc

SEQ ID NO: 3429851 - RNA, 14 nt, Pseudomonas aeruginosa PA01
cgccgggccgcauc

SEQ ID NO: 3429852 - RNA, 13 nt, Pseudomonas aeruginosa PA01
cgccgggccgccu

SEQ ID NO: 3429853 - RNA, 17 nt, Pseudomonas aeruginosa PA01
cgccgggccgccuugcg

SEQ ID NO: 3429854 - RNA, 18 nt, Pseudomonas aeruginosa PA01
cgccgggccgccuugcgc

SEQ ID NO: 3429855 - RNA, 15 nt, Pseudomonas aeruginosa PA01
cgccgggcgcccggc

SEQ ID NO: 3429856 - RNA, 12 nt, Pseudomonas aeruginosa PA01
cgccgggcgcga

SEQ ID NO: 3429857 - RNA, 14 nt, Pseudomonas aeruginosa PA01
cgccgggcgcgcgc

SEQ ID NO: 3429858 - RNA, 18 nt, Pseudomonas aeruginosa PA01
cgccgggcgcgcgccuca

SEQ ID NO: 3429859 - RNA, 14 nt, Pseudomonas aeruginosa PA01
cgccgggcggcguc

SEQ ID NO: 3429860 - RNA, 19 nt, Pseudomonas aeruginosa PA01
cgccgggcggcgucgcgga

SEQ ID NO: 3429861 - RNA, 20 nt, Pseudomonas aeruginosa PA01
cgccgggcggcgucgcggag

SEQ ID NO: 3429862 - RNA, 23 nt, Pseudomonas aeruginosa PA01
cgccgggcgucugcccgguccaa

SEQ ID NO: 3429863 - RNA, 19 nt, Pseudomonas aeruginosa PA01
cgccgggcucagcgcgcgu

SEQ ID NO: 3429864 - RNA, 18 nt, Pseudomonas aeruginosa PA01
cgccgggcuccagcauca

SEQ ID NO: 3429865 - RNA, 15 nt, Pseudomonas aeruginosa PA01
cgccgggcugccgaa

SEQ ID NO: 3429866 - RNA, 22 nt, Pseudomonas aeruginosa PA01
cgccggggaagauguucgccgc

SEQ ID NO: 3429867 - RNA, 15 nt, Pseudomonas aeruginosa PA01
cgccggggaagcugc

SEQ ID NO: 3429868 - RNA, 16 nt, Pseudomonas aeruginosa PA01
cgccggggaagcugcc

SEQ ID NO: 3429869 - RNA, 21 nt, Pseudomonas aeruginosa PA01
cgccggggaucaggucgccgc

SEQ ID NO: 3429870 - RNA, 19 nt, Pseudomonas aeruginosa PA01
cgccggggcagcagggcgu

SEQ ID NO: 3429871 - RNA, 12 nt, Pseudomonas aeruginosa PA01
cgccggggccua

SEQ ID NO: 3429872 - RNA, 13 nt, Pseudomonas aeruginosa PA01
cgccggggcgcag

SEQ ID NO: 3429873 - RNA, 17 nt, Pseudomonas aeruginosa PA01
cgccggggcgcaggucg

SEQ ID NO: 3429874 - RNA, 20 nt, Pseudomonas aeruginosa PA01
cgccggggcgggccgcgccu

SEQ ID NO: 3429875 - RNA, 20 nt, Pseudomonas aeruginosa PA01
cgccggggcgugcaggccgc

SEQ ID NO: 3429876 - RNA, 21 nt, Pseudomonas aeruginosa PA01
cgccgggggucucguagcagc

SEQ ID NO: 3429877 - RNA, 16 nt, Pseudomonas aeruginosa PA01
cgccggguacagcgcc

SEQ ID NO: 3429878 - RNA, 21 nt, Pseudomonas aeruginosa PA01
cgccggguacagcgccacggc

SEQ ID NO: 3429879 - RNA, 22 nt, Pseudomonas aeruginosa PA01
cgccggguacagcgccacggcc

SEQ ID NO: 3429880 - RNA, 20 nt, Pseudomonas aeruginosa PA01
cgccggguagcguuaucgcc

SEQ ID NO: 3429881 - RNA, 21 nt, Pseudomonas aeruginosa PA01
cgccggguagcguuaucgccg

SEQ ID NO: 3429882 - RNA, 22 nt, Pseudomonas aeruginosa PA01
cgccggguagcguuaucgccgg

SEQ ID NO: 3429883 - RNA, 17 nt, Pseudomonas aeruginosa PA01
cgccggguagggcggau

SEQ ID NO: 3429884 - RNA, 14 nt, Pseudomonas aeruginosa PA01
cgccgggucgacau

SEQ ID NO: 3429885 - RNA, 22 nt, Pseudomonas aeruginosa PA01
cgccgggucgacaugcaggccg

SEQ ID NO: 3429886 - RNA, 19 nt, Pseudomonas aeruginosa PA01
cgccgggucgaccuugccg

SEQ ID NO: 3429887 - RNA, 23 nt, Pseudomonas aeruginosa PA01
cgccgggucgaccuugccgacgc

SEQ ID NO: 3429888 - RNA, 17 nt, Pseudomonas aeruginosa PA01
cgccgggucgacuucgc

SEQ ID NO: 3429889 - RNA, 15 nt, Pseudomonas aeruginosa PA01
cgccgggucgauggg

SEQ ID NO: 3429890 - RNA, 16 nt, Pseudomonas aeruginosa PA01
cgccgggucgaugggc

SEQ ID NO: 3429891 - RNA, 19 nt, Pseudomonas aeruginosa PA01
cgccgggucgaugggccgu

SEQ ID NO: 3429892 - RNA, 14 nt, Pseudomonas aeruginosa PA01
cgccgggucgccgc

SEQ ID NO: 3429893 - RNA, 17 nt, Pseudomonas aeruginosa PA01
cgccgggugccggugcg

SEQ ID NO: 3429894 - RNA, 18 nt, Pseudomonas aeruginosa PA01
cgccggguguuuuuccuc

SEQ ID NO: 3429895 - RNA, 23 nt, Pseudomonas aeruginosa PA01
cgccggguucaucgacaccccgg

SEQ ID NO: 3429896 - RNA, 13 nt, Pseudomonas aeruginosa PA01
cgccggguugcgc

SEQ ID NO: 3429897 - RNA, 17 nt, Pseudomonas aeruginosa PA01
cgccggguugcgccgca

SEQ ID NO: 3429898 - RNA, 17 nt, Pseudomonas aeruginosa PA01
cgccggguuguccaggc

SEQ ID NO: 3429899 - RNA, 20 nt, Pseudomonas aeruginosa PA01
cgccggguuucacggcggau

SEQ ID NO: 3429900 - RNA, 20 nt, Pseudomonas aeruginosa PA01
cgccgguaaugaaaagcccc

SEQ ID NO: 3429901 - RNA, 16 nt, Pseudomonas aeruginosa PA01
cgccgguagcggcgca

SEQ ID NO: 3429902 - RNA, 21 nt, Pseudomonas aeruginosa PA01
cgccgguagcggcgcaccgac

SEQ ID NO: 3429903 - RNA, 22 nt, Pseudomonas aeruginosa PA01
cgccgguagcggcgcaccgacg

SEQ ID NO: 3429904 - RNA, 23 nt, Pseudomonas aeruginosa PA01
cgccgguagcggcgcaccgacgc

SEQ ID NO: 3429905 - RNA, 18 nt, Pseudomonas aeruginosa PA01
cgccgguaguucgcugac

SEQ ID NO: 3429906 - RNA, 19 nt, Pseudomonas aeruginosa PA01
cgccgguaguucgcugacc

SEQ ID NO: 3429907 - RNA, 22 nt, Pseudomonas aeruginosa PA01
cgccgguaguucgcugaccgcg

SEQ ID NO: 3429908 - RNA, 20 nt, Pseudomonas aeruginosa PA01
cgccgguaucccggcugagc

SEQ ID NO: 3429909 - RNA, 17 nt, Pseudomonas aeruginosa PA01
cgccggucaaccgcggg

SEQ ID NO: 3429910 - RNA, 18 nt, Pseudomonas aeruginosa PA01
cgccggucaaccgcgggc

SEQ ID NO: 3429911 - RNA, 23 nt, Pseudomonas aeruginosa PA01
cgccggucaaccgcgggcgaggu

SEQ ID NO: 3429912 - RNA, 16 nt, Pseudomonas aeruginosa PA01
cgccggucaccacugg

SEQ ID NO: 3429913 - RNA, 14 nt, Pseudomonas aeruginosa PA01
cgccggucaggcug

SEQ ID NO: 3429914 - RNA, 15 nt, Pseudomonas aeruginosa PA01
cgccggucaggcugc

SEQ ID NO: 3429915 - RNA, 19 nt, Pseudomonas aeruginosa PA01
cgccggucaggcugcggcg

SEQ ID NO: 3429916 - RNA, 13 nt, Pseudomonas aeruginosa PA01
cgccgguccucga

SEQ ID NO: 3429917 - RNA, 14 nt, Pseudomonas aeruginosa PA01
cgccgguccucgac

SEQ ID NO: 3429918 - RNA, 15 nt, Pseudomonas aeruginosa PA01
cgccgguccucgaca

SEQ ID NO: 3429919 - RNA, 22 nt, Pseudomonas aeruginosa PA01
cgccggucgcgcucaggcgcag

SEQ ID NO: 3429920 - RNA, 23 nt, Pseudomonas aeruginosa PA01
cgccggucgcgcucaggcgcagc

SEQ ID NO: 3429921 - RNA, 13 nt, Pseudomonas aeruginosa PA01
cgccggucucggc

SEQ ID NO: 3429922 - RNA, 15 nt, Pseudomonas aeruginosa PA01
cgccggucucggcga

SEQ ID NO: 3429923 - RNA, 17 nt, Pseudomonas aeruginosa PA01
cgccggucuucacgccu

SEQ ID NO: 3429924 - RNA, 19 nt, Pseudomonas aeruginosa PA01
cgccggucuucacgccuug

SEQ ID NO: 3429925 - RNA, 20 nt, Pseudomonas aeruginosa PA01
cgccggucuucacgccuugc

SEQ ID NO: 3429926 - RNA, 16 nt, Pseudomonas aeruginosa PA01
cgccggugaacaggua

SEQ ID NO: 3429927 - RNA, 21 nt, Pseudomonas aeruginosa PA01
cgccggugacccacuccggca

SEQ ID NO: 3429928 - RNA, 23 nt, Pseudomonas aeruginosa PA01
cgccggugacccacuccggcagg

SEQ ID NO: 3429929 - RNA, 15 nt, Pseudomonas aeruginosa PA01
cgccggugacgcugc

SEQ ID NO: 3429930 - RNA, 17 nt, Pseudomonas aeruginosa PA01
cgccggugacgcugcuc

SEQ ID NO: 3429931 - RNA, 18 nt, Pseudomonas aeruginosa PA01
cgccggugacgcugcuca

SEQ ID NO: 3429932 - RNA, 21 nt, Pseudomonas aeruginosa PA01
cgccggugacgcugcucacca

SEQ ID NO: 3429933 - RNA, 15 nt, Pseudomonas aeruginosa PA01
cgccggugaggcgca

SEQ ID NO: 3429934 - RNA, 18 nt, Pseudomonas aeruginosa PA01
cgccggugaggcgcagca

SEQ ID NO: 3429935 - RNA, 21 nt, Pseudomonas aeruginosa PA01
cgccggugaggcgcagcagcg

SEQ ID NO: 3429936 - RNA, 23 nt, Pseudomonas aeruginosa PA01
cgccggugaggcgcagcagcgcc

SEQ ID NO: 3429937 - RNA, 18 nt, Pseudomonas aeruginosa PA01
cgccggugaucgagccgc

SEQ ID NO: 3429938 - RNA, 20 nt, Pseudomonas aeruginosa PA01
cgccggugaucgagccgccg

SEQ ID NO: 3429939 - RNA, 21 nt, Pseudomonas aeruginosa PA01
cgccggugaucgagccgccgg

SEQ ID NO: 3429940 - RNA, 22 nt, Pseudomonas aeruginosa PA01
cgccggugauguaggacgccuc

SEQ ID NO: 3429941 - RNA, 21 nt, Pseudomonas aeruginosa PA01
cgccggugcaccaggcgaugc

SEQ ID NO: 3429942 - RNA, 22 nt, Pseudomonas aeruginosa PA01
cgccggugcaccaggcgaugcg

SEQ ID NO: 3429943 - RNA, 23 nt, Pseudomonas aeruginosa PA01
cgccggugcaccaggcgaugcgc

SEQ ID NO: 3429944 - RNA, 14 nt, Pseudomonas aeruginosa PA01
cgccggugcaugaa

SEQ ID NO: 3429945 - RNA, 19 nt, Pseudomonas aeruginosa PA01
cgccggugcaugaaggcgc

SEQ ID NO: 3429946 - RNA, 20 nt, Pseudomonas aeruginosa PA01
cgccggugcaugaaggcgcu

SEQ ID NO: 3429947 - RNA, 22 nt, Pseudomonas aeruginosa PA01
cgccggugcaugaaggcgcuga

SEQ ID NO: 3429948 - RNA, 17 nt, Pseudomonas aeruginosa PA01
cgccggugccaggacca

SEQ ID NO: 3429949 - RNA, 20 nt, Pseudomonas aeruginosa PA01
cgccggugccaggaccagcc

SEQ ID NO: 3429950 - RNA, 21 nt, Pseudomonas aeruginosa PA01
cgccggugccaggaccagccc

SEQ ID NO: 3429951 - RNA, 14 nt, Pseudomonas aeruginosa PA01
cgccggugcuggcg

SEQ ID NO: 3429952 - RNA, 23 nt, Pseudomonas aeruginosa PA01
cgccggugcuggcgagcaggguc

SEQ ID NO: 3429953 - RNA, 23 nt, Pseudomonas aeruginosa PA01
cgccgguggccaggacgcuggcg

SEQ ID NO: 3429954 - RNA, 15 nt, Pseudomonas aeruginosa PA01
cgccgguggccaggc

SEQ ID NO: 3429955 - RNA, 16 nt, Pseudomonas aeruginosa PA01
cgccgguggccaggcu

SEQ ID NO: 3429956 - RNA, 17 nt, Pseudomonas aeruginosa PA01
cgccgguggccaggcuc

SEQ ID NO: 3429957 - RNA, 23 nt, Pseudomonas aeruginosa PA01
cgccgguucaguucagccgguac

SEQ ID NO: 3429958 - RNA, 19 nt, Pseudomonas aeruginosa PA01
cgccgguucgcaggccagg

SEQ ID NO: 3429959 - RNA, 21 nt, Pseudomonas aeruginosa PA01
cgccgguucgcaggccaggcg

SEQ ID NO: 3429960 - RNA, 23 nt, Pseudomonas aeruginosa PA01
cgccgguucgcaggccaggcgca

SEQ ID NO: 3429961 - RNA, 20 nt, Pseudomonas aeruginosa PA01
cgccgguucguugaccgucc

SEQ ID NO: 3429962 - RNA, 13 nt, Pseudomonas aeruginosa PA01
cgccgguugcguc

SEQ ID NO: 3429963 - RNA, 18 nt, Pseudomonas aeruginosa PA01
cgccgguugcgucucagc

SEQ ID NO: 3429964 - RNA, 20 nt, Pseudomonas aeruginosa PA01
cgccgguugcgucucagcgg

SEQ ID NO: 3429965 - RNA, 18 nt, Pseudomonas aeruginosa PA01
cgccgguugcugcugcgg

SEQ ID NO: 3429966 - RNA, 21 nt, Pseudomonas aeruginosa PA01
cgccgguugcugcugcggggc

SEQ ID NO: 3429967 - RNA, 19 nt, Pseudomonas aeruginosa PA01
cgccgguugcugcuugcgc

SEQ ID NO: 3429968 - RNA, 15 nt, Pseudomonas aeruginosa PA01
cgccgguuucgaccg

SEQ ID NO: 3429969 - RNA, 17 nt, Pseudomonas aeruginosa PA01
cgccgguuucgaccggc

SEQ ID NO: 3429970 - RNA, 19 nt, Pseudomonas aeruginosa PA01
cgccgguuucgaccggcgc

SEQ ID NO: 3429971 - RNA, 20 nt, Pseudomonas aeruginosa PA01
cgccgguuucgaccggcgcg

SEQ ID NO: 3429972 - RNA, 21 nt, Pseudomonas aeruginosa PA01
cgccgguuucgaccggcgcgc

SEQ ID NO: 3429973 - RNA, 23 nt, Pseudomonas aeruginosa PA01
cgccgguuucgaccggcgcgccu

SEQ ID NO: 3429974 - RNA, 16 nt, Pseudomonas aeruginosa PA01
cgccguaaccaacagc

SEQ ID NO: 3429975 - RNA, 14 nt, Pseudomonas aeruginosa PA01
cgccguacagcagg

SEQ ID NO: 3429976 - RNA, 16 nt, Pseudomonas aeruginosa PA01
cgccguacgcaccgcg

SEQ ID NO: 3429977 - RNA, 17 nt, Pseudomonas aeruginosa PA01
cgccguacgcaccgcgu

SEQ ID NO: 3429978 - RNA, 17 nt, Pseudomonas aeruginosa PA01
cgccguagaacagcacg

SEQ ID NO: 3429979 - RNA, 19 nt, Pseudomonas aeruginosa PA01
cgccguagaguucggcugc

SEQ ID NO: 3429980 - RNA, 20 nt, Pseudomonas aeruginosa PA01
cgccguagccgucguagcgc

SEQ ID NO: 3429981 - RNA, 13 nt, Pseudomonas aeruginosa PA01
cgccguaggccac

SEQ ID NO: 3429982 - RNA, 19 nt, Pseudomonas aeruginosa PA01
cgccguaggccacuucccg

SEQ ID NO: 3429983 - RNA, 22 nt, Pseudomonas aeruginosa PA01
cgccguaggccacuucccggcg

SEQ ID NO: 3429984 - RNA, 23 nt, Pseudomonas aeruginosa PA01
cgccguaggccacuucccggcgc

SEQ ID NO: 3429985 - RNA, 21 nt, Pseudomonas aeruginosa PA01
cgccgucaccagcagccccga

SEQ ID NO: 3429986 - RNA, 23 nt, Pseudomonas aeruginosa PA01
cgccgucaccagcagccccgagg

SEQ ID NO: 3429987 - RNA, 15 nt, Pseudomonas aeruginosa PA01
cgccgucagacgcgg

SEQ ID NO: 3429988 - RNA, 16 nt, Pseudomonas aeruginosa PA01
cgccgucaucgcugac

SEQ ID NO: 3429989 - RNA, 20 nt, Pseudomonas aeruginosa PA01
cgccgucaucgcugaccugg

SEQ ID NO: 3429990 - RNA, 13 nt, Pseudomonas aeruginosa PA01
cgccgucauggcg

SEQ ID NO: 3429991 - RNA, 15 nt, Pseudomonas aeruginosa PA01
cgccguccaccaagc

SEQ ID NO: 3429992 - RNA, 13 nt, Pseudomonas aeruginosa PA01
cgccguccaccag

SEQ ID NO: 3429993 - RNA, 16 nt, Pseudomonas aeruginosa PA01
cgccguccaccagcca

SEQ ID NO: 3429994 - RNA, 22 nt, Pseudomonas aeruginosa PA01
cgccguccaccagccagcucgg

SEQ ID NO: 3429995 - RNA, 12 nt, Pseudomonas aeruginosa PA01
cgccguccgagg

SEQ ID NO: 3429996 - RNA, 22 nt, Pseudomonas aeruginosa PA01
cgccguccgaggauaccgcacg

SEQ ID NO: 3429997 - RNA, 16 nt, Pseudomonas aeruginosa PA01
cgccguccgcgaugcg

SEQ ID NO: 3429998 - RNA, 17 nt, Pseudomonas aeruginosa PA01
cgccguccgcgaugcgu

SEQ ID NO: 3429999 - RNA, 21 nt, Pseudomonas aeruginosa PA01
cgccguccuugucgcagcggc

SEQ ID NO: 3430000 - RNA, 17 nt, Pseudomonas aeruginosa PA01
cgccgucgagccagccc

SEQ ID NO: 3430001 - RNA, 19 nt, Pseudomonas aeruginosa PA01
cgccgucgagccagcccag

SEQ ID NO: 3430002 - RNA, 21 nt, Pseudomonas aeruginosa PA01
cgccgucgagccagcccagcg

SEQ ID NO: 3430003 - RNA, 24 nt, Pseudomonas aeruginosa PA01
cgccgucgagccagcccagcggcg

SEQ ID NO: 3430004 - RNA, 13 nt, Pseudomonas aeruginosa PA01
cgccgucgaucag

SEQ ID NO: 3430005 - RNA, 22 nt, Pseudomonas aeruginosa PA01
cgccgucgaucagguaggccgg

SEQ ID NO: 3430006 - RNA, 13 nt, Pseudomonas aeruginosa PA01
cgccgucgccgcu

SEQ ID NO: 3430007 - RNA, 23 nt, Pseudomonas aeruginosa PA01
cgccgucgcgaccuucggugucg

SEQ ID NO: 3430008 - RNA, 14 nt, Pseudomonas aeruginosa PA01
cgccgucgcgcucu

SEQ ID NO: 3430009 - RNA, 15 nt, Pseudomonas aeruginosa PA01
cgccgucgcuggcga

SEQ ID NO: 3430010 - RNA, 13 nt, Pseudomonas aeruginosa PA01
cgccgucggcggu

SEQ ID NO: 3430011 - RNA, 14 nt, Pseudomonas aeruginosa PA01
cgccgucgggggcg

SEQ ID NO: 3430012 - RNA, 13 nt, Pseudomonas aeruginosa PA01
cgccgucguccgg

SEQ ID NO: 3430013 - RNA, 14 nt, Pseudomonas aeruginosa PA01
cgccgucguccggg

SEQ ID NO: 3430014 - RNA, 16 nt, Pseudomonas aeruginosa PA01
cgccgucuccgccgcu

SEQ ID NO: 3430015 - RNA, 22 nt, Pseudomonas aeruginosa PA01
cgccgucuccgccgcuaucgcc

SEQ ID NO: 3430016 - RNA, 16 nt, Pseudomonas aeruginosa PA01
cgccgucuuauucgac

SEQ ID NO: 3430017 - RNA, 15 nt, Pseudomonas aeruginosa PA01
cgccgucuugccgcu

SEQ ID NO: 3430018 - RNA, 24 nt, Pseudomonas aeruginosa PA01
cgccgucuugccgcugcgcgcagu

SEQ ID NO: 3430019 - RNA, 13 nt, Pseudomonas aeruginosa PA01
cgccgugaggcgc

SEQ ID NO: 3430020 - RNA, 14 nt, Pseudomonas aeruginosa PA01
cgccgugaggcgcg

SEQ ID NO: 3430021 - RNA, 17 nt, Pseudomonas aeruginosa PA01
cgccgugaggcgcgcgc

SEQ ID NO: 3430022 - RNA, 15 nt, Pseudomonas aeruginosa PA01
cgccgugcaggguca

SEQ ID NO: 3430023 - RNA, 21 nt, Pseudomonas aeruginosa PA01
cgccgugcagggucaggucgu

SEQ ID NO: 3430024 - RNA, 18 nt, Pseudomonas aeruginosa PA01
cgccgugcaucaccggca

SEQ ID NO: 3430025 - RNA, 19 nt, Pseudomonas aeruginosa PA01
cgccgugcaucaccggcag

SEQ ID NO: 3430026 - RNA, 21 nt, Pseudomonas aeruginosa PA01
cgccgugcaucaccggcagca

SEQ ID NO: 3430027 - RNA, 18 nt, Pseudomonas aeruginosa PA01
cgccgugcgcuccgccag

SEQ ID NO: 3430028 - RNA, 23 nt, Pseudomonas aeruginosa PA01
cgccgugcgcuccgccaggccgc

SEQ ID NO: 3430029 - RNA, 20 nt, Pseudomonas aeruginosa PA01
cgccgugcuugugguagugg

SEQ ID NO: 3430030 - RNA, 12 nt, Pseudomonas aeruginosa PA01
cgccguggaacg

SEQ ID NO: 3430031 - RNA, 14 nt, Pseudomonas aeruginosa PA01
cgccguggaacgca

SEQ ID NO: 3430032 - RNA, 17 nt, Pseudomonas aeruginosa PA01
cgccguggaucgcccgg

SEQ ID NO: 3430033 - RNA, 16 nt, Pseudomonas aeruginosa PA01
cgccguggcaccaggu

SEQ ID NO: 3430034 - RNA, 17 nt, Pseudomonas aeruginosa PA01
cgccguggcaccagguc

SEQ ID NO: 3430035 - RNA, 21 nt, Pseudomonas aeruginosa PA01
cgccguggcugugcuggccac

SEQ ID NO: 3430036 - RNA, 22 nt, Pseudomonas aeruginosa PA01
cgccguggcugugcuggccacc

SEQ ID NO: 3430037 - RNA, 23 nt, Pseudomonas aeruginosa PA01
cgccguggcugugcuggccaccc

SEQ ID NO: 3430038 - RNA, 13 nt, Pseudomonas aeruginosa PA01
cgccgugggaacg

SEQ ID NO: 3430039 - RNA, 20 nt, Pseudomonas aeruginosa PA01
cgccgugggaguccagguac

SEQ ID NO: 3430040 - RNA, 21 nt, Pseudomonas aeruginosa PA01
cgccgugggaguccagguaca

SEQ ID NO: 3430041 - RNA, 20 nt, Pseudomonas aeruginosa PA01
cgccgugguggccguggcgc

SEQ ID NO: 3430042 - RNA, 23 nt, Pseudomonas aeruginosa PA01
cgccguguaaugacuccggucaa

SEQ ID NO: 3430043 - RNA, 16 nt, Pseudomonas aeruginosa PA01
cgccguuacgccggau

SEQ ID NO: 3430044 - RNA, 14 nt, Pseudomonas aeruginosa PA01
cgccguucacgccu

SEQ ID NO: 3430045 - RNA, 18 nt, Pseudomonas aeruginosa PA01
cgccguucacgccuggcg

SEQ ID NO: 3430046 - RNA, 17 nt, Pseudomonas aeruginosa PA01
cgccguuccuccucgcc

SEQ ID NO: 3430047 - RNA, 18 nt, Pseudomonas aeruginosa PA01
cgccguuccuccucgccg

SEQ ID NO: 3430048 - RNA, 22 nt, Pseudomonas aeruginosa PA01
cgccguuccuccucgccgccga

SEQ ID NO: 3430049 - RNA, 13 nt, Pseudomonas aeruginosa PA01
cgccguucgcccg

SEQ ID NO: 3430050 - RNA, 14 nt, Pseudomonas aeruginosa PA01
cgccguucgcccgc

SEQ ID NO: 3430051 - RNA, 15 nt, Pseudomonas aeruginosa PA01
cgccguucgcccgcc

SEQ ID NO: 3430052 - RNA, 17 nt, Pseudomonas aeruginosa PA01
cgccguucucauugcgc

SEQ ID NO: 3430053 - RNA, 14 nt, Pseudomonas aeruginosa PA01
cgccguucucgauc

SEQ ID NO: 3430054 - RNA, 23 nt, Pseudomonas aeruginosa PA01
cgccguucuuguugagcuggccg

SEQ ID NO: 3430055 - RNA, 18 nt, Pseudomonas aeruginosa PA01
cgccguugacgaucagga

SEQ ID NO: 3430056 - RNA, 20 nt, Pseudomonas aeruginosa PA01
cgccguugaugacgaacugc

SEQ ID NO: 3430057 - RNA, 22 nt, Pseudomonas aeruginosa PA01
cgccguugaugacgaacugcac

SEQ ID NO: 3430058 - RNA, 24 nt, Pseudomonas aeruginosa PA01
cgccguugaugacgaacugcacgc

SEQ ID NO: 3430059 - RNA, 16 nt, Pseudomonas aeruginosa PA01
cgccguugccagcauc

SEQ ID NO: 3430060 - RNA, 14 nt, Pseudomonas aeruginosa PA01
cgccguugccgaug

SEQ ID NO: 3430061 - RNA, 16 nt, Pseudomonas aeruginosa PA01
cgccguugccgaugcc

SEQ ID NO: 3430062 - RNA, 14 nt, Pseudomonas aeruginosa PA01
cgccguugccggua

SEQ ID NO: 3430063 - RNA, 23 nt, Pseudomonas aeruginosa PA01
cgccguugccgguacucgccggg

SEQ ID NO: 3430064 - RNA, 16 nt, Pseudomonas aeruginosa PA01
cgccguugcggcagca

SEQ ID NO: 3430065 - RNA, 14 nt, Pseudomonas aeruginosa PA01
cgccguuggcgagg

SEQ ID NO: 3430066 - RNA, 21 nt, Pseudomonas aeruginosa PA01
cgccguuggcgaggacuuucu

SEQ ID NO: 3430067 - RNA, 19 nt, Pseudomonas aeruginosa PA01
cgccguuguugaccgcagg

SEQ ID NO: 3430068 - RNA, 20 nt, Pseudomonas aeruginosa PA01
cgccguuguugaccgcagga

SEQ ID NO: 3430069 - RNA, 21 nt, Pseudomonas aeruginosa PA01
cgccguuuucaaugacgggga

SEQ ID NO: 3430070 - RNA, 19 nt, Pseudomonas aeruginosa PA01
cgccuaccagaccgcagcc

SEQ ID NO: 3430071 - RNA, 22 nt, Pseudomonas aeruginosa PA01
cgccuaccagaccgcagccggc

SEQ ID NO: 3430072 - RNA, 13 nt, Pseudomonas aeruginosa PA01
cgccuaccggggc

SEQ ID NO: 3430073 - RNA, 17 nt, Pseudomonas aeruginosa PA01
cgccuaccggggcgcgg

SEQ ID NO: 3430074 - RNA, 21 nt, Pseudomonas aeruginosa PA01
cgccuaccggggcgcgggcga

SEQ ID NO: 3430075 - RNA, 15 nt, Pseudomonas aeruginosa PA01
cgccuauccacgacg

SEQ ID NO: 3430076 - RNA, 20 nt, Pseudomonas aeruginosa PA01
cgccuauccacgacgucggc

SEQ ID NO: 3430077 - RNA, 22 nt, Pseudomonas aeruginosa PA01
cgccuauccacgacgucggcgg

SEQ ID NO: 3430078 - RNA, 23 nt, Pseudomonas aeruginosa PA01
cgccuauccacgacgucggcggc

SEQ ID NO: 3430079 - RNA, 20 nt, Pseudomonas aeruginosa PA01
cgccuauccgugacgucggc

SEQ ID NO: 3430080 - RNA, 23 nt, Pseudomonas aeruginosa PA01
cgccuauccgugacgucggcggc

SEQ ID NO: 3430081 - RNA, 17 nt, Pseudomonas aeruginosa PA01
cgccucaaggugaagug

SEQ ID NO: 3430082 - RNA, 21 nt, Pseudomonas aeruginosa PA01
cgccucacggucgcaggggcu

SEQ ID NO: 3430083 - RNA, 24 nt, Pseudomonas aeruginosa PA01
cgccucagcggccuucgacgaugc

SEQ ID NO: 3430084 - RNA, 13 nt, Pseudomonas aeruginosa PA01
cgccucagcggcu

SEQ ID NO: 3430085 - RNA, 16 nt, Pseudomonas aeruginosa PA01
cgccucagcggcuggc

SEQ ID NO: 3430086 - RNA, 18 nt, Pseudomonas aeruginosa PA01
cgccucagcggcuggcga

SEQ ID NO: 3430087 - RNA, 12 nt, Pseudomonas aeruginosa PA01
cgccucaggccg

SEQ ID NO: 3430088 - RNA, 13 nt, Pseudomonas aeruginosa PA01
cgccucaggccgg

SEQ ID NO: 3430089 - RNA, 14 nt, Pseudomonas aeruginosa PA01
cgccucaggccggg

SEQ ID NO: 3430090 - RNA, 13 nt, Pseudomonas aeruginosa PA01
cgccuccaccagc

SEQ ID NO: 3430091 - RNA, 17 nt, Pseudomonas aeruginosa PA01
cgccuccaccagcgccg

SEQ ID NO: 3430092 - RNA, 12 nt, Pseudomonas aeruginosa PA01
cgccuccacggc

SEQ ID NO: 3430093 - RNA, 14 nt, Pseudomonas aeruginosa PA01
cgccuccagcaccg

SEQ ID NO: 3430094 - RNA, 16 nt, Pseudomonas aeruginosa PA01
cgccuccagcaccggg

SEQ ID NO: 3430095 - RNA, 22 nt, Pseudomonas aeruginosa PA01
cgccuccagcgucugccgcugg

SEQ ID NO: 3430096 - RNA, 23 nt, Pseudomonas aeruginosa PA01
cgccuccaggaauccuccgccag

SEQ ID NO: 3430097 - RNA, 12 nt, Pseudomonas aeruginosa PA01
cgccuccaggac

SEQ ID NO: 3430098 - RNA, 13 nt, Pseudomonas aeruginosa PA01
cgccuccaggcgc

SEQ ID NO: 3430099 - RNA, 14 nt, Pseudomonas aeruginosa PA01
cgccuccaggcgcg

SEQ ID NO: 3430100 - RNA, 15 nt, Pseudomonas aeruginosa PA01
cgccuccaggcgcgc

SEQ ID NO: 3430101 - RNA, 18 nt, Pseudomonas aeruginosa PA01
cgccucccaccgcgcggc

SEQ ID NO: 3430102 - RNA, 22 nt, Pseudomonas aeruginosa PA01
cgccucccaccgcgcggcacag

SEQ ID NO: 3430103 - RNA, 17 nt, Pseudomonas aeruginosa PA01
cgccucccgccaaaugg

SEQ ID NO: 3430104 - RNA, 17 nt, Pseudomonas aeruginosa PA01
cgccucccggcucgccg

SEQ ID NO: 3430105 - RNA, 15 nt, Pseudomonas aeruginosa PA01
cgccucccuggcgac

SEQ ID NO: 3430106 - RNA, 14 nt, Pseudomonas aeruginosa PA01
cgccuccggcacgc

SEQ ID NO: 3430107 - RNA, 19 nt, Pseudomonas aeruginosa PA01
cgccuccggcacgcugccg

SEQ ID NO: 3430108 - RNA, 22 nt, Pseudomonas aeruginosa PA01
cgccuccggcacgcugccgccg

SEQ ID NO: 3430109 - RNA, 15 nt, Pseudomonas aeruginosa PA01
cgccuccggcagcgu

SEQ ID NO: 3430110 - RNA, 17 nt, Pseudomonas aeruginosa PA01
cgccuccgggcguaacg

SEQ ID NO: 3430111 - RNA, 16 nt, Pseudomonas aeruginosa PA01
cgccuccucggcggcc

SEQ ID NO: 3430112 - RNA, 22 nt, Pseudomonas aeruginosa PA01
cgccuccucggcggccuuuucg

SEQ ID NO: 3430113 - RNA, 14 nt, Pseudomonas aeruginosa PA01
cgccuccugcggau

SEQ ID NO: 3430114 - RNA, 17 nt, Pseudomonas aeruginosa PA01
cgccucgaacauggcca

SEQ ID NO: 3430115 - RNA, 14 nt, Pseudomonas aeruginosa PA01
cgccucgaagcgga

SEQ ID NO: 3430116 - RNA, 21 nt, Pseudomonas aeruginosa PA01
cgccucgaaggucagcccgug

SEQ ID NO: 3430117 - RNA, 15 nt, Pseudomonas aeruginosa PA01
cgccucgaccagcgc

SEQ ID NO: 3430118 - RNA, 16 nt, Pseudomonas aeruginosa PA01
cgccucgaccagcgcc

SEQ ID NO: 3430119 - RNA, 19 nt, Pseudomonas aeruginosa PA01
cgccucgaccagcgccgcg

SEQ ID NO: 3430120 - RNA, 21 nt, Pseudomonas aeruginosa PA01
cgccucgaccagcgccgcggc

SEQ ID NO: 3430121 - RNA, 17 nt, Pseudomonas aeruginosa PA01
cgccucgaccaucggcg

SEQ ID NO: 3430122 - RNA, 20 nt, Pseudomonas aeruginosa PA01
cgccucgaccaucggcggcg

SEQ ID NO: 3430123 - RNA, 21 nt, Pseudomonas aeruginosa PA01
cgccucgaccaucggcggcgg

SEQ ID NO: 3430124 - RNA, 23 nt, Pseudomonas aeruginosa PA01
cgccucgaccaucggcggcggcc

SEQ ID NO: 3430125 - RNA, 16 nt, Pseudomonas aeruginosa PA01
cgccucgaccucggcc

SEQ ID NO: 3430126 - RNA, 14 nt, Pseudomonas aeruginosa PA01
cgccucgaccuggc

SEQ ID NO: 3430127 - RNA, 18 nt, Pseudomonas aeruginosa PA01
cgccucgaccuggccacg

SEQ ID NO: 3430128 - RNA, 19 nt, Pseudomonas aeruginosa PA01
cgccucgaggaucuugcgc

SEQ ID NO: 3430129 - RNA, 23 nt, Pseudomonas aeruginosa PA01
cgccucgaucagugcaucggccg

SEQ ID NO: 3430130 - RNA, 15 nt, Pseudomonas aeruginosa PA01
cgccucgaucgccuc

SEQ ID NO: 3430131 - RNA, 21 nt, Pseudomonas aeruginosa PA01
cgccucgaucgccucgggcga

SEQ ID NO: 3430132 - RNA, 17 nt, Pseudomonas aeruginosa PA01
cgccucgaucuucuucc

SEQ ID NO: 3430133 - RNA, 20 nt, Pseudomonas aeruginosa PA01
cgccucgaucuucuuccccg

SEQ ID NO: 3430134 - RNA, 22 nt, Pseudomonas aeruginosa PA01
cgccucgaucuucuuccccgcc

SEQ ID NO: 3430135 - RNA, 16 nt, Pseudomonas aeruginosa PA01
cgccucgauggcggca

SEQ ID NO: 3430136 - RNA, 19 nt, Pseudomonas aeruginosa PA01
cgccucgcaaaggucggcg

SEQ ID NO: 3430137 - RNA, 21 nt, Pseudomonas aeruginosa PA01
cgccucgcaaaggucggcgaa

SEQ ID NO: 3430138 - RNA, 16 nt, Pseudomonas aeruginosa PA01
cgccucgcagagcgcc

SEQ ID NO: 3430139 - RNA, 17 nt, Pseudomonas aeruginosa PA01
cgccucgcagagcgcca

SEQ ID NO: 3430140 - RNA, 19 nt, Pseudomonas aeruginosa PA01
cgccucgcagagcgccagc

SEQ ID NO: 3430141 - RNA, 20 nt, Pseudomonas aeruginosa PA01
cgccucgcagagcgccagcc

SEQ ID NO: 3430142 - RNA, 21 nt, Pseudomonas aeruginosa PA01
cgccucgccccagacccaggu

SEQ ID NO: 3430143 - RNA, 22 nt, Pseudomonas aeruginosa PA01
cgccucgccccagacccaggug

SEQ ID NO: 3430144 - RNA, 12 nt, Pseudomonas aeruginosa PA01
cgccucgccgag

SEQ ID NO: 3430145 - RNA, 14 nt, Pseudomonas aeruginosa PA01
cgccucgccgcccg

SEQ ID NO: 3430146 - RNA, 15 nt, Pseudomonas aeruginosa PA01
cgccucgccgcggca

SEQ ID NO: 3430147 - RNA, 12 nt, Pseudomonas aeruginosa PA01
cgccucgccggc

SEQ ID NO: 3430148 - RNA, 14 nt, Pseudomonas aeruginosa PA01
cgccucgccggcca

SEQ ID NO: 3430149 - RNA, 14 nt, Pseudomonas aeruginosa PA01
cgccucgcgcaacg

SEQ ID NO: 3430150 - RNA, 22 nt, Pseudomonas aeruginosa PA01
cgccucgcgcaacgccgacggc

SEQ ID NO: 3430151 - RNA, 23 nt, Pseudomonas aeruginosa PA01
cgccucgcgcaacgccgacggcg

SEQ ID NO: 3430152 - RNA, 12 nt, Pseudomonas aeruginosa PA01
cgccucgcgcca

SEQ ID NO: 3430153 - RNA, 20 nt, Pseudomonas aeruginosa PA01
cgccucgcgccagagaucgc

SEQ ID NO: 3430154 - RNA, 21 nt, Pseudomonas aeruginosa PA01
cgccucgcgccagagaucgcc

SEQ ID NO: 3430155 - RNA, 15 nt, Pseudomonas aeruginosa PA01
cgccucgcgccgcgc

SEQ ID NO: 3430156 - RNA, 14 nt, Pseudomonas aeruginosa PA01
cgccucgcgccguc

SEQ ID NO: 3430157 - RNA, 21 nt, Pseudomonas aeruginosa PA01
cgccucgcggaccucgggcag

SEQ ID NO: 3430158 - RNA, 14 nt, Pseudomonas aeruginosa PA01
cgccucgcgggucu

SEQ ID NO: 3430159 - RNA, 13 nt, Pseudomonas aeruginosa PA01
cgccucgcuggcg

SEQ ID NO: 3430160 - RNA, 17 nt, Pseudomonas aeruginosa PA01
cgccucggagaacagca

SEQ ID NO: 3430161 - RNA, 12 nt, Pseudomonas aeruginosa PA01
cgccucggcauc

SEQ ID NO: 3430162 - RNA, 14 nt, Pseudomonas aeruginosa PA01
cgccucggcaucga

SEQ ID NO: 3430163 - RNA, 18 nt, Pseudomonas aeruginosa PA01
cgccucggcaucgaccag

SEQ ID NO: 3430164 - RNA, 22 nt, Pseudomonas aeruginosa PA01
cgccucggcaucgaccagggcc

SEQ ID NO: 3430165 - RNA, 16 nt, Pseudomonas aeruginosa PA01
cgccucggcccuggcg

SEQ ID NO: 3430166 - RNA, 13 nt, Pseudomonas aeruginosa PA01
cgccucggcgcga

SEQ ID NO: 3430167 - RNA, 17 nt, Pseudomonas aeruginosa PA01
cgccucggcgcgauccu

SEQ ID NO: 3430168 - RNA, 16 nt, Pseudomonas aeruginosa PA01
cgccucggcgcgcgcc

SEQ ID NO: 3430169 - RNA, 17 nt, Pseudomonas aeruginosa PA01
cgccucggcgcgcgccc

SEQ ID NO: 3430170 - RNA, 18 nt, Pseudomonas aeruginosa PA01
cgccucggcgcgcgcccc

SEQ ID NO: 3430171 - RNA, 11 nt, Pseudomonas aeruginosa PA01
cgccucggcgg

SEQ ID NO: 3430172 - RNA, 12 nt, Pseudomonas aeruginosa PA01
cgccucggcggc

SEQ ID NO: 3430173 - RNA, 13 nt, Pseudomonas aeruginosa PA01
cgccucggcggcu

SEQ ID NO: 3430174 - RNA, 13 nt, Pseudomonas aeruginosa PA01
cgccucggcguag

SEQ ID NO: 3430175 - RNA, 22 nt, Pseudomonas aeruginosa PA01
cgccucggcguagaccuucucg

SEQ ID NO: 3430176 - RNA, 13 nt, Pseudomonas aeruginosa PA01
cgccucgggcagc

SEQ ID NO: 3430177 - RNA, 15 nt, Pseudomonas aeruginosa PA01
cgccucgggcagccc

SEQ ID NO: 3430178 - RNA, 16 nt, Pseudomonas aeruginosa PA01
cgccucgggcagcccc

SEQ ID NO: 3430179 - RNA, 23 nt, Pseudomonas aeruginosa PA01
cgccucgggcagccccuugagcg

SEQ ID NO: 3430180 - RNA, 12 nt, Pseudomonas aeruginosa PA01
cgccucgggcca

SEQ ID NO: 3430181 - RNA, 14 nt, Pseudomonas aeruginosa PA01
cgccucgggccaug

SEQ ID NO: 3430182 - RNA, 17 nt, Pseudomonas aeruginosa PA01
cgccucgggccggagca

SEQ ID NO: 3430183 - RNA, 16 nt, Pseudomonas aeruginosa PA01
cgccucgggcgagcgc

SEQ ID NO: 3430184 - RNA, 17 nt, Pseudomonas aeruginosa PA01
cgccucgguccaaccca

SEQ ID NO: 3430185 - RNA, 14 nt, Pseudomonas aeruginosa PA01
cgccucgucgacgc

SEQ ID NO: 3430186 - RNA, 18 nt, Pseudomonas aeruginosa PA01
cgccucgucgacgcucag

SEQ ID NO: 3430187 - RNA, 23 nt, Pseudomonas aeruginosa PA01
cgccucgucgacgcucagcaccc

SEQ ID NO: 3430188 - RNA, 19 nt, Pseudomonas aeruginosa PA01
cgccucgucgagcgcagcg

SEQ ID NO: 3430189 - RNA, 21 nt, Pseudomonas aeruginosa PA01
cgccucgucgccaugcggcag

SEQ ID NO: 3430190 - RNA, 13 nt, Pseudomonas aeruginosa PA01
cgccucgucgcgc

SEQ ID NO: 3430191 - RNA, 15 nt, Pseudomonas aeruginosa PA01
cgccucgucgcgcca

SEQ ID NO: 3430192 - RNA, 17 nt, Pseudomonas aeruginosa PA01
cgccucgucgcgccagg

SEQ ID NO: 3430193 - RNA, 19 nt, Pseudomonas aeruginosa PA01
cgccucgucggaggcgagg

SEQ ID NO: 3430194 - RNA, 15 nt, Pseudomonas aeruginosa PA01
cgccucgugcagcaa

SEQ ID NO: 3430195 - RNA, 16 nt, Pseudomonas aeruginosa PA01
cgccucguggaacagc

SEQ ID NO: 3430196 - RNA, 17 nt, Pseudomonas aeruginosa PA01
cgccucguggaacagcg

SEQ ID NO: 3430197 - RNA, 15 nt, Pseudomonas aeruginosa PA01
cgccucguucagcag

SEQ ID NO: 3430198 - RNA, 17 nt, Pseudomonas aeruginosa PA01
cgccucguucagcagca

SEQ ID NO: 3430199 - RNA, 22 nt, Pseudomonas aeruginosa PA01
cgccucguucagcagcaugccg

SEQ ID NO: 3430200 - RNA, 19 nt, Pseudomonas aeruginosa PA01
cgccucguucgucgccgac

SEQ ID NO: 3430201 - RNA, 22 nt, Pseudomonas aeruginosa PA01
cgccucguucgucgccgacugc

SEQ ID NO: 3430202 - RNA, 19 nt, Pseudomonas aeruginosa PA01
cgccucuuccuggaccucc

SEQ ID NO: 3430203 - RNA, 22 nt, Pseudomonas aeruginosa PA01
cgccucuuccuggaccuccgcc

SEQ ID NO: 3430204 - RNA, 13 nt, Pseudomonas aeruginosa PA01
cgccucuucgcag

SEQ ID NO: 3430205 - RNA, 20 nt, Pseudomonas aeruginosa PA01
cgccucuucgcaggagucga

SEQ ID NO: 3430206 - RNA, 14 nt, Pseudomonas aeruginosa PA01
cgccugagcagcgc

SEQ ID NO: 3430207 - RNA, 16 nt, Pseudomonas aeruginosa PA01
cgccugagcagcgcuu

SEQ ID NO: 3430208 - RNA, 14 nt, Pseudomonas aeruginosa PA01
cgccugagcuggcc

SEQ ID NO: 3430209 - RNA, 18 nt, Pseudomonas aeruginosa PA01
cgccugagcuggcccagu

SEQ ID NO: 3430210 - RNA, 21 nt, Pseudomonas aeruginosa PA01
cgccugcaaagaggcgcucaa

SEQ ID NO: 3430211 - RNA, 17 nt, Pseudomonas aeruginosa PA01
cgccugcaacgccagca

SEQ ID NO: 3430212 - RNA, 18 nt, Pseudomonas aeruginosa PA01
cgccugcaacgccagcag

SEQ ID NO: 3430213 - RNA, 21 nt, Pseudomonas aeruginosa PA01
cgccugcaacgccagcaggcg

SEQ ID NO: 3430214 - RNA, 23 nt, Pseudomonas aeruginosa PA01
cgccugcaacgccagcaggcgca

SEQ ID NO: 3430215 - RNA, 20 nt, Pseudomonas aeruginosa PA01
cgccugcaacguccucgcgc

SEQ ID NO: 3430216 - RNA, 24 nt, Pseudomonas aeruginosa PA01
cgccugcaacguccucgcgccgcu

SEQ ID NO: 3430217 - RNA, 13 nt, Pseudomonas aeruginosa PA01
cgccugcagcacc

SEQ ID NO: 3430218 - RNA, 14 nt, Pseudomonas aeruginosa PA01
cgccugcagcacca

SEQ ID NO: 3430219 - RNA, 20 nt, Pseudomonas aeruginosa PA01
cgccugcagcaccaccucgc

SEQ ID NO: 3430220 - RNA, 21 nt, Pseudomonas aeruginosa PA01
cgccugcagcaccaccucgcc

SEQ ID NO: 3430221 - RNA, 23 nt, Pseudomonas aeruginosa PA01
cgccugcagcucggugaggaacu

SEQ ID NO: 3430222 - RNA, 17 nt, Pseudomonas aeruginosa PA01
cgccugcaggaaggcuu

SEQ ID NO: 3430223 - RNA, 23 nt, Pseudomonas aeruginosa PA01
cgccugcaggucgaggcgcucca

SEQ ID NO: 3430224 - RNA, 19 nt, Pseudomonas aeruginosa PA01
cgccugcaucucuuccucg

SEQ ID NO: 3430225 - RNA, 16 nt, Pseudomonas aeruginosa PA01
cgccugccaggcgggg

SEQ ID NO: 3430226 - RNA, 18 nt, Pseudomonas aeruginosa PA01
cgccugccaggcggggau

SEQ ID NO: 3430227 - RNA, 20 nt, Pseudomonas aeruginosa PA01
cgccugccaggcggggaugg

SEQ ID NO: 3430228 - RNA, 22 nt, Pseudomonas aeruginosa PA01
cgccugccaggcggggauggcg

SEQ ID NO: 3430229 - RNA, 20 nt, Pseudomonas aeruginosa PA01
cgccugccauccgggguggg

SEQ ID NO: 3430230 - RNA, 22 nt, Pseudomonas aeruginosa PA01
cgccugccccacuuccggcccg

SEQ ID NO: 3430231 - RNA, 24 nt, Pseudomonas aeruginosa PA01
cgccugccccacuuccggcccggc

SEQ ID NO: 3430232 - RNA, 16 nt, Pseudomonas aeruginosa PA01
cgccugcgccucggcc

SEQ ID NO: 3430233 - RNA, 18 nt, Pseudomonas aeruginosa PA01
cgccugcgccucggcccu

SEQ ID NO: 3430234 - RNA, 22 nt, Pseudomonas aeruginosa PA01
cgccugcgcuucguuggcgacg

SEQ ID NO: 3430235 - RNA, 15 nt, Pseudomonas aeruginosa PA01
cgccugcggaccaca

SEQ ID NO: 3430236 - RNA, 24 nt, Pseudomonas aeruginosa PA01
cgccugcggcgccuagacccuggg

SEQ ID NO: 3430237 - RNA, 14 nt, Pseudomonas aeruginosa PA01
cgccugcggcguag

SEQ ID NO: 3430238 - RNA, 22 nt, Pseudomonas aeruginosa PA01
cgccugcggcguuauccgcccu

SEQ ID NO: 3430239 - RNA, 19 nt, Pseudomonas aeruginosa PA01
cgccugcucgccgcugaag

SEQ ID NO: 3430240 - RNA, 15 nt, Pseudomonas aeruginosa PA01
cgccugcucgcggcu

SEQ ID NO: 3430241 - RNA, 19 nt, Pseudomonas aeruginosa PA01
cgccugcucggccugcugc

SEQ ID NO: 3430242 - RNA, 22 nt, Pseudomonas aeruginosa PA01
cgccugcucggccugcugcgcc

SEQ ID NO: 3430243 - RNA, 16 nt, Pseudomonas aeruginosa PA01
cgccugcucuucggcg

SEQ ID NO: 3430244 - RNA, 18 nt, Pseudomonas aeruginosa PA01
cgccugcucuucggcggc

SEQ ID NO: 3430245 - RNA, 22 nt, Pseudomonas aeruginosa PA01
cgccugcucuucggcggccagc

SEQ ID NO: 3430246 - RNA, 13 nt, Pseudomonas aeruginosa PA01
cgccugcugcgcg

SEQ ID NO: 3430247 - RNA, 21 nt, Pseudomonas aeruginosa PA01
cgccugcugcgcguguacccc

SEQ ID NO: 3430248 - RNA, 12 nt, Pseudomonas aeruginosa PA01
cgccugcuggcc

SEQ ID NO: 3430249 - RNA, 13 nt, Pseudomonas aeruginosa PA01
cgccugcuggccg

SEQ ID NO: 3430250 - RNA, 19 nt, Pseudomonas aeruginosa PA01
cgccugcuggccggugcca

SEQ ID NO: 3430251 - RNA, 13 nt, Pseudomonas aeruginosa PA01
cgccugcuggcug

SEQ ID NO: 3430252 - RNA, 20 nt, Pseudomonas aeruginosa PA01
cgccugcuggugggugaucu

SEQ ID NO: 3430253 - RNA, 20 nt, Pseudomonas aeruginosa PA01
cgccugcuucagcccggcac

SEQ ID NO: 3430254 - RNA, 22 nt, Pseudomonas aeruginosa PA01
cgccugcuucagcccggcacca

SEQ ID NO: 3430255 - RNA, 23 nt, Pseudomonas aeruginosa PA01
cgccugcuugaaauggcggacga

SEQ ID NO: 3430256 - RNA, 14 nt, Pseudomonas aeruginosa PA01
cgccugcuuuggga

SEQ ID NO: 3430257 - RNA, 14 nt, Pseudomonas aeruginosa PA01
cgccuggaaggcgc

SEQ ID NO: 3430258 - RNA, 16 nt, Pseudomonas aeruginosa PA01
cgccuggaaggcgcug

SEQ ID NO: 3430259 - RNA, 21 nt, Pseudomonas aeruginosa PA01
cgccuggaaggcgcugggcgg

SEQ ID NO: 3430260 - RNA, 18 nt, Pseudomonas aeruginosa PA01
cgccuggaccaggucgag

SEQ ID NO: 3430261 - RNA, 14 nt, Pseudomonas aeruginosa PA01
cgccuggagcagaa

SEQ ID NO: 3430262 - RNA, 21 nt, Pseudomonas aeruginosa PA01
cgccuggagcagaaccgccag

SEQ ID NO: 3430263 - RNA, 22 nt, Pseudomonas aeruginosa PA01
cgccuggagcagaaccgccagc

SEQ ID NO: 3430264 - RNA, 15 nt, Pseudomonas aeruginosa PA01
cgccuggaucagcgc

SEQ ID NO: 3430265 - RNA, 16 nt, Pseudomonas aeruginosa PA01
cgccuggaugaucgcg

SEQ ID NO: 3430266 - RNA, 14 nt, Pseudomonas aeruginosa PA01
cgccuggccacgcc

SEQ ID NO: 3430267 - RNA, 13 nt, Pseudomonas aeruginosa PA01
cgccuggcccugg

SEQ ID NO: 3430268 - RNA, 16 nt, Pseudomonas aeruginosa PA01
cgccuggcccuggacc

SEQ ID NO: 3430269 - RNA, 12 nt, Pseudomonas aeruginosa PA01
cgccuggccgcg

SEQ ID NO: 3430270 - RNA, 13 nt, Pseudomonas aeruginosa PA01
cgccuggccgcgc

SEQ ID NO: 3430271 - RNA, 14 nt, Pseudomonas aeruginosa PA01
cgccuggccgcgca

SEQ ID NO: 3430272 - RNA, 15 nt, Pseudomonas aeruginosa PA01
cgccuggccgcgcag

SEQ ID NO: 3430273 - RNA, 16 nt, Pseudomonas aeruginosa PA01
cgccuggcgcaacgcc

SEQ ID NO: 3430274 - RNA, 19 nt, Pseudomonas aeruginosa PA01
cgccuggcgcaacgccggc

SEQ ID NO: 3430275 - RNA, 13 nt, Pseudomonas aeruginosa PA01
cgccuggcgcaag

SEQ ID NO: 3430276 - RNA, 14 nt, Pseudomonas aeruginosa PA01
cgccuggcgcaugg

SEQ ID NO: 3430277 - RNA, 17 nt, Pseudomonas aeruginosa PA01
cgccuggcgcauggcgc

SEQ ID NO: 3430278 - RNA, 13 nt, Pseudomonas aeruginosa PA01
cgccuggcgcgac

SEQ ID NO: 3430279 - RNA, 14 nt, Pseudomonas aeruginosa PA01
cgccuggcgcgacg

SEQ ID NO: 3430280 - RNA, 18 nt, Pseudomonas aeruginosa PA01
cgccuggcgcgacgaggc

SEQ ID NO: 3430281 - RNA, 19 nt, Pseudomonas aeruginosa PA01
cgccuggcgcgacgaggcg

SEQ ID NO: 3430282 - RNA, 15 nt, Pseudomonas aeruginosa PA01
cgccuggcggcuggc

SEQ ID NO: 3430283 - RNA, 12 nt, Pseudomonas aeruginosa PA01
cgccuggcguag

SEQ ID NO: 3430284 - RNA, 15 nt, Pseudomonas aeruginosa PA01
cgccuggcgucccgu

SEQ ID NO: 3430285 - RNA, 18 nt, Pseudomonas aeruginosa PA01
cgccuggcgucgaugccg

SEQ ID NO: 3430286 - RNA, 21 nt, Pseudomonas aeruginosa PA01
cgccuggcgucgaugccgaau

SEQ ID NO: 3430287 - RNA, 21 nt, Pseudomonas aeruginosa PA01
cgccuggcgugccgccaggcc

SEQ ID NO: 3430288 - RNA, 14 nt, Pseudomonas aeruginosa PA01
cgccuggcuggcca

SEQ ID NO: 3430289 - RNA, 16 nt, Pseudomonas aeruginosa PA01
cgccuggcuggccagc

SEQ ID NO: 3430290 - RNA, 18 nt, Pseudomonas aeruginosa PA01
cgccuggcuggccagcag

SEQ ID NO: 3430291 - RNA, 21 nt, Pseudomonas aeruginosa PA01
cgccuggcuggccagcaggcu

SEQ ID NO: 3430292 - RNA, 19 nt, Pseudomonas aeruginosa PA01
cgccugggacggaacgucg

SEQ ID NO: 3430293 - RNA, 22 nt, Pseudomonas aeruginosa PA01
cgccugggacggaacgucggcc

SEQ ID NO: 3430294 - RNA, 17 nt, Pseudomonas aeruginosa PA01
cgccugggccgccucgc

SEQ ID NO: 3430295 - RNA, 20 nt, Pseudomonas aeruginosa PA01
cgccugggccgcgagguccg

SEQ ID NO: 3430296 - RNA, 15 nt, Pseudomonas aeruginosa PA01
cgccugggccgcgcu

SEQ ID NO: 3430297 - RNA, 23 nt, Pseudomonas aeruginosa PA01
cgccugggccgcgcugucggccu

SEQ ID NO: 3430298 - RNA, 14 nt, Pseudomonas aeruginosa PA01
cgccugggccggcg

SEQ ID NO: 3430299 - RNA, 18 nt, Pseudomonas aeruginosa PA01
cgccugggcggucggcuc

SEQ ID NO: 3430300 - RNA, 14 nt, Pseudomonas aeruginosa PA01
cgccugggcguaga

SEQ ID NO: 3430301 - RNA, 14 nt, Pseudomonas aeruginosa PA01
cgccuggguggcga

SEQ ID NO: 3430302 - RNA, 15 nt, Pseudomonas aeruginosa PA01
cgccuggguggcgac

SEQ ID NO: 3430303 - RNA, 16 nt, Pseudomonas aeruginosa PA01
cgccuggguggcgacg

SEQ ID NO: 3430304 - RNA, 18 nt, Pseudomonas aeruginosa PA01
cgccuggguggcgacgaa

SEQ ID NO: 3430305 - RNA, 23 nt, Pseudomonas aeruginosa PA01
cgccuggguggcgacgaagacgc

SEQ ID NO: 3430306 - RNA, 16 nt, Pseudomonas aeruginosa PA01
cgccugguaggcggcg

SEQ ID NO: 3430307 - RNA, 17 nt, Pseudomonas aeruginosa PA01
cgccugguaggcggcga

SEQ ID NO: 3430308 - RNA, 19 nt, Pseudomonas aeruginosa PA01
cgccugguaggcggcgacg

SEQ ID NO: 3430309 - RNA, 18 nt, Pseudomonas aeruginosa PA01
cgccugguccagcagguu

SEQ ID NO: 3430310 - RNA, 15 nt, Pseudomonas aeruginosa PA01
cgccuggucgccggg

SEQ ID NO: 3430311 - RNA, 13 nt, Pseudomonas aeruginosa PA01
cgccuggucggcg

SEQ ID NO: 3430312 - RNA, 16 nt, Pseudomonas aeruginosa PA01
cgccuggucggcggcc

SEQ ID NO: 3430313 - RNA, 19 nt, Pseudomonas aeruginosa PA01
cgccuggucggggccggcg

SEQ ID NO: 3430314 - RNA, 20 nt, Pseudomonas aeruginosa PA01
cgccuggucggggccggcga

SEQ ID NO: 3430315 - RNA, 17 nt, Pseudomonas aeruginosa PA01
cgccuggugcaggucgc

SEQ ID NO: 3430316 - RNA, 21 nt, Pseudomonas aeruginosa PA01
cgccuggugcaggucgcgcgg

SEQ ID NO: 3430317 - RNA, 19 nt, Pseudomonas aeruginosa PA01
cgccuggugcccgaugccg

SEQ ID NO: 3430318 - RNA, 20 nt, Pseudomonas aeruginosa PA01
cgccuggugcccgaugccgc

SEQ ID NO: 3430319 - RNA, 22 nt, Pseudomonas aeruginosa PA01
cgccuggugcccgaugccgcgc

SEQ ID NO: 3430320 - RNA, 23 nt, Pseudomonas aeruginosa PA01
cgccuggugcccgaugccgcgcc

SEQ ID NO: 3430321 - RNA, 21 nt, Pseudomonas aeruginosa PA01
cgccugguucugcuccggacu

SEQ ID NO: 3430322 - RNA, 13 nt, Pseudomonas aeruginosa PA01
cgccuguccaccg

SEQ ID NO: 3430323 - RNA, 22 nt, Pseudomonas aeruginosa PA01
cgccuguccaccgguggcgacg

SEQ ID NO: 3430324 - RNA, 17 nt, Pseudomonas aeruginosa PA01
cgccugucgcuccggca

SEQ ID NO: 3430325 - RNA, 19 nt, Pseudomonas aeruginosa PA01
cgccugucgcuccggcagc

SEQ ID NO: 3430326 - RNA, 15 nt, Pseudomonas aeruginosa PA01
cgccugucggcacga

SEQ ID NO: 3430327 - RNA, 20 nt, Pseudomonas aeruginosa PA01
cgccuguggcguuauucgcc

SEQ ID NO: 3430328 - RNA, 17 nt, Pseudomonas aeruginosa PA01
cgccuguuccagggccu

SEQ ID NO: 3430329 - RNA, 16 nt, Pseudomonas aeruginosa PA01
cgccuucagccccagc

SEQ ID NO: 3430330 - RNA, 16 nt, Pseudomonas aeruginosa PA01
cgccuucagcgccagc

SEQ ID NO: 3430331 - RNA, 22 nt, Pseudomonas aeruginosa PA01
cgccuucagcgccagcaggcga

SEQ ID NO: 3430332 - RNA, 16 nt, Pseudomonas aeruginosa PA01
cgccuucagcgccgcc

SEQ ID NO: 3430333 - RNA, 17 nt, Pseudomonas aeruginosa PA01
cgccuucagcgccgcca

SEQ ID NO: 3430334 - RNA, 19 nt, Pseudomonas aeruginosa PA01
cgccuucagcgccgccagg

SEQ ID NO: 3430335 - RNA, 15 nt, Pseudomonas aeruginosa PA01
cgccuucagcgccuc

SEQ ID NO: 3430336 - RNA, 15 nt, Pseudomonas aeruginosa PA01
cgccuucaucgccac

SEQ ID NO: 3430337 - RNA, 16 nt, Pseudomonas aeruginosa PA01
cgccuuccagcccuuc

SEQ ID NO: 3430338 - RNA, 17 nt, Pseudomonas aeruginosa PA01
cgccuuccagcccuucg

SEQ ID NO: 3430339 - RNA, 20 nt, Pseudomonas aeruginosa PA01
cgccuuccagcccuucgacg

SEQ ID NO: 3430340 - RNA, 21 nt, Pseudomonas aeruginosa PA01
cgccuuccagcuugcgccaga

SEQ ID NO: 3430341 - RNA, 12 nt, Pseudomonas aeruginosa PA01
cgccuuccaggc

SEQ ID NO: 3430342 - RNA, 23 nt, Pseudomonas aeruginosa PA01
cgccuuccaggcgugccuguucc

SEQ ID NO: 3430343 - RNA, 12 nt, Pseudomonas aeruginosa PA01
cgccuucccaga

SEQ ID NO: 3430344 - RNA, 21 nt, Pseudomonas aeruginosa PA01
cgccuucccagacguccagcg

SEQ ID NO: 3430345 - RNA, 19 nt, Pseudomonas aeruginosa PA01
cgccuucccggucgacggc

SEQ ID NO: 3430346 - RNA, 22 nt, Pseudomonas aeruginosa PA01
cgccuuccggcagguucagcag

SEQ ID NO: 3430347 - RNA, 14 nt, Pseudomonas aeruginosa PA01
cgccuuccucggcc

SEQ ID NO: 3430348 - RNA, 16 nt, Pseudomonas aeruginosa PA01
cgccuuccucggccgc

SEQ ID NO: 3430349 - RNA, 20 nt, Pseudomonas aeruginosa PA01
cgccuuccucggccgccagg

SEQ ID NO: 3430350 - RNA, 15 nt, Pseudomonas aeruginosa PA01
cgccuuccucggcga

SEQ ID NO: 3430351 - RNA, 16 nt, Pseudomonas aeruginosa PA01
cgccuuccucggcgaa

SEQ ID NO: 3430352 - RNA, 16 nt, Pseudomonas aeruginosa PA01
cgccuuccuugaucca

SEQ ID NO: 3430353 - RNA, 22 nt, Pseudomonas aeruginosa PA01
cgccuucgacgcguugcuugug

SEQ ID NO: 3430354 - RNA, 13 nt, Pseudomonas aeruginosa PA01
cgccuucgccgga

SEQ ID NO: 3430355 - RNA, 14 nt, Pseudomonas aeruginosa PA01
cgccuucgcggccg

SEQ ID NO: 3430356 - RNA, 15 nt, Pseudomonas aeruginosa PA01
cgccuucgcggccga

SEQ ID NO: 3430357 - RNA, 13 nt, Pseudomonas aeruginosa PA01
cgccuucgcgggc

SEQ ID NO: 3430358 - RNA, 15 nt, Pseudomonas aeruginosa PA01
cgccuucgcgggcca

SEQ ID NO: 3430359 - RNA, 21 nt, Pseudomonas aeruginosa PA01
cgccuucgcgggccaggccga

SEQ ID NO: 3430360 - RNA, 15 nt, Pseudomonas aeruginosa PA01
cgccuucgcguucgc

SEQ ID NO: 3430361 - RNA, 21 nt, Pseudomonas aeruginosa PA01
cgccuucgcguucgcuccggg

SEQ ID NO: 3430362 - RNA, 23 nt, Pseudomonas aeruginosa PA01
cgccuucgcguucgcuccgggcc

SEQ ID NO: 3430363 - RNA, 23 nt, Pseudomonas aeruginosa PA01
cgccuucggagaacagcgagacc

SEQ ID NO: 3430364 - RNA, 15 nt, Pseudomonas aeruginosa PA01
cgccuucggcaggac

SEQ ID NO: 3430365 - RNA, 24 nt, Pseudomonas aeruginosa PA01
cgccuucggcaggaccucgggcga

SEQ ID NO: 3430366 - RNA, 14 nt, Pseudomonas aeruginosa PA01
cgccuucggcgaca

SEQ ID NO: 3430367 - RNA, 22 nt, Pseudomonas aeruginosa PA01
cgccuucggcgacacagacgca

SEQ ID NO: 3430368 - RNA, 12 nt, Pseudomonas aeruginosa PA01
cgccuucggcgu

SEQ ID NO: 3430369 - RNA, 18 nt, Pseudomonas aeruginosa PA01
cgccuucugcgugggcaa

SEQ ID NO: 3430370 - RNA, 21 nt, Pseudomonas aeruginosa PA01
cgccuucuuuucuuccgccuc

SEQ ID NO: 3430371 - RNA, 17 nt, Pseudomonas aeruginosa PA01
cgccuugaccagcggcc

SEQ ID NO: 3430372 - RNA, 20 nt, Pseudomonas aeruginosa PA01
cgccuugaccagcggcccgg

SEQ ID NO: 3430373 - RNA, 19 nt, Pseudomonas aeruginosa PA01
cgccuugaccucgacgccg

SEQ ID NO: 3430374 - RNA, 22 nt, Pseudomonas aeruginosa PA01
cgccuugaccucgacgccgagc

SEQ ID NO: 3430375 - RNA, 20 nt, Pseudomonas aeruginosa PA01
cgccuugaccugcugggcca

SEQ ID NO: 3430376 - RNA, 20 nt, Pseudomonas aeruginosa PA01
cgccuugagcggcgcccugg

SEQ ID NO: 3430377 - RNA, 13 nt, Pseudomonas aeruginosa PA01
cgccuugauggcg

SEQ ID NO: 3430378 - RNA, 14 nt, Pseudomonas aeruginosa PA01
cgccuugcagcacc

SEQ ID NO: 3430379 - RNA, 17 nt, Pseudomonas aeruginosa PA01
cgccuugcagcaccgcc

SEQ ID NO: 3430380 - RNA, 15 nt, Pseudomonas aeruginosa PA01
cgccuugcccggcgc

SEQ ID NO: 3430381 - RNA, 15 nt, Pseudomonas aeruginosa PA01
cgccuugcccuggcc

SEQ ID NO: 3430382 - RNA, 18 nt, Pseudomonas aeruginosa PA01
cgccuugcccuggccggc

SEQ ID NO: 3430383 - RNA, 15 nt, Pseudomonas aeruginosa PA01
cgccuugcgccaggc

SEQ ID NO: 3430384 - RNA, 16 nt, Pseudomonas aeruginosa PA01
cgccuugcgccaggcc

SEQ ID NO: 3430385 - RNA, 16 nt, Pseudomonas aeruginosa PA01
cgccuugcgcgugcug

SEQ ID NO: 3430386 - RNA, 17 nt, Pseudomonas aeruginosa PA01
cgccuugcggcgccgag

SEQ ID NO: 3430387 - RNA, 18 nt, Pseudomonas aeruginosa PA01
cgccuugcggcgccgagg

SEQ ID NO: 3430388 - RNA, 20 nt, Pseudomonas aeruginosa PA01
cgccuugcggcgccgaggcc

SEQ ID NO: 3430389 - RNA, 23 nt, Pseudomonas aeruginosa PA01
cgccuugcggcgccgaggcccua

SEQ ID NO: 3430390 - RNA, 19 nt, Pseudomonas aeruginosa PA01
cgccuugcggggcggcgca

SEQ ID NO: 3430391 - RNA, 24 nt, Pseudomonas aeruginosa PA01
cgccuugcgguccagcgagcgggc

SEQ ID NO: 3430392 - RNA, 13 nt, Pseudomonas aeruginosa PA01
cgccuugcguacc

SEQ ID NO: 3430393 - RNA, 20 nt, Pseudomonas aeruginosa PA01
cgccuugcguaccagcgcgc

SEQ ID NO: 3430394 - RNA, 22 nt, Pseudomonas aeruginosa PA01
cgccuugcguaccagcgcgcag

SEQ ID NO: 3430395 - RNA, 20 nt, Pseudomonas aeruginosa PA01
cgccuugcucaggucgucga

SEQ ID NO: 3430396 - RNA, 16 nt, Pseudomonas aeruginosa PA01
cgccuugcucgacccg

SEQ ID NO: 3430397 - RNA, 23 nt, Pseudomonas aeruginosa PA01
cgccuugcugcggguugaugucg

SEQ ID NO: 3430398 - RNA, 23 nt, Pseudomonas aeruginosa PA01
cgccuuggauaccagggugguga

SEQ ID NO: 3430399 - RNA, 22 nt, Pseudomonas aeruginosa PA01
cgccuuggcaucgugcuucuca

SEQ ID NO: 3430400 - RNA, 20 nt, Pseudomonas aeruginosa PA01
cgccuugguguagccgagca

SEQ ID NO: 3430401 - RNA, 15 nt, Pseudomonas aeruginosa PA01
cgccuuguccugcaa

SEQ ID NO: 3430402 - RNA, 15 nt, Pseudomonas aeruginosa PA01
cgccuuguuccaggc

SEQ ID NO: 3430403 - RNA, 17 nt, Pseudomonas aeruginosa PA01
cgccuuguucgccagca

SEQ ID NO: 3430404 - RNA, 20 nt, Pseudomonas aeruginosa PA01
cgccuuuuucauggccuggc

SEQ ID NO: 3430405 - RNA, 21 nt, Pseudomonas aeruginosa PA01
cgccuuuuucauggccuggcg

SEQ ID NO: 3430406 - RNA, 24 nt, Pseudomonas aeruginosa PA01
cgccuuuuuucauuucguugcgcu

SEQ ID NO: 3430407 - RNA, 19 nt, Pseudomonas aeruginosa PA01
cgccuuuuuugugcccggc

SEQ ID NO: 3430408 - RNA, 20 nt, Pseudomonas aeruginosa PA01
cgccuuuuuugugcccggcg

SEQ ID NO: 3430409 - RNA, 16 nt, Pseudomonas aeruginosa PA01
cgcgaaaacucccggc

SEQ ID NO: 3430410 - RNA, 15 nt, Pseudomonas aeruginosa PA01
cgcgaaagcgccccg

SEQ ID NO: 3430411 - RNA, 22 nt, Pseudomonas aeruginosa PA01
cgcgaaauggcagaacaucgcc

SEQ ID NO: 3430412 - RNA, 22 nt, Pseudomonas aeruginosa PA01
cgcgaacaguuccgacugcgag

SEQ ID NO: 3430413 - RNA, 21 nt, Pseudomonas aeruginosa PA01
cgcgaaccacauccuugccgu

SEQ ID NO: 3430414 - RNA, 14 nt, Pseudomonas aeruginosa PA01
cgcgaaccagcagc

SEQ ID NO: 3430415 - RNA, 17 nt, Pseudomonas aeruginosa PA01
cgcgaaccagcagcagg

SEQ ID NO: 3430416 - RNA, 18 nt, Pseudomonas aeruginosa PA01
cgcgaaccgcuggugacg

SEQ ID NO: 3430417 - RNA, 22 nt, Pseudomonas aeruginosa PA01
cgcgaaccgcuggugacgguga

SEQ ID NO: 3430418 - RNA, 20 nt, Pseudomonas aeruginosa PA01
cgcgaaccgggucgucagca

SEQ ID NO: 3430419 - RNA, 19 nt, Pseudomonas aeruginosa PA01
cgcgaacgcucccagccga

SEQ ID NO: 3430420 - RNA, 22 nt, Pseudomonas aeruginosa PA01
cgcgaacgcucccagccgacgu

SEQ ID NO: 3430421 - RNA, 15 nt, Pseudomonas aeruginosa PA01
cgcgaacgguccugc

SEQ ID NO: 3430422 - RNA, 19 nt, Pseudomonas aeruginosa PA01
cgcgaacgguccugcggau

SEQ ID NO: 3430423 - RNA, 20 nt, Pseudomonas aeruginosa PA01
cgcgaacgguccugcggauc

SEQ ID NO: 3430424 - RNA, 17 nt, Pseudomonas aeruginosa PA01
cgcgaacucggcgccga

SEQ ID NO: 3430425 - RNA, 19 nt, Pseudomonas aeruginosa PA01
cgcgaagaacacgccccag

SEQ ID NO: 3430426 - RNA, 17 nt, Pseudomonas aeruginosa PA01
cgcgaagaccggccggc

SEQ ID NO: 3430427 - RNA, 23 nt, Pseudomonas aeruginosa PA01
cgcgaagcacgcucuucuuacag

SEQ ID NO: 3430428 - RNA, 23 nt, Pseudomonas aeruginosa PA01
cgcgaagccaggaagcggcggua

SEQ ID NO: 3430429 - RNA, 14 nt, Pseudomonas aeruginosa PA01
cgcgaagcccagcg

SEQ ID NO: 3430430 - RNA, 16 nt, Pseudomonas aeruginosa PA01
cgcgaagcccagcgcc

SEQ ID NO: 3430431 - RNA, 15 nt, Pseudomonas aeruginosa PA01
cgcgaagcgacggcg

SEQ ID NO: 3430432 - RNA, 16 nt, Pseudomonas aeruginosa PA01
cgcgaagcgacggcgc

SEQ ID NO: 3430433 - RNA, 15 nt, Pseudomonas aeruginosa PA01
cgcgaagcgcagcac

SEQ ID NO: 3430434 - RNA, 16 nt, Pseudomonas aeruginosa PA01
cgcgaagcgcagcacg

SEQ ID NO: 3430435 - RNA, 21 nt, Pseudomonas aeruginosa PA01
cgcgaagcgguuagccggcga

SEQ ID NO: 3430436 - RNA, 18 nt, Pseudomonas aeruginosa PA01
cgcgaaggccacgccgac

SEQ ID NO: 3430437 - RNA, 19 nt, Pseudomonas aeruginosa PA01
cgcgaaggccacgccgacg

SEQ ID NO: 3430438 - RNA, 15 nt, Pseudomonas aeruginosa PA01
cgcgaaggcgccuuc

SEQ ID NO: 3430439 - RNA, 20 nt, Pseudomonas aeruginosa PA01
cgcgaaggcgccuuccaggc

SEQ ID NO: 3430440 - RNA, 18 nt, Pseudomonas aeruginosa PA01
cgcgaauaccgcgcgcgc

SEQ ID NO: 3430441 - RNA, 19 nt, Pseudomonas aeruginosa PA01
cgcgaauaccgcgcgcgca

SEQ ID NO: 3430442 - RNA, 15 nt, Pseudomonas aeruginosa PA01
cgcgaauagggcggc

SEQ ID NO: 3430443 - RNA, 19 nt, Pseudomonas aeruginosa PA01
cgcgaauagggcggcgcca

SEQ ID NO: 3430444 - RNA, 16 nt, Pseudomonas aeruginosa PA01
cgcgaauccgcggccc

SEQ ID NO: 3430445 - RNA, 17 nt, Pseudomonas aeruginosa PA01
cgcgaauccgcggcccu

SEQ ID NO: 3430446 - RNA, 19 nt, Pseudomonas aeruginosa PA01
cgcgaauccgcggcccugc

SEQ ID NO: 3430447 - RNA, 18 nt, Pseudomonas aeruginosa PA01
cgcgaaucuucggcgcgc

SEQ ID NO: 3430448 - RNA, 21 nt, Pseudomonas aeruginosa PA01
cgcgaaucuucggcgcgccgg

SEQ ID NO: 3430449 - RNA, 13 nt, Pseudomonas aeruginosa PA01
cgcgaaugcccgg

SEQ ID NO: 3430450 - RNA, 20 nt, Pseudomonas aeruginosa PA01
cgcgaaugcccggcagcgcc

SEQ ID NO: 3430451 - RNA, 19 nt, Pseudomonas aeruginosa PA01
cgcgaauggcagcaggcac

SEQ ID NO: 3430452 - RNA, 15 nt, Pseudomonas aeruginosa PA01
cgcgaauggcauuca

SEQ ID NO: 3430453 - RNA, 22 nt, Pseudomonas aeruginosa PA01
cgcgacaacccuguccccucac

SEQ ID NO: 3430454 - RNA, 19 nt, Pseudomonas aeruginosa PA01
cgcgacacauggucggcca

SEQ ID NO: 3430455 - RNA, 20 nt, Pseudomonas aeruginosa PA01
cgcgacacauggucggccag

SEQ ID NO: 3430456 - RNA, 15 nt, Pseudomonas aeruginosa PA01
cgcgacagauagcag

SEQ ID NO: 3430457 - RNA, 17 nt, Pseudomonas aeruginosa PA01
cgcgacagauagcaggu

SEQ ID NO: 3430458 - RNA, 23 nt, Pseudomonas aeruginosa PA01
cgcgacagcucguggcuggcgcc

SEQ ID NO: 3430459 - RNA, 21 nt, Pseudomonas aeruginosa PA01
cgcgacagguucaggacgcuc

SEQ ID NO: 3430460 - RNA, 19 nt, Pseudomonas aeruginosa PA01
cgcgacaguucgccgcccg

SEQ ID NO: 3430461 - RNA, 19 nt, Pseudomonas aeruginosa PA01
cgcgacaucggcgauggcc

SEQ ID NO: 3430462 - RNA, 14 nt, Pseudomonas aeruginosa PA01
cgcgaccacaggcg

SEQ ID NO: 3430463 - RNA, 14 nt, Pseudomonas aeruginosa PA01
cgcgaccagcgcca

SEQ ID NO: 3430464 - RNA, 17 nt, Pseudomonas aeruginosa PA01
cgcgaccagcgccaggc

SEQ ID NO: 3430465 - RNA, 19 nt, Pseudomonas aeruginosa PA01
cgcgaccagcgccaggcgc

SEQ ID NO: 3430466 - RNA, 13 nt, Pseudomonas aeruginosa PA01
cgcgacccaucgc

SEQ ID NO: 3430467 - RNA, 15 nt, Pseudomonas aeruginosa PA01
cgcgacccaucgccg

SEQ ID NO: 3430468 - RNA, 19 nt, Pseudomonas aeruginosa PA01
cgcgacccaucgccgaaga

SEQ ID NO: 3430469 - RNA, 17 nt, Pseudomonas aeruginosa PA01
cgcgacccucagucgcc

SEQ ID NO: 3430470 - RNA, 15 nt, Pseudomonas aeruginosa PA01
cgcgacccuggccgc

SEQ ID NO: 3430471 - RNA, 18 nt, Pseudomonas aeruginosa PA01
cgcgaccgaagccgcgca

SEQ ID NO: 3430472 - RNA, 20 nt, Pseudomonas aeruginosa PA01
cgcgaccgaagccgcgcagc

SEQ ID NO: 3430473 - RNA, 20 nt, Pseudomonas aeruginosa PA01
cgcgaccgagaugcucgcgc

SEQ ID NO: 3430474 - RNA, 16 nt, Pseudomonas aeruginosa PA01
cgcgaccgcccgccuc

SEQ ID NO: 3430475 - RNA, 20 nt, Pseudomonas aeruginosa PA01
cgcgaccgcccgccucaggc

SEQ ID NO: 3430476 - RNA, 23 nt, Pseudomonas aeruginosa PA01
cgcgaccgcccgccucaggccgg

SEQ ID NO: 3430477 - RNA, 13 nt, Pseudomonas aeruginosa PA01
cgcgaccggucag

SEQ ID NO: 3430478 - RNA, 13 nt, Pseudomonas aeruginosa PA01
cgcgaccgucggc

SEQ ID NO: 3430479 - RNA, 17 nt, Pseudomonas aeruginosa PA01
cgcgaccgucggccggg

SEQ ID NO: 3430480 - RNA, 15 nt, Pseudomonas aeruginosa PA01
cgcgaccuccggcgc

SEQ ID NO: 3430481 - RNA, 16 nt, Pseudomonas aeruginosa PA01
cgcgaccuccggcgcc

SEQ ID NO: 3430482 - RNA, 19 nt, Pseudomonas aeruginosa PA01
cgcgaccuccggcgccagg

SEQ ID NO: 3430483 - RNA, 21 nt, Pseudomonas aeruginosa PA01
cgcgaccuccggcgccaggcc

SEQ ID NO: 3430484 - RNA, 22 nt, Pseudomonas aeruginosa PA01
cgcgaccuccggcgccaggccc

SEQ ID NO: 3430485 - RNA, 21 nt, Pseudomonas aeruginosa PA01
cgcgaccucguugcaggcacg

SEQ ID NO: 3430486 - RNA, 23 nt, Pseudomonas aeruginosa PA01
cgcgaccugcucgucgaugcugc

SEQ ID NO: 3430487 - RNA, 17 nt, Pseudomonas aeruginosa PA01
cgcgacgaggcgcggcg

SEQ ID NO: 3430488 - RNA, 18 nt, Pseudomonas aeruginosa PA01
cgcgacgaggcgcggcgg

SEQ ID NO: 3430489 - RNA, 22 nt, Pseudomonas aeruginosa PA01
cgcgacgaggcgcggcggaggc

SEQ ID NO: 3430490 - RNA, 12 nt, Pseudomonas aeruginosa PA01
cgcgacgcgacc

SEQ ID NO: 3430491 - RNA, 17 nt, Pseudomonas aeruginosa PA01
cgcgacgcgaccuccgg

SEQ ID NO: 3430492 - RNA, 20 nt, Pseudomonas aeruginosa PA01
cgcgacgcuacguuccaggg

SEQ ID NO: 3430493 - RNA, 14 nt, Pseudomonas aeruginosa PA01
cgcgacgcuccagc

SEQ ID NO: 3430494 - RNA, 15 nt, Pseudomonas aeruginosa PA01
cgcgacgcuccagcg

SEQ ID NO: 3430495 - RNA, 17 nt, Pseudomonas aeruginosa PA01
cgcgacgcuccagcggc

SEQ ID NO: 3430496 - RNA, 18 nt, Pseudomonas aeruginosa PA01
cgcgacgcuccagcggca

SEQ ID NO: 3430497 - RNA, 19 nt, Pseudomonas aeruginosa PA01
cgcgacgcuccagcggcag

SEQ ID NO: 3430498 - RNA, 20 nt, Pseudomonas aeruginosa PA01
cgcgacgcuccagcggcagc

SEQ ID NO: 3430499 - RNA, 22 nt, Pseudomonas aeruginosa PA01
cgcgacgcuccagcggcagcuc

SEQ ID NO: 3430500 - RNA, 15 nt, Pseudomonas aeruginosa PA01
cgcgacgcuccaggu

SEQ ID NO: 3430501 - RNA, 16 nt, Pseudomonas aeruginosa PA01
cgcgacgcuccaggug

SEQ ID NO: 3430502 - RNA, 20 nt, Pseudomonas aeruginosa PA01
cgcgacggaacaagccgccu

SEQ ID NO: 3430503 - RNA, 16 nt, Pseudomonas aeruginosa PA01
cgcgacggaccgcgac

SEQ ID NO: 3430504 - RNA, 18 nt, Pseudomonas aeruginosa PA01
cgcgacggaccgcgacaa

SEQ ID NO: 3430505 - RNA, 22 nt, Pseudomonas aeruginosa PA01
cgcgacggcauuccugguccag

SEQ ID NO: 3430506 - RNA, 14 nt, Pseudomonas aeruginosa PA01
cgcgacggcccacg

SEQ ID NO: 3430507 - RNA, 14 nt, Pseudomonas aeruginosa PA01
cgcgacggcugcuc

SEQ ID NO: 3430508 - RNA, 19 nt, Pseudomonas aeruginosa PA01
cgcgacgggugcguccauc

SEQ ID NO: 3430509 - RNA, 20 nt, Pseudomonas aeruginosa PA01
cgcgacucgagcaccaccac

SEQ ID NO: 3430510 - RNA, 13 nt, Pseudomonas aeruginosa PA01
cgcgacucguagg

SEQ ID NO: 3430511 - RNA, 16 nt, Pseudomonas aeruginosa PA01
cgcgacugaccacgca

SEQ ID NO: 3430512 - RNA, 17 nt, Pseudomonas aeruginosa PA01
cuuuuccgaauacugca

SEQ ID NO: 3430513 - RNA, 13 nt, Pseudomonas aeruginosa PA01
cuuuuccggcgcc

SEQ ID NO: 3430514 - RNA, 14 nt, Pseudomonas aeruginosa PA01
cuuuuccucgaccc

SEQ ID NO: 3430515 - RNA, 20 nt, Pseudomonas aeruginosa PA01
cuuuuccucgaucaggccuu

SEQ ID NO: 3430516 - RNA, 22 nt, Pseudomonas aeruginosa PA01
cuuuuccugcuggcgaauuucc

SEQ ID NO: 3430517 - RNA, 16 nt, Pseudomonas aeruginosa PA01
cuuuucgaacaauccc

SEQ ID NO: 3430518 - RNA, 20 nt, Pseudomonas aeruginosa PA01
cuuuucgaacaaucccagcu

SEQ ID NO: 3430519 - RNA, 15 nt, Pseudomonas aeruginosa PA01
cuuuucgcuuugcgc

SEQ ID NO: 3430520 - RNA, 19 nt, Pseudomonas aeruginosa PA01
cuuuucuauuucccgugcg

SEQ ID NO: 3430521 - RNA, 13 nt, Pseudomonas aeruginosa PA01
cuuuucucugcau

SEQ ID NO: 3430522 - RNA, 17 nt, Pseudomonas aeruginosa PA01
cuuuucugccacccggc

SEQ ID NO: 3430523 - RNA, 22 nt, Pseudomonas aeruginosa PA01
cuuuucugccacccggcgcccg

SEQ ID NO: 3430524 - RNA, 15 nt, Pseudomonas aeruginosa PA01
cuuuugcaaucggcg

SEQ ID NO: 3430525 - RNA, 16 nt, Pseudomonas aeruginosa PA01
cuuuugcaaucggcga

SEQ ID NO: 3430526 - RNA, 20 nt, Pseudomonas aeruginosa PA01
cuuuugcaaucggcgagccg

SEQ ID NO: 3430527 - RNA, 21 nt, Pseudomonas aeruginosa PA01
cuuuugcaaucggcgagccgc

SEQ ID NO: 3430528 - RNA, 22 nt, Pseudomonas aeruginosa PA01
cuuuuucacuacaggaccuuca

SEQ ID NO: 3430529 - RNA, 16 nt, Pseudomonas aeruginosa PA01
cuuuuuuaugcgcagc

SEQ ID NO: 3430530 - RNA, 13 nt, Pseudomonas aeruginosa PA01
gaaaaaaaagccc

SEQ ID NO: 3430531 - RNA, 14 nt, Pseudomonas aeruginosa PA01
gaaaaaaaggcgcu

SEQ ID NO: 3430532 - RNA, 16 nt, Pseudomonas aeruginosa PA01
gaaaaaacgccgguca

SEQ ID NO: 3430533 - RNA, 16 nt, Pseudomonas aeruginosa PA01
gaaaaaaggggaugcc

SEQ ID NO: 3430534 - RNA, 15 nt, Pseudomonas aeruginosa PA01
gaaaaacccaugcgg

SEQ ID NO: 3430535 - RNA, 15 nt, Pseudomonas aeruginosa PA01
gaaaaacgccggcga

SEQ ID NO: 3430536 - RNA, 12 nt, Pseudomonas aeruginosa PA01
gaaaaagccccu

SEQ ID NO: 3430537 - RNA, 14 nt, Pseudomonas aeruginosa PA01
gaaaaagcccggca

SEQ ID NO: 3430538 - RNA, 15 nt, Pseudomonas aeruginosa PA01
gaaaaagccggaagc

SEQ ID NO: 3430539 - RNA, 15 nt, Pseudomonas aeruginosa PA01
gaaaaaggccggugc

SEQ ID NO: 3430540 - RNA, 14 nt, Pseudomonas aeruginosa PA01
gaaaaaggcgccuu

SEQ ID NO: 3430541 - RNA, 22 nt, Pseudomonas aeruginosa PA01
gaaaaaggcgccuucgggcgcc

SEQ ID NO: 3430542 - RNA, 14 nt, Pseudomonas aeruginosa PA01
gaaaaagggaugcc

SEQ ID NO: 3430543 - RNA, 21 nt, Pseudomonas aeruginosa PA01
gaaaaagggaugccgccggca

SEQ ID NO: 3430544 - RNA, 21 nt, Pseudomonas aeruginosa PA01
gaaaaagggaugccggcggca

SEQ ID NO: 3430545 - RNA, 21 nt, Pseudomonas aeruginosa PA01
gaaaaauggccgcuugaagcg

SEQ ID NO: 3430546 - RNA, 17 nt, Pseudomonas aeruginosa PA01
gaaaacaagaagccccg

SEQ ID NO: 3430547 - RNA, 18 nt, Pseudomonas aeruginosa PA01
gaaaacccugggaauggc

SEQ ID NO: 3430548 - RNA, 20 nt, Pseudomonas aeruginosa PA01
gaaaacccugggaauggcgg

SEQ ID NO: 3430549 - RNA, 12 nt, Pseudomonas aeruginosa PA01
gaaaacgcccgg

SEQ ID NO: 3430550 - RNA, 21 nt, Pseudomonas aeruginosa PA01
gaaaacgcccggcaucugccg

SEQ ID NO: 3430551 - RNA, 22 nt, Pseudomonas aeruginosa PA01
gaaaacgccgcgaagcccagcg

SEQ ID NO: 3430552 - RNA, 20 nt, Pseudomonas aeruginosa PA01
gaaaacgcucaggccaagca

SEQ ID NO: 3430553 - RNA, 18 nt, Pseudomonas aeruginosa PA01
gaaaacggcgacccuggg

SEQ ID NO: 3430554 - RNA, 23 nt, Pseudomonas aeruginosa PA01
gaaaagaagccccgcagccgcgg

SEQ ID NO: 3430555 - RNA, 17 nt, Pseudomonas aeruginosa PA01
gaaaagaaggcggaugg

SEQ ID NO: 3430556 - RNA, 21 nt, Pseudomonas aeruginosa PA01
gaaaagcccagguggcaggcc

SEQ ID NO: 3430557 - RNA, 19 nt, Pseudomonas aeruginosa PA01
gaaaagcgguuucgccacc

SEQ ID NO: 3430558 - RNA, 16 nt, Pseudomonas aeruginosa PA01
gaaaauaacgcuugac

SEQ ID NO: 3430559 - RNA, 14 nt, Pseudomonas aeruginosa PA01
gaaaaucggcagua

SEQ ID NO: 3430560 - RNA, 21 nt, Pseudomonas aeruginosa PA01
gaaaauggaacagucgcgcgg

SEQ ID NO: 3430561 - RNA, 15 nt, Pseudomonas aeruginosa PA01
gaaacaccaggccga

SEQ ID NO: 3430562 - RNA, 15 nt, Pseudomonas aeruginosa PA01
gaaacagggcgacca

SEQ ID NO: 3430563 - RNA, 21 nt, Pseudomonas aeruginosa PA01
gaaacagggcgacgccgaugc

SEQ ID NO: 3430564 - RNA, 13 nt, Pseudomonas aeruginosa PA01
gaaaccaccugga

SEQ ID NO: 3430565 - RNA, 21 nt, Pseudomonas aeruginosa PA01
gaaaccaccuggaacuugcug

SEQ ID NO: 3430566 - RNA, 17 nt, Pseudomonas aeruginosa PA01
gaaaccccggccuggcg

SEQ ID NO: 3430567 - RNA, 18 nt, Pseudomonas aeruginosa PA01
gaaaccccggccuggcgc

SEQ ID NO: 3430568 - RNA, 20 nt, Pseudomonas aeruginosa PA01
gaaaccccggccuggcgccg

SEQ ID NO: 3430569 - RNA, 21 nt, Pseudomonas aeruginosa PA01
gaaacccgugguccgccagca

SEQ ID NO: 3430570 - RNA, 22 nt, Pseudomonas aeruginosa PA01
gaaacccgugguccgccagcag

SEQ ID NO: 3430571 - RNA, 18 nt, Pseudomonas aeruginosa PA01
gaaacccucaggucggcg

SEQ ID NO: 3430572 - RNA, 14 nt, Pseudomonas aeruginosa PA01
gaaacccuuccagc

SEQ ID NO: 3430573 - RNA, 20 nt, Pseudomonas aeruginosa PA01
gaaacccuuccagccgcccu

SEQ ID NO: 3430574 - RNA, 20 nt, Pseudomonas aeruginosa PA01
gaaaccgaaguagucgcccc

SEQ ID NO: 3430575 - RNA, 21 nt, Pseudomonas aeruginosa PA01
gaaaccgaaguagucgccccg

SEQ ID NO: 3430576 - RNA, 16 nt, Pseudomonas aeruginosa PA01
gaaaccgaucagcacc

SEQ ID NO: 3430577 - RNA, 22 nt, Pseudomonas aeruginosa PA01
gaaaccgccaucgauggucagg

SEQ ID NO: 3430578 - RNA, 14 nt, Pseudomonas aeruginosa PA01
gaaaccggccagcg

SEQ ID NO: 3430579 - RNA, 18 nt, Pseudomonas aeruginosa PA01
gaaaccggccagcgcggc

SEQ ID NO: 3430580 - RNA, 14 nt, Pseudomonas aeruginosa PA01
gaaaccggccucga

SEQ ID NO: 3430581 - RNA, 17 nt, Pseudomonas aeruginosa PA01
gaaaccggcgaaccagu

SEQ ID NO: 3430582 - RNA, 22 nt, Pseudomonas aeruginosa PA01
gaaaccggcgaugcucagcgcc

SEQ ID NO: 3430583 - RNA, 14 nt, Pseudomonas aeruginosa PA01
gaaaccguggucgc

SEQ ID NO: 3430584 - RNA, 17 nt, Pseudomonas aeruginosa PA01
gaaaccguggucgccgc

SEQ ID NO: 3430585 - RNA, 18 nt, Pseudomonas aeruginosa PA01
gaaaccguggucgccgcu

SEQ ID NO: 3430586 - RNA, 20 nt, Pseudomonas aeruginosa PA01
gaaaccugcaacucggcgcc

SEQ ID NO: 3430587 - RNA, 20 nt, Pseudomonas aeruginosa PA01
gaaaccugugcugcgcgccg

SEQ ID NO: 3430588 - RNA, 22 nt, Pseudomonas aeruginosa PA01
gaaaccugugcugcgcgccgca

SEQ ID NO: 3430589 - RNA, 20 nt, Pseudomonas aeruginosa PA01
gaaaccuucgguggcgacca

SEQ ID NO: 3430590 - RNA, 23 nt, Pseudomonas aeruginosa PA01
gaaaccuucgguggcgaccagga

SEQ ID NO: 3430591 - RNA, 19 nt, Pseudomonas aeruginosa PA01
gaaacgaaaaagcccggcg

SEQ ID NO: 3430592 - RNA, 14 nt, Pseudomonas aeruginosa PA01
gaaacgacaggcug

SEQ ID NO: 3430593 - RNA, 19 nt, Pseudomonas aeruginosa PA01
gaaacgacaggcuggaggc

SEQ ID NO: 3430594 - RNA, 19 nt, Pseudomonas aeruginosa PA01
gaaacgcagggccggaugc

SEQ ID NO: 3430595 - RNA, 23 nt, Pseudomonas aeruginosa PA01
gaaacgcauguucaugcgcuggu

SEQ ID NO: 3430596 - RNA, 19 nt, Pseudomonas aeruginosa PA01
gaaacgcgccuccggcagc

SEQ ID NO: 3430597 - RNA, 22 nt, Pseudomonas aeruginosa PA01
gaaacgcgcgcucucgccggcc

SEQ ID NO: 3430598 - RNA, 15 nt, Pseudomonas aeruginosa PA01
gaaacgcuggcggcc

SEQ ID NO: 3430599 - RNA, 11 nt, Pseudomonas aeruginosa PA01
cuacgccaccu

SEQ ID NO: 3430600 - RNA, 18 nt, Pseudomonas aeruginosa PA01
cuacgccuugcggcgccg

SEQ ID NO: 3430601 - RNA, 20 nt, Pseudomonas aeruginosa PA01
cuacgccuugcggcgccgag

SEQ ID NO: 3430602 - RNA, 16 nt, Pseudomonas aeruginosa PA01
cuacgcuccguagggc

SEQ ID NO: 3430603 - RNA, 15 nt, Pseudomonas aeruginosa PA01
cuacgcucgccgacg

SEQ ID NO: 3430604 - RNA, 15 nt, Pseudomonas aeruginosa PA01
cuacgcucggggugc

SEQ ID NO: 3430605 - RNA, 22 nt, Pseudomonas aeruginosa PA01
cuacgcucggggugcgcggcga

SEQ ID NO: 3430606 - RNA, 16 nt, Pseudomonas aeruginosa PA01
cuacggaaggucgccg

SEQ ID NO: 3430607 - RNA, 19 nt, Pseudomonas aeruginosa PA01
cuacggaggaaacccaugc

SEQ ID NO: 3430608 - RNA, 21 nt, Pseudomonas aeruginosa PA01
cuacggaggaaacccaugccc

SEQ ID NO: 3430609 - RNA, 23 nt, Pseudomonas aeruginosa PA01
cuacggcaucaccggcgggaugu

SEQ ID NO: 3430610 - RNA, 20 nt, Pseudomonas aeruginosa PA01
cuacgggggcgugucgaggg

SEQ ID NO: 3430611 - RNA, 20 nt, Pseudomonas aeruginosa PA01
cuacgguacaguucaggcug

SEQ ID NO: 3430612 - RNA, 21 nt, Pseudomonas aeruginosa PA01
cuacgguacaguucaggcugg

SEQ ID NO: 3430613 - RNA, 22 nt, Pseudomonas aeruginosa PA01
cuacgguacaguucaggcuggg

SEQ ID NO: 3430614 - RNA, 14 nt, Pseudomonas aeruginosa PA01
cuacguuccagggc

SEQ ID NO: 3430615 - RNA, 17 nt, Pseudomonas aeruginosa PA01
cuacuaccgccagcgca

SEQ ID NO: 3430616 - RNA, 14 nt, Pseudomonas aeruginosa PA01
cuacucgcccgacc

SEQ ID NO: 3430617 - RNA, 16 nt, Pseudomonas aeruginosa PA01
cuacugcuggacggcg

SEQ ID NO: 3430618 - RNA, 23 nt, Pseudomonas aeruginosa PA01
cuacugggcguggcggccgccgg

SEQ ID NO: 3430619 - RNA, 14 nt, Pseudomonas aeruginosa PA01
cuacuucucgacga

SEQ ID NO: 3430620 - RNA, 17 nt, Pseudomonas aeruginosa PA01
cuacuugaucagccgca

SEQ ID NO: 3430621 - RNA, 18 nt, Pseudomonas aeruginosa PA01
cuacuugaucagccgcag

SEQ ID NO: 3430622 - RNA, 16 nt, Pseudomonas aeruginosa PA01
cuagaccaacugcgcc

SEQ ID NO: 3430623 - RNA, 14 nt, Pseudomonas aeruginosa PA01
cuagacccugggcc

SEQ ID NO: 3430624 - RNA, 19 nt, Pseudomonas aeruginosa PA01
cuagcccugcugcucgcca

SEQ ID NO: 3430625 - RNA, 20 nt, Pseudomonas aeruginosa PA01
cuagcgaaggcuccgcugcu

SEQ ID NO: 3430626 - RNA, 13 nt, Pseudomonas aeruginosa PA01
cuagcgcaggcgg

SEQ ID NO: 3430627 - RNA, 15 nt, Pseudomonas aeruginosa PA01
cuagcgcauggcgac

SEQ ID NO: 3430628 - RNA, 21 nt, Pseudomonas aeruginosa PA01
cuagcgcauggcgaccuggug

SEQ ID NO: 3430629 - RNA, 14 nt, Pseudomonas aeruginosa PA01
cuagcgccccggcc

SEQ ID NO: 3430630 - RNA, 15 nt, Pseudomonas aeruginosa PA01
cuagcgccccggccg

SEQ ID NO: 3430631 - RNA, 16 nt, Pseudomonas aeruginosa PA01
cuagcgccccggccgc

SEQ ID NO: 3430632 - RNA, 22 nt, Pseudomonas aeruginosa PA01
cuagcgccccggccgcgccagc

SEQ ID NO: 3430633 - RNA, 21 nt, Pseudomonas aeruginosa PA01
cuagcggguggcaacugccgc

SEQ ID NO: 3430634 - RNA, 22 nt, Pseudomonas aeruginosa PA01
cuaggaauaucuugcgcauggu

SEQ ID NO: 3430635 - RNA, 13 nt, Pseudomonas aeruginosa PA01
cuaggcgacccgg

SEQ ID NO: 3430636 - RNA, 16 nt, Pseudomonas aeruginosa PA01
cuaggcgacccggcau

SEQ ID NO: 3430637 - RNA, 22 nt, Pseudomonas aeruginosa PA01
cuaggcuggaagccgcgcucgc

SEQ ID NO: 3430638 - RNA, 21 nt, Pseudomonas aeruginosa PA01
cuagggcgcccucgccaauca

SEQ ID NO: 3430639 - RNA, 13 nt, Pseudomonas aeruginosa PA01
cuagggucggcgu

SEQ ID NO: 3430640 - RNA, 13 nt, Pseudomonas aeruginosa PA01
cuagucgagggga

SEQ ID NO: 3430641 - RNA, 20 nt, Pseudomonas aeruginosa PA01
cuaucacacuguccagggcg

SEQ ID NO: 3430642 - RNA, 17 nt, Pseudomonas aeruginosa PA01
cuaucaggcauccccgg

SEQ ID NO: 3430643 - RNA, 20 nt, Pseudomonas aeruginosa PA01
cuaucaggcauccccggacc

SEQ ID NO: 3430644 - RNA, 13 nt, Pseudomonas aeruginosa PA01
cuaucaggugagg

SEQ ID NO: 3430645 - RNA, 20 nt, Pseudomonas aeruginosa PA01
cuauccacgacgucggcggc

SEQ ID NO: 3430646 - RNA, 19 nt, Pseudomonas aeruginosa PA01
cuaucccgugccgggccag

SEQ ID NO: 3430647 - RNA, 13 nt, Pseudomonas aeruginosa PA01
cuauccgccgcua

SEQ ID NO: 3430648 - RNA, 21 nt, Pseudomonas aeruginosa PA01
cuauccgccguuacgccgggu

SEQ ID NO: 3430649 - RNA, 13 nt, Pseudomonas aeruginosa PA01
cuauccuccaggc

SEQ ID NO: 3430650 - RNA, 15 nt, Pseudomonas aeruginosa PA01
cuauccuccaggccg

SEQ ID NO: 3430651 - RNA, 22 nt, Pseudomonas aeruginosa PA01
cuaucgacgguuucaggccuug

SEQ ID NO: 3430652 - RNA, 17 nt, Pseudomonas aeruginosa PA01
cuaucgccaacgccacc

SEQ ID NO: 3430653 - RNA, 15 nt, Pseudomonas aeruginosa PA01
cuaucgccgccgcag

SEQ ID NO: 3430654 - RNA, 17 nt, Pseudomonas aeruginosa PA01
cuaucgccgccgcagcc

SEQ ID NO: 3430655 - RNA, 17 nt, Pseudomonas aeruginosa PA01
cuaucgcuggcgcagcc

SEQ ID NO: 3430656 - RNA, 18 nt, Pseudomonas aeruginosa PA01
cuaucgcuggcgcagccg

SEQ ID NO: 3430657 - RNA, 13 nt, Pseudomonas aeruginosa PA01
cuaucggcccggg

SEQ ID NO: 3430658 - RNA, 21 nt, Pseudomonas aeruginosa PA01
cuaucgggcagggcagccgcc

SEQ ID NO: 3430659 - RNA, 17 nt, Pseudomonas aeruginosa PA01
cuaucgggccgaucgag

SEQ ID NO: 3430660 - RNA, 13 nt, Pseudomonas aeruginosa PA01
cuaugcagcaggu

SEQ ID NO: 3430661 - RNA, 12 nt, Pseudomonas aeruginosa PA01
cuaugcgccggg

SEQ ID NO: 3430662 - RNA, 13 nt, Pseudomonas aeruginosa PA01
cuaugcgccgggc

SEQ ID NO: 3430663 - RNA, 14 nt, Pseudomonas aeruginosa PA01
cuaugggcaccgcg

SEQ ID NO: 3430664 - RNA, 15 nt, Pseudomonas aeruginosa PA01
cuauucgcccagugg

SEQ ID NO: 3430665 - RNA, 23 nt, Pseudomonas aeruginosa PA01
cuauucugauugcguaacguuac

SEQ ID NO: 3430666 - RNA, 15 nt, Pseudomonas aeruginosa PA01
cucaacgaccgccca

SEQ ID NO: 3430667 - RNA, 21 nt, Pseudomonas aeruginosa PA01
cucaacgaccgcccaggcugc

SEQ ID NO: 3430668 - RNA, 17 nt, Pseudomonas aeruginosa PA01
cucaacgccucgcggcu

SEQ ID NO: 3430669 - RNA, 16 nt, Pseudomonas aeruginosa PA01
cucaacggcgugccgg

SEQ ID NO: 3430670 - RNA, 19 nt, Pseudomonas aeruginosa PA01
cucaacggcgugccgggca

SEQ ID NO: 3430671 - RNA, 19 nt, Pseudomonas aeruginosa PA01
cucaacgggaccguccagg

SEQ ID NO: 3430672 - RNA, 20 nt, Pseudomonas aeruginosa PA01
cucaacugcuuaccuugccg

SEQ ID NO: 3430673 - RNA, 17 nt, Pseudomonas aeruginosa PA01
cucaacugguuggccgc

SEQ ID NO: 3430674 - RNA, 21 nt, Pseudomonas aeruginosa PA01
cucaacugguuggccgccugg

SEQ ID NO: 3430675 - RNA, 15 nt, Pseudomonas aeruginosa PA01
cucaagacggcccgc

SEQ ID NO: 3430676 - RNA, 17 nt, Pseudomonas aeruginosa PA01
cucaagggcuggcaggu

SEQ ID NO: 3430677 - RNA, 12 nt, Pseudomonas aeruginosa PA01
cucaagucucca

SEQ ID NO: 3430678 - RNA, 15 nt, Pseudomonas aeruginosa PA01
cucaagucuccagcg

SEQ ID NO: 3430679 - RNA, 13 nt, Pseudomonas aeruginosa PA01
cucacaccaccag

SEQ ID NO: 3430680 - RNA, 18 nt, Pseudomonas aeruginosa PA01
cucacaccaccagcauca

SEQ ID NO: 3430681 - RNA, 21 nt, Pseudomonas aeruginosa PA01
cucacagauauugaugcaagg

SEQ ID NO: 3430682 - RNA, 16 nt, Pseudomonas aeruginosa PA01
cucaccaccaccgcgc

SEQ ID NO: 3430683 - RNA, 19 nt, Pseudomonas aeruginosa PA01
cucaccaccaccgcgccga

SEQ ID NO: 3430684 - RNA, 14 nt, Pseudomonas aeruginosa PA01
cucacccugcuggg

SEQ ID NO: 3430685 - RNA, 18 nt, Pseudomonas aeruginosa PA01
cucacccugcugggcggg

SEQ ID NO: 3430686 - RNA, 16 nt, Pseudomonas aeruginosa PA01
cucacccugucccauc

SEQ ID NO: 3430687 - RNA, 17 nt, Pseudomonas aeruginosa PA01
cucacccugucccauca

SEQ ID NO: 3430688 - RNA, 16 nt, Pseudomonas aeruginosa PA01
cucaccgcauagucgc

SEQ ID NO: 3430689 - RNA, 21 nt, Pseudomonas aeruginosa PA01
cucaccgccaccccgccggcg

SEQ ID NO: 3430690 - RNA, 13 nt, Pseudomonas aeruginosa PA01
cucaccgcccugc

SEQ ID NO: 3430691 - RNA, 16 nt, Pseudomonas aeruginosa PA01
cucaccgcccugcgcg

SEQ ID NO: 3430692 - RNA, 19 nt, Pseudomonas aeruginosa PA01
cucacgcaccucgucgagc

SEQ ID NO: 3430693 - RNA, 21 nt, Pseudomonas aeruginosa PA01
cucacgcaccucgucgagcag

SEQ ID NO: 3430694 - RNA, 17 nt, Pseudomonas aeruginosa PA01
cucacgccgaacuugua

SEQ ID NO: 3430695 - RNA, 16 nt, Pseudomonas aeruginosa PA01
cucacgcguucggcga

SEQ ID NO: 3430696 - RNA, 17 nt, Pseudomonas aeruginosa PA01
cucacggccgaacagac

SEQ ID NO: 3430697 - RNA, 16 nt, Pseudomonas aeruginosa PA01
cucacggcgcagccgc

SEQ ID NO: 3430698 - RNA, 20 nt, Pseudomonas aeruginosa PA01
cucacggcgcagccgcaagg

SEQ ID NO: 3430699 - RNA, 21 nt, Pseudomonas aeruginosa PA01
cucacggcgcgagaaaaacca

SEQ ID NO: 3430700 - RNA, 21 nt, Pseudomonas aeruginosa PA01
cucacggguguuucggccgcu

SEQ ID NO: 3430701 - RNA, 15 nt, Pseudomonas aeruginosa PA01
cucacguagcccccg

SEQ ID NO: 3430702 - RNA, 18 nt, Pseudomonas aeruginosa PA01
cucacguagcccccgccg

SEQ ID NO: 3430703 - RNA, 18 nt, Pseudomonas aeruginosa PA01
cucacgugaccguccagc

SEQ ID NO: 3430704 - RNA, 16 nt, Pseudomonas aeruginosa PA01
cucacugcgagcacca

SEQ ID NO: 3430705 - RNA, 18 nt, Pseudomonas aeruginosa PA01
cucagaaauccaccuugc

SEQ ID NO: 3430706 - RNA, 20 nt, Pseudomonas aeruginosa PA01
cucagaaauccaccuugccg

SEQ ID NO: 3430707 - RNA, 22 nt, Pseudomonas aeruginosa PA01
cucagaaauccaccuugccgcg

SEQ ID NO: 3430708 - RNA, 11 nt, Pseudomonas aeruginosa PA01
cucagaaguag

SEQ ID NO: 3430709 - RNA, 15 nt, Pseudomonas aeruginosa PA01
cucagaccacgcccu

SEQ ID NO: 3430710 - RNA, 23 nt, Pseudomonas aeruginosa PA01
cucagaccacgcccugcgccagc

SEQ ID NO: 3430711 - RNA, 20 nt, Pseudomonas aeruginosa PA01
cucagaggcgaccagccggg

SEQ ID NO: 3430712 - RNA, 22 nt, Pseudomonas aeruginosa PA01
cucagcaccuugugcugccugc

SEQ ID NO: 3430713 - RNA, 14 nt, Pseudomonas aeruginosa PA01
cucagcagcgccgc

SEQ ID NO: 3430714 - RNA, 16 nt, Pseudomonas aeruginosa PA01
cucagcagcgccgccc

SEQ ID NO: 3430715 - RNA, 17 nt, Pseudomonas aeruginosa PA01
cucagcagcgccgcccu

SEQ ID NO: 3430716 - RNA, 12 nt, Pseudomonas aeruginosa PA01
cucagcaggucg

SEQ ID NO: 3430717 - RNA, 13 nt, Pseudomonas aeruginosa PA01
cucagcaggucgc

SEQ ID NO: 3430718 - RNA, 18 nt, Pseudomonas aeruginosa PA01
cucagcaucagcgacagc

SEQ ID NO: 3430719 - RNA, 14 nt, Pseudomonas aeruginosa PA01
cucagccagcggcg

SEQ ID NO: 3430720 - RNA, 16 nt, Pseudomonas aeruginosa PA01
cucagccagcggcgcu

SEQ ID NO: 3430721 - RNA, 14 nt, Pseudomonas aeruginosa PA01
cucagcccaggcgc

SEQ ID NO: 3430722 - RNA, 17 nt, Pseudomonas aeruginosa PA01
cucagcccaggcgccgc

SEQ ID NO: 3430723 - RNA, 15 nt, Pseudomonas aeruginosa PA01
cucagccccucgcca

SEQ ID NO: 3430724 - RNA, 15 nt, Pseudomonas aeruginosa PA01
cucagcccucggccc

SEQ ID NO: 3430725 - RNA, 17 nt, Pseudomonas aeruginosa PA01
cucagcccucggcccgg

SEQ ID NO: 3430726 - RNA, 13 nt, Pseudomonas aeruginosa PA01
cucagccgaccac

SEQ ID NO: 3430727 - RNA, 17 nt, Pseudomonas aeruginosa PA01
cucagccgaccaccuuc

SEQ ID NO: 3430728 - RNA, 20 nt, Pseudomonas aeruginosa PA01
cucagccgaggucgccgcca

SEQ ID NO: 3430729 - RNA, 14 nt, Pseudomonas aeruginosa PA01
cucagccgcgccgg

SEQ ID NO: 3430730 - RNA, 17 nt, Pseudomonas aeruginosa PA01
cucagccgcuggcgucg

SEQ ID NO: 3430731 - RNA, 18 nt, Pseudomonas aeruginosa PA01
cucagccgcuggcgucga

SEQ ID NO: 3430732 - RNA, 22 nt, Pseudomonas aeruginosa PA01
cucagccguggcacccaggcca

SEQ ID NO: 3430733 - RNA, 24 nt, Pseudomonas aeruginosa PA01
cucagccguggcacccaggccacg

SEQ ID NO: 3430734 - RNA, 17 nt, Pseudomonas aeruginosa PA01
cucagccucacccugcu

SEQ ID NO: 3430735 - RNA, 21 nt, Pseudomonas aeruginosa PA01
cucagccucacccugcugggc

SEQ ID NO: 3430736 - RNA, 23 nt, Pseudomonas aeruginosa PA01
cucagccucacccugcugggcgg

SEQ ID NO: 3430737 - RNA, 18 nt, Pseudomonas aeruginosa PA01
cucagcgaaacucgugcu

SEQ ID NO: 3430738 - RNA, 12 nt, Pseudomonas aeruginosa PA01
cucagcgccggc

SEQ ID NO: 3430739 - RNA, 17 nt, Pseudomonas aeruginosa PA01
cucagcgccggccaggg

SEQ ID NO: 3430740 - RNA, 21 nt, Pseudomonas aeruginosa PA01
cucagcgccgguagcggcgca

SEQ ID NO: 3430741 - RNA, 17 nt, Pseudomonas aeruginosa PA01
cucagcgccguugcggc

SEQ ID NO: 3430742 - RNA, 12 nt, Pseudomonas aeruginosa PA01
cucagcgcgaca

SEQ ID NO: 3430743 - RNA, 18 nt, Pseudomonas aeruginosa PA01
cucagcgcgacaggcugg

SEQ ID NO: 3430744 - RNA, 16 nt, Pseudomonas aeruginosa PA01
cucagcgcgcucggcc

SEQ ID NO: 3430745 - RNA, 18 nt, Pseudomonas aeruginosa PA01
cucagcgcgcucggccug

SEQ ID NO: 3430746 - RNA, 22 nt, Pseudomonas aeruginosa PA01
cucagcgcgcucggccuggugc

SEQ ID NO: 3430747 - RNA, 16 nt, Pseudomonas aeruginosa PA01
cucagcgcggcggcgg

SEQ ID NO: 3430748 - RNA, 18 nt, Pseudomonas aeruginosa PA01
cucagcgcggcggcggcc

SEQ ID NO: 3430749 - RNA, 20 nt, Pseudomonas aeruginosa PA01
cucagcgcggcggcggccgc

SEQ ID NO: 3430750 - RNA, 21 nt, Pseudomonas aeruginosa PA01
cucagcgcggcggcggccgca

SEQ ID NO: 3430751 - RNA, 22 nt, Pseudomonas aeruginosa PA01
cucagcgcggcggcggccgcau

SEQ ID NO: 3430752 - RNA, 15 nt, Pseudomonas aeruginosa PA01
cucagcgcuucucgg

SEQ ID NO: 3430753 - RNA, 22 nt, Pseudomonas aeruginosa PA01
cucagcgcuucucggcagcgcu

SEQ ID NO: 3430754 - RNA, 17 nt, Pseudomonas aeruginosa PA01
cucagcggaacauuucc

SEQ ID NO: 3430755 - RNA, 19 nt, Pseudomonas aeruginosa PA01
cucagcggaacauuuccuu

SEQ ID NO: 3430756 - RNA, 14 nt, Pseudomonas aeruginosa PA01
cucagcggcccagc

SEQ ID NO: 3430757 - RNA, 17 nt, Pseudomonas aeruginosa PA01
cucagcggcccagcgcc

SEQ ID NO: 3430758 - RNA, 18 nt, Pseudomonas aeruginosa PA01
cucagcggcccagcgccc

SEQ ID NO: 3430759 - RNA, 22 nt, Pseudomonas aeruginosa PA01
cucagcggcccagcgccccgcc

SEQ ID NO: 3430760 - RNA, 20 nt, Pseudomonas aeruginosa PA01
cucagcggcggugcgccggc

SEQ ID NO: 3430761 - RNA, 21 nt, Pseudomonas aeruginosa PA01
cucagcggcggugcgccggcg

SEQ ID NO: 3430762 - RNA, 22 nt, Pseudomonas aeruginosa PA01
cucagcggcggugcgccggcgg

SEQ ID NO: 3430763 - RNA, 19 nt, Pseudomonas aeruginosa PA01
cucagcguccucagccuca

SEQ ID NO: 3430764 - RNA, 12 nt, Pseudomonas aeruginosa PA01
cucagcucggcg

SEQ ID NO: 3430765 - RNA, 22 nt, Pseudomonas aeruginosa PA01
cucagcucggcgaugccgccgg

SEQ ID NO: 3430766 - RNA, 15 nt, Pseudomonas aeruginosa PA01
cucagcucugucucc

SEQ ID NO: 3430767 - RNA, 15 nt, Pseudomonas aeruginosa PA01
cucagcugggagagc

SEQ ID NO: 3430768 - RNA, 19 nt, Pseudomonas aeruginosa PA01
cucaggaagaagccucgcg

SEQ ID NO: 3430769 - RNA, 18 nt, Pseudomonas aeruginosa PA01
cucaggaccuuccgccag

SEQ ID NO: 3430770 - RNA, 22 nt, Pseudomonas aeruginosa PA01
cucaggaccuuccgccagcagg

SEQ ID NO: 3430771 - RNA, 19 nt, Pseudomonas aeruginosa PA01
cucaggacguccuggccga

SEQ ID NO: 3430772 - RNA, 20 nt, Pseudomonas aeruginosa PA01
cucaggacguccuggccgag

SEQ ID NO: 3430773 - RNA, 19 nt, Pseudomonas aeruginosa PA01
cucaggagcgccgcgcagc

SEQ ID NO: 3430774 - RNA, 21 nt, Pseudomonas aeruginosa PA01
cucaggagcgccgcgcagcgc

SEQ ID NO: 3430775 - RNA, 16 nt, Pseudomonas aeruginosa PA01
cucaggauagccggcg

SEQ ID NO: 3430776 - RNA, 22 nt, Pseudomonas aeruginosa PA01
cucaggcagcgaucgccgccau

SEQ ID NO: 3430777 - RNA, 13 nt, Pseudomonas aeruginosa PA01
cucaggccgccgc

SEQ ID NO: 3430778 - RNA, 14 nt, Pseudomonas aeruginosa PA01
cucaggccgccgcg

SEQ ID NO: 3430779 - RNA, 23 nt, Pseudomonas aeruginosa PA01
cucaggccgccgcgucgaagcug

SEQ ID NO: 3430780 - RNA, 23 nt, Pseudomonas aeruginosa PA01
cucaggccgggcggaugaccugu

SEQ ID NO: 3430781 - RNA, 13 nt, Pseudomonas aeruginosa PA01
cucaggcgcagcg

SEQ ID NO: 3430782 - RNA, 20 nt, Pseudomonas aeruginosa PA01
cucaggcgcagcguccugcc

SEQ ID NO: 3430783 - RNA, 22 nt, Pseudomonas aeruginosa PA01
cucaggcgcagcguccugcccu

SEQ ID NO: 3430784 - RNA, 12 nt, Pseudomonas aeruginosa PA01
cucaggcgccag

SEQ ID NO: 3430785 - RNA, 21 nt, Pseudomonas aeruginosa PA01
cucaggcgccaggccucagaa

SEQ ID NO: 3430786 - RNA, 13 nt, Pseudomonas aeruginosa PA01
cucaggcgccgcu

SEQ ID NO: 3430787 - RNA, 14 nt, Pseudomonas aeruginosa PA01
cucaggcgccgcug

SEQ ID NO: 3430788 - RNA, 16 nt, Pseudomonas aeruginosa PA01
cucaggcgcugcgcgg

SEQ ID NO: 3430789 - RNA, 15 nt, Pseudomonas aeruginosa PA01
cucaggcgcugcugg

SEQ ID NO: 3430790 - RNA, 19 nt, Pseudomonas aeruginosa PA01
cucaggcgcugcuggugga

SEQ ID NO: 3430791 - RNA, 16 nt, Pseudomonas aeruginosa PA01
cucaggcgucccgcuc

SEQ ID NO: 3430792 - RNA, 21 nt, Pseudomonas aeruginosa PA01
cucagggaaaucgguugcgac

SEQ ID NO: 3430793 - RNA, 21 nt, Pseudomonas aeruginosa PA01
cucagggaagaugcacaccag

SEQ ID NO: 3430794 - RNA, 22 nt, Pseudomonas aeruginosa PA01
cucagggaauggaugcgcggca

SEQ ID NO: 3430795 - RNA, 19 nt, Pseudomonas aeruginosa PA01
cucagggacaccccgucuc

SEQ ID NO: 3430796 - RNA, 12 nt, Pseudomonas aeruginosa PA01
cucagggccgcg

SEQ ID NO: 3430797 - RNA, 14 nt, Pseudomonas aeruginosa PA01
cucagggccgcgcc

SEQ ID NO: 3430798 - RNA, 16 nt, Pseudomonas aeruginosa PA01
cucagggccgcgccga

SEQ ID NO: 3430799 - RNA, 18 nt, Pseudomonas aeruginosa PA01
cucagggcgcgaaguagc

SEQ ID NO: 3430800 - RNA, 19 nt, Pseudomonas aeruginosa PA01
cucagggcgcgaaguagcg

SEQ ID NO: 3430801 - RNA, 20 nt, Pseudomonas aeruginosa PA01
cucaggggccgacgcgcugc

SEQ ID NO: 3430802 - RNA, 23 nt, Pseudomonas aeruginosa PA01
cucaggucggucgaacugaccac

SEQ ID NO: 3430803 - RNA, 17 nt, Pseudomonas aeruginosa PA01
cucaguaccugcaaggc

SEQ ID NO: 3430804 - RNA, 24 nt, Pseudomonas aeruginosa PA01
cucaguauuucucgacuuccgccu

SEQ ID NO: 3430805 - RNA, 19 nt, Pseudomonas aeruginosa PA01
cucagucgaccgucgccac

SEQ ID NO: 3430806 - RNA, 20 nt, Pseudomonas aeruginosa PA01
cucagucgaccgucgccacg

SEQ ID NO: 3430807 - RNA, 12 nt, Pseudomonas aeruginosa PA01
cucagucgaggu

SEQ ID NO: 3430808 - RNA, 19 nt, Pseudomonas aeruginosa PA01
cucagucgcccccaccgcc

SEQ ID NO: 3430809 - RNA, 23 nt, Pseudomonas aeruginosa PA01
cucagucgcccccaccgcccccg

SEQ ID NO: 3430810 - RNA, 16 nt, Pseudomonas aeruginosa PA01
cucagucgguagagca

SEQ ID NO: 3430811 - RNA, 17 nt, Pseudomonas aeruginosa PA01
cucagucgguagagcag

SEQ ID NO: 3430812 - RNA, 15 nt, Pseudomonas aeruginosa PA01
cucagucgugcaggu

SEQ ID NO: 3430813 - RNA, 20 nt, Pseudomonas aeruginosa PA01
cucaguggaucguugaacug

SEQ ID NO: 3430814 - RNA, 15 nt, Pseudomonas aeruginosa PA01
cucaguucggccagc

SEQ ID NO: 3430815 - RNA, 16 nt, Pseudomonas aeruginosa PA01
cucaguucggccagcg

SEQ ID NO: 3430816 - RNA, 19 nt, Pseudomonas aeruginosa PA01
cucaguucggccagcggca

SEQ ID NO: 3430817 - RNA, 20 nt, Pseudomonas aeruginosa PA01
cucaguugcugaucaggccg

SEQ ID NO: 3430818 - RNA, 23 nt, Pseudomonas aeruginosa PA01
cucaguugcugaucaggccgagg

SEQ ID NO: 3430819 - RNA, 23 nt, Pseudomonas aeruginosa PA01
cucauacgaaaaaaaggcgcugc

SEQ ID NO: 3430820 - RNA, 14 nt, Pseudomonas aeruginosa PA01
cucauagcucagcu

SEQ ID NO: 3430821 - RNA, 16 nt, Pseudomonas aeruginosa PA01
cucauagcucagcugg

SEQ ID NO: 3430822 - RNA, 17 nt, Pseudomonas aeruginosa PA01
cucauagcucagcugga

SEQ ID NO: 3430823 - RNA, 17 nt, Pseudomonas aeruginosa PA01
cucaucaggcugccgag

SEQ ID NO: 3430824 - RNA, 18 nt, Pseudomonas aeruginosa PA01
cucaucaggcugccgagc

SEQ ID NO: 3430825 - RNA, 20 nt, Pseudomonas aeruginosa PA01
cucaucaggcugccgagcag

SEQ ID NO: 3430826 - RNA, 15 nt, Pseudomonas aeruginosa PA01
cucauccgcgaggca

SEQ ID NO: 3430827 - RNA, 20 nt, Pseudomonas aeruginosa PA01
cucauccucgccgcuggcgc

SEQ ID NO: 3430828 - RNA, 19 nt, Pseudomonas aeruginosa PA01
cucaucgcccaugaaaaag

SEQ ID NO: 3430829 - RNA, 14 nt, Pseudomonas aeruginosa PA01
cucaucgcccgccc

SEQ ID NO: 3430830 - RNA, 22 nt, Pseudomonas aeruginosa PA01
cucaucgcguagguggcgccgc

SEQ ID NO: 3430831 - RNA, 23 nt, Pseudomonas aeruginosa PA01
cucaucgcguagguggcgccgcc

SEQ ID NO: 3430832 - RNA, 24 nt, Pseudomonas aeruginosa PA01
cucaucgcguagguggcgccgccg

SEQ ID NO: 3430833 - RNA, 23 nt, Pseudomonas aeruginosa PA01
cucaucuucucguucagcgcgaa

SEQ ID NO: 3430834 - RNA, 17 nt, Pseudomonas aeruginosa PA01
cucaugaaaaagccccu

SEQ ID NO: 3430835 - RNA, 15 nt, Pseudomonas aeruginosa PA01
cucaugaccgccgcu

SEQ ID NO: 3430836 - RNA, 14 nt, Pseudomonas aeruginosa PA01
cucaugcaggccga

SEQ ID NO: 3430837 - RNA, 12 nt, Pseudomonas aeruginosa PA01
cucaugcccagc

SEQ ID NO: 3430838 - RNA, 15 nt, Pseudomonas aeruginosa PA01
cucaugcccagcuuc

SEQ ID NO: 3430839 - RNA, 21 nt, Pseudomonas aeruginosa PA01
cucaugcccagcuucaccggu

SEQ ID NO: 3430840 - RNA, 17 nt, Pseudomonas aeruginosa PA01
cucaugccguugcccuc

SEQ ID NO: 3430841 - RNA, 14 nt, Pseudomonas aeruginosa PA01
cucaugccuugucg

SEQ ID NO: 3430842 - RNA, 14 nt, Pseudomonas aeruginosa PA01
cucaugcugcgcgg

SEQ ID NO: 3430843 - RNA, 21 nt, Pseudomonas aeruginosa PA01
cucauggaaaccccggccugg

SEQ ID NO: 3430844 - RNA, 20 nt, Pseudomonas aeruginosa PA01
cucauggaacagcagccagg

SEQ ID NO: 3430845 - RNA, 19 nt, Pseudomonas aeruginosa PA01
cucauggaacugcagggca

SEQ ID NO: 3430846 - RNA, 14 nt, Pseudomonas aeruginosa PA01
cucauggccgcagc

SEQ ID NO: 3430847 - RNA, 18 nt, Pseudomonas aeruginosa PA01
cucauggccgcagcggcu

SEQ ID NO: 3430848 - RNA, 16 nt, Pseudomonas aeruginosa PA01
cucauggcgucaacga

SEQ ID NO: 3430849 - RNA, 16 nt, Pseudomonas aeruginosa PA01
cucauguucaguucgg

SEQ ID NO: 3430850 - RNA, 19 nt, Pseudomonas aeruginosa PA01
cucauucaucucgccgucg

SEQ ID NO: 3430851 - RNA, 23 nt, Pseudomonas aeruginosa PA01
cucauucaucucgccgucggcgg

SEQ ID NO: 3430852 - RNA, 22 nt, Pseudomonas aeruginosa PA01
cucauucgcucugcgccaggcg

SEQ ID NO: 3430853 - RNA, 17 nt, Pseudomonas aeruginosa PA01
cucauucggccagcgcg

SEQ ID NO: 3430854 - RNA, 19 nt, Pseudomonas aeruginosa PA01
cucauucggccagcgcggc

SEQ ID NO: 3430855 - RNA, 15 nt, Pseudomonas aeruginosa PA01
cucauugcgccgccg

SEQ ID NO: 3430856 - RNA, 19 nt, Pseudomonas aeruginosa PA01
cuccaaagccuggagcagg

SEQ ID NO: 3430857 - RNA, 13 nt, Pseudomonas aeruginosa PA01
cuccaacagcagg

SEQ ID NO: 3430858 - RNA, 16 nt, Pseudomonas aeruginosa PA01
cuccaacagcagguag

SEQ ID NO: 3430859 - RNA, 12 nt, Pseudomonas aeruginosa PA01
cuccaacgcagg

SEQ ID NO: 3430860 - RNA, 16 nt, Pseudomonas aeruginosa PA01
cuccaaugcaccugcg

SEQ ID NO: 3430861 - RNA, 17 nt, Pseudomonas aeruginosa PA01
cuccaauucgacgccga

SEQ ID NO: 3430862 - RNA, 13 nt, Pseudomonas aeruginosa PA01
cuccacacccggu

SEQ ID NO: 3430863 - RNA, 14 nt, Pseudomonas aeruginosa PA01
cuccacacccgguc

SEQ ID NO: 3430864 - RNA, 20 nt, Pseudomonas aeruginosa PA01
cuccacagcugccagccccg

SEQ ID NO: 3430865 - RNA, 16 nt, Pseudomonas aeruginosa PA01
cuccaccagcgccggc

SEQ ID NO: 3430866 - RNA, 21 nt, Pseudomonas aeruginosa PA01
cuccaccagcgccggcggcgc

SEQ ID NO: 3430867 - RNA, 22 nt, Pseudomonas aeruginosa PA01
cuccaccaggccauagcgcgcc

SEQ ID NO: 3430868 - RNA, 14 nt, Pseudomonas aeruginosa PA01
cuccaccagggccu

SEQ ID NO: 3430869 - RNA, 14 nt, Pseudomonas aeruginosa PA01
cuccaccaguagcc

SEQ ID NO: 3430870 - RNA, 14 nt, Pseudomonas aeruginosa PA01
cuccacccaggcgc

SEQ ID NO: 3430871 - RNA, 17 nt, Pseudomonas aeruginosa PA01
cuccacccaggcgccga

SEQ ID NO: 3430872 - RNA, 18 nt, Pseudomonas aeruginosa PA01
cuccacccccaucgcccg

SEQ ID NO: 3430873 - RNA, 16 nt, Pseudomonas aeruginosa PA01
cuccacccgcagccgc

SEQ ID NO: 3430874 - RNA, 19 nt, Pseudomonas aeruginosa PA01
cuccacccguucgccggcc

SEQ ID NO: 3430875 - RNA, 21 nt, Pseudomonas aeruginosa PA01
cuccaccgauggcgcgcuuuc

SEQ ID NO: 3430876 - RNA, 14 nt, Pseudomonas aeruginosa PA01
cuccaccgcuccgg

SEQ ID NO: 3430877 - RNA, 23 nt, Pseudomonas aeruginosa PA01
cuccaccgcuccggcgccgaggu

SEQ ID NO: 3430878 - RNA, 21 nt, Pseudomonas aeruginosa PA01
cuccaccggaucgcccuggcg

SEQ ID NO: 3430879 - RNA, 23 nt, Pseudomonas aeruginosa PA01
cuccaccggaucgcccuggcgcc

SEQ ID NO: 3430880 - RNA, 21 nt, Pseudomonas aeruginosa PA01
cuccaccguuccgacccggcc

SEQ ID NO: 3430881 - RNA, 23 nt, Pseudomonas aeruginosa PA01
cuccaccguuccgacccggccga

SEQ ID NO: 3430882 - RNA, 19 nt, Pseudomonas aeruginosa PA01
cuccaccucgacccuggcg

SEQ ID NO: 3430883 - RNA, 14 nt, Pseudomonas aeruginosa PA01
cuccacgaggaugu

SEQ ID NO: 3430884 - RNA, 20 nt, Pseudomonas aeruginosa PA01
cuccacgaggaugucggcga

SEQ ID NO: 3430885 - RNA, 14 nt, Pseudomonas aeruginosa PA01
cuccacgucggccc

SEQ ID NO: 3430886 - RNA, 16 nt, Pseudomonas aeruginosa PA01
cuccacgucggcccgg

SEQ ID NO: 3430887 - RNA, 20 nt, Pseudomonas aeruginosa PA01
cuccacgucguccggcgcca

SEQ ID NO: 3430888 - RNA, 22 nt, Pseudomonas aeruginosa PA01
cuccacuaccgccgagggcgcc

SEQ ID NO: 3430889 - RNA, 14 nt, Pseudomonas aeruginosa PA01
cuccacugcuuggc

SEQ ID NO: 3430890 - RNA, 15 nt, Pseudomonas aeruginosa PA01
cuccacugcuuggcc

SEQ ID NO: 3430891 - RNA, 16 nt, Pseudomonas aeruginosa PA01
cuccacugcuuggcca

SEQ ID NO: 3430892 - RNA, 19 nt, Pseudomonas aeruginosa PA01
cuccagacucuccaggucg

SEQ ID NO: 3430893 - RNA, 22 nt, Pseudomonas aeruginosa PA01
cuccagagccaugggccggccg

SEQ ID NO: 3430894 - RNA, 19 nt, Pseudomonas aeruginosa PA01
cuccagaggaacaguucgg

SEQ ID NO: 3430895 - RNA, 20 nt, Pseudomonas aeruginosa PA01
cuccagaggaacaguucggc

SEQ ID NO: 3430896 - RNA, 13 nt, Pseudomonas aeruginosa PA01
cuccagagugcgc

SEQ ID NO: 3430897 - RNA, 18 nt, Pseudomonas aeruginosa PA01
cuccagagugcgcagcag

SEQ ID NO: 3430898 - RNA, 19 nt, Pseudomonas aeruginosa PA01
cuccagagugcgcagcagc

SEQ ID NO: 3430899 - RNA, 20 nt, Pseudomonas aeruginosa PA01
cuccagagugcgcagcagcg

SEQ ID NO: 3430900 - RNA, 23 nt, Pseudomonas aeruginosa PA01
cuccagagugcgcagcagcgucg

SEQ ID NO: 3430901 - RNA, 21 nt, Pseudomonas aeruginosa PA01
cuccagauagugcggccaggc

SEQ ID NO: 3430902 - RNA, 23 nt, Pseudomonas aeruginosa PA01
cuccagauagugcggccaggcgu

SEQ ID NO: 3430903 - RNA, 15 nt, Pseudomonas aeruginosa PA01
cuccagaucgccguu

SEQ ID NO: 3430904 - RNA, 17 nt, Pseudomonas aeruginosa PA01
cuccagaucgccguucu

SEQ ID NO: 3430905 - RNA, 14 nt, Pseudomonas aeruginosa PA01
cuccagcaacgccg

SEQ ID NO: 3430906 - RNA, 15 nt, Pseudomonas aeruginosa PA01
cuccagcaacgccgc

SEQ ID NO: 3430907 - RNA, 16 nt, Pseudomonas aeruginosa PA01
cuccagcaaugccagc

SEQ ID NO: 3430908 - RNA, 17 nt, Pseudomonas aeruginosa PA01
cuccagcaaugccagcg

SEQ ID NO: 3430909 - RNA, 20 nt, Pseudomonas aeruginosa PA01
cuccagcaaugccagcgcca

SEQ ID NO: 3430910 - RNA, 18 nt, Pseudomonas aeruginosa PA01
cuccagcaccagcacgcc

SEQ ID NO: 3430911 - RNA, 20 nt, Pseudomonas aeruginosa PA01
cuccagcaccgccuggcgca

SEQ ID NO: 3430912 - RNA, 21 nt, Pseudomonas aeruginosa PA01
cuccagcaccgccuggcgcaa

SEQ ID NO: 3430913 - RNA, 20 nt, Pseudomonas aeruginosa PA01
cuccagcaccggcggcgcca

SEQ ID NO: 3430914 - RNA, 14 nt, Pseudomonas aeruginosa PA01
cuccagcaccgugg

SEQ ID NO: 3430915 - RNA, 10 nt, Pseudomonas aeruginosa PA01
cuccagcagg

SEQ ID NO: 3430916 - RNA, 15 nt, Pseudomonas aeruginosa PA01
cuccagcaggaccug

SEQ ID NO: 3430917 - RNA, 20 nt, Pseudomonas aeruginosa PA01
cuccagcaggaccuggccgu

SEQ ID NO: 3430918 - RNA, 22 nt, Pseudomonas aeruginosa PA01
cuccagcaggcucuuggucgcg

SEQ ID NO: 3430919 - RNA, 11 nt, Pseudomonas aeruginosa PA01
cuccagcaggg

SEQ ID NO: 3430920 - RNA, 21 nt, Pseudomonas aeruginosa PA01
cuccagcagggccagcgccug

SEQ ID NO: 3430921 - RNA, 19 nt, Pseudomonas aeruginosa PA01
cuccagcagggucgccugg

SEQ ID NO: 3430922 - RNA, 20 nt, Pseudomonas aeruginosa PA01
cuccagcagucgcacagcca

SEQ ID NO: 3430923 - RNA, 21 nt, Pseudomonas aeruginosa PA01
cuccagcagucgcacagccag

SEQ ID NO: 3430924 - RNA, 16 nt, Pseudomonas aeruginosa PA01
cuccagcauccagcga

SEQ ID NO: 3430925 - RNA, 18 nt, Pseudomonas aeruginosa PA01
cuccagcauccagcgaua

SEQ ID NO: 3430926 - RNA, 16 nt, Pseudomonas aeruginosa PA01
cuccagccaggcccgg

SEQ ID NO: 3430927 - RNA, 20 nt, Pseudomonas aeruginosa PA01
cuccagccccacuggaagaa

SEQ ID NO: 3430928 - RNA, 22 nt, Pseudomonas aeruginosa PA01
cuccagccccacuggaagaagg

SEQ ID NO: 3430929 - RNA, 22 nt, Pseudomonas aeruginosa PA01
cuccagccccgcgauugcagcu

SEQ ID NO: 3430930 - RNA, 23 nt, Pseudomonas aeruginosa PA01
cuccagccggcaagcgugccccg

SEQ ID NO: 3430931 - RNA, 23 nt, Pseudomonas aeruginosa PA01
cuccagccggccauccagccagg

SEQ ID NO: 3430932 - RNA, 14 nt, Pseudomonas aeruginosa PA01
cuccagccggcgac

SEQ ID NO: 3430933 - RNA, 22 nt, Pseudomonas aeruginosa PA01
cuccagccgggcuccgccgcga

SEQ ID NO: 3430934 - RNA, 22 nt, Pseudomonas aeruginosa PA01
cuccagcgaauggacaggcgcc

SEQ ID NO: 3430935 - RNA, 14 nt, Pseudomonas aeruginosa PA01
cuccagcgcccagg

SEQ ID NO: 3430936 - RNA, 14 nt, Pseudomonas aeruginosa PA01
cuccagcgccgcau

SEQ ID NO: 3430937 - RNA, 22 nt, Pseudomonas aeruginosa PA01
cuccagcgccgcauuggccagg

SEQ ID NO: 3430938 - RNA, 14 nt, Pseudomonas aeruginosa PA01
cuccagcgccgccu

SEQ ID NO: 3430939 - RNA, 15 nt, Pseudomonas aeruginosa PA01
cuccagcgccgccuc

SEQ ID NO: 3430940 - RNA, 11 nt, Pseudomonas aeruginosa PA01
cuccagcgccu

SEQ ID NO: 3430941 - RNA, 23 nt, Pseudomonas aeruginosa PA01
cuccagcgccucgaccagaucgg

SEQ ID NO: 3430942 - RNA, 16 nt, Pseudomonas aeruginosa PA01
cuccagcgccucgccg

SEQ ID NO: 3430943 - RNA, 17 nt, Pseudomonas aeruginosa PA01
cuccagcgccucgccga

SEQ ID NO: 3430944 - RNA, 18 nt, Pseudomonas aeruginosa PA01
cuccagcgccuggcgcag

SEQ ID NO: 3430945 - RNA, 20 nt, Pseudomonas aeruginosa PA01
cuccagcggaaucgcgcccu

SEQ ID NO: 3430946 - RNA, 17 nt, Pseudomonas aeruginosa PA01
cuccagcggcagcucgg

SEQ ID NO: 3430947 - RNA, 19 nt, Pseudomonas aeruginosa PA01
cuccagcggcagcucggcg

SEQ ID NO: 3430948 - RNA, 20 nt, Pseudomonas aeruginosa PA01
cuccagcgggaaggucggca

SEQ ID NO: 3430949 - RNA, 19 nt, Pseudomonas aeruginosa PA01
cuccagcgggccuucgcca

SEQ ID NO: 3430950 - RNA, 18 nt, Pseudomonas aeruginosa PA01
cuccagcgggguggcgcg

SEQ ID NO: 3430951 - RNA, 17 nt, Pseudomonas aeruginosa PA01
cuccagcgucugccgcu

SEQ ID NO: 3430952 - RNA, 19 nt, Pseudomonas aeruginosa PA01
cuccagcgugcccgcugca

SEQ ID NO: 3430953 - RNA, 14 nt, Pseudomonas aeruginosa PA01
cuccagcucggcga

SEQ ID NO: 3430954 - RNA, 20 nt, Pseudomonas aeruginosa PA01
cuccagcugcgccugcagcu

SEQ ID NO: 3430955 - RNA, 16 nt, Pseudomonas aeruginosa PA01
cuccagcuucuucugc

SEQ ID NO: 3430956 - RNA, 14 nt, Pseudomonas aeruginosa PA01
cuccagcuugucgu

SEQ ID NO: 3430957 - RNA, 19 nt, Pseudomonas aeruginosa PA01
cuccagcuugucgucggcc

SEQ ID NO: 3430958 - RNA, 23 nt, Pseudomonas aeruginosa PA01
cuccaggaaccaggggucgacgc

SEQ ID NO: 3430959 - RNA, 21 nt, Pseudomonas aeruginosa PA01
cuccaggaauccuccgccagc

SEQ ID NO: 3430960 - RNA, 22 nt, Pseudomonas aeruginosa PA01
cuccaggaauccuccgccagcg

SEQ ID NO: 3430961 - RNA, 17 nt, Pseudomonas aeruginosa PA01
cuccaggaccaggaucg

SEQ ID NO: 3430962 - RNA, 14 nt, Pseudomonas aeruginosa PA01
cuccaggaccggca

SEQ ID NO: 3430963 - RNA, 14 nt, Pseudomonas aeruginosa PA01
cuccaggaucgccu

SEQ ID NO: 3430964 - RNA, 18 nt, Pseudomonas aeruginosa PA01
cuccaggccgaagccgcc

SEQ ID NO: 3430965 - RNA, 19 nt, Pseudomonas aeruginosa PA01
cuccaggccgccggcgacc

SEQ ID NO: 3430966 - RNA, 16 nt, Pseudomonas aeruginosa PA01
cuccaggcgaaggucg

SEQ ID NO: 3430967 - RNA, 21 nt, Pseudomonas aeruginosa PA01
cuccaggcgaaggucgaaggc

SEQ ID NO: 3430968 - RNA, 23 nt, Pseudomonas aeruginosa PA01
cuccaggcgaaggucgaaggcgc

SEQ ID NO: 3430969 - RNA, 14 nt, Pseudomonas aeruginosa PA01
cuccaggcgcgccg

SEQ ID NO: 3430970 - RNA, 14 nt, Pseudomonas aeruginosa PA01
cuccaggcgcgccu

SEQ ID NO: 3430971 - RNA, 20 nt, Pseudomonas aeruginosa PA01
cuccaggcgcgccuggauca

SEQ ID NO: 3430972 - RNA, 13 nt, Pseudomonas aeruginosa PA01
cuccaggcggcgg

SEQ ID NO: 3430973 - RNA, 23 nt, Pseudomonas aeruginosa PA01
cuccaggcggcgguagccgaggc

SEQ ID NO: 3430974 - RNA, 17 nt, Pseudomonas aeruginosa PA01
cuccaggcucagggucu

SEQ ID NO: 3430975 - RNA, 20 nt, Pseudomonas aeruginosa PA01
cuccaggcucuucagcacgc

SEQ ID NO: 3430976 - RNA, 14 nt, Pseudomonas aeruginosa PA01
cuccaggcuggccu

SEQ ID NO: 3430977 - RNA, 17 nt, Pseudomonas aeruginosa PA01
cuccaggcuggccuugg

SEQ ID NO: 3430978 - RNA, 16 nt, Pseudomonas aeruginosa PA01
cuccagggagcgcucg

SEQ ID NO: 3430979 - RNA, 20 nt, Pseudomonas aeruginosa PA01
cuccagggagcgcucgcgca

SEQ ID NO: 3430980 - RNA, 21 nt, Pseudomonas aeruginosa PA01
cuccagggagcgcucgcgcag

SEQ ID NO: 3430981 - RNA, 18 nt, Pseudomonas aeruginosa PA01
cuccagggcauccucgcg

SEQ ID NO: 3430982 - RNA, 12 nt, Pseudomonas aeruginosa PA01
cuccagggccag

SEQ ID NO: 3430983 - RNA, 22 nt, Pseudomonas aeruginosa PA01
cuccagggcgaauaccagugcc

SEQ ID NO: 3430984 - RNA, 23 nt, Pseudomonas aeruginosa PA01
cuccagggcgaauaccagugccg

SEQ ID NO: 3430985 - RNA, 20 nt, Pseudomonas aeruginosa PA01
cuccagggcgcugaccaggu

SEQ ID NO: 3430986 - RNA, 16 nt, Pseudomonas aeruginosa PA01
cuccagggcggcccgg

SEQ ID NO: 3430987 - RNA, 15 nt, Pseudomonas aeruginosa PA01
cuccaggggucggca

SEQ ID NO: 3430988 - RNA, 17 nt, Pseudomonas aeruginosa PA01
cuccaggggucggcauc

SEQ ID NO: 3430989 - RNA, 18 nt, Pseudomonas aeruginosa PA01
cuccaggggucggcaucg

SEQ ID NO: 3430990 - RNA, 17 nt, Pseudomonas aeruginosa PA01
cuccagguacagccgca

SEQ ID NO: 3430991 - RNA, 18 nt, Pseudomonas aeruginosa PA01
cuccagguacagccgcag

SEQ ID NO: 3430992 - RNA, 19 nt, Pseudomonas aeruginosa PA01
cuccagguacagccgcaga

SEQ ID NO: 3430993 - RNA, 20 nt, Pseudomonas aeruginosa PA01
cuccaggucgaacagcggcu

SEQ ID NO: 3430994 - RNA, 22 nt, Pseudomonas aeruginosa PA01
cuccaggucggucggcggcggu

SEQ ID NO: 3430995 - RNA, 15 nt, Pseudomonas aeruginosa PA01
cuccaggugcacggc

SEQ ID NO: 3430996 - RNA, 19 nt, Pseudomonas aeruginosa PA01
cuccaggugcacggccagg

SEQ ID NO: 3430997 - RNA, 13 nt, Pseudomonas aeruginosa PA01
cuccagguucggc

SEQ ID NO: 3430998 - RNA, 18 nt, Pseudomonas aeruginosa PA01
cuccagguucggcgccag

SEQ ID NO: 3430999 - RNA, 22 nt, Pseudomonas aeruginosa PA01
cuccagguucggcgccagcucg

SEQ ID NO: 3431000 - RNA, 23 nt, Pseudomonas aeruginosa PA01
cuccagguucggcgccagcucgg

SEQ ID NO: 3431001 - RNA, 20 nt, Pseudomonas aeruginosa PA01
cuccagucggggcaggcgca

SEQ ID NO: 3431002 - RNA, 17 nt, Pseudomonas aeruginosa PA01
cuccaguuccucgcgag

SEQ ID NO: 3431003 - RNA, 16 nt, Pseudomonas aeruginosa PA01
cuccaguucggcgaug

SEQ ID NO: 3431004 - RNA, 21 nt, Pseudomonas aeruginosa PA01
cuccauaguagagaugcaccg

SEQ ID NO: 3431005 - RNA, 12 nt, Pseudomonas aeruginosa PA01
cuccaucagcgc

SEQ ID NO: 3431006 - RNA, 14 nt, Pseudomonas aeruginosa PA01
cuccaucagcgccu

SEQ ID NO: 3431007 - RNA, 21 nt, Pseudomonas aeruginosa PA01
cuccauccagucuucgccggc

SEQ ID NO: 3431008 - RNA, 22 nt, Pseudomonas aeruginosa PA01
cuccauccagucuucgccggcc

SEQ ID NO: 3431009 - RNA, 16 nt, Pseudomonas aeruginosa PA01
cuccauccccccgcga

SEQ ID NO: 3431010 - RNA, 18 nt, Pseudomonas aeruginosa PA01
cuccaugaaacgguuggc

SEQ ID NO: 3431011 - RNA, 20 nt, Pseudomonas aeruginosa PA01
cuccaugcgggagagcgccg

SEQ ID NO: 3431012 - RNA, 20 nt, Pseudomonas aeruginosa PA01
cguugaggccgucgaagugg

SEQ ID NO: 3431013 - RNA, 15 nt, Pseudomonas aeruginosa PA01
cguugagggccuuga

SEQ ID NO: 3431014 - RNA, 19 nt, Pseudomonas aeruginosa PA01
cguugagggccuugagcac

SEQ ID NO: 3431015 - RNA, 17 nt, Pseudomonas aeruginosa PA01
cguugagggucagcgac

SEQ ID NO: 3431016 - RNA, 21 nt, Pseudomonas aeruginosa PA01
cguugaguucgaagcgccagg

SEQ ID NO: 3431017 - RNA, 23 nt, Pseudomonas aeruginosa PA01
cguugaguucgaagcgccaggcg

SEQ ID NO: 3431018 - RNA, 20 nt, Pseudomonas aeruginosa PA01
cguugaucacgaacagcuug

SEQ ID NO: 3431019 - RNA, 22 nt, Pseudomonas aeruginosa PA01
cguugaucacgaacagcuugcc

SEQ ID NO: 3431020 - RNA, 18 nt, Pseudomonas aeruginosa PA01
cguugauccgcguggcgu

SEQ ID NO: 3431021 - RNA, 20 nt, Pseudomonas aeruginosa PA01
cguugaucggcaacgagcag

SEQ ID NO: 3431022 - RNA, 13 nt, Pseudomonas aeruginosa PA01
cguugaucggcuu

SEQ ID NO: 3431023 - RNA, 20 nt, Pseudomonas aeruginosa PA01
cguugaucggcuugaaguga

SEQ ID NO: 3431024 - RNA, 22 nt, Pseudomonas aeruginosa PA01
cguugaugauacgcacgcuggu

SEQ ID NO: 3431025 - RNA, 14 nt, Pseudomonas aeruginosa PA01
cguugcacagcgcc

SEQ ID NO: 3431026 - RNA, 15 nt, Pseudomonas aeruginosa PA01
cguugcacgcaggcc

SEQ ID NO: 3431027 - RNA, 22 nt, Pseudomonas aeruginosa PA01
cguugcacguacuuuggucgag

SEQ ID NO: 3431028 - RNA, 22 nt, Pseudomonas aeruginosa PA01
cguugcagcgccuguuccaggg

SEQ ID NO: 3431029 - RNA, 14 nt, Pseudomonas aeruginosa PA01
cguugcagcgucug

SEQ ID NO: 3431030 - RNA, 13 nt, Pseudomonas aeruginosa PA01
cguugcaggccca

SEQ ID NO: 3431031 - RNA, 15 nt, Pseudomonas aeruginosa PA01
cguugcaggcccagc

SEQ ID NO: 3431032 - RNA, 23 nt, Pseudomonas aeruginosa PA01
cguugcaggcccagcuucuuggc

SEQ ID NO: 3431033 - RNA, 17 nt, Pseudomonas aeruginosa PA01
cguugcaguccaggccg

SEQ ID NO: 3431034 - RNA, 18 nt, Pseudomonas aeruginosa PA01
cguugcaguccaggccgu

SEQ ID NO: 3431035 - RNA, 17 nt, Pseudomonas aeruginosa PA01
cguugcagugcgccgca

SEQ ID NO: 3431036 - RNA, 18 nt, Pseudomonas aeruginosa PA01
cguugcagugcgccgcag

SEQ ID NO: 3431037 - RNA, 17 nt, Pseudomonas aeruginosa PA01
cguugcauguccucggc

SEQ ID NO: 3431038 - RNA, 13 nt, Pseudomonas aeruginosa PA01
cguugccagccgg

SEQ ID NO: 3431039 - RNA, 15 nt, Pseudomonas aeruginosa PA01
cguugccagccggcc

SEQ ID NO: 3431040 - RNA, 16 nt, Pseudomonas aeruginosa PA01
cguugccauagccgac

SEQ ID NO: 3431041 - RNA, 18 nt, Pseudomonas aeruginosa PA01
cguugccauccagcgccu

SEQ ID NO: 3431042 - RNA, 20 nt, Pseudomonas aeruginosa PA01
cguugccauccagcgccugg

SEQ ID NO: 3431043 - RNA, 23 nt, Pseudomonas aeruginosa PA01
cguugcccaccgaauccuugauc

SEQ ID NO: 3431044 - RNA, 14 nt, Pseudomonas aeruginosa PA01
cguugcccagcccc

SEQ ID NO: 3431045 - RNA, 16 nt, Pseudomonas aeruginosa PA01
cguugcccggcuugcc

SEQ ID NO: 3431046 - RNA, 17 nt, Pseudomonas aeruginosa PA01
cguugccgaccgagcag

SEQ ID NO: 3431047 - RNA, 18 nt, Pseudomonas aeruginosa PA01
cguugccgaccgagcagc

SEQ ID NO: 3431048 - RNA, 19 nt, Pseudomonas aeruginosa PA01
cguugccgaccgagcagcg

SEQ ID NO: 3431049 - RNA, 20 nt, Pseudomonas aeruginosa PA01
cguugccgaccgagcagcgg

SEQ ID NO: 3431050 - RNA, 12 nt, Pseudomonas aeruginosa PA01
cguugccgaugg

SEQ ID NO: 3431051 - RNA, 12 nt, Pseudomonas aeruginosa PA01
cguugccgcgcg

SEQ ID NO: 3431052 - RNA, 13 nt, Pseudomonas aeruginosa PA01
cguugccgcgcuc

SEQ ID NO: 3431053 - RNA, 19 nt, Pseudomonas aeruginosa PA01
cguugccggacuuccuugc

SEQ ID NO: 3431054 - RNA, 12 nt, Pseudomonas aeruginosa PA01
cguugccggcau

SEQ ID NO: 3431055 - RNA, 18 nt, Pseudomonas aeruginosa PA01
cguugccgguacucgccg

SEQ ID NO: 3431056 - RNA, 19 nt, Pseudomonas aeruginosa PA01
cguugccgguacucgccgg

SEQ ID NO: 3431057 - RNA, 20 nt, Pseudomonas aeruginosa PA01
cguugccgguacucgccggg

SEQ ID NO: 3431058 - RNA, 20 nt, Pseudomonas aeruginosa PA01
cguugccuucgccgucgagc

SEQ ID NO: 3431059 - RNA, 18 nt, Pseudomonas aeruginosa PA01
cguugcgagggcucgggc

SEQ ID NO: 3431060 - RNA, 14 nt, Pseudomonas aeruginosa PA01
cguugcgcagcacc

SEQ ID NO: 3431061 - RNA, 12 nt, Pseudomonas aeruginosa PA01
cguugcgcaggc

SEQ ID NO: 3431062 - RNA, 18 nt, Pseudomonas aeruginosa PA01
cguugcgcaggggcgcgg

SEQ ID NO: 3431063 - RNA, 14 nt, Pseudomonas aeruginosa PA01
cguugcgccagacc

SEQ ID NO: 3431064 - RNA, 15 nt, Pseudomonas aeruginosa PA01
cguugcgccagacca

SEQ ID NO: 3431065 - RNA, 20 nt, Pseudomonas aeruginosa PA01
cguugcgccagaccagcccc

SEQ ID NO: 3431066 - RNA, 12 nt, Pseudomonas aeruginosa PA01
cguugcgccccg

SEQ ID NO: 3431067 - RNA, 13 nt, Pseudomonas aeruginosa PA01
cguugcgccccgg

SEQ ID NO: 3431068 - RNA, 14 nt, Pseudomonas aeruginosa PA01
cguugcgccccggg

SEQ ID NO: 3431069 - RNA, 16 nt, Pseudomonas aeruginosa PA01
cguugcgccgcagcaa

SEQ ID NO: 3431070 - RNA, 17 nt, Pseudomonas aeruginosa PA01
cguugcgccgcagcaag

SEQ ID NO: 3431071 - RNA, 18 nt, Pseudomonas aeruginosa PA01
cguugcgccggcccagca

SEQ ID NO: 3431072 - RNA, 19 nt, Pseudomonas aeruginosa PA01
cguugcgccggcccagcag

SEQ ID NO: 3431073 - RNA, 22 nt, Pseudomonas aeruginosa PA01
cguugcgccggcccagcaggcc

SEQ ID NO: 3431074 - RNA, 16 nt, Pseudomonas aeruginosa PA01
cguugcgccucgccgc

SEQ ID NO: 3431075 - RNA, 15 nt, Pseudomonas aeruginosa PA01
cguugcgccugcuuc

SEQ ID NO: 3431076 - RNA, 18 nt, Pseudomonas aeruginosa PA01
cguugcgcgagcaccgcg

SEQ ID NO: 3431077 - RNA, 22 nt, Pseudomonas aeruginosa PA01
cguugcgcgagcaccgcgcaga

SEQ ID NO: 3431078 - RNA, 23 nt, Pseudomonas aeruginosa PA01
cguugcgcgagcaccgcgcagac

SEQ ID NO: 3431079 - RNA, 18 nt, Pseudomonas aeruginosa PA01
cguugcgcgcauagcagg

SEQ ID NO: 3431080 - RNA, 19 nt, Pseudomonas aeruginosa PA01
cguugcgcgccagcgccac

SEQ ID NO: 3431081 - RNA, 22 nt, Pseudomonas aeruginosa PA01
cguugcgcgccagcgccacggc

SEQ ID NO: 3431082 - RNA, 20 nt, Pseudomonas aeruginosa PA01
cguugcgcgccucgccccag

SEQ ID NO: 3431083 - RNA, 20 nt, Pseudomonas aeruginosa PA01
cguugcgcggaauccuucgc

SEQ ID NO: 3431084 - RNA, 14 nt, Pseudomonas aeruginosa PA01
cguugcgcggcagg

SEQ ID NO: 3431085 - RNA, 16 nt, Pseudomonas aeruginosa PA01
cguugcgcggcaggug

SEQ ID NO: 3431086 - RNA, 17 nt, Pseudomonas aeruginosa PA01
cguugcgcuaucggccc

SEQ ID NO: 3431087 - RNA, 14 nt, Pseudomonas aeruginosa PA01
cguugcggaaagcg

SEQ ID NO: 3431088 - RNA, 14 nt, Pseudomonas aeruginosa PA01
cguugcggaacgcg

SEQ ID NO: 3431089 - RNA, 19 nt, Pseudomonas aeruginosa PA01
cguugcgguagugcccggu

SEQ ID NO: 3431090 - RNA, 16 nt, Pseudomonas aeruginosa PA01
cguugcuccugcggcu

SEQ ID NO: 3431091 - RNA, 22 nt, Pseudomonas aeruginosa PA01
cguugcuccugcggcuggcgaa

SEQ ID NO: 3431092 - RNA, 16 nt, Pseudomonas aeruginosa PA01
cguugcucgcaccagg

SEQ ID NO: 3431093 - RNA, 15 nt, Pseudomonas aeruginosa PA01
cguugcugcccuggc

SEQ ID NO: 3431094 - RNA, 20 nt, Pseudomonas aeruginosa PA01
cguugcugugcugcaccagc

SEQ ID NO: 3431095 - RNA, 14 nt, Pseudomonas aeruginosa PA01
cguugcuuccaggc

SEQ ID NO: 3431096 - RNA, 17 nt, Pseudomonas aeruginosa PA01
cguuggaguaggggcag

SEQ ID NO: 3431097 - RNA, 22 nt, Pseudomonas aeruginosa PA01
cguuggaucaccgggguguguu

SEQ ID NO: 3431098 - RNA, 14 nt, Pseudomonas aeruginosa PA01
cguuggccagcagg

SEQ ID NO: 3431099 - RNA, 18 nt, Pseudomonas aeruginosa PA01
cguuggccagcaggcgcc

SEQ ID NO: 3431100 - RNA, 22 nt, Pseudomonas aeruginosa PA01
cguuggccagcaggcgccgcgc

SEQ ID NO: 3431101 - RNA, 14 nt, Pseudomonas aeruginosa PA01
cguuggccagcgcc

SEQ ID NO: 3431102 - RNA, 15 nt, Pseudomonas aeruginosa PA01
cguuggccagcgcca

SEQ ID NO: 3431103 - RNA, 22 nt, Pseudomonas aeruginosa PA01
cguuggccagcgccaccagcag

SEQ ID NO: 3431104 - RNA, 23 nt, Pseudomonas aeruginosa PA01
cguuggccagcgccaccagcagg

SEQ ID NO: 3431105 - RNA, 14 nt, Pseudomonas aeruginosa PA01
cguuggccaggcgc

SEQ ID NO: 3431106 - RNA, 14 nt, Pseudomonas aeruginosa PA01
cguuggcccagacc

SEQ ID NO: 3431107 - RNA, 15 nt, Pseudomonas aeruginosa PA01
cguuggcccagaccu

SEQ ID NO: 3431108 - RNA, 18 nt, Pseudomonas aeruginosa PA01
cguuggccgagcgcgagu

SEQ ID NO: 3431109 - RNA, 17 nt, Pseudomonas aeruginosa PA01
cguuggccggcugcucc

SEQ ID NO: 3431110 - RNA, 23 nt, Pseudomonas aeruginosa PA01
cguuggccgggguauccgggcac

SEQ ID NO: 3431111 - RNA, 20 nt, Pseudomonas aeruginosa PA01
cguuggccgucuccaggcgc

SEQ ID NO: 3431112 - RNA, 19 nt, Pseudomonas aeruginosa PA01
cguuggcgaacuucaggcc

SEQ ID NO: 3431113 - RNA, 23 nt, Pseudomonas aeruginosa PA01
cguuggcgaacuucaggccggcg

SEQ ID NO: 3431114 - RNA, 15 nt, Pseudomonas aeruginosa PA01
cguuggcgcgaccgc

SEQ ID NO: 3431115 - RNA, 23 nt, Pseudomonas aeruginosa PA01
cguuggcgcgaccgcccgccuca

SEQ ID NO: 3431116 - RNA, 14 nt, Pseudomonas aeruginosa PA01
cguuggcggccagc

SEQ ID NO: 3431117 - RNA, 13 nt, Pseudomonas aeruginosa PA01
cguuggcggccau

SEQ ID NO: 3431118 - RNA, 14 nt, Pseudomonas aeruginosa PA01
cguuggcggccauc

SEQ ID NO: 3431119 - RNA, 20 nt, Pseudomonas aeruginosa PA01
cguuggcggccaucaggcgc

SEQ ID NO: 3431120 - RNA, 16 nt, Pseudomonas aeruginosa PA01
cguuggcggugccgca

SEQ ID NO: 3431121 - RNA, 17 nt, Pseudomonas aeruginosa PA01
cguuggcggugccgcag

SEQ ID NO: 3431122 - RNA, 20 nt, Pseudomonas aeruginosa PA01
cguuggcgucaacggugacg

SEQ ID NO: 3431123 - RNA, 18 nt, Pseudomonas aeruginosa PA01
cguuggcgugcucgcgca

SEQ ID NO: 3431124 - RNA, 19 nt, Pseudomonas aeruginosa PA01
cguuggcgugcucgcgcau

SEQ ID NO: 3431125 - RNA, 16 nt, Pseudomonas aeruginosa PA01
cguuggcuccgggccg

SEQ ID NO: 3431126 - RNA, 15 nt, Pseudomonas aeruginosa PA01
cguugggccagggcc

SEQ ID NO: 3431127 - RNA, 18 nt, Pseudomonas aeruginosa PA01
cguugggccucgcugcgc

SEQ ID NO: 3431128 - RNA, 15 nt, Pseudomonas aeruginosa PA01
cguuguacuggccga

SEQ ID NO: 3431129 - RNA, 17 nt, Pseudomonas aeruginosa PA01
cguuguagaucggcagc

SEQ ID NO: 3431130 - RNA, 18 nt, Pseudomonas aeruginosa PA01
cguuguagaucggcagca

SEQ ID NO: 3431131 - RNA, 20 nt, Pseudomonas aeruginosa PA01
cguuguagaucugcaccgcc

SEQ ID NO: 3431132 - RNA, 19 nt, Pseudomonas aeruginosa PA01
cguuguagcguucggcgac

SEQ ID NO: 3431133 - RNA, 12 nt, Pseudomonas aeruginosa PA01
cguuguccaggg

SEQ ID NO: 3431134 - RNA, 21 nt, Pseudomonas aeruginosa PA01
cguugucccugucccgccgcg

SEQ ID NO: 3431135 - RNA, 22 nt, Pseudomonas aeruginosa PA01
cguugucccugucccgccgcgc

SEQ ID NO: 3431136 - RNA, 23 nt, Pseudomonas aeruginosa PA01
cguugucccugucccgccgcgcc

SEQ ID NO: 3431137 - RNA, 14 nt, Pseudomonas aeruginosa PA01
cguuguccucggcg

SEQ ID NO: 3431138 - RNA, 15 nt, Pseudomonas aeruginosa PA01
cguuguccucggcgg

SEQ ID NO: 3431139 - RNA, 21 nt, Pseudomonas aeruginosa PA01
cguugucggccagcagcaugg

SEQ ID NO: 3431140 - RNA, 23 nt, Pseudomonas aeruginosa PA01
cguugucugggaguuccgcgcaa

SEQ ID NO: 3431141 - RNA, 21 nt, Pseudomonas aeruginosa PA01
cguugugauuggguuccucua

SEQ ID NO: 3431142 - RNA, 19 nt, Pseudomonas aeruginosa PA01
cguugugcagguacggcgc

SEQ ID NO: 3431143 - RNA, 18 nt, Pseudomonas aeruginosa PA01
cguuguguagucauggcc

SEQ ID NO: 3431144 - RNA, 22 nt, Pseudomonas aeruginosa PA01
cguuguucuucgacgcugguca

SEQ ID NO: 3431145 - RNA, 13 nt, Pseudomonas aeruginosa PA01
cguuguugccgcg

SEQ ID NO: 3431146 - RNA, 16 nt, Pseudomonas aeruginosa PA01
cguuguugccgcgcac

SEQ ID NO: 3431147 - RNA, 16 nt, Pseudomonas aeruginosa PA01
cguuguuggucaggcu

SEQ ID NO: 3431148 - RNA, 21 nt, Pseudomonas aeruginosa PA01
cguuguuggucaggcugcgca

SEQ ID NO: 3431149 - RNA, 16 nt, Pseudomonas aeruginosa PA01
cguuuagcgcccgacg

SEQ ID NO: 3431150 - RNA, 18 nt, Pseudomonas aeruginosa PA01
cguuuagcgcccgacggc

SEQ ID NO: 3431151 - RNA, 13 nt, Pseudomonas aeruginosa PA01
cguuucagcgcca

SEQ ID NO: 3431152 - RNA, 13 nt, Pseudomonas aeruginosa PA01
cguuuccagcggc

SEQ ID NO: 3431153 - RNA, 13 nt, Pseudomonas aeruginosa PA01
cguuuccggcagg

SEQ ID NO: 3431154 - RNA, 17 nt, Pseudomonas aeruginosa PA01
cguuuccggcaggcuca

SEQ ID NO: 3431155 - RNA, 15 nt, Pseudomonas aeruginosa PA01
cguuucgccgggccu

SEQ ID NO: 3431156 - RNA, 13 nt, Pseudomonas aeruginosa PA01
cguuucucagcgc

SEQ ID NO: 3431157 - RNA, 16 nt, Pseudomonas aeruginosa PA01
cguuucucagcgccgu

SEQ ID NO: 3431158 - RNA, 21 nt, Pseudomonas aeruginosa PA01
cguuucugcggaucgaucagc

SEQ ID NO: 3431159 - RNA, 16 nt, Pseudomonas aeruginosa PA01
cguuugccgucggcgc

SEQ ID NO: 3431160 - RNA, 17 nt, Pseudomonas aeruginosa PA01
cguuugccgucggcgcg

SEQ ID NO: 3431161 - RNA, 22 nt, Pseudomonas aeruginosa PA01
cguuuucaggcgacgccgcgcu

SEQ ID NO: 3431162 - RNA, 15 nt, Pseudomonas aeruginosa PA01
cguuuucccaggugg

SEQ ID NO: 3431163 - RNA, 18 nt, Pseudomonas aeruginosa PA01
cguuuucguugccgcgcu

SEQ ID NO: 3431164 - RNA, 20 nt, Pseudomonas aeruginosa PA01
cguuuucguuggcgcgaccg

SEQ ID NO: 3431165 - RNA, 17 nt, Pseudomonas aeruginosa PA01
cguuuucuuuugcaauc

SEQ ID NO: 3431166 - RNA, 12 nt, Pseudomonas aeruginosa PA01
cguuuugccgcu

SEQ ID NO: 3431167 - RNA, 17 nt, Pseudomonas aeruginosa PA01
cguuuuucguuucaggu

SEQ ID NO: 3431168 - RNA, 15 nt, Pseudomonas aeruginosa PA01
cguuuuuucuuucca

SEQ ID NO: 3431169 - RNA, 14 nt, Pseudomonas aeruginosa PA01
cguuuuuuuauccu

SEQ ID NO: 3431170 - RNA, 20 nt, Pseudomonas aeruginosa PA01
cguuuuuuuauccucgcgga

SEQ ID NO: 3431171 - RNA, 14 nt, Pseudomonas aeruginosa PA01
cuaaacaagccacc

SEQ ID NO: 3431172 - RNA, 17 nt, Pseudomonas aeruginosa PA01
cuaaacaagccaccuuc

SEQ ID NO: 3431173 - RNA, 16 nt, Pseudomonas aeruginosa PA01
cuaaaugccauuuuuu

SEQ ID NO: 3431174 - RNA, 18 nt, Pseudomonas aeruginosa PA01
cuaacaggucaacaagaa

SEQ ID NO: 3431175 - RNA, 19 nt, Pseudomonas aeruginosa PA01
cuaacaggucaacaagaau

SEQ ID NO: 3431176 - RNA, 17 nt, Pseudomonas aeruginosa PA01
cuaaccggcguccgggu

SEQ ID NO: 3431177 - RNA, 20 nt, Pseudomonas aeruginosa PA01
cuaaggggcggcucggcucc

SEQ ID NO: 3431178 - RNA, 22 nt, Pseudomonas aeruginosa PA01
cuaaggggcggcucggcuccag

SEQ ID NO: 3431179 - RNA, 18 nt, Pseudomonas aeruginosa PA01
cuaaguagauaaaugccc

SEQ ID NO: 3431180 - RNA, 21 nt, Pseudomonas aeruginosa PA01
cuaaguagauaaaugcccggg

SEQ ID NO: 3431181 - RNA, 17 nt, Pseudomonas aeruginosa PA01
cuaauggcaccuggaua

SEQ ID NO: 3431182 - RNA, 20 nt, Pseudomonas aeruginosa PA01
cuaauuucaugucugcaacc

SEQ ID NO: 3431183 - RNA, 15 nt, Pseudomonas aeruginosa PA01
cuacaaugauggccc

SEQ ID NO: 3431184 - RNA, 19 nt, Pseudomonas aeruginosa PA01
cuacagcccccccagcacg

SEQ ID NO: 3431185 - RNA, 20 nt, Pseudomonas aeruginosa PA01
cuaccaccaccauuuccagc

SEQ ID NO: 3431186 - RNA, 16 nt, Pseudomonas aeruginosa PA01
cuaccagaccgcagcc

SEQ ID NO: 3431187 - RNA, 12 nt, Pseudomonas aeruginosa PA01
cuaccagcaauu

SEQ ID NO: 3431188 - RNA, 18 nt, Pseudomonas aeruginosa PA01
cuaccagcgcuucggcgg

SEQ ID NO: 3431189 - RNA, 23 nt, Pseudomonas aeruginosa PA01
cuaccaggcgguuggcccgcgcc

SEQ ID NO: 3431190 - RNA, 16 nt, Pseudomonas aeruginosa PA01
cuaccauuagaggaac

SEQ ID NO: 3431191 - RNA, 22 nt, Pseudomonas aeruginosa PA01
cuaccauuagaggaacccaauc

SEQ ID NO: 3431192 - RNA, 13 nt, Pseudomonas aeruginosa PA01
cuaccccacgcga

SEQ ID NO: 3431193 - RNA, 15 nt, Pseudomonas aeruginosa PA01
cuaccccaggggucg

SEQ ID NO: 3431194 - RNA, 18 nt, Pseudomonas aeruginosa PA01
cuaccccaggggucggca

SEQ ID NO: 3431195 - RNA, 20 nt, Pseudomonas aeruginosa PA01
cuacccgacaggcagcgccg

SEQ ID NO: 3431196 - RNA, 21 nt, Pseudomonas aeruginosa PA01
cuacccgacaggcagcgccgc

SEQ ID NO: 3431197 - RNA, 20 nt, Pseudomonas aeruginosa PA01
cuacccgagcaacugcucgg

SEQ ID NO: 3431198 - RNA, 23 nt, Pseudomonas aeruginosa PA01
cuacccgagcaacugcucgggcg

SEQ ID NO: 3431199 - RNA, 20 nt, Pseudomonas aeruginosa PA01
cuacccucuccccaaccuuc

SEQ ID NO: 3431200 - RNA, 22 nt, Pseudomonas aeruginosa PA01
cuacccugccccagcaucgccg

SEQ ID NO: 3431201 - RNA, 15 nt, Pseudomonas aeruginosa PA01
cuaccgcaucgccac

SEQ ID NO: 3431202 - RNA, 14 nt, Pseudomonas aeruginosa PA01
cuaccgccagcgca

SEQ ID NO: 3431203 - RNA, 14 nt, Pseudomonas aeruginosa PA01
cuaccgcccacccu

SEQ ID NO: 3431204 - RNA, 20 nt, Pseudomonas aeruginosa PA01
cuaccgcccacccugcgcga

SEQ ID NO: 3431205 - RNA, 16 nt, Pseudomonas aeruginosa PA01
cuaccgccgagggcgc

SEQ ID NO: 3431206 - RNA, 19 nt, Pseudomonas aeruginosa PA01
cuaccgccgagggcgccag

SEQ ID NO: 3431207 - RNA, 23 nt, Pseudomonas aeruginosa PA01
cuaccgcgcauggcggcgaccgc

SEQ ID NO: 3431208 - RNA, 12 nt, Pseudomonas aeruginosa PA01
cuaccggcaagg

SEQ ID NO: 3431209 - RNA, 13 nt, Pseudomonas aeruginosa PA01
cuaccggcaaggc

SEQ ID NO: 3431210 - RNA, 23 nt, Pseudomonas aeruginosa PA01
cuaccggggcgcgggcgaagcgc

SEQ ID NO: 3431211 - RNA, 16 nt, Pseudomonas aeruginosa PA01
cuaccgucggccugca

SEQ ID NO: 3431212 - RNA, 22 nt, Pseudomonas aeruginosa PA01
cuaccuggggauggccggcgcg

SEQ ID NO: 3431213 - RNA, 15 nt, Pseudomonas aeruginosa PA01
cuacgaaagcgccuu

SEQ ID NO: 3431214 - RNA, 16 nt, Pseudomonas aeruginosa PA01
cuacgaaagcgccuuc

SEQ ID NO: 3431215 - RNA, 15 nt, Pseudomonas aeruginosa PA01
cuacgaaagcggugc

SEQ ID NO: 3431216 - RNA, 23 nt, Pseudomonas aeruginosa PA01
cuacgaaggcauauccccucuca

SEQ ID NO: 3431217 - RNA, 19 nt, Pseudomonas aeruginosa PA01
cuacgcaacccgcccggcu

SEQ ID NO: 3431218 - RNA, 17 nt, Pseudomonas aeruginosa PA01
cguggaaaccucgccga

SEQ ID NO: 3431219 - RNA, 18 nt, Pseudomonas aeruginosa PA01
cguggaaccgauggccag

SEQ ID NO: 3431220 - RNA, 20 nt, Pseudomonas aeruginosa PA01
cguggacauacaggcgcgcc

SEQ ID NO: 3431221 - RNA, 21 nt, Pseudomonas aeruginosa PA01
cguggacauacaggcgcgccu

SEQ ID NO: 3431222 - RNA, 14 nt, Pseudomonas aeruginosa PA01
cguggaccaacagc

SEQ ID NO: 3431223 - RNA, 21 nt, Pseudomonas aeruginosa PA01
cguggaccaacagccggcggg

SEQ ID NO: 3431224 - RNA, 12 nt, Pseudomonas aeruginosa PA01
cguggacgccgg

SEQ ID NO: 3431225 - RNA, 19 nt, Pseudomonas aeruginosa PA01
cguggagaggucgccgaca

SEQ ID NO: 3431226 - RNA, 20 nt, Pseudomonas aeruginosa PA01
cguggagaggucgccgacac

SEQ ID NO: 3431227 - RNA, 15 nt, Pseudomonas aeruginosa PA01
cguggauauugugcg

SEQ ID NO: 3431228 - RNA, 15 nt, Pseudomonas aeruginosa PA01
cguggaucgcccggc

SEQ ID NO: 3431229 - RNA, 15 nt, Pseudomonas aeruginosa PA01
cguggaugucgagga

SEQ ID NO: 3431230 - RNA, 14 nt, Pseudomonas aeruginosa PA01
cguggauuucagca

SEQ ID NO: 3431231 - RNA, 17 nt, Pseudomonas aeruginosa PA01
cguggauuucagcaggc

SEQ ID NO: 3431232 - RNA, 21 nt, Pseudomonas aeruginosa PA01
cguggauuucagcaggccgag

SEQ ID NO: 3431233 - RNA, 22 nt, Pseudomonas aeruginosa PA01
cguggcaaaaaugcccuuggcu

SEQ ID NO: 3431234 - RNA, 16 nt, Pseudomonas aeruginosa PA01
cguggcaccaggucgu

SEQ ID NO: 3431235 - RNA, 19 nt, Pseudomonas aeruginosa PA01
cguggcacccaggccacgc

SEQ ID NO: 3431236 - RNA, 12 nt, Pseudomonas aeruginosa PA01
cguggcaggcgc

SEQ ID NO: 3431237 - RNA, 17 nt, Pseudomonas aeruginosa PA01
cguggcaggcgcccggu

SEQ ID NO: 3431238 - RNA, 22 nt, Pseudomonas aeruginosa PA01
cguggcaggcgcccggucaggu

SEQ ID NO: 3431239 - RNA, 19 nt, Pseudomonas aeruginosa PA01
cguggcauucgucgccgcu

SEQ ID NO: 3431240 - RNA, 14 nt, Pseudomonas aeruginosa PA01
cguggccagcgaac

SEQ ID NO: 3431241 - RNA, 23 nt, Pseudomonas aeruginosa PA01
cguggccagcgaacccaggccgc

SEQ ID NO: 3431242 - RNA, 14 nt, Pseudomonas aeruginosa PA01
cguggccagcgccc

SEQ ID NO: 3431243 - RNA, 18 nt, Pseudomonas aeruginosa PA01
cguggccagcgcccaggc

SEQ ID NO: 3431244 - RNA, 21 nt, Pseudomonas aeruginosa PA01
cguggccauagagccgcuggg

SEQ ID NO: 3431245 - RNA, 23 nt, Pseudomonas aeruginosa PA01
cguggccauagagccgcuggguu

SEQ ID NO: 3431246 - RNA, 17 nt, Pseudomonas aeruginosa PA01
cguggccauggguaucg

SEQ ID NO: 3431247 - RNA, 23 nt, Pseudomonas aeruginosa PA01
cguggcccggcgcggcggccgcc

SEQ ID NO: 3431248 - RNA, 19 nt, Pseudomonas aeruginosa PA01
cguggccgcccaucgaggu

SEQ ID NO: 3431249 - RNA, 19 nt, Pseudomonas aeruginosa PA01
cguggccgcgggaggccgc

SEQ ID NO: 3431250 - RNA, 22 nt, Pseudomonas aeruginosa PA01
cguggccgcgggaggccgccuc

SEQ ID NO: 3431251 - RNA, 12 nt, Pseudomonas aeruginosa PA01
cguggccggcga

SEQ ID NO: 3431252 - RNA, 14 nt, Pseudomonas aeruginosa PA01
cguggccggcgagg

SEQ ID NO: 3431253 - RNA, 12 nt, Pseudomonas aeruginosa PA01
cguggccggcgc

SEQ ID NO: 3431254 - RNA, 19 nt, Pseudomonas aeruginosa PA01
cguggcgaacgcccggcuu

SEQ ID NO: 3431255 - RNA, 18 nt, Pseudomonas aeruginosa PA01
cguggcgacgcagcacgg

SEQ ID NO: 3431256 - RNA, 18 nt, Pseudomonas aeruginosa PA01
cguggcgaucaggcagcg

SEQ ID NO: 3431257 - RNA, 23 nt, Pseudomonas aeruginosa PA01
cguggcgaucaggcagcgcgcgg

SEQ ID NO: 3431258 - RNA, 18 nt, Pseudomonas aeruginosa PA01
cguggcgccggcgcgcuu

SEQ ID NO: 3431259 - RNA, 14 nt, Pseudomonas aeruginosa PA01
cguggcgcgaaucc

SEQ ID NO: 3431260 - RNA, 23 nt, Pseudomonas aeruginosa PA01
cguggcgcgcaucggugccggca

SEQ ID NO: 3431261 - RNA, 22 nt, Pseudomonas aeruginosa PA01
cguggcgcggacgggccgcgcc

SEQ ID NO: 3431262 - RNA, 20 nt, Pseudomonas aeruginosa PA01
cguggcgcuacgcucgccga

SEQ ID NO: 3431263 - RNA, 18 nt, Pseudomonas aeruginosa PA01
cguggcgcuugagcagcc

SEQ ID NO: 3431264 - RNA, 21 nt, Pseudomonas aeruginosa PA01
cguggcgcuugagcagccagg

SEQ ID NO: 3431265 - RNA, 20 nt, Pseudomonas aeruginosa PA01
cguggcggacaacccggcgc

SEQ ID NO: 3431266 - RNA, 21 nt, Pseudomonas aeruginosa PA01
cguggcggacaacccggcgcu

SEQ ID NO: 3431267 - RNA, 23 nt, Pseudomonas aeruginosa PA01
cguggcggacaacccggcgcugg

SEQ ID NO: 3431268 - RNA, 13 nt, Pseudomonas aeruginosa PA01
cguggcggccgcc

SEQ ID NO: 3431269 - RNA, 14 nt, Pseudomonas aeruginosa PA01
cguggcggccgccg

SEQ ID NO: 3431270 - RNA, 20 nt, Pseudomonas aeruginosa PA01
cguggcggccgccgcgcagc

SEQ ID NO: 3431271 - RNA, 15 nt, Pseudomonas aeruginosa PA01
cguggcggccgccgg

SEQ ID NO: 3431272 - RNA, 17 nt, Pseudomonas aeruginosa PA01
cguggcggccgccggcg

SEQ ID NO: 3431273 - RNA, 18 nt, Pseudomonas aeruginosa PA01
cguggcggccgccggcgc

SEQ ID NO: 3431274 - RNA, 15 nt, Pseudomonas aeruginosa PA01
cguggcgggccagca

SEQ ID NO: 3431275 - RNA, 17 nt, Pseudomonas aeruginosa PA01
cguggcgggccagcagg

SEQ ID NO: 3431276 - RNA, 18 nt, Pseudomonas aeruginosa PA01
cguggcgggccagcaggc

SEQ ID NO: 3431277 - RNA, 20 nt, Pseudomonas aeruginosa PA01
cguggcgggccagcaggcgc

SEQ ID NO: 3431278 - RNA, 21 nt, Pseudomonas aeruginosa PA01
cguggcgggccagcaggcgcu

SEQ ID NO: 3431279 - RNA, 15 nt, Pseudomonas aeruginosa PA01
cguggcgggccaugc

SEQ ID NO: 3431280 - RNA, 19 nt, Pseudomonas aeruginosa PA01
cguggcgguacuccggguu

SEQ ID NO: 3431281 - RNA, 16 nt, Pseudomonas aeruginosa PA01
cguggcgugcucggcg

SEQ ID NO: 3431282 - RNA, 17 nt, Pseudomonas aeruginosa PA01
cguggcgugcucggcga

SEQ ID NO: 3431283 - RNA, 16 nt, Pseudomonas aeruginosa PA01
cguggcguucucgugu

SEQ ID NO: 3431284 - RNA, 17 nt, Pseudomonas aeruginosa PA01
cguggcucgaucagccg

SEQ ID NO: 3431285 - RNA, 18 nt, Pseudomonas aeruginosa PA01
cguggcucgaucagccgg

SEQ ID NO: 3431286 - RNA, 22 nt, Pseudomonas aeruginosa PA01
cguggcucgaucagccggcgcg

SEQ ID NO: 3431287 - RNA, 23 nt, Pseudomonas aeruginosa PA01
cguggcucgaucagccggcgcgc

SEQ ID NO: 3431288 - RNA, 14 nt, Pseudomonas aeruginosa PA01
cguggcucggcggc

SEQ ID NO: 3431289 - RNA, 15 nt, Pseudomonas aeruginosa PA01
cguggcucggcggca

SEQ ID NO: 3431290 - RNA, 17 nt, Pseudomonas aeruginosa PA01
cguggcucggcggcagg

SEQ ID NO: 3431291 - RNA, 18 nt, Pseudomonas aeruginosa PA01
cguggcucggcggcaggc

SEQ ID NO: 3431292 - RNA, 17 nt, Pseudomonas aeruginosa PA01
cguggcuggggccggcc

SEQ ID NO: 3431293 - RNA, 15 nt, Pseudomonas aeruginosa PA01
cguggcugugcuggc

SEQ ID NO: 3431294 - RNA, 16 nt, Pseudomonas aeruginosa PA01
cguggcugugcuggcc

SEQ ID NO: 3431295 - RNA, 18 nt, Pseudomonas aeruginosa PA01
cguggcugugcuggccac

SEQ ID NO: 3431296 - RNA, 19 nt, Pseudomonas aeruginosa PA01
cguggcugugcuggccacc

SEQ ID NO: 3431297 - RNA, 22 nt, Pseudomonas aeruginosa PA01
cguggcugugcuggccacccuu

SEQ ID NO: 3431298 - RNA, 18 nt, Pseudomonas aeruginosa PA01
cguggcuucguccagcga

SEQ ID NO: 3431299 - RNA, 13 nt, Pseudomonas aeruginosa PA01
cguggcuuggccc

SEQ ID NO: 3431300 - RNA, 19 nt, Pseudomonas aeruginosa PA01
cguggcuuggcccugcgcg

SEQ ID NO: 3431301 - RNA, 20 nt, Pseudomonas aeruginosa PA01
cguggcuuggcccugcgcgc

SEQ ID NO: 3431302 - RNA, 22 nt, Pseudomonas aeruginosa PA01
cguggcuuggcccugcgcgcgc

SEQ ID NO: 3431303 - RNA, 17 nt, Pseudomonas aeruginosa PA01
cgugggaaaucaccgcc

SEQ ID NO: 3431304 - RNA, 20 nt, Pseudomonas aeruginosa PA01
cgugggaaaucaccgccacc

SEQ ID NO: 3431305 - RNA, 18 nt, Pseudomonas aeruginosa PA01
cgugggaguccagguaca

SEQ ID NO: 3431306 - RNA, 22 nt, Pseudomonas aeruginosa PA01
cgugggaucgccacgccggcgc

SEQ ID NO: 3431307 - RNA, 23 nt, Pseudomonas aeruginosa PA01
cgugggaucgccacgccggcgcu

SEQ ID NO: 3431308 - RNA, 14 nt, Pseudomonas aeruginosa PA01
cgugggccaccauc

SEQ ID NO: 3431309 - RNA, 17 nt, Pseudomonas aeruginosa PA01
cgugggccaccaucagg

SEQ ID NO: 3431310 - RNA, 13 nt, Pseudomonas aeruginosa PA01
cgugggccagcag

SEQ ID NO: 3431311 - RNA, 15 nt, Pseudomonas aeruginosa PA01
cgugggccagcaggc

SEQ ID NO: 3431312 - RNA, 17 nt, Pseudomonas aeruginosa PA01
cgugggccagcaggccg

SEQ ID NO: 3431313 - RNA, 23 nt, Pseudomonas aeruginosa PA01
cgugggccagcaggccgaucagc

SEQ ID NO: 3431314 - RNA, 13 nt, Pseudomonas aeruginosa PA01
cgugggccagccc

SEQ ID NO: 3431315 - RNA, 14 nt, Pseudomonas aeruginosa PA01
cgugggccagccca

SEQ ID NO: 3431316 - RNA, 15 nt, Pseudomonas aeruginosa PA01
cgugggccagcccag

SEQ ID NO: 3431317 - RNA, 23 nt, Pseudomonas aeruginosa PA01
cgugggccagcccagaacagcaa

SEQ ID NO: 3431318 - RNA, 12 nt, Pseudomonas aeruginosa PA01
cgugggccgccg

SEQ ID NO: 3431319 - RNA, 14 nt, Pseudomonas aeruginosa PA01
cgugggccgccgaa

SEQ ID NO: 3431320 - RNA, 15 nt, Pseudomonas aeruginosa PA01
cgugggccgguuccg

SEQ ID NO: 3431321 - RNA, 23 nt, Pseudomonas aeruginosa PA01
cgugggccgguuccgaaucgccu

SEQ ID NO: 3431322 - RNA, 13 nt, Pseudomonas aeruginosa PA01
cgugggccugcuc

SEQ ID NO: 3431323 - RNA, 18 nt, Pseudomonas aeruginosa PA01
cgugggccugcuccucgg

SEQ ID NO: 3431324 - RNA, 18 nt, Pseudomonas aeruginosa PA01
cgugggccugcucggaga

SEQ ID NO: 3431325 - RNA, 19 nt, Pseudomonas aeruginosa PA01
cgugggcgccgccggugaa

SEQ ID NO: 3431326 - RNA, 15 nt, Pseudomonas aeruginosa PA01
cgugggcgccggcgc

SEQ ID NO: 3431327 - RNA, 20 nt, Pseudomonas aeruginosa PA01
cgugggcgccggcgcgcagg

SEQ ID NO: 3431328 - RNA, 14 nt, Pseudomonas aeruginosa PA01
cgugggcggccggc

SEQ ID NO: 3431329 - RNA, 15 nt, Pseudomonas aeruginosa PA01
cgugggcuucgccgc

SEQ ID NO: 3431330 - RNA, 18 nt, Pseudomonas aeruginosa PA01
cgugggcuucgccgccgc

SEQ ID NO: 3431331 - RNA, 20 nt, Pseudomonas aeruginosa PA01
cgugggcuucgccgccgcgc

SEQ ID NO: 3431332 - RNA, 14 nt, Pseudomonas aeruginosa PA01
cguggggcggcgca

SEQ ID NO: 3431333 - RNA, 15 nt, Pseudomonas aeruginosa PA01
cguggggcggcgcag

SEQ ID NO: 3431334 - RNA, 17 nt, Pseudomonas aeruginosa PA01
cguggggcggcgcagau

SEQ ID NO: 3431335 - RNA, 19 nt, Pseudomonas aeruginosa PA01
cguggggcggcgcagaucg

SEQ ID NO: 3431336 - RNA, 18 nt, Pseudomonas aeruginosa PA01
cgugggggauuuccucgu

SEQ ID NO: 3431337 - RNA, 20 nt, Pseudomonas aeruginosa PA01
cgugggggggaagggccgga

SEQ ID NO: 3431338 - RNA, 14 nt, Pseudomonas aeruginosa PA01
cguggguagccgcc

SEQ ID NO: 3431339 - RNA, 20 nt, Pseudomonas aeruginosa PA01
cguggguagccgcccaccgc

SEQ ID NO: 3431340 - RNA, 13 nt, Pseudomonas aeruginosa PA01
cgugggucgccuc

SEQ ID NO: 3431341 - RNA, 17 nt, Pseudomonas aeruginosa PA01
cgugggucgccucgaac

SEQ ID NO: 3431342 - RNA, 17 nt, Pseudomonas aeruginosa PA01
cgugggugccgggggcg

SEQ ID NO: 3431343 - RNA, 22 nt, Pseudomonas aeruginosa PA01
cgugguaccgcugcgugccagg

SEQ ID NO: 3431344 - RNA, 18 nt, Pseudomonas aeruginosa PA01
cgugguagucgagccgga

SEQ ID NO: 3431345 - RNA, 14 nt, Pseudomonas aeruginosa PA01
cgugguaucggcgc

SEQ ID NO: 3431346 - RNA, 20 nt, Pseudomonas aeruginosa PA01
cguggucagcaccagggcca

SEQ ID NO: 3431347 - RNA, 18 nt, Pseudomonas aeruginosa PA01
cguggucauggcgcagac

SEQ ID NO: 3431348 - RNA, 20 nt, Pseudomonas aeruginosa PA01
cgugguccagcucggucagc

SEQ ID NO: 3431349 - RNA, 15 nt, Pseudomonas aeruginosa PA01
cgugguccgccagca

SEQ ID NO: 3431350 - RNA, 16 nt, Pseudomonas aeruginosa PA01
cgugguccgccagcag

SEQ ID NO: 3431351 - RNA, 18 nt, Pseudomonas aeruginosa PA01
cgugguccgccagcaggc

SEQ ID NO: 3431352 - RNA, 14 nt, Pseudomonas aeruginosa PA01
cguggucgccgcuc

SEQ ID NO: 3431353 - RNA, 16 nt, Pseudomonas aeruginosa PA01
cguggucgcgcaggcg

SEQ ID NO: 3431354 - RNA, 22 nt, Pseudomonas aeruginosa PA01
cguggucgcgcaggcgguggag

SEQ ID NO: 3431355 - RNA, 12 nt, Pseudomonas aeruginosa PA01
cguggucggcgg

SEQ ID NO: 3431356 - RNA, 13 nt, Pseudomonas aeruginosa PA01
cguggucggcggc

SEQ ID NO: 3431357 - RNA, 14 nt, Pseudomonas aeruginosa PA01
cguggugauguccc

SEQ ID NO: 3431358 - RNA, 15 nt, Pseudomonas aeruginosa PA01
cguggugcauccgcc

SEQ ID NO: 3431359 - RNA, 17 nt, Pseudomonas aeruginosa PA01
cguggugcauccgccgc

SEQ ID NO: 3431360 - RNA, 18 nt, Pseudomonas aeruginosa PA01
cguggugcauccgccgca

SEQ ID NO: 3431361 - RNA, 19 nt, Pseudomonas aeruginosa PA01
cguggugcauccgccgcag

SEQ ID NO: 3431362 - RNA, 20 nt, Pseudomonas aeruginosa PA01
cguggugcauccgccgcaga

SEQ ID NO: 3431363 - RNA, 20 nt, Pseudomonas aeruginosa PA01
cgugguggaugacccgcacc

SEQ ID NO: 3431364 - RNA, 14 nt, Pseudomonas aeruginosa PA01
cgugguggcacccg

SEQ ID NO: 3431365 - RNA, 12 nt, Pseudomonas aeruginosa PA01
cgugguggcggg

SEQ ID NO: 3431366 - RNA, 19 nt, Pseudomonas aeruginosa PA01
cgugguggcggggaacagc

SEQ ID NO: 3431367 - RNA, 21 nt, Pseudomonas aeruginosa PA01
cgugguggcggggaacagcau

SEQ ID NO: 3431368 - RNA, 23 nt, Pseudomonas aeruginosa PA01
cgugguugaggcgcucguagagc

SEQ ID NO: 3431369 - RNA, 21 nt, Pseudomonas aeruginosa PA01
cguguaaugacuccggucaag

SEQ ID NO: 3431370 - RNA, 23 nt, Pseudomonas aeruginosa PA01
cguguaccuggguugccgcgccg

SEQ ID NO: 3431371 - RNA, 12 nt, Pseudomonas aeruginosa PA01
cgugucgacgac

SEQ ID NO: 3431372 - RNA, 17 nt, Pseudomonas aeruginosa PA01
cgugucgaggaaggcca

SEQ ID NO: 3431373 - RNA, 18 nt, Pseudomonas aeruginosa PA01
cgugucgaggaaggccag

SEQ ID NO: 3431374 - RNA, 21 nt, Pseudomonas aeruginosa PA01
cgugucgaggaaggccagcag

SEQ ID NO: 3431375 - RNA, 12 nt, Pseudomonas aeruginosa PA01
cgugucgagggc

SEQ ID NO: 3431376 - RNA, 23 nt, Pseudomonas aeruginosa PA01
cgugucgagggcgaacagcagcg

SEQ ID NO: 3431377 - RNA, 17 nt, Pseudomonas aeruginosa PA01
cgugugccugagcuggc

SEQ ID NO: 3431378 - RNA, 21 nt, Pseudomonas aeruginosa PA01
cguguggcgaaacuccagcag

SEQ ID NO: 3431379 - RNA, 22 nt, Pseudomonas aeruginosa PA01
cguguggcgaaacuccagcagg

SEQ ID NO: 3431380 - RNA, 17 nt, Pseudomonas aeruginosa PA01
cgugugucgacaccugg

SEQ ID NO: 3431381 - RNA, 18 nt, Pseudomonas aeruginosa PA01
cguguucgcggcucuggc

SEQ ID NO: 3431382 - RNA, 14 nt, Pseudomonas aeruginosa PA01
cguguucggccagc

SEQ ID NO: 3431383 - RNA, 21 nt, Pseudomonas aeruginosa PA01
cguguucggccagccggcgcc

SEQ ID NO: 3431384 - RNA, 14 nt, Pseudomonas aeruginosa PA01
cguguucggcggcu

SEQ ID NO: 3431385 - RNA, 17 nt, Pseudomonas aeruginosa PA01
cguguugaucgccgcgc

SEQ ID NO: 3431386 - RNA, 14 nt, Pseudomonas aeruginosa PA01
cguguugcagcaga

SEQ ID NO: 3431387 - RNA, 16 nt, Pseudomonas aeruginosa PA01
cguguugcgccgcacc

SEQ ID NO: 3431388 - RNA, 17 nt, Pseudomonas aeruginosa PA01
cguuaaccugccugcgc

SEQ ID NO: 3431389 - RNA, 18 nt, Pseudomonas aeruginosa PA01
cguuaccgcgggcucagg

SEQ ID NO: 3431390 - RNA, 16 nt, Pseudomonas aeruginosa PA01
cguuaccguccgcgcc

SEQ ID NO: 3431391 - RNA, 15 nt, Pseudomonas aeruginosa PA01
cguuacgaaacggcg

SEQ ID NO: 3431392 - RNA, 14 nt, Pseudomonas aeruginosa PA01
cguuacgccggguu

SEQ ID NO: 3431393 - RNA, 14 nt, Pseudomonas aeruginosa PA01
cguuagcucagucg

SEQ ID NO: 3431394 - RNA, 20 nt, Pseudomonas aeruginosa PA01
cguuagcucagucgguagag

SEQ ID NO: 3431395 - RNA, 16 nt, Pseudomonas aeruginosa PA01
cguuauccgccccacc

SEQ ID NO: 3431396 - RNA, 22 nt, Pseudomonas aeruginosa PA01
cguuauccgccccaccccaggg

SEQ ID NO: 3431397 - RNA, 16 nt, Pseudomonas aeruginosa PA01
cguuauccgccgccga

SEQ ID NO: 3431398 - RNA, 21 nt, Pseudomonas aeruginosa PA01
cguuauccgccgcucacccug

SEQ ID NO: 3431399 - RNA, 16 nt, Pseudomonas aeruginosa PA01
cguuauucgcccuacc

SEQ ID NO: 3431400 - RNA, 16 nt, Pseudomonas aeruginosa PA01
cguucaaagcccgccu

SEQ ID NO: 3431401 - RNA, 14 nt, Pseudomonas aeruginosa PA01
cguucaccccgccc

SEQ ID NO: 3431402 - RNA, 14 nt, Pseudomonas aeruginosa PA01
cguucaccgcgcaa

SEQ ID NO: 3431403 - RNA, 17 nt, Pseudomonas aeruginosa PA01
cguucacgccuggcggc

SEQ ID NO: 3431404 - RNA, 21 nt, Pseudomonas aeruginosa PA01
cguucacgccuggcggcuggc

SEQ ID NO: 3431405 - RNA, 15 nt, Pseudomonas aeruginosa PA01
cguucagcagcaugc

SEQ ID NO: 3431406 - RNA, 21 nt, Pseudomonas aeruginosa PA01
cguucagcccacccccggccc

SEQ ID NO: 3431407 - RNA, 15 nt, Pseudomonas aeruginosa PA01
cguucagcgccucgc

SEQ ID NO: 3431408 - RNA, 18 nt, Pseudomonas aeruginosa PA01
cguucagcgccucgcggg

SEQ ID NO: 3431409 - RNA, 14 nt, Pseudomonas aeruginosa PA01
cguucaggccggcg

SEQ ID NO: 3431410 - RNA, 16 nt, Pseudomonas aeruginosa PA01
cguucaggccggcgcc

SEQ ID NO: 3431411 - RNA, 17 nt, Pseudomonas aeruginosa PA01
cguucaggccggcgccg

SEQ ID NO: 3431412 - RNA, 18 nt, Pseudomonas aeruginosa PA01
cguucaggccggcgccgc

SEQ ID NO: 3431413 - RNA, 17 nt, Pseudomonas aeruginosa PA01
cguucaggcuguugccc

SEQ ID NO: 3431414 - RNA, 23 nt, Pseudomonas aeruginosa PA01
cguucagggucagguugccggug

SEQ ID NO: 3431415 - RNA, 16 nt, Pseudomonas aeruginosa PA01
cguucagucccgcggc

SEQ ID NO: 3431416 - RNA, 17 nt, Pseudomonas aeruginosa PA01
cguucagugccagcaga

SEQ ID NO: 3431417 - RNA, 12 nt, Pseudomonas aeruginosa PA01
cguucaguucug

SEQ ID NO: 3431418 - RNA, 23 nt, Pseudomonas aeruginosa PA01
cguucaguucugggcggccaggu

SEQ ID NO: 3431419 - RNA, 17 nt, Pseudomonas aeruginosa PA01
cguucaguugccucugu

SEQ ID NO: 3431420 - RNA, 14 nt, Pseudomonas aeruginosa PA01
cguucaucgucggc

SEQ ID NO: 3431421 - RNA, 16 nt, Pseudomonas aeruginosa PA01
cguucaucgucggcag

SEQ ID NO: 3431422 - RNA, 21 nt, Pseudomonas aeruginosa PA01
cguucaucgucggcagccauc

SEQ ID NO: 3431423 - RNA, 21 nt, Pseudomonas aeruginosa PA01
cguucaugaaagccagcaaac

SEQ ID NO: 3431424 - RNA, 14 nt, Pseudomonas aeruginosa PA01
cguuccaccaggcg

SEQ ID NO: 3431425 - RNA, 20 nt, Pseudomonas aeruginosa PA01
cguuccaccaggcgucgcac

SEQ ID NO: 3431426 - RNA, 14 nt, Pseudomonas aeruginosa PA01
cguuccaccuggcg

SEQ ID NO: 3431427 - RNA, 16 nt, Pseudomonas aeruginosa PA01
cguuccaccuggcgca

SEQ ID NO: 3431428 - RNA, 21 nt, Pseudomonas aeruginosa PA01
cguuccaccuggcgcagguag

SEQ ID NO: 3431429 - RNA, 23 nt, Pseudomonas aeruginosa PA01
cguuccaccuggcgcagguagaa

SEQ ID NO: 3431430 - RNA, 23 nt, Pseudomonas aeruginosa PA01
cguuccacgaaaaagcccggcau

SEQ ID NO: 3431431 - RNA, 18 nt, Pseudomonas aeruginosa PA01
cguuccacgggucgcagc

SEQ ID NO: 3431432 - RNA, 22 nt, Pseudomonas aeruginosa PA01
cguuccacgggucgcagccgag

SEQ ID NO: 3431433 - RNA, 21 nt, Pseudomonas aeruginosa PA01
cguuccacguccuccaggcuc

SEQ ID NO: 3431434 - RNA, 13 nt, Pseudomonas aeruginosa PA01
cguuccagcaccu

SEQ ID NO: 3431435 - RNA, 20 nt, Pseudomonas aeruginosa PA01
cguuccagcgccucgggccg

SEQ ID NO: 3431436 - RNA, 13 nt, Pseudomonas aeruginosa PA01
cguuccagcggca

SEQ ID NO: 3431437 - RNA, 17 nt, Pseudomonas aeruginosa PA01
cguuccagcggcacuuc

SEQ ID NO: 3431438 - RNA, 15 nt, Pseudomonas aeruginosa PA01
cguuccagcucggcg

SEQ ID NO: 3431439 - RNA, 17 nt, Pseudomonas aeruginosa PA01
cguuccagcucggugcc

SEQ ID NO: 3431440 - RNA, 12 nt, Pseudomonas aeruginosa PA01
cguuccaggcgg

SEQ ID NO: 3431441 - RNA, 16 nt, Pseudomonas aeruginosa PA01
cguuccaggcggcgga

SEQ ID NO: 3431442 - RNA, 18 nt, Pseudomonas aeruginosa PA01
cguuccaugaacucuucc

SEQ ID NO: 3431443 - RNA, 16 nt, Pseudomonas aeruginosa PA01
cguuccaugauguguc

SEQ ID NO: 3431444 - RNA, 17 nt, Pseudomonas aeruginosa PA01
cguucccagcagcgccu

SEQ ID NO: 3431445 - RNA, 20 nt, Pseudomonas aeruginosa PA01
cguucccagcagcgccucgg

SEQ ID NO: 3431446 - RNA, 15 nt, Pseudomonas aeruginosa PA01
cguucccggccuggc

SEQ ID NO: 3431447 - RNA, 15 nt, Pseudomonas aeruginosa PA01
cguucccggucgagg

SEQ ID NO: 3431448 - RNA, 19 nt, Pseudomonas aeruginosa PA01
cguuccgcucaccaggccc

SEQ ID NO: 3431449 - RNA, 15 nt, Pseudomonas aeruginosa PA01
cguuccggcgcagcg

SEQ ID NO: 3431450 - RNA, 16 nt, Pseudomonas aeruginosa PA01
cguuccggcucagccg

SEQ ID NO: 3431451 - RNA, 17 nt, Pseudomonas aeruginosa PA01
cguuccggcucagccgc

SEQ ID NO: 3431452 - RNA, 17 nt, Pseudomonas aeruginosa PA01
cguuccgggcagcggcg

SEQ ID NO: 3431453 - RNA, 20 nt, Pseudomonas aeruginosa PA01
cguuccgggcagcggcgcaa

SEQ ID NO: 3431454 - RNA, 18 nt, Pseudomonas aeruginosa PA01
cguuccuccucgccgccg

SEQ ID NO: 3431455 - RNA, 21 nt, Pseudomonas aeruginosa PA01
cguuccuccucgccgccgacc

SEQ ID NO: 3431456 - RNA, 13 nt, Pseudomonas aeruginosa PA01
cguuccuccucgu

SEQ ID NO: 3431457 - RNA, 16 nt, Pseudomonas aeruginosa PA01
cguuccuggaagccga

SEQ ID NO: 3431458 - RNA, 19 nt, Pseudomonas aeruginosa PA01
cguuccuggaagccgaucg

SEQ ID NO: 3431459 - RNA, 16 nt, Pseudomonas aeruginosa PA01
cguuccuugcgcggca

SEQ ID NO: 3431460 - RNA, 21 nt, Pseudomonas aeruginosa PA01
cguuccuugcgcggcaggccg

SEQ ID NO: 3431461 - RNA, 20 nt, Pseudomonas aeruginosa PA01
cguuccuuuuccucgaucag

SEQ ID NO: 3431462 - RNA, 21 nt, Pseudomonas aeruginosa PA01
cguucgacgaagggcucagcc

SEQ ID NO: 3431463 - RNA, 16 nt, Pseudomonas aeruginosa PA01
cguucgaucuccucgc

SEQ ID NO: 3431464 - RNA, 22 nt, Pseudomonas aeruginosa PA01
cguucgcauugaaaaacccaug

SEQ ID NO: 3431465 - RNA, 16 nt, Pseudomonas aeruginosa PA01
cguucgccgaaauagc

SEQ ID NO: 3431466 - RNA, 20 nt, Pseudomonas aeruginosa PA01
cguucgccgaaauagcgcgc

SEQ ID NO: 3431467 - RNA, 21 nt, Pseudomonas aeruginosa PA01
cguucgccgaaauagcgcgcc

SEQ ID NO: 3431468 - RNA, 12 nt, Pseudomonas aeruginosa PA01
cguucgccgagc

SEQ ID NO: 3431469 - RNA, 13 nt, Pseudomonas aeruginosa PA01
cguucgccgaggc

SEQ ID NO: 3431470 - RNA, 21 nt, Pseudomonas aeruginosa PA01
cguucgccgaggcggcgcagc

SEQ ID NO: 3431471 - RNA, 15 nt, Pseudomonas aeruginosa PA01
cguucgcgggcgccg

SEQ ID NO: 3431472 - RNA, 23 nt, Pseudomonas aeruginosa PA01
cguucgcggucggugagcacgcc

SEQ ID NO: 3431473 - RNA, 24 nt, Pseudomonas aeruginosa PA01
cguucgcuggacaggcgcaggggc

SEQ ID NO: 3431474 - RNA, 15 nt, Pseudomonas aeruginosa PA01
cguucggaucggccc

SEQ ID NO: 3431475 - RNA, 18 nt, Pseudomonas aeruginosa PA01
cguucggaucggcccggc

SEQ ID NO: 3431476 - RNA, 19 nt, Pseudomonas aeruginosa PA01
cguucggaucggcccggcg

SEQ ID NO: 3431477 - RNA, 23 nt, Pseudomonas aeruginosa PA01
cguucggcgaugccgcgccaggc

SEQ ID NO: 3431478 - RNA, 14 nt, Pseudomonas aeruginosa PA01
cguucggcgcuggc

SEQ ID NO: 3431479 - RNA, 19 nt, Pseudomonas aeruginosa PA01
cguucggggcccuccaggc

SEQ ID NO: 3431480 - RNA, 21 nt, Pseudomonas aeruginosa PA01
cguucggggcccuccaggcga

SEQ ID NO: 3431481 - RNA, 16 nt, Pseudomonas aeruginosa PA01
cguucgucaccggcgc

SEQ ID NO: 3431482 - RNA, 19 nt, Pseudomonas aeruginosa PA01
cguucgucaccggcgccac

SEQ ID NO: 3431483 - RNA, 21 nt, Pseudomonas aeruginosa PA01
cguucgugcauuuccuggacg

SEQ ID NO: 3431484 - RNA, 18 nt, Pseudomonas aeruginosa PA01
cguucucauugcgccgcc

SEQ ID NO: 3431485 - RNA, 13 nt, Pseudomonas aeruginosa PA01
cguucuccagguc

SEQ ID NO: 3431486 - RNA, 21 nt, Pseudomonas aeruginosa PA01
cguucuccaggucgaacagcg

SEQ ID NO: 3431487 - RNA, 15 nt, Pseudomonas aeruginosa PA01
cguucucccgcgcgc

SEQ ID NO: 3431488 - RNA, 18 nt, Pseudomonas aeruginosa PA01
cguucucccugagccugu

SEQ ID NO: 3431489 - RNA, 18 nt, Pseudomonas aeruginosa PA01
cguucucgaucaucgcca

SEQ ID NO: 3431490 - RNA, 17 nt, Pseudomonas aeruginosa PA01
cguucucggugaccacc

SEQ ID NO: 3431491 - RNA, 17 nt, Pseudomonas aeruginosa PA01
cguucucguccucggcg

SEQ ID NO: 3431492 - RNA, 18 nt, Pseudomonas aeruginosa PA01
cguucugcacaugcacca

SEQ ID NO: 3431493 - RNA, 18 nt, Pseudomonas aeruginosa PA01
cguucugcaggacgaagu

SEQ ID NO: 3431494 - RNA, 16 nt, Pseudomonas aeruginosa PA01
cguucugcccgccggc

SEQ ID NO: 3431495 - RNA, 19 nt, Pseudomonas aeruginosa PA01
cguucugcccgccggcgcc

SEQ ID NO: 3431496 - RNA, 24 nt, Pseudomonas aeruginosa PA01
cguucugcccgccggcgcccuggg

SEQ ID NO: 3431497 - RNA, 16 nt, Pseudomonas aeruginosa PA01
cguucugccgcagcgc

SEQ ID NO: 3431498 - RNA, 17 nt, Pseudomonas aeruginosa PA01
cguucugccgcagcgcc

SEQ ID NO: 3431499 - RNA, 19 nt, Pseudomonas aeruginosa PA01
cguucugccgcagcgccuc

SEQ ID NO: 3431500 - RNA, 15 nt, Pseudomonas aeruginosa PA01
cguucugcucgcugc

SEQ ID NO: 3431501 - RNA, 22 nt, Pseudomonas aeruginosa PA01
cguucugcucgcugcccgacgg

SEQ ID NO: 3431502 - RNA, 18 nt, Pseudomonas aeruginosa PA01
cguucugggucgcgcagg

SEQ ID NO: 3431503 - RNA, 21 nt, Pseudomonas aeruginosa PA01
cguucugggucgcgcagggca

SEQ ID NO: 3431504 - RNA, 23 nt, Pseudomonas aeruginosa PA01
cguucugggucgcgcagggcagc

SEQ ID NO: 3431505 - RNA, 21 nt, Pseudomonas aeruginosa PA01
cguucuucacccgcagcggca

SEQ ID NO: 3431506 - RNA, 22 nt, Pseudomonas aeruginosa PA01
cguucuucacccgcagcggcag

SEQ ID NO: 3431507 - RNA, 20 nt, Pseudomonas aeruginosa PA01
cguucuuccccugcaugccg

SEQ ID NO: 3431508 - RNA, 22 nt, Pseudomonas aeruginosa PA01
cguucuuccccugcaugccggc

SEQ ID NO: 3431509 - RNA, 19 nt, Pseudomonas aeruginosa PA01
cguucuugaccuucugcac

SEQ ID NO: 3431510 - RNA, 17 nt, Pseudomonas aeruginosa PA01
cguugaaacgcucggcg

SEQ ID NO: 3431511 - RNA, 15 nt, Pseudomonas aeruginosa PA01
cguugaacucggcgc

SEQ ID NO: 3431512 - RNA, 16 nt, Pseudomonas aeruginosa PA01
cguugaacucggcgcc

SEQ ID NO: 3431513 - RNA, 19 nt, Pseudomonas aeruginosa PA01
cguugaccacgcucagccg

SEQ ID NO: 3431514 - RNA, 23 nt, Pseudomonas aeruginosa PA01
cguugaccacgcucagccguggc

SEQ ID NO: 3431515 - RNA, 13 nt, Pseudomonas aeruginosa PA01
cguugaccagcgc

SEQ ID NO: 3431516 - RNA, 23 nt, Pseudomonas aeruginosa PA01
cguugaccagcgcgucgaccacc

SEQ ID NO: 3431517 - RNA, 16 nt, Pseudomonas aeruginosa PA01
cguugaccugcgaggc

SEQ ID NO: 3431518 - RNA, 17 nt, Pseudomonas aeruginosa PA01
cguugacgaucaggaag

SEQ ID NO: 3431519 - RNA, 16 nt, Pseudomonas aeruginosa PA01
cguugacgaucgcccc

SEQ ID NO: 3431520 - RNA, 18 nt, Pseudomonas aeruginosa PA01
cguugacgaucugcgagc

SEQ ID NO: 3431521 - RNA, 15 nt, Pseudomonas aeruginosa PA01
cguugacgcggaugc

SEQ ID NO: 3431522 - RNA, 21 nt, Pseudomonas aeruginosa PA01
cguugacugccugcagguagc

SEQ ID NO: 3431523 - RNA, 14 nt, Pseudomonas aeruginosa PA01
cguugagcaccgga

SEQ ID NO: 3431524 - RNA, 17 nt, Pseudomonas aeruginosa PA01
cguugagcaccucgacc

SEQ ID NO: 3431525 - RNA, 20 nt, Pseudomonas aeruginosa PA01
cguugagcaccucgaccugg

SEQ ID NO: 3431526 - RNA, 16 nt, Pseudomonas aeruginosa PA01
cguugagcaucaccgc

SEQ ID NO: 3431527 - RNA, 18 nt, Pseudomonas aeruginosa PA01
cguugagcaucaccgcgg

SEQ ID NO: 3431528 - RNA, 24 nt, Pseudomonas aeruginosa PA01
aaagcuccucggccuugcuggcga

SEQ ID NO: 3431529 - RNA, 21 nt, Pseudomonas aeruginosa PA01
aaagcucgcgcaagcgcccgg

SEQ ID NO: 3431530 - RNA, 22 nt, Pseudomonas aeruginosa PA01
aaagcuucgucgcgcaggcggg

SEQ ID NO: 3431531 - RNA, 20 nt, Pseudomonas aeruginosa PA01
aaaggccaccagagccagcc

SEQ ID NO: 3431532 - RNA, 18 nt, Pseudomonas aeruginosa PA01
aaaggccgcguaagcggc

SEQ ID NO: 3431533 - RNA, 21 nt, Pseudomonas aeruginosa PA01
aaaggccgcguaagcggccuu

SEQ ID NO: 3431534 - RNA, 12 nt, Pseudomonas aeruginosa PA01
aaaggcggauga

SEQ ID NO: 3431535 - RNA, 18 nt, Pseudomonas aeruginosa PA01
aaagggagccaggcggcu

SEQ ID NO: 3431536 - RNA, 16 nt, Pseudomonas aeruginosa PA01
aaagggaugccgccgg

SEQ ID NO: 3431537 - RNA, 14 nt, Pseudomonas aeruginosa PA01
aaagggcagcggcg

SEQ ID NO: 3431538 - RNA, 12 nt, Pseudomonas aeruginosa PA01
aaaggggaugcc

SEQ ID NO: 3431539 - RNA, 11 nt, Pseudomonas aeruginosa PA01
aaaggggcccg

SEQ ID NO: 3431540 - RNA, 14 nt, Pseudomonas aeruginosa PA01
aaagggucaggccu

SEQ ID NO: 3431541 - RNA, 13 nt, Pseudomonas aeruginosa PA01
aaauaaccggcgu

SEQ ID NO: 3431542 - RNA, 12 nt, Pseudomonas aeruginosa PA01
aaauagccggcg

SEQ ID NO: 3431543 - RNA, 17 nt, Pseudomonas aeruginosa PA01
aaauaggcgcugcggua

SEQ ID NO: 3431544 - RNA, 20 nt, Pseudomonas aeruginosa PA01
aaauagucgcgggccugggc

SEQ ID NO: 3431545 - RNA, 23 nt, Pseudomonas aeruginosa PA01
aaaucaaaaccagccuugagccu

SEQ ID NO: 3431546 - RNA, 13 nt, Pseudomonas aeruginosa PA01
aaaucauccacag

SEQ ID NO: 3431547 - RNA, 17 nt, Pseudomonas aeruginosa PA01
aaauccuuucgaucugg

SEQ ID NO: 3431548 - RNA, 23 nt, Pseudomonas aeruginosa PA01
aaaucgccguugccuucgccguc

SEQ ID NO: 3431549 - RNA, 20 nt, Pseudomonas aeruginosa PA01
aaaucggcaggcugcaucgg

SEQ ID NO: 3431550 - RNA, 17 nt, Pseudomonas aeruginosa PA01
aaaugacuguuaaucau

SEQ ID NO: 3431551 - RNA, 13 nt, Pseudomonas aeruginosa PA01
aaaugcucgugca

SEQ ID NO: 3431552 - RNA, 14 nt, Pseudomonas aeruginosa PA01
aaauggcagaacau

SEQ ID NO: 3431553 - RNA, 20 nt, Pseudomonas aeruginosa PA01
aaauggccgcuugaagcggc

SEQ ID NO: 3431554 - RNA, 18 nt, Pseudomonas aeruginosa PA01
aaauggguucccagcagc

SEQ ID NO: 3431555 - RNA, 19 nt, Pseudomonas aeruginosa PA01
aaauggguucccagcagca

SEQ ID NO: 3431556 - RNA, 22 nt, Pseudomonas aeruginosa PA01
aaauggucaccaugaucaucgg

SEQ ID NO: 3431557 - RNA, 18 nt, Pseudomonas aeruginosa PA01
aaauuucgugaaaugaaa

SEQ ID NO: 3431558 - RNA, 13 nt, Pseudomonas aeruginosa PA01
aacaaccgcuugu

SEQ ID NO: 3431559 - RNA, 16 nt, Pseudomonas aeruginosa PA01
aacaagaauaggaaca

SEQ ID NO: 3431560 - RNA, 16 nt, Pseudomonas aeruginosa PA01
aacaagccaccuucga

SEQ ID NO: 3431561 - RNA, 17 nt, Pseudomonas aeruginosa PA01
aacacacgcuucugcug

SEQ ID NO: 3431562 - RNA, 17 nt, Pseudomonas aeruginosa PA01
aacaccagcgccgccag

SEQ ID NO: 3431563 - RNA, 20 nt, Pseudomonas aeruginosa PA01
aacaccagcgccgccaggca

SEQ ID NO: 3431564 - RNA, 21 nt, Pseudomonas aeruginosa PA01
aacaccagcgccgccaggcag

SEQ ID NO: 3431565 - RNA, 22 nt, Pseudomonas aeruginosa PA01
aacaccagcgccgccaggcaga

SEQ ID NO: 3431566 - RNA, 20 nt, Pseudomonas aeruginosa PA01
aacaccaggagcgccagcac

SEQ ID NO: 3431567 - RNA, 21 nt, Pseudomonas aeruginosa PA01
aacaccaggagcgccagcacc

SEQ ID NO: 3431568 - RNA, 11 nt, Pseudomonas aeruginosa PA01
aacaccaggcc

SEQ ID NO: 3431569 - RNA, 13 nt, Pseudomonas aeruginosa PA01
aacaccaggccga

SEQ ID NO: 3431570 - RNA, 13 nt, Pseudomonas aeruginosa PA01
aacaccaggcgcc

SEQ ID NO: 3431571 - RNA, 16 nt, Pseudomonas aeruginosa PA01
aacaccaucggcccca

SEQ ID NO: 3431572 - RNA, 22 nt, Pseudomonas aeruginosa PA01
aacaccaucggccccaccgcac

SEQ ID NO: 3431573 - RNA, 15 nt, Pseudomonas aeruginosa PA01
aacacccaggccugg

SEQ ID NO: 3431574 - RNA, 18 nt, Pseudomonas aeruginosa PA01
aacaccggaagcguccag

SEQ ID NO: 3431575 - RNA, 15 nt, Pseudomonas aeruginosa PA01
aacaccgggccgccg

SEQ ID NO: 3431576 - RNA, 18 nt, Pseudomonas aeruginosa PA01
aacaccgggccgccggcg

SEQ ID NO: 3431577 - RNA, 15 nt, Pseudomonas aeruginosa PA01
aacacucgugaauuc

SEQ ID NO: 3431578 - RNA, 22 nt, Pseudomonas aeruginosa PA01
aacacuuccuucucccggcugg

SEQ ID NO: 3431579 - RNA, 20 nt, Pseudomonas aeruginosa PA01
aacagaggaaggcgccggca

SEQ ID NO: 3431580 - RNA, 15 nt, Pseudomonas aeruginosa PA01
aacagcaaagcgcag

SEQ ID NO: 3431581 - RNA, 14 nt, Pseudomonas aeruginosa PA01
aacagcagcaagcc

SEQ ID NO: 3431582 - RNA, 15 nt, Pseudomonas aeruginosa PA01
aacagcagccaggcg

SEQ ID NO: 3431583 - RNA, 17 nt, Pseudomonas aeruginosa PA01
aacagcagcggcaccag

SEQ ID NO: 3431584 - RNA, 20 nt, Pseudomonas aeruginosa PA01
aacagcagcggcaccagcac

SEQ ID NO: 3431585 - RNA, 10 nt, Pseudomonas aeruginosa PA01
aacagcagcu

SEQ ID NO: 3431586 - RNA, 15 nt, Pseudomonas aeruginosa PA01
aacagcagcucgccg

SEQ ID NO: 3431587 - RNA, 11 nt, Pseudomonas aeruginosa PA01
aacagcaggga

SEQ ID NO: 3431588 - RNA, 17 nt, Pseudomonas aeruginosa PA01
aacagcagggucagggu

SEQ ID NO: 3431589 - RNA, 14 nt, Pseudomonas aeruginosa PA01
aacagccagcgguu

SEQ ID NO: 3431590 - RNA, 23 nt, Pseudomonas aeruginosa PA01
aacagccagcgguugagcagggc

SEQ ID NO: 3431591 - RNA, 19 nt, Pseudomonas aeruginosa PA01
aacagcccgucgcgcgccg

SEQ ID NO: 3431592 - RNA, 22 nt, Pseudomonas aeruginosa PA01
aacagcccgucgcgcgccggag

SEQ ID NO: 3431593 - RNA, 12 nt, Pseudomonas aeruginosa PA01
aacagccgcccc

SEQ ID NO: 3431594 - RNA, 14 nt, Pseudomonas aeruginosa PA01
aacagccggcgggu

SEQ ID NO: 3431595 - RNA, 19 nt, Pseudomonas aeruginosa PA01
aacagccguuugugaaagg

SEQ ID NO: 3431596 - RNA, 14 nt, Pseudomonas aeruginosa PA01
aacagcgagcccag

SEQ ID NO: 3431597 - RNA, 15 nt, Pseudomonas aeruginosa PA01
aacagcgagcccagg

SEQ ID NO: 3431598 - RNA, 13 nt, Pseudomonas aeruginosa PA01
aacagcgccacca

SEQ ID NO: 3431599 - RNA, 15 nt, Pseudomonas aeruginosa PA01
aacagcgccaccagc

SEQ ID NO: 3431600 - RNA, 17 nt, Pseudomonas aeruginosa PA01
aacagcgccaccagcau

SEQ ID NO: 3431601 - RNA, 23 nt, Pseudomonas aeruginosa PA01
aacagcgccaccagcaugcccag

SEQ ID NO: 3431602 - RNA, 15 nt, Pseudomonas aeruginosa PA01
aacagcgccagcggc

SEQ ID NO: 3431603 - RNA, 17 nt, Pseudomonas aeruginosa PA01
aacagcgccagcggcag

SEQ ID NO: 3431604 - RNA, 13 nt, Pseudomonas aeruginosa PA01
aacagcgccggaa

SEQ ID NO: 3431605 - RNA, 12 nt, Pseudomonas aeruginosa PA01
aacagcgcgcca

SEQ ID NO: 3431606 - RNA, 13 nt, Pseudomonas aeruginosa PA01
aacagcggaaugc

SEQ ID NO: 3431607 - RNA, 16 nt, Pseudomonas aeruginosa PA01
aacagcggcccgaggg

SEQ ID NO: 3431608 - RNA, 18 nt, Pseudomonas aeruginosa PA01
aacagcggcuggcccucg

SEQ ID NO: 3431609 - RNA, 22 nt, Pseudomonas aeruginosa PA01
aacagcgggucgcggcuggccg

SEQ ID NO: 3431610 - RNA, 18 nt, Pseudomonas aeruginosa PA01
aacagcggugugcucagg

SEQ ID NO: 3431611 - RNA, 13 nt, Pseudomonas aeruginosa PA01
aacagcuccucca

SEQ ID NO: 3431612 - RNA, 18 nt, Pseudomonas aeruginosa PA01
aacagcuccuccagccgc

SEQ ID NO: 3431613 - RNA, 22 nt, Pseudomonas aeruginosa PA01
aacagcuccuccagcguggcgg

SEQ ID NO: 3431614 - RNA, 15 nt, Pseudomonas aeruginosa PA01
aacaggacccagcca

SEQ ID NO: 3431615 - RNA, 22 nt, Pseudomonas aeruginosa PA01
aacaggcucgaggccgagccgg

SEQ ID NO: 3431616 - RNA, 13 nt, Pseudomonas aeruginosa PA01
aacaggcuggcgu

SEQ ID NO: 3431617 - RNA, 17 nt, Pseudomonas aeruginosa PA01
aacaggcugugcgccag

SEQ ID NO: 3431618 - RNA, 19 nt, Pseudomonas aeruginosa PA01
aacagggcgagcagggcgc

SEQ ID NO: 3431619 - RNA, 20 nt, Pseudomonas aeruginosa PA01
aacagggcgagcagggcgcu

SEQ ID NO: 3431620 - RNA, 20 nt, Pseudomonas aeruginosa PA01
aacaggucgacgccauggcg

SEQ ID NO: 3431621 - RNA, 20 nt, Pseudomonas aeruginosa PA01
aacagguggcuuuccagcau

SEQ ID NO: 3431622 - RNA, 18 nt, Pseudomonas aeruginosa PA01
aacagguucggcaggccu

SEQ ID NO: 3431623 - RNA, 15 nt, Pseudomonas aeruginosa PA01
aacagugcgcccgug

SEQ ID NO: 3431624 - RNA, 17 nt, Pseudomonas aeruginosa PA01
aacaguucgaugggccg

SEQ ID NO: 3431625 - RNA, 16 nt, Pseudomonas aeruginosa PA01
aacaguugagcugugg

SEQ ID NO: 3431626 - RNA, 20 nt, Pseudomonas aeruginosa PA01
aacaguugccgcagcagcgg

SEQ ID NO: 3431627 - RNA, 21 nt, Pseudomonas aeruginosa PA01
aacaucagcagcgccagcagg

SEQ ID NO: 3431628 - RNA, 13 nt, Pseudomonas aeruginosa PA01
aacauccgcggcc

SEQ ID NO: 3431629 - RNA, 18 nt, Pseudomonas aeruginosa PA01
aacauccgcggccccggc

SEQ ID NO: 3431630 - RNA, 23 nt, Pseudomonas aeruginosa PA01
aacaucgccugcuuggcggcggu

SEQ ID NO: 3431631 - RNA, 12 nt, Pseudomonas aeruginosa PA01
aacgcaggcgca

SEQ ID NO: 3431632 - RNA, 20 nt, Pseudomonas aeruginosa PA01
aacgcaggggcaccggcgga

SEQ ID NO: 3431633 - RNA, 15 nt, Pseudomonas aeruginosa PA01
aacgccaacggcguu

SEQ ID NO: 3431634 - RNA, 21 nt, Pseudomonas aeruginosa PA01
aacgccacacauccagugugg

SEQ ID NO: 3431635 - RNA, 15 nt, Pseudomonas aeruginosa PA01
aacgccacaggcguu

SEQ ID NO: 3431636 - RNA, 17 nt, Pseudomonas aeruginosa PA01
aacgccaccgcgcgccc

SEQ ID NO: 3431637 - RNA, 14 nt, Pseudomonas aeruginosa PA01
aacgccagcaggcg

SEQ ID NO: 3431638 - RNA, 13 nt, Pseudomonas aeruginosa PA01
aacgccauccgcc

SEQ ID NO: 3431639 - RNA, 22 nt, Pseudomonas aeruginosa PA01
aacgccccucuuccacgcgccg

SEQ ID NO: 3431640 - RNA, 15 nt, Pseudomonas aeruginosa PA01
aacgcccgcgagccg

SEQ ID NO: 3431641 - RNA, 22 nt, Pseudomonas aeruginosa PA01
aacgcccggcaucugccgggcg

SEQ ID NO: 3431642 - RNA, 19 nt, Pseudomonas aeruginosa PA01
aacgccgagaacgcggcga

SEQ ID NO: 3431643 - RNA, 15 nt, Pseudomonas aeruginosa PA01
aacgccgauggcguu

SEQ ID NO: 3431644 - RNA, 17 nt, Pseudomonas aeruginosa PA01
aacgccgauggcguuau

SEQ ID NO: 3431645 - RNA, 13 nt, Pseudomonas aeruginosa PA01
aacgccgcaggcg

SEQ ID NO: 3431646 - RNA, 15 nt, Pseudomonas aeruginosa PA01
aacgccgcaggcguu

SEQ ID NO: 3431647 - RNA, 18 nt, Pseudomonas aeruginosa PA01
aacgccgccacgccgaua

SEQ ID NO: 3431648 - RNA, 21 nt, Pseudomonas aeruginosa PA01
aacgccgcccccagcgcgccg

SEQ ID NO: 3431649 - RNA, 14 nt, Pseudomonas aeruginosa PA01
aacgccgccggcgu

SEQ ID NO: 3431650 - RNA, 22 nt, Pseudomonas aeruginosa PA01
aacgccgcgaaauggcagaaca

SEQ ID NO: 3431651 - RNA, 20 nt, Pseudomonas aeruginosa PA01
aacgccgcgaagcccagcgc

SEQ ID NO: 3431652 - RNA, 21 nt, Pseudomonas aeruginosa PA01
aacgccgcgaagcccagcgcc

SEQ ID NO: 3431653 - RNA, 22 nt, Pseudomonas aeruginosa PA01
aacgccgcgaagcccagcgccg

SEQ ID NO: 3431654 - RNA, 21 nt, Pseudomonas aeruginosa PA01
aacgccgcgcaccucgaccgc

SEQ ID NO: 3431655 - RNA, 21 nt, Pseudomonas aeruginosa PA01
aacgccgggcaacgccaggcc

SEQ ID NO: 3431656 - RNA, 23 nt, Pseudomonas aeruginosa PA01
aacgccgggcaacgccaggccgc

SEQ ID NO: 3431657 - RNA, 17 nt, Pseudomonas aeruginosa PA01
aacgccggucauugucg

SEQ ID NO: 3431658 - RNA, 17 nt, Pseudomonas aeruginosa PA01
aacgccgguggcguuau

SEQ ID NO: 3431659 - RNA, 21 nt, Pseudomonas aeruginosa PA01
aacgccucgcagagcgccagc

SEQ ID NO: 3431660 - RNA, 21 nt, Pseudomonas aeruginosa PA01
aacgccuggugcaggucgcgc

SEQ ID NO: 3431661 - RNA, 18 nt, Pseudomonas aeruginosa PA01
aacgccugucgcuccggc

SEQ ID NO: 3431662 - RNA, 16 nt, Pseudomonas aeruginosa PA01
aacgccuuccuugucg

SEQ ID NO: 3431663 - RNA, 16 nt, Pseudomonas aeruginosa PA01
aacgcgcagaggcgcu

SEQ ID NO: 3431664 - RNA, 18 nt, Pseudomonas aeruginosa PA01
aacgcgcccacuccuccg

SEQ ID NO: 3431665 - RNA, 17 nt, Pseudomonas aeruginosa PA01
aacgcgcccggccaggc

SEQ ID NO: 3431666 - RNA, 16 nt, Pseudomonas aeruginosa PA01
aacgcgccuccggcag

SEQ ID NO: 3431667 - RNA, 17 nt, Pseudomonas aeruginosa PA01
aacgcgccuccggcagc

SEQ ID NO: 3431668 - RNA, 18 nt, Pseudomonas aeruginosa PA01
aacgcgcgcucucgccgg

SEQ ID NO: 3431669 - RNA, 15 nt, Pseudomonas aeruginosa PA01
aacgcggagcaggcg

SEQ ID NO: 3431670 - RNA, 13 nt, Pseudomonas aeruginosa PA01
aacgcggccagca

SEQ ID NO: 3431671 - RNA, 19 nt, Pseudomonas aeruginosa PA01
aacgcggcuucggucaggu

SEQ ID NO: 3431672 - RNA, 21 nt, Pseudomonas aeruginosa PA01
aacgcggguugcccggcucca

SEQ ID NO: 3431673 - RNA, 20 nt, Pseudomonas aeruginosa PA01
aacgcguaggggaccacccc

SEQ ID NO: 3431674 - RNA, 23 nt, Pseudomonas aeruginosa PA01
aacgcugcaauucgucggccugc

SEQ ID NO: 3431675 - RNA, 20 nt, Pseudomonas aeruginosa PA01
aacgcuucgaagcucucgcc

SEQ ID NO: 3431676 - RNA, 21 nt, Pseudomonas aeruginosa PA01
aacgcuucgaagcucucgccg

SEQ ID NO: 3431677 - RNA, 23 nt, Pseudomonas aeruginosa PA01
aacgcuucgaagcucucgccgcg

SEQ ID NO: 3431678 - RNA, 17 nt, Pseudomonas aeruginosa PA01
aacgcuugagcuggcgc

SEQ ID NO: 3431679 - RNA, 19 nt, Pseudomonas aeruginosa PA01
aacgcuugagcuggcgcug

SEQ ID NO: 3431680 - RNA, 14 nt, Pseudomonas aeruginosa PA01
aacggaccccaugu

SEQ ID NO: 3431681 - RNA, 12 nt, Pseudomonas aeruginosa PA01
aacggcagcugg

SEQ ID NO: 3431682 - RNA, 14 nt, Pseudomonas aeruginosa PA01
aacggcaggccagc

SEQ ID NO: 3431683 - RNA, 15 nt, Pseudomonas aeruginosa PA01
aacggcaggccagca

SEQ ID NO: 3431684 - RNA, 16 nt, Pseudomonas aeruginosa PA01
aacggcaggccagcag

SEQ ID NO: 3431685 - RNA, 17 nt, Pseudomonas aeruginosa PA01
aacggcaggccagcagg

SEQ ID NO: 3431686 - RNA, 23 nt, Pseudomonas aeruginosa PA01
aacggcagguggucguugcgcgc

SEQ ID NO: 3431687 - RNA, 23 nt, Pseudomonas aeruginosa PA01
aacggccgcuugaucuuguccug

SEQ ID NO: 3431688 - RNA, 19 nt, Pseudomonas aeruginosa PA01
aacggcgcccucgggcgcc

SEQ ID NO: 3431689 - RNA, 23 nt, Pseudomonas aeruginosa PA01
aacggcggauaacaccguuggcg

SEQ ID NO: 3431690 - RNA, 16 nt, Pseudomonas aeruginosa PA01
aacggcggauaaccgc

SEQ ID NO: 3431691 - RNA, 16 nt, Pseudomonas aeruginosa PA01
aacggcgucacgccga

SEQ ID NO: 3431692 - RNA, 17 nt, Pseudomonas aeruginosa PA01
aacgggacgccaggcgu

SEQ ID NO: 3431693 - RNA, 15 nt, Pseudomonas aeruginosa PA01
aacgggcgcucuggc

SEQ ID NO: 3431694 - RNA, 16 nt, Pseudomonas aeruginosa PA01
aacgggcugccagcau

SEQ ID NO: 3431695 - RNA, 23 nt, Pseudomonas aeruginosa PA01
aacgguagcccgcggcgagcagc

SEQ ID NO: 3431696 - RNA, 19 nt, Pseudomonas aeruginosa PA01
aacgguagcggaucagccg

SEQ ID NO: 3431697 - RNA, 19 nt, Pseudomonas aeruginosa PA01
aacgguagguagcguugcg

SEQ ID NO: 3431698 - RNA, 23 nt, Pseudomonas aeruginosa PA01
aacgguagguagcguugcgccag

SEQ ID NO: 3431699 - RNA, 21 nt, Pseudomonas aeruginosa PA01
aacgguaucggcuugccggcg

SEQ ID NO: 3431700 - RNA, 16 nt, Pseudomonas aeruginosa PA01
aacgguccagggccgc

SEQ ID NO: 3431701 - RNA, 13 nt, Pseudomonas aeruginosa PA01
aacgucaggcugu

SEQ ID NO: 3431702 - RNA, 18 nt, Pseudomonas aeruginosa PA01
aacguccucgaugcccgc

SEQ ID NO: 3431703 - RNA, 15 nt, Pseudomonas aeruginosa PA01
aacguccucgcgccg

SEQ ID NO: 3431704 - RNA, 16 nt, Pseudomonas aeruginosa PA01
aacgucggccugggug

SEQ ID NO: 3431705 - RNA, 13 nt, Pseudomonas aeruginosa PA01
aacuagcccucga

SEQ ID NO: 3431706 - RNA, 16 nt, Pseudomonas aeruginosa PA01
aacuagcccucgaccu

SEQ ID NO: 3431707 - RNA, 15 nt, Pseudomonas aeruginosa PA01
aacucaucaggcugc

SEQ ID NO: 3431708 - RNA, 17 nt, Pseudomonas aeruginosa PA01
aacucaucaggcugccg

SEQ ID NO: 3431709 - RNA, 20 nt, Pseudomonas aeruginosa PA01
aacucaugcccagcuuggcc

SEQ ID NO: 3431710 - RNA, 22 nt, Pseudomonas aeruginosa PA01
aacuccagagccaugggccggc

SEQ ID NO: 3431711 - RNA, 16 nt, Pseudomonas aeruginosa PA01
aacuccgccagcacca

SEQ ID NO: 3431712 - RNA, 16 nt, Pseudomonas aeruginosa PA01
aacuccgccaggcgcu

SEQ ID NO: 3431713 - RNA, 23 nt, Pseudomonas aeruginosa PA01
aacucgacuucuucgcuggacca

SEQ ID NO: 3431714 - RNA, 16 nt, Pseudomonas aeruginosa PA01
aacucgaucagcgcgg

SEQ ID NO: 3431715 - RNA, 20 nt, Pseudomonas aeruginosa PA01
aacucgccgccgacacccgc

SEQ ID NO: 3431716 - RNA, 19 nt, Pseudomonas aeruginosa PA01
aacucgccgucuuccacca

SEQ ID NO: 3431717 - RNA, 15 nt, Pseudomonas aeruginosa PA01
aacucgcggucccgg

SEQ ID NO: 3431718 - RNA, 12 nt, Pseudomonas aeruginosa PA01
aacucggcgccc

SEQ ID NO: 3431719 - RNA, 18 nt, Pseudomonas aeruginosa PA01
aacucggcgcccagggcu

SEQ ID NO: 3431720 - RNA, 13 nt, Pseudomonas aeruginosa PA01
aacugacggcgga

SEQ ID NO: 3431721 - RNA, 19 nt, Pseudomonas aeruginosa PA01
aacugacggcggaaggcgg

SEQ ID NO: 3431722 - RNA, 20 nt, Pseudomonas aeruginosa PA01
aacugacggcggaaggcggc

SEQ ID NO: 3431723 - RNA, 15 nt, Pseudomonas aeruginosa PA01
aacugagcggcggca

SEQ ID NO: 3431724 - RNA, 19 nt, Pseudomonas aeruginosa PA01
aacugcacgcccaucgcca

SEQ ID NO: 3431725 - RNA, 19 nt, Pseudomonas aeruginosa PA01
aacugcagggcgucgccgg

SEQ ID NO: 3431726 - RNA, 10 nt, Pseudomonas aeruginosa PA01
aacugcaugu

SEQ ID NO: 3431727 - RNA, 20 nt, Pseudomonas aeruginosa PA01
aacugccaaccgcgcucggc

SEQ ID NO: 3431728 - RNA, 23 nt, Pseudomonas aeruginosa PA01
aacugcccgcaggggcugccgua

SEQ ID NO: 3431729 - RNA, 19 nt, Pseudomonas aeruginosa PA01
aacugccgacggcggcggc

SEQ ID NO: 3431730 - RNA, 17 nt, Pseudomonas aeruginosa PA01
aacugccgcccgcucaa

SEQ ID NO: 3431731 - RNA, 18 nt, Pseudomonas aeruginosa PA01
aacugccgggccagcucc

SEQ ID NO: 3431732 - RNA, 16 nt, Pseudomonas aeruginosa PA01
aacugcgauggaacga

SEQ ID NO: 3431733 - RNA, 22 nt, Pseudomonas aeruginosa PA01
aagccgaugaaauagccggcga

SEQ ID NO: 3431734 - RNA, 19 nt, Pseudomonas aeruginosa PA01
aagccgcacuuccaggcgc

SEQ ID NO: 3431735 - RNA, 19 nt, Pseudomonas aeruginosa PA01
aagccgccgcccagcagca

SEQ ID NO: 3431736 - RNA, 21 nt, Pseudomonas aeruginosa PA01
aagccgccgggaaucuggccg

SEQ ID NO: 3431737 - RNA, 20 nt, Pseudomonas aeruginosa PA01
aagccgcgcaaggcagcguc

SEQ ID NO: 3431738 - RNA, 19 nt, Pseudomonas aeruginosa PA01
aagccgcgcagcacuuccu

SEQ ID NO: 3431739 - RNA, 18 nt, Pseudomonas aeruginosa PA01
aagccgcgccaucggucg

SEQ ID NO: 3431740 - RNA, 14 nt, Pseudomonas aeruginosa PA01
aagccgcucggcgu

SEQ ID NO: 3431741 - RNA, 20 nt, Pseudomonas aeruginosa PA01
aagccgcucggcguagccgg

SEQ ID NO: 3431742 - RNA, 22 nt, Pseudomonas aeruginosa PA01
aagccgcucggcguagccggcg

SEQ ID NO: 3431743 - RNA, 23 nt, Pseudomonas aeruginosa PA01
aagccgcucggcguagccggcga

SEQ ID NO: 3431744 - RNA, 13 nt, Pseudomonas aeruginosa PA01
aagccggaagcgc

SEQ ID NO: 3431745 - RNA, 17 nt, Pseudomonas aeruginosa PA01
aagccggaagcgcucgc

SEQ ID NO: 3431746 - RNA, 14 nt, Pseudomonas aeruginosa PA01
aagccggaggcagc

SEQ ID NO: 3431747 - RNA, 18 nt, Pseudomonas aeruginosa PA01
aagccggccccugggccg

SEQ ID NO: 3431748 - RNA, 18 nt, Pseudomonas aeruginosa PA01
aagccggcgcgccccugc

SEQ ID NO: 3431749 - RNA, 22 nt, Pseudomonas aeruginosa PA01
aagccggcgcgccccugcgccc

SEQ ID NO: 3431750 - RNA, 16 nt, Pseudomonas aeruginosa PA01
aagccggggcaggcau

SEQ ID NO: 3431751 - RNA, 20 nt, Pseudomonas aeruginosa PA01
aagccguggcgggccaugcg

SEQ ID NO: 3431752 - RNA, 22 nt, Pseudomonas aeruginosa PA01
aagccucaggcgcugcgcggcc

SEQ ID NO: 3431753 - RNA, 13 nt, Pseudomonas aeruginosa PA01
aagccuccagcag

SEQ ID NO: 3431754 - RNA, 15 nt, Pseudomonas aeruginosa PA01
aagccuccagcgccg

SEQ ID NO: 3431755 - RNA, 19 nt, Pseudomonas aeruginosa PA01
aagccuccagcgccgccuc

SEQ ID NO: 3431756 - RNA, 12 nt, Pseudomonas aeruginosa PA01
aagccucgacga

SEQ ID NO: 3431757 - RNA, 17 nt, Pseudomonas aeruginosa PA01
aagccucgcgacugcug

SEQ ID NO: 3431758 - RNA, 15 nt, Pseudomonas aeruginosa PA01
aagccuggagcaggg

SEQ ID NO: 3431759 - RNA, 18 nt, Pseudomonas aeruginosa PA01
aagccuggagcagggcgc

SEQ ID NO: 3431760 - RNA, 14 nt, Pseudomonas aeruginosa PA01
aagccuggccggcg

SEQ ID NO: 3431761 - RNA, 16 nt, Pseudomonas aeruginosa PA01
aagcgaaccaggcaau

SEQ ID NO: 3431762 - RNA, 22 nt, Pseudomonas aeruginosa PA01
aagcgacgccgcgauggcucgc

SEQ ID NO: 3431763 - RNA, 13 nt, Pseudomonas aeruginosa PA01
aagcgagcgcccg

SEQ ID NO: 3431764 - RNA, 15 nt, Pseudomonas aeruginosa PA01
aagcgagcgcccgcc

SEQ ID NO: 3431765 - RNA, 17 nt, Pseudomonas aeruginosa PA01
aagcgcaacgcgcgcag

SEQ ID NO: 3431766 - RNA, 14 nt, Pseudomonas aeruginosa PA01
aagcgcaccaccug

SEQ ID NO: 3431767 - RNA, 23 nt, Pseudomonas aeruginosa PA01
aagcgcagcacgaugcacaggcg

SEQ ID NO: 3431768 - RNA, 13 nt, Pseudomonas aeruginosa PA01
aagcgcagcaggu

SEQ ID NO: 3431769 - RNA, 15 nt, Pseudomonas aeruginosa PA01
aagcgcagcuccggc

SEQ ID NO: 3431770 - RNA, 20 nt, Pseudomonas aeruginosa PA01
aagcgcaggccgccggcggc

SEQ ID NO: 3431771 - RNA, 12 nt, Pseudomonas aeruginosa PA01
aagcgcaggcgg

SEQ ID NO: 3431772 - RNA, 14 nt, Pseudomonas aeruginosa PA01
aagcgcaggugcac

SEQ ID NO: 3431773 - RNA, 19 nt, Pseudomonas aeruginosa PA01
aagcgcaggugcaccgcgc

SEQ ID NO: 3431774 - RNA, 12 nt, Pseudomonas aeruginosa PA01
aagcgccaggcg

SEQ ID NO: 3431775 - RNA, 14 nt, Pseudomonas aeruginosa PA01
aagcgccccgggcg

SEQ ID NO: 3431776 - RNA, 17 nt, Pseudomonas aeruginosa PA01
aagcgcccucgcugagc

SEQ ID NO: 3431777 - RNA, 18 nt, Pseudomonas aeruginosa PA01
aagcgccgcggcccggcg

SEQ ID NO: 3431778 - RNA, 20 nt, Pseudomonas aeruginosa PA01
aagcgccggcaacagcagca

SEQ ID NO: 3431779 - RNA, 20 nt, Pseudomonas aeruginosa PA01
aagcgccggcggccugcccc

SEQ ID NO: 3431780 - RNA, 21 nt, Pseudomonas aeruginosa PA01
aagcgccggcggccugccccg

SEQ ID NO: 3431781 - RNA, 13 nt, Pseudomonas aeruginosa PA01
aagcgccucgccu

SEQ ID NO: 3431782 - RNA, 21 nt, Pseudomonas aeruginosa PA01
aagcgcgaguaguaggucggu

SEQ ID NO: 3431783 - RNA, 18 nt, Pseudomonas aeruginosa PA01
aagcgcgcccgauugggc

SEQ ID NO: 3431784 - RNA, 22 nt, Pseudomonas aeruginosa PA01
aagcgcgccugcucuucggcgg

SEQ ID NO: 3431785 - RNA, 13 nt, Pseudomonas aeruginosa PA01
aagcgcgcgccag

SEQ ID NO: 3431786 - RNA, 14 nt, Pseudomonas aeruginosa PA01
aagcgcgcgucggc

SEQ ID NO: 3431787 - RNA, 19 nt, Pseudomonas aeruginosa PA01
aagcggaagccgggaagcc

SEQ ID NO: 3431788 - RNA, 16 nt, Pseudomonas aeruginosa PA01
aagcggaucucgucgc

SEQ ID NO: 3431789 - RNA, 18 nt, Pseudomonas aeruginosa PA01
aagcggaucucgucgccg

SEQ ID NO: 3431790 - RNA, 21 nt, Pseudomonas aeruginosa PA01
aagcggaucucgucgccgacc

SEQ ID NO: 3431791 - RNA, 21 nt, Pseudomonas aeruginosa PA01
aagcggccgagauccugcagc

SEQ ID NO: 3431792 - RNA, 13 nt, Pseudomonas aeruginosa PA01
aagcggccuuuuc

SEQ ID NO: 3431793 - RNA, 21 nt, Pseudomonas aeruginosa PA01
aagcggcgacgccacccgcau

SEQ ID NO: 3431794 - RNA, 19 nt, Pseudomonas aeruginosa PA01
aagcggguucccugcgccu

SEQ ID NO: 3431795 - RNA, 20 nt, Pseudomonas aeruginosa PA01
aagcggguucccugcgccuc

SEQ ID NO: 3431796 - RNA, 20 nt, Pseudomonas aeruginosa PA01
aagcgguagugggcgaggcg

SEQ ID NO: 3431797 - RNA, 22 nt, Pseudomonas aeruginosa PA01
aagcgguagugggcgaggcgcu

SEQ ID NO: 3431798 - RNA, 18 nt, Pseudomonas aeruginosa PA01
aagcgguuagccggcgau

SEQ ID NO: 3431799 - RNA, 20 nt, Pseudomonas aeruginosa PA01
aagcgguucucguccagguc

SEQ ID NO: 3431800 - RNA, 12 nt, Pseudomonas aeruginosa PA01
aagcgguugagu

SEQ ID NO: 3431801 - RNA, 16 nt, Pseudomonas aeruginosa PA01
aagcgguuucgccacc

SEQ ID NO: 3431802 - RNA, 17 nt, Pseudomonas aeruginosa PA01
aagcgguuucgccaccu

SEQ ID NO: 3431803 - RNA, 16 nt, Pseudomonas aeruginosa PA01
aagcguccaggguugg

SEQ ID NO: 3431804 - RNA, 22 nt, Pseudomonas aeruginosa PA01
aagcguccaggguuggaagaaa

SEQ ID NO: 3431805 - RNA, 14 nt, Pseudomonas aeruginosa PA01
aagcgucgugcgcc

SEQ ID NO: 3431806 - RNA, 15 nt, Pseudomonas aeruginosa PA01
aagcgucgugcgccg

SEQ ID NO: 3431807 - RNA, 19 nt, Pseudomonas aeruginosa PA01
aagcgugggcggccggcca

SEQ ID NO: 3431808 - RNA, 22 nt, Pseudomonas aeruginosa PA01
aagcucaccuugaagccuucgc

SEQ ID NO: 3431809 - RNA, 14 nt, Pseudomonas aeruginosa PA01
aagcuccagcgugc

SEQ ID NO: 3431810 - RNA, 21 nt, Pseudomonas aeruginosa PA01
aagcuccccgccgccaggcgc

SEQ ID NO: 3431811 - RNA, 22 nt, Pseudomonas aeruginosa PA01
aagcuccccgccgccaggcgcu

SEQ ID NO: 3431812 - RNA, 20 nt, Pseudomonas aeruginosa PA01
aagcucgcgcaagcgcccgg

SEQ ID NO: 3431813 - RNA, 22 nt, Pseudomonas aeruginosa PA01
aagcugaggccgguguagcgac

SEQ ID NO: 3431814 - RNA, 14 nt, Pseudomonas aeruginosa PA01
aagcugcacggcga

SEQ ID NO: 3431815 - RNA, 16 nt, Pseudomonas aeruginosa PA01
aagcugcacggcgacc

SEQ ID NO: 3431816 - RNA, 15 nt, Pseudomonas aeruginosa PA01
aagcugccccacagg

SEQ ID NO: 3431817 - RNA, 20 nt, Pseudomonas aeruginosa PA01
aagcugccccacaggcccug

SEQ ID NO: 3431818 - RNA, 16 nt, Pseudomonas aeruginosa PA01
aagcugccuuccagca

SEQ ID NO: 3431819 - RNA, 17 nt, Pseudomonas aeruginosa PA01
aagcugccuuccagcag

SEQ ID NO: 3431820 - RNA, 19 nt, Pseudomonas aeruginosa PA01
aagcugccuuccagcaggu

SEQ ID NO: 3431821 - RNA, 21 nt, Pseudomonas aeruginosa PA01
aagcugccuuccagcaggucg

SEQ ID NO: 3431822 - RNA, 17 nt, Pseudomonas aeruginosa PA01
aagcuggagcagcagcg

SEQ ID NO: 3431823 - RNA, 15 nt, Pseudomonas aeruginosa PA01
aagcugucggcccgc

SEQ ID NO: 3431824 - RNA, 16 nt, Pseudomonas aeruginosa PA01
aagcugucggcccgcg

SEQ ID NO: 3431825 - RNA, 19 nt, Pseudomonas aeruginosa PA01
aagcuguucuugauccgcu

SEQ ID NO: 3431826 - RNA, 12 nt, Pseudomonas aeruginosa PA01
aagcuguugcuc

SEQ ID NO: 3431827 - RNA, 13 nt, Pseudomonas aeruginosa PA01
aagcuucaggcuc

SEQ ID NO: 3431828 - RNA, 23 nt, Pseudomonas aeruginosa PA01
aagcuucaucgaggugcuugaca

SEQ ID NO: 3431829 - RNA, 14 nt, Pseudomonas aeruginosa PA01
aagcuucgucgcgc

SEQ ID NO: 3431830 - RNA, 17 nt, Pseudomonas aeruginosa PA01
aagcuucuucggcagcc

SEQ ID NO: 3431831 - RNA, 17 nt, Pseudomonas aeruginosa PA01
aagcuuuuccagcgcac

SEQ ID NO: 3431832 - RNA, 20 nt, Pseudomonas aeruginosa PA01
aaggaccagcuuguggccgg

SEQ ID NO: 3431833 - RNA, 15 nt, Pseudomonas aeruginosa PA01
aaggaccugcugccc

SEQ ID NO: 3431834 - RNA, 16 nt, Pseudomonas aeruginosa PA01
aaggaccugcugcccg

SEQ ID NO: 3431835 - RNA, 16 nt, Pseudomonas aeruginosa PA01
aaggucggcagcagcu

SEQ ID NO: 3431836 - RNA, 11 nt, Pseudomonas aeruginosa PA01
aaggucggcga

SEQ ID NO: 3431837 - RNA, 13 nt, Pseudomonas aeruginosa PA01
aaggucggcgaag

SEQ ID NO: 3431838 - RNA, 18 nt, Pseudomonas aeruginosa PA01
aaggucggucucgccacc

SEQ ID NO: 3431839 - RNA, 16 nt, Pseudomonas aeruginosa PA01
aaggucucgccgccgg

SEQ ID NO: 3431840 - RNA, 23 nt, Pseudomonas aeruginosa PA01
aaggucugcgguauaggccuugg

SEQ ID NO: 3431841 - RNA, 19 nt, Pseudomonas aeruginosa PA01
aaggugcaggccgcgcgau

SEQ ID NO: 3431842 - RNA, 15 nt, Pseudomonas aeruginosa PA01
aaggugcccagggcg

SEQ ID NO: 3431843 - RNA, 17 nt, Pseudomonas aeruginosa PA01
aaggugggcagcagcga

SEQ ID NO: 3431844 - RNA, 18 nt, Pseudomonas aeruginosa PA01
aaggugggcagcagcgaa

SEQ ID NO: 3431845 - RNA, 19 nt, Pseudomonas aeruginosa PA01
aagguuccagccccgccgg

SEQ ID NO: 3431846 - RNA, 21 nt, Pseudomonas aeruginosa PA01
aagguugucgaagcgaucgga

SEQ ID NO: 3431847 - RNA, 15 nt, Pseudomonas aeruginosa PA01
aaguaccgccggcag

SEQ ID NO: 3431848 - RNA, 19 nt, Pseudomonas aeruginosa PA01
aaguacggcgcggugaggg

SEQ ID NO: 3431849 - RNA, 16 nt, Pseudomonas aeruginosa PA01
aaguagauaaaugccc

SEQ ID NO: 3431850 - RNA, 16 nt, Pseudomonas aeruginosa PA01
aaguaggaguagguca

SEQ ID NO: 3431851 - RNA, 16 nt, Pseudomonas aeruginosa PA01
aaguauuucaaccagg

SEQ ID NO: 3431852 - RNA, 17 nt, Pseudomonas aeruginosa PA01
aaguauuucaaccaggc

SEQ ID NO: 3431853 - RNA, 13 nt, Pseudomonas aeruginosa PA01
aagucagccaggu

SEQ ID NO: 3431854 - RNA, 16 nt, Pseudomonas aeruginosa PA01
aagucagguccuuguu

SEQ ID NO: 3431855 - RNA, 18 nt, Pseudomonas aeruginosa PA01
aaguccaccaggcgccgg

SEQ ID NO: 3431856 - RNA, 23 nt, Pseudomonas aeruginosa PA01
aagucccauugcaucugcgccgg

SEQ ID NO: 3431857 - RNA, 15 nt, Pseudomonas aeruginosa PA01
aaguccgggcgcggc

SEQ ID NO: 3431858 - RNA, 18 nt, Pseudomonas aeruginosa PA01
aaguccggguugagcacc

SEQ ID NO: 3431859 - RNA, 17 nt, Pseudomonas aeruginosa PA01
aaguccuggccgagcau

SEQ ID NO: 3431860 - RNA, 17 nt, Pseudomonas aeruginosa PA01
aaguccuugugcugcuc

SEQ ID NO: 3431861 - RNA, 21 nt, Pseudomonas aeruginosa PA01
aagucgaucagcgcgcggacc

SEQ ID NO: 3431862 - RNA, 19 nt, Pseudomonas aeruginosa PA01
aagucgccauccuggucgc

SEQ ID NO: 3431863 - RNA, 13 nt, Pseudomonas aeruginosa PA01
aagucgccggcau

SEQ ID NO: 3431864 - RNA, 22 nt, Pseudomonas aeruginosa PA01
aagucgcgagguuccgcggcga

SEQ ID NO: 3431865 - RNA, 18 nt, Pseudomonas aeruginosa PA01
aagucggccugcaccagc

SEQ ID NO: 3431866 - RNA, 14 nt, Pseudomonas aeruginosa PA01
aagucggcgagccg

SEQ ID NO: 3431867 - RNA, 13 nt, Pseudomonas aeruginosa PA01
aagugauccaggu

SEQ ID NO: 3431868 - RNA, 15 nt, Pseudomonas aeruginosa PA01
aagugcccugggcga

SEQ ID NO: 3431869 - RNA, 20 nt, Pseudomonas aeruginosa PA01
aaguguuagagguugauuca

SEQ ID NO: 3431870 - RNA, 22 nt, Pseudomonas aeruginosa PA01
aaguuacugauuugauugaaaa

SEQ ID NO: 3431871 - RNA, 16 nt, Pseudomonas aeruginosa PA01
aaguucaccucgguga

SEQ ID NO: 3431872 - RNA, 19 nt, Pseudomonas aeruginosa PA01
aaguucgcauaggcggcca

SEQ ID NO: 3431873 - RNA, 16 nt, Pseudomonas aeruginosa PA01
aaguugccgccagcgc

SEQ ID NO: 3431874 - RNA, 19 nt, Pseudomonas aeruginosa PA01
aaguuguacagcgaggccc

SEQ ID NO: 3431875 - RNA, 20 nt, Pseudomonas aeruginosa PA01
aauaaugcggcgcgaugccc

SEQ ID NO: 3431876 - RNA, 21 nt, Pseudomonas aeruginosa PA01
aauacaccgcugcgccgccgu

SEQ ID NO: 3431877 - RNA, 23 nt, Pseudomonas aeruginosa PA01
aauacaccuuggugucgaugccg

SEQ ID NO: 3431878 - RNA, 19 nt, Pseudomonas aeruginosa PA01
aauacugcacgcccaggcg

SEQ ID NO: 3431879 - RNA, 15 nt, Pseudomonas aeruginosa PA01
aauagaaaagaauaa

SEQ ID NO: 3431880 - RNA, 16 nt, Pseudomonas aeruginosa PA01
aauagaucugcaccag

SEQ ID NO: 3431881 - RNA, 16 nt, Pseudomonas aeruginosa PA01
aauagcagccauagca

SEQ ID NO: 3431882 - RNA, 14 nt, Pseudomonas aeruginosa PA01
aauagccggcgcug

SEQ ID NO: 3431883 - RNA, 14 nt, Pseudomonas aeruginosa PA01
aauaggcgcugcgg

SEQ ID NO: 3431884 - RNA, 13 nt, Pseudomonas aeruginosa PA01
aauagggcggcgc

SEQ ID NO: 3431885 - RNA, 22 nt, Pseudomonas aeruginosa PA01
aauagggcggcgccaccgcgac

SEQ ID NO: 3431886 - RNA, 22 nt, Pseudomonas aeruginosa PA01
aauauauuuuucuaaaauggcu

SEQ ID NO: 3431887 - RNA, 14 nt, Pseudomonas aeruginosa PA01
aaucaccgccaccu

SEQ ID NO: 3431888 - RNA, 16 nt, Pseudomonas aeruginosa PA01
aaucagcggcgggcgg

SEQ ID NO: 3431889 - RNA, 11 nt, Pseudomonas aeruginosa PA01
aaucagggcug

SEQ ID NO: 3431890 - RNA, 18 nt, Pseudomonas aeruginosa PA01
aaucauccacaggcggcu

SEQ ID NO: 3431891 - RNA, 17 nt, Pseudomonas aeruginosa PA01
aauccaccuugccgcgc

SEQ ID NO: 3431892 - RNA, 18 nt, Pseudomonas aeruginosa PA01
aauccacgcugugcggca

SEQ ID NO: 3431893 - RNA, 22 nt, Pseudomonas aeruginosa PA01
aauccagggagaacagcagggu

SEQ ID NO: 3431894 - RNA, 21 nt, Pseudomonas aeruginosa PA01
aaucccuuggcugcucgccuc

SEQ ID NO: 3431895 - RNA, 19 nt, Pseudomonas aeruginosa PA01
aauccgcauagugacccca

SEQ ID NO: 3431896 - RNA, 12 nt, Pseudomonas aeruginosa PA01
aauccgccgcuc

SEQ ID NO: 3431897 - RNA, 22 nt, Pseudomonas aeruginosa PA01
aauccgcggcccugcucgccgg

SEQ ID NO: 3431898 - RNA, 11 nt, Pseudomonas aeruginosa PA01
aauccgcucgg

SEQ ID NO: 3431899 - RNA, 15 nt, Pseudomonas aeruginosa PA01
aauccggcgcugccg

SEQ ID NO: 3431900 - RNA, 18 nt, Pseudomonas aeruginosa PA01
aauccggcuggcgccggu

SEQ ID NO: 3431901 - RNA, 15 nt, Pseudomonas aeruginosa PA01
aauccucgcgcaccg

SEQ ID NO: 3431902 - RNA, 13 nt, Pseudomonas aeruginosa PA01
aauccuugaucac

SEQ ID NO: 3431903 - RNA, 22 nt, Pseudomonas aeruginosa PA01
aaucgaacccccgaccuucuca

SEQ ID NO: 3431904 - RNA, 15 nt, Pseudomonas aeruginosa PA01
aaucgagcgccagga

SEQ ID NO: 3431905 - RNA, 13 nt, Pseudomonas aeruginosa PA01
aaucgaugcugua

SEQ ID NO: 3431906 - RNA, 16 nt, Pseudomonas aeruginosa PA01
aaucgaugucgcggcg

SEQ ID NO: 3431907 - RNA, 13 nt, Pseudomonas aeruginosa PA01
aaucgccagcagg

SEQ ID NO: 3431908 - RNA, 18 nt, Pseudomonas aeruginosa PA01
aaucgccauuggccaggg

SEQ ID NO: 3431909 - RNA, 14 nt, Pseudomonas aeruginosa PA01
aaucgcgccaggcc

SEQ ID NO: 3431910 - RNA, 20 nt, Pseudomonas aeruginosa PA01
aaucgcucaacggcgugccg

SEQ ID NO: 3431911 - RNA, 19 nt, Pseudomonas aeruginosa PA01
aaucgcuugacggauaaaa

SEQ ID NO: 3431912 - RNA, 15 nt, Pseudomonas aeruginosa PA01
aaucggcaggcugca

SEQ ID NO: 3431913 - RNA, 22 nt, Pseudomonas aeruginosa PA01
aaucgguugccgcgccaaaaag

SEQ ID NO: 3431914 - RNA, 22 nt, Pseudomonas aeruginosa PA01
aaucgguuggggaggugcggcg

SEQ ID NO: 3431915 - RNA, 17 nt, Pseudomonas aeruginosa PA01
aaucgucacggcgugcc

SEQ ID NO: 3431916 - RNA, 18 nt, Pseudomonas aeruginosa PA01
aaucgucacggcgugccg

SEQ ID NO: 3431917 - RNA, 19 nt, Pseudomonas aeruginosa PA01
aaucgucacggcgugccgc

SEQ ID NO: 3431918 - RNA, 13 nt, Pseudomonas aeruginosa PA01
aaucgucgccgga

SEQ ID NO: 3431919 - RNA, 22 nt, Pseudomonas aeruginosa PA01
aaucugcccggccaugccgccg

SEQ ID NO: 3431920 - RNA, 18 nt, Pseudomonas aeruginosa PA01
aaugacgaucucgaugac

SEQ ID NO: 3431921 - RNA, 19 nt, Pseudomonas aeruginosa PA01
aaugacgaucucgaugacc

SEQ ID NO: 3431922 - RNA, 18 nt, Pseudomonas aeruginosa PA01
aaugcaacccgccgcuga

SEQ ID NO: 3431923 - RNA, 11 nt, Pseudomonas aeruginosa PA01
aaugcccggca

SEQ ID NO: 3431924 - RNA, 17 nt, Pseudomonas aeruginosa PA01
aaugcccggcagcgccg

SEQ ID NO: 3431925 - RNA, 23 nt, Pseudomonas aeruginosa PA01
aaugccgcaccccauccucgccg

SEQ ID NO: 3431926 - RNA, 18 nt, Pseudomonas aeruginosa PA01
aaugccuuccgacgccgc

SEQ ID NO: 3431927 - RNA, 11 nt, Pseudomonas aeruginosa PA01
aaugcgccccc

SEQ ID NO: 3431928 - RNA, 15 nt, Pseudomonas aeruginosa PA01
aaugcggcguggaag

SEQ ID NO: 3431929 - RNA, 22 nt, Pseudomonas aeruginosa PA01
aaugcguuccuguccauuucca

SEQ ID NO: 3431930 - RNA, 23 nt, Pseudomonas aeruginosa PA01
aaugcucgugcagguagccgcgc

SEQ ID NO: 3431931 - RNA, 19 nt, Pseudomonas aeruginosa PA01
aaugcugcccggagcggcu

SEQ ID NO: 3431932 - RNA, 14 nt, Pseudomonas aeruginosa PA01
aaugcuugaaaauc

SEQ ID NO: 3431933 - RNA, 17 nt, Pseudomonas aeruginosa PA01
aaugcuugccggcgccu

SEQ ID NO: 3431934 - RNA, 19 nt, Pseudomonas aeruginosa PA01
aauggaaacgccagcccuc

SEQ ID NO: 3431935 - RNA, 16 nt, Pseudomonas aeruginosa PA01
aauggaacagucgcgc

SEQ ID NO: 3431936 - RNA, 17 nt, Pseudomonas aeruginosa PA01
aauggacaggcgccccu

SEQ ID NO: 3431937 - RNA, 13 nt, Pseudomonas aeruginosa PA01
aauggaugaacgu

SEQ ID NO: 3431938 - RNA, 17 nt, Pseudomonas aeruginosa PA01
acaccgggccgccggcg

SEQ ID NO: 3431939 - RNA, 20 nt, Pseudomonas aeruginosa PA01
acaccgggccgccggcgacg

SEQ ID NO: 3431940 - RNA, 22 nt, Pseudomonas aeruginosa PA01
acaccguguugaucgccgcgcc

SEQ ID NO: 3431941 - RNA, 21 nt, Pseudomonas aeruginosa PA01
acaccguuggcguuaugcgcc

SEQ ID NO: 3431942 - RNA, 15 nt, Pseudomonas aeruginosa PA01
acaccuccagcggcu

SEQ ID NO: 3431943 - RNA, 14 nt, Pseudomonas aeruginosa PA01
acaccucccgggcc

SEQ ID NO: 3431944 - RNA, 18 nt, Pseudomonas aeruginosa PA01
acaccucgaucagcgggu

SEQ ID NO: 3431945 - RNA, 21 nt, Pseudomonas aeruginosa PA01
acaccugaucgaagcccaucg

SEQ ID NO: 3431946 - RNA, 17 nt, Pseudomonas aeruginosa PA01
acaccugcaacgcccgc

SEQ ID NO: 3431947 - RNA, 15 nt, Pseudomonas aeruginosa PA01
acaccuuggcgcgac

SEQ ID NO: 3431948 - RNA, 20 nt, Pseudomonas aeruginosa PA01
acaccuuggugucgaugccg

SEQ ID NO: 3431949 - RNA, 16 nt, Pseudomonas aeruginosa PA01
acacgaaaaagccggc

SEQ ID NO: 3431950 - RNA, 14 nt, Pseudomonas aeruginosa PA01
acacgcacucauag

SEQ ID NO: 3431951 - RNA, 23 nt, Pseudomonas aeruginosa PA01
acacgcacucauagcucagcugg

SEQ ID NO: 3431952 - RNA, 20 nt, Pseudomonas aeruginosa PA01
acacgccccagaagccccag

SEQ ID NO: 3431953 - RNA, 12 nt, Pseudomonas aeruginosa PA01
acacgcccggca

SEQ ID NO: 3431954 - RNA, 19 nt, Pseudomonas aeruginosa PA01
acacgcuucugcuggccgc

SEQ ID NO: 3431955 - RNA, 18 nt, Pseudomonas aeruginosa PA01
acacggauauccgggccc

SEQ ID NO: 3431956 - RNA, 13 nt, Pseudomonas aeruginosa PA01
acacguagcgcag

SEQ ID NO: 3431957 - RNA, 19 nt, Pseudomonas aeruginosa PA01
acacguagcgcaggucgcu

SEQ ID NO: 3431958 - RNA, 14 nt, Pseudomonas aeruginosa PA01
acacgucggcgcgc

SEQ ID NO: 3431959 - RNA, 23 nt, Pseudomonas aeruginosa PA01
acacugauauccgcucuguaggg

SEQ ID NO: 3431960 - RNA, 23 nt, Pseudomonas aeruginosa PA01
acacuugaccgucggcaagcagg

SEQ ID NO: 3431961 - RNA, 17 nt, Pseudomonas aeruginosa PA01
acagaaguugcuggcga

SEQ ID NO: 3431962 - RNA, 12 nt, Pseudomonas aeruginosa PA01
acagagcggccg

SEQ ID NO: 3431963 - RNA, 18 nt, Pseudomonas aeruginosa PA01
acagauauugaugcaagg

SEQ ID NO: 3431964 - RNA, 15 nt, Pseudomonas aeruginosa PA01
acagaucgccagcuc

SEQ ID NO: 3431965 - RNA, 16 nt, Pseudomonas aeruginosa PA01
acagaucuuccucgga

SEQ ID NO: 3431966 - RNA, 18 nt, Pseudomonas aeruginosa PA01
acagcaccacgccgcugg

SEQ ID NO: 3431967 - RNA, 20 nt, Pseudomonas aeruginosa PA01
acagcaccacgccgcuggcg

SEQ ID NO: 3431968 - RNA, 15 nt, Pseudomonas aeruginosa PA01
acagcacccgguagc

SEQ ID NO: 3431969 - RNA, 12 nt, Pseudomonas aeruginosa PA01
acagcaccuugg

SEQ ID NO: 3431970 - RNA, 14 nt, Pseudomonas aeruginosa PA01
acagcaccuuggcc

SEQ ID NO: 3431971 - RNA, 20 nt, Pseudomonas aeruginosa PA01
acagcaccuuggccaugggc

SEQ ID NO: 3431972 - RNA, 19 nt, Pseudomonas aeruginosa PA01
acagcacgcucaggcagcg

SEQ ID NO: 3431973 - RNA, 13 nt, Pseudomonas aeruginosa PA01
acagcacgucgau

SEQ ID NO: 3431974 - RNA, 16 nt, Pseudomonas aeruginosa PA01
acagcagcaagccgau

SEQ ID NO: 3431975 - RNA, 18 nt, Pseudomonas aeruginosa PA01
acagcagcggcaccagca

SEQ ID NO: 3431976 - RNA, 19 nt, Pseudomonas aeruginosa PA01
acagcagcggcaccagcac

SEQ ID NO: 3431977 - RNA, 22 nt, Pseudomonas aeruginosa PA01
acagcaggagaagcgccucgcc

SEQ ID NO: 3431978 - RNA, 11 nt, Pseudomonas aeruginosa PA01
acagcaggcag

SEQ ID NO: 3431979 - RNA, 14 nt, Pseudomonas aeruginosa PA01
acagcaggcaggca

SEQ ID NO: 3431980 - RNA, 15 nt, Pseudomonas aeruginosa PA01
acagcagggucaggg

SEQ ID NO: 3431981 - RNA, 18 nt, Pseudomonas aeruginosa PA01
acagcaggucgugcugga

SEQ ID NO: 3431982 - RNA, 18 nt, Pseudomonas aeruginosa PA01
acagcaucagaggcaaca

SEQ ID NO: 3431983 - RNA, 23 nt, Pseudomonas aeruginosa PA01
acagcaucugcugguccuggcgc

SEQ ID NO: 3431984 - RNA, 12 nt, Pseudomonas aeruginosa PA01
acagcaugguga

SEQ ID NO: 3431985 - RNA, 17 nt, Pseudomonas aeruginosa PA01
acagccaggggcacgcu

SEQ ID NO: 3431986 - RNA, 19 nt, Pseudomonas aeruginosa PA01
acagccaguaguccuccgc

SEQ ID NO: 3431987 - RNA, 16 nt, Pseudomonas aeruginosa PA01
acagccauagcgccgg

SEQ ID NO: 3431988 - RNA, 18 nt, Pseudomonas aeruginosa PA01
acagccauagugcugggc

SEQ ID NO: 3431989 - RNA, 19 nt, Pseudomonas aeruginosa PA01
acagccauagugcugggcg

SEQ ID NO: 3431990 - RNA, 21 nt, Pseudomonas aeruginosa PA01
acagccauagugcugggcgac

SEQ ID NO: 3431991 - RNA, 14 nt, Pseudomonas aeruginosa PA01
acagccccagccuc

SEQ ID NO: 3431992 - RNA, 21 nt, Pseudomonas aeruginosa PA01
acagccccagccucggcaggg

SEQ ID NO: 3431993 - RNA, 18 nt, Pseudomonas aeruginosa PA01
acagcccccaggcaccgu

SEQ ID NO: 3431994 - RNA, 16 nt, Pseudomonas aeruginosa PA01
acagcccccgccggcc

SEQ ID NO: 3431995 - RNA, 18 nt, Pseudomonas aeruginosa PA01
acagcccgcgcucggccg

SEQ ID NO: 3431996 - RNA, 19 nt, Pseudomonas aeruginosa PA01
acagcccgucgcgcgccgg

SEQ ID NO: 3431997 - RNA, 23 nt, Pseudomonas aeruginosa PA01
acagccgcagaugcuccagggag

SEQ ID NO: 3431998 - RNA, 15 nt, Pseudomonas aeruginosa PA01
acagccgcagcggca

SEQ ID NO: 3431999 - RNA, 20 nt, Pseudomonas aeruginosa PA01
acagccgggaucuccucgac

SEQ ID NO: 3432000 - RNA, 18 nt, Pseudomonas aeruginosa PA01
acagccuucgagccacuc

SEQ ID NO: 3432001 - RNA, 14 nt, Pseudomonas aeruginosa PA01
acagcgaagcuggc

SEQ ID NO: 3432002 - RNA, 23 nt, Pseudomonas aeruginosa PA01
acagcgacucgcugccggcgcgc

SEQ ID NO: 3432003 - RNA, 22 nt, Pseudomonas aeruginosa PA01
acagcgagacccgguacuccuc

SEQ ID NO: 3432004 - RNA, 15 nt, Pseudomonas aeruginosa PA01
acagcgagaccucgc

SEQ ID NO: 3432005 - RNA, 15 nt, Pseudomonas aeruginosa PA01
acagcgagaggggcg

SEQ ID NO: 3432006 - RNA, 18 nt, Pseudomonas aeruginosa PA01
acagcgagaggggcgcuc

SEQ ID NO: 3432007 - RNA, 14 nt, Pseudomonas aeruginosa PA01
acagcgaggcccgc

SEQ ID NO: 3432008 - RNA, 20 nt, Pseudomonas aeruginosa PA01
acagcgaggcccgcgccgcc

SEQ ID NO: 3432009 - RNA, 16 nt, Pseudomonas aeruginosa PA01
acagcgccaccagcau

SEQ ID NO: 3432010 - RNA, 20 nt, Pseudomonas aeruginosa PA01
acagcgccacggccagcagg

SEQ ID NO: 3432011 - RNA, 13 nt, Pseudomonas aeruginosa PA01
acagcgccagcgg

SEQ ID NO: 3432012 - RNA, 15 nt, Pseudomonas aeruginosa PA01
acagcgccagcggca

SEQ ID NO: 3432013 - RNA, 17 nt, Pseudomonas aeruginosa PA01
acagcgccagcggcagc

SEQ ID NO: 3432014 - RNA, 20 nt, Pseudomonas aeruginosa PA01
acagcgcccagacacgccuc

SEQ ID NO: 3432015 - RNA, 16 nt, Pseudomonas aeruginosa PA01
acagcgccgcgcgcuu

SEQ ID NO: 3432016 - RNA, 21 nt, Pseudomonas aeruginosa PA01
acagcgccuggucggcggccu

SEQ ID NO: 3432017 - RNA, 23 nt, Pseudomonas aeruginosa PA01
acagcgccuggucggcggccuug

SEQ ID NO: 3432018 - RNA, 19 nt, Pseudomonas aeruginosa PA01
acagcgcgacaucggcgau

SEQ ID NO: 3432019 - RNA, 21 nt, Pseudomonas aeruginosa PA01
acagcgcgacaucggcgaugg

SEQ ID NO: 3432020 - RNA, 18 nt, Pseudomonas aeruginosa PA01
acagcgcgucgcggucuu

SEQ ID NO: 3432021 - RNA, 15 nt, Pseudomonas aeruginosa PA01
acagcggaaugcuuc

SEQ ID NO: 3432022 - RNA, 15 nt, Pseudomonas aeruginosa PA01
acagcggcuggcccu

SEQ ID NO: 3432023 - RNA, 14 nt, Pseudomonas aeruginosa PA01
acagcggcuggcgc

SEQ ID NO: 3432024 - RNA, 21 nt, Pseudomonas aeruginosa PA01
acagcgggucgcggcuggccg

SEQ ID NO: 3432025 - RNA, 23 nt, Pseudomonas aeruginosa PA01
acagcgggucgcggcuggccgcc

SEQ ID NO: 3432026 - RNA, 15 nt, Pseudomonas aeruginosa PA01
acagcgggucggcga

SEQ ID NO: 3432027 - RNA, 16 nt, Pseudomonas aeruginosa PA01
acagcgucgccaacgc

SEQ ID NO: 3432028 - RNA, 22 nt, Pseudomonas aeruginosa PA01
acagcgucugggugaccagcag

SEQ ID NO: 3432029 - RNA, 18 nt, Pseudomonas aeruginosa PA01
acagcgugcagaccaggg

SEQ ID NO: 3432030 - RNA, 17 nt, Pseudomonas aeruginosa PA01
acagcguggccagcgcc

SEQ ID NO: 3432031 - RNA, 20 nt, Pseudomonas aeruginosa PA01
acagcguggccagcgcccag

SEQ ID NO: 3432032 - RNA, 14 nt, Pseudomonas aeruginosa PA01
acagcuccuccagc

SEQ ID NO: 3432033 - RNA, 17 nt, Pseudomonas aeruginosa PA01
acagcuccuccagccgc

SEQ ID NO: 3432034 - RNA, 19 nt, Pseudomonas aeruginosa PA01
acagcuccuccagcguggc

SEQ ID NO: 3432035 - RNA, 20 nt, Pseudomonas aeruginosa PA01
acagcucgcgcaaccagccg

SEQ ID NO: 3432036 - RNA, 17 nt, Pseudomonas aeruginosa PA01
acagcucgcugucgccg

SEQ ID NO: 3432037 - RNA, 18 nt, Pseudomonas aeruginosa PA01
acagcucgcugucgccga

SEQ ID NO: 3432038 - RNA, 17 nt, Pseudomonas aeruginosa PA01
acagcucggcgcccugg

SEQ ID NO: 3432039 - RNA, 19 nt, Pseudomonas aeruginosa PA01
acagcucggcgcccuggcc

SEQ ID NO: 3432040 - RNA, 13 nt, Pseudomonas aeruginosa PA01
acaugcaggccgg

SEQ ID NO: 3432041 - RNA, 15 nt, Pseudomonas aeruginosa PA01
acaugcaggccggcc

SEQ ID NO: 3432042 - RNA, 16 nt, Pseudomonas aeruginosa PA01
acaugcaggcucucgc

SEQ ID NO: 3432043 - RNA, 16 nt, Pseudomonas aeruginosa PA01
acaugcccgcgcgcau

SEQ ID NO: 3432044 - RNA, 15 nt, Pseudomonas aeruginosa PA01
acaugccgaagagcu

SEQ ID NO: 3432045 - RNA, 16 nt, Pseudomonas aeruginosa PA01
acaugccgaagagcuu

SEQ ID NO: 3432046 - RNA, 14 nt, Pseudomonas aeruginosa PA01
acaugccgagcgaa

SEQ ID NO: 3432047 - RNA, 22 nt, Pseudomonas aeruginosa PA01
acaugccgguucccgcagcgau

SEQ ID NO: 3432048 - RNA, 12 nt, Pseudomonas aeruginosa PA01
acaugcgcucgu

SEQ ID NO: 3432049 - RNA, 14 nt, Pseudomonas aeruginosa PA01
acauggcgcucgag

SEQ ID NO: 3432050 - RNA, 22 nt, Pseudomonas aeruginosa PA01
acauggcgucggcgaucacguc

SEQ ID NO: 3432051 - RNA, 17 nt, Pseudomonas aeruginosa PA01
acaugggaaccucggca

SEQ ID NO: 3432052 - RNA, 22 nt, Pseudomonas aeruginosa PA01
acaugggaaccucggcaggcug

SEQ ID NO: 3432053 - RNA, 13 nt, Pseudomonas aeruginosa PA01
acaugggccgcgc

SEQ ID NO: 3432054 - RNA, 14 nt, Pseudomonas aeruginosa PA01
acaugggcgaccgg

SEQ ID NO: 3432055 - RNA, 23 nt, Pseudomonas aeruginosa PA01
acauggguguccggauugccgcg

SEQ ID NO: 3432056 - RNA, 20 nt, Pseudomonas aeruginosa PA01
acauggucgagaaggcugcc

SEQ ID NO: 3432057 - RNA, 22 nt, Pseudomonas aeruginosa PA01
acauggucgagaaggcugccgg

SEQ ID NO: 3432058 - RNA, 16 nt, Pseudomonas aeruginosa PA01
acauggucggccaggu

SEQ ID NO: 3432059 - RNA, 15 nt, Pseudomonas aeruginosa PA01
acauugccaccacca

SEQ ID NO: 3432060 - RNA, 23 nt, Pseudomonas aeruginosa PA01
acauuuccuugaccaucuuuucc

SEQ ID NO: 3432061 - RNA, 13 nt, Pseudomonas aeruginosa PA01
accaacagccggc

SEQ ID NO: 3432062 - RNA, 13 nt, Pseudomonas aeruginosa PA01
accaaggugcugg

SEQ ID NO: 3432063 - RNA, 20 nt, Pseudomonas aeruginosa PA01
accaaugccagugccucgcg

SEQ ID NO: 3432064 - RNA, 21 nt, Pseudomonas aeruginosa PA01
accaaugccagugccucgcgc

SEQ ID NO: 3432065 - RNA, 21 nt, Pseudomonas aeruginosa PA01
accaauuuuaauuuugcuacc

SEQ ID NO: 3432066 - RNA, 21 nt, Pseudomonas aeruginosa PA01
accacaaccagccaugcaggc

SEQ ID NO: 3432067 - RNA, 15 nt, Pseudomonas aeruginosa PA01
accacacaugcaggu

SEQ ID NO: 3432068 - RNA, 23 nt, Pseudomonas aeruginosa PA01
accacacaugcaggucgugcagc

SEQ ID NO: 3432069 - RNA, 16 nt, Pseudomonas aeruginosa PA01
accacaccaggucgcc

SEQ ID NO: 3432070 - RNA, 19 nt, Pseudomonas aeruginosa PA01
accacaccaggucgccgca

SEQ ID NO: 3432071 - RNA, 21 nt, Pseudomonas aeruginosa PA01
accacaccaggucgccgcaca

SEQ ID NO: 3432072 - RNA, 15 nt, Pseudomonas aeruginosa PA01
accacaccugcaaca

SEQ ID NO: 3432073 - RNA, 16 nt, Pseudomonas aeruginosa PA01
accacagcaccacgcu

SEQ ID NO: 3432074 - RNA, 21 nt, Pseudomonas aeruginosa PA01
accacaggcggcggaagaagc

SEQ ID NO: 3432075 - RNA, 23 nt, Pseudomonas aeruginosa PA01
accacaggcggcggaagaagccc

SEQ ID NO: 3432076 - RNA, 14 nt, Pseudomonas aeruginosa PA01
accacauccuugcc

SEQ ID NO: 3432077 - RNA, 15 nt, Pseudomonas aeruginosa PA01
accacaugggugucc

SEQ ID NO: 3432078 - RNA, 19 nt, Pseudomonas aeruginosa PA01
accaccaccgacgccggac

SEQ ID NO: 3432079 - RNA, 14 nt, Pseudomonas aeruginosa PA01
accaccaccgcgcc

SEQ ID NO: 3432080 - RNA, 15 nt, Pseudomonas aeruginosa PA01
accaccaccgcgccg

SEQ ID NO: 3432081 - RNA, 22 nt, Pseudomonas aeruginosa PA01
accaccacgaucugcuugcgcg

SEQ ID NO: 3432082 - RNA, 17 nt, Pseudomonas aeruginosa PA01
accaccacgccgucgcc

SEQ ID NO: 3432083 - RNA, 22 nt, Pseudomonas aeruginosa PA01
accaccacgguguugccguggu

SEQ ID NO: 3432084 - RNA, 14 nt, Pseudomonas aeruginosa PA01
accaccacucgcga

SEQ ID NO: 3432085 - RNA, 23 nt, Pseudomonas aeruginosa PA01
accaccacucgcgagcuggcgcc

SEQ ID NO: 3432086 - RNA, 24 nt, Pseudomonas aeruginosa PA01
accaccacucgcgagcuggcgccg

SEQ ID NO: 3432087 - RNA, 12 nt, Pseudomonas aeruginosa PA01
accaccagcagg

SEQ ID NO: 3432088 - RNA, 13 nt, Pseudomonas aeruginosa PA01
accaccagcagga

SEQ ID NO: 3432089 - RNA, 17 nt, Pseudomonas aeruginosa PA01
accaccagcaggcccag

SEQ ID NO: 3432090 - RNA, 20 nt, Pseudomonas aeruginosa PA01
accaccagcaggcccaguuc

SEQ ID NO: 3432091 - RNA, 15 nt, Pseudomonas aeruginosa PA01
accaccagcgccgcc

SEQ ID NO: 3432092 - RNA, 20 nt, Pseudomonas aeruginosa PA01
accaccagcgcgcgcuggcg

SEQ ID NO: 3432093 - RNA, 23 nt, Pseudomonas aeruginosa PA01
accaccaggaaggcgucgccguc

SEQ ID NO: 3432094 - RNA, 11 nt, Pseudomonas aeruginosa PA01
accaccaggcg

SEQ ID NO: 3432095 - RNA, 13 nt, Pseudomonas aeruginosa PA01
accaccaggucga

SEQ ID NO: 3432096 - RNA, 15 nt, Pseudomonas aeruginosa PA01
accaccaggucggcg

SEQ ID NO: 3432097 - RNA, 16 nt, Pseudomonas aeruginosa PA01
accaccaggucggcgc

SEQ ID NO: 3432098 - RNA, 15 nt, Pseudomonas aeruginosa PA01
accaccaucaccgcc

SEQ ID NO: 3432099 - RNA, 14 nt, Pseudomonas aeruginosa PA01
accaccaucgccgc

SEQ ID NO: 3432100 - RNA, 15 nt, Pseudomonas aeruginosa PA01
accacccgcagcccc

SEQ ID NO: 3432101 - RNA, 15 nt, Pseudomonas aeruginosa PA01
accacccggccgcgc

SEQ ID NO: 3432102 - RNA, 17 nt, Pseudomonas aeruginosa PA01
accacccggccgcgcuc

SEQ ID NO: 3432103 - RNA, 21 nt, Pseudomonas aeruginosa PA01
accacccggcgcacgccggcc

SEQ ID NO: 3432104 - RNA, 23 nt, Pseudomonas aeruginosa PA01
accacccggcgcacgccggccuc

SEQ ID NO: 3432105 - RNA, 17 nt, Pseudomonas aeruginosa PA01
accacccuguccugcuc

SEQ ID NO: 3432106 - RNA, 15 nt, Pseudomonas aeruginosa PA01
accaccgacgccgga

SEQ ID NO: 3432107 - RNA, 13 nt, Pseudomonas aeruginosa PA01
accaccgccaggc

SEQ ID NO: 3432108 - RNA, 14 nt, Pseudomonas aeruginosa PA01
accaccgccaggcu

SEQ ID NO: 3432109 - RNA, 15 nt, Pseudomonas aeruginosa PA01
accaccgccaggcug

SEQ ID NO: 3432110 - RNA, 13 nt, Pseudomonas aeruginosa PA01
accaccgccgcca

SEQ ID NO: 3432111 - RNA, 14 nt, Pseudomonas aeruginosa PA01
accaccgccgccag

SEQ ID NO: 3432112 - RNA, 17 nt, Pseudomonas aeruginosa PA01
accaccgccgccagcaa

SEQ ID NO: 3432113 - RNA, 13 nt, Pseudomonas aeruginosa PA01
accaccgcgccga

SEQ ID NO: 3432114 - RNA, 21 nt, Pseudomonas aeruginosa PA01
accaccggaccgggcgccucg

SEQ ID NO: 3432115 - RNA, 22 nt, Pseudomonas aeruginosa PA01
accaccggcuggcggcucggcu

SEQ ID NO: 3432116 - RNA, 23 nt, Pseudomonas aeruginosa PA01
accaccgggaucgcuaccgacag

SEQ ID NO: 3432117 - RNA, 21 nt, Pseudomonas aeruginosa PA01
accaccgggaugaacugcagc

SEQ ID NO: 3432118 - RNA, 12 nt, Pseudomonas aeruginosa PA01
accaccgguuug

SEQ ID NO: 3432119 - RNA, 15 nt, Pseudomonas aeruginosa PA01
accaccgucuggcgc

SEQ ID NO: 3432120 - RNA, 22 nt, Pseudomonas aeruginosa PA01
accaccgugcccgccggcgcgc

SEQ ID NO: 3432121 - RNA, 20 nt, Pseudomonas aeruginosa PA01
accaccucgacggcgaucuc

SEQ ID NO: 3432122 - RNA, 20 nt, Pseudomonas aeruginosa PA01
accaccugcuugggcgccuc

SEQ ID NO: 3432123 - RNA, 21 nt, Pseudomonas aeruginosa PA01
accaccugcuugggcgccucg

SEQ ID NO: 3432124 - RNA, 20 nt, Pseudomonas aeruginosa PA01
accaccuggauggugcccgg

SEQ ID NO: 3432125 - RNA, 22 nt, Pseudomonas aeruginosa PA01
accaccuucaggcugcucaugc

SEQ ID NO: 3432126 - RNA, 17 nt, Pseudomonas aeruginosa PA01
accacgaagaacggcgc

SEQ ID NO: 3432127 - RNA, 14 nt, Pseudomonas aeruginosa PA01
accacgaucaggcc

SEQ ID NO: 3432128 - RNA, 22 nt, Pseudomonas aeruginosa PA01
accacgaucaggcccuuuucca

SEQ ID NO: 3432129 - RNA, 17 nt, Pseudomonas aeruginosa PA01
accacgcaggccagcgc

SEQ ID NO: 3432130 - RNA, 22 nt, Pseudomonas aeruginosa PA01
accacgcaggccagcgccaggg

SEQ ID NO: 3432131 - RNA, 15 nt, Pseudomonas aeruginosa PA01
accacgcaggcgcgu

SEQ ID NO: 3432132 - RNA, 18 nt, Pseudomonas aeruginosa PA01
accacgcauugucgggcg

SEQ ID NO: 3432133 - RNA, 14 nt, Pseudomonas aeruginosa PA01
accacgccugccau

SEQ ID NO: 3432134 - RNA, 15 nt, Pseudomonas aeruginosa PA01
accacgcuccuggaa

SEQ ID NO: 3432135 - RNA, 14 nt, Pseudomonas aeruginosa PA01
accacgcuggucac

SEQ ID NO: 3432136 - RNA, 22 nt, Pseudomonas aeruginosa PA01
accacgcuggucaccgucugca

SEQ ID NO: 3432137 - RNA, 16 nt, Pseudomonas aeruginosa PA01
accacggccuucggca

SEQ ID NO: 3432138 - RNA, 18 nt, Pseudomonas aeruginosa PA01
accacgggaauggcggau

SEQ ID NO: 3432139 - RNA, 14 nt, Pseudomonas aeruginosa PA01
accacgggcaguuc

SEQ ID NO: 3432140 - RNA, 14 nt, Pseudomonas aeruginosa PA01
accacggugaucag

SEQ ID NO: 3432141 - RNA, 15 nt, Pseudomonas aeruginosa PA01
accacguagccggcg

SEQ ID NO: 3432142 - RNA, 18 nt, Pseudomonas aeruginosa PA01
accacguaguaggcgcgg

SEQ ID NO: 3432143 - RNA, 21 nt, Pseudomonas aeruginosa PA01
accagcgcgauacccuggccg

SEQ ID NO: 3432144 - RNA, 20 nt, Pseudomonas aeruginosa PA01
accagcgcgcucuucgccgc

SEQ ID NO: 3432145 - RNA, 14 nt, Pseudomonas aeruginosa PA01
accagcgcuucggc

SEQ ID NO: 3432146 - RNA, 17 nt, Pseudomonas aeruginosa PA01
accagcgcuucggcggc

SEQ ID NO: 3432147 - RNA, 15 nt, Pseudomonas aeruginosa PA01
accagcggcccggcg

SEQ ID NO: 3432148 - RNA, 12 nt, Pseudomonas aeruginosa PA01
accagcggcggu

SEQ ID NO: 3432149 - RNA, 21 nt, Pseudomonas aeruginosa PA01
accagcggcuggcugaagccg

SEQ ID NO: 3432150 - RNA, 21 nt, Pseudomonas aeruginosa PA01
accagcgggucgucgaagcgc

SEQ ID NO: 3432151 - RNA, 19 nt, Pseudomonas aeruginosa PA01
accagcgucgccaggccgu

SEQ ID NO: 3432152 - RNA, 20 nt, Pseudomonas aeruginosa PA01
accagcgugggcaacaggcc

SEQ ID NO: 3432153 - RNA, 21 nt, Pseudomonas aeruginosa PA01
accagcucagcuccaggccgc

SEQ ID NO: 3432154 - RNA, 21 nt, Pseudomonas aeruginosa PA01
accagcuccccgucccucagg

SEQ ID NO: 3432155 - RNA, 19 nt, Pseudomonas aeruginosa PA01
accagcucgaagccgccgu

SEQ ID NO: 3432156 - RNA, 13 nt, Pseudomonas aeruginosa PA01
accagcucggcgg

SEQ ID NO: 3432157 - RNA, 14 nt, Pseudomonas aeruginosa PA01
accagcucggcggg

SEQ ID NO: 3432158 - RNA, 22 nt, Pseudomonas aeruginosa PA01
accagcucggcgggacggcgca

SEQ ID NO: 3432159 - RNA, 22 nt, Pseudomonas aeruginosa PA01
accagcuucaaccguggcucga

SEQ ID NO: 3432160 - RNA, 23 nt, Pseudomonas aeruginosa PA01
accagcuucaaccguggcucgau

SEQ ID NO: 3432161 - RNA, 22 nt, Pseudomonas aeruginosa PA01
accagcuugaugcuuucgaagc

SEQ ID NO: 3432162 - RNA, 23 nt, Pseudomonas aeruginosa PA01
accagcuugcgucccuuggcguc

SEQ ID NO: 3432163 - RNA, 15 nt, Pseudomonas aeruginosa PA01
accagcuugucgccu

SEQ ID NO: 3432164 - RNA, 17 nt, Pseudomonas aeruginosa PA01
accagcuugucgccuuc

SEQ ID NO: 3432165 - RNA, 16 nt, Pseudomonas aeruginosa PA01
accaggaaaucgccgu

SEQ ID NO: 3432166 - RNA, 18 nt, Pseudomonas aeruginosa PA01
accaggaagccccagaag

SEQ ID NO: 3432167 - RNA, 23 nt, Pseudomonas aeruginosa PA01
accaggaagcgucgugcgccggc

SEQ ID NO: 3432168 - RNA, 13 nt, Pseudomonas aeruginosa PA01
accaggaagcucg

SEQ ID NO: 3432169 - RNA, 14 nt, Pseudomonas aeruginosa PA01
accaggaaggccgg

SEQ ID NO: 3432170 - RNA, 22 nt, Pseudomonas aeruginosa PA01
accaggaaggcguagaccucgc

SEQ ID NO: 3432171 - RNA, 16 nt, Pseudomonas aeruginosa PA01
accaggaaggcgucgc

SEQ ID NO: 3432172 - RNA, 13 nt, Pseudomonas aeruginosa PA01
accaggaauuccu

SEQ ID NO: 3432173 - RNA, 19 nt, Pseudomonas aeruginosa PA01
accaggaccagcgccugcu

SEQ ID NO: 3432174 - RNA, 16 nt, Pseudomonas aeruginosa PA01
accaggacccagauga

SEQ ID NO: 3432175 - RNA, 22 nt, Pseudomonas aeruginosa PA01
accaggacccagaugaucuuca

SEQ ID NO: 3432176 - RNA, 13 nt, Pseudomonas aeruginosa PA01
accaggagcgcca

SEQ ID NO: 3432177 - RNA, 17 nt, Pseudomonas aeruginosa PA01
accaggagcgccagcac

SEQ ID NO: 3432178 - RNA, 22 nt, Pseudomonas aeruginosa PA01
accaggaucgaccccgccgggg

SEQ ID NO: 3432179 - RNA, 17 nt, Pseudomonas aeruginosa PA01
accaggccaggcugcgc

SEQ ID NO: 3432180 - RNA, 19 nt, Pseudomonas aeruginosa PA01
accaggccaggcugcgcuu

SEQ ID NO: 3432181 - RNA, 17 nt, Pseudomonas aeruginosa PA01
accaggccauagcgcgc

SEQ ID NO: 3432182 - RNA, 19 nt, Pseudomonas aeruginosa PA01
accaggccauagcgcgccg

SEQ ID NO: 3432183 - RNA, 19 nt, Pseudomonas aeruginosa PA01
accaggccgaacgggaagu

SEQ ID NO: 3432184 - RNA, 21 nt, Pseudomonas aeruginosa PA01
accaggccgaacgggaaguag

SEQ ID NO: 3432185 - RNA, 18 nt, Pseudomonas aeruginosa PA01
accaggccgagcaggaag

SEQ ID NO: 3432186 - RNA, 22 nt, Pseudomonas aeruginosa PA01
accaggccgccaugcucggcca

SEQ ID NO: 3432187 - RNA, 15 nt, Pseudomonas aeruginosa PA01
accaggccgcugccg

SEQ ID NO: 3432188 - RNA, 12 nt, Pseudomonas aeruginosa PA01
accaggcgaugc

SEQ ID NO: 3432189 - RNA, 14 nt, Pseudomonas aeruginosa PA01
accaggcgaugcgc

SEQ ID NO: 3432190 - RNA, 16 nt, Pseudomonas aeruginosa PA01
accaggcgccagggac

SEQ ID NO: 3432191 - RNA, 20 nt, Pseudomonas aeruginosa PA01
accaggcgccgcccccggcc

SEQ ID NO: 3432192 - RNA, 20 nt, Pseudomonas aeruginosa PA01
accaggcggccgucggccug

SEQ ID NO: 3432193 - RNA, 21 nt, Pseudomonas aeruginosa PA01
accaggcgguacaccgccagg

SEQ ID NO: 3432194 - RNA, 17 nt, Pseudomonas aeruginosa PA01
accaggcgguuggcccg

SEQ ID NO: 3432195 - RNA, 20 nt, Pseudomonas aeruginosa PA01
accaggcgguuggcccgcgc

SEQ ID NO: 3432196 - RNA, 13 nt, Pseudomonas aeruginosa PA01
accaggcugauca

SEQ ID NO: 3432197 - RNA, 14 nt, Pseudomonas aeruginosa PA01
accaggcugaucag

SEQ ID NO: 3432198 - RNA, 14 nt, Pseudomonas aeruginosa PA01
accaggcuggccag

SEQ ID NO: 3432199 - RNA, 15 nt, Pseudomonas aeruginosa PA01
accagggaagcgcgc

SEQ ID NO: 3432200 - RNA, 20 nt, Pseudomonas aeruginosa PA01
accagggaagcgcgcgccag

SEQ ID NO: 3432201 - RNA, 23 nt, Pseudomonas aeruginosa PA01
accagggccgggucguacaccag

SEQ ID NO: 3432202 - RNA, 13 nt, Pseudomonas aeruginosa PA01
accagggccucgg

SEQ ID NO: 3432203 - RNA, 13 nt, Pseudomonas aeruginosa PA01
accagggcgaugg

SEQ ID NO: 3432204 - RNA, 16 nt, Pseudomonas aeruginosa PA01
accagggcgggccgcu

SEQ ID NO: 3432205 - RNA, 19 nt, Pseudomonas aeruginosa PA01
accagggcgggccgcucgc

SEQ ID NO: 3432206 - RNA, 16 nt, Pseudomonas aeruginosa PA01
accaggggucgacgca

SEQ ID NO: 3432207 - RNA, 15 nt, Pseudomonas aeruginosa PA01
accagggucgccagg

SEQ ID NO: 3432208 - RNA, 18 nt, Pseudomonas aeruginosa PA01
accagggucgggccgcgc

SEQ ID NO: 3432209 - RNA, 15 nt, Pseudomonas aeruginosa PA01
accagggucuccagg

SEQ ID NO: 3432210 - RNA, 15 nt, Pseudomonas aeruginosa PA01
accagggugcgcucg

SEQ ID NO: 3432211 - RNA, 15 nt, Pseudomonas aeruginosa PA01
accaggguggcgcgc

SEQ ID NO: 3432212 - RNA, 23 nt, Pseudomonas aeruginosa PA01
accaggguggcgcgcaccaccug

SEQ ID NO: 3432213 - RNA, 13 nt, Pseudomonas aeruginosa PA01
accaggguggcgg

SEQ ID NO: 3432214 - RNA, 16 nt, Pseudomonas aeruginosa PA01
accaggguggcggcgg

SEQ ID NO: 3432215 - RNA, 16 nt, Pseudomonas aeruginosa PA01
accagguagagcagcc

SEQ ID NO: 3432216 - RNA, 21 nt, Pseudomonas aeruginosa PA01
accagguccgccacuucaagc

SEQ ID NO: 3432217 - RNA, 14 nt, Pseudomonas aeruginosa PA01
accaggucgauccu

SEQ ID NO: 3432218 - RNA, 20 nt, Pseudomonas aeruginosa PA01
accaggucgccaugcccguc

SEQ ID NO: 3432219 - RNA, 20 nt, Pseudomonas aeruginosa PA01
accaggucgccgcacaccgc

SEQ ID NO: 3432220 - RNA, 23 nt, Pseudomonas aeruginosa PA01
accaggucgcggaucaggcuggg

SEQ ID NO: 3432221 - RNA, 15 nt, Pseudomonas aeruginosa PA01
accaggucggcgcgc

SEQ ID NO: 3432222 - RNA, 17 nt, Pseudomonas aeruginosa PA01
accaggucggcgcgcga

SEQ ID NO: 3432223 - RNA, 18 nt, Pseudomonas aeruginosa PA01
accaggucggcgcgcgac

SEQ ID NO: 3432224 - RNA, 18 nt, Pseudomonas aeruginosa PA01
accaggucguggaaggcu

SEQ ID NO: 3432225 - RNA, 16 nt, Pseudomonas aeruginosa PA01
accaggugaugcacgu

SEQ ID NO: 3432226 - RNA, 22 nt, Pseudomonas aeruginosa PA01
accagguucugccagagcgcug

SEQ ID NO: 3432227 - RNA, 23 nt, Pseudomonas aeruginosa PA01
accagguugaagaacggcccgcu

SEQ ID NO: 3432228 - RNA, 17 nt, Pseudomonas aeruginosa PA01
accagguugcccggcuu

SEQ ID NO: 3432229 - RNA, 21 nt, Pseudomonas aeruginosa PA01
accagguugugaucgaccucg

SEQ ID NO: 3432230 - RNA, 23 nt, Pseudomonas aeruginosa PA01
accaguacuugaacagcaggaug

SEQ ID NO: 3432231 - RNA, 19 nt, Pseudomonas aeruginosa PA01
accaguagcgacagcaucu

SEQ ID NO: 3432232 - RNA, 13 nt, Pseudomonas aeruginosa PA01
accaguccagcac

SEQ ID NO: 3432233 - RNA, 14 nt, Pseudomonas aeruginosa PA01
accaguccagcacg

SEQ ID NO: 3432234 - RNA, 22 nt, Pseudomonas aeruginosa PA01
accagucccggcuugccggcag

SEQ ID NO: 3432235 - RNA, 12 nt, Pseudomonas aeruginosa PA01
accagucccugg

SEQ ID NO: 3432236 - RNA, 22 nt, Pseudomonas aeruginosa PA01
accagucccuggccggcgaugg

SEQ ID NO: 3432237 - RNA, 18 nt, Pseudomonas aeruginosa PA01
accagucgcccgcuucgc

SEQ ID NO: 3432238 - RNA, 14 nt, Pseudomonas aeruginosa PA01
accagugcaccgcc

SEQ ID NO: 3432239 - RNA, 17 nt, Pseudomonas aeruginosa PA01
accagugcaccgccggg

SEQ ID NO: 3432240 - RNA, 16 nt, Pseudomonas aeruginosa PA01
accaguggcgccgcca

SEQ ID NO: 3432241 - RNA, 20 nt, Pseudomonas aeruginosa PA01
accaguggcgccgccauggu

SEQ ID NO: 3432242 - RNA, 21 nt, Pseudomonas aeruginosa PA01
accaguugccgagcuugaccu

SEQ ID NO: 3432243 - RNA, 23 nt, Pseudomonas aeruginosa PA01
accaguugcucgcuccgagcagg

SEQ ID NO: 3432244 - RNA, 19 nt, Pseudomonas aeruginosa PA01
accaguuucuucgcguggg

SEQ ID NO: 3432245 - RNA, 19 nt, Pseudomonas aeruginosa PA01
agccaacugcuucaggcgc

SEQ ID NO: 3432246 - RNA, 16 nt, Pseudomonas aeruginosa PA01
agccaagccaccagcg

SEQ ID NO: 3432247 - RNA, 20 nt, Pseudomonas aeruginosa PA01
agccaaugcguggguccacg

SEQ ID NO: 3432248 - RNA, 13 nt, Pseudomonas aeruginosa PA01
agccacaggcgcc

SEQ ID NO: 3432249 - RNA, 17 nt, Pseudomonas aeruginosa PA01
agccacaggcgccaguc

SEQ ID NO: 3432250 - RNA, 15 nt, Pseudomonas aeruginosa PA01
agccaccagccgaac

SEQ ID NO: 3432251 - RNA, 15 nt, Pseudomonas aeruginosa PA01
agccacccagcagca

SEQ ID NO: 3432252 - RNA, 16 nt, Pseudomonas aeruginosa PA01
agccacccgcucgacc

SEQ ID NO: 3432253 - RNA, 13 nt, Pseudomonas aeruginosa PA01
agccaccgccgac

SEQ ID NO: 3432254 - RNA, 14 nt, Pseudomonas aeruginosa PA01
agccaccgccgaca

SEQ ID NO: 3432255 - RNA, 16 nt, Pseudomonas aeruginosa PA01
agccaccuucgaucac

SEQ ID NO: 3432256 - RNA, 12 nt, Pseudomonas aeruginosa PA01
agccacgaagcc

SEQ ID NO: 3432257 - RNA, 19 nt, Pseudomonas aeruginosa PA01
agccacggacgcgcagggu

SEQ ID NO: 3432258 - RNA, 21 nt, Pseudomonas aeruginosa PA01
agccacggauaugcgccgcca

SEQ ID NO: 3432259 - RNA, 19 nt, Pseudomonas aeruginosa PA01
agccacggcacacgucggc

SEQ ID NO: 3432260 - RNA, 21 nt, Pseudomonas aeruginosa PA01
agccacggcacacgucggcau

SEQ ID NO: 3432261 - RNA, 18 nt, Pseudomonas aeruginosa PA01
agccacgggcgccagcgg

SEQ ID NO: 3432262 - RNA, 13 nt, Pseudomonas aeruginosa PA01
agccacucccggc

SEQ ID NO: 3432263 - RNA, 16 nt, Pseudomonas aeruginosa PA01
agccacucccggcccu

SEQ ID NO: 3432264 - RNA, 22 nt, Pseudomonas aeruginosa PA01
agccacuggcggaccgccucga

SEQ ID NO: 3432265 - RNA, 13 nt, Pseudomonas aeruginosa PA01
agccagaccggca

SEQ ID NO: 3432266 - RNA, 20 nt, Pseudomonas aeruginosa PA01
agccagaccggcagcgccgc

SEQ ID NO: 3432267 - RNA, 22 nt, Pseudomonas aeruginosa PA01
agccagaccggcagcgccgcca

SEQ ID NO: 3432268 - RNA, 19 nt, Pseudomonas aeruginosa PA01
agccagacguccggcaggu

SEQ ID NO: 3432269 - RNA, 22 nt, Pseudomonas aeruginosa PA01
agccagacguccggcaggucuu

SEQ ID NO: 3432270 - RNA, 21 nt, Pseudomonas aeruginosa PA01
agccagagcguaucgaugcgc

SEQ ID NO: 3432271 - RNA, 15 nt, Pseudomonas aeruginosa PA01
agccagagcuccagg

SEQ ID NO: 3432272 - RNA, 19 nt, Pseudomonas aeruginosa PA01
agccagagcuccagggcug

SEQ ID NO: 3432273 - RNA, 14 nt, Pseudomonas aeruginosa PA01
agccagcagcccgg

SEQ ID NO: 3432274 - RNA, 15 nt, Pseudomonas aeruginosa PA01
agccagccaggucgg

SEQ ID NO: 3432275 - RNA, 18 nt, Pseudomonas aeruginosa PA01
agccagcccagcggcgcg

SEQ ID NO: 3432276 - RNA, 13 nt, Pseudomonas aeruginosa PA01
agccagcccggcg

SEQ ID NO: 3432277 - RNA, 13 nt, Pseudomonas aeruginosa PA01
agccagccgagca

SEQ ID NO: 3432278 - RNA, 13 nt, Pseudomonas aeruginosa PA01
agccagccgcagc

SEQ ID NO: 3432279 - RNA, 16 nt, Pseudomonas aeruginosa PA01
agccagccgccgaagg

SEQ ID NO: 3432280 - RNA, 12 nt, Pseudomonas aeruginosa PA01
agccagccgccu

SEQ ID NO: 3432281 - RNA, 13 nt, Pseudomonas aeruginosa PA01
agccagccgccuu

SEQ ID NO: 3432282 - RNA, 11 nt, Pseudomonas aeruginosa PA01
agccagccguc

SEQ ID NO: 3432283 - RNA, 22 nt, Pseudomonas aeruginosa PA01
agccagccugcagccagcuuca

SEQ ID NO: 3432284 - RNA, 18 nt, Pseudomonas aeruginosa PA01
agccagcuucagccgacc

SEQ ID NO: 3432285 - RNA, 14 nt, Pseudomonas aeruginosa PA01
agccaggaagagcc

SEQ ID NO: 3432286 - RNA, 20 nt, Pseudomonas aeruginosa PA01
agccaggaagagcccgccac

SEQ ID NO: 3432287 - RNA, 23 nt, Pseudomonas aeruginosa PA01
agccaggaagagcccgccacgcu

SEQ ID NO: 3432288 - RNA, 15 nt, Pseudomonas aeruginosa PA01
agccaggcaccaccu

SEQ ID NO: 3432289 - RNA, 14 nt, Pseudomonas aeruginosa PA01
agccaggcccgguu

SEQ ID NO: 3432290 - RNA, 17 nt, Pseudomonas aeruginosa PA01
agccaggccuugugcgc

SEQ ID NO: 3432291 - RNA, 20 nt, Pseudomonas aeruginosa PA01
agccaggccuugugcgccag

SEQ ID NO: 3432292 - RNA, 22 nt, Pseudomonas aeruginosa PA01
agccaggcgaagcggcuggccg

SEQ ID NO: 3432293 - RNA, 23 nt, Pseudomonas aeruginosa PA01
agccaggcgaagcggcuggccgc

SEQ ID NO: 3432294 - RNA, 14 nt, Pseudomonas aeruginosa PA01
agccaggcgauggu

SEQ ID NO: 3432295 - RNA, 20 nt, Pseudomonas aeruginosa PA01
agccaggcgauggugcgcuc

SEQ ID NO: 3432296 - RNA, 17 nt, Pseudomonas aeruginosa PA01
agccaggcgcucucgcc

SEQ ID NO: 3432297 - RNA, 19 nt, Pseudomonas aeruginosa PA01
agccaggcgcucucgccgc

SEQ ID NO: 3432298 - RNA, 10 nt, Pseudomonas aeruginosa PA01
agccaggcgg

SEQ ID NO: 3432299 - RNA, 13 nt, Pseudomonas aeruginosa PA01
agccaggcggcca

SEQ ID NO: 3432300 - RNA, 14 nt, Pseudomonas aeruginosa PA01
agccaggcggccac

SEQ ID NO: 3432301 - RNA, 18 nt, Pseudomonas aeruginosa PA01
agccaggcguauucggcg

SEQ ID NO: 3432302 - RNA, 14 nt, Pseudomonas aeruginosa PA01
agccaggcuggcug

SEQ ID NO: 3432303 - RNA, 16 nt, Pseudomonas aeruginosa PA01
agccagggcagcaggu

SEQ ID NO: 3432304 - RNA, 19 nt, Pseudomonas aeruginosa PA01
agccagggcagcaggucgc

SEQ ID NO: 3432305 - RNA, 19 nt, Pseudomonas aeruginosa PA01
agccaggggcacgcuggcg

SEQ ID NO: 3432306 - RNA, 21 nt, Pseudomonas aeruginosa PA01
agccaggggcacgcuggcgag

SEQ ID NO: 3432307 - RNA, 18 nt, Pseudomonas aeruginosa PA01
agccaggggucaggccga

SEQ ID NO: 3432308 - RNA, 21 nt, Pseudomonas aeruginosa PA01
agccagguacggaugccgcga

SEQ ID NO: 3432309 - RNA, 18 nt, Pseudomonas aeruginosa PA01
agccagguguucggcccc

SEQ ID NO: 3432310 - RNA, 19 nt, Pseudomonas aeruginosa PA01
agccagguuuccggcagca

SEQ ID NO: 3432311 - RNA, 18 nt, Pseudomonas aeruginosa PA01
agccaguaguccuccgcg

SEQ ID NO: 3432312 - RNA, 16 nt, Pseudomonas aeruginosa PA01
agccaguccggcagca

SEQ ID NO: 3432313 - RNA, 17 nt, Pseudomonas aeruginosa PA01
agccaguccuggacccg

SEQ ID NO: 3432314 - RNA, 18 nt, Pseudomonas aeruginosa PA01
agccagucgagacgccag

SEQ ID NO: 3432315 - RNA, 21 nt, Pseudomonas aeruginosa PA01
agccagucgagacgccagccg

SEQ ID NO: 3432316 - RNA, 22 nt, Pseudomonas aeruginosa PA01
agccagucgagacgccagccgc

SEQ ID NO: 3432317 - RNA, 13 nt, Pseudomonas aeruginosa PA01
agccagucggcgg

SEQ ID NO: 3432318 - RNA, 15 nt, Pseudomonas aeruginosa PA01
agccaguggcuggcg

SEQ ID NO: 3432319 - RNA, 16 nt, Pseudomonas aeruginosa PA01
agccauagcgccggca

SEQ ID NO: 3432320 - RNA, 21 nt, Pseudomonas aeruginosa PA01
agccauagugcugggcgaccu

SEQ ID NO: 3432321 - RNA, 21 nt, Pseudomonas aeruginosa PA01
agccaucaaacgggcgugagu

SEQ ID NO: 3432322 - RNA, 19 nt, Pseudomonas aeruginosa PA01
agccaucgcauagccggcg

SEQ ID NO: 3432323 - RNA, 16 nt, Pseudomonas aeruginosa PA01
agccaucgcuccagcg

SEQ ID NO: 3432324 - RNA, 19 nt, Pseudomonas aeruginosa PA01
agccaucgcuccagcgaau

SEQ ID NO: 3432325 - RNA, 21 nt, Pseudomonas aeruginosa PA01
agccaugcccagacgccgcuc

SEQ ID NO: 3432326 - RNA, 18 nt, Pseudomonas aeruginosa PA01
agccaugcgggcgggugc

SEQ ID NO: 3432327 - RNA, 13 nt, Pseudomonas aeruginosa PA01
agccauucgccgc

SEQ ID NO: 3432328 - RNA, 15 nt, Pseudomonas aeruginosa PA01
agccauucggcuucc

SEQ ID NO: 3432329 - RNA, 21 nt, Pseudomonas aeruginosa PA01
agccauucggcuuccugggcg

SEQ ID NO: 3432330 - RNA, 13 nt, Pseudomonas aeruginosa PA01
agccauugagcgc

SEQ ID NO: 3432331 - RNA, 17 nt, Pseudomonas aeruginosa PA01
agccauugagcgcgccc

SEQ ID NO: 3432332 - RNA, 19 nt, Pseudomonas aeruginosa PA01
agccauuggccgacgccgc

SEQ ID NO: 3432333 - RNA, 19 nt, Pseudomonas aeruginosa PA01
agccgccccgaggggcggc

SEQ ID NO: 3432334 - RNA, 16 nt, Pseudomonas aeruginosa PA01
agccgcccuggcucug

SEQ ID NO: 3432335 - RNA, 15 nt, Pseudomonas aeruginosa PA01
agccgccgaacacgc

SEQ ID NO: 3432336 - RNA, 17 nt, Pseudomonas aeruginosa PA01
agccgccgaagggccgc

SEQ ID NO: 3432337 - RNA, 19 nt, Pseudomonas aeruginosa PA01
agccgccgaagggccgcag

SEQ ID NO: 3432338 - RNA, 18 nt, Pseudomonas aeruginosa PA01
agccgccgcccagcagca

SEQ ID NO: 3432339 - RNA, 21 nt, Pseudomonas aeruginosa PA01
agccgccgcccagcagcacca

SEQ ID NO: 3432340 - RNA, 14 nt, Pseudomonas aeruginosa PA01
agccgccgccgaga

SEQ ID NO: 3432341 - RNA, 21 nt, Pseudomonas aeruginosa PA01
agccgccgccgagaacccggc

SEQ ID NO: 3432342 - RNA, 15 nt, Pseudomonas aeruginosa PA01
agccgccgccgcgcc

SEQ ID NO: 3432343 - RNA, 16 nt, Pseudomonas aeruginosa PA01
agccgccgccgcgccg

SEQ ID NO: 3432344 - RNA, 17 nt, Pseudomonas aeruginosa PA01
agccgccgcggcaccgg

SEQ ID NO: 3432345 - RNA, 12 nt, Pseudomonas aeruginosa PA01
agccgccgcugc

SEQ ID NO: 3432346 - RNA, 16 nt, Pseudomonas aeruginosa PA01
agccgccgcugcaccg

SEQ ID NO: 3432347 - RNA, 19 nt, Pseudomonas aeruginosa PA01
agccgccgggaaucuggcc

SEQ ID NO: 3432348 - RNA, 20 nt, Pseudomonas aeruginosa PA01
agccgccgggaaucuggccg

SEQ ID NO: 3432349 - RNA, 12 nt, Pseudomonas aeruginosa PA01
agccgccgggac

SEQ ID NO: 3432350 - RNA, 12 nt, Pseudomonas aeruginosa PA01
agccgccgggcg

SEQ ID NO: 3432351 - RNA, 18 nt, Pseudomonas aeruginosa PA01
agccgccggggaagcugc

SEQ ID NO: 3432352 - RNA, 19 nt, Pseudomonas aeruginosa PA01
agccgccggggaagcugcc

SEQ ID NO: 3432353 - RNA, 14 nt, Pseudomonas aeruginosa PA01
agccgcgacgcgac

SEQ ID NO: 3432354 - RNA, 15 nt, Pseudomonas aeruginosa PA01
agccgcgacgcgacc

SEQ ID NO: 3432355 - RNA, 17 nt, Pseudomonas aeruginosa PA01
agccgcgacucggcugc

SEQ ID NO: 3432356 - RNA, 20 nt, Pseudomonas aeruginosa PA01
agccgcgaguccuucggcgc

SEQ ID NO: 3432357 - RNA, 21 nt, Pseudomonas aeruginosa PA01
agccgcgaguccuucggcgca

SEQ ID NO: 3432358 - RNA, 18 nt, Pseudomonas aeruginosa PA01
agccgcgcaaccguucca

SEQ ID NO: 3432359 - RNA, 16 nt, Pseudomonas aeruginosa PA01
agccgcgcaaggcagc

SEQ ID NO: 3432360 - RNA, 12 nt, Pseudomonas aeruginosa PA01
agccgcgcagca

SEQ ID NO: 3432361 - RNA, 13 nt, Pseudomonas aeruginosa PA01
agccgcgccagug

SEQ ID NO: 3432362 - RNA, 19 nt, Pseudomonas aeruginosa PA01
agccgcgccagugccugca

SEQ ID NO: 3432363 - RNA, 13 nt, Pseudomonas aeruginosa PA01
agccgcgccggcc

SEQ ID NO: 3432364 - RNA, 21 nt, Pseudomonas aeruginosa PA01
agccgcgccggccgucccagu

SEQ ID NO: 3432365 - RNA, 16 nt, Pseudomonas aeruginosa PA01
agccgcgccggggcag

SEQ ID NO: 3432366 - RNA, 14 nt, Pseudomonas aeruginosa PA01
agccgcgcgccagc

SEQ ID NO: 3432367 - RNA, 15 nt, Pseudomonas aeruginosa PA01
agccgcgcgccagca

SEQ ID NO: 3432368 - RNA, 18 nt, Pseudomonas aeruginosa PA01
agccgcgcgccgaguugg

SEQ ID NO: 3432369 - RNA, 20 nt, Pseudomonas aeruginosa PA01
agccgcgcgccgaguuggcc

SEQ ID NO: 3432370 - RNA, 14 nt, Pseudomonas aeruginosa PA01
agccgcgcgccgca

SEQ ID NO: 3432371 - RNA, 21 nt, Pseudomonas aeruginosa PA01
agccgcgcguaggcuuggucg

SEQ ID NO: 3432372 - RNA, 22 nt, Pseudomonas aeruginosa PA01
agccgcgcguaggcuuggucgg

SEQ ID NO: 3432373 - RNA, 12 nt, Pseudomonas aeruginosa PA01
agccgcgcucgg

SEQ ID NO: 3432374 - RNA, 15 nt, Pseudomonas aeruginosa PA01
agccgcgcucggcca

SEQ ID NO: 3432375 - RNA, 16 nt, Pseudomonas aeruginosa PA01
agccgcgcugcuggua

SEQ ID NO: 3432376 - RNA, 15 nt, Pseudomonas aeruginosa PA01
agccgcggaucaccu

SEQ ID NO: 3432377 - RNA, 17 nt, Pseudomonas aeruginosa PA01
agccgcggcgccacgcu

SEQ ID NO: 3432378 - RNA, 18 nt, Pseudomonas aeruginosa PA01
agccgcggcgccacgcuc

SEQ ID NO: 3432379 - RNA, 23 nt, Pseudomonas aeruginosa PA01
agccgcggcgccacgcucaccgg

SEQ ID NO: 3432380 - RNA, 17 nt, Pseudomonas aeruginosa PA01
agccgcgguccaucccu

SEQ ID NO: 3432381 - RNA, 18 nt, Pseudomonas aeruginosa PA01
agccgcgugcgcgccgcc

SEQ ID NO: 3432382 - RNA, 23 nt, Pseudomonas aeruginosa PA01
agccgcguugcauguccucggcg

SEQ ID NO: 3432383 - RNA, 22 nt, Pseudomonas aeruginosa PA01
agccgcguugucccugucccgc

SEQ ID NO: 3432384 - RNA, 17 nt, Pseudomonas aeruginosa PA01
agccgcucgcguccgca

SEQ ID NO: 3432385 - RNA, 13 nt, Pseudomonas aeruginosa PA01
agccgcucggccg

SEQ ID NO: 3432386 - RNA, 19 nt, Pseudomonas aeruginosa PA01
agccgcucggccgccagca

SEQ ID NO: 3432387 - RNA, 13 nt, Pseudomonas aeruginosa PA01
agccgcucggcgu

SEQ ID NO: 3432388 - RNA, 21 nt, Pseudomonas aeruginosa PA01
agccgcugaccucggugagga

SEQ ID NO: 3432389 - RNA, 13 nt, Pseudomonas aeruginosa PA01
agccgcugcaggg

SEQ ID NO: 3432390 - RNA, 18 nt, Pseudomonas aeruginosa PA01
agccgcugcggcucgccg

SEQ ID NO: 3432391 - RNA, 16 nt, Pseudomonas aeruginosa PA01
agccgcugcugcaacc

SEQ ID NO: 3432392 - RNA, 22 nt, Pseudomonas aeruginosa PA01
agccgcuggcauacacaugcag

SEQ ID NO: 3432393 - RNA, 13 nt, Pseudomonas aeruginosa PA01
agccgcuggcguc

SEQ ID NO: 3432394 - RNA, 14 nt, Pseudomonas aeruginosa PA01
agccgcuggcgucg

SEQ ID NO: 3432395 - RNA, 15 nt, Pseudomonas aeruginosa PA01
agccgcuggcgucga

SEQ ID NO: 3432396 - RNA, 18 nt, Pseudomonas aeruginosa PA01
agccgcugguccagcugg

SEQ ID NO: 3432397 - RNA, 22 nt, Pseudomonas aeruginosa PA01
agccgcugguccagcuggcgca

SEQ ID NO: 3432398 - RNA, 21 nt, Pseudomonas aeruginosa PA01
agccgcuuccggcgcuccaca

SEQ ID NO: 3432399 - RNA, 22 nt, Pseudomonas aeruginosa PA01
agccgcuuggagcgggcgccgg

SEQ ID NO: 3432400 - RNA, 23 nt, Pseudomonas aeruginosa PA01
agccgcuuggagcgggcgccgga

SEQ ID NO: 3432401 - RNA, 18 nt, Pseudomonas aeruginosa PA01
agccggaaaacagcgagc

SEQ ID NO: 3432402 - RNA, 22 nt, Pseudomonas aeruginosa PA01
agccggaaaacagcgagcccag

SEQ ID NO: 3432403 - RNA, 13 nt, Pseudomonas aeruginosa PA01
agccggaagcgcu

SEQ ID NO: 3432404 - RNA, 16 nt, Pseudomonas aeruginosa PA01
agccggaccagccguc

SEQ ID NO: 3432405 - RNA, 21 nt, Pseudomonas aeruginosa PA01
agccggaccucucucgcugcg

SEQ ID NO: 3432406 - RNA, 13 nt, Pseudomonas aeruginosa PA01
agccggacggcgg

SEQ ID NO: 3432407 - RNA, 16 nt, Pseudomonas aeruginosa PA01
agccggacggcggcgu

SEQ ID NO: 3432408 - RNA, 22 nt, Pseudomonas aeruginosa PA01
agccggauagaucaggccggcg

SEQ ID NO: 3432409 - RNA, 18 nt, Pseudomonas aeruginosa PA01
agccggauucgcgcagca

SEQ ID NO: 3432410 - RNA, 20 nt, Pseudomonas aeruginosa PA01
agccggauucgcgcagcagg

SEQ ID NO: 3432411 - RNA, 21 nt, Pseudomonas aeruginosa PA01
agccggauucgcgcagcaggc

SEQ ID NO: 3432412 - RNA, 16 nt, Pseudomonas aeruginosa PA01
agccggcaagcgugcc

SEQ ID NO: 3432413 - RNA, 15 nt, Pseudomonas aeruginosa PA01
agccggcauccagca

SEQ ID NO: 3432414 - RNA, 16 nt, Pseudomonas aeruginosa PA01
agccggcauccagcau

SEQ ID NO: 3432415 - RNA, 13 nt, Pseudomonas aeruginosa PA01
agccggccaggcg

SEQ ID NO: 3432416 - RNA, 15 nt, Pseudomonas aeruginosa PA01
agccggccagggcgc

SEQ ID NO: 3432417 - RNA, 19 nt, Pseudomonas aeruginosa PA01
agccggccagggcgcggua

SEQ ID NO: 3432418 - RNA, 22 nt, Pseudomonas aeruginosa PA01
agccggccauccagccaggcgc

SEQ ID NO: 3432419 - RNA, 19 nt, Pseudomonas aeruginosa PA01
agccggcccauccgccgca

SEQ ID NO: 3432420 - RNA, 15 nt, Pseudomonas aeruginosa PA01
agccggccccugggc

SEQ ID NO: 3432421 - RNA, 20 nt, Pseudomonas aeruginosa PA01
agccggccccugggccggcu

SEQ ID NO: 3432422 - RNA, 22 nt, Pseudomonas aeruginosa PA01
agccggccgaucuucagcagca

SEQ ID NO: 3432423 - RNA, 16 nt, Pseudomonas aeruginosa PA01
agccggccgcgucgcc

SEQ ID NO: 3432424 - RNA, 13 nt, Pseudomonas aeruginosa PA01
agccggccuugcu

SEQ ID NO: 3432425 - RNA, 17 nt, Pseudomonas aeruginosa PA01
agccggcgaaccaggcg

SEQ ID NO: 3432426 - RNA, 20 nt, Pseudomonas aeruginosa PA01
agccggcgaaccaggcggcc

SEQ ID NO: 3432427 - RNA, 21 nt, Pseudomonas aeruginosa PA01
agccggcgaaccaggcggccg

SEQ ID NO: 3432428 - RNA, 20 nt, Pseudomonas aeruginosa PA01
agccggcgaagggcaggccg

SEQ ID NO: 3432429 - RNA, 14 nt, Pseudomonas aeruginosa PA01
agccggcgagcgcc

SEQ ID NO: 3432430 - RNA, 21 nt, Pseudomonas aeruginosa PA01
agccggcgaucagcgcuucca

SEQ ID NO: 3432431 - RNA, 18 nt, Pseudomonas aeruginosa PA01
agccggcgauccgcugca

SEQ ID NO: 3432432 - RNA, 12 nt, Pseudomonas aeruginosa PA01
agccggcgaugc

SEQ ID NO: 3432433 - RNA, 18 nt, Pseudomonas aeruginosa PA01
agccggcgaugccgccca

SEQ ID NO: 3432434 - RNA, 21 nt, Pseudomonas aeruginosa PA01
agccggcgaugccgcccagca

SEQ ID NO: 3432435 - RNA, 23 nt, Pseudomonas aeruginosa PA01
agccggcgaugccgcccagcacc

SEQ ID NO: 3432436 - RNA, 16 nt, Pseudomonas aeruginosa PA01
agccuggcgcgcugcg

SEQ ID NO: 3432437 - RNA, 20 nt, Pseudomonas aeruginosa PA01
agccuggcgcgcugcggcag

SEQ ID NO: 3432438 - RNA, 21 nt, Pseudomonas aeruginosa PA01
agccuggcgcgcugcggcagg

SEQ ID NO: 3432439 - RNA, 22 nt, Pseudomonas aeruginosa PA01
agccuggcuggccucagggcgc

SEQ ID NO: 3432440 - RNA, 23 nt, Pseudomonas aeruginosa PA01
agccuggcuggccucagggcgcg

SEQ ID NO: 3432441 - RNA, 14 nt, Pseudomonas aeruginosa PA01
agccugggcggcuu

SEQ ID NO: 3432442 - RNA, 19 nt, Pseudomonas aeruginosa PA01
agccuggggugcagcaggu

SEQ ID NO: 3432443 - RNA, 18 nt, Pseudomonas aeruginosa PA01
agccugucgauuuccccc

SEQ ID NO: 3432444 - RNA, 20 nt, Pseudomonas aeruginosa PA01
agccuucagcacggcgcggg

SEQ ID NO: 3432445 - RNA, 19 nt, Pseudomonas aeruginosa PA01
agccuucgcaaagcgagcg

SEQ ID NO: 3432446 - RNA, 21 nt, Pseudomonas aeruginosa PA01
agccuucgcccagguaggcga

SEQ ID NO: 3432447 - RNA, 14 nt, Pseudomonas aeruginosa PA01
agccuucgcccggc

SEQ ID NO: 3432448 - RNA, 15 nt, Pseudomonas aeruginosa PA01
agccuucgcccggcu

SEQ ID NO: 3432449 - RNA, 12 nt, Pseudomonas aeruginosa PA01
agccuucgucga

SEQ ID NO: 3432450 - RNA, 20 nt, Pseudomonas aeruginosa PA01
agccuugacccgcaguuccu

SEQ ID NO: 3432451 - RNA, 21 nt, Pseudomonas aeruginosa PA01
agccuugacccgcaguuccuu

SEQ ID NO: 3432452 - RNA, 17 nt, Pseudomonas aeruginosa PA01
agccuugagccuugccc

SEQ ID NO: 3432453 - RNA, 16 nt, Pseudomonas aeruginosa PA01
agccuugcggcgcucg

SEQ ID NO: 3432454 - RNA, 18 nt, Pseudomonas aeruginosa PA01
agccuugcuggacuuccc

SEQ ID NO: 3432455 - RNA, 13 nt, Pseudomonas aeruginosa PA01
agcgaaaacagcc

SEQ ID NO: 3432456 - RNA, 16 nt, Pseudomonas aeruginosa PA01
agcgaaacucgugcuc

SEQ ID NO: 3432457 - RNA, 22 nt, Pseudomonas aeruginosa PA01
agcgaaacucgugcuccaccuc

SEQ ID NO: 3432458 - RNA, 13 nt, Pseudomonas aeruginosa PA01
agcgaaagaacaa

SEQ ID NO: 3432459 - RNA, 12 nt, Pseudomonas aeruginosa PA01
agcgaaccaggc

SEQ ID NO: 3432460 - RNA, 13 nt, Pseudomonas aeruginosa PA01
agcgaaccaggca

SEQ ID NO: 3432461 - RNA, 19 nt, Pseudomonas aeruginosa PA01
agcgaacccaggccgcgca

SEQ ID NO: 3432462 - RNA, 15 nt, Pseudomonas aeruginosa PA01
agcgaaccgccggcc

SEQ ID NO: 3432463 - RNA, 16 nt, Pseudomonas aeruginosa PA01
agcgaaccgccggccu

SEQ ID NO: 3432464 - RNA, 18 nt, Pseudomonas aeruginosa PA01
agcgaacgacagcgaaug

SEQ ID NO: 3432465 - RNA, 14 nt, Pseudomonas aeruginosa PA01
agcgaacgccgcag

SEQ ID NO: 3432466 - RNA, 15 nt, Pseudomonas aeruginosa PA01
agcgaacgccgcagc

SEQ ID NO: 3432467 - RNA, 17 nt, Pseudomonas aeruginosa PA01
agcgaaucugcagggca

SEQ ID NO: 3432468 - RNA, 21 nt, Pseudomonas aeruginosa PA01
agcgaaucugcagggcaucgc

SEQ ID NO: 3432469 - RNA, 16 nt, Pseudomonas aeruginosa PA01
agcgaaugcuugccgg

SEQ ID NO: 3432470 - RNA, 17 nt, Pseudomonas aeruginosa PA01
agcgaaugcuugccggc

SEQ ID NO: 3432471 - RNA, 20 nt, Pseudomonas aeruginosa PA01
agcgaaugcuugccggcgcc

SEQ ID NO: 3432472 - RNA, 20 nt, Pseudomonas aeruginosa PA01
agcgaauggacaggcgcccc

SEQ ID NO: 3432473 - RNA, 21 nt, Pseudomonas aeruginosa PA01
agcgaauggacaggcgccccu

SEQ ID NO: 3432474 - RNA, 20 nt, Pseudomonas aeruginosa PA01
agcgaauuugaacgcuguag

SEQ ID NO: 3432475 - RNA, 19 nt, Pseudomonas aeruginosa PA01
agcgacaccaugcuccgcc

SEQ ID NO: 3432476 - RNA, 15 nt, Pseudomonas aeruginosa PA01
agcgacagcaucugc

SEQ ID NO: 3432477 - RNA, 16 nt, Pseudomonas aeruginosa PA01
agcgacagcaucugcu

SEQ ID NO: 3432478 - RNA, 14 nt, Pseudomonas aeruginosa PA01
agcgacaggcccuu

SEQ ID NO: 3432479 - RNA, 17 nt, Pseudomonas aeruginosa PA01
agcgaccaccaccaggu

SEQ ID NO: 3432480 - RNA, 23 nt, Pseudomonas aeruginosa PA01
agcgaccaccaccaggucggcgc

SEQ ID NO: 3432481 - RNA, 21 nt, Pseudomonas aeruginosa PA01
agcgaccaguugcucgcuccg

SEQ ID NO: 3432482 - RNA, 18 nt, Pseudomonas aeruginosa PA01
agcgaccgaucaugcccu

SEQ ID NO: 3432483 - RNA, 16 nt, Pseudomonas aeruginosa PA01
agcgacgcgacauccu

SEQ ID NO: 3432484 - RNA, 15 nt, Pseudomonas aeruginosa PA01
agcgacggaagcccu

SEQ ID NO: 3432485 - RNA, 15 nt, Pseudomonas aeruginosa PA01
agcgacguggcaggg

SEQ ID NO: 3432486 - RNA, 18 nt, Pseudomonas aeruginosa PA01
agcgacuccagccaggcg

SEQ ID NO: 3432487 - RNA, 22 nt, Pseudomonas aeruginosa PA01
agcgacucgaugaacgcccuga

SEQ ID NO: 3432488 - RNA, 13 nt, Pseudomonas aeruginosa PA01
agcgacucgaugc

SEQ ID NO: 3432489 - RNA, 11 nt, Pseudomonas aeruginosa PA01
agcgacucgcu

SEQ ID NO: 3432490 - RNA, 22 nt, Pseudomonas aeruginosa PA01
agcgacucgcugccggcgcgca

SEQ ID NO: 3432491 - RNA, 17 nt, Pseudomonas aeruginosa PA01
agcgacucguagucgau

SEQ ID NO: 3432492 - RNA, 18 nt, Pseudomonas aeruginosa PA01
agcgacugcgcuggccga

SEQ ID NO: 3432493 - RNA, 13 nt, Pseudomonas aeruginosa PA01
agcgacuggcccu

SEQ ID NO: 3432494 - RNA, 16 nt, Pseudomonas aeruginosa PA01
agcgacuggcccuggu

SEQ ID NO: 3432495 - RNA, 16 nt, Pseudomonas aeruginosa PA01
agcgagaacuugccgg

SEQ ID NO: 3432496 - RNA, 18 nt, Pseudomonas aeruginosa PA01
agcgagaacuugccggcg

SEQ ID NO: 3432497 - RNA, 14 nt, Pseudomonas aeruginosa PA01
agcgagacccggua

SEQ ID NO: 3432498 - RNA, 19 nt, Pseudomonas aeruginosa PA01
agcgagacccgguacuccu

SEQ ID NO: 3432499 - RNA, 16 nt, Pseudomonas aeruginosa PA01
agcgagaccucgccca

SEQ ID NO: 3432500 - RNA, 22 nt, Pseudomonas aeruginosa PA01
agcgagaccucgcccaucgcca

SEQ ID NO: 3432501 - RNA, 19 nt, Pseudomonas aeruginosa PA01
agcgagacgccgccccagc

SEQ ID NO: 3432502 - RNA, 21 nt, Pseudomonas aeruginosa PA01
agcgagacgccgccccagccu

SEQ ID NO: 3432503 - RNA, 23 nt, Pseudomonas aeruginosa PA01
agcgagacgccgccccagccucg

SEQ ID NO: 3432504 - RNA, 13 nt, Pseudomonas aeruginosa PA01
agcgagccgauca

SEQ ID NO: 3432505 - RNA, 16 nt, Pseudomonas aeruginosa PA01
agcgagccgcgcugcu

SEQ ID NO: 3432506 - RNA, 13 nt, Pseudomonas aeruginosa PA01
agcgagcgauguc

SEQ ID NO: 3432507 - RNA, 15 nt, Pseudomonas aeruginosa PA01
agcgagcgcccgccg

SEQ ID NO: 3432508 - RNA, 22 nt, Pseudomonas aeruginosa PA01
agcgagcggucggccauggcau

SEQ ID NO: 3432509 - RNA, 16 nt, Pseudomonas aeruginosa PA01
agcgagcuucgccgcg

SEQ ID NO: 3432510 - RNA, 15 nt, Pseudomonas aeruginosa PA01
agcgaggcguggaag

SEQ ID NO: 3432511 - RNA, 23 nt, Pseudomonas aeruginosa PA01
agcgaggggaagaucuccggguc

SEQ ID NO: 3432512 - RNA, 15 nt, Pseudomonas aeruginosa PA01
agcgaguccgacccg

SEQ ID NO: 3432513 - RNA, 23 nt, Pseudomonas aeruginosa PA01
agcgaguccgacccgcuccggac

SEQ ID NO: 3432514 - RNA, 19 nt, Pseudomonas aeruginosa PA01
agcgagucgacccaggccc

SEQ ID NO: 3432515 - RNA, 21 nt, Pseudomonas aeruginosa PA01
agcgagugcaggaaguggcgg

SEQ ID NO: 3432516 - RNA, 16 nt, Pseudomonas aeruginosa PA01
agcgagugcugaacau

SEQ ID NO: 3432517 - RNA, 17 nt, Pseudomonas aeruginosa PA01
agcgaucccaggucggc

SEQ ID NO: 3432518 - RNA, 21 nt, Pseudomonas aeruginosa PA01
agcgaucccaggucggcgggc

SEQ ID NO: 3432519 - RNA, 20 nt, Pseudomonas aeruginosa PA01
agcgauguccaggccgaucu

SEQ ID NO: 3432520 - RNA, 21 nt, Pseudomonas aeruginosa PA01
agcgaugucgaaaguguugga

SEQ ID NO: 3432521 - RNA, 20 nt, Pseudomonas aeruginosa PA01
agcgcaacgaaaagccgccc

SEQ ID NO: 3432522 - RNA, 23 nt, Pseudomonas aeruginosa PA01
agcgcaacgaaaagccgccccga

SEQ ID NO: 3432523 - RNA, 18 nt, Pseudomonas aeruginosa PA01
agcgcaacgcgcgcagga

SEQ ID NO: 3432524 - RNA, 15 nt, Pseudomonas aeruginosa PA01
agcgcaagcggcggc

SEQ ID NO: 3432525 - RNA, 14 nt, Pseudomonas aeruginosa PA01
agcgcaagucggcc

SEQ ID NO: 3432526 - RNA, 13 nt, Pseudomonas aeruginosa PA01
agcgcaccauccu

SEQ ID NO: 3432527 - RNA, 15 nt, Pseudomonas aeruginosa PA01
agcgcaccgccaagg

SEQ ID NO: 3432528 - RNA, 13 nt, Pseudomonas aeruginosa PA01
agcgcaccgcccu

SEQ ID NO: 3432529 - RNA, 19 nt, Pseudomonas aeruginosa PA01
agcgcaccuacuaccgcug

SEQ ID NO: 3432530 - RNA, 18 nt, Pseudomonas aeruginosa PA01
agcgcagacgggugcuga

SEQ ID NO: 3432531 - RNA, 15 nt, Pseudomonas aeruginosa PA01
agcgcagcaccggcu

SEQ ID NO: 3432532 - RNA, 13 nt, Pseudomonas aeruginosa PA01
agcgcagcacgau

SEQ ID NO: 3432533 - RNA, 12 nt, Pseudomonas aeruginosa PA01
agcgcagcaggu

SEQ ID NO: 3432534 - RNA, 20 nt, Pseudomonas aeruginosa PA01
agcgcagccauucgccgcga

SEQ ID NO: 3432535 - RNA, 18 nt, Pseudomonas aeruginosa PA01
agcgcagccgcucggccg

SEQ ID NO: 3432536 - RNA, 20 nt, Pseudomonas aeruginosa PA01
agcgcagccgcucggccgcc

SEQ ID NO: 3432537 - RNA, 21 nt, Pseudomonas aeruginosa PA01
agcgcagccgcucggccgcca

SEQ ID NO: 3432538 - RNA, 16 nt, Pseudomonas aeruginosa PA01
agcgcagcgaagaucu

SEQ ID NO: 3432539 - RNA, 13 nt, Pseudomonas aeruginosa PA01
agcgcagcggcag

SEQ ID NO: 3432540 - RNA, 14 nt, Pseudomonas aeruginosa PA01
agcgcagcggcagg

SEQ ID NO: 3432541 - RNA, 17 nt, Pseudomonas aeruginosa PA01
agcgcagcuccggcagc

SEQ ID NO: 3432542 - RNA, 14 nt, Pseudomonas aeruginosa PA01
agcgcaggaagcug

SEQ ID NO: 3432543 - RNA, 15 nt, Pseudomonas aeruginosa PA01
agcgcaggaagcugc

SEQ ID NO: 3432544 - RNA, 17 nt, Pseudomonas aeruginosa PA01
agcgcaggaagcugcgc

SEQ ID NO: 3432545 - RNA, 12 nt, Pseudomonas aeruginosa PA01
agcgcaggccgc

SEQ ID NO: 3432546 - RNA, 16 nt, Pseudomonas aeruginosa PA01
agcgcaggccgccggc

SEQ ID NO: 3432547 - RNA, 19 nt, Pseudomonas aeruginosa PA01
agcgcaggccgccggcggc

SEQ ID NO: 3432548 - RNA, 20 nt, Pseudomonas aeruginosa PA01
agcgcaggccgccggcggcc

SEQ ID NO: 3432549 - RNA, 21 nt, Pseudomonas aeruginosa PA01
agcgcaggcggacacgcaggc

SEQ ID NO: 3432550 - RNA, 15 nt, Pseudomonas aeruginosa PA01
agcgcaggcggcugg

SEQ ID NO: 3432551 - RNA, 20 nt, Pseudomonas aeruginosa PA01
agcgcaggcggcuggcgcga

SEQ ID NO: 3432552 - RNA, 15 nt, Pseudomonas aeruginosa PA01
agcgcaggugcaccg

SEQ ID NO: 3432553 - RNA, 17 nt, Pseudomonas aeruginosa PA01
agcgcaggugcaccgcg

SEQ ID NO: 3432554 - RNA, 18 nt, Pseudomonas aeruginosa PA01
agcgcaggugcaccgcgc

SEQ ID NO: 3432555 - RNA, 22 nt, Pseudomonas aeruginosa PA01
agcgcaggugcaccgcgcugga

SEQ ID NO: 3432556 - RNA, 19 nt, Pseudomonas aeruginosa PA01
agcgcagguugcgcuggcg

SEQ ID NO: 3432557 - RNA, 20 nt, Pseudomonas aeruginosa PA01
agcgcagguugcgcuggcgc

SEQ ID NO: 3432558 - RNA, 19 nt, Pseudomonas aeruginosa PA01
agcgcaguacccggccgcc

SEQ ID NO: 3432559 - RNA, 22 nt, Pseudomonas aeruginosa PA01
agcgcaguccgguagcgcgccu

SEQ ID NO: 3432560 - RNA, 13 nt, Pseudomonas aeruginosa PA01
agcgcaguucgcc

SEQ ID NO: 3432561 - RNA, 17 nt, Pseudomonas aeruginosa PA01
agcgcaguucgccgccg

SEQ ID NO: 3432562 - RNA, 18 nt, Pseudomonas aeruginosa PA01
agcgcaguucgccgccga

SEQ ID NO: 3432563 - RNA, 12 nt, Pseudomonas aeruginosa PA01
agcgcaguucgu

SEQ ID NO: 3432564 - RNA, 19 nt, Pseudomonas aeruginosa PA01
agcgcaguucgucgcccau

SEQ ID NO: 3432565 - RNA, 16 nt, Pseudomonas aeruginosa PA01
agcgcaguugccagga

SEQ ID NO: 3432566 - RNA, 17 nt, Pseudomonas aeruginosa PA01
agcgcaguugccaggag

SEQ ID NO: 3432567 - RNA, 18 nt, Pseudomonas aeruginosa PA01
agcgcaguugccaggagg

SEQ ID NO: 3432568 - RNA, 19 nt, Pseudomonas aeruginosa PA01
agcgcauacgaaaacggcc

SEQ ID NO: 3432569 - RNA, 15 nt, Pseudomonas aeruginosa PA01
agcgcauaggccugg

SEQ ID NO: 3432570 - RNA, 17 nt, Pseudomonas aeruginosa PA01
agcgcaucgaggccggc

SEQ ID NO: 3432571 - RNA, 15 nt, Pseudomonas aeruginosa PA01
agcgcaucggcgccu

SEQ ID NO: 3432572 - RNA, 15 nt, Pseudomonas aeruginosa PA01
agcgcauggcgaccu

SEQ ID NO: 3432573 - RNA, 15 nt, Pseudomonas aeruginosa PA01
agcgccaccagcagg

SEQ ID NO: 3432574 - RNA, 17 nt, Pseudomonas aeruginosa PA01
agcgccaccagcagggc

SEQ ID NO: 3432575 - RNA, 20 nt, Pseudomonas aeruginosa PA01
agcgccaccagcagggccag

SEQ ID NO: 3432576 - RNA, 15 nt, Pseudomonas aeruginosa PA01
agcgccaccagcaug

SEQ ID NO: 3432577 - RNA, 21 nt, Pseudomonas aeruginosa PA01
agcgccaccagcaugcccagc

SEQ ID NO: 3432578 - RNA, 13 nt, Pseudomonas aeruginosa PA01
agcgccaccagga

SEQ ID NO: 3432579 - RNA, 19 nt, Pseudomonas aeruginosa PA01
agcgccacgcugaucauca

SEQ ID NO: 3432580 - RNA, 21 nt, Pseudomonas aeruginosa PA01
agcgccacgcugaucaucagc

SEQ ID NO: 3432581 - RNA, 16 nt, Pseudomonas aeruginosa PA01
agcgccacggccagca

SEQ ID NO: 3432582 - RNA, 18 nt, Pseudomonas aeruginosa PA01
agcgccacggcgaucgcc

SEQ ID NO: 3432583 - RNA, 19 nt, Pseudomonas aeruginosa PA01
agcgccacggugaucugga

SEQ ID NO: 3432584 - RNA, 17 nt, Pseudomonas aeruginosa PA01
agcgccacuuccagcuu

SEQ ID NO: 3432585 - RNA, 23 nt, Pseudomonas aeruginosa PA01
agcgccacuuccagcuugcgcuc

SEQ ID NO: 3432586 - RNA, 13 nt, Pseudomonas aeruginosa PA01
agcgccagcacca

SEQ ID NO: 3432587 - RNA, 13 nt, Pseudomonas aeruginosa PA01
agcgccagcaggu

SEQ ID NO: 3432588 - RNA, 22 nt, Pseudomonas aeruginosa PA01
agcgccagcagguacagcagcu

SEQ ID NO: 3432589 - RNA, 22 nt, Pseudomonas aeruginosa PA01
agcgccagcaggucgcgcuggg

SEQ ID NO: 3432590 - RNA, 23 nt, Pseudomonas aeruginosa PA01
agcgccagcagguggucgauggg

SEQ ID NO: 3432591 - RNA, 16 nt, Pseudomonas aeruginosa PA01
agcgccagcagucguu

SEQ ID NO: 3432592 - RNA, 17 nt, Pseudomonas aeruginosa PA01
agcgccagccagcgcgg

SEQ ID NO: 3432593 - RNA, 22 nt, Pseudomonas aeruginosa PA01
agcgccagccagcgcggcucgg

SEQ ID NO: 3432594 - RNA, 13 nt, Pseudomonas aeruginosa PA01
agcgccagcgaga

SEQ ID NO: 3432595 - RNA, 20 nt, Pseudomonas aeruginosa PA01
agcgccagcgagacgggcga

SEQ ID NO: 3432596 - RNA, 23 nt, Pseudomonas aeruginosa PA01
agcgccagcgagacgggcgaggc

SEQ ID NO: 3432597 - RNA, 14 nt, Pseudomonas aeruginosa PA01
agcgccagcggcag

SEQ ID NO: 3432598 - RNA, 21 nt, Pseudomonas aeruginosa PA01
agcgccaggaacgccucugcg

SEQ ID NO: 3432599 - RNA, 20 nt, Pseudomonas aeruginosa PA01
agcgccaggaagccgcgccc

SEQ ID NO: 3432600 - RNA, 15 nt, Pseudomonas aeruginosa PA01
agcgccaggagcagg

SEQ ID NO: 3432601 - RNA, 22 nt, Pseudomonas aeruginosa PA01
agcgccaggccgaucagcgccu

SEQ ID NO: 3432602 - RNA, 17 nt, Pseudomonas aeruginosa PA01
agcgccaggccgccgaa

SEQ ID NO: 3432603 - RNA, 11 nt, Pseudomonas aeruginosa PA01
agcgccaggcg

SEQ ID NO: 3432604 - RNA, 14 nt, Pseudomonas aeruginosa PA01
agcgccaggcgcaa

SEQ ID NO: 3432605 - RNA, 16 nt, Pseudomonas aeruginosa PA01
agcgccaggcgcgguu

SEQ ID NO: 3432606 - RNA, 20 nt, Pseudomonas aeruginosa PA01
agcgccagggcauguuccuc

SEQ ID NO: 3432607 - RNA, 12 nt, Pseudomonas aeruginosa PA01
agcgccagggcc

SEQ ID NO: 3432608 - RNA, 16 nt, Pseudomonas aeruginosa PA01
agcgccagggccaggg

SEQ ID NO: 3432609 - RNA, 20 nt, Pseudomonas aeruginosa PA01
agcgccagggguaggaggaa

SEQ ID NO: 3432610 - RNA, 19 nt, Pseudomonas aeruginosa PA01
agcgccagguaguccagcg

SEQ ID NO: 3432611 - RNA, 21 nt, Pseudomonas aeruginosa PA01
agcgccagguuggccuggccc

SEQ ID NO: 3432612 - RNA, 22 nt, Pseudomonas aeruginosa PA01
agcgccagguuggccuggcccg

SEQ ID NO: 3432613 - RNA, 17 nt, Pseudomonas aeruginosa PA01
agcgccaucagcgacca

SEQ ID NO: 3432614 - RNA, 16 nt, Pseudomonas aeruginosa PA01
agcgccaucaggcccu

SEQ ID NO: 3432615 - RNA, 19 nt, Pseudomonas aeruginosa PA01
agcgccaucaggcccuuga

SEQ ID NO: 3432616 - RNA, 17 nt, Pseudomonas aeruginosa PA01
agcgccaugacccgcgg

SEQ ID NO: 3432617 - RNA, 20 nt, Pseudomonas aeruginosa PA01
agcgccaugacccgcggcag

SEQ ID NO: 3432618 - RNA, 22 nt, Pseudomonas aeruginosa PA01
agcgccaugacccgcggcaggu

SEQ ID NO: 3432619 - RNA, 12 nt, Pseudomonas aeruginosa PA01
agcgccaugcuc

SEQ ID NO: 3432620 - RNA, 19 nt, Pseudomonas aeruginosa PA01
agcgcccaggccgggucgc

SEQ ID NO: 3432621 - RNA, 21 nt, Pseudomonas aeruginosa PA01
agcgcccaggugcgagucacc

SEQ ID NO: 3432622 - RNA, 12 nt, Pseudomonas aeruginosa PA01
agcgccccacca

SEQ ID NO: 3432623 - RNA, 16 nt, Pseudomonas aeruginosa PA01
agcgccccaccaggcu

SEQ ID NO: 3432624 - RNA, 17 nt, Pseudomonas aeruginosa PA01
agcgccccaccaggcuc

SEQ ID NO: 3432625 - RNA, 15 nt, Pseudomonas aeruginosa PA01
agcgccccagcaccu

SEQ ID NO: 3432626 - RNA, 16 nt, Pseudomonas aeruginosa PA01
agcgccccgccuaccg

SEQ ID NO: 3432627 - RNA, 18 nt, Pseudomonas aeruginosa PA01
agcgccccggccgcgcca

SEQ ID NO: 3432628 - RNA, 19 nt, Pseudomonas aeruginosa PA01
agcgccccggccgcgccag

SEQ ID NO: 3432629 - RNA, 22 nt, Pseudomonas aeruginosa PA01
agcgccccggccgcgccagcca

SEQ ID NO: 3432630 - RNA, 23 nt, Pseudomonas aeruginosa PA01
agcgccccggccgcgccagccac

SEQ ID NO: 3432631 - RNA, 21 nt, Pseudomonas aeruginosa PA01
agcgccccucccagccacaga

SEQ ID NO: 3432632 - RNA, 20 nt, Pseudomonas aeruginosa PA01
agcgccccuuggccagcacc

SEQ ID NO: 3432633 - RNA, 20 nt, Pseudomonas aeruginosa PA01
agcgcccgauaggcgccggc

SEQ ID NO: 3432634 - RNA, 22 nt, Pseudomonas aeruginosa PA01
agcgcccgaugaucgagcgcac

SEQ ID NO: 3432635 - RNA, 13 nt, Pseudomonas aeruginosa PA01
agcgcccgcacca

SEQ ID NO: 3432636 - RNA, 18 nt, Pseudomonas aeruginosa PA01
agcgcccgccgucauggc

SEQ ID NO: 3432637 - RNA, 13 nt, Pseudomonas aeruginosa PA01
agcgcccgcgcau

SEQ ID NO: 3432638 - RNA, 21 nt, Pseudomonas aeruginosa PA01
agcgcccggcacgcuccaggg

SEQ ID NO: 3432639 - RNA, 20 nt, Pseudomonas aeruginosa PA01
agcgcccggcgaacagcgcu

SEQ ID NO: 3432640 - RNA, 23 nt, Pseudomonas aeruginosa PA01
agcgcgagcggcagauccgccgu

SEQ ID NO: 3432641 - RNA, 23 nt, Pseudomonas aeruginosa PA01
agcgcgagcguuccaugaacucu

SEQ ID NO: 3432642 - RNA, 18 nt, Pseudomonas aeruginosa PA01
agcgcgagggggccucgg

SEQ ID NO: 3432643 - RNA, 18 nt, Pseudomonas aeruginosa PA01
agcgcgauacccuggccg

SEQ ID NO: 3432644 - RNA, 21 nt, Pseudomonas aeruginosa PA01
agcgcgauaucgcaggccagg

SEQ ID NO: 3432645 - RNA, 23 nt, Pseudomonas aeruginosa PA01
agcgcgauaucgcaggccaggcc

SEQ ID NO: 3432646 - RNA, 14 nt, Pseudomonas aeruginosa PA01
agcgcgaucagccg

SEQ ID NO: 3432647 - RNA, 15 nt, Pseudomonas aeruginosa PA01
agcgcgaucagccgc

SEQ ID NO: 3432648 - RNA, 17 nt, Pseudomonas aeruginosa PA01
agcgcgaucagccgcuc

SEQ ID NO: 3432649 - RNA, 19 nt, Pseudomonas aeruginosa PA01
agcgcgaucucuacuaccg

SEQ ID NO: 3432650 - RNA, 19 nt, Pseudomonas aeruginosa PA01
agcgcgauuuugggcucag

SEQ ID NO: 3432651 - RNA, 14 nt, Pseudomonas aeruginosa PA01
agcgcgcccagguc

SEQ ID NO: 3432652 - RNA, 20 nt, Pseudomonas aeruginosa PA01
agcgcgcccggcgccacccc

SEQ ID NO: 3432653 - RNA, 18 nt, Pseudomonas aeruginosa PA01
agcgcgcccugcaggccg

SEQ ID NO: 3432654 - RNA, 15 nt, Pseudomonas aeruginosa PA01
agcgcgccgagccag

SEQ ID NO: 3432655 - RNA, 12 nt, Pseudomonas aeruginosa PA01
agcgcgccgccg

SEQ ID NO: 3432656 - RNA, 14 nt, Pseudomonas aeruginosa PA01
agcgcgccgccgau

SEQ ID NO: 3432657 - RNA, 15 nt, Pseudomonas aeruginosa PA01
agcgcgccgccgauc

SEQ ID NO: 3432658 - RNA, 19 nt, Pseudomonas aeruginosa PA01
agcgcgccggguugcgccg

SEQ ID NO: 3432659 - RNA, 14 nt, Pseudomonas aeruginosa PA01
agcgcgccugcucu

SEQ ID NO: 3432660 - RNA, 16 nt, Pseudomonas aeruginosa PA01
agcgcgccuucgacgc

SEQ ID NO: 3432661 - RNA, 16 nt, Pseudomonas aeruginosa PA01
agcgcgcgccaguccc

SEQ ID NO: 3432662 - RNA, 20 nt, Pseudomonas aeruginosa PA01
agcgcgcgcuggcgcagcgg

SEQ ID NO: 3432663 - RNA, 14 nt, Pseudomonas aeruginosa PA01
agcgcgcgcugguc

SEQ ID NO: 3432664 - RNA, 15 nt, Pseudomonas aeruginosa PA01
agcgcgcgcuggucg

SEQ ID NO: 3432665 - RNA, 14 nt, Pseudomonas aeruginosa PA01
agcgcgcggcgagc

SEQ ID NO: 3432666 - RNA, 17 nt, Pseudomonas aeruginosa PA01
agcgcgcggcucggcgg

SEQ ID NO: 3432667 - RNA, 17 nt, Pseudomonas aeruginosa PA01
agcgcgcgucggcgaac

SEQ ID NO: 3432668 - RNA, 16 nt, Pseudomonas aeruginosa PA01
agcgcgcguuccaggu

SEQ ID NO: 3432669 - RNA, 17 nt, Pseudomonas aeruginosa PA01
agcgcgcguuccagguc

SEQ ID NO: 3432670 - RNA, 21 nt, Pseudomonas aeruginosa PA01
agcgcgcguuccaggucgcug

SEQ ID NO: 3432671 - RNA, 23 nt, Pseudomonas aeruginosa PA01
agcgcgcguuccaggucgcugcu

SEQ ID NO: 3432672 - RNA, 20 nt, Pseudomonas aeruginosa PA01
agcgcgcucggccuggugca

SEQ ID NO: 3432673 - RNA, 18 nt, Pseudomonas aeruginosa PA01
agcgcgcucuucgccgcg

SEQ ID NO: 3432674 - RNA, 21 nt, Pseudomonas aeruginosa PA01
agcgcgcuguagccggcgccg

SEQ ID NO: 3432675 - RNA, 20 nt, Pseudomonas aeruginosa PA01
agcgcggagcguccaccagc

SEQ ID NO: 3432676 - RNA, 17 nt, Pseudomonas aeruginosa PA01
agcgcggcaacgaaaac

SEQ ID NO: 3432677 - RNA, 15 nt, Pseudomonas aeruginosa PA01
agcgcggcagcgcca

SEQ ID NO: 3432678 - RNA, 16 nt, Pseudomonas aeruginosa PA01
agcgcggcagcgccau

SEQ ID NO: 3432679 - RNA, 14 nt, Pseudomonas aeruginosa PA01
agcgcggccggcca

SEQ ID NO: 3432680 - RNA, 16 nt, Pseudomonas aeruginosa PA01
agcgcggccggccacg

SEQ ID NO: 3432681 - RNA, 21 nt, Pseudomonas aeruginosa PA01
agcgcggccuucagcgguggc

SEQ ID NO: 3432682 - RNA, 20 nt, Pseudomonas aeruginosa PA01
agcgcggcgccccaggcgcc

SEQ ID NO: 3432683 - RNA, 17 nt, Pseudomonas aeruginosa PA01
agcgcggcgcuuggcga

SEQ ID NO: 3432684 - RNA, 17 nt, Pseudomonas aeruginosa PA01
agcgcggcggacaggca

SEQ ID NO: 3432685 - RNA, 22 nt, Pseudomonas aeruginosa PA01
agcgcggcggacaggcagccgg

SEQ ID NO: 3432686 - RNA, 15 nt, Pseudomonas aeruginosa PA01
agcgcggcggcggcc

SEQ ID NO: 3432687 - RNA, 16 nt, Pseudomonas aeruginosa PA01
agcgcggcggcggcca

SEQ ID NO: 3432688 - RNA, 19 nt, Pseudomonas aeruginosa PA01
agcgcggcggcggccagca

SEQ ID NO: 3432689 - RNA, 20 nt, Pseudomonas aeruginosa PA01
agcgcggcggcggccgcaug

SEQ ID NO: 3432690 - RNA, 23 nt, Pseudomonas aeruginosa PA01
agcgcggcggcggccgcaugccg

SEQ ID NO: 3432691 - RNA, 21 nt, Pseudomonas aeruginosa PA01
agcgcggcguggccggcgacc

SEQ ID NO: 3432692 - RNA, 17 nt, Pseudomonas aeruginosa PA01
agcgcggcuucagagcu

SEQ ID NO: 3432693 - RNA, 19 nt, Pseudomonas aeruginosa PA01
agcgcgggcugccccucac

SEQ ID NO: 3432694 - RNA, 18 nt, Pseudomonas aeruginosa PA01
agcgcggucauccgcccu

SEQ ID NO: 3432695 - RNA, 20 nt, Pseudomonas aeruginosa PA01
agcgcggugagcagggugac

SEQ ID NO: 3432696 - RNA, 14 nt, Pseudomonas aeruginosa PA01
agcgcggugcgcgc

SEQ ID NO: 3432697 - RNA, 16 nt, Pseudomonas aeruginosa PA01
agcgcggugcgcgcca

SEQ ID NO: 3432698 - RNA, 21 nt, Pseudomonas aeruginosa PA01
agcgcggugcgguuguucgcc

SEQ ID NO: 3432699 - RNA, 21 nt, Pseudomonas aeruginosa PA01
agcgcguacucaggccgggcg

SEQ ID NO: 3432700 - RNA, 20 nt, Pseudomonas aeruginosa PA01
agcgcguagaccaccucgac

SEQ ID NO: 3432701 - RNA, 21 nt, Pseudomonas aeruginosa PA01
agcgcgucacucgacaggcca

SEQ ID NO: 3432702 - RNA, 16 nt, Pseudomonas aeruginosa PA01
agcgcgucaucaggcu

SEQ ID NO: 3432703 - RNA, 17 nt, Pseudomonas aeruginosa PA01
agcgcgucaucaggcuc

SEQ ID NO: 3432704 - RNA, 18 nt, Pseudomonas aeruginosa PA01
agcgcgucgaccaccgcg

SEQ ID NO: 3432705 - RNA, 22 nt, Pseudomonas aeruginosa PA01
agcgcgucgaccaccgcguggu

SEQ ID NO: 3432706 - RNA, 14 nt, Pseudomonas aeruginosa PA01
agcgcgucgcgguc

SEQ ID NO: 3432707 - RNA, 21 nt, Pseudomonas aeruginosa PA01
agcgcgucgcggucuuccgcc

SEQ ID NO: 3432708 - RNA, 18 nt, Pseudomonas aeruginosa PA01
agcgcgucggcacgccga

SEQ ID NO: 3432709 - RNA, 21 nt, Pseudomonas aeruginosa PA01
agcgcgucggcacgccgaagu

SEQ ID NO: 3432710 - RNA, 14 nt, Pseudomonas aeruginosa PA01
agcgcgugcaggcg

SEQ ID NO: 3432711 - RNA, 16 nt, Pseudomonas aeruginosa PA01
agcgcgugcaggcgcc

SEQ ID NO: 3432712 - RNA, 17 nt, Pseudomonas aeruginosa PA01
agcgcguucaccccgcc

SEQ ID NO: 3432713 - RNA, 16 nt, Pseudomonas aeruginosa PA01
agcgcuacgcaggccc

SEQ ID NO: 3432714 - RNA, 18 nt, Pseudomonas aeruginosa PA01
agcgcuagcgcauggcga

SEQ ID NO: 3432715 - RNA, 14 nt, Pseudomonas aeruginosa PA01
agcgcucacgcacc

SEQ ID NO: 3432716 - RNA, 21 nt, Pseudomonas aeruginosa PA01
agcgcucacgcaccucgucga

SEQ ID NO: 3432717 - RNA, 15 nt, Pseudomonas aeruginosa PA01
agcgcucccagaccu

SEQ ID NO: 3432718 - RNA, 23 nt, Pseudomonas aeruginosa PA01
agcgcuccucgcgcugcccggcg

SEQ ID NO: 3432719 - RNA, 17 nt, Pseudomonas aeruginosa PA01
agcgcuccuucuccggg

SEQ ID NO: 3432720 - RNA, 19 nt, Pseudomonas aeruginosa PA01
agcgcuccuugcgccaggc

SEQ ID NO: 3432721 - RNA, 17 nt, Pseudomonas aeruginosa PA01
agcgcucgaacgccgcc

SEQ ID NO: 3432722 - RNA, 18 nt, Pseudomonas aeruginosa PA01
agcgcucgaacgccgccc

SEQ ID NO: 3432723 - RNA, 19 nt, Pseudomonas aeruginosa PA01
agcgcucgaacgccgcccg

SEQ ID NO: 3432724 - RNA, 21 nt, Pseudomonas aeruginosa PA01
agcgcucgaacgccgcccguc

SEQ ID NO: 3432725 - RNA, 22 nt, Pseudomonas aeruginosa PA01
agcgcucgaacgccgcccgucg

SEQ ID NO: 3432726 - RNA, 21 nt, Pseudomonas aeruginosa PA01
agcgcucgacauacuccgccg

SEQ ID NO: 3432727 - RNA, 22 nt, Pseudomonas aeruginosa PA01
agcgcucgacauacuccgccgc

SEQ ID NO: 3432728 - RNA, 22 nt, Pseudomonas aeruginosa PA01
agcgcucgccgucaucgagcag

SEQ ID NO: 3432729 - RNA, 18 nt, Pseudomonas aeruginosa PA01
agcgcucgcgcagccacu

SEQ ID NO: 3432730 - RNA, 13 nt, Pseudomonas aeruginosa PA01
agcgcucgcgcuu

SEQ ID NO: 3432731 - RNA, 18 nt, Pseudomonas aeruginosa PA01
agcgcucggucagcuccc

SEQ ID NO: 3432732 - RNA, 12 nt, Pseudomonas aeruginosa PA01
agcgcugaucac

SEQ ID NO: 3432733 - RNA, 15 nt, Pseudomonas aeruginosa PA01
agcgcugaucacgau

SEQ ID NO: 3432734 - RNA, 18 nt, Pseudomonas aeruginosa PA01
agcgcugccgcaugcagu

SEQ ID NO: 3432735 - RNA, 16 nt, Pseudomonas aeruginosa PA01
agcgcugccugcaccg

SEQ ID NO: 3432736 - RNA, 12 nt, Pseudomonas aeruginosa PA01
agcgcugcgcca

SEQ ID NO: 3432737 - RNA, 17 nt, Pseudomonas aeruginosa PA01
agcgcugcgcccgcucg

SEQ ID NO: 3432738 - RNA, 22 nt, Pseudomonas aeruginosa PA01
agcgcugcgcccgcucgacccg

SEQ ID NO: 3432739 - RNA, 13 nt, Pseudomonas aeruginosa PA01
agcgcugcucgac

SEQ ID NO: 3432740 - RNA, 16 nt, Pseudomonas aeruginosa PA01
agcgcugcucgaccac

SEQ ID NO: 3432741 - RNA, 17 nt, Pseudomonas aeruginosa PA01
agcgcugcucgaccacc

SEQ ID NO: 3432742 - RNA, 17 nt, Pseudomonas aeruginosa PA01
agcggccgagcaggcgc

SEQ ID NO: 3432743 - RNA, 18 nt, Pseudomonas aeruginosa PA01
agcggccgagcaggcgcg

SEQ ID NO: 3432744 - RNA, 21 nt, Pseudomonas aeruginosa PA01
agcggccgcgaggacaacacu

SEQ ID NO: 3432745 - RNA, 14 nt, Pseudomonas aeruginosa PA01
agcggccggcgcgg

SEQ ID NO: 3432746 - RNA, 18 nt, Pseudomonas aeruginosa PA01
agcggccggcgcggcgcg

SEQ ID NO: 3432747 - RNA, 23 nt, Pseudomonas aeruginosa PA01
agcggccgugcaugccgacgagc

SEQ ID NO: 3432748 - RNA, 17 nt, Pseudomonas aeruginosa PA01
agcggcgaagcgcaggc

SEQ ID NO: 3432749 - RNA, 17 nt, Pseudomonas aeruginosa PA01
agcggcgacaccgccag

SEQ ID NO: 3432750 - RNA, 17 nt, Pseudomonas aeruginosa PA01
agcggcgacgccacccg

SEQ ID NO: 3432751 - RNA, 19 nt, Pseudomonas aeruginosa PA01
agcggcgcaccgacgccgc

SEQ ID NO: 3432752 - RNA, 20 nt, Pseudomonas aeruginosa PA01
agcggcgcaccgacgccgcc

SEQ ID NO: 3432753 - RNA, 16 nt, Pseudomonas aeruginosa PA01
agcggcgcagccucgc

SEQ ID NO: 3432754 - RNA, 19 nt, Pseudomonas aeruginosa PA01
agcggcgccaacucggccu

SEQ ID NO: 3432755 - RNA, 14 nt, Pseudomonas aeruginosa PA01
agcggcgccagcuc

SEQ ID NO: 3432756 - RNA, 14 nt, Pseudomonas aeruginosa PA01
agcggcgccaggcg

SEQ ID NO: 3432757 - RNA, 19 nt, Pseudomonas aeruginosa PA01
agcggcgccaggcguucca

SEQ ID NO: 3432758 - RNA, 13 nt, Pseudomonas aeruginosa PA01
agcggcgcccugg

SEQ ID NO: 3432759 - RNA, 15 nt, Pseudomonas aeruginosa PA01
agcggcgcccuggcu

SEQ ID NO: 3432760 - RNA, 14 nt, Pseudomonas aeruginosa PA01
agcggcgccgaggg

SEQ ID NO: 3432761 - RNA, 16 nt, Pseudomonas aeruginosa PA01
agcggcgccucgaagc

SEQ ID NO: 3432762 - RNA, 19 nt, Pseudomonas aeruginosa PA01
agcggcgccucgaagcgga

SEQ ID NO: 3432763 - RNA, 14 nt, Pseudomonas aeruginosa PA01
agcggcgcgaggcc

SEQ ID NO: 3432764 - RNA, 20 nt, Pseudomonas aeruginosa PA01
agcggcgcgaggccguacca

SEQ ID NO: 3432765 - RNA, 22 nt, Pseudomonas aeruginosa PA01
agcggcgcggcguaccagccgc

SEQ ID NO: 3432766 - RNA, 15 nt, Pseudomonas aeruginosa PA01
agcggcgcgucgacc

SEQ ID NO: 3432767 - RNA, 18 nt, Pseudomonas aeruginosa PA01
agcggcgcgucgaccacg

SEQ ID NO: 3432768 - RNA, 18 nt, Pseudomonas aeruginosa PA01
agcggcgcuacgaaggcg

SEQ ID NO: 3432769 - RNA, 23 nt, Pseudomonas aeruginosa PA01
agcggcgcuuuccacucgggguc

SEQ ID NO: 3432770 - RNA, 19 nt, Pseudomonas aeruginosa PA01
agcggcggauacaggcgca

SEQ ID NO: 3432771 - RNA, 20 nt, Pseudomonas aeruginosa PA01
agcggcggauacaggcgcag

SEQ ID NO: 3432772 - RNA, 22 nt, Pseudomonas aeruginosa PA01
agcggcggauacaggcgcagca

SEQ ID NO: 3432773 - RNA, 12 nt, Pseudomonas aeruginosa PA01
agcggcggcgcc

SEQ ID NO: 3432774 - RNA, 21 nt, Pseudomonas aeruginosa PA01
agcggcgguagcuccaggccg

SEQ ID NO: 3432775 - RNA, 17 nt, Pseudomonas aeruginosa PA01
agcggcggucccaucag

SEQ ID NO: 3432776 - RNA, 19 nt, Pseudomonas aeruginosa PA01
agcggcggucccaucagca

SEQ ID NO: 3432777 - RNA, 17 nt, Pseudomonas aeruginosa PA01
agcggcggugcgccggc

SEQ ID NO: 3432778 - RNA, 19 nt, Pseudomonas aeruginosa PA01
agcggcguauccucggcca

SEQ ID NO: 3432779 - RNA, 20 nt, Pseudomonas aeruginosa PA01
agcggcguauccucggccau

SEQ ID NO: 3432780 - RNA, 15 nt, Pseudomonas aeruginosa PA01
agcggcguaugcgcc

SEQ ID NO: 3432781 - RNA, 18 nt, Pseudomonas aeruginosa PA01
agcggcguaugcgccucc

SEQ ID NO: 3432782 - RNA, 14 nt, Pseudomonas aeruginosa PA01
agcggcgucugccg

SEQ ID NO: 3432783 - RNA, 18 nt, Pseudomonas aeruginosa PA01
agcggcgucugccgcucg

SEQ ID NO: 3432784 - RNA, 17 nt, Pseudomonas aeruginosa PA01
agcggcgugaagccgcc

SEQ ID NO: 3432785 - RNA, 22 nt, Pseudomonas aeruginosa PA01
agcggcgugaagccgccgccca

SEQ ID NO: 3432786 - RNA, 16 nt, Pseudomonas aeruginosa PA01
agcggcguucgccgag

SEQ ID NO: 3432787 - RNA, 21 nt, Pseudomonas aeruginosa PA01
agcggcguuucuuuuugccgg

SEQ ID NO: 3432788 - RNA, 21 nt, Pseudomonas aeruginosa PA01
agcggcucacgccccagcgca

SEQ ID NO: 3432789 - RNA, 16 nt, Pseudomonas aeruginosa PA01
agcggcuccucggccu

SEQ ID NO: 3432790 - RNA, 21 nt, Pseudomonas aeruginosa PA01
agcggcuccucggccugggcg

SEQ ID NO: 3432791 - RNA, 13 nt, Pseudomonas aeruginosa PA01
agcggcucgccga

SEQ ID NO: 3432792 - RNA, 14 nt, Pseudomonas aeruginosa PA01
agcggcucgccgaa

SEQ ID NO: 3432793 - RNA, 23 nt, Pseudomonas aeruginosa PA01
agcggcucgcugaaauccaccag

SEQ ID NO: 3432794 - RNA, 16 nt, Pseudomonas aeruginosa PA01
agcggcucggccaggg

SEQ ID NO: 3432795 - RNA, 19 nt, Pseudomonas aeruginosa PA01
agcggcucgucaucgucca

SEQ ID NO: 3432796 - RNA, 15 nt, Pseudomonas aeruginosa PA01
agcggcugccgaggc

SEQ ID NO: 3432797 - RNA, 11 nt, Pseudomonas aeruginosa PA01
agcggcugcug

SEQ ID NO: 3432798 - RNA, 14 nt, Pseudomonas aeruginosa PA01
agcggcugcugucg

SEQ ID NO: 3432799 - RNA, 15 nt, Pseudomonas aeruginosa PA01
agcggcuggccgucg

SEQ ID NO: 3432800 - RNA, 16 nt, Pseudomonas aeruginosa PA01
agcggcuggcgggcga

SEQ ID NO: 3432801 - RNA, 18 nt, Pseudomonas aeruginosa PA01
agcggcuggcugaagccg

SEQ ID NO: 3432802 - RNA, 22 nt, Pseudomonas aeruginosa PA01
agcggcuggcugaagccgggca

SEQ ID NO: 3432803 - RNA, 16 nt, Pseudomonas aeruginosa PA01
agcggcuguugccgga

SEQ ID NO: 3432804 - RNA, 19 nt, Pseudomonas aeruginosa PA01
agcggcuuguccuggcgca

SEQ ID NO: 3432805 - RNA, 18 nt, Pseudomonas aeruginosa PA01
agcgggaaggucggcagc

SEQ ID NO: 3432806 - RNA, 17 nt, Pseudomonas aeruginosa PA01
agcgggacagcuugccg

SEQ ID NO: 3432807 - RNA, 15 nt, Pseudomonas aeruginosa PA01
agcgggacgaugccg

SEQ ID NO: 3432808 - RNA, 23 nt, Pseudomonas aeruginosa PA01
agcgggacgaugccgaucucgcc

SEQ ID NO: 3432809 - RNA, 16 nt, Pseudomonas aeruginosa PA01
agcgggaugugcacca

SEQ ID NO: 3432810 - RNA, 19 nt, Pseudomonas aeruginosa PA01
agcgggaugugcaccagca

SEQ ID NO: 3432811 - RNA, 12 nt, Pseudomonas aeruginosa PA01
agcgggccagca

SEQ ID NO: 3432812 - RNA, 13 nt, Pseudomonas aeruginosa PA01
agcgggccagcag

SEQ ID NO: 3432813 - RNA, 18 nt, Pseudomonas aeruginosa PA01
agcgggccagcagcuccg

SEQ ID NO: 3432814 - RNA, 16 nt, Pseudomonas aeruginosa PA01
agcgggccaucagguc

SEQ ID NO: 3432815 - RNA, 15 nt, Pseudomonas aeruginosa PA01
agcgggccgauccgc

SEQ ID NO: 3432816 - RNA, 13 nt, Pseudomonas aeruginosa PA01
agcgggccucggc

SEQ ID NO: 3432817 - RNA, 22 nt, Pseudomonas aeruginosa PA01
agcgggccuucgccagcggcca

SEQ ID NO: 3432818 - RNA, 18 nt, Pseudomonas aeruginosa PA01
agcgggcgagggcggcgc

SEQ ID NO: 3432819 - RNA, 20 nt, Pseudomonas aeruginosa PA01
agcgggcgagggcggcgcgg

SEQ ID NO: 3432820 - RNA, 14 nt, Pseudomonas aeruginosa PA01
agcgggcgccgccg

SEQ ID NO: 3432821 - RNA, 17 nt, Pseudomonas aeruginosa PA01
agcgggcgcuugaagcc

SEQ ID NO: 3432822 - RNA, 23 nt, Pseudomonas aeruginosa PA01
agcgggcgcuugaagccggcgua

SEQ ID NO: 3432823 - RNA, 17 nt, Pseudomonas aeruginosa PA01
agcgggcgguagaucuc

SEQ ID NO: 3432824 - RNA, 18 nt, Pseudomonas aeruginosa PA01
agcgggcggucgcggacc

SEQ ID NO: 3432825 - RNA, 16 nt, Pseudomonas aeruginosa PA01
agcgggcguccggcga

SEQ ID NO: 3432826 - RNA, 14 nt, Pseudomonas aeruginosa PA01
agcggguagcgccg

SEQ ID NO: 3432827 - RNA, 19 nt, Pseudomonas aeruginosa PA01
agcggguaguagaucagcu

SEQ ID NO: 3432828 - RNA, 16 nt, Pseudomonas aeruginosa PA01
agcggguauugcagac

SEQ ID NO: 3432829 - RNA, 20 nt, Pseudomonas aeruginosa PA01
agcggguauugcagacgcug

SEQ ID NO: 3432830 - RNA, 19 nt, Pseudomonas aeruginosa PA01
agcggguccuggguggcga

SEQ ID NO: 3432831 - RNA, 13 nt, Pseudomonas aeruginosa PA01
agcgggucgagcc

SEQ ID NO: 3432832 - RNA, 18 nt, Pseudomonas aeruginosa PA01
agcgggucgaucaggcgc

SEQ ID NO: 3432833 - RNA, 21 nt, Pseudomonas aeruginosa PA01
agcgggucgaucaggcgcaug

SEQ ID NO: 3432834 - RNA, 17 nt, Pseudomonas aeruginosa PA01
agcgggucgcggcuggc

SEQ ID NO: 3432835 - RNA, 13 nt, Pseudomonas aeruginosa PA01
agcgggucggcga

SEQ ID NO: 3432836 - RNA, 23 nt, Pseudomonas aeruginosa PA01
agcgggugccgaagaccaccaug

SEQ ID NO: 3432837 - RNA, 20 nt, Pseudomonas aeruginosa PA01
agcggguggcaacugccgcc

SEQ ID NO: 3432838 - RNA, 22 nt, Pseudomonas aeruginosa PA01
agcggguucccugcgccucgac

SEQ ID NO: 3432839 - RNA, 22 nt, Pseudomonas aeruginosa PA01
agcggguuggcuuccagccagc

SEQ ID NO: 3432840 - RNA, 16 nt, Pseudomonas aeruginosa PA01
agcgguaccagcagcg

SEQ ID NO: 3432841 - RNA, 22 nt, Pseudomonas aeruginosa PA01
agcgguaccagcagcgccgaac

SEQ ID NO: 3432842 - RNA, 15 nt, Pseudomonas aeruginosa PA01
agcgguacccgccgg

SEQ ID NO: 3432843 - RNA, 19 nt, Pseudomonas aeruginosa PA01
agcgguaccgggccaggca

SEQ ID NO: 3432844 - RNA, 22 nt, Pseudomonas aeruginosa PA01
agcguugcgcgagcaccgcgca

SEQ ID NO: 3432845 - RNA, 16 nt, Pseudomonas aeruginosa PA01
agcguugcgggcaggu

SEQ ID NO: 3432846 - RNA, 15 nt, Pseudomonas aeruginosa PA01
agcguugggccucgc

SEQ ID NO: 3432847 - RNA, 19 nt, Pseudomonas aeruginosa PA01
agcguugggccucgcugcg

SEQ ID NO: 3432848 - RNA, 21 nt, Pseudomonas aeruginosa PA01
agcguugggccucgcugcgca

SEQ ID NO: 3432849 - RNA, 23 nt, Pseudomonas aeruginosa PA01
agcguuguucuucgacgcugguc

SEQ ID NO: 3432850 - RNA, 21 nt, Pseudomonas aeruginosa PA01
agcguuucgaagccgccgccg

SEQ ID NO: 3432851 - RNA, 16 nt, Pseudomonas aeruginosa PA01
agcuaccgucggccug

SEQ ID NO: 3432852 - RNA, 17 nt, Pseudomonas aeruginosa PA01
agcuaccgucggccugc

SEQ ID NO: 3432853 - RNA, 18 nt, Pseudomonas aeruginosa PA01
agcuaccgucggccugca

SEQ ID NO: 3432854 - RNA, 21 nt, Pseudomonas aeruginosa PA01
agcuaccgucggccugcaaca

SEQ ID NO: 3432855 - RNA, 16 nt, Pseudomonas aeruginosa PA01
agcuaugcaaaagugc

SEQ ID NO: 3432856 - RNA, 14 nt, Pseudomonas aeruginosa PA01
agcucagcuccagg

SEQ ID NO: 3432857 - RNA, 15 nt, Pseudomonas aeruginosa PA01
agcucagcuccaggc

SEQ ID NO: 3432858 - RNA, 14 nt, Pseudomonas aeruginosa PA01
agcucagcuggaua

SEQ ID NO: 3432859 - RNA, 17 nt, Pseudomonas aeruginosa PA01
agcucagcugggagagc

SEQ ID NO: 3432860 - RNA, 21 nt, Pseudomonas aeruginosa PA01
agcucagucgguagagcagcu

SEQ ID NO: 3432861 - RNA, 20 nt, Pseudomonas aeruginosa PA01
agcucagucgguagagcagu

SEQ ID NO: 3432862 - RNA, 23 nt, Pseudomonas aeruginosa PA01
agcucauggccaggucagccacc

SEQ ID NO: 3432863 - RNA, 13 nt, Pseudomonas aeruginosa PA01
agcuccaccaggc

SEQ ID NO: 3432864 - RNA, 17 nt, Pseudomonas aeruginosa PA01
agcuccaccgauggcgc

SEQ ID NO: 3432865 - RNA, 14 nt, Pseudomonas aeruginosa PA01
agcuccacgucggc

SEQ ID NO: 3432866 - RNA, 16 nt, Pseudomonas aeruginosa PA01
agcuccacgucggccc

SEQ ID NO: 3432867 - RNA, 16 nt, Pseudomonas aeruginosa PA01
agcuccagcaccggcg

SEQ ID NO: 3432868 - RNA, 20 nt, Pseudomonas aeruginosa PA01
agcuccagcaccggcggcgc

SEQ ID NO: 3432869 - RNA, 22 nt, Pseudomonas aeruginosa PA01
agcuccagcaccggcggcgcca

SEQ ID NO: 3432870 - RNA, 18 nt, Pseudomonas aeruginosa PA01
agcuccagcagucgcaca

SEQ ID NO: 3432871 - RNA, 13 nt, Pseudomonas aeruginosa PA01
agcuccagcgccc

SEQ ID NO: 3432872 - RNA, 21 nt, Pseudomonas aeruginosa PA01
agcuccagcgcccaggugcga

SEQ ID NO: 3432873 - RNA, 22 nt, Pseudomonas aeruginosa PA01
agcuccagcggaaucgcgcccu

SEQ ID NO: 3432874 - RNA, 23 nt, Pseudomonas aeruginosa PA01
agcuccagcggaaucgcgcccuu

SEQ ID NO: 3432875 - RNA, 13 nt, Pseudomonas aeruginosa PA01
agcuccaggccga

SEQ ID NO: 3432876 - RNA, 17 nt, Pseudomonas aeruginosa PA01
agcuccagggcugccac

SEQ ID NO: 3432877 - RNA, 19 nt, Pseudomonas aeruginosa PA01
agcucccaggcgucgccga

SEQ ID NO: 3432878 - RNA, 13 nt, Pseudomonas aeruginosa PA01
agcuccccgcacc

SEQ ID NO: 3432879 - RNA, 15 nt, Pseudomonas aeruginosa PA01
agcuccccgccgcca

SEQ ID NO: 3432880 - RNA, 22 nt, Pseudomonas aeruginosa PA01
agcuccccgccgccaggcgcug

SEQ ID NO: 3432881 - RNA, 14 nt, Pseudomonas aeruginosa PA01
agcucccugccgcc

SEQ ID NO: 3432882 - RNA, 16 nt, Pseudomonas aeruginosa PA01
agcucccugccgcccu

SEQ ID NO: 3432883 - RNA, 16 nt, Pseudomonas aeruginosa PA01
agcucccuugccgccg

SEQ ID NO: 3432884 - RNA, 13 nt, Pseudomonas aeruginosa PA01
agcuccggcagca

SEQ ID NO: 3432885 - RNA, 14 nt, Pseudomonas aeruginosa PA01
agcuccggcgggcg

SEQ ID NO: 3432886 - RNA, 21 nt, Pseudomonas aeruginosa PA01
agcuccgggcuggccaccagc

SEQ ID NO: 3432887 - RNA, 12 nt, Pseudomonas aeruginosa PA01
agcuccuccagc

SEQ ID NO: 3432888 - RNA, 14 nt, Pseudomonas aeruginosa PA01
agcuccuccagcag

SEQ ID NO: 3432889 - RNA, 14 nt, Pseudomonas aeruginosa PA01
agcuccuccagccg

SEQ ID NO: 3432890 - RNA, 13 nt, Pseudomonas aeruginosa PA01
agcuccuccagcg

SEQ ID NO: 3432891 - RNA, 15 nt, Pseudomonas aeruginosa PA01
agcuccucggcgugg

SEQ ID NO: 3432892 - RNA, 13 nt, Pseudomonas aeruginosa PA01
agcuccuggucgc

SEQ ID NO: 3432893 - RNA, 19 nt, Pseudomonas aeruginosa PA01
agcuccuggucgcggggcu

SEQ ID NO: 3432894 - RNA, 21 nt, Pseudomonas aeruginosa PA01
agcuccuugcgcuccuuggcu

SEQ ID NO: 3432895 - RNA, 16 nt, Pseudomonas aeruginosa PA01
agcucgaacagcaccg

SEQ ID NO: 3432896 - RNA, 20 nt, Pseudomonas aeruginosa PA01
agcucgaacagcaccgagca

SEQ ID NO: 3432897 - RNA, 13 nt, Pseudomonas aeruginosa PA01
agcucgaagccgc

SEQ ID NO: 3432898 - RNA, 18 nt, Pseudomonas aeruginosa PA01
agcucgacccgcccgccg

SEQ ID NO: 3432899 - RNA, 23 nt, Pseudomonas aeruginosa PA01
agcucgacccgcccgccguccuc

SEQ ID NO: 3432900 - RNA, 17 nt, Pseudomonas aeruginosa PA01
agcucgaucagcccgcc

SEQ ID NO: 3432901 - RNA, 22 nt, Pseudomonas aeruginosa PA01
agcucgaucucauggucgggca

SEQ ID NO: 3432902 - RNA, 14 nt, Pseudomonas aeruginosa PA01
agcucgcccgccuc

SEQ ID NO: 3432903 - RNA, 15 nt, Pseudomonas aeruginosa PA01
agcucgcccgccucg

SEQ ID NO: 3432904 - RNA, 16 nt, Pseudomonas aeruginosa PA01
agcucgccgcgcucca

SEQ ID NO: 3432905 - RNA, 18 nt, Pseudomonas aeruginosa PA01
agcucgccggcguccucc

SEQ ID NO: 3432906 - RNA, 16 nt, Pseudomonas aeruginosa PA01
agcucgcgcaaccagc

SEQ ID NO: 3432907 - RNA, 13 nt, Pseudomonas aeruginosa PA01
agcucgcgcaagc

SEQ ID NO: 3432908 - RNA, 17 nt, Pseudomonas aeruginosa PA01
agcucgcgcaagcgccc

SEQ ID NO: 3432909 - RNA, 19 nt, Pseudomonas aeruginosa PA01
agcucgcgggacagcuuga

SEQ ID NO: 3432910 - RNA, 17 nt, Pseudomonas aeruginosa PA01
agcucgcgguaggccag

SEQ ID NO: 3432911 - RNA, 22 nt, Pseudomonas aeruginosa PA01
agcucgcgguaggccagcuccu

SEQ ID NO: 3432912 - RNA, 18 nt, Pseudomonas aeruginosa PA01
agcucgcuaugcagcagg

SEQ ID NO: 3432913 - RNA, 17 nt, Pseudomonas aeruginosa PA01
agcucgcugucgccgag

SEQ ID NO: 3432914 - RNA, 18 nt, Pseudomonas aeruginosa PA01
agcucgcugucgccgagc

SEQ ID NO: 3432915 - RNA, 21 nt, Pseudomonas aeruginosa PA01
agcucggacaagggccagagc

SEQ ID NO: 3432916 - RNA, 22 nt, Pseudomonas aeruginosa PA01
agcucggcaaucgcggggugau

SEQ ID NO: 3432917 - RNA, 14 nt, Pseudomonas aeruginosa PA01
agcucggcacgcag

SEQ ID NO: 3432918 - RNA, 15 nt, Pseudomonas aeruginosa PA01
agcucggcacgcagc

SEQ ID NO: 3432919 - RNA, 13 nt, Pseudomonas aeruginosa PA01
agcucggcagcac

SEQ ID NO: 3432920 - RNA, 16 nt, Pseudomonas aeruginosa PA01
agcucggcagcacgcu

SEQ ID NO: 3432921 - RNA, 17 nt, Pseudomonas aeruginosa PA01
agcucggcaucgucgaa

SEQ ID NO: 3432922 - RNA, 13 nt, Pseudomonas aeruginosa PA01
agcucggccaggc

SEQ ID NO: 3432923 - RNA, 14 nt, Pseudomonas aeruginosa PA01
agcucggccaggca

SEQ ID NO: 3432924 - RNA, 22 nt, Pseudomonas aeruginosa PA01
agcucggccaggcacagguuga

SEQ ID NO: 3432925 - RNA, 23 nt, Pseudomonas aeruginosa PA01
agcucggccaggcacagguugau

SEQ ID NO: 3432926 - RNA, 11 nt, Pseudomonas aeruginosa PA01
agcucggccau

SEQ ID NO: 3432927 - RNA, 17 nt, Pseudomonas aeruginosa PA01
agcucggccgagggcag

SEQ ID NO: 3432928 - RNA, 20 nt, Pseudomonas aeruginosa PA01
agcucggccgagggcagccu

SEQ ID NO: 3432929 - RNA, 13 nt, Pseudomonas aeruginosa PA01
agcucggccggca

SEQ ID NO: 3432930 - RNA, 16 nt, Pseudomonas aeruginosa PA01
agcucggccggcaggc

SEQ ID NO: 3432931 - RNA, 19 nt, Pseudomonas aeruginosa PA01
agcucggccugguccggca

SEQ ID NO: 3432932 - RNA, 20 nt, Pseudomonas aeruginosa PA01
agcucggcgacauagccggc

SEQ ID NO: 3432933 - RNA, 21 nt, Pseudomonas aeruginosa PA01
agcucggcgacauagccggcg

SEQ ID NO: 3432934 - RNA, 16 nt, Pseudomonas aeruginosa PA01
agcucggcgauggcgc

SEQ ID NO: 3432935 - RNA, 19 nt, Pseudomonas aeruginosa PA01
agcucggcgauggcgcgcg

SEQ ID NO: 3432936 - RNA, 20 nt, Pseudomonas aeruginosa PA01
agcucggcgauggcgcgcgg

SEQ ID NO: 3432937 - RNA, 14 nt, Pseudomonas aeruginosa PA01
agcucggcgcccug

SEQ ID NO: 3432938 - RNA, 17 nt, Pseudomonas aeruginosa PA01
agcucggcgcccuggcc

SEQ ID NO: 3432939 - RNA, 22 nt, Pseudomonas aeruginosa PA01
agcucggcgcgaugaugccgcc

SEQ ID NO: 3432940 - RNA, 23 nt, Pseudomonas aeruginosa PA01
agcucggcgcgaugaugccgccg

SEQ ID NO: 3432941 - RNA, 12 nt, Pseudomonas aeruginosa PA01
agcucggcggga

SEQ ID NO: 3432942 - RNA, 17 nt, Pseudomonas aeruginosa PA01
agcucggcguagcgcug

SEQ ID NO: 3432943 - RNA, 18 nt, Pseudomonas aeruginosa PA01
agcucggcuugacuggca

SEQ ID NO: 3432944 - RNA, 19 nt, Pseudomonas aeruginosa PA01
agcucggucagcggcgcag

SEQ ID NO: 3432945 - RNA, 17 nt, Pseudomonas aeruginosa PA01
agcucggugagcaggcg

SEQ ID NO: 3432946 - RNA, 19 nt, Pseudomonas aeruginosa PA01
agcucggugagcaggcgcc

SEQ ID NO: 3432947 - RNA, 23 nt, Pseudomonas aeruginosa PA01
agcugucgagcacggcgcugguc

SEQ ID NO: 3432948 - RNA, 15 nt, Pseudomonas aeruginosa PA01
agcugucgcccucgc

SEQ ID NO: 3432949 - RNA, 16 nt, Pseudomonas aeruginosa PA01
agcugucgcccucgcg

SEQ ID NO: 3432950 - RNA, 17 nt, Pseudomonas aeruginosa PA01
agcugucgcccucgcgg

SEQ ID NO: 3432951 - RNA, 15 nt, Pseudomonas aeruginosa PA01
agcugucggcccgcg

SEQ ID NO: 3432952 - RNA, 16 nt, Pseudomonas aeruginosa PA01
agcugucggcccgcgc

SEQ ID NO: 3432953 - RNA, 21 nt, Pseudomonas aeruginosa PA01
agcugucguaguccugggccg

SEQ ID NO: 3432954 - RNA, 17 nt, Pseudomonas aeruginosa PA01
agcuguuggccaaccag

SEQ ID NO: 3432955 - RNA, 15 nt, Pseudomonas aeruginosa PA01
agcuguuucagccca

SEQ ID NO: 3432956 - RNA, 22 nt, Pseudomonas aeruginosa PA01
agcuucaccggugccgggaagc

SEQ ID NO: 3432957 - RNA, 15 nt, Pseudomonas aeruginosa PA01
agcuucagccgaccg

SEQ ID NO: 3432958 - RNA, 15 nt, Pseudomonas aeruginosa PA01
agcuucagcuccgag

SEQ ID NO: 3432959 - RNA, 13 nt, Pseudomonas aeruginosa PA01
agcuucaggcgca

SEQ ID NO: 3432960 - RNA, 14 nt, Pseudomonas aeruginosa PA01
agcuuccaggcgcg

SEQ ID NO: 3432961 - RNA, 15 nt, Pseudomonas aeruginosa PA01
agcuuccaggcgcgc

SEQ ID NO: 3432962 - RNA, 16 nt, Pseudomonas aeruginosa PA01
agcuucgccgcccugg

SEQ ID NO: 3432963 - RNA, 22 nt, Pseudomonas aeruginosa PA01
agcuucgccggguguuuuuccu

SEQ ID NO: 3432964 - RNA, 17 nt, Pseudomonas aeruginosa PA01
agcuucgcuggguuuuc

SEQ ID NO: 3432965 - RNA, 12 nt, Pseudomonas aeruginosa PA01
agcuucgucgcg

SEQ ID NO: 3432966 - RNA, 16 nt, Pseudomonas aeruginosa PA01
agcuucgucgcgcagg

SEQ ID NO: 3432967 - RNA, 13 nt, Pseudomonas aeruginosa PA01
agcuucugcaggg

SEQ ID NO: 3432968 - RNA, 17 nt, Pseudomonas aeruginosa PA01
agcuucugcagggcggc

SEQ ID NO: 3432969 - RNA, 16 nt, Pseudomonas aeruginosa PA01
agcuucugcuggaucc

SEQ ID NO: 3432970 - RNA, 18 nt, Pseudomonas aeruginosa PA01
agcuucugguuguaagcg

SEQ ID NO: 3432971 - RNA, 17 nt, Pseudomonas aeruginosa PA01
agcuucuucagcagcgg

SEQ ID NO: 3432972 - RNA, 12 nt, Pseudomonas aeruginosa PA01
agcuucuugccu

SEQ ID NO: 3432973 - RNA, 19 nt, Pseudomonas aeruginosa PA01
agcuugacgaucuucugca

SEQ ID NO: 3432974 - RNA, 16 nt, Pseudomonas aeruginosa PA01
agcuugaggucggccu

SEQ ID NO: 3432975 - RNA, 18 nt, Pseudomonas aeruginosa PA01
agcuugaugaagcccgcg

SEQ ID NO: 3432976 - RNA, 13 nt, Pseudomonas aeruginosa PA01
agcuugcccucag

SEQ ID NO: 3432977 - RNA, 19 nt, Pseudomonas aeruginosa PA01
agcuugccgaagauaccca

SEQ ID NO: 3432978 - RNA, 22 nt, Pseudomonas aeruginosa PA01
agcuugccgagguucuuccacu

SEQ ID NO: 3432979 - RNA, 19 nt, Pseudomonas aeruginosa PA01
agcuugccgcaggucuugu

SEQ ID NO: 3432980 - RNA, 13 nt, Pseudomonas aeruginosa PA01
agcuugccgcugc

SEQ ID NO: 3432981 - RNA, 20 nt, Pseudomonas aeruginosa PA01
agcuugccggcauagccgaa

SEQ ID NO: 3432982 - RNA, 16 nt, Pseudomonas aeruginosa PA01
agcuugccguuggcgu

SEQ ID NO: 3432983 - RNA, 17 nt, Pseudomonas aeruginosa PA01
agcuugccuuccaggcu

SEQ ID NO: 3432984 - RNA, 14 nt, Pseudomonas aeruginosa PA01
agcuugcgccagag

SEQ ID NO: 3432985 - RNA, 21 nt, Pseudomonas aeruginosa PA01
agcuugcgccagagcaggcgg

SEQ ID NO: 3432986 - RNA, 16 nt, Pseudomonas aeruginosa PA01
agcuugcgcgccaggg

SEQ ID NO: 3432987 - RNA, 18 nt, Pseudomonas aeruginosa PA01
agcuugcgucccuuggcg

SEQ ID NO: 3432988 - RNA, 21 nt, Pseudomonas aeruginosa PA01
agcuugcgucccuuggcgucg

SEQ ID NO: 3432989 - RNA, 16 nt, Pseudomonas aeruginosa PA01
agcuuggccacguccu

SEQ ID NO: 3432990 - RNA, 18 nt, Pseudomonas aeruginosa PA01
agcuuggccacuccgggc

SEQ ID NO: 3432991 - RNA, 17 nt, Pseudomonas aeruginosa PA01
agcuugguauccaccuc

SEQ ID NO: 3432992 - RNA, 20 nt, Pseudomonas aeruginosa PA01
agcuugguggugauccaggc

SEQ ID NO: 3432993 - RNA, 19 nt, Pseudomonas aeruginosa PA01
agcuuguccagggcgcccu

SEQ ID NO: 3432994 - RNA, 20 nt, Pseudomonas aeruginosa PA01
agcuuguccagggcgcccuu

SEQ ID NO: 3432995 - RNA, 19 nt, Pseudomonas aeruginosa PA01
agcuuguccgccggaaugu

SEQ ID NO: 3432996 - RNA, 19 nt, Pseudomonas aeruginosa PA01
agcuugucggccuugguca

SEQ ID NO: 3432997 - RNA, 19 nt, Pseudomonas aeruginosa PA01
agcuugugggcaugcucgg

SEQ ID NO: 3432998 - RNA, 17 nt, Pseudomonas aeruginosa PA01
agcuuguugcgcaggcg

SEQ ID NO: 3432999 - RNA, 18 nt, Pseudomonas aeruginosa PA01
agcuuguuggccagcagc

SEQ ID NO: 3433000 - RNA, 21 nt, Pseudomonas aeruginosa PA01
agcuuguuggccagcagccag

SEQ ID NO: 3433001 - RNA, 13 nt, Pseudomonas aeruginosa PA01
agcuuuccagggc

SEQ ID NO: 3433002 - RNA, 14 nt, Pseudomonas aeruginosa PA01
agcuuugcagggcg

SEQ ID NO: 3433003 - RNA, 17 nt, Pseudomonas aeruginosa PA01
agcuuugcgcagccacc

SEQ ID NO: 3433004 - RNA, 22 nt, Pseudomonas aeruginosa PA01
aggaaaaagacaaaauucuccc

SEQ ID NO: 3433005 - RNA, 15 nt, Pseudomonas aeruginosa PA01
aggaaaaagcccgcg

SEQ ID NO: 3433006 - RNA, 16 nt, Pseudomonas aeruginosa PA01
aggaaaacgcucaggc

SEQ ID NO: 3433007 - RNA, 22 nt, Pseudomonas aeruginosa PA01
aggaaaacgcucaggccaagca

SEQ ID NO: 3433008 - RNA, 21 nt, Pseudomonas aeruginosa PA01
aggaaacucacccuggcaccg

SEQ ID NO: 3433009 - RNA, 15 nt, Pseudomonas aeruginosa PA01
aggaaauacagcacc

SEQ ID NO: 3433010 - RNA, 23 nt, Pseudomonas aeruginosa PA01
aggaaaucaccgcugcgcaggug

SEQ ID NO: 3433011 - RNA, 15 nt, Pseudomonas aeruginosa PA01
aggaaaugccuggcu

SEQ ID NO: 3433012 - RNA, 17 nt, Pseudomonas aeruginosa PA01
aggaacacccagaagcc

SEQ ID NO: 3433013 - RNA, 19 nt, Pseudomonas aeruginosa PA01
aggaacagcuccuccagcg

SEQ ID NO: 3433014 - RNA, 20 nt, Pseudomonas aeruginosa PA01
aggaacauccgcggccccgg

SEQ ID NO: 3433015 - RNA, 21 nt, Pseudomonas aeruginosa PA01
aggaacauccgcggccccggc

SEQ ID NO: 3433016 - RNA, 14 nt, Pseudomonas aeruginosa PA01
aggaaccagggguc

SEQ ID NO: 3433017 - RNA, 18 nt, Pseudomonas aeruginosa PA01
aggaaccgacgcgcagga

SEQ ID NO: 3433018 - RNA, 13 nt, Pseudomonas aeruginosa PA01
aggaaccggccau

SEQ ID NO: 3433019 - RNA, 23 nt, Pseudomonas aeruginosa PA01
aggaaccggccauuacgccgagc

SEQ ID NO: 3433020 - RNA, 18 nt, Pseudomonas aeruginosa PA01
aggaacgcccgcggcagc

SEQ ID NO: 3433021 - RNA, 16 nt, Pseudomonas aeruginosa PA01
aggaacgccucgcaga

SEQ ID NO: 3433022 - RNA, 15 nt, Pseudomonas aeruginosa PA01
aggaacgugcggccu

SEQ ID NO: 3433023 - RNA, 21 nt, Pseudomonas aeruginosa PA01
aggaacgugcggccugcaaca

SEQ ID NO: 3433024 - RNA, 23 nt, Pseudomonas aeruginosa PA01
aggaacuccuccucgcuccagag

SEQ ID NO: 3433025 - RNA, 14 nt, Pseudomonas aeruginosa PA01
aggaacucgcgguc

SEQ ID NO: 3433026 - RNA, 13 nt, Pseudomonas aeruginosa PA01
aggaacuggaagc

SEQ ID NO: 3433027 - RNA, 16 nt, Pseudomonas aeruginosa PA01
aggaagaagcccgccu

SEQ ID NO: 3433028 - RNA, 15 nt, Pseudomonas aeruginosa PA01
aggaagagcccgcca

SEQ ID NO: 3433029 - RNA, 19 nt, Pseudomonas aeruginosa PA01
aggaagccgaccggcgccg

SEQ ID NO: 3433030 - RNA, 20 nt, Pseudomonas aeruginosa PA01
aggaagccgcgccccagcgg

SEQ ID NO: 3433031 - RNA, 16 nt, Pseudomonas aeruginosa PA01
aggaagcgccgggccg

SEQ ID NO: 3433032 - RNA, 13 nt, Pseudomonas aeruginosa PA01
aggaagcgggccu

SEQ ID NO: 3433033 - RNA, 17 nt, Pseudomonas aeruginosa PA01
aggaagcucggcagcac

SEQ ID NO: 3433034 - RNA, 19 nt, Pseudomonas aeruginosa PA01
aggaagcugacgaacaucg

SEQ ID NO: 3433035 - RNA, 13 nt, Pseudomonas aeruginosa PA01
aggaaggccaggu

SEQ ID NO: 3433036 - RNA, 17 nt, Pseudomonas aeruginosa PA01
aggaaggccaggucgcc

SEQ ID NO: 3433037 - RNA, 13 nt, Pseudomonas aeruginosa PA01
aggaaggccgcuu

SEQ ID NO: 3433038 - RNA, 13 nt, Pseudomonas aeruginosa PA01
aggaaggcgacga

SEQ ID NO: 3433039 - RNA, 19 nt, Pseudomonas aeruginosa PA01
aggaaggcgccggcauugc

SEQ ID NO: 3433040 - RNA, 16 nt, Pseudomonas aeruginosa PA01
aggaaggcgcgcacca

SEQ ID NO: 3433041 - RNA, 19 nt, Pseudomonas aeruginosa PA01
aggaaggcgcgcaccagcg

SEQ ID NO: 3433042 - RNA, 16 nt, Pseudomonas aeruginosa PA01
aggaagguccaggccc

SEQ ID NO: 3433043 - RNA, 17 nt, Pseudomonas aeruginosa PA01
aggaagugcagggcguc

SEQ ID NO: 3433044 - RNA, 21 nt, Pseudomonas aeruginosa PA01
aggaagugcagggcguccagu

SEQ ID NO: 3433045 - RNA, 22 nt, Pseudomonas aeruginosa PA01
aggaaguggccggugugcgacu

SEQ ID NO: 3433046 - RNA, 16 nt, Pseudomonas aeruginosa PA01
aggaaguugcgcagca

SEQ ID NO: 3433047 - RNA, 17 nt, Pseudomonas aeruginosa PA01
aggaauacggcgcgaug

SEQ ID NO: 3433048 - RNA, 22 nt, Pseudomonas aeruginosa PA01
aggaaucaccacucgccagcgc

SEQ ID NO: 3433049 - RNA, 18 nt, Pseudomonas aeruginosa PA01
aggaaucgaacccccgac

SEQ ID NO: 3433050 - RNA, 20 nt, Pseudomonas aeruginosa PA01
aggacgcauaaccgcuugcg

SEQ ID NO: 3433051 - RNA, 16 nt, Pseudomonas aeruginosa PA01
aggacgccaccaggcc

SEQ ID NO: 3433052 - RNA, 17 nt, Pseudomonas aeruginosa PA01
aggacgccaccaggccg

SEQ ID NO: 3433053 - RNA, 13 nt, Pseudomonas aeruginosa PA01
aggacgccgccgg

SEQ ID NO: 3433054 - RNA, 22 nt, Pseudomonas aeruginosa PA01
aggacgcuccugcgccggcucg

SEQ ID NO: 3433055 - RNA, 22 nt, Pseudomonas aeruginosa PA01
aggacgcuggcgauaucgaagg

SEQ ID NO: 3433056 - RNA, 20 nt, Pseudomonas aeruginosa PA01
aggacggauaacggcagccg

SEQ ID NO: 3433057 - RNA, 21 nt, Pseudomonas aeruginosa PA01
aggacgucguagccaggcacc

SEQ ID NO: 3433058 - RNA, 14 nt, Pseudomonas aeruginosa PA01
aggacgugcaccau

SEQ ID NO: 3433059 - RNA, 19 nt, Pseudomonas aeruginosa PA01
aggacugccaacuggcguc

SEQ ID NO: 3433060 - RNA, 23 nt, Pseudomonas aeruginosa PA01
aggagaucggcguuuacgcgcca

SEQ ID NO: 3433061 - RNA, 21 nt, Pseudomonas aeruginosa PA01
aggagaugcagcgucgcgcgu

SEQ ID NO: 3433062 - RNA, 11 nt, Pseudomonas aeruginosa PA01
aggagcagggc

SEQ ID NO: 3433063 - RNA, 19 nt, Pseudomonas aeruginosa PA01
aggagcaugaaggucgaca

SEQ ID NO: 3433064 - RNA, 20 nt, Pseudomonas aeruginosa PA01
aggagcaugucuucgucgcg

SEQ ID NO: 3433065 - RNA, 19 nt, Pseudomonas aeruginosa PA01
aggagccaucgcuccagcg

SEQ ID NO: 3433066 - RNA, 21 nt, Pseudomonas aeruginosa PA01
aggagccaucgcuccagcgaa

SEQ ID NO: 3433067 - RNA, 12 nt, Pseudomonas aeruginosa PA01
aggagccggcca

SEQ ID NO: 3433068 - RNA, 16 nt, Pseudomonas aeruginosa PA01
aggagccgucgccggc

SEQ ID NO: 3433069 - RNA, 21 nt, Pseudomonas aeruginosa PA01
aggagccuuucacuuucaggu

SEQ ID NO: 3433070 - RNA, 17 nt, Pseudomonas aeruginosa PA01
aggagcgccagcaccag

SEQ ID NO: 3433071 - RNA, 19 nt, Pseudomonas aeruginosa PA01
aggagcgccaucagcgacc

SEQ ID NO: 3433072 - RNA, 12 nt, Pseudomonas aeruginosa PA01
aggagcgccgcg

SEQ ID NO: 3433073 - RNA, 23 nt, Pseudomonas aeruginosa PA01
aggagcgccgcgcagcgcggcgc

SEQ ID NO: 3433074 - RNA, 12 nt, Pseudomonas aeruginosa PA01
aggagcgcgagc

SEQ ID NO: 3433075 - RNA, 16 nt, Pseudomonas aeruginosa PA01
aggaggaaauacagca

SEQ ID NO: 3433076 - RNA, 19 nt, Pseudomonas aeruginosa PA01
aggaggaaauacagcaccc

SEQ ID NO: 3433077 - RNA, 20 nt, Pseudomonas aeruginosa PA01
aggaggaaauacagcacccg

SEQ ID NO: 3433078 - RNA, 21 nt, Pseudomonas aeruginosa PA01
aggaggaaauacagcacccgg

SEQ ID NO: 3433079 - RNA, 18 nt, Pseudomonas aeruginosa PA01
aggaggacgauggaacgc

SEQ ID NO: 3433080 - RNA, 13 nt, Pseudomonas aeruginosa PA01
aggaggaucgcca

SEQ ID NO: 3433081 - RNA, 20 nt, Pseudomonas aeruginosa PA01
aggaggaucucgcgccccgg

SEQ ID NO: 3433082 - RNA, 19 nt, Pseudomonas aeruginosa PA01
aggaggauucgccagccuc

SEQ ID NO: 3433083 - RNA, 19 nt, Pseudomonas aeruginosa PA01
aggaggcccacgggcggcc

SEQ ID NO: 3433084 - RNA, 15 nt, Pseudomonas aeruginosa PA01
aggagggaaugacua

SEQ ID NO: 3433085 - RNA, 22 nt, Pseudomonas aeruginosa PA01
aggagggcugcuguccagcgcu

SEQ ID NO: 3433086 - RNA, 16 nt, Pseudomonas aeruginosa PA01
aggagguuggucugcu

SEQ ID NO: 3433087 - RNA, 17 nt, Pseudomonas aeruginosa PA01
aggagguuggucugcuc

SEQ ID NO: 3433088 - RNA, 20 nt, Pseudomonas aeruginosa PA01
aggagugugggacaggaaga

SEQ ID NO: 3433089 - RNA, 17 nt, Pseudomonas aeruginosa PA01
aggauaccgcacggccg

SEQ ID NO: 3433090 - RNA, 18 nt, Pseudomonas aeruginosa PA01
aggauacgcucaggaaga

SEQ ID NO: 3433091 - RNA, 17 nt, Pseudomonas aeruginosa PA01
aggauagaugcguccgu

SEQ ID NO: 3433092 - RNA, 12 nt, Pseudomonas aeruginosa PA01
aggauagccggc

SEQ ID NO: 3433093 - RNA, 13 nt, Pseudomonas aeruginosa PA01
aggauagccggcg

SEQ ID NO: 3433094 - RNA, 16 nt, Pseudomonas aeruginosa PA01
aggauagcguccagcu

SEQ ID NO: 3433095 - RNA, 17 nt, Pseudomonas aeruginosa PA01
aggauaucgcccagggc

SEQ ID NO: 3433096 - RNA, 12 nt, Pseudomonas aeruginosa PA01
aggaucacgcag

SEQ ID NO: 3433097 - RNA, 20 nt, Pseudomonas aeruginosa PA01
aggaucacgcagcaggcgac

SEQ ID NO: 3433098 - RNA, 22 nt, Pseudomonas aeruginosa PA01
aggaucacgcagcaggcgacgg

SEQ ID NO: 3433099 - RNA, 15 nt, Pseudomonas aeruginosa PA01
aggaucaggcucgag

SEQ ID NO: 3433100 - RNA, 23 nt, Pseudomonas aeruginosa PA01
aggaucagguugaagagcagcac

SEQ ID NO: 3433101 - RNA, 16 nt, Pseudomonas aeruginosa PA01
aggaucgaacuggcca

SEQ ID NO: 3433102 - RNA, 16 nt, Pseudomonas aeruginosa PA01
aggaucgacagcagcg

SEQ ID NO: 3433103 - RNA, 20 nt, Pseudomonas aeruginosa PA01
aggaucgacagcagcgccag

SEQ ID NO: 3433104 - RNA, 14 nt, Pseudomonas aeruginosa PA01
aggaucgagcccug

SEQ ID NO: 3433105 - RNA, 18 nt, Pseudomonas aeruginosa PA01
aggaucgagcccuggucg

SEQ ID NO: 3433106 - RNA, 16 nt, Pseudomonas aeruginosa PA01
aggaucgccaggacgc

SEQ ID NO: 3433107 - RNA, 19 nt, Pseudomonas aeruginosa PA01
aggaucgccgcgaccugcu

SEQ ID NO: 3433108 - RNA, 19 nt, Pseudomonas aeruginosa PA01
aggaucgccuccaccagcg

SEQ ID NO: 3433109 - RNA, 24 nt, Pseudomonas aeruginosa PA01
aggaucgccuccaccagcgccggc

SEQ ID NO: 3433110 - RNA, 16 nt, Pseudomonas aeruginosa PA01
aggaucgcucccaggc

SEQ ID NO: 3433111 - RNA, 18 nt, Pseudomonas aeruginosa PA01
aggaucgcucccaggcuc

SEQ ID NO: 3433112 - RNA, 21 nt, Pseudomonas aeruginosa PA01
aggaucggagagacccgccag

SEQ ID NO: 3433113 - RNA, 13 nt, Pseudomonas aeruginosa PA01
aggaucggcgccc

SEQ ID NO: 3433114 - RNA, 18 nt, Pseudomonas aeruginosa PA01
aggaucggcgcccagcac

SEQ ID NO: 3433115 - RNA, 15 nt, Pseudomonas aeruginosa PA01
aggaucggcgcgguc

SEQ ID NO: 3433116 - RNA, 18 nt, Pseudomonas aeruginosa PA01
aggaucggcgcggucggg

SEQ ID NO: 3433117 - RNA, 14 nt, Pseudomonas aeruginosa PA01
aggaucgucggccc

SEQ ID NO: 3433118 - RNA, 15 nt, Pseudomonas aeruginosa PA01
aggaucgucggcccg

SEQ ID NO: 3433119 - RNA, 19 nt, Pseudomonas aeruginosa PA01
aggaucuccaacuggcggc

SEQ ID NO: 3433120 - RNA, 16 nt, Pseudomonas aeruginosa PA01
aggaucucgcgccccg

SEQ ID NO: 3433121 - RNA, 14 nt, Pseudomonas aeruginosa PA01
aggccgccacggcg

SEQ ID NO: 3433122 - RNA, 15 nt, Pseudomonas aeruginosa PA01
aggccgccacggcgg

SEQ ID NO: 3433123 - RNA, 15 nt, Pseudomonas aeruginosa PA01
aggccgccaggccuc

SEQ ID NO: 3433124 - RNA, 20 nt, Pseudomonas aeruginosa PA01
aggccgccaggccucggcgc

SEQ ID NO: 3433125 - RNA, 17 nt, Pseudomonas aeruginosa PA01
aggccgccaugcucggc

SEQ ID NO: 3433126 - RNA, 21 nt, Pseudomonas aeruginosa PA01
aggccgccaugcucggccagc

SEQ ID NO: 3433127 - RNA, 13 nt, Pseudomonas aeruginosa PA01
aggccgcccagcg

SEQ ID NO: 3433128 - RNA, 16 nt, Pseudomonas aeruginosa PA01
aggccgcccuggccga

SEQ ID NO: 3433129 - RNA, 10 nt, Pseudomonas aeruginosa PA01
aggccgccga

SEQ ID NO: 3433130 - RNA, 11 nt, Pseudomonas aeruginosa PA01
aggccgccgaa

SEQ ID NO: 3433131 - RNA, 11 nt, Pseudomonas aeruginosa PA01
aggccgccgag

SEQ ID NO: 3433132 - RNA, 21 nt, Pseudomonas aeruginosa PA01
aggccgccgaucccgacgccc

SEQ ID NO: 3433133 - RNA, 13 nt, Pseudomonas aeruginosa PA01
aggccgccgccug

SEQ ID NO: 3433134 - RNA, 18 nt, Pseudomonas aeruginosa PA01
aggccgccgccugcucgc

SEQ ID NO: 3433135 - RNA, 15 nt, Pseudomonas aeruginosa PA01
aggccgccgcgggca

SEQ ID NO: 3433136 - RNA, 20 nt, Pseudomonas aeruginosa PA01
aggccgccgcgggcaaccgc

SEQ ID NO: 3433137 - RNA, 22 nt, Pseudomonas aeruginosa PA01
aggccgccgcgugccgccggac

SEQ ID NO: 3433138 - RNA, 15 nt, Pseudomonas aeruginosa PA01
aggccgccggcgacc

SEQ ID NO: 3433139 - RNA, 19 nt, Pseudomonas aeruginosa PA01
aggccgccggcggccaggg

SEQ ID NO: 3433140 - RNA, 11 nt, Pseudomonas aeruginosa PA01
aggccgcgcag

SEQ ID NO: 3433141 - RNA, 18 nt, Pseudomonas aeruginosa PA01
aggccgcgcagcaacggc

SEQ ID NO: 3433142 - RNA, 19 nt, Pseudomonas aeruginosa PA01
aggccgcgcagcaacggcg

SEQ ID NO: 3433143 - RNA, 17 nt, Pseudomonas aeruginosa PA01
aggccgcgcagucccgc

SEQ ID NO: 3433144 - RNA, 13 nt, Pseudomonas aeruginosa PA01
aggccgcgccgga

SEQ ID NO: 3433145 - RNA, 14 nt, Pseudomonas aeruginosa PA01
aggccgcgccggau

SEQ ID NO: 3433146 - RNA, 15 nt, Pseudomonas aeruginosa PA01
aggccgcgccggauc

SEQ ID NO: 3433147 - RNA, 15 nt, Pseudomonas aeruginosa PA01
aggccgcgcgauggc

SEQ ID NO: 3433148 - RNA, 17 nt, Pseudomonas aeruginosa PA01
aggccgcggagcaccgc

SEQ ID NO: 3433149 - RNA, 18 nt, Pseudomonas aeruginosa PA01
aggccgcggagcaccgcg

SEQ ID NO: 3433150 - RNA, 22 nt, Pseudomonas aeruginosa PA01
aggccgcggagcaccgcgccuu

SEQ ID NO: 3433151 - RNA, 23 nt, Pseudomonas aeruginosa PA01
aggccgcucuucugguaggccag

SEQ ID NO: 3433152 - RNA, 22 nt, Pseudomonas aeruginosa PA01
aggccgcugccugucgcagcgg

SEQ ID NO: 3433153 - RNA, 16 nt, Pseudomonas aeruginosa PA01
aggccgcuggcggcga

SEQ ID NO: 3433154 - RNA, 17 nt, Pseudomonas aeruginosa PA01
aggccgcuggcggcgac

SEQ ID NO: 3433155 - RNA, 14 nt, Pseudomonas aeruginosa PA01
aggccgcuuccggc

SEQ ID NO: 3433156 - RNA, 17 nt, Pseudomonas aeruginosa PA01
aggccgcuucgccgccc

SEQ ID NO: 3433157 - RNA, 21 nt, Pseudomonas aeruginosa PA01
aggccgcuucgccgcccucgc

SEQ ID NO: 3433158 - RNA, 18 nt, Pseudomonas aeruginosa PA01
aggccgcuuggccauggc

SEQ ID NO: 3433159 - RNA, 19 nt, Pseudomonas aeruginosa PA01
aggccgcuuggccauggcg

SEQ ID NO: 3433160 - RNA, 17 nt, Pseudomonas aeruginosa PA01
aggccggagccgcguuc

SEQ ID NO: 3433161 - RNA, 19 nt, Pseudomonas aeruginosa PA01
aggccggagccgcguucag

SEQ ID NO: 3433162 - RNA, 17 nt, Pseudomonas aeruginosa PA01
aggccggccuccagcgc

SEQ ID NO: 3433163 - RNA, 15 nt, Pseudomonas aeruginosa PA01
aggccggcgagccag

SEQ ID NO: 3433164 - RNA, 13 nt, Pseudomonas aeruginosa PA01
aggccggcgaggg

SEQ ID NO: 3433165 - RNA, 12 nt, Pseudomonas aeruginosa PA01
aggccggcgccg

SEQ ID NO: 3433166 - RNA, 17 nt, Pseudomonas aeruginosa PA01
aggccggcgccgccgaa

SEQ ID NO: 3433167 - RNA, 20 nt, Pseudomonas aeruginosa PA01
aggccggcgcgauccuggcg

SEQ ID NO: 3433168 - RNA, 17 nt, Pseudomonas aeruginosa PA01
aggccggcggccgaggc

SEQ ID NO: 3433169 - RNA, 13 nt, Pseudomonas aeruginosa PA01
aggccggcgucga

SEQ ID NO: 3433170 - RNA, 19 nt, Pseudomonas aeruginosa PA01
aggccggcuaaccgcgaag

SEQ ID NO: 3433171 - RNA, 23 nt, Pseudomonas aeruginosa PA01
aggccgggaauggagaugccgaa

SEQ ID NO: 3433172 - RNA, 16 nt, Pseudomonas aeruginosa PA01
aggccgggcaccccga

SEQ ID NO: 3433173 - RNA, 15 nt, Pseudomonas aeruginosa PA01
aggccgggcaggccg

SEQ ID NO: 3433174 - RNA, 18 nt, Pseudomonas aeruginosa PA01
aggccgggcccugggccc

SEQ ID NO: 3433175 - RNA, 13 nt, Pseudomonas aeruginosa PA01
aggccgggcuggc

SEQ ID NO: 3433176 - RNA, 15 nt, Pseudomonas aeruginosa PA01
aggccgggcuggcca

SEQ ID NO: 3433177 - RNA, 20 nt, Pseudomonas aeruginosa PA01
aggccggugaucucgcggcg

SEQ ID NO: 3433178 - RNA, 18 nt, Pseudomonas aeruginosa PA01
aggccggugccgccggcc

SEQ ID NO: 3433179 - RNA, 21 nt, Pseudomonas aeruginosa PA01
aggccggugccgccggccacc

SEQ ID NO: 3433180 - RNA, 19 nt, Pseudomonas aeruginosa PA01
aggccguaccagucgcccg

SEQ ID NO: 3433181 - RNA, 16 nt, Pseudomonas aeruginosa PA01
aggccguagaccacca

SEQ ID NO: 3433182 - RNA, 17 nt, Pseudomonas aeruginosa PA01
aggccguagaccaccag

SEQ ID NO: 3433183 - RNA, 20 nt, Pseudomonas aeruginosa PA01
aggccguagaccaccagcag

SEQ ID NO: 3433184 - RNA, 14 nt, Pseudomonas aeruginosa PA01
aggccguagcgcuc

SEQ ID NO: 3433185 - RNA, 16 nt, Pseudomonas aeruginosa PA01
aggccguagcgcucga

SEQ ID NO: 3433186 - RNA, 17 nt, Pseudomonas aeruginosa PA01
aggccguaggcgauggc

SEQ ID NO: 3433187 - RNA, 24 nt, Pseudomonas aeruginosa PA01
aggccguaggcgauggccuggucg

SEQ ID NO: 3433188 - RNA, 20 nt, Pseudomonas aeruginosa PA01
aggccguccaguucuuccac

SEQ ID NO: 3433189 - RNA, 13 nt, Pseudomonas aeruginosa PA01
aggccgucgaggg

SEQ ID NO: 3433190 - RNA, 19 nt, Pseudomonas aeruginosa PA01
aggccgugggccggcgcgc

SEQ ID NO: 3433191 - RNA, 22 nt, Pseudomonas aeruginosa PA01
aggccuacccgcgcuucuucga

SEQ ID NO: 3433192 - RNA, 12 nt, Pseudomonas aeruginosa PA01
aggccuccagca

SEQ ID NO: 3433193 - RNA, 13 nt, Pseudomonas aeruginosa PA01
aggccuccagcaa

SEQ ID NO: 3433194 - RNA, 14 nt, Pseudomonas aeruginosa PA01
aggccuccagcaac

SEQ ID NO: 3433195 - RNA, 19 nt, Pseudomonas aeruginosa PA01
aggccuccagcaacgccgc

SEQ ID NO: 3433196 - RNA, 12 nt, Pseudomonas aeruginosa PA01
aggccuccucgu

SEQ ID NO: 3433197 - RNA, 23 nt, Pseudomonas aeruginosa PA01
aggccuccucguaggcguccugg

SEQ ID NO: 3433198 - RNA, 18 nt, Pseudomonas aeruginosa PA01
aggccucgagguucucga

SEQ ID NO: 3433199 - RNA, 17 nt, Pseudomonas aeruginosa PA01
aggccucgaugaucgcc

SEQ ID NO: 3433200 - RNA, 18 nt, Pseudomonas aeruginosa PA01
aggccucggcauccucgc

SEQ ID NO: 3433201 - RNA, 18 nt, Pseudomonas aeruginosa PA01
aggccucggcgcgggccu

SEQ ID NO: 3433202 - RNA, 16 nt, Pseudomonas aeruginosa PA01
aggccucggucaggcg

SEQ ID NO: 3433203 - RNA, 17 nt, Pseudomonas aeruginosa PA01
aggccucggucaggcgc

SEQ ID NO: 3433204 - RNA, 19 nt, Pseudomonas aeruginosa PA01
aggccucggucaggcgcug

SEQ ID NO: 3433205 - RNA, 23 nt, Pseudomonas aeruginosa PA01
aggccucggucaggcgcugguga

SEQ ID NO: 3433206 - RNA, 14 nt, Pseudomonas aeruginosa PA01
aggccucgguggcc

SEQ ID NO: 3433207 - RNA, 13 nt, Pseudomonas aeruginosa PA01
aggccucgucguu

SEQ ID NO: 3433208 - RNA, 17 nt, Pseudomonas aeruginosa PA01
aggccucgucguucagc

SEQ ID NO: 3433209 - RNA, 21 nt, Pseudomonas aeruginosa PA01
aggccucgucguucagcccac

SEQ ID NO: 3433210 - RNA, 16 nt, Pseudomonas aeruginosa PA01
aggccuggaacaccag

SEQ ID NO: 3433211 - RNA, 17 nt, Pseudomonas aeruginosa PA01
aggccuggaacaccagg

SEQ ID NO: 3433212 - RNA, 21 nt, Pseudomonas aeruginosa PA01
aggccuggaacaccaggccgc

SEQ ID NO: 3433213 - RNA, 16 nt, Pseudomonas aeruginosa PA01
aggccuggagcgccuc

SEQ ID NO: 3433214 - RNA, 12 nt, Pseudomonas aeruginosa PA01
aggccuggaugu

SEQ ID NO: 3433215 - RNA, 20 nt, Pseudomonas aeruginosa PA01
aggccuggaugucgaagcgc

SEQ ID NO: 3433216 - RNA, 21 nt, Pseudomonas aeruginosa PA01
aggccuggcccuggcgcaggc

SEQ ID NO: 3433217 - RNA, 22 nt, Pseudomonas aeruginosa PA01
aggccuggcccuggcgcaggcg

SEQ ID NO: 3433218 - RNA, 13 nt, Pseudomonas aeruginosa PA01
aggccuggccgcc

SEQ ID NO: 3433219 - RNA, 16 nt, Pseudomonas aeruginosa PA01
aggccuggccguugcg

SEQ ID NO: 3433220 - RNA, 19 nt, Pseudomonas aeruginosa PA01
aggccuggcgcaacaggcg

SEQ ID NO: 3433221 - RNA, 16 nt, Pseudomonas aeruginosa PA01
aggccugggucaccag

SEQ ID NO: 3433222 - RNA, 15 nt, Pseudomonas aeruginosa PA01
aggccuuccacgccu

SEQ ID NO: 3433223 - RNA, 17 nt, Pseudomonas aeruginosa PA01
aggccuuccagaacgcc

SEQ ID NO: 3433224 - RNA, 15 nt, Pseudomonas aeruginosa PA01
aggcgccggcgcgcg

SEQ ID NO: 3433225 - RNA, 16 nt, Pseudomonas aeruginosa PA01
aggcgccgggucgaug

SEQ ID NO: 3433226 - RNA, 21 nt, Pseudomonas aeruginosa PA01
aggcgccgggucgaugggccg

SEQ ID NO: 3433227 - RNA, 19 nt, Pseudomonas aeruginosa PA01
aggcgccugagcagcgcuu

SEQ ID NO: 3433228 - RNA, 21 nt, Pseudomonas aeruginosa PA01
aggcgcgcaacgcuuccagca

SEQ ID NO: 3433229 - RNA, 15 nt, Pseudomonas aeruginosa PA01
aggcgcgcagggccg

SEQ ID NO: 3433230 - RNA, 18 nt, Pseudomonas aeruginosa PA01
aggcgcgccaaggccgcc

SEQ ID NO: 3433231 - RNA, 13 nt, Pseudomonas aeruginosa PA01
aggcgcgccgaca

SEQ ID NO: 3433232 - RNA, 13 nt, Pseudomonas aeruginosa PA01
aggcgcgccgguu

SEQ ID NO: 3433233 - RNA, 16 nt, Pseudomonas aeruginosa PA01
aggcgcgccgugcggc

SEQ ID NO: 3433234 - RNA, 23 nt, Pseudomonas aeruginosa PA01
aggcgcgccuggaucagcgccuc

SEQ ID NO: 3433235 - RNA, 19 nt, Pseudomonas aeruginosa PA01
aggcgcgccuggcccuggc

SEQ ID NO: 3433236 - RNA, 12 nt, Pseudomonas aeruginosa PA01
aggcgcgcgccg

SEQ ID NO: 3433237 - RNA, 13 nt, Pseudomonas aeruginosa PA01
aggcgcgcgccga

SEQ ID NO: 3433238 - RNA, 21 nt, Pseudomonas aeruginosa PA01
aggcgcgcgccgaacucgaac

SEQ ID NO: 3433239 - RNA, 13 nt, Pseudomonas aeruginosa PA01
aggcgcgcggcca

SEQ ID NO: 3433240 - RNA, 18 nt, Pseudomonas aeruginosa PA01
aggcgcgcggccagcgcg

SEQ ID NO: 3433241 - RNA, 22 nt, Pseudomonas aeruginosa PA01
aggcgcgcggccagcgcggccg

SEQ ID NO: 3433242 - RNA, 22 nt, Pseudomonas aeruginosa PA01
aggcgcgcggucuucaucaccu

SEQ ID NO: 3433243 - RNA, 17 nt, Pseudomonas aeruginosa PA01
aggcgcgcucagcgcuu

SEQ ID NO: 3433244 - RNA, 12 nt, Pseudomonas aeruginosa PA01
aggcgcgcucga

SEQ ID NO: 3433245 - RNA, 19 nt, Pseudomonas aeruginosa PA01
aggcgcgcuggaugcccuc

SEQ ID NO: 3433246 - RNA, 15 nt, Pseudomonas aeruginosa PA01
aggcgcgggcggcgg

SEQ ID NO: 3433247 - RNA, 13 nt, Pseudomonas aeruginosa PA01
aggcgcgggcugg

SEQ ID NO: 3433248 - RNA, 16 nt, Pseudomonas aeruginosa PA01
aggcgcggggcgaggu

SEQ ID NO: 3433249 - RNA, 23 nt, Pseudomonas aeruginosa PA01
aggcgcgggucuucaggccgcag

SEQ ID NO: 3433250 - RNA, 22 nt, Pseudomonas aeruginosa PA01
aggcgcggguggcgucgaucag

SEQ ID NO: 3433251 - RNA, 13 nt, Pseudomonas aeruginosa PA01
aggcgcgucgcgg

SEQ ID NO: 3433252 - RNA, 18 nt, Pseudomonas aeruginosa PA01
aggcgcgucgcggccucu

SEQ ID NO: 3433253 - RNA, 21 nt, Pseudomonas aeruginosa PA01
aggcgcguugcuuccaggcac

SEQ ID NO: 3433254 - RNA, 19 nt, Pseudomonas aeruginosa PA01
aggcgcucaacgccucgcg

SEQ ID NO: 3433255 - RNA, 20 nt, Pseudomonas aeruginosa PA01
aggcgcuccaccagggccuc

SEQ ID NO: 3433256 - RNA, 17 nt, Pseudomonas aeruginosa PA01
aggcgcuccaccgcccc

SEQ ID NO: 3433257 - RNA, 12 nt, Pseudomonas aeruginosa PA01
aggcgcuccaga

SEQ ID NO: 3433258 - RNA, 15 nt, Pseudomonas aeruginosa PA01
aggcgcuccagacuc

SEQ ID NO: 3433259 - RNA, 16 nt, Pseudomonas aeruginosa PA01
aggcgcuccagggcau

SEQ ID NO: 3433260 - RNA, 20 nt, Pseudomonas aeruginosa PA01
aggcgcuccccugcuaaggg

SEQ ID NO: 3433261 - RNA, 14 nt, Pseudomonas aeruginosa PA01
aggcgcuccgggcu

SEQ ID NO: 3433262 - RNA, 15 nt, Pseudomonas aeruginosa PA01
aggcgcuccgggcuc

SEQ ID NO: 3433263 - RNA, 16 nt, Pseudomonas aeruginosa PA01
aggcgcuccuccagcg

SEQ ID NO: 3433264 - RNA, 20 nt, Pseudomonas aeruginosa PA01
aggcgcuccuccagcgccgc

SEQ ID NO: 3433265 - RNA, 22 nt, Pseudomonas aeruginosa PA01
aggcgcuccuccagcgccgcca

SEQ ID NO: 3433266 - RNA, 23 nt, Pseudomonas aeruginosa PA01
aggcgcuccuccagcgccgccag

SEQ ID NO: 3433267 - RNA, 19 nt, Pseudomonas aeruginosa PA01
aggcgcuccuugagcagcu

SEQ ID NO: 3433268 - RNA, 22 nt, Pseudomonas aeruginosa PA01
aggcgcuccuugagcagcucga

SEQ ID NO: 3433269 - RNA, 22 nt, Pseudomonas aeruginosa PA01
aggcgcucgacgaucaggugca

SEQ ID NO: 3433270 - RNA, 13 nt, Pseudomonas aeruginosa PA01
aggcgcucggcga

SEQ ID NO: 3433271 - RNA, 23 nt, Pseudomonas aeruginosa PA01
aggcgcucggcgaccuugcgcac

SEQ ID NO: 3433272 - RNA, 13 nt, Pseudomonas aeruginosa PA01
aggcgcucggcgg

SEQ ID NO: 3433273 - RNA, 14 nt, Pseudomonas aeruginosa PA01
aggcgcucggcggc

SEQ ID NO: 3433274 - RNA, 15 nt, Pseudomonas aeruginosa PA01
aggcgcucggcggcg

SEQ ID NO: 3433275 - RNA, 16 nt, Pseudomonas aeruginosa PA01
aggcgcucggcggcgc

SEQ ID NO: 3433276 - RNA, 18 nt, Pseudomonas aeruginosa PA01
aggcgcucggcggcgcgc

SEQ ID NO: 3433277 - RNA, 21 nt, Pseudomonas aeruginosa PA01
aggcgcucguagagcuugcug

SEQ ID NO: 3433278 - RNA, 13 nt, Pseudomonas aeruginosa PA01
aggcgcucuggaa

SEQ ID NO: 3433279 - RNA, 17 nt, Pseudomonas aeruginosa PA01
aggcgcugaagcggccg

SEQ ID NO: 3433280 - RNA, 18 nt, Pseudomonas aeruginosa PA01
aggcgcugcaaucgcugc

SEQ ID NO: 3433281 - RNA, 17 nt, Pseudomonas aeruginosa PA01
aggcgcugcagccacug

SEQ ID NO: 3433282 - RNA, 14 nt, Pseudomonas aeruginosa PA01
aggcgcugccguag

SEQ ID NO: 3433283 - RNA, 22 nt, Pseudomonas aeruginosa PA01
aggcgcugcgcggccugcgccg

SEQ ID NO: 3433284 - RNA, 22 nt, Pseudomonas aeruginosa PA01
aggcgcugcgguaccagcgcac

SEQ ID NO: 3433285 - RNA, 23 nt, Pseudomonas aeruginosa PA01
aggcgcugcgguaccagcgcacc

SEQ ID NO: 3433286 - RNA, 12 nt, Pseudomonas aeruginosa PA01
aggcgcuggcca

SEQ ID NO: 3433287 - RNA, 15 nt, Pseudomonas aeruginosa PA01
aggcgcuggccagcg

SEQ ID NO: 3433288 - RNA, 17 nt, Pseudomonas aeruginosa PA01
aggcgcuggccagcgcu

SEQ ID NO: 3433289 - RNA, 19 nt, Pseudomonas aeruginosa PA01
aggcgcuggccagcgcuuc

SEQ ID NO: 3433290 - RNA, 22 nt, Pseudomonas aeruginosa PA01
aggcgcuggcgcuguaggcgag

SEQ ID NO: 3433291 - RNA, 15 nt, Pseudomonas aeruginosa PA01
aggcgcuggcgggcg

SEQ ID NO: 3433292 - RNA, 17 nt, Pseudomonas aeruginosa PA01
aggcgcugggcggcugg

SEQ ID NO: 3433293 - RNA, 20 nt, Pseudomonas aeruginosa PA01
aggcgcugguccagcacgcu

SEQ ID NO: 3433294 - RNA, 18 nt, Pseudomonas aeruginosa PA01
aggcgcuguccuguggcg

SEQ ID NO: 3433295 - RNA, 22 nt, Pseudomonas aeruginosa PA01
aggcgcuucagcucgaggccag

SEQ ID NO: 3433296 - RNA, 19 nt, Pseudomonas aeruginosa PA01
aggcgcuucugcucggccu

SEQ ID NO: 3433297 - RNA, 18 nt, Pseudomonas aeruginosa PA01
aggcggacacgcaggcgc

SEQ ID NO: 3433298 - RNA, 20 nt, Pseudomonas aeruginosa PA01
aggcggagaagccgcugacc

SEQ ID NO: 3433299 - RNA, 14 nt, Pseudomonas aeruginosa PA01
aggcggagcauggu

SEQ ID NO: 3433300 - RNA, 20 nt, Pseudomonas aeruginosa PA01
aggcggagcauggugucgcu

SEQ ID NO: 3433301 - RNA, 15 nt, Pseudomonas aeruginosa PA01
aggcggaguagccgg

SEQ ID NO: 3433302 - RNA, 16 nt, Pseudomonas aeruginosa PA01
aggcggaucgcccggc

SEQ ID NO: 3433303 - RNA, 17 nt, Pseudomonas aeruginosa PA01
aggcggaucgccgccuu

SEQ ID NO: 3433304 - RNA, 18 nt, Pseudomonas aeruginosa PA01
aggcggauuuccugcggc

SEQ ID NO: 3433305 - RNA, 15 nt, Pseudomonas aeruginosa PA01
aggcggauuugccgc

SEQ ID NO: 3433306 - RNA, 12 nt, Pseudomonas aeruginosa PA01
aggcggcacucg

SEQ ID NO: 3433307 - RNA, 17 nt, Pseudomonas aeruginosa PA01
aggcggcacucggcgac

SEQ ID NO: 3433308 - RNA, 22 nt, Pseudomonas aeruginosa PA01
aggcggcacucggcgaccaccc

SEQ ID NO: 3433309 - RNA, 13 nt, Pseudomonas aeruginosa PA01
aggcggcagccgc

SEQ ID NO: 3433310 - RNA, 18 nt, Pseudomonas aeruginosa PA01
aggcggcagccgcggcug

SEQ ID NO: 3433311 - RNA, 24 nt, Pseudomonas aeruginosa PA01
aggcggccaccaccgugaccagca

SEQ ID NO: 3433312 - RNA, 14 nt, Pseudomonas aeruginosa PA01
aggcggccagccuu

SEQ ID NO: 3433313 - RNA, 17 nt, Pseudomonas aeruginosa PA01
aggcggccagccuuccu

SEQ ID NO: 3433314 - RNA, 23 nt, Pseudomonas aeruginosa PA01
aggcggcccaugcggaucgccuc

SEQ ID NO: 3433315 - RNA, 21 nt, Pseudomonas aeruginosa PA01
aggcggccgaauccuccagcc

SEQ ID NO: 3433316 - RNA, 18 nt, Pseudomonas aeruginosa PA01
aggcggccgacgauguug

SEQ ID NO: 3433317 - RNA, 13 nt, Pseudomonas aeruginosa PA01
aggcggccgcugg

SEQ ID NO: 3433318 - RNA, 18 nt, Pseudomonas aeruginosa PA01
aggcggccguagccgucg

SEQ ID NO: 3433319 - RNA, 21 nt, Pseudomonas aeruginosa PA01
aggcggcgaggugaucgaggg

SEQ ID NO: 3433320 - RNA, 15 nt, Pseudomonas aeruginosa PA01
aggcggcgcagcaac

SEQ ID NO: 3433321 - RNA, 20 nt, Pseudomonas aeruginosa PA01
aggcggcggaagaagcccuu

SEQ ID NO: 3433322 - RNA, 22 nt, Pseudomonas aeruginosa PA01
aggcggcggcguuggccgagga

SEQ ID NO: 3433323 - RNA, 22 nt, Pseudomonas aeruginosa PA01
aggcggcgguagccgaggcggc

SEQ ID NO: 3433324 - RNA, 18 nt, Pseudomonas aeruginosa PA01
aggcggcggucaucgcgc

SEQ ID NO: 3433325 - RNA, 22 nt, Pseudomonas aeruginosa PA01
aggcggcgucgucgcugcgcgg

SEQ ID NO: 3433326 - RNA, 16 nt, Pseudomonas aeruginosa PA01
aggcucggucgcgcgg

SEQ ID NO: 3433327 - RNA, 17 nt, Pseudomonas aeruginosa PA01
aggcucucgcgcagcag

SEQ ID NO: 3433328 - RNA, 18 nt, Pseudomonas aeruginosa PA01
aggcucucgcgcagcagg

SEQ ID NO: 3433329 - RNA, 13 nt, Pseudomonas aeruginosa PA01
aggcucugcucca

SEQ ID NO: 3433330 - RNA, 16 nt, Pseudomonas aeruginosa PA01
aggcucugcuccagca

SEQ ID NO: 3433331 - RNA, 17 nt, Pseudomonas aeruginosa PA01
aggcucuugggcucugc

SEQ ID NO: 3433332 - RNA, 18 nt, Pseudomonas aeruginosa PA01
aggcucuuggucgcgguc

SEQ ID NO: 3433333 - RNA, 16 nt, Pseudomonas aeruginosa PA01
aggcucuuugcgacug

SEQ ID NO: 3433334 - RNA, 23 nt, Pseudomonas aeruginosa PA01
aggcugaaaaaaggggaugccau

SEQ ID NO: 3433335 - RNA, 14 nt, Pseudomonas aeruginosa PA01
aggcugacccgguc

SEQ ID NO: 3433336 - RNA, 19 nt, Pseudomonas aeruginosa PA01
aggcugaccgcgugggccg

SEQ ID NO: 3433337 - RNA, 13 nt, Pseudomonas aeruginosa PA01
aggcugaggccga

SEQ ID NO: 3433338 - RNA, 16 nt, Pseudomonas aeruginosa PA01
aggcugaguucgucga

SEQ ID NO: 3433339 - RNA, 18 nt, Pseudomonas aeruginosa PA01
aggcugaucagcccgcug

SEQ ID NO: 3433340 - RNA, 14 nt, Pseudomonas aeruginosa PA01
aggcugaucggcgc

SEQ ID NO: 3433341 - RNA, 20 nt, Pseudomonas aeruginosa PA01
aggcugcaucggcucggcaa

SEQ ID NO: 3433342 - RNA, 22 nt, Pseudomonas aeruginosa PA01
aggcugcccagguagccggcga

SEQ ID NO: 3433343 - RNA, 22 nt, Pseudomonas aeruginosa PA01
aggcugccgagaaucugcccgg

SEQ ID NO: 3433344 - RNA, 22 nt, Pseudomonas aeruginosa PA01
aggcugccgcaguagaugccgc

SEQ ID NO: 3433345 - RNA, 13 nt, Pseudomonas aeruginosa PA01
aggcugccgccgc

SEQ ID NO: 3433346 - RNA, 17 nt, Pseudomonas aeruginosa PA01
aggcugccgccgccguc

SEQ ID NO: 3433347 - RNA, 13 nt, Pseudomonas aeruginosa PA01
aggcugccgccgu

SEQ ID NO: 3433348 - RNA, 16 nt, Pseudomonas aeruginosa PA01
aggcugccgccguaga

SEQ ID NO: 3433349 - RNA, 21 nt, Pseudomonas aeruginosa PA01
aggcugccgccuucgcgggcc

SEQ ID NO: 3433350 - RNA, 17 nt, Pseudomonas aeruginosa PA01
aggcugccggccaggua

SEQ ID NO: 3433351 - RNA, 17 nt, Pseudomonas aeruginosa PA01
aggcugccguccaggcg

SEQ ID NO: 3433352 - RNA, 14 nt, Pseudomonas aeruginosa PA01
aggcugccuucgac

SEQ ID NO: 3433353 - RNA, 19 nt, Pseudomonas aeruginosa PA01
aggcugcgcaccucggcca

SEQ ID NO: 3433354 - RNA, 22 nt, Pseudomonas aeruginosa PA01
aggcugcgcaccucggccaggc

SEQ ID NO: 3433355 - RNA, 23 nt, Pseudomonas aeruginosa PA01
aggcugcgcaccucggccaggcg

SEQ ID NO: 3433356 - RNA, 22 nt, Pseudomonas aeruginosa PA01
aggcugcggcggaaggcggcgu

SEQ ID NO: 3433357 - RNA, 13 nt, Pseudomonas aeruginosa PA01
aggcugcgggcga

SEQ ID NO: 3433358 - RNA, 17 nt, Pseudomonas aeruginosa PA01
aggcugcugucgagggu

SEQ ID NO: 3433359 - RNA, 22 nt, Pseudomonas aeruginosa PA01
aggcugcugucgagggucugcu

SEQ ID NO: 3433360 - RNA, 19 nt, Pseudomonas aeruginosa PA01
aggcugcuucggcagccuu

SEQ ID NO: 3433361 - RNA, 22 nt, Pseudomonas aeruginosa PA01
aggcuggaagccgcgcucgcgg

SEQ ID NO: 3433362 - RNA, 15 nt, Pseudomonas aeruginosa PA01
aggcuggagcgcugc

SEQ ID NO: 3433363 - RNA, 18 nt, Pseudomonas aeruginosa PA01
aggcuggagcgcugcgga

SEQ ID NO: 3433364 - RNA, 16 nt, Pseudomonas aeruginosa PA01
aggcuggccacgaaca

SEQ ID NO: 3433365 - RNA, 13 nt, Pseudomonas aeruginosa PA01
aggcuggccagca

SEQ ID NO: 3433366 - RNA, 12 nt, Pseudomonas aeruginosa PA01
aggcuggccgag

SEQ ID NO: 3433367 - RNA, 21 nt, Pseudomonas aeruginosa PA01
aggcuggccgagcgccgccug

SEQ ID NO: 3433368 - RNA, 19 nt, Pseudomonas aeruginosa PA01
aggcuggccuuggccaugc

SEQ ID NO: 3433369 - RNA, 19 nt, Pseudomonas aeruginosa PA01
aggcuggcggcaucggcgc

SEQ ID NO: 3433370 - RNA, 21 nt, Pseudomonas aeruginosa PA01
aggcuggcggcaucggcgccg

SEQ ID NO: 3433371 - RNA, 19 nt, Pseudomonas aeruginosa PA01
aggcuggcggccagggcau

SEQ ID NO: 3433372 - RNA, 21 nt, Pseudomonas aeruginosa PA01
aggcuggcgucgacgccgaag

SEQ ID NO: 3433373 - RNA, 19 nt, Pseudomonas aeruginosa PA01
aggcuguacagcaggagcg

SEQ ID NO: 3433374 - RNA, 19 nt, Pseudomonas aeruginosa PA01
aggcuguagccucccgccg

SEQ ID NO: 3433375 - RNA, 21 nt, Pseudomonas aeruginosa PA01
aggcuguagccucccgccgcg

SEQ ID NO: 3433376 - RNA, 14 nt, Pseudomonas aeruginosa PA01
aggcuguagcgcuc

SEQ ID NO: 3433377 - RNA, 12 nt, Pseudomonas aeruginosa PA01
aggcugucaggg

SEQ ID NO: 3433378 - RNA, 15 nt, Pseudomonas aeruginosa PA01
aggcugucagggcgc

SEQ ID NO: 3433379 - RNA, 18 nt, Pseudomonas aeruginosa PA01
aggcuguccacgccgaag

SEQ ID NO: 3433380 - RNA, 22 nt, Pseudomonas aeruginosa PA01
aggcugucgcggacccgcgccg

SEQ ID NO: 3433381 - RNA, 15 nt, Pseudomonas aeruginosa PA01
aggcugucggccagc

SEQ ID NO: 3433382 - RNA, 14 nt, Pseudomonas aeruginosa PA01
aggcugucggccau

SEQ ID NO: 3433383 - RNA, 14 nt, Pseudomonas aeruginosa PA01
aggcugucgucgag

SEQ ID NO: 3433384 - RNA, 22 nt, Pseudomonas aeruginosa PA01
aggcugucgucgaggguggcgc

SEQ ID NO: 3433385 - RNA, 19 nt, Pseudomonas aeruginosa PA01
aggcugugcaucugcgaca

SEQ ID NO: 3433386 - RNA, 23 nt, Pseudomonas aeruginosa PA01
aggcugugccauuccugggcccc

SEQ ID NO: 3433387 - RNA, 19 nt, Pseudomonas aeruginosa PA01
aggcugugcgccaggccgg

SEQ ID NO: 3433388 - RNA, 13 nt, Pseudomonas aeruginosa PA01
aggcuguggcgcg

SEQ ID NO: 3433389 - RNA, 14 nt, Pseudomonas aeruginosa PA01
aggcugugggcgac

SEQ ID NO: 3433390 - RNA, 13 nt, Pseudomonas aeruginosa PA01
aggcugugggucg

SEQ ID NO: 3433391 - RNA, 23 nt, Pseudomonas aeruginosa PA01
aggcugugggucgggucggcgaa

SEQ ID NO: 3433392 - RNA, 19 nt, Pseudomonas aeruginosa PA01
aggcuguugcccugggccg

SEQ ID NO: 3433393 - RNA, 21 nt, Pseudomonas aeruginosa PA01
aggcuuacccgcgaccacagg

SEQ ID NO: 3433394 - RNA, 20 nt, Pseudomonas aeruginosa PA01
aggcuucgagcacuucccag

SEQ ID NO: 3433395 - RNA, 23 nt, Pseudomonas aeruginosa PA01
aggcuucgaugcuuagcccggga

SEQ ID NO: 3433396 - RNA, 14 nt, Pseudomonas aeruginosa PA01
aggcuucggcgcgc

SEQ ID NO: 3433397 - RNA, 18 nt, Pseudomonas aeruginosa PA01
aggcuucuuccuggccgg

SEQ ID NO: 3433398 - RNA, 18 nt, Pseudomonas aeruginosa PA01
aggcuugccacugcgcgc

SEQ ID NO: 3433399 - RNA, 15 nt, Pseudomonas aeruginosa PA01
aggcuuggucgggcg

SEQ ID NO: 3433400 - RNA, 16 nt, Pseudomonas aeruginosa PA01
aggcuuguccuuggcc

SEQ ID NO: 3433401 - RNA, 15 nt, Pseudomonas aeruginosa PA01
aggcuuuccagcccg

SEQ ID NO: 3433402 - RNA, 19 nt, Pseudomonas aeruginosa PA01
aggcuuucguaggcaggcg

SEQ ID NO: 3433403 - RNA, 18 nt, Pseudomonas aeruginosa PA01
aggcuuugcggcaaggcg

SEQ ID NO: 3433404 - RNA, 19 nt, Pseudomonas aeruginosa PA01
agggaaaagcccagguggc

SEQ ID NO: 3433405 - RNA, 16 nt, Pseudomonas aeruginosa PA01
agggaaacaccaggcc

SEQ ID NO: 3433406 - RNA, 21 nt, Pseudomonas aeruginosa PA01
agggaaccauccggaguucgc

SEQ ID NO: 3433407 - RNA, 16 nt, Pseudomonas aeruginosa PA01
agggaacccgcggcgc

SEQ ID NO: 3433408 - RNA, 17 nt, Pseudomonas aeruginosa PA01
agggaacgucuggccag

SEQ ID NO: 3433409 - RNA, 22 nt, Pseudomonas aeruginosa PA01
agggaagaugcacaccagcucc

SEQ ID NO: 3433410 - RNA, 17 nt, Pseudomonas aeruginosa PA01
agggaagcgcgcgccag

SEQ ID NO: 3433411 - RNA, 19 nt, Pseudomonas aeruginosa PA01
agggaaucuuuccuccaga

SEQ ID NO: 3433412 - RNA, 17 nt, Pseudomonas aeruginosa PA01
agggaauggaugcgcgg

SEQ ID NO: 3433413 - RNA, 16 nt, Pseudomonas aeruginosa PA01
agggacaugucgaggg

SEQ ID NO: 3433414 - RNA, 15 nt, Pseudomonas aeruginosa PA01
agggacgcgcagcgg

SEQ ID NO: 3433415 - RNA, 17 nt, Pseudomonas aeruginosa PA01
agggacgcgcagcggcg

SEQ ID NO: 3433416 - RNA, 20 nt, Pseudomonas aeruginosa PA01
agggacgcgcagcggcgccg

SEQ ID NO: 3433417 - RNA, 12 nt, Pseudomonas aeruginosa PA01
agggacgcgccg

SEQ ID NO: 3433418 - RNA, 16 nt, Pseudomonas aeruginosa PA01
agggacgcgccggcgg

SEQ ID NO: 3433419 - RNA, 23 nt, Pseudomonas aeruginosa PA01
agggacugaagagugggcggggu

SEQ ID NO: 3433420 - RNA, 22 nt, Pseudomonas aeruginosa PA01
agggagaacagcagggucaggg

SEQ ID NO: 3433421 - RNA, 13 nt, Pseudomonas aeruginosa PA01
agggagccaggcg

SEQ ID NO: 3433422 - RNA, 15 nt, Pseudomonas aeruginosa PA01
agggagccaggcggc

SEQ ID NO: 3433423 - RNA, 15 nt, Pseudomonas aeruginosa PA01
agggagcgacaccau

SEQ ID NO: 3433424 - RNA, 12 nt, Pseudomonas aeruginosa PA01
agggagcgccug

SEQ ID NO: 3433425 - RNA, 12 nt, Pseudomonas aeruginosa PA01
agggaggcgcac

SEQ ID NO: 3433426 - RNA, 15 nt, Pseudomonas aeruginosa PA01
agggaguccgccagc

SEQ ID NO: 3433427 - RNA, 15 nt, Pseudomonas aeruginosa PA01
agggauacucaugca

SEQ ID NO: 3433428 - RNA, 15 nt, Pseudomonas aeruginosa PA01
agggcgaaggucugc

SEQ ID NO: 3433429 - RNA, 15 nt, Pseudomonas aeruginosa PA01
agggcgaagucggcg

SEQ ID NO: 3433430 - RNA, 16 nt, Pseudomonas aeruginosa PA01
agggcgaagucggcgc

SEQ ID NO: 3433431 - RNA, 21 nt, Pseudomonas aeruginosa PA01
agggcgaagucggcgcgccag

SEQ ID NO: 3433432 - RNA, 18 nt, Pseudomonas aeruginosa PA01
agggcgaauaaccgcauc

SEQ ID NO: 3433433 - RNA, 20 nt, Pseudomonas aeruginosa PA01
agggcgaauaacgccacagg

SEQ ID NO: 3433434 - RNA, 18 nt, Pseudomonas aeruginosa PA01
agggcgaauaacgccacc

SEQ ID NO: 3433435 - RNA, 19 nt, Pseudomonas aeruginosa PA01
agggcgaauaacgccgcag

SEQ ID NO: 3433436 - RNA, 22 nt, Pseudomonas aeruginosa PA01
agggcgaauaacgccgcaggcg

SEQ ID NO: 3433437 - RNA, 17 nt, Pseudomonas aeruginosa PA01
agggcgaauagcgccgc

SEQ ID NO: 3433438 - RNA, 18 nt, Pseudomonas aeruginosa PA01
agggcgaauagcgccgca

SEQ ID NO: 3433439 - RNA, 23 nt, Pseudomonas aeruginosa PA01
agggcgaauagcgccgcaggcgc

SEQ ID NO: 3433440 - RNA, 18 nt, Pseudomonas aeruginosa PA01
agggcgaauagcgccgcg

SEQ ID NO: 3433441 - RNA, 13 nt, Pseudomonas aeruginosa PA01
agggcgaccgcca

SEQ ID NO: 3433442 - RNA, 17 nt, Pseudomonas aeruginosa PA01
agggcgaccgccaggcg

SEQ ID NO: 3433443 - RNA, 21 nt, Pseudomonas aeruginosa PA01
agggcgaccgccaggcggccg

SEQ ID NO: 3433444 - RNA, 18 nt, Pseudomonas aeruginosa PA01
agggcgacgccgaugcuc

SEQ ID NO: 3433445 - RNA, 16 nt, Pseudomonas aeruginosa PA01
agggcgacuaccaggu

SEQ ID NO: 3433446 - RNA, 18 nt, Pseudomonas aeruginosa PA01
agggcgacuaccagguuc

SEQ ID NO: 3433447 - RNA, 15 nt, Pseudomonas aeruginosa PA01
agggcgagcagggca

SEQ ID NO: 3433448 - RNA, 16 nt, Pseudomonas aeruginosa PA01
agggcgagcagggcac

SEQ ID NO: 3433449 - RNA, 18 nt, Pseudomonas aeruginosa PA01
agggcgagcagggcacag

SEQ ID NO: 3433450 - RNA, 15 nt, Pseudomonas aeruginosa PA01
agggcgagcagggcg

SEQ ID NO: 3433451 - RNA, 17 nt, Pseudomonas aeruginosa PA01
agggcgagcagggcgcu

SEQ ID NO: 3433452 - RNA, 18 nt, Pseudomonas aeruginosa PA01
agggcgagcagggcgcug

SEQ ID NO: 3433453 - RNA, 14 nt, Pseudomonas aeruginosa PA01
agggcgaggagguu

SEQ ID NO: 3433454 - RNA, 21 nt, Pseudomonas aeruginosa PA01
agggcgaggagguuggucugc

SEQ ID NO: 3433455 - RNA, 13 nt, Pseudomonas aeruginosa PA01
agggcgaggccgc

SEQ ID NO: 3433456 - RNA, 15 nt, Pseudomonas aeruginosa PA01
agggcgaggucaccu

SEQ ID NO: 3433457 - RNA, 18 nt, Pseudomonas aeruginosa PA01
agggcgaguaagcgcggu

SEQ ID NO: 3433458 - RNA, 15 nt, Pseudomonas aeruginosa PA01
agggcgaguucggcg

SEQ ID NO: 3433459 - RNA, 19 nt, Pseudomonas aeruginosa PA01
agggcgaguucggcgagca

SEQ ID NO: 3433460 - RNA, 20 nt, Pseudomonas aeruginosa PA01
agggcgaguucggcgagcag

SEQ ID NO: 3433461 - RNA, 21 nt, Pseudomonas aeruginosa PA01
agggcgaugccgauggcgccg

SEQ ID NO: 3433462 - RNA, 18 nt, Pseudomonas aeruginosa PA01
agggcgauggccagcgcg

SEQ ID NO: 3433463 - RNA, 19 nt, Pseudomonas aeruginosa PA01
agggcgauggccagcgcgu

SEQ ID NO: 3433464 - RNA, 17 nt, Pseudomonas aeruginosa PA01
agggcgaugguccccgg

SEQ ID NO: 3433465 - RNA, 18 nt, Pseudomonas aeruginosa PA01
agggcgcaauugcaccgc

SEQ ID NO: 3433466 - RNA, 20 nt, Pseudomonas aeruginosa PA01
agggcgcauaaccgcucgcg

SEQ ID NO: 3433467 - RNA, 16 nt, Pseudomonas aeruginosa PA01
agggcgccaggugcag

SEQ ID NO: 3433468 - RNA, 18 nt, Pseudomonas aeruginosa PA01
agggcgccaggugcagga

SEQ ID NO: 3433469 - RNA, 20 nt, Pseudomonas aeruginosa PA01
agggcgccaggugcaggaag

SEQ ID NO: 3433470 - RNA, 13 nt, Pseudomonas aeruginosa PA01
agggcgccgccga

SEQ ID NO: 3433471 - RNA, 20 nt, Pseudomonas aeruginosa PA01
agggcgccgccgacgccaug

SEQ ID NO: 3433472 - RNA, 12 nt, Pseudomonas aeruginosa PA01
agggcgccgucg

SEQ ID NO: 3433473 - RNA, 23 nt, Pseudomonas aeruginosa PA01
agggcgcgcacuuccucggcgac

SEQ ID NO: 3433474 - RNA, 14 nt, Pseudomonas aeruginosa PA01
agggcgcgccccgu

SEQ ID NO: 3433475 - RNA, 21 nt, Pseudomonas aeruginosa PA01
agggcgcgccccgucccuacc

SEQ ID NO: 3433476 - RNA, 14 nt, Pseudomonas aeruginosa PA01
agggcgcggcgcca

SEQ ID NO: 3433477 - RNA, 15 nt, Pseudomonas aeruginosa PA01
agggcgcggcgccag

SEQ ID NO: 3433478 - RNA, 16 nt, Pseudomonas aeruginosa PA01
agggcgcguccagcuc

SEQ ID NO: 3433479 - RNA, 12 nt, Pseudomonas aeruginosa PA01
agggcgcugccg

SEQ ID NO: 3433480 - RNA, 13 nt, Pseudomonas aeruginosa PA01
agggcgcugccga

SEQ ID NO: 3433481 - RNA, 22 nt, Pseudomonas aeruginosa PA01
agggcggauagcgcgcaggcgc

SEQ ID NO: 3433482 - RNA, 16 nt, Pseudomonas aeruginosa PA01
agggcggcgagcugga

SEQ ID NO: 3433483 - RNA, 13 nt, Pseudomonas aeruginosa PA01
agggcggcgauga

SEQ ID NO: 3433484 - RNA, 14 nt, Pseudomonas aeruginosa PA01
agggcggcgccgaa

SEQ ID NO: 3433485 - RNA, 15 nt, Pseudomonas aeruginosa PA01
agggcggcgccgaac

SEQ ID NO: 3433486 - RNA, 12 nt, Pseudomonas aeruginosa PA01
agggcggcgccu

SEQ ID NO: 3433487 - RNA, 18 nt, Pseudomonas aeruginosa PA01
agggcggcgcggagcugc

SEQ ID NO: 3433488 - RNA, 22 nt, Pseudomonas aeruginosa PA01
agggcggcgcggagcugcauga

SEQ ID NO: 3433489 - RNA, 13 nt, Pseudomonas aeruginosa PA01
agggcggcggcga

SEQ ID NO: 3433490 - RNA, 19 nt, Pseudomonas aeruginosa PA01
agggcggcggcucaggccg

SEQ ID NO: 3433491 - RNA, 19 nt, Pseudomonas aeruginosa PA01
agggcggcuuccagguacg

SEQ ID NO: 3433492 - RNA, 20 nt, Pseudomonas aeruginosa PA01
agggcggucggccaggggag

SEQ ID NO: 3433493 - RNA, 16 nt, Pseudomonas aeruginosa PA01
agggcggugagguugc

SEQ ID NO: 3433494 - RNA, 23 nt, Pseudomonas aeruginosa PA01
agggcggugagguugccgccgau

SEQ ID NO: 3433495 - RNA, 19 nt, Pseudomonas aeruginosa PA01
agggcgguuaccaggucug

SEQ ID NO: 3433496 - RNA, 20 nt, Pseudomonas aeruginosa PA01
agggcgucaguuccacgcgg

SEQ ID NO: 3433497 - RNA, 23 nt, Pseudomonas aeruginosa PA01
agggcgucaguuccacgcggacc

SEQ ID NO: 3433498 - RNA, 15 nt, Pseudomonas aeruginosa PA01
agggcgucgaaggcg

SEQ ID NO: 3433499 - RNA, 17 nt, Pseudomonas aeruginosa PA01
agggcgucgaaggcggc

SEQ ID NO: 3433500 - RNA, 19 nt, Pseudomonas aeruginosa PA01
agggcgucgaaggcggcgc

SEQ ID NO: 3433501 - RNA, 15 nt, Pseudomonas aeruginosa PA01
agggcgucgccggga

SEQ ID NO: 3433502 - RNA, 22 nt, Pseudomonas aeruginosa PA01
agggcgucggcgugcugggucu

SEQ ID NO: 3433503 - RNA, 18 nt, Pseudomonas aeruginosa PA01
agggcgucgucgaggcug

SEQ ID NO: 3433504 - RNA, 18 nt, Pseudomonas aeruginosa PA01
agggcgucugggacggca

SEQ ID NO: 3433505 - RNA, 20 nt, Pseudomonas aeruginosa PA01
agggcgucugggacggcagc

SEQ ID NO: 3433506 - RNA, 22 nt, Pseudomonas aeruginosa PA01
agggcgucugggacggcagccu

SEQ ID NO: 3433507 - RNA, 22 nt, Pseudomonas aeruginosa PA01
agggcgugguguagccguugag

SEQ ID NO: 3433508 - RNA, 23 nt, Pseudomonas aeruginosa PA01
agggcguuucagaacgucggcgg

SEQ ID NO: 3433509 - RNA, 18 nt, Pseudomonas aeruginosa PA01
agggcuauguauucggcg

SEQ ID NO: 3433510 - RNA, 20 nt, Pseudomonas aeruginosa PA01
agggcuauguauucggcggu

SEQ ID NO: 3433511 - RNA, 14 nt, Pseudomonas aeruginosa PA01
agggcucagcccag

SEQ ID NO: 3433512 - RNA, 15 nt, Pseudomonas aeruginosa PA01
agggcucagcccagg

SEQ ID NO: 3433513 - RNA, 21 nt, Pseudomonas aeruginosa PA01
agggcucgugccaucaggccg

SEQ ID NO: 3433514 - RNA, 22 nt, Pseudomonas aeruginosa PA01
agggcugagacgcugccguucg

SEQ ID NO: 3433515 - RNA, 17 nt, Pseudomonas aeruginosa PA01
agggcugcuguugccag

SEQ ID NO: 3433516 - RNA, 17 nt, Pseudomonas aeruginosa PA01
agggcugggcagcgccg

SEQ ID NO: 3433517 - RNA, 15 nt, Pseudomonas aeruginosa PA01
agggcugggcgcccu

SEQ ID NO: 3433518 - RNA, 15 nt, Pseudomonas aeruginosa PA01
agggcuucccaggcc

SEQ ID NO: 3433519 - RNA, 14 nt, Pseudomonas aeruginosa PA01
agggcuucgcgcag

SEQ ID NO: 3433520 - RNA, 20 nt, Pseudomonas aeruginosa PA01
agggcuugcgcgccaccagc

SEQ ID NO: 3433521 - RNA, 23 nt, Pseudomonas aeruginosa PA01
aggggaaaccguggucgccgcuc

SEQ ID NO: 3433522 - RNA, 23 nt, Pseudomonas aeruginosa PA01
aggggaacauugccaccaccaug

SEQ ID NO: 3433523 - RNA, 15 nt, Pseudomonas aeruginosa PA01
aggggaaucgccguc

SEQ ID NO: 3433524 - RNA, 14 nt, Pseudomonas aeruginosa PA01
aggggagcgccggc

SEQ ID NO: 3433525 - RNA, 23 nt, Pseudomonas aeruginosa PA01
aggggaugccauggcauccccuu

SEQ ID NO: 3433526 - RNA, 15 nt, Pseudomonas aeruginosa PA01
aggggcacgcuggcg

SEQ ID NO: 3433527 - RNA, 18 nt, Pseudomonas aeruginosa PA01
aggggcacgcuggcgaga

SEQ ID NO: 3433528 - RNA, 22 nt, Pseudomonas aeruginosa PA01
aggggcagaccuggugggcggc

SEQ ID NO: 3433529 - RNA, 19 nt, Pseudomonas aeruginosa PA01
aggggcauguccaccgccg

SEQ ID NO: 3433530 - RNA, 18 nt, Pseudomonas aeruginosa PA01
agguagcugcgccgccuu

SEQ ID NO: 3433531 - RNA, 16 nt, Pseudomonas aeruginosa PA01
agguaggccagcccca

SEQ ID NO: 3433532 - RNA, 20 nt, Pseudomonas aeruginosa PA01
agguaggcgacgaagcuggc

SEQ ID NO: 3433533 - RNA, 13 nt, Pseudomonas aeruginosa PA01
agguaggcgcggg

SEQ ID NO: 3433534 - RNA, 16 nt, Pseudomonas aeruginosa PA01
agguagucgcccagcg

SEQ ID NO: 3433535 - RNA, 18 nt, Pseudomonas aeruginosa PA01
agguagucgcccagcgcc

SEQ ID NO: 3433536 - RNA, 24 nt, Pseudomonas aeruginosa PA01
agguagucgcccggcucgcccaug

SEQ ID NO: 3433537 - RNA, 22 nt, Pseudomonas aeruginosa PA01
agguagucggugaagcgcggcg

SEQ ID NO: 3433538 - RNA, 20 nt, Pseudomonas aeruginosa PA01
agguagugcaacaccuggcg

SEQ ID NO: 3433539 - RNA, 15 nt, Pseudomonas aeruginosa PA01
agguagugccgcccu

SEQ ID NO: 3433540 - RNA, 20 nt, Pseudomonas aeruginosa PA01
agguagugccgcccuugcca

SEQ ID NO: 3433541 - RNA, 19 nt, Pseudomonas aeruginosa PA01
agguagugcggcgggcgcc

SEQ ID NO: 3433542 - RNA, 16 nt, Pseudomonas aeruginosa PA01
agguagugcucggcca

SEQ ID NO: 3433543 - RNA, 16 nt, Pseudomonas aeruginosa PA01
agguaguucuccaggc

SEQ ID NO: 3433544 - RNA, 21 nt, Pseudomonas aeruginosa PA01
agguauccgccggccggggcg

SEQ ID NO: 3433545 - RNA, 14 nt, Pseudomonas aeruginosa PA01
agguauugcgcgug

SEQ ID NO: 3433546 - RNA, 23 nt, Pseudomonas aeruginosa PA01
agguauugcgcguggcgucggcg

SEQ ID NO: 3433547 - RNA, 23 nt, Pseudomonas aeruginosa PA01
aggucaaugccacgugcggggug

SEQ ID NO: 3433548 - RNA, 20 nt, Pseudomonas aeruginosa PA01
aggucaccagguugcccggc

SEQ ID NO: 3433549 - RNA, 21 nt, Pseudomonas aeruginosa PA01
aggucaccagguugcccggcu

SEQ ID NO: 3433550 - RNA, 23 nt, Pseudomonas aeruginosa PA01
aggucaccagguugcccggcuug

SEQ ID NO: 3433551 - RNA, 19 nt, Pseudomonas aeruginosa PA01
aggucaccgaaaggcucuu

SEQ ID NO: 3433552 - RNA, 14 nt, Pseudomonas aeruginosa PA01
aggucaccgcgccg

SEQ ID NO: 3433553 - RNA, 19 nt, Pseudomonas aeruginosa PA01
aggucaccgcgccgguaau

SEQ ID NO: 3433554 - RNA, 18 nt, Pseudomonas aeruginosa PA01
aggucacgcccugcaccu

SEQ ID NO: 3433555 - RNA, 21 nt, Pseudomonas aeruginosa PA01
aggucacuuccgucacgcccu

SEQ ID NO: 3433556 - RNA, 15 nt, Pseudomonas aeruginosa PA01
aggucagcacgccuu

SEQ ID NO: 3433557 - RNA, 22 nt, Pseudomonas aeruginosa PA01
aggucagcccguguucggccag

SEQ ID NO: 3433558 - RNA, 21 nt, Pseudomonas aeruginosa PA01
aggucagcgguaugccgcagg

SEQ ID NO: 3433559 - RNA, 22 nt, Pseudomonas aeruginosa PA01
aggucagcgguaugccgcaggc

SEQ ID NO: 3433560 - RNA, 17 nt, Pseudomonas aeruginosa PA01
aggucaguucggugccg

SEQ ID NO: 3433561 - RNA, 15 nt, Pseudomonas aeruginosa PA01
aggucaucaggauca

SEQ ID NO: 3433562 - RNA, 15 nt, Pseudomonas aeruginosa PA01
aggucaugcccaggc

SEQ ID NO: 3433563 - RNA, 18 nt, Pseudomonas aeruginosa PA01
aggucaugcccuggccga

SEQ ID NO: 3433564 - RNA, 15 nt, Pseudomonas aeruginosa PA01
agguccaccagccag

SEQ ID NO: 3433565 - RNA, 10 nt, Pseudomonas aeruginosa PA01
agguccaggc

SEQ ID NO: 3433566 - RNA, 12 nt, Pseudomonas aeruginosa PA01
agguccaggcga

SEQ ID NO: 3433567 - RNA, 15 nt, Pseudomonas aeruginosa PA01
agguccaggcgacga

SEQ ID NO: 3433568 - RNA, 15 nt, Pseudomonas aeruginosa PA01
agguccaggcgucgg

SEQ ID NO: 3433569 - RNA, 16 nt, Pseudomonas aeruginosa PA01
agguccgccuggucca

SEQ ID NO: 3433570 - RNA, 22 nt, Pseudomonas aeruginosa PA01
agguccgccugguccagcaggu

SEQ ID NO: 3433571 - RNA, 23 nt, Pseudomonas aeruginosa PA01
agguccgccugguccagcagguu

SEQ ID NO: 3433572 - RNA, 16 nt, Pseudomonas aeruginosa PA01
agguccggagggcccg

SEQ ID NO: 3433573 - RNA, 16 nt, Pseudomonas aeruginosa PA01
agguccggcagcgccu

SEQ ID NO: 3433574 - RNA, 15 nt, Pseudomonas aeruginosa PA01
agguccuggccgaag

SEQ ID NO: 3433575 - RNA, 12 nt, Pseudomonas aeruginosa PA01
agguccuguccc

SEQ ID NO: 3433576 - RNA, 15 nt, Pseudomonas aeruginosa PA01
agguccuugggccag

SEQ ID NO: 3433577 - RNA, 15 nt, Pseudomonas aeruginosa PA01
agguccuuguuccug

SEQ ID NO: 3433578 - RNA, 19 nt, Pseudomonas aeruginosa PA01
aggucgaaagcuucgucgc

SEQ ID NO: 3433579 - RNA, 14 nt, Pseudomonas aeruginosa PA01
aggucgaacagcgg

SEQ ID NO: 3433580 - RNA, 16 nt, Pseudomonas aeruginosa PA01
aggucgaacagcggcu

SEQ ID NO: 3433581 - RNA, 22 nt, Pseudomonas aeruginosa PA01
aggucgaacagcggcuggcccu

SEQ ID NO: 3433582 - RNA, 20 nt, Pseudomonas aeruginosa PA01
aggucgaagaccuguugcag

SEQ ID NO: 3433583 - RNA, 19 nt, Pseudomonas aeruginosa PA01
aggucgacgaacaggaagc

SEQ ID NO: 3433584 - RNA, 16 nt, Pseudomonas aeruginosa PA01
aggucgacgccauggc

SEQ ID NO: 3433585 - RNA, 17 nt, Pseudomonas aeruginosa PA01
aggucgacgccauggcg

SEQ ID NO: 3433586 - RNA, 15 nt, Pseudomonas aeruginosa PA01
aggucgacgccgccg

SEQ ID NO: 3433587 - RNA, 17 nt, Pseudomonas aeruginosa PA01
aggucgacgccgccgag

SEQ ID NO: 3433588 - RNA, 17 nt, Pseudomonas aeruginosa PA01
aggucgaggauguagua

SEQ ID NO: 3433589 - RNA, 15 nt, Pseudomonas aeruginosa PA01
aggucgaggccgcgg

SEQ ID NO: 3433590 - RNA, 19 nt, Pseudomonas aeruginosa PA01
aggucgaggccgcggagca

SEQ ID NO: 3433591 - RNA, 13 nt, Pseudomonas aeruginosa PA01
aggucgagggcau

SEQ ID NO: 3433592 - RNA, 18 nt, Pseudomonas aeruginosa PA01
aggucgagguucuccagg

SEQ ID NO: 3433593 - RNA, 18 nt, Pseudomonas aeruginosa PA01
aggucgcacgcagcgccg

SEQ ID NO: 3433594 - RNA, 19 nt, Pseudomonas aeruginosa PA01
aggucgcacgcagcgccgc

SEQ ID NO: 3433595 - RNA, 20 nt, Pseudomonas aeruginosa PA01
aggucgcagcguuccagcgc

SEQ ID NO: 3433596 - RNA, 14 nt, Pseudomonas aeruginosa PA01
aggucgccacgcag

SEQ ID NO: 3433597 - RNA, 20 nt, Pseudomonas aeruginosa PA01
aggucgcccugcagcgcgcg

SEQ ID NO: 3433598 - RNA, 16 nt, Pseudomonas aeruginosa PA01
aggucgccgacacgug

SEQ ID NO: 3433599 - RNA, 17 nt, Pseudomonas aeruginosa PA01
aggucgccgacacgugu

SEQ ID NO: 3433600 - RNA, 15 nt, Pseudomonas aeruginosa PA01
aggucgccgccagcu

SEQ ID NO: 3433601 - RNA, 15 nt, Pseudomonas aeruginosa PA01
aggucgccgccgccg

SEQ ID NO: 3433602 - RNA, 22 nt, Pseudomonas aeruginosa PA01
aggucgccguagaacagcacgu

SEQ ID NO: 3433603 - RNA, 15 nt, Pseudomonas aeruginosa PA01
aggucgcgacagguu

SEQ ID NO: 3433604 - RNA, 16 nt, Pseudomonas aeruginosa PA01
aggucgcgcggcgccu

SEQ ID NO: 3433605 - RNA, 16 nt, Pseudomonas aeruginosa PA01
aggucgcgcugggcga

SEQ ID NO: 3433606 - RNA, 16 nt, Pseudomonas aeruginosa PA01
aggucgcgggccaggc

SEQ ID NO: 3433607 - RNA, 13 nt, Pseudomonas aeruginosa PA01
aggucgcggugca

SEQ ID NO: 3433608 - RNA, 22 nt, Pseudomonas aeruginosa PA01
aggucgcggugcaguucgccgu

SEQ ID NO: 3433609 - RNA, 23 nt, Pseudomonas aeruginosa PA01
aggucgcugaccacccggugcag

SEQ ID NO: 3433610 - RNA, 21 nt, Pseudomonas aeruginosa PA01
aggucgcugcccucgaccagg

SEQ ID NO: 3433611 - RNA, 22 nt, Pseudomonas aeruginosa PA01
aggucgcugcugaaaaacgccu

SEQ ID NO: 3433612 - RNA, 17 nt, Pseudomonas aeruginosa PA01
aggucgcuggcaccggc

SEQ ID NO: 3433613 - RNA, 15 nt, Pseudomonas aeruginosa PA01
aggucgcuggcgucg

SEQ ID NO: 3433614 - RNA, 16 nt, Pseudomonas aeruginosa PA01
aggucgcuggcgucga

SEQ ID NO: 3433615 - RNA, 19 nt, Pseudomonas aeruginosa PA01
aggucgcuguccuccagcg

SEQ ID NO: 3433616 - RNA, 22 nt, Pseudomonas aeruginosa PA01
aggucgcuguccuccagcggcg

SEQ ID NO: 3433617 - RNA, 16 nt, Pseudomonas aeruginosa PA01
aggucgcuuucgcgca

SEQ ID NO: 3433618 - RNA, 17 nt, Pseudomonas aeruginosa PA01
aggucgcuuucgcgcag

SEQ ID NO: 3433619 - RNA, 13 nt, Pseudomonas aeruginosa PA01
aggucggacaggc

SEQ ID NO: 3433620 - RNA, 19 nt, Pseudomonas aeruginosa PA01
aggucggccggcagcuccg

SEQ ID NO: 3433621 - RNA, 14 nt, Pseudomonas aeruginosa PA01
aggucggccucggc

SEQ ID NO: 3433622 - RNA, 14 nt, Pseudomonas aeruginosa PA01
aggucggccuggcu

SEQ ID NO: 3433623 - RNA, 18 nt, Pseudomonas aeruginosa PA01
aggucggcgcaagcgguu

SEQ ID NO: 3433624 - RNA, 14 nt, Pseudomonas aeruginosa PA01
aggucggcgccggu

SEQ ID NO: 3433625 - RNA, 15 nt, Pseudomonas aeruginosa PA01
aggucggcgccggug

SEQ ID NO: 3433626 - RNA, 18 nt, Pseudomonas aeruginosa PA01
aggucggcgccggugcug

SEQ ID NO: 3433627 - RNA, 14 nt, Pseudomonas aeruginosa PA01
aggucggcgcgcac

SEQ ID NO: 3433628 - RNA, 14 nt, Pseudomonas aeruginosa PA01
aggucggcgcgccc

SEQ ID NO: 3433629 - RNA, 21 nt, Pseudomonas aeruginosa PA01
aggucggcgcgcccggcgcag

SEQ ID NO: 3433630 - RNA, 11 nt, Pseudomonas aeruginosa PA01
aggucggcggc

SEQ ID NO: 3433631 - RNA, 16 nt, Pseudomonas aeruginosa PA01
aggucggcggcacgcu

SEQ ID NO: 3433632 - RNA, 17 nt, Pseudomonas aeruginosa PA01
aggucggcggcagcugc

SEQ ID NO: 3433633 - RNA, 22 nt, Pseudomonas aeruginosa PA01
aggucggcggcagcugcggcgg

SEQ ID NO: 3433634 - RNA, 21 nt, Pseudomonas aeruginosa PA01
aggucggcgucuuccggcucg

SEQ ID NO: 3433635 - RNA, 16 nt, Pseudomonas aeruginosa PA01
aggucgggcaacggcu

SEQ ID NO: 3433636 - RNA, 16 nt, Pseudomonas aeruginosa PA01
aggucgguccgccgau

SEQ ID NO: 3433637 - RNA, 16 nt, Pseudomonas aeruginosa PA01
aggucggucggcggcg

SEQ ID NO: 3433638 - RNA, 17 nt, Pseudomonas aeruginosa PA01
aggucggucggcggcgg

SEQ ID NO: 3433639 - RNA, 22 nt, Pseudomonas aeruginosa PA01
aggucggucucgccaccccgcu

SEQ ID NO: 3433640 - RNA, 18 nt, Pseudomonas aeruginosa PA01
aggucggucuggcggccc

SEQ ID NO: 3433641 - RNA, 15 nt, Pseudomonas aeruginosa PA01
aggucgguucgccca

SEQ ID NO: 3433642 - RNA, 12 nt, Pseudomonas aeruginosa PA01
aggucgucgagg

SEQ ID NO: 3433643 - RNA, 13 nt, Pseudomonas aeruginosa PA01
aggucgucgagga

SEQ ID NO: 3433644 - RNA, 14 nt, Pseudomonas aeruginosa PA01
aggucgucgcgcuu

SEQ ID NO: 3433645 - RNA, 20 nt, Pseudomonas aeruginosa PA01
aggucgucgcgcuugagcag

SEQ ID NO: 3433646 - RNA, 22 nt, Pseudomonas aeruginosa PA01
aggucgucgcgcuugagcaggg

SEQ ID NO: 3433647 - RNA, 22 nt, Pseudomonas aeruginosa PA01
aggucgucgggcagaguggcgc

SEQ ID NO: 3433648 - RNA, 20 nt, Pseudomonas aeruginosa PA01
aggucgucgucacgcaggcu

SEQ ID NO: 3433649 - RNA, 21 nt, Pseudomonas aeruginosa PA01
aggucgucgucacgcaggcuu

SEQ ID NO: 3433650 - RNA, 20 nt, Pseudomonas aeruginosa PA01
aggucgucucagaccuuccu

SEQ ID NO: 3433651 - RNA, 16 nt, Pseudomonas aeruginosa PA01
aggucgugcagcccgg

SEQ ID NO: 3433652 - RNA, 22 nt, Pseudomonas aeruginosa PA01
aggucguugaaagucugcaccu

SEQ ID NO: 3433653 - RNA, 16 nt, Pseudomonas aeruginosa PA01
aggucguugcgccggc

SEQ ID NO: 3433654 - RNA, 23 nt, Pseudomonas aeruginosa PA01
aggucguugcgccggcccagcag

SEQ ID NO: 3433655 - RNA, 17 nt, Pseudomonas aeruginosa PA01
aggucguuggccaggcg

SEQ ID NO: 3433656 - RNA, 15 nt, Pseudomonas aeruginosa PA01
aggucucaccgcccu

SEQ ID NO: 3433657 - RNA, 17 nt, Pseudomonas aeruginosa PA01
aggucucaccgcccugc

SEQ ID NO: 3433658 - RNA, 14 nt, Pseudomonas aeruginosa PA01
aggucucgauggug

SEQ ID NO: 3433659 - RNA, 15 nt, Pseudomonas aeruginosa PA01
aggucucgccgccgg

SEQ ID NO: 3433660 - RNA, 17 nt, Pseudomonas aeruginosa PA01
aggucugccccggcuug

SEQ ID NO: 3433661 - RNA, 21 nt, Pseudomonas aeruginosa PA01
aggucugcccgacgaaguugc

SEQ ID NO: 3433662 - RNA, 18 nt, Pseudomonas aeruginosa PA01
aggugaaaagcgcugacg

SEQ ID NO: 3433663 - RNA, 15 nt, Pseudomonas aeruginosa PA01
aggugaagcccaggc

SEQ ID NO: 3433664 - RNA, 16 nt, Pseudomonas aeruginosa PA01
aggugaagcccaggcg

SEQ ID NO: 3433665 - RNA, 17 nt, Pseudomonas aeruginosa PA01
aggugaagcccaggcgc

SEQ ID NO: 3433666 - RNA, 16 nt, Pseudomonas aeruginosa PA01
aggugaagcugccguc

SEQ ID NO: 3433667 - RNA, 17 nt, Pseudomonas aeruginosa PA01
aggugaagcugccgucg

SEQ ID NO: 3433668 - RNA, 17 nt, Pseudomonas aeruginosa PA01
aggugagcgacccgcug

SEQ ID NO: 3433669 - RNA, 11 nt, Pseudomonas aeruginosa PA01
aggugaucgag

SEQ ID NO: 3433670 - RNA, 14 nt, Pseudomonas aeruginosa PA01
aggugauguugcgc

SEQ ID NO: 3433671 - RNA, 12 nt, Pseudomonas aeruginosa PA01
aggugcaccgcg

SEQ ID NO: 3433672 - RNA, 14 nt, Pseudomonas aeruginosa PA01
aggugcaccgcgcu

SEQ ID NO: 3433673 - RNA, 17 nt, Pseudomonas aeruginosa PA01
aggugcaccgcgcugga

SEQ ID NO: 3433674 - RNA, 16 nt, Pseudomonas aeruginosa PA01
aggugcacggccaggc

SEQ ID NO: 3433675 - RNA, 16 nt, Pseudomonas aeruginosa PA01
aggugcaggaacagcc

SEQ ID NO: 3433676 - RNA, 18 nt, Pseudomonas aeruginosa PA01
aggugcaggaacagccag

SEQ ID NO: 3433677 - RNA, 13 nt, Pseudomonas aeruginosa PA01
aggugcaggccgc

SEQ ID NO: 3433678 - RNA, 16 nt, Pseudomonas aeruginosa PA01
aggugcaggccgcgcg

SEQ ID NO: 3433679 - RNA, 19 nt, Pseudomonas aeruginosa PA01
aggugcaggccgcgcgaug

SEQ ID NO: 3433680 - RNA, 16 nt, Pseudomonas aeruginosa PA01
aggugcccagcggcgc

SEQ ID NO: 3433681 - RNA, 13 nt, Pseudomonas aeruginosa PA01
aggugcccagggc

SEQ ID NO: 3433682 - RNA, 22 nt, Pseudomonas aeruginosa PA01
aggugccgaggucgucgcugag

SEQ ID NO: 3433683 - RNA, 20 nt, Pseudomonas aeruginosa PA01
aggugcgccgagcgcucgcc

SEQ ID NO: 3433684 - RNA, 20 nt, Pseudomonas aeruginosa PA01
aggugcgcggcaggacccag

SEQ ID NO: 3433685 - RNA, 20 nt, Pseudomonas aeruginosa PA01
aggugcgguugaaacugcgc

SEQ ID NO: 3433686 - RNA, 20 nt, Pseudomonas aeruginosa PA01
aggugcguacuuggcccggc

SEQ ID NO: 3433687 - RNA, 22 nt, Pseudomonas aeruginosa PA01
aggugcguacuuggcccggcgu

SEQ ID NO: 3433688 - RNA, 13 nt, Pseudomonas aeruginosa PA01
aggugcugcaccg

SEQ ID NO: 3433689 - RNA, 20 nt, Pseudomonas aeruginosa PA01
aggugcugguggcccugggc

SEQ ID NO: 3433690 - RNA, 15 nt, Pseudomonas aeruginosa PA01
agguggaagcgcgcg

SEQ ID NO: 3433691 - RNA, 16 nt, Pseudomonas aeruginosa PA01
agguggaucgcggcgu

SEQ ID NO: 3433692 - RNA, 17 nt, Pseudomonas aeruginosa PA01
agguggaucgcggcgua

SEQ ID NO: 3433693 - RNA, 15 nt, Pseudomonas aeruginosa PA01
agguggaugaacagc

SEQ ID NO: 3433694 - RNA, 17 nt, Pseudomonas aeruginosa PA01
agguggaugaacagcgg

SEQ ID NO: 3433695 - RNA, 14 nt, Pseudomonas aeruginosa PA01
agguggauugcagc

SEQ ID NO: 3433696 - RNA, 15 nt, Pseudomonas aeruginosa PA01
agguggccggaaaaa

SEQ ID NO: 3433697 - RNA, 17 nt, Pseudomonas aeruginosa PA01
agguggcgcagccgucc

SEQ ID NO: 3433698 - RNA, 14 nt, Pseudomonas aeruginosa PA01
agguggcgccgccg

SEQ ID NO: 3433699 - RNA, 18 nt, Pseudomonas aeruginosa PA01
agguggcgggucggcgga

SEQ ID NO: 3433700 - RNA, 18 nt, Pseudomonas aeruginosa PA01
agguggcguugcagggug

SEQ ID NO: 3433701 - RNA, 16 nt, Pseudomonas aeruginosa PA01
agguggcugaagcccc

SEQ ID NO: 3433702 - RNA, 14 nt, Pseudomonas aeruginosa PA01
agguggcuggucag

SEQ ID NO: 3433703 - RNA, 14 nt, Pseudomonas aeruginosa PA01
aggugggcgcgccg

SEQ ID NO: 3433704 - RNA, 16 nt, Pseudomonas aeruginosa PA01
agguggucgaccaggc

SEQ ID NO: 3433705 - RNA, 21 nt, Pseudomonas aeruginosa PA01
agguggucgaugggcgagcga

SEQ ID NO: 3433706 - RNA, 12 nt, Pseudomonas aeruginosa PA01
aggugucgccgc

SEQ ID NO: 3433707 - RNA, 13 nt, Pseudomonas aeruginosa PA01
aggugugcagguu

SEQ ID NO: 3433708 - RNA, 14 nt, Pseudomonas aeruginosa PA01
agguguucggcccc

SEQ ID NO: 3433709 - RNA, 23 nt, Pseudomonas aeruginosa PA01
agguguucggccccggccaggua

SEQ ID NO: 3433710 - RNA, 16 nt, Pseudomonas aeruginosa PA01
agguguucggcggcgu

SEQ ID NO: 3433711 - RNA, 16 nt, Pseudomonas aeruginosa PA01
agguucaauccuuccg

SEQ ID NO: 3433712 - RNA, 14 nt, Pseudomonas aeruginosa PA01
agguucaccgccuc

SEQ ID NO: 3433713 - RNA, 23 nt, Pseudomonas aeruginosa PA01
agguucaggacgcuccugcgccg

SEQ ID NO: 3433714 - RNA, 21 nt, Pseudomonas aeruginosa PA01
agguucaggccgggcaggccg

SEQ ID NO: 3433715 - RNA, 14 nt, Pseudomonas aeruginosa PA01
agguucaugccgcg

SEQ ID NO: 3433716 - RNA, 17 nt, Pseudomonas aeruginosa PA01
agguuccgcggcgacgg

SEQ ID NO: 3433717 - RNA, 19 nt, Pseudomonas aeruginosa PA01
agguuccgcggcgacggcu

SEQ ID NO: 3433718 - RNA, 19 nt, Pseudomonas aeruginosa PA01
agguucgaaugcugcccgg

SEQ ID NO: 3433719 - RNA, 13 nt, Pseudomonas aeruginosa PA01
agguucggcaggu

SEQ ID NO: 3433720 - RNA, 15 nt, Pseudomonas aeruginosa PA01
agguucugccagagc

SEQ ID NO: 3433721 - RNA, 16 nt, Pseudomonas aeruginosa PA01
agguucugccagagcg

SEQ ID NO: 3433722 - RNA, 22 nt, Pseudomonas aeruginosa PA01
agguucugccagagcgcugccu

SEQ ID NO: 3433723 - RNA, 16 nt, Pseudomonas aeruginosa PA01
agguucuggucgccga

SEQ ID NO: 3433724 - RNA, 22 nt, Pseudomonas aeruginosa PA01
agguugaccccgcggccgagga

SEQ ID NO: 3433725 - RNA, 23 nt, Pseudomonas aeruginosa PA01
agguugauccugggcgccagccg

SEQ ID NO: 3433726 - RNA, 17 nt, Pseudomonas aeruginosa PA01
agguugaucggguggga

SEQ ID NO: 3433727 - RNA, 23 nt, Pseudomonas aeruginosa PA01
agguugcacggccgguagucggg

SEQ ID NO: 3433728 - RNA, 18 nt, Pseudomonas aeruginosa PA01
agguugcccacggccagg

SEQ ID NO: 3433729 - RNA, 20 nt, Pseudomonas aeruginosa PA01
agguugcccacggccaggcc

SEQ ID NO: 3433730 - RNA, 13 nt, Pseudomonas aeruginosa PA01
agguugccgccga

SEQ ID NO: 3433731 - RNA, 16 nt, Pseudomonas aeruginosa PA01
agguugcgauugucca

SEQ ID NO: 3433732 - RNA, 21 nt, Pseudomonas aeruginosa PA01
agguugcgcaaccagcgcucg

SEQ ID NO: 3433733 - RNA, 17 nt, Pseudomonas aeruginosa PA01
agguugcgcuccaucca

SEQ ID NO: 3433734 - RNA, 22 nt, Pseudomonas aeruginosa PA01
agguugcgcuggcgcagcagca

SEQ ID NO: 3433735 - RNA, 14 nt, Pseudomonas aeruginosa PA01
agguugcucgccuu

SEQ ID NO: 3433736 - RNA, 14 nt, Pseudomonas aeruginosa PA01
agucgacgccgguc

SEQ ID NO: 3433737 - RNA, 17 nt, Pseudomonas aeruginosa PA01
agucgagacgccagccg

SEQ ID NO: 3433738 - RNA, 12 nt, Pseudomonas aeruginosa PA01
agucgagcaguu

SEQ ID NO: 3433739 - RNA, 13 nt, Pseudomonas aeruginosa PA01
agucgagccggau

SEQ ID NO: 3433740 - RNA, 18 nt, Pseudomonas aeruginosa PA01
agucgaucaccgcaucga

SEQ ID NO: 3433741 - RNA, 16 nt, Pseudomonas aeruginosa PA01
agucgaucaggucgcc

SEQ ID NO: 3433742 - RNA, 18 nt, Pseudomonas aeruginosa PA01
agucgaucaggucgccgc

SEQ ID NO: 3433743 - RNA, 20 nt, Pseudomonas aeruginosa PA01
agucgaucaggucgccgccg

SEQ ID NO: 3433744 - RNA, 21 nt, Pseudomonas aeruginosa PA01
agucgaugaacaagugcucga

SEQ ID NO: 3433745 - RNA, 21 nt, Pseudomonas aeruginosa PA01
agucgaugacgaggcccgccc

SEQ ID NO: 3433746 - RNA, 19 nt, Pseudomonas aeruginosa PA01
agucgcagucguagcgcag

SEQ ID NO: 3433747 - RNA, 15 nt, Pseudomonas aeruginosa PA01
agucgcccagcgccu

SEQ ID NO: 3433748 - RNA, 14 nt, Pseudomonas aeruginosa PA01
agucgcccgccggc

SEQ ID NO: 3433749 - RNA, 21 nt, Pseudomonas aeruginosa PA01
agucgcccggcucgcccaugc

SEQ ID NO: 3433750 - RNA, 18 nt, Pseudomonas aeruginosa PA01
agucgcccugcccggugg

SEQ ID NO: 3433751 - RNA, 14 nt, Pseudomonas aeruginosa PA01
agucgccggcgaac

SEQ ID NO: 3433752 - RNA, 22 nt, Pseudomonas aeruginosa PA01
agucgccgguucaguucagccg

SEQ ID NO: 3433753 - RNA, 22 nt, Pseudomonas aeruginosa PA01
agucgccguucagguucagggu

SEQ ID NO: 3433754 - RNA, 16 nt, Pseudomonas aeruginosa PA01
agucgcgcagcgccuc

SEQ ID NO: 3433755 - RNA, 21 nt, Pseudomonas aeruginosa PA01
agucgcgcccagugcccggca

SEQ ID NO: 3433756 - RNA, 17 nt, Pseudomonas aeruginosa PA01
agucgcucauggcgccg

SEQ ID NO: 3433757 - RNA, 14 nt, Pseudomonas aeruginosa PA01
agucgcucgcgcag

SEQ ID NO: 3433758 - RNA, 17 nt, Pseudomonas aeruginosa PA01
agucgcucgcgcagguc

SEQ ID NO: 3433759 - RNA, 16 nt, Pseudomonas aeruginosa PA01
agucgcugcucggccu

SEQ ID NO: 3433760 - RNA, 14 nt, Pseudomonas aeruginosa PA01
agucgcugcuggcg

SEQ ID NO: 3433761 - RNA, 15 nt, Pseudomonas aeruginosa PA01
agucgcugcuggcgc

SEQ ID NO: 3433762 - RNA, 16 nt, Pseudomonas aeruginosa PA01
agucgcugcuggcgcc

SEQ ID NO: 3433763 - RNA, 21 nt, Pseudomonas aeruginosa PA01
agucgcugcuggcgccgcugg

SEQ ID NO: 3433764 - RNA, 22 nt, Pseudomonas aeruginosa PA01
agucgcugcuggcgccgcuggc

SEQ ID NO: 3433765 - RNA, 22 nt, Pseudomonas aeruginosa PA01
agucgcuggccugggguagccg

SEQ ID NO: 3433766 - RNA, 21 nt, Pseudomonas aeruginosa PA01
agucgcuucacucauccucgc

SEQ ID NO: 3433767 - RNA, 16 nt, Pseudomonas aeruginosa PA01
agucggaagcuucaga

SEQ ID NO: 3433768 - RNA, 18 nt, Pseudomonas aeruginosa PA01
agucggcagucgccgcac

SEQ ID NO: 3433769 - RNA, 20 nt, Pseudomonas aeruginosa PA01
agucggcagucgccgcaccg

SEQ ID NO: 3433770 - RNA, 15 nt, Pseudomonas aeruginosa PA01
agucggccaggcgcc

SEQ ID NO: 3433771 - RNA, 19 nt, Pseudomonas aeruginosa PA01
agucggccaggcgccaggu

SEQ ID NO: 3433772 - RNA, 17 nt, Pseudomonas aeruginosa PA01
agucggccugcaccagc

SEQ ID NO: 3433773 - RNA, 18 nt, Pseudomonas aeruginosa PA01
agucggcgacgaugccgc

SEQ ID NO: 3433774 - RNA, 14 nt, Pseudomonas aeruginosa PA01
agucggcgaugcgc

SEQ ID NO: 3433775 - RNA, 16 nt, Pseudomonas aeruginosa PA01
agucggcguaggccag

SEQ ID NO: 3433776 - RNA, 21 nt, Pseudomonas aeruginosa PA01
agucggcguaggccaguucgc

SEQ ID NO: 3433777 - RNA, 18 nt, Pseudomonas aeruginosa PA01
agucggcguccgccucgc

SEQ ID NO: 3433778 - RNA, 22 nt, Pseudomonas aeruginosa PA01
agucggcuugggucagcggguu

SEQ ID NO: 3433779 - RNA, 17 nt, Pseudomonas aeruginosa PA01
agucggggcaggcgcag

SEQ ID NO: 3433780 - RNA, 14 nt, Pseudomonas aeruginosa PA01
agucgguagagcag

SEQ ID NO: 3433781 - RNA, 13 nt, Pseudomonas aeruginosa PA01
agucggugaccuc

SEQ ID NO: 3433782 - RNA, 16 nt, Pseudomonas aeruginosa PA01
agucguagcgcgcggc

SEQ ID NO: 3433783 - RNA, 15 nt, Pseudomonas aeruginosa PA01
agucguaggucugcc

SEQ ID NO: 3433784 - RNA, 12 nt, Pseudomonas aeruginosa PA01
agucguccucgc

SEQ ID NO: 3433785 - RNA, 16 nt, Pseudomonas aeruginosa PA01
agucguucagcgccuc

SEQ ID NO: 3433786 - RNA, 19 nt, Pseudomonas aeruginosa PA01
agucguucagcgccucgcg

SEQ ID NO: 3433787 - RNA, 23 nt, Pseudomonas aeruginosa PA01
agucguucccggccuggcgcgcg

SEQ ID NO: 3433788 - RNA, 15 nt, Pseudomonas aeruginosa PA01
agucguugaagcggc

SEQ ID NO: 3433789 - RNA, 18 nt, Pseudomonas aeruginosa PA01
agucguuguacuggccga

SEQ ID NO: 3433790 - RNA, 14 nt, Pseudomonas aeruginosa PA01
agucuucgaugcgc

SEQ ID NO: 3433791 - RNA, 15 nt, Pseudomonas aeruginosa PA01
agucuuucagcuuca

SEQ ID NO: 3433792 - RNA, 23 nt, Pseudomonas aeruginosa PA01
agugaagagcucccugccgcccu

SEQ ID NO: 3433793 - RNA, 19 nt, Pseudomonas aeruginosa PA01
agugacauccucccugccc

SEQ ID NO: 3433794 - RNA, 15 nt, Pseudomonas aeruginosa PA01
agugaccgcgcgcca

SEQ ID NO: 3433795 - RNA, 19 nt, Pseudomonas aeruginosa PA01
agugaccgcgcgccauggc

SEQ ID NO: 3433796 - RNA, 21 nt, Pseudomonas aeruginosa PA01
agugagccccggcgucggcgc

SEQ ID NO: 3433797 - RNA, 14 nt, Pseudomonas aeruginosa PA01
agugaggccgagcc

SEQ ID NO: 3433798 - RNA, 20 nt, Pseudomonas aeruginosa PA01
agugauggaagagcgccgcg

SEQ ID NO: 3433799 - RNA, 15 nt, Pseudomonas aeruginosa PA01
agugcaacaccuggc

SEQ ID NO: 3433800 - RNA, 18 nt, Pseudomonas aeruginosa PA01
agugcaacaccuggcgcu

SEQ ID NO: 3433801 - RNA, 18 nt, Pseudomonas aeruginosa PA01
agugcacguuccagcucg

SEQ ID NO: 3433802 - RNA, 17 nt, Pseudomonas aeruginosa PA01
agugcagcgagucgccg

SEQ ID NO: 3433803 - RNA, 18 nt, Pseudomonas aeruginosa PA01
agugcagcgagucgccgu

SEQ ID NO: 3433804 - RNA, 15 nt, Pseudomonas aeruginosa PA01
agugcagcuccaccg

SEQ ID NO: 3433805 - RNA, 14 nt, Pseudomonas aeruginosa PA01
agugcagcugcgag

SEQ ID NO: 3433806 - RNA, 18 nt, Pseudomonas aeruginosa PA01
agugcaggaaguggcgga

SEQ ID NO: 3433807 - RNA, 15 nt, Pseudomonas aeruginosa PA01
agugcaucggccgcc

SEQ ID NO: 3433808 - RNA, 20 nt, Pseudomonas aeruginosa PA01
agugcaucggccgccaggcu

SEQ ID NO: 3433809 - RNA, 19 nt, Pseudomonas aeruginosa PA01
agugcaugcguucgccgaa

SEQ ID NO: 3433810 - RNA, 15 nt, Pseudomonas aeruginosa PA01
agugccaggcucgcc

SEQ ID NO: 3433811 - RNA, 19 nt, Pseudomonas aeruginosa PA01
agugccaggcucgccgcca

SEQ ID NO: 3433812 - RNA, 22 nt, Pseudomonas aeruginosa PA01
agugccaggcucgccgccagca

SEQ ID NO: 3433813 - RNA, 15 nt, Pseudomonas aeruginosa PA01
agugcccaggcgcug

SEQ ID NO: 3433814 - RNA, 11 nt, Pseudomonas aeruginosa PA01
agugcccggca

SEQ ID NO: 3433815 - RNA, 20 nt, Pseudomonas aeruginosa PA01
agugccgaccacaugggcga

SEQ ID NO: 3433816 - RNA, 22 nt, Pseudomonas aeruginosa PA01
agugccggcgcgucgcugcgca

SEQ ID NO: 3433817 - RNA, 23 nt, Pseudomonas aeruginosa PA01
agugccggcgcgucgcugcgcaa

SEQ ID NO: 3433818 - RNA, 13 nt, Pseudomonas aeruginosa PA01
agugccucgcgcg

SEQ ID NO: 3433819 - RNA, 15 nt, Pseudomonas aeruginosa PA01
agugccucgcgcgug

SEQ ID NO: 3433820 - RNA, 22 nt, Pseudomonas aeruginosa PA01
agugccucgcgcguggccgcca

SEQ ID NO: 3433821 - RNA, 13 nt, Pseudomonas aeruginosa PA01
agugccugcacca

SEQ ID NO: 3433822 - RNA, 14 nt, Pseudomonas aeruginosa PA01
agugcgcagcagcg

SEQ ID NO: 3433823 - RNA, 16 nt, Pseudomonas aeruginosa PA01
agugcgcccagcagca

SEQ ID NO: 3433824 - RNA, 16 nt, Pseudomonas aeruginosa PA01
agugcgccgcagcgca

SEQ ID NO: 3433825 - RNA, 12 nt, Pseudomonas aeruginosa PA01
agugcgccggca

SEQ ID NO: 3433826 - RNA, 13 nt, Pseudomonas aeruginosa PA01
agugcgccggcau

SEQ ID NO: 3433827 - RNA, 21 nt, Pseudomonas aeruginosa PA01
agugcgccggcaucgccaugg

SEQ ID NO: 3433828 - RNA, 14 nt, Pseudomonas aeruginosa PA01
agugcggccaggcg

SEQ ID NO: 3433829 - RNA, 19 nt, Pseudomonas aeruginosa PA01
agugcggcgggcgcccgcc

SEQ ID NO: 3433830 - RNA, 18 nt, Pseudomonas aeruginosa PA01
agugcgggcaguccuggc

SEQ ID NO: 3433831 - RNA, 17 nt, Pseudomonas aeruginosa PA01
agugcggggcgcucgcc

SEQ ID NO: 3433832 - RNA, 23 nt, Pseudomonas aeruginosa PA01
agugcggggcgcucgcccuugcg

SEQ ID NO: 3433833 - RNA, 14 nt, Pseudomonas aeruginosa PA01
agugcuccggggcg

SEQ ID NO: 3433834 - RNA, 13 nt, Pseudomonas aeruginosa PA01
agugcuccucguc

SEQ ID NO: 3433835 - RNA, 18 nt, Pseudomonas aeruginosa PA01
agugcucgaucaggcugu

SEQ ID NO: 3433836 - RNA, 23 nt, Pseudomonas aeruginosa PA01
agugcucgaucagguaggcgccg

SEQ ID NO: 3433837 - RNA, 16 nt, Pseudomonas aeruginosa PA01
agugcucgauggcgaa

SEQ ID NO: 3433838 - RNA, 20 nt, Pseudomonas aeruginosa PA01
agugcugaguuucacgucga

SEQ ID NO: 3433839 - RNA, 17 nt, Pseudomonas aeruginosa PA01
aguugcuuggcgcgcug

SEQ ID NO: 3433840 - RNA, 19 nt, Pseudomonas aeruginosa PA01
aguugcuuggcgcgcuggc

SEQ ID NO: 3433841 - RNA, 20 nt, Pseudomonas aeruginosa PA01
aguugcuuggcgcgcuggca

SEQ ID NO: 3433842 - RNA, 13 nt, Pseudomonas aeruginosa PA01
aguuggacgcggc

SEQ ID NO: 3433843 - RNA, 20 nt, Pseudomonas aeruginosa PA01
aguuggcccaauccgcgccg

SEQ ID NO: 3433844 - RNA, 13 nt, Pseudomonas aeruginosa PA01
aguuggccgaacu

SEQ ID NO: 3433845 - RNA, 13 nt, Pseudomonas aeruginosa PA01
aguuggcggccga

SEQ ID NO: 3433846 - RNA, 15 nt, Pseudomonas aeruginosa PA01
aguugggcgaccugc

SEQ ID NO: 3433847 - RNA, 15 nt, Pseudomonas aeruginosa PA01
aguuggugcacgcgc

SEQ ID NO: 3433848 - RNA, 16 nt, Pseudomonas aeruginosa PA01
aguuguacagcgaggc

SEQ ID NO: 3433849 - RNA, 21 nt, Pseudomonas aeruginosa PA01
aguuguuccggguugguggcc

SEQ ID NO: 3433850 - RNA, 21 nt, Pseudomonas aeruginosa PA01
aguuucaucucggcgcaggca

SEQ ID NO: 3433851 - RNA, 17 nt, Pseudomonas aeruginosa PA01
aguuucucggucgccgc

SEQ ID NO: 3433852 - RNA, 19 nt, Pseudomonas aeruginosa PA01
aguuucucggucgccgcca

SEQ ID NO: 3433853 - RNA, 20 nt, Pseudomonas aeruginosa PA01
aguuucuucgcgugggccag

SEQ ID NO: 3433854 - RNA, 19 nt, Pseudomonas aeruginosa PA01
aguuugccgaacugcaggg

SEQ ID NO: 3433855 - RNA, 14 nt, Pseudomonas aeruginosa PA01
auaaaaaggcccgg

SEQ ID NO: 3433856 - RNA, 13 nt, Pseudomonas aeruginosa PA01
auaaagcuggacc

SEQ ID NO: 3433857 - RNA, 23 nt, Pseudomonas aeruginosa PA01
auaaaugcccgggagguuugcca

SEQ ID NO: 3433858 - RNA, 20 nt, Pseudomonas aeruginosa PA01
auaaccgcaagcgguuauuc

SEQ ID NO: 3433859 - RNA, 17 nt, Pseudomonas aeruginosa PA01
auaaccgcaucgcgguu

SEQ ID NO: 3433860 - RNA, 19 nt, Pseudomonas aeruginosa PA01
auaaccgcucgcgguuauc

SEQ ID NO: 3433861 - RNA, 12 nt, Pseudomonas aeruginosa PA01
auaaccgcugcg

SEQ ID NO: 3433862 - RNA, 19 nt, Pseudomonas aeruginosa PA01
auaaccgcuugcgguuauc

SEQ ID NO: 3433863 - RNA, 14 nt, Pseudomonas aeruginosa PA01
auaaccuccuaaau

SEQ ID NO: 3433864 - RNA, 21 nt, Pseudomonas aeruginosa PA01
auaacgccaacggcguuaucc

SEQ ID NO: 3433865 - RNA, 14 nt, Pseudomonas aeruginosa PA01
auaacgcuucgcag

SEQ ID NO: 3433866 - RNA, 20 nt, Pseudomonas aeruginosa PA01
auaacucagcaucagugcuc

SEQ ID NO: 3433867 - RNA, 23 nt, Pseudomonas aeruginosa PA01
auaagcucggcuugacuggcagu

SEQ ID NO: 3433868 - RNA, 13 nt, Pseudomonas aeruginosa PA01
auaaugcgcacca

SEQ ID NO: 3433869 - RNA, 18 nt, Pseudomonas aeruginosa PA01
auacacaugcaggcucga

SEQ ID NO: 3433870 - RNA, 23 nt, Pseudomonas aeruginosa PA01
auacagcacccgguagccgauca

SEQ ID NO: 3433871 - RNA, 19 nt, Pseudomonas aeruginosa PA01
auaccacguggccggcgcg

SEQ ID NO: 3433872 - RNA, 20 nt, Pseudomonas aeruginosa PA01
auaccccgguugugcgcccg

SEQ ID NO: 3433873 - RNA, 13 nt, Pseudomonas aeruginosa PA01
auacccggcgccc

SEQ ID NO: 3433874 - RNA, 15 nt, Pseudomonas aeruginosa PA01
auacccggcgccccg

SEQ ID NO: 3433875 - RNA, 23 nt, Pseudomonas aeruginosa PA01
auacccggcgccccggcccagcc

SEQ ID NO: 3433876 - RNA, 21 nt, Pseudomonas aeruginosa PA01
auacccgguagacgccuccca

SEQ ID NO: 3433877 - RNA, 12 nt, Pseudomonas aeruginosa PA01
auacccuggccg

SEQ ID NO: 3433878 - RNA, 18 nt, Pseudomonas aeruginosa PA01
auacccugggagccgccg

SEQ ID NO: 3433879 - RNA, 15 nt, Pseudomonas aeruginosa PA01
auaccgccgccggcc

SEQ ID NO: 3433880 - RNA, 14 nt, Pseudomonas aeruginosa PA01
auaccgccggcggc

SEQ ID NO: 3433881 - RNA, 12 nt, Pseudomonas aeruginosa PA01
auaccgcgcgcg

SEQ ID NO: 3433882 - RNA, 13 nt, Pseudomonas aeruginosa PA01
auaccgcgcgcgc

SEQ ID NO: 3433883 - RNA, 18 nt, Pseudomonas aeruginosa PA01
auaccggcaaggcggccu

SEQ ID NO: 3433884 - RNA, 13 nt, Pseudomonas aeruginosa PA01
auaccggccuguc

SEQ ID NO: 3433885 - RNA, 19 nt, Pseudomonas aeruginosa PA01
auacgaaaaaaaggcgcug

SEQ ID NO: 3433886 - RNA, 20 nt, Pseudomonas aeruginosa PA01
auacgaaaaaaaggcgcugc

SEQ ID NO: 3433887 - RNA, 18 nt, Pseudomonas aeruginosa PA01
auacgcuccggugccagg

SEQ ID NO: 3433888 - RNA, 18 nt, Pseudomonas aeruginosa PA01
auacggaacacacgcuuc

SEQ ID NO: 3433889 - RNA, 17 nt, Pseudomonas aeruginosa PA01
auacggaugcugacauc

SEQ ID NO: 3433890 - RNA, 21 nt, Pseudomonas aeruginosa PA01
auacgucuucgauggcggccg

SEQ ID NO: 3433891 - RNA, 12 nt, Pseudomonas aeruginosa PA01
auacucaugcag

SEQ ID NO: 3433892 - RNA, 22 nt, Pseudomonas aeruginosa PA01
auacuccuucaaccacuccagc

SEQ ID NO: 3433893 - RNA, 23 nt, Pseudomonas aeruginosa PA01
auacuccuucaaccacuccagcg

SEQ ID NO: 3433894 - RNA, 17 nt, Pseudomonas aeruginosa PA01
auacugcacgcccaggc

SEQ ID NO: 3433895 - RNA, 17 nt, Pseudomonas aeruginosa PA01
auagaaacgcagggccu

SEQ ID NO: 3433896 - RNA, 14 nt, Pseudomonas aeruginosa PA01
auagaccaaggcau

SEQ ID NO: 3433897 - RNA, 13 nt, Pseudomonas aeruginosa PA01
auagaccagcacc

SEQ ID NO: 3433898 - RNA, 20 nt, Pseudomonas aeruginosa PA01
auagaccagcaccgccugca

SEQ ID NO: 3433899 - RNA, 17 nt, Pseudomonas aeruginosa PA01
auagaguacucggcuac

SEQ ID NO: 3433900 - RNA, 22 nt, Pseudomonas aeruginosa PA01
auagagugcccaggcgcuggcg

SEQ ID NO: 3433901 - RNA, 22 nt, Pseudomonas aeruginosa PA01
auagaguugcuuggcgcgcugg

SEQ ID NO: 3433902 - RNA, 23 nt, Pseudomonas aeruginosa PA01
auagaugaaggcuugccacugcg

SEQ ID NO: 3433903 - RNA, 16 nt, Pseudomonas aeruginosa PA01
auagaugccgcccugc

SEQ ID NO: 3433904 - RNA, 20 nt, Pseudomonas aeruginosa PA01
auagcagccauagcaauaca

SEQ ID NO: 3433905 - RNA, 23 nt, Pseudomonas aeruginosa PA01
auagcaggucacgcccugcaccu

SEQ ID NO: 3433906 - RNA, 23 nt, Pseudomonas aeruginosa PA01
auagccgaacuccgccagcacca

SEQ ID NO: 3433907 - RNA, 20 nt, Pseudomonas aeruginosa PA01
auagccgcaagcggauaucc

SEQ ID NO: 3433908 - RNA, 19 nt, Pseudomonas aeruginosa PA01
auagccggcgaaccaggcg

SEQ ID NO: 3433909 - RNA, 18 nt, Pseudomonas aeruginosa PA01
auagccggcgaugccgcc

SEQ ID NO: 3433910 - RNA, 14 nt, Pseudomonas aeruginosa PA01
auagccggcgcgcc

SEQ ID NO: 3433911 - RNA, 12 nt, Pseudomonas aeruginosa PA01
auagccuccucc

SEQ ID NO: 3433912 - RNA, 12 nt, Pseudomonas aeruginosa PA01
auagcgcagcac

SEQ ID NO: 3433913 - RNA, 20 nt, Pseudomonas aeruginosa PA01
auagcgcaguccgguagcgc

SEQ ID NO: 3433914 - RNA, 13 nt, Pseudomonas aeruginosa PA01
auagcgccgcggg

SEQ ID NO: 3433915 - RNA, 12 nt, Pseudomonas aeruginosa PA01
auagcgccggca

SEQ ID NO: 3433916 - RNA, 16 nt, Pseudomonas aeruginosa PA01
auagcgcggccuucag

SEQ ID NO: 3433917 - RNA, 17 nt, Pseudomonas aeruginosa PA01
auagcgcggccuucagc

SEQ ID NO: 3433918 - RNA, 14 nt, Pseudomonas aeruginosa PA01
auagcguccagcuc

SEQ ID NO: 3433919 - RNA, 17 nt, Pseudomonas aeruginosa PA01
auagcucagcuggauag

SEQ ID NO: 3433920 - RNA, 17 nt, Pseudomonas aeruginosa PA01
auagcucauggccaggu

SEQ ID NO: 3433921 - RNA, 20 nt, Pseudomonas aeruginosa PA01
auaggagccugcgugagcug

SEQ ID NO: 3433922 - RNA, 21 nt, Pseudomonas aeruginosa PA01
auaggcauauucuucaacagc

SEQ ID NO: 3433923 - RNA, 17 nt, Pseudomonas aeruginosa PA01
auaggcgaagcggcucg

SEQ ID NO: 3433924 - RNA, 23 nt, Pseudomonas aeruginosa PA01
auaggcgccagccuacugggcgu

SEQ ID NO: 3433925 - RNA, 23 nt, Pseudomonas aeruginosa PA01
auagggcacccgguugaccccgc

SEQ ID NO: 3433926 - RNA, 12 nt, Pseudomonas aeruginosa PA01
auagggcggcgc

SEQ ID NO: 3433927 - RNA, 15 nt, Pseudomonas aeruginosa PA01
auagugcggccaggc

SEQ ID NO: 3433928 - RNA, 16 nt, Pseudomonas aeruginosa PA01
auagugcggccaggcg

SEQ ID NO: 3433929 - RNA, 17 nt, Pseudomonas aeruginosa PA01
auagugcggccaggcgu

SEQ ID NO: 3433930 - RNA, 17 nt, Pseudomonas aeruginosa PA01
auagugcugcggcaggu

SEQ ID NO: 3433931 - RNA, 20 nt, Pseudomonas aeruginosa PA01
auauccccguauccuccgcg

SEQ ID NO: 3433932 - RNA, 14 nt, Pseudomonas aeruginosa PA01
auaucccgccgccg

SEQ ID NO: 3433933 - RNA, 14 nt, Pseudomonas aeruginosa PA01
auauccgccaggga

SEQ ID NO: 3433934 - RNA, 18 nt, Pseudomonas aeruginosa PA01
auauccgggcccaggcug

SEQ ID NO: 3433935 - RNA, 18 nt, Pseudomonas aeruginosa PA01
auaucgcaggccaggccc

SEQ ID NO: 3433936 - RNA, 14 nt, Pseudomonas aeruginosa PA01
auaucugggccauc

SEQ ID NO: 3433937 - RNA, 14 nt, Pseudomonas aeruginosa PA01
auaugcaggucgaa

SEQ ID NO: 3433938 - RNA, 18 nt, Pseudomonas aeruginosa PA01
auaugcgccgccacgugc

SEQ ID NO: 3433939 - RNA, 18 nt, Pseudomonas aeruginosa PA01
auauucaagacgaaaaag

SEQ ID NO: 3433940 - RNA, 18 nt, Pseudomonas aeruginosa PA01
auauugugcgagaccccc

SEQ ID NO: 3433941 - RNA, 23 nt, Pseudomonas aeruginosa PA01
aucaacccaccgaccaccaucac

SEQ ID NO: 3433942 - RNA, 19 nt, Pseudomonas aeruginosa PA01
aucagcucgucuuucaggu

SEQ ID NO: 3433943 - RNA, 15 nt, Pseudomonas aeruginosa PA01
aucagcuucagcucc

SEQ ID NO: 3433944 - RNA, 20 nt, Pseudomonas aeruginosa PA01
aucagcuucucuuucaccug

SEQ ID NO: 3433945 - RNA, 19 nt, Pseudomonas aeruginosa PA01
aucagcuucuucagcagcg

SEQ ID NO: 3433946 - RNA, 23 nt, Pseudomonas aeruginosa PA01
aucagcuucuucagcagcgggcg

SEQ ID NO: 3433947 - RNA, 21 nt, Pseudomonas aeruginosa PA01
aucagcuuguggucguggcgg

SEQ ID NO: 3433948 - RNA, 22 nt, Pseudomonas aeruginosa PA01
aucagcuuguggucguggcgga

SEQ ID NO: 3433949 - RNA, 17 nt, Pseudomonas aeruginosa PA01
aucaggaacacccgguc

SEQ ID NO: 3433950 - RNA, 20 nt, Pseudomonas aeruginosa PA01
aucaggaaggucucgccgcc

SEQ ID NO: 3433951 - RNA, 21 nt, Pseudomonas aeruginosa PA01
aucaggaaggucucgccgccg

SEQ ID NO: 3433952 - RNA, 16 nt, Pseudomonas aeruginosa PA01
aucaggaggaucgcca

SEQ ID NO: 3433953 - RNA, 17 nt, Pseudomonas aeruginosa PA01
aucaggauguggccguc

SEQ ID NO: 3433954 - RNA, 22 nt, Pseudomonas aeruginosa PA01
aucaggauguggccgucgcgcc

SEQ ID NO: 3433955 - RNA, 15 nt, Pseudomonas aeruginosa PA01
aucaggcagcgcgcg

SEQ ID NO: 3433956 - RNA, 17 nt, Pseudomonas aeruginosa PA01
aucaggccaaagccgca

SEQ ID NO: 3433957 - RNA, 16 nt, Pseudomonas aeruginosa PA01
aucaggccgagcaccg

SEQ ID NO: 3433958 - RNA, 21 nt, Pseudomonas aeruginosa PA01
aucaggccgaggaugcucgcc

SEQ ID NO: 3433959 - RNA, 16 nt, Pseudomonas aeruginosa PA01
aucaggccuuccggga

SEQ ID NO: 3433960 - RNA, 19 nt, Pseudomonas aeruginosa PA01
aucaggcgcaugcccaggg

SEQ ID NO: 3433961 - RNA, 18 nt, Pseudomonas aeruginosa PA01
aucaggcgcuccgggcuc

SEQ ID NO: 3433962 - RNA, 17 nt, Pseudomonas aeruginosa PA01
aucaggcgggcuccgcc

SEQ ID NO: 3433963 - RNA, 15 nt, Pseudomonas aeruginosa PA01
aucaggcucaggcgu

SEQ ID NO: 3433964 - RNA, 17 nt, Pseudomonas aeruginosa PA01
aucaggcucaggcguuc

SEQ ID NO: 3433965 - RNA, 15 nt, Pseudomonas aeruginosa PA01
aucaggcugaagcgg

SEQ ID NO: 3433966 - RNA, 16 nt, Pseudomonas aeruginosa PA01
aucaggcugccgagca

SEQ ID NO: 3433967 - RNA, 17 nt, Pseudomonas aeruginosa PA01
aucaggcuguccacgcc

SEQ ID NO: 3433968 - RNA, 14 nt, Pseudomonas aeruginosa PA01
aucaggcugugcau

SEQ ID NO: 3433969 - RNA, 14 nt, Pseudomonas aeruginosa PA01
aucagggcaccgcc

SEQ ID NO: 3433970 - RNA, 16 nt, Pseudomonas aeruginosa PA01
aucagggcaccgccga

SEQ ID NO: 3433971 - RNA, 19 nt, Pseudomonas aeruginosa PA01
aucagggcaccgccgagga

SEQ ID NO: 3433972 - RNA, 14 nt, Pseudomonas aeruginosa PA01
aucagguagucgcc

SEQ ID NO: 3433973 - RNA, 16 nt, Pseudomonas aeruginosa PA01
aucaggucgccagcgc

SEQ ID NO: 3433974 - RNA, 18 nt, Pseudomonas aeruginosa PA01
aucaggucgccagcgccu

SEQ ID NO: 3433975 - RNA, 15 nt, Pseudomonas aeruginosa PA01
aucaggucgcgcgcc

SEQ ID NO: 3433976 - RNA, 15 nt, Pseudomonas aeruginosa PA01
aucaggucggccgcc

SEQ ID NO: 3433977 - RNA, 16 nt, Pseudomonas aeruginosa PA01
aucaggucggccgccu

SEQ ID NO: 3433978 - RNA, 20 nt, Pseudomonas aeruginosa PA01
aucaggucggucuggcggcc

SEQ ID NO: 3433979 - RNA, 17 nt, Pseudomonas aeruginosa PA01
aucaggugcaggaacag

SEQ ID NO: 3433980 - RNA, 13 nt, Pseudomonas aeruginosa PA01
aucaguaccggca

SEQ ID NO: 3433981 - RNA, 17 nt, Pseudomonas aeruginosa PA01
aucaguacucuggccau

SEQ ID NO: 3433982 - RNA, 15 nt, Pseudomonas aeruginosa PA01
aucagucgcugcucg

SEQ ID NO: 3433983 - RNA, 22 nt, Pseudomonas aeruginosa PA01
aucaguggucgcagcuccagcg

SEQ ID NO: 3433984 - RNA, 16 nt, Pseudomonas aeruginosa PA01
aucaguugcgcgcggg

SEQ ID NO: 3433985 - RNA, 23 nt, Pseudomonas aeruginosa PA01
aucauccagcccccaugaaaaag

SEQ ID NO: 3433986 - RNA, 13 nt, Pseudomonas aeruginosa PA01
aucaucgccagcg

SEQ ID NO: 3433987 - RNA, 14 nt, Pseudomonas aeruginosa PA01
aucaucgccagcgg

SEQ ID NO: 3433988 - RNA, 17 nt, Pseudomonas aeruginosa PA01
aucaucggcccugggcg

SEQ ID NO: 3433989 - RNA, 15 nt, Pseudomonas aeruginosa PA01
aucaucggcuggccg

SEQ ID NO: 3433990 - RNA, 13 nt, Pseudomonas aeruginosa PA01
aucaucugggcca

SEQ ID NO: 3433991 - RNA, 13 nt, Pseudomonas aeruginosa PA01
aucaugcgccccg

SEQ ID NO: 3433992 - RNA, 15 nt, Pseudomonas aeruginosa PA01
aucaugggugaagac

SEQ ID NO: 3433993 - RNA, 17 nt, Pseudomonas aeruginosa PA01
aucaugggugaagacca

SEQ ID NO: 3433994 - RNA, 16 nt, Pseudomonas aeruginosa PA01
auccaagagagcgcca

SEQ ID NO: 3433995 - RNA, 23 nt, Pseudomonas aeruginosa PA01
auccacagcagguugcuggcgag

SEQ ID NO: 3433996 - RNA, 13 nt, Pseudomonas aeruginosa PA01
auccaccagcacg

SEQ ID NO: 3433997 - RNA, 13 nt, Pseudomonas aeruginosa PA01
auccaccgccagg

SEQ ID NO: 3433998 - RNA, 22 nt, Pseudomonas aeruginosa PA01
auccaccgucgcggucaucgcc

SEQ ID NO: 3433999 - RNA, 13 nt, Pseudomonas aeruginosa PA01
auccaccucgccc

SEQ ID NO: 3434000 - RNA, 15 nt, Pseudomonas aeruginosa PA01
auccaccuugccgcg

SEQ ID NO: 3434001 - RNA, 20 nt, Pseudomonas aeruginosa PA01
auccacgcugugcggcagca

SEQ ID NO: 3434002 - RNA, 16 nt, Pseudomonas aeruginosa PA01
auccacuugccgccgc

SEQ ID NO: 3434003 - RNA, 21 nt, Pseudomonas aeruginosa PA01
auccacuugccgccgccggag

SEQ ID NO: 3434004 - RNA, 16 nt, Pseudomonas aeruginosa PA01
auccagaagaucagcg

SEQ ID NO: 3434005 - RNA, 15 nt, Pseudomonas aeruginosa PA01
auccagcacccgcac

SEQ ID NO: 3434006 - RNA, 14 nt, Pseudomonas aeruginosa PA01
auccagcaccgcuu

SEQ ID NO: 3434007 - RNA, 19 nt, Pseudomonas aeruginosa PA01
auccagccaggcgcucucg

SEQ ID NO: 3434008 - RNA, 21 nt, Pseudomonas aeruginosa PA01
auccagccaggcgcucucgcc

SEQ ID NO: 3434009 - RNA, 22 nt, Pseudomonas aeruginosa PA01
auccagccaggcgcucucgccg

SEQ ID NO: 3434010 - RNA, 13 nt, Pseudomonas aeruginosa PA01
auccagcccugga

SEQ ID NO: 3434011 - RNA, 20 nt, Pseudomonas aeruginosa PA01
auccagccggcauccagcau

SEQ ID NO: 3434012 - RNA, 12 nt, Pseudomonas aeruginosa PA01
auccagcgccug

SEQ ID NO: 3434013 - RNA, 15 nt, Pseudomonas aeruginosa PA01
auccagcggacgcuu

SEQ ID NO: 3434014 - RNA, 12 nt, Pseudomonas aeruginosa PA01
auccagcggcag

SEQ ID NO: 3434015 - RNA, 13 nt, Pseudomonas aeruginosa PA01
auccaggcguggg

SEQ ID NO: 3434016 - RNA, 17 nt, Pseudomonas aeruginosa PA01
auccagggccaggauga

SEQ ID NO: 3434017 - RNA, 14 nt, Pseudomonas aeruginosa PA01
auccagggccgagc

SEQ ID NO: 3434018 - RNA, 15 nt, Pseudomonas aeruginosa PA01
auccagggccgagca

SEQ ID NO: 3434019 - RNA, 23 nt, Pseudomonas aeruginosa PA01
auccaggugcgcggcaggaccca

SEQ ID NO: 3434020 - RNA, 23 nt, Pseudomonas aeruginosa PA01
auccagguucgcguggcccggcg

SEQ ID NO: 3434021 - RNA, 16 nt, Pseudomonas aeruginosa PA01
auccagucggcgcugg

SEQ ID NO: 3434022 - RNA, 18 nt, Pseudomonas aeruginosa PA01
auccagucuucgccggcc

SEQ ID NO: 3434023 - RNA, 13 nt, Pseudomonas aeruginosa PA01
auccaguuccugc

SEQ ID NO: 3434024 - RNA, 16 nt, Pseudomonas aeruginosa PA01
auccauaucggccacc

SEQ ID NO: 3434025 - RNA, 11 nt, Pseudomonas aeruginosa PA01
aucccagcucg

SEQ ID NO: 3434026 - RNA, 14 nt, Pseudomonas aeruginosa PA01
aucccaggucggcg

SEQ ID NO: 3434027 - RNA, 15 nt, Pseudomonas aeruginosa PA01
aucccaggucggcgg

SEQ ID NO: 3434028 - RNA, 23 nt, Pseudomonas aeruginosa PA01
aucccaggucggcgggcaccgcc

SEQ ID NO: 3434029 - RNA, 17 nt, Pseudomonas aeruginosa PA01
auccccaacccggccag

SEQ ID NO: 3434030 - RNA, 19 nt, Pseudomonas aeruginosa PA01
auccccccacccgucccgc

SEQ ID NO: 3434031 - RNA, 14 nt, Pseudomonas aeruginosa PA01
auccccccgcgaag

SEQ ID NO: 3434032 - RNA, 11 nt, Pseudomonas aeruginosa PA01
aucccccgccc

SEQ ID NO: 3434033 - RNA, 13 nt, Pseudomonas aeruginosa PA01
auccccgccucga

SEQ ID NO: 3434034 - RNA, 16 nt, Pseudomonas aeruginosa PA01
auccccgccucgacca

SEQ ID NO: 3434035 - RNA, 21 nt, Pseudomonas aeruginosa PA01
auccccgccucgaccagcgcc

SEQ ID NO: 3434036 - RNA, 19 nt, Pseudomonas aeruginosa PA01
auccccggaccagggcgcc

SEQ ID NO: 3434037 - RNA, 19 nt, Pseudomonas aeruginosa PA01
aucccgacgcccuccagca

SEQ ID NO: 3434038 - RNA, 20 nt, Pseudomonas aeruginosa PA01
aucccgacgcccuccagcac

SEQ ID NO: 3434039 - RNA, 20 nt, Pseudomonas aeruginosa PA01
aucccgcccggucucagccg

SEQ ID NO: 3434040 - RNA, 23 nt, Pseudomonas aeruginosa PA01
aucccgcccggucucagccggcg

SEQ ID NO: 3434041 - RNA, 16 nt, Pseudomonas aeruginosa PA01
aucccgccgccgcgcc

SEQ ID NO: 3434042 - RNA, 17 nt, Pseudomonas aeruginosa PA01
aucccgccgccgcgccu

SEQ ID NO: 3434043 - RNA, 15 nt, Pseudomonas aeruginosa PA01
aucccggagaucggc

SEQ ID NO: 3434044 - RNA, 18 nt, Pseudomonas aeruginosa PA01
aucccggauucgccgagg

SEQ ID NO: 3434045 - RNA, 13 nt, Pseudomonas aeruginosa PA01
auccugccgccug

SEQ ID NO: 3434046 - RNA, 13 nt, Pseudomonas aeruginosa PA01
auccugcgcgccu

SEQ ID NO: 3434047 - RNA, 18 nt, Pseudomonas aeruginosa PA01
auccuggcccuggauauc

SEQ ID NO: 3434048 - RNA, 21 nt, Pseudomonas aeruginosa PA01
auccuggcgaucaggccaagc

SEQ ID NO: 3434049 - RNA, 12 nt, Pseudomonas aeruginosa PA01
auccuggcggca

SEQ ID NO: 3434050 - RNA, 17 nt, Pseudomonas aeruginosa PA01
auccuggucgcguucca

SEQ ID NO: 3434051 - RNA, 16 nt, Pseudomonas aeruginosa PA01
auccuguggcugcagg

SEQ ID NO: 3434052 - RNA, 22 nt, Pseudomonas aeruginosa PA01
auccuucggaggucgagcagag

SEQ ID NO: 3434053 - RNA, 15 nt, Pseudomonas aeruginosa PA01
auccuuggucagggu

SEQ ID NO: 3434054 - RNA, 17 nt, Pseudomonas aeruginosa PA01
aucgaaaaaaggcgccu

SEQ ID NO: 3434055 - RNA, 14 nt, Pseudomonas aeruginosa PA01
aucgaaaugccgca

SEQ ID NO: 3434056 - RNA, 17 nt, Pseudomonas aeruginosa PA01
aucgaacaucucgaagc

SEQ ID NO: 3434057 - RNA, 14 nt, Pseudomonas aeruginosa PA01
aucgaacccccgac

SEQ ID NO: 3434058 - RNA, 15 nt, Pseudomonas aeruginosa PA01
aucgaaggcgccggc

SEQ ID NO: 3434059 - RNA, 16 nt, Pseudomonas aeruginosa PA01
aucgaaggcgccggca

SEQ ID NO: 3434060 - RNA, 13 nt, Pseudomonas aeruginosa PA01
aucgacaauagcg

SEQ ID NO: 3434061 - RNA, 12 nt, Pseudomonas aeruginosa PA01
aucgacagcagc

SEQ ID NO: 3434062 - RNA, 17 nt, Pseudomonas aeruginosa PA01
aucgacagcagcgccag

SEQ ID NO: 3434063 - RNA, 24 nt, Pseudomonas aeruginosa PA01
aucgaccacacaugcaggucgugc

SEQ ID NO: 3434064 - RNA, 17 nt, Pseudomonas aeruginosa PA01
aucgaccagacgcagca

SEQ ID NO: 3434065 - RNA, 22 nt, Pseudomonas aeruginosa PA01
aucgaccaggaauuccuggccg

SEQ ID NO: 3434066 - RNA, 16 nt, Pseudomonas aeruginosa PA01
aucgaccagggccggg

SEQ ID NO: 3434067 - RNA, 14 nt, Pseudomonas aeruginosa PA01
aucgaccaggucgc

SEQ ID NO: 3434068 - RNA, 20 nt, Pseudomonas aeruginosa PA01
aucgacccagccgcacgccc

SEQ ID NO: 3434069 - RNA, 13 nt, Pseudomonas aeruginosa PA01
aucgaccuugccc

SEQ ID NO: 3434070 - RNA, 18 nt, Pseudomonas aeruginosa PA01
aucgacgccgcuggcggc

SEQ ID NO: 3434071 - RNA, 15 nt, Pseudomonas aeruginosa PA01
aucgacgccucggcg

SEQ ID NO: 3434072 - RNA, 21 nt, Pseudomonas aeruginosa PA01
aucgacgccuucguggccgcg

SEQ ID NO: 3434073 - RNA, 20 nt, Pseudomonas aeruginosa PA01
aucgacgguuucaggccuug

SEQ ID NO: 3434074 - RNA, 20 nt, Pseudomonas aeruginosa PA01
aucgagaaauaggcgcugcg

SEQ ID NO: 3434075 - RNA, 17 nt, Pseudomonas aeruginosa PA01
aucgagcaacagcagga

SEQ ID NO: 3434076 - RNA, 11 nt, Pseudomonas aeruginosa PA01
aucgagcagcg

SEQ ID NO: 3434077 - RNA, 20 nt, Pseudomonas aeruginosa PA01
aucgagcaguuccaggcguc

SEQ ID NO: 3434078 - RNA, 13 nt, Pseudomonas aeruginosa PA01
aucgagccagcgc

SEQ ID NO: 3434079 - RNA, 22 nt, Pseudomonas aeruginosa PA01
aucgagcccuugcgcggcgcac

SEQ ID NO: 3434080 - RNA, 22 nt, Pseudomonas aeruginosa PA01
aucgagccgccggggaagcugc

SEQ ID NO: 3434081 - RNA, 19 nt, Pseudomonas aeruginosa PA01
aucgagcgcgcccaggucc

SEQ ID NO: 3434082 - RNA, 23 nt, Pseudomonas aeruginosa PA01
aucgagcggcggccgucgcuggc

SEQ ID NO: 3434083 - RNA, 15 nt, Pseudomonas aeruginosa PA01
aucgagcugcucgau

SEQ ID NO: 3434084 - RNA, 22 nt, Pseudomonas aeruginosa PA01
aucgagcuguccaucucgccgc

SEQ ID NO: 3434085 - RNA, 23 nt, Pseudomonas aeruginosa PA01
aucgaggaauuccggcagcgacu

SEQ ID NO: 3434086 - RNA, 19 nt, Pseudomonas aeruginosa PA01
aucgaggccaggccgagcg

SEQ ID NO: 3434087 - RNA, 14 nt, Pseudomonas aeruginosa PA01
aucgaggccauccc

SEQ ID NO: 3434088 - RNA, 20 nt, Pseudomonas aeruginosa PA01
aucgaggccauccccgaggc

SEQ ID NO: 3434089 - RNA, 16 nt, Pseudomonas aeruginosa PA01
aucgaggccgcccagc

SEQ ID NO: 3434090 - RNA, 19 nt, Pseudomonas aeruginosa PA01
aucgaggccgcccagcgca

SEQ ID NO: 3434091 - RNA, 20 nt, Pseudomonas aeruginosa PA01
aucgaggccgcccagcgcag

SEQ ID NO: 3434092 - RNA, 24 nt, Pseudomonas aeruginosa PA01
aucgaggccgcccagcgcagccug

SEQ ID NO: 3434093 - RNA, 13 nt, Pseudomonas aeruginosa PA01
aucgaggccggca

SEQ ID NO: 3434094 - RNA, 22 nt, Pseudomonas aeruginosa PA01
aucgaggccuacccgcgcuucu

SEQ ID NO: 3434095 - RNA, 16 nt, Pseudomonas aeruginosa PA01
aucgaggcgucggcgg

SEQ ID NO: 3434096 - RNA, 19 nt, Pseudomonas aeruginosa PA01
aucgagucgccggcgaacu

SEQ ID NO: 3434097 - RNA, 19 nt, Pseudomonas aeruginosa PA01
aucgauaacaccaggagcg

SEQ ID NO: 3434098 - RNA, 13 nt, Pseudomonas aeruginosa PA01
aucgaucacugcc

SEQ ID NO: 3434099 - RNA, 24 nt, Pseudomonas aeruginosa PA01
aucgaucacugccuggcagguccg

SEQ ID NO: 3434100 - RNA, 16 nt, Pseudomonas aeruginosa PA01
aucgaucacuucaccu

SEQ ID NO: 3434101 - RNA, 12 nt, Pseudomonas aeruginosa PA01
aucgaucagcag

SEQ ID NO: 3434102 - RNA, 13 nt, Pseudomonas aeruginosa PA01
aucgaucggcugg

SEQ ID NO: 3434103 - RNA, 11 nt, Pseudomonas aeruginosa PA01
aucgaucucga

SEQ ID NO: 3434104 - RNA, 21 nt, Pseudomonas aeruginosa PA01
aucgaucucgaucgagucgcc

SEQ ID NO: 3434105 - RNA, 15 nt, Pseudomonas aeruginosa PA01
aucgaucucgucggc

SEQ ID NO: 3434106 - RNA, 15 nt, Pseudomonas aeruginosa PA01
aucgaugaugaucgc

SEQ ID NO: 3434107 - RNA, 18 nt, Pseudomonas aeruginosa PA01
aucgaugcucauccugcc

SEQ ID NO: 3434108 - RNA, 21 nt, Pseudomonas aeruginosa PA01
aucgauggucacuggcgaggc

SEQ ID NO: 3434109 - RNA, 15 nt, Pseudomonas aeruginosa PA01
aucgcaagauuauca

SEQ ID NO: 3434110 - RNA, 11 nt, Pseudomonas aeruginosa PA01
aucgcacggcg

SEQ ID NO: 3434111 - RNA, 18 nt, Pseudomonas aeruginosa PA01
aucgcacggucguccugc

SEQ ID NO: 3434112 - RNA, 21 nt, Pseudomonas aeruginosa PA01
aucgcacggucguccugcgga

SEQ ID NO: 3434113 - RNA, 15 nt, Pseudomonas aeruginosa PA01
aucgcacuucgucac

SEQ ID NO: 3434114 - RNA, 18 nt, Pseudomonas aeruginosa PA01
aucgcacuucgucacugu

SEQ ID NO: 3434115 - RNA, 13 nt, Pseudomonas aeruginosa PA01
aucgcagcgcggu

SEQ ID NO: 3434116 - RNA, 14 nt, Pseudomonas aeruginosa PA01
aucgcagcgcgguc

SEQ ID NO: 3434117 - RNA, 13 nt, Pseudomonas aeruginosa PA01
aucgcaggccagg

SEQ ID NO: 3434118 - RNA, 14 nt, Pseudomonas aeruginosa PA01
aucgcaggccaggc

SEQ ID NO: 3434119 - RNA, 16 nt, Pseudomonas aeruginosa PA01
aucgcaggccaggccc

SEQ ID NO: 3434120 - RNA, 22 nt, Pseudomonas aeruginosa PA01
aucgcaggccaggccccagggc

SEQ ID NO: 3434121 - RNA, 14 nt, Pseudomonas aeruginosa PA01
aucgcauagccggc

SEQ ID NO: 3434122 - RNA, 17 nt, Pseudomonas aeruginosa PA01
aucgcauagccggcgcg

SEQ ID NO: 3434123 - RNA, 21 nt, Pseudomonas aeruginosa PA01
aucgcauagccggcgcgcccg

SEQ ID NO: 3434124 - RNA, 22 nt, Pseudomonas aeruginosa PA01
aucgcauagccggcgcgcccgg

SEQ ID NO: 3434125 - RNA, 23 nt, Pseudomonas aeruginosa PA01
aucgcauaggugggaacgaaacg

SEQ ID NO: 3434126 - RNA, 16 nt, Pseudomonas aeruginosa PA01
aucgcaucggcgaccu

SEQ ID NO: 3434127 - RNA, 15 nt, Pseudomonas aeruginosa PA01
aucgcaucgguggug

SEQ ID NO: 3434128 - RNA, 15 nt, Pseudomonas aeruginosa PA01
aucgcauuguugcgg

SEQ ID NO: 3434129 - RNA, 20 nt, Pseudomonas aeruginosa PA01
aucgccaaccaguagggggu

SEQ ID NO: 3434130 - RNA, 13 nt, Pseudomonas aeruginosa PA01
aucgccaacgcca

SEQ ID NO: 3434131 - RNA, 16 nt, Pseudomonas aeruginosa PA01
aucgccaccccgccgc

SEQ ID NO: 3434132 - RNA, 21 nt, Pseudomonas aeruginosa PA01
aucgccaccccgccgcuggcg

SEQ ID NO: 3434133 - RNA, 22 nt, Pseudomonas aeruginosa PA01
aucgccaccccgccgcuggcgg

SEQ ID NO: 3434134 - RNA, 24 nt, Pseudomonas aeruginosa PA01
aucgccaccccgccgcuggcggca

SEQ ID NO: 3434135 - RNA, 23 nt, Pseudomonas aeruginosa PA01
aucgccaccgcggauccacgccu

SEQ ID NO: 3434136 - RNA, 20 nt, Pseudomonas aeruginosa PA01
aucgccaccgguacgcucac

SEQ ID NO: 3434137 - RNA, 21 nt, Pseudomonas aeruginosa PA01
aucgccaccgguacgcucacc

SEQ ID NO: 3434138 - RNA, 15 nt, Pseudomonas aeruginosa PA01
aucgccacgccggcg

SEQ ID NO: 3434139 - RNA, 20 nt, Pseudomonas aeruginosa PA01
aucgccagcccguagucguu

SEQ ID NO: 3434140 - RNA, 12 nt, Pseudomonas aeruginosa PA01
aucgccagcgcc

SEQ ID NO: 3434141 - RNA, 15 nt, Pseudomonas aeruginosa PA01
aucgccagcgccagc

SEQ ID NO: 3434142 - RNA, 13 nt, Pseudomonas aeruginosa PA01
aucgccagcggcg

SEQ ID NO: 3434143 - RNA, 15 nt, Pseudomonas aeruginosa PA01
aucgccagcgguacc

SEQ ID NO: 3434144 - RNA, 18 nt, Pseudomonas aeruginosa PA01
aucgccagcgguacccgc

SEQ ID NO: 3434145 - RNA, 23 nt, Pseudomonas aeruginosa PA01
aucgccagcgguacccgccggcc

SEQ ID NO: 3434146 - RNA, 16 nt, Pseudomonas aeruginosa PA01
aucgccagcucgccgc

SEQ ID NO: 3434147 - RNA, 17 nt, Pseudomonas aeruginosa PA01
aucgccagcucgccgcg

SEQ ID NO: 3434148 - RNA, 18 nt, Pseudomonas aeruginosa PA01
aucgcguagguggcgccg

SEQ ID NO: 3434149 - RNA, 15 nt, Pseudomonas aeruginosa PA01
aucgcgucgcaggcg

SEQ ID NO: 3434150 - RNA, 16 nt, Pseudomonas aeruginosa PA01
aucgcgucgcaggcga

SEQ ID NO: 3434151 - RNA, 20 nt, Pseudomonas aeruginosa PA01
aucgcgucgcaggcgaugcc

SEQ ID NO: 3434152 - RNA, 13 nt, Pseudomonas aeruginosa PA01
aucgcgucgccga

SEQ ID NO: 3434153 - RNA, 14 nt, Pseudomonas aeruginosa PA01
aucgcgucgccgaa

SEQ ID NO: 3434154 - RNA, 15 nt, Pseudomonas aeruginosa PA01
aucgcgucgccgaac

SEQ ID NO: 3434155 - RNA, 16 nt, Pseudomonas aeruginosa PA01
aucgcgucgccgaacu

SEQ ID NO: 3434156 - RNA, 17 nt, Pseudomonas aeruginosa PA01
aucgcgugggccaccau

SEQ ID NO: 3434157 - RNA, 17 nt, Pseudomonas aeruginosa PA01
aucgcucaacggcgugc

SEQ ID NO: 3434158 - RNA, 22 nt, Pseudomonas aeruginosa PA01
aucgcucaacggcgugccgggc

SEQ ID NO: 3434159 - RNA, 12 nt, Pseudomonas aeruginosa PA01
aucgcucaccgg

SEQ ID NO: 3434160 - RNA, 21 nt, Pseudomonas aeruginosa PA01
aucgcucaugugggcuaccgc

SEQ ID NO: 3434161 - RNA, 22 nt, Pseudomonas aeruginosa PA01
aucgcucaugugggcuaccgca

SEQ ID NO: 3434162 - RNA, 21 nt, Pseudomonas aeruginosa PA01
aucgcugaccucgagcuggac

SEQ ID NO: 3434163 - RNA, 17 nt, Pseudomonas aeruginosa PA01
aucgcugccggucaggc

SEQ ID NO: 3434164 - RNA, 20 nt, Pseudomonas aeruginosa PA01
aucgcuggcgcagccgcugc

SEQ ID NO: 3434165 - RNA, 21 nt, Pseudomonas aeruginosa PA01
aucgcuggcgcagccgcugcu

SEQ ID NO: 3434166 - RNA, 12 nt, Pseudomonas aeruginosa PA01
aucgcuggcgcc

SEQ ID NO: 3434167 - RNA, 13 nt, Pseudomonas aeruginosa PA01
aucgcuggcgccc

SEQ ID NO: 3434168 - RNA, 21 nt, Pseudomonas aeruginosa PA01
aucgcugggcgccucgucgac

SEQ ID NO: 3434169 - RNA, 13 nt, Pseudomonas aeruginosa PA01
aucgcugucgccc

SEQ ID NO: 3434170 - RNA, 23 nt, Pseudomonas aeruginosa PA01
aucgcuuucaggcgcucgucgag

SEQ ID NO: 3434171 - RNA, 19 nt, Pseudomonas aeruginosa PA01
aucgcuuuccuggccgacc

SEQ ID NO: 3434172 - RNA, 17 nt, Pseudomonas aeruginosa PA01
aucggaagaugguuuga

SEQ ID NO: 3434173 - RNA, 15 nt, Pseudomonas aeruginosa PA01
aucggacagguuggc

SEQ ID NO: 3434174 - RNA, 23 nt, Pseudomonas aeruginosa PA01
aucggagagacccgccagcggca

SEQ ID NO: 3434175 - RNA, 17 nt, Pseudomonas aeruginosa PA01
aucggcaacgagcagga

SEQ ID NO: 3434176 - RNA, 20 nt, Pseudomonas aeruginosa PA01
aucggcaacuggcuggccug

SEQ ID NO: 3434177 - RNA, 20 nt, Pseudomonas aeruginosa PA01
aucggcaccaucaccgacag

SEQ ID NO: 3434178 - RNA, 20 nt, Pseudomonas aeruginosa PA01
aucggcagccguccgcccag

SEQ ID NO: 3434179 - RNA, 14 nt, Pseudomonas aeruginosa PA01
aucggcagcucgcu

SEQ ID NO: 3434180 - RNA, 14 nt, Pseudomonas aeruginosa PA01
aucggcaggcugca

SEQ ID NO: 3434181 - RNA, 20 nt, Pseudomonas aeruginosa PA01
aucggcaggcugcaucggcu

SEQ ID NO: 3434182 - RNA, 14 nt, Pseudomonas aeruginosa PA01
aucggcagggcgcc

SEQ ID NO: 3434183 - RNA, 20 nt, Pseudomonas aeruginosa PA01
aucggcagggcgccgaccag

SEQ ID NO: 3434184 - RNA, 16 nt, Pseudomonas aeruginosa PA01
aucggcauggccacgc

SEQ ID NO: 3434185 - RNA, 19 nt, Pseudomonas aeruginosa PA01
aucggccaacugagcggcg

SEQ ID NO: 3434186 - RNA, 20 nt, Pseudomonas aeruginosa PA01
aucggccaccgaaucgaugc

SEQ ID NO: 3434187 - RNA, 17 nt, Pseudomonas aeruginosa PA01
aucggccaccuucgccc

SEQ ID NO: 3434188 - RNA, 19 nt, Pseudomonas aeruginosa PA01
aucggccaccuucgcccgc

SEQ ID NO: 3434189 - RNA, 19 nt, Pseudomonas aeruginosa PA01
aucggccacuaucgccaac

SEQ ID NO: 3434190 - RNA, 23 nt, Pseudomonas aeruginosa PA01
aucggccaguccggucagcagca

SEQ ID NO: 3434191 - RNA, 16 nt, Pseudomonas aeruginosa PA01
aucggccauggccgag

SEQ ID NO: 3434192 - RNA, 22 nt, Pseudomonas aeruginosa PA01
aucggccauucggccuggcagu

SEQ ID NO: 3434193 - RNA, 15 nt, Pseudomonas aeruginosa PA01
aucggccccaccgca

SEQ ID NO: 3434194 - RNA, 13 nt, Pseudomonas aeruginosa PA01
aucggccccaccu

SEQ ID NO: 3434195 - RNA, 15 nt, Pseudomonas aeruginosa PA01
aucggccccaccugg

SEQ ID NO: 3434196 - RNA, 23 nt, Pseudomonas aeruginosa PA01
aucggcccgacgccgcccggcac

SEQ ID NO: 3434197 - RNA, 12 nt, Pseudomonas aeruginosa PA01
aucggcccggcg

SEQ ID NO: 3434198 - RNA, 21 nt, Pseudomonas aeruginosa PA01
aucggcccggcuucgcgggug

SEQ ID NO: 3434199 - RNA, 12 nt, Pseudomonas aeruginosa PA01
aucggcccuggg

SEQ ID NO: 3434200 - RNA, 14 nt, Pseudomonas aeruginosa PA01
aucggcccugggcg

SEQ ID NO: 3434201 - RNA, 15 nt, Pseudomonas aeruginosa PA01
aucggcccuucgaca

SEQ ID NO: 3434202 - RNA, 16 nt, Pseudomonas aeruginosa PA01
aucggccgacagagcg

SEQ ID NO: 3434203 - RNA, 21 nt, Pseudomonas aeruginosa PA01
aucggccgacagagcggccgg

SEQ ID NO: 3434204 - RNA, 15 nt, Pseudomonas aeruginosa PA01
aucggccgccaggcu

SEQ ID NO: 3434205 - RNA, 14 nt, Pseudomonas aeruginosa PA01
aucggccgccagug

SEQ ID NO: 3434206 - RNA, 21 nt, Pseudomonas aeruginosa PA01
aucggccgggauacagcagcc

SEQ ID NO: 3434207 - RNA, 17 nt, Pseudomonas aeruginosa PA01
aucggccucgcggcgcu

SEQ ID NO: 3434208 - RNA, 21 nt, Pseudomonas aeruginosa PA01
aucggcgaagcggaagcgcag

SEQ ID NO: 3434209 - RNA, 22 nt, Pseudomonas aeruginosa PA01
aucggcgagccgcagcggcucg

SEQ ID NO: 3434210 - RNA, 15 nt, Pseudomonas aeruginosa PA01
aucggcgaucgggua

SEQ ID NO: 3434211 - RNA, 15 nt, Pseudomonas aeruginosa PA01
aucggcgauggccau

SEQ ID NO: 3434212 - RNA, 22 nt, Pseudomonas aeruginosa PA01
aucggcgccgcgcaccugggcg

SEQ ID NO: 3434213 - RNA, 21 nt, Pseudomonas aeruginosa PA01
aucggcgccggccuccagcgc

SEQ ID NO: 3434214 - RNA, 18 nt, Pseudomonas aeruginosa PA01
aucggcgcgcagggccag

SEQ ID NO: 3434215 - RNA, 19 nt, Pseudomonas aeruginosa PA01
aucggcgcgcagggccagc

SEQ ID NO: 3434216 - RNA, 22 nt, Pseudomonas aeruginosa PA01
aucggcgcgcagggccagcaac

SEQ ID NO: 3434217 - RNA, 19 nt, Pseudomonas aeruginosa PA01
aucggcgcgccgaaggcga

SEQ ID NO: 3434218 - RNA, 15 nt, Pseudomonas aeruginosa PA01
aucggcgcggccuuc

SEQ ID NO: 3434219 - RNA, 16 nt, Pseudomonas aeruginosa PA01
aucggcgcggucgggu

SEQ ID NO: 3434220 - RNA, 17 nt, Pseudomonas aeruginosa PA01
aucggcgcuccgccgaa

SEQ ID NO: 3434221 - RNA, 23 nt, Pseudomonas aeruginosa PA01
aucggcgcuccgccgaacgccac

SEQ ID NO: 3434222 - RNA, 21 nt, Pseudomonas aeruginosa PA01
aucggcggauaacgccgcugg

SEQ ID NO: 3434223 - RNA, 18 nt, Pseudomonas aeruginosa PA01
aucggcggauaacgccgg

SEQ ID NO: 3434224 - RNA, 17 nt, Pseudomonas aeruginosa PA01
aucggcggcaggccgau

SEQ ID NO: 3434225 - RNA, 22 nt, Pseudomonas aeruginosa PA01
aucggcggcgcggcguacucca

SEQ ID NO: 3434226 - RNA, 11 nt, Pseudomonas aeruginosa PA01
aucggcggcgg

SEQ ID NO: 3434227 - RNA, 14 nt, Pseudomonas aeruginosa PA01
aucggcggcggccc

SEQ ID NO: 3434228 - RNA, 18 nt, Pseudomonas aeruginosa PA01
aucggcggcggcccgcac

SEQ ID NO: 3434229 - RNA, 23 nt, Pseudomonas aeruginosa PA01
aucggcggugccauggaucacca

SEQ ID NO: 3434230 - RNA, 13 nt, Pseudomonas aeruginosa PA01
aucggcguccugg

SEQ ID NO: 3434231 - RNA, 15 nt, Pseudomonas aeruginosa PA01
aucggcgucggcugg

SEQ ID NO: 3434232 - RNA, 12 nt, Pseudomonas aeruginosa PA01
aucggcguggcg

SEQ ID NO: 3434233 - RNA, 22 nt, Pseudomonas aeruginosa PA01
aucggcguguucaggugcugga

SEQ ID NO: 3434234 - RNA, 14 nt, Pseudomonas aeruginosa PA01
aucggcuccagcuu

SEQ ID NO: 3434235 - RNA, 22 nt, Pseudomonas aeruginosa PA01
aucggcuccucugccugcgccc

SEQ ID NO: 3434236 - RNA, 14 nt, Pseudomonas aeruginosa PA01
aucggcuugccggc

SEQ ID NO: 3434237 - RNA, 17 nt, Pseudomonas aeruginosa PA01
aucggcuugccggcggc

SEQ ID NO: 3434238 - RNA, 18 nt, Pseudomonas aeruginosa PA01
aucggcuugccggcggcg

SEQ ID NO: 3434239 - RNA, 13 nt, Pseudomonas aeruginosa PA01
aucgggauaccgg

SEQ ID NO: 3434240 - RNA, 18 nt, Pseudomonas aeruginosa PA01
aucggguaguaguggaag

SEQ ID NO: 3434241 - RNA, 13 nt, Pseudomonas aeruginosa PA01
aucgggugggaca

SEQ ID NO: 3434242 - RNA, 16 nt, Pseudomonas aeruginosa PA01
aucgguaggcucugcu

SEQ ID NO: 3434243 - RNA, 17 nt, Pseudomonas aeruginosa PA01
aucggucaccgugguca

SEQ ID NO: 3434244 - RNA, 17 nt, Pseudomonas aeruginosa PA01
aucgguccccuccaggu

SEQ ID NO: 3434245 - RNA, 12 nt, Pseudomonas aeruginosa PA01
aucggucgcccu

SEQ ID NO: 3434246 - RNA, 15 nt, Pseudomonas aeruginosa PA01
aucggucgcgccccc

SEQ ID NO: 3434247 - RNA, 20 nt, Pseudomonas aeruginosa PA01
aucggucgugaucuucgagu

SEQ ID NO: 3434248 - RNA, 23 nt, Pseudomonas aeruginosa PA01
aucggugccggcaggccuucgac

SEQ ID NO: 3434249 - RNA, 23 nt, Pseudomonas aeruginosa PA01
aucgguggugugauccugcuggu

SEQ ID NO: 3434250 - RNA, 16 nt, Pseudomonas aeruginosa PA01
aucugggccaucguca

SEQ ID NO: 3434251 - RNA, 21 nt, Pseudomonas aeruginosa PA01
aucuggguccuggugaucauc

SEQ ID NO: 3434252 - RNA, 18 nt, Pseudomonas aeruginosa PA01
aucugguagaccaccgug

SEQ ID NO: 3434253 - RNA, 17 nt, Pseudomonas aeruginosa PA01
aucugguggaacagcau

SEQ ID NO: 3434254 - RNA, 19 nt, Pseudomonas aeruginosa PA01
aucugguggaacagcauca

SEQ ID NO: 3434255 - RNA, 17 nt, Pseudomonas aeruginosa PA01
aucugguugaacugcgg

SEQ ID NO: 3434256 - RNA, 20 nt, Pseudomonas aeruginosa PA01
aucugucgauaccagcgccg

SEQ ID NO: 3434257 - RNA, 23 nt, Pseudomonas aeruginosa PA01
aucugucgauaccagcgccgcuc

SEQ ID NO: 3434258 - RNA, 16 nt, Pseudomonas aeruginosa PA01
aucugucgcagcgggc

SEQ ID NO: 3434259 - RNA, 20 nt, Pseudomonas aeruginosa PA01
aucugugcggugccgcgcag

SEQ ID NO: 3434260 - RNA, 19 nt, Pseudomonas aeruginosa PA01
aucuguucgaccaguugcc

SEQ ID NO: 3434261 - RNA, 21 nt, Pseudomonas aeruginosa PA01
aucuguuucaacucccaggac

SEQ ID NO: 3434262 - RNA, 13 nt, Pseudomonas aeruginosa PA01
aucuucagcagca

SEQ ID NO: 3434263 - RNA, 19 nt, Pseudomonas aeruginosa PA01
aucuucagcaucaggucgg

SEQ ID NO: 3434264 - RNA, 20 nt, Pseudomonas aeruginosa PA01
aucuucgccuccuucaucuu

SEQ ID NO: 3434265 - RNA, 16 nt, Pseudomonas aeruginosa PA01
aucuucggcgcccacu

SEQ ID NO: 3434266 - RNA, 22 nt, Pseudomonas aeruginosa PA01
aucuucguaggucaugcgugcg

SEQ ID NO: 3434267 - RNA, 23 nt, Pseudomonas aeruginosa PA01
aucuucguaggucaugcgugcgg

SEQ ID NO: 3434268 - RNA, 14 nt, Pseudomonas aeruginosa PA01
aucuucuaccuggc

SEQ ID NO: 3434269 - RNA, 17 nt, Pseudomonas aeruginosa PA01
aucuucucgaagcgcgc

SEQ ID NO: 3434270 - RNA, 17 nt, Pseudomonas aeruginosa PA01
aucuugaucgccagcgg

SEQ ID NO: 3434271 - RNA, 16 nt, Pseudomonas aeruginosa PA01
aucuugaucugcaugc

SEQ ID NO: 3434272 - RNA, 16 nt, Pseudomonas aeruginosa PA01
aucuugcgcccggcgc

SEQ ID NO: 3434273 - RNA, 12 nt, Pseudomonas aeruginosa PA01
aucuuggcccau

SEQ ID NO: 3434274 - RNA, 13 nt, Pseudomonas aeruginosa PA01
aucuuuuccugcu

SEQ ID NO: 3434275 - RNA, 16 nt, Pseudomonas aeruginosa PA01
augaaaaacgccggcg

SEQ ID NO: 3434276 - RNA, 14 nt, Pseudomonas aeruginosa PA01
augaaaaagccgga

SEQ ID NO: 3434277 - RNA, 16 nt, Pseudomonas aeruginosa PA01
augaaaaagggaugcc

SEQ ID NO: 3434278 - RNA, 21 nt, Pseudomonas aeruginosa PA01
augaaaaagggaugccgccgg

SEQ ID NO: 3434279 - RNA, 19 nt, Pseudomonas aeruginosa PA01
augaaaaagggaugccggc

SEQ ID NO: 3434280 - RNA, 19 nt, Pseudomonas aeruginosa PA01
augaacagugcgcccgugg

SEQ ID NO: 3434281 - RNA, 19 nt, Pseudomonas aeruginosa PA01
augaacgcccugacccgca

SEQ ID NO: 3434282 - RNA, 20 nt, Pseudomonas aeruginosa PA01
augaacuggucgcuccagcc

SEQ ID NO: 3434283 - RNA, 22 nt, Pseudomonas aeruginosa PA01
augaacuggucgcuccagcccc

SEQ ID NO: 3434284 - RNA, 21 nt, Pseudomonas aeruginosa PA01
augaagcccgcggcaucggcc

SEQ ID NO: 3434285 - RNA, 22 nt, Pseudomonas aeruginosa PA01
augaagcuuuuccagcgcaccg

SEQ ID NO: 3434286 - RNA, 19 nt, Pseudomonas aeruginosa PA01
augaaggaaaccggccagc

SEQ ID NO: 3434287 - RNA, 16 nt, Pseudomonas aeruginosa PA01
augaauguggugucgc

SEQ ID NO: 3434288 - RNA, 19 nt, Pseudomonas aeruginosa PA01
augaccacgucgcgaccgg

SEQ ID NO: 3434289 - RNA, 17 nt, Pseudomonas aeruginosa PA01
augaccagagccgccga

SEQ ID NO: 3434290 - RNA, 23 nt, Pseudomonas aeruginosa PA01
augaccaggcugaucagcccgcu

SEQ ID NO: 3434291 - RNA, 17 nt, Pseudomonas aeruginosa PA01
augaccaggguggcggc

SEQ ID NO: 3434292 - RNA, 19 nt, Pseudomonas aeruginosa PA01
augaccaggguggcggcgg

SEQ ID NO: 3434293 - RNA, 12 nt, Pseudomonas aeruginosa PA01
augaccgagcau

SEQ ID NO: 3434294 - RNA, 18 nt, Pseudomonas aeruginosa PA01
augaccgauggcgccgcg

SEQ ID NO: 3434295 - RNA, 15 nt, Pseudomonas aeruginosa PA01
augaccgccccggca

SEQ ID NO: 3434296 - RNA, 15 nt, Pseudomonas aeruginosa PA01
augaccgucagccag

SEQ ID NO: 3434297 - RNA, 18 nt, Pseudomonas aeruginosa PA01
augaccgucagccaggcu

SEQ ID NO: 3434298 - RNA, 19 nt, Pseudomonas aeruginosa PA01
augaccguccacggcgcgu

SEQ ID NO: 3434299 - RNA, 23 nt, Pseudomonas aeruginosa PA01
augaccuucagguagauguccag

SEQ ID NO: 3434300 - RNA, 16 nt, Pseudomonas aeruginosa PA01
augacgaggcccgccc

SEQ ID NO: 3434301 - RNA, 17 nt, Pseudomonas aeruginosa PA01
augacgauaucggcgcc

SEQ ID NO: 3434302 - RNA, 19 nt, Pseudomonas aeruginosa PA01
augacgccauccuucggcg

SEQ ID NO: 3434303 - RNA, 22 nt, Pseudomonas aeruginosa PA01
augacggggaucacucgccgcc

SEQ ID NO: 3434304 - RNA, 14 nt, Pseudomonas aeruginosa PA01
augagcgaugucca

SEQ ID NO: 3434305 - RNA, 18 nt, Pseudomonas aeruginosa PA01
augagcgauguccaggcc

SEQ ID NO: 3434306 - RNA, 16 nt, Pseudomonas aeruginosa PA01
augagcugcucuaccg

SEQ ID NO: 3434307 - RNA, 15 nt, Pseudomonas aeruginosa PA01
augagcuucgccggg

SEQ ID NO: 3434308 - RNA, 20 nt, Pseudomonas aeruginosa PA01
augaggaugcugaucagcac

SEQ ID NO: 3434309 - RNA, 14 nt, Pseudomonas aeruginosa PA01
augaggcgugggga

SEQ ID NO: 3434310 - RNA, 16 nt, Pseudomonas aeruginosa PA01
augaggcuggccagca

SEQ ID NO: 3434311 - RNA, 19 nt, Pseudomonas aeruginosa PA01
augaggcuguccagcaggc

SEQ ID NO: 3434312 - RNA, 22 nt, Pseudomonas aeruginosa PA01
augaggcuguccagcaggcguu

SEQ ID NO: 3434313 - RNA, 16 nt, Pseudomonas aeruginosa PA01
augaguugcagggcuu

SEQ ID NO: 3434314 - RNA, 22 nt, Pseudomonas aeruginosa PA01
augaucaccaggacccagauga

SEQ ID NO: 3434315 - RNA, 14 nt, Pseudomonas aeruginosa PA01
augaucaggccgag

SEQ ID NO: 3434316 - RNA, 15 nt, Pseudomonas aeruginosa PA01
augaucaggccgagc

SEQ ID NO: 3434317 - RNA, 18 nt, Pseudomonas aeruginosa PA01
augauccacuugccgccg

SEQ ID NO: 3434318 - RNA, 21 nt, Pseudomonas aeruginosa PA01
augauccggugcaggccgagc

SEQ ID NO: 3434319 - RNA, 14 nt, Pseudomonas aeruginosa PA01
augaucgagcgcac

SEQ ID NO: 3434320 - RNA, 22 nt, Pseudomonas aeruginosa PA01
augaucgccaccgcguccuuga

SEQ ID NO: 3434321 - RNA, 19 nt, Pseudomonas aeruginosa PA01
augaucgccucggcgcgcg

SEQ ID NO: 3434322 - RNA, 16 nt, Pseudomonas aeruginosa PA01
augaucgguucccgcc

SEQ ID NO: 3434323 - RNA, 20 nt, Pseudomonas aeruginosa PA01
augaucgguucccgcccgcu

SEQ ID NO: 3434324 - RNA, 23 nt, Pseudomonas aeruginosa PA01
augaucgguucccgcccgcucau

SEQ ID NO: 3434325 - RNA, 17 nt, Pseudomonas aeruginosa PA01
augaucuccgcgccggg

SEQ ID NO: 3434326 - RNA, 19 nt, Pseudomonas aeruginosa PA01
augaucugacuaacagguc

SEQ ID NO: 3434327 - RNA, 20 nt, Pseudomonas aeruginosa PA01
augaugacgagggacugaag

SEQ ID NO: 3434328 - RNA, 13 nt, Pseudomonas aeruginosa PA01
augaugccgaggc

SEQ ID NO: 3434329 - RNA, 17 nt, Pseudomonas aeruginosa PA01
augaugccgaggcggcc

SEQ ID NO: 3434330 - RNA, 13 nt, Pseudomonas aeruginosa PA01
augaugccgccgu

SEQ ID NO: 3434331 - RNA, 22 nt, Pseudomonas aeruginosa PA01
augaugccgcggcgauaggcgc

SEQ ID NO: 3434332 - RNA, 17 nt, Pseudomonas aeruginosa PA01
augaugcgcccggagcu

SEQ ID NO: 3434333 - RNA, 18 nt, Pseudomonas aeruginosa PA01
augauggucaacaccagc

SEQ ID NO: 3434334 - RNA, 16 nt, Pseudomonas aeruginosa PA01
augauggugccgccgg

SEQ ID NO: 3434335 - RNA, 17 nt, Pseudomonas aeruginosa PA01
augauggugccgccggg

SEQ ID NO: 3434336 - RNA, 18 nt, Pseudomonas aeruginosa PA01
augaugugcgcaggcugg

SEQ ID NO: 3434337 - RNA, 14 nt, Pseudomonas aeruginosa PA01
augcaaccgcccug

SEQ ID NO: 3434338 - RNA, 22 nt, Pseudomonas aeruginosa PA01
augcaauggauguugccgccgc

SEQ ID NO: 3434339 - RNA, 18 nt, Pseudomonas aeruginosa PA01
augcacacgcucccaaca

SEQ ID NO: 3434340 - RNA, 22 nt, Pseudomonas aeruginosa PA01
augcacaggcguaccagcuugu

SEQ ID NO: 3434341 - RNA, 21 nt, Pseudomonas aeruginosa PA01
augcaccggccacucgcagcc

SEQ ID NO: 3434342 - RNA, 23 nt, Pseudomonas aeruginosa PA01
augcaccuaccaguaguucucca

SEQ ID NO: 3434343 - RNA, 12 nt, Pseudomonas aeruginosa PA01
augcacgcccug

SEQ ID NO: 3434344 - RNA, 20 nt, Pseudomonas aeruginosa PA01
augcacgugcagcucggcac

SEQ ID NO: 3434345 - RNA, 24 nt, Pseudomonas aeruginosa PA01
augcacgugcagcucggcacgcag

SEQ ID NO: 3434346 - RNA, 23 nt, Pseudomonas aeruginosa PA01
augcagcagguagugcucggcca

SEQ ID NO: 3434347 - RNA, 16 nt, Pseudomonas aeruginosa PA01
augcaggccagggcgg

SEQ ID NO: 3434348 - RNA, 19 nt, Pseudomonas aeruginosa PA01
augcaggccagggcgguga

SEQ ID NO: 3434349 - RNA, 19 nt, Pseudomonas aeruginosa PA01
augcaggccgaagcguggg

SEQ ID NO: 3434350 - RNA, 22 nt, Pseudomonas aeruginosa PA01
augcaggccggccuccagcgcc

SEQ ID NO: 3434351 - RNA, 22 nt, Pseudomonas aeruginosa PA01
augcaggcgucgguccagcucc

SEQ ID NO: 3434352 - RNA, 20 nt, Pseudomonas aeruginosa PA01
accggccaggcgguccagcc

SEQ ID NO: 3434353 - RNA, 23 nt, Pseudomonas aeruginosa PA01
accggccaggcgguccagccaga

SEQ ID NO: 3434354 - RNA, 14 nt, Pseudomonas aeruginosa PA01
accggccaucagca

SEQ ID NO: 3434355 - RNA, 17 nt, Pseudomonas aeruginosa PA01
accggccaucagcacca

SEQ ID NO: 3434356 - RNA, 20 nt, Pseudomonas aeruginosa PA01
accggccaucagcaccagga

SEQ ID NO: 3434357 - RNA, 22 nt, Pseudomonas aeruginosa PA01
accggccaucagcaccaggaag

SEQ ID NO: 3434358 - RNA, 20 nt, Pseudomonas aeruginosa PA01
accggccauuacgccgagca

SEQ ID NO: 3434359 - RNA, 14 nt, Pseudomonas aeruginosa PA01
accggccgcagcag

SEQ ID NO: 3434360 - RNA, 17 nt, Pseudomonas aeruginosa PA01
accggccgcagcagguu

SEQ ID NO: 3434361 - RNA, 14 nt, Pseudomonas aeruginosa PA01
accggccucaagca

SEQ ID NO: 3434362 - RNA, 21 nt, Pseudomonas aeruginosa PA01
accggccucaagcaagcgauc

SEQ ID NO: 3434363 - RNA, 23 nt, Pseudomonas aeruginosa PA01
accggccugucacgccggggguc

SEQ ID NO: 3434364 - RNA, 22 nt, Pseudomonas aeruginosa PA01
accggcgaaccagugcaccgcc

SEQ ID NO: 3434365 - RNA, 14 nt, Pseudomonas aeruginosa PA01
accggcgaccaccg

SEQ ID NO: 3434366 - RNA, 14 nt, Pseudomonas aeruginosa PA01
accggcgaugcuca

SEQ ID NO: 3434367 - RNA, 15 nt, Pseudomonas aeruginosa PA01
accggcgccacccuc

SEQ ID NO: 3434368 - RNA, 17 nt, Pseudomonas aeruginosa PA01
accggcgccccugcggc

SEQ ID NO: 3434369 - RNA, 22 nt, Pseudomonas aeruginosa PA01
accggcgccccugcggcgccgg

SEQ ID NO: 3434370 - RNA, 19 nt, Pseudomonas aeruginosa PA01
accggcgccgccuggccgg

SEQ ID NO: 3434371 - RNA, 20 nt, Pseudomonas aeruginosa PA01
accggcgccgccuggccggu

SEQ ID NO: 3434372 - RNA, 13 nt, Pseudomonas aeruginosa PA01
accggcgcgccgg

SEQ ID NO: 3434373 - RNA, 15 nt, Pseudomonas aeruginosa PA01
accggcgcgccggac

SEQ ID NO: 3434374 - RNA, 19 nt, Pseudomonas aeruginosa PA01
accggcgcgccggacaggc

SEQ ID NO: 3434375 - RNA, 16 nt, Pseudomonas aeruginosa PA01
accggcggauaaccgc

SEQ ID NO: 3434376 - RNA, 13 nt, Pseudomonas aeruginosa PA01
accggcggaugac

SEQ ID NO: 3434377 - RNA, 21 nt, Pseudomonas aeruginosa PA01
accggcggauuacuccgccgg

SEQ ID NO: 3434378 - RNA, 20 nt, Pseudomonas aeruginosa PA01
accggcggcgccaggccggc

SEQ ID NO: 3434379 - RNA, 22 nt, Pseudomonas aeruginosa PA01
accggcgggauguacgccaggg

SEQ ID NO: 3434380 - RNA, 14 nt, Pseudomonas aeruginosa PA01
accggcguccacuc

SEQ ID NO: 3434381 - RNA, 21 nt, Pseudomonas aeruginosa PA01
accggcguccacuccggcagc

SEQ ID NO: 3434382 - RNA, 18 nt, Pseudomonas aeruginosa PA01
accggcguccccuuccuc

SEQ ID NO: 3434383 - RNA, 15 nt, Pseudomonas aeruginosa PA01
accggcguccgggug

SEQ ID NO: 3434384 - RNA, 14 nt, Pseudomonas aeruginosa PA01
accggcguccucgg

SEQ ID NO: 3434385 - RNA, 17 nt, Pseudomonas aeruginosa PA01
accggcguccucggaga

SEQ ID NO: 3434386 - RNA, 16 nt, Pseudomonas aeruginosa PA01
accggcguuauccgcc

SEQ ID NO: 3434387 - RNA, 19 nt, Pseudomonas aeruginosa PA01
accggcguuauccgccgau

SEQ ID NO: 3434388 - RNA, 22 nt, Pseudomonas aeruginosa PA01
accggcguugaacugcccgcag

SEQ ID NO: 3434389 - RNA, 14 nt, Pseudomonas aeruginosa PA01
accggcuacaggcc

SEQ ID NO: 3434390 - RNA, 20 nt, Pseudomonas aeruginosa PA01
accggcuaucccccggccga

SEQ ID NO: 3434391 - RNA, 22 nt, Pseudomonas aeruginosa PA01
accggcuaucccccggccgaug

SEQ ID NO: 3434392 - RNA, 18 nt, Pseudomonas aeruginosa PA01
accggcuccagggcgaau

SEQ ID NO: 3434393 - RNA, 14 nt, Pseudomonas aeruginosa PA01
accggcucgucggc

SEQ ID NO: 3434394 - RNA, 16 nt, Pseudomonas aeruginosa PA01
accggcucgucggcgu

SEQ ID NO: 3434395 - RNA, 16 nt, Pseudomonas aeruginosa PA01
accggcucucuucggc

SEQ ID NO: 3434396 - RNA, 21 nt, Pseudomonas aeruginosa PA01
accggcugcauguccgccagu

SEQ ID NO: 3434397 - RNA, 16 nt, Pseudomonas aeruginosa PA01
accggcugcuuggcca

SEQ ID NO: 3434398 - RNA, 19 nt, Pseudomonas aeruginosa PA01
accggcugcuuggccaggu

SEQ ID NO: 3434399 - RNA, 16 nt, Pseudomonas aeruginosa PA01
accggcuggccgcgac

SEQ ID NO: 3434400 - RNA, 13 nt, Pseudomonas aeruginosa PA01
accggcuggcggc

SEQ ID NO: 3434401 - RNA, 15 nt, Pseudomonas aeruginosa PA01
accggcuggcggcuc

SEQ ID NO: 3434402 - RNA, 16 nt, Pseudomonas aeruginosa PA01
accgggaagcaggucu

SEQ ID NO: 3434403 - RNA, 17 nt, Pseudomonas aeruginosa PA01
accgggaagcaggucuc

SEQ ID NO: 3434404 - RNA, 13 nt, Pseudomonas aeruginosa PA01
accgggaggcgcc

SEQ ID NO: 3434405 - RNA, 18 nt, Pseudomonas aeruginosa PA01
accgggaggcgccgcgcc

SEQ ID NO: 3434406 - RNA, 19 nt, Pseudomonas aeruginosa PA01
accgggaggcgccgcgcca

SEQ ID NO: 3434407 - RNA, 23 nt, Pseudomonas aeruginosa PA01
accgggaucagcggcggggccau

SEQ ID NO: 3434408 - RNA, 16 nt, Pseudomonas aeruginosa PA01
accgggaucgcuaccg

SEQ ID NO: 3434409 - RNA, 14 nt, Pseudomonas aeruginosa PA01
accgggaucugccg

SEQ ID NO: 3434410 - RNA, 16 nt, Pseudomonas aeruginosa PA01
accgggaucugccggu

SEQ ID NO: 3434411 - RNA, 20 nt, Pseudomonas aeruginosa PA01
accgggauggucgagggcgc

SEQ ID NO: 3434412 - RNA, 13 nt, Pseudomonas aeruginosa PA01
accgggccaucgc

SEQ ID NO: 3434413 - RNA, 17 nt, Pseudomonas aeruginosa PA01
accgggccgaccugccc

SEQ ID NO: 3434414 - RNA, 16 nt, Pseudomonas aeruginosa PA01
accgggccgccggcga

SEQ ID NO: 3434415 - RNA, 23 nt, Pseudomonas aeruginosa PA01
accgggccgucgggcauggcgau

SEQ ID NO: 3434416 - RNA, 24 nt, Pseudomonas aeruginosa PA01
accgggccgucgggcauggcgauc

SEQ ID NO: 3434417 - RNA, 15 nt, Pseudomonas aeruginosa PA01
accgggcgccucguc

SEQ ID NO: 3434418 - RNA, 17 nt, Pseudomonas aeruginosa PA01
accgggcgccucgucga

SEQ ID NO: 3434419 - RNA, 18 nt, Pseudomonas aeruginosa PA01
accgggcgccucgucgaa

SEQ ID NO: 3434420 - RNA, 17 nt, Pseudomonas aeruginosa PA01
accgggcggcaggcgcc

SEQ ID NO: 3434421 - RNA, 18 nt, Pseudomonas aeruginosa PA01
accgggcggcaggcgccg

SEQ ID NO: 3434422 - RNA, 14 nt, Pseudomonas aeruginosa PA01
accgggcgggucug

SEQ ID NO: 3434423 - RNA, 19 nt, Pseudomonas aeruginosa PA01
accgggcgggucuggcgga

SEQ ID NO: 3434424 - RNA, 18 nt, Pseudomonas aeruginosa PA01
accggguaccugcucgcg

SEQ ID NO: 3434425 - RNA, 16 nt, Pseudomonas aeruginosa PA01
accgguaccacgggca

SEQ ID NO: 3434426 - RNA, 20 nt, Pseudomonas aeruginosa PA01
accgguacgcucaccaccac

SEQ ID NO: 3434427 - RNA, 17 nt, Pseudomonas aeruginosa PA01
accggucaaaccauggc

SEQ ID NO: 3434428 - RNA, 20 nt, Pseudomonas aeruginosa PA01
accggucaaaccauggcgua

SEQ ID NO: 3434429 - RNA, 16 nt, Pseudomonas aeruginosa PA01
accggucccucggggc

SEQ ID NO: 3434430 - RNA, 13 nt, Pseudomonas aeruginosa PA01
accgguccucgcc

SEQ ID NO: 3434431 - RNA, 21 nt, Pseudomonas aeruginosa PA01
accgguccucgcccgucacuu

SEQ ID NO: 3434432 - RNA, 16 nt, Pseudomonas aeruginosa PA01
accggucuuggcgcgc

SEQ ID NO: 3434433 - RNA, 14 nt, Pseudomonas aeruginosa PA01
accgguggacuggu

SEQ ID NO: 3434434 - RNA, 15 nt, Pseudomonas aeruginosa PA01
accgguggacugguu

SEQ ID NO: 3434435 - RNA, 22 nt, Pseudomonas aeruginosa PA01
accgguggcgacgcgcaggccg

SEQ ID NO: 3434436 - RNA, 19 nt, Pseudomonas aeruginosa PA01
accgguuggcuacccgcag

SEQ ID NO: 3434437 - RNA, 18 nt, Pseudomonas aeruginosa PA01
accgguuucccucgagca

SEQ ID NO: 3434438 - RNA, 19 nt, Pseudomonas aeruginosa PA01
accgguuucccucgagcac

SEQ ID NO: 3434439 - RNA, 22 nt, Pseudomonas aeruginosa PA01
accgguuucccucgagcaccgc

SEQ ID NO: 3434440 - RNA, 23 nt, Pseudomonas aeruginosa PA01
accgguuucccucgagcaccgcg

SEQ ID NO: 3434441 - RNA, 15 nt, Pseudomonas aeruginosa PA01
accguaggccaggca

SEQ ID NO: 3434442 - RNA, 19 nt, Pseudomonas aeruginosa PA01
accgucacgcggacccagu

SEQ ID NO: 3434443 - RNA, 22 nt, Pseudomonas aeruginosa PA01
accgucacggcgaaaccggcca

SEQ ID NO: 3434444 - RNA, 23 nt, Pseudomonas aeruginosa PA01
accgucacggcgaaaccggccag

SEQ ID NO: 3434445 - RNA, 13 nt, Pseudomonas aeruginosa PA01
accgucagccagg

SEQ ID NO: 3434446 - RNA, 15 nt, Pseudomonas aeruginosa PA01
accgucagccaggcu

SEQ ID NO: 3434447 - RNA, 18 nt, Pseudomonas aeruginosa PA01
accgucagccaggcuggc

SEQ ID NO: 3434448 - RNA, 16 nt, Pseudomonas aeruginosa PA01
accgucauggugcguu

SEQ ID NO: 3434449 - RNA, 15 nt, Pseudomonas aeruginosa PA01
accguccacggcgcg

SEQ ID NO: 3434450 - RNA, 19 nt, Pseudomonas aeruginosa PA01
accguccgcagcacagccc

SEQ ID NO: 3434451 - RNA, 17 nt, Pseudomonas aeruginosa PA01
accguccgcagcgccac

SEQ ID NO: 3434452 - RNA, 18 nt, Pseudomonas aeruginosa PA01
accguccuucggccgcac

SEQ ID NO: 3434453 - RNA, 17 nt, Pseudomonas aeruginosa PA01
accgucgaaccagccgc

SEQ ID NO: 3434454 - RNA, 23 nt, Pseudomonas aeruginosa PA01
accgucgaauuggacagcaggcu

SEQ ID NO: 3434455 - RNA, 15 nt, Pseudomonas aeruginosa PA01
accgucgaucucgag

SEQ ID NO: 3434456 - RNA, 17 nt, Pseudomonas aeruginosa PA01
accgucgaucucgagca

SEQ ID NO: 3434457 - RNA, 18 nt, Pseudomonas aeruginosa PA01
accgucgaucucgagcau

SEQ ID NO: 3434458 - RNA, 20 nt, Pseudomonas aeruginosa PA01
accgucgaucucgagcaugu

SEQ ID NO: 3434459 - RNA, 18 nt, Pseudomonas aeruginosa PA01
accgucgcgauagacgcc

SEQ ID NO: 3434460 - RNA, 20 nt, Pseudomonas aeruginosa PA01
accgucgcgauagacgccgg

SEQ ID NO: 3434461 - RNA, 21 nt, Pseudomonas aeruginosa PA01
accgucgcgauagacgccggc

SEQ ID NO: 3434462 - RNA, 22 nt, Pseudomonas aeruginosa PA01
accgucgcgauagacgccggcg

SEQ ID NO: 3434463 - RNA, 12 nt, Pseudomonas aeruginosa PA01
accgucggccgg

SEQ ID NO: 3434464 - RNA, 21 nt, Pseudomonas aeruginosa PA01
accgucuucaguaggccagcg

SEQ ID NO: 3434465 - RNA, 22 nt, Pseudomonas aeruginosa PA01
accgucuucaguaggccagcgg

SEQ ID NO: 3434466 - RNA, 14 nt, Pseudomonas aeruginosa PA01
accgugaccagcau

SEQ ID NO: 3434467 - RNA, 23 nt, Pseudomonas aeruginosa PA01
accgugaugcccagcggcgccag

SEQ ID NO: 3434468 - RNA, 16 nt, Pseudomonas aeruginosa PA01
accgugcccgccggcg

SEQ ID NO: 3434469 - RNA, 17 nt, Pseudomonas aeruginosa PA01
accgugcccgccggcgc

SEQ ID NO: 3434470 - RNA, 19 nt, Pseudomonas aeruginosa PA01
accgugcccgccggcgcgc

SEQ ID NO: 3434471 - RNA, 13 nt, Pseudomonas aeruginosa PA01
accgugccgccgg

SEQ ID NO: 3434472 - RNA, 19 nt, Pseudomonas aeruginosa PA01
accguggaaaccucgccga

SEQ ID NO: 3434473 - RNA, 20 nt, Pseudomonas aeruginosa PA01
accguggaaaccucgccgau

SEQ ID NO: 3434474 - RNA, 13 nt, Pseudomonas aeruginosa PA01
accguggcgcugg

SEQ ID NO: 3434475 - RNA, 16 nt, Pseudomonas aeruginosa PA01
accguggcgcuggccg

SEQ ID NO: 3434476 - RNA, 17 nt, Pseudomonas aeruginosa PA01
accguggcgcuggccga

SEQ ID NO: 3434477 - RNA, 16 nt, Pseudomonas aeruginosa PA01
accguggcggccgccg

SEQ ID NO: 3434478 - RNA, 17 nt, Pseudomonas aeruginosa PA01
accguggcggccgccgc

SEQ ID NO: 3434479 - RNA, 22 nt, Pseudomonas aeruginosa PA01
accguggucagcaccagggcca

SEQ ID NO: 3434480 - RNA, 17 nt, Pseudomonas aeruginosa PA01
accguggucauggcgca

SEQ ID NO: 3434481 - RNA, 24 nt, Pseudomonas aeruginosa PA01
accguggucgccgcucauccgcug

SEQ ID NO: 3434482 - RNA, 15 nt, Pseudomonas aeruginosa PA01
accgugucgaagccu

SEQ ID NO: 3434483 - RNA, 19 nt, Pseudomonas aeruginosa PA01
accguguugaucgccgcgc

SEQ ID NO: 3434484 - RNA, 21 nt, Pseudomonas aeruginosa PA01
accguguugaucgccgcgccg

SEQ ID NO: 3434485 - RNA, 22 nt, Pseudomonas aeruginosa PA01
accguguugaucgccgcgccgc

SEQ ID NO: 3434486 - RNA, 16 nt, Pseudomonas aeruginosa PA01
accguucccagcagcg

SEQ ID NO: 3434487 - RNA, 17 nt, Pseudomonas aeruginosa PA01
accguucccagcagcgc

SEQ ID NO: 3434488 - RNA, 20 nt, Pseudomonas aeruginosa PA01
accguucugccgcagcgccu

SEQ ID NO: 3434489 - RNA, 21 nt, Pseudomonas aeruginosa PA01
accguucugccgcagcgccuc

SEQ ID NO: 3434490 - RNA, 17 nt, Pseudomonas aeruginosa PA01
accguucuugaucaccg

SEQ ID NO: 3434491 - RNA, 15 nt, Pseudomonas aeruginosa PA01
accguugcgcaggcg

SEQ ID NO: 3434492 - RNA, 18 nt, Pseudomonas aeruginosa PA01
accguuucgccgccggcc

SEQ ID NO: 3434493 - RNA, 21 nt, Pseudomonas aeruginosa PA01
accucagaccacgcccugcgc

SEQ ID NO: 3434494 - RNA, 17 nt, Pseudomonas aeruginosa PA01
accucauacuugggucg

SEQ ID NO: 3434495 - RNA, 22 nt, Pseudomonas aeruginosa PA01
accuccagccagcagcccggcc

SEQ ID NO: 3434496 - RNA, 14 nt, Pseudomonas aeruginosa PA01
accuccagccggcc

SEQ ID NO: 3434497 - RNA, 16 nt, Pseudomonas aeruginosa PA01
accuccagcggcuugu

SEQ ID NO: 3434498 - RNA, 16 nt, Pseudomonas aeruginosa PA01
accuccagggccagcu

SEQ ID NO: 3434499 - RNA, 18 nt, Pseudomonas aeruginosa PA01
accuccagggccagcuug

SEQ ID NO: 3434500 - RNA, 20 nt, Pseudomonas aeruginosa PA01
accucccgcgccagcucgaa

SEQ ID NO: 3434501 - RNA, 16 nt, Pseudomonas aeruginosa PA01
accuccgccaggaccu

SEQ ID NO: 3434502 - RNA, 21 nt, Pseudomonas aeruginosa PA01
accuccgccaggaccuccugc

SEQ ID NO: 3434503 - RNA, 14 nt, Pseudomonas aeruginosa PA01
accuccgccagguc

SEQ ID NO: 3434504 - RNA, 12 nt, Pseudomonas aeruginosa PA01
accuccgccgcu

SEQ ID NO: 3434505 - RNA, 13 nt, Pseudomonas aeruginosa PA01
accuccgccgcuu

SEQ ID NO: 3434506 - RNA, 13 nt, Pseudomonas aeruginosa PA01
accuccuggcgcg

SEQ ID NO: 3434507 - RNA, 16 nt, Pseudomonas aeruginosa PA01
accuccuguucgcgcg

SEQ ID NO: 3434508 - RNA, 18 nt, Pseudomonas aeruginosa PA01
accucgaaccccuggcgc

SEQ ID NO: 3434509 - RNA, 14 nt, Pseudomonas aeruginosa PA01
accucgaagcccag

SEQ ID NO: 3434510 - RNA, 15 nt, Pseudomonas aeruginosa PA01
accucgaagcccagc

SEQ ID NO: 3434511 - RNA, 20 nt, Pseudomonas aeruginosa PA01
accucgaagcccagcgccug

SEQ ID NO: 3434512 - RNA, 17 nt, Pseudomonas aeruginosa PA01
accucgaagcuggccag

SEQ ID NO: 3434513 - RNA, 18 nt, Pseudomonas aeruginosa PA01
accucgaaguccugcagg

SEQ ID NO: 3434514 - RNA, 21 nt, Pseudomonas aeruginosa PA01
accucgaaguccugcaggauc

SEQ ID NO: 3434515 - RNA, 15 nt, Pseudomonas aeruginosa PA01
accucgacccuggcg

SEQ ID NO: 3434516 - RNA, 12 nt, Pseudomonas aeruginosa PA01
accucgaccgcg

SEQ ID NO: 3434517 - RNA, 16 nt, Pseudomonas aeruginosa PA01
accucgaccgcgccgg

SEQ ID NO: 3434518 - RNA, 15 nt, Pseudomonas aeruginosa PA01
accucgacgccgagc

SEQ ID NO: 3434519 - RNA, 21 nt, Pseudomonas aeruginosa PA01
accucgacgccgagccagccg

SEQ ID NO: 3434520 - RNA, 13 nt, Pseudomonas aeruginosa PA01
accucgagcugga

SEQ ID NO: 3434521 - RNA, 13 nt, Pseudomonas aeruginosa PA01
accucgauggcga

SEQ ID NO: 3434522 - RNA, 15 nt, Pseudomonas aeruginosa PA01
accucgauggcggcg

SEQ ID NO: 3434523 - RNA, 16 nt, Pseudomonas aeruginosa PA01
accucgauggcggcgg

SEQ ID NO: 3434524 - RNA, 17 nt, Pseudomonas aeruginosa PA01
accucgccaagcuggcg

SEQ ID NO: 3434525 - RNA, 18 nt, Pseudomonas aeruginosa PA01
accucgccaagcuggcga

SEQ ID NO: 3434526 - RNA, 16 nt, Pseudomonas aeruginosa PA01
accucgcccaucgcca

SEQ ID NO: 3434527 - RNA, 20 nt, Pseudomonas aeruginosa PA01
accucgccgaucuccuccgc

SEQ ID NO: 3434528 - RNA, 21 nt, Pseudomonas aeruginosa PA01
accucgcugacuuccaucagc

SEQ ID NO: 3434529 - RNA, 20 nt, Pseudomonas aeruginosa PA01
accucggaccagaggcugac

SEQ ID NO: 3434530 - RNA, 21 nt, Pseudomonas aeruginosa PA01
accucggccagccagggcagc

SEQ ID NO: 3434531 - RNA, 20 nt, Pseudomonas aeruginosa PA01
accucggcgccauaggccag

SEQ ID NO: 3434532 - RNA, 23 nt, Pseudomonas aeruginosa PA01
accucggcgccauaggccagcac

SEQ ID NO: 3434533 - RNA, 19 nt, Pseudomonas aeruginosa PA01
accucgggcagcuuggcgg

SEQ ID NO: 3434534 - RNA, 24 nt, Pseudomonas aeruginosa PA01
accucgggcgagaaucgccgaggc

SEQ ID NO: 3434535 - RNA, 18 nt, Pseudomonas aeruginosa PA01
accucggguuuggcgccc

SEQ ID NO: 3434536 - RNA, 20 nt, Pseudomonas aeruginosa PA01
accucggguuuggcgcccgc

SEQ ID NO: 3434537 - RNA, 17 nt, Pseudomonas aeruginosa PA01
accucggugagguagca

SEQ ID NO: 3434538 - RNA, 21 nt, Pseudomonas aeruginosa PA01
accucguaggccgacucgcga

SEQ ID NO: 3434539 - RNA, 22 nt, Pseudomonas aeruginosa PA01
accucguauuccacgucgccga

SEQ ID NO: 3434540 - RNA, 23 nt, Pseudomonas aeruginosa PA01
accucguauuccacgucgccgac

SEQ ID NO: 3434541 - RNA, 17 nt, Pseudomonas aeruginosa PA01
accucguccagcaggac

SEQ ID NO: 3434542 - RNA, 16 nt, Pseudomonas aeruginosa PA01
accucgugcucgggga

SEQ ID NO: 3434543 - RNA, 11 nt, Pseudomonas aeruginosa PA01
accucucccca

SEQ ID NO: 3434544 - RNA, 17 nt, Pseudomonas aeruginosa PA01
accucugcguucugcug

SEQ ID NO: 3434545 - RNA, 20 nt, Pseudomonas aeruginosa PA01
accucuggcugaagacccug

SEQ ID NO: 3434546 - RNA, 22 nt, Pseudomonas aeruginosa PA01
accucuggcugaagacccugca

SEQ ID NO: 3434547 - RNA, 23 nt, Pseudomonas aeruginosa PA01
accucuggcugaagacccugcac

SEQ ID NO: 3434548 - RNA, 21 nt, Pseudomonas aeruginosa PA01
accucuucgccauccuugagu

SEQ ID NO: 3434549 - RNA, 12 nt, Pseudomonas aeruginosa PA01
accugaacgcgc

SEQ ID NO: 3434550 - RNA, 17 nt, Pseudomonas aeruginosa PA01
accugaacgcgcccggc

SEQ ID NO: 3434551 - RNA, 18 nt, Pseudomonas aeruginosa PA01
accugaacgcgcccggcc

SEQ ID NO: 3434552 - RNA, 20 nt, Pseudomonas aeruginosa PA01
accugaacgcgcccggccag

SEQ ID NO: 3434553 - RNA, 16 nt, Pseudomonas aeruginosa PA01
accugaccaucgucgc

SEQ ID NO: 3434554 - RNA, 18 nt, Pseudomonas aeruginosa PA01
accugaccaucgucgcuu

SEQ ID NO: 3434555 - RNA, 21 nt, Pseudomonas aeruginosa PA01
accugacccgcuccucgucga

SEQ ID NO: 3434556 - RNA, 18 nt, Pseudomonas aeruginosa PA01
accugcaacacgucggac

SEQ ID NO: 3434557 - RNA, 17 nt, Pseudomonas aeruginosa PA01
accugcaacucggcguc

SEQ ID NO: 3434558 - RNA, 23 nt, Pseudomonas aeruginosa PA01
accugcaacucggcgucgcgcuu

SEQ ID NO: 3434559 - RNA, 22 nt, Pseudomonas aeruginosa PA01
accugcaaggcggugaccagcg

SEQ ID NO: 3434560 - RNA, 21 nt, Pseudomonas aeruginosa PA01
accugcagacgguucagcagc

SEQ ID NO: 3434561 - RNA, 23 nt, Pseudomonas aeruginosa PA01
accugcagacgguucagcagcgg

SEQ ID NO: 3434562 - RNA, 12 nt, Pseudomonas aeruginosa PA01
accugcaucacg

SEQ ID NO: 3434563 - RNA, 20 nt, Pseudomonas aeruginosa PA01
accugcaucacguacggcgc

SEQ ID NO: 3434564 - RNA, 22 nt, Pseudomonas aeruginosa PA01
accugcaugcuuuugaacacca

SEQ ID NO: 3434565 - RNA, 23 nt, Pseudomonas aeruginosa PA01
accugcaugcuuuugaacaccag

SEQ ID NO: 3434566 - RNA, 13 nt, Pseudomonas aeruginosa PA01
accugccgaucgc

SEQ ID NO: 3434567 - RNA, 17 nt, Pseudomonas aeruginosa PA01
accugccgaucgccgcg

SEQ ID NO: 3434568 - RNA, 12 nt, Pseudomonas aeruginosa PA01
accugccgcccg

SEQ ID NO: 3434569 - RNA, 13 nt, Pseudomonas aeruginosa PA01
accugccgcccgg

SEQ ID NO: 3434570 - RNA, 12 nt, Pseudomonas aeruginosa PA01
accugccggcac

SEQ ID NO: 3434571 - RNA, 17 nt, Pseudomonas aeruginosa PA01
accugcgaauugcgcug

SEQ ID NO: 3434572 - RNA, 19 nt, Pseudomonas aeruginosa PA01
accugcgaauugcgcugga

SEQ ID NO: 3434573 - RNA, 22 nt, Pseudomonas aeruginosa PA01
accugcgaauugcgcuggaagu

SEQ ID NO: 3434574 - RNA, 23 nt, Pseudomonas aeruginosa PA01
accugcgccccggucucgcgcag

SEQ ID NO: 3434575 - RNA, 16 nt, Pseudomonas aeruginosa PA01
accugcgggcugcgug

SEQ ID NO: 3434576 - RNA, 16 nt, Pseudomonas aeruginosa PA01
accugcggugucccuu

SEQ ID NO: 3434577 - RNA, 20 nt, Pseudomonas aeruginosa PA01
accugcggugucccuucuuu

SEQ ID NO: 3434578 - RNA, 19 nt, Pseudomonas aeruginosa PA01
accugcgugcgccguagca

SEQ ID NO: 3434579 - RNA, 18 nt, Pseudomonas aeruginosa PA01
accugcucacggccgaac

SEQ ID NO: 3434580 - RNA, 22 nt, Pseudomonas aeruginosa PA01
accugcucgcgcaccgcggcca

SEQ ID NO: 3434581 - RNA, 18 nt, Pseudomonas aeruginosa PA01
accugcucgucgaugcug

SEQ ID NO: 3434582 - RNA, 13 nt, Pseudomonas aeruginosa PA01
accugcugggcca

SEQ ID NO: 3434583 - RNA, 18 nt, Pseudomonas aeruginosa PA01
accugcuugggcgccucg

SEQ ID NO: 3434584 - RNA, 19 nt, Pseudomonas aeruginosa PA01
accugcuugggcgccucgc

SEQ ID NO: 3434585 - RNA, 23 nt, Pseudomonas aeruginosa PA01
accugcuugggcgccucgccgcg

SEQ ID NO: 3434586 - RNA, 17 nt, Pseudomonas aeruginosa PA01
accuggaucgccaggcu

SEQ ID NO: 3434587 - RNA, 14 nt, Pseudomonas aeruginosa PA01
accuggauggugcc

SEQ ID NO: 3434588 - RNA, 13 nt, Pseudomonas aeruginosa PA01
accuggcagguau

SEQ ID NO: 3434589 - RNA, 16 nt, Pseudomonas aeruginosa PA01
accuggccgcguucgc

SEQ ID NO: 3434590 - RNA, 19 nt, Pseudomonas aeruginosa PA01
accuggccgcguucgccga

SEQ ID NO: 3434591 - RNA, 22 nt, Pseudomonas aeruginosa PA01
accuggccgcguucgccgaggc

SEQ ID NO: 3434592 - RNA, 19 nt, Pseudomonas aeruginosa PA01
accuggccgcuguggaagu

SEQ ID NO: 3434593 - RNA, 21 nt, Pseudomonas aeruginosa PA01
accuggccgcuguggaaguac

SEQ ID NO: 3434594 - RNA, 19 nt, Pseudomonas aeruginosa PA01
accuggccgucccugacca

SEQ ID NO: 3434595 - RNA, 16 nt, Pseudomonas aeruginosa PA01
accuggcgaugcccug

SEQ ID NO: 3434596 - RNA, 20 nt, Pseudomonas aeruginosa PA01
accuggcgaugcccuggccg

SEQ ID NO: 3434597 - RNA, 13 nt, Pseudomonas aeruginosa PA01
accuggcgcaggu

SEQ ID NO: 3434598 - RNA, 16 nt, Pseudomonas aeruginosa PA01
accuggcgcucgccgu

SEQ ID NO: 3434599 - RNA, 19 nt, Pseudomonas aeruginosa PA01
accuggcgcugaacaagcc

SEQ ID NO: 3434600 - RNA, 21 nt, Pseudomonas aeruginosa PA01
accuggcgcugaacaagcccu

SEQ ID NO: 3434601 - RNA, 22 nt, Pseudomonas aeruginosa PA01
accuggcgcugaacaagcccug

SEQ ID NO: 3434602 - RNA, 16 nt, Pseudomonas aeruginosa PA01
accuggcggcugagcu

SEQ ID NO: 3434603 - RNA, 16 nt, Pseudomonas aeruginosa PA01
accuggcgguacagcc

SEQ ID NO: 3434604 - RNA, 17 nt, Pseudomonas aeruginosa PA01
accuggcgguacagccc

SEQ ID NO: 3434605 - RNA, 13 nt, Pseudomonas aeruginosa PA01
accuggcggucgc

SEQ ID NO: 3434606 - RNA, 18 nt, Pseudomonas aeruginosa PA01
accuggcggucgccgccg

SEQ ID NO: 3434607 - RNA, 20 nt, Pseudomonas aeruginosa PA01
accuggcggucgccgccggc

SEQ ID NO: 3434608 - RNA, 20 nt, Pseudomonas aeruginosa PA01
accuggcucuguuccucggc

SEQ ID NO: 3434609 - RNA, 23 nt, Pseudomonas aeruginosa PA01
accuggcucuguuccucggcggc

SEQ ID NO: 3434610 - RNA, 15 nt, Pseudomonas aeruginosa PA01
accuggcugaggcgu

SEQ ID NO: 3434611 - RNA, 19 nt, Pseudomonas aeruginosa PA01
accuggcugaggcguucca

SEQ ID NO: 3434612 - RNA, 23 nt, Pseudomonas aeruginosa PA01
accuggcugaggcguuccaguuc

SEQ ID NO: 3434613 - RNA, 18 nt, Pseudomonas aeruginosa PA01
accugggacucccgcaga

SEQ ID NO: 3434614 - RNA, 22 nt, Pseudomonas aeruginosa PA01
accugggcguuggccagcgcca

SEQ ID NO: 3434615 - RNA, 23 nt, Pseudomonas aeruginosa PA01
accugggcguuggccagcgccac

SEQ ID NO: 3434616 - RNA, 16 nt, Pseudomonas aeruginosa PA01
accuggggcggccuca

SEQ ID NO: 3434617 - RNA, 18 nt, Pseudomonas aeruginosa PA01
accuggggcggccucagg

SEQ ID NO: 3434618 - RNA, 21 nt, Pseudomonas aeruginosa PA01
accuggggcggccucaggccu

SEQ ID NO: 3434619 - RNA, 20 nt, Pseudomonas aeruginosa PA01
accugggugcuuuccugcuc

SEQ ID NO: 3434620 - RNA, 16 nt, Pseudomonas aeruginosa PA01
accuggguugccgcgc

SEQ ID NO: 3434621 - RNA, 17 nt, Pseudomonas aeruginosa PA01
accuggguugccgcgcc

SEQ ID NO: 3434622 - RNA, 22 nt, Pseudomonas aeruginosa PA01
accugguaggucacuuccguca

SEQ ID NO: 3434623 - RNA, 17 nt, Pseudomonas aeruginosa PA01
accugguccaacgggcu

SEQ ID NO: 3434624 - RNA, 22 nt, Pseudomonas aeruginosa PA01
accuggucuucgguggcggcga

SEQ ID NO: 3434625 - RNA, 17 nt, Pseudomonas aeruginosa PA01
accugguggacacccug

SEQ ID NO: 3434626 - RNA, 21 nt, Pseudomonas aeruginosa PA01
accugguggacacccugcugc

SEQ ID NO: 3434627 - RNA, 23 nt, Pseudomonas aeruginosa PA01
accugguggacacccugcugcug

SEQ ID NO: 3434628 - RNA, 24 nt, Pseudomonas aeruginosa PA01
accugguggcgccggcugacgcug

SEQ ID NO: 3434629 - RNA, 16 nt, Pseudomonas aeruginosa PA01
accuggugggcggcgg

SEQ ID NO: 3434630 - RNA, 14 nt, Pseudomonas aeruginosa PA01
accuguccagucac

SEQ ID NO: 3434631 - RNA, 11 nt, Pseudomonas aeruginosa PA01
accugucccga

SEQ ID NO: 3434632 - RNA, 17 nt, Pseudomonas aeruginosa PA01
accugucggcucgcgcc

SEQ ID NO: 3434633 - RNA, 17 nt, Pseudomonas aeruginosa PA01
accugugcugcgcgccg

SEQ ID NO: 3434634 - RNA, 18 nt, Pseudomonas aeruginosa PA01
accugugcugcgcgccgc

SEQ ID NO: 3434635 - RNA, 20 nt, Pseudomonas aeruginosa PA01
accuguggaauguccugccg

SEQ ID NO: 3434636 - RNA, 23 nt, Pseudomonas aeruginosa PA01
accuguggaauguccugccgcag

SEQ ID NO: 3434637 - RNA, 15 nt, Pseudomonas aeruginosa PA01
accuguuccagcaac

SEQ ID NO: 3434638 - RNA, 20 nt, Pseudomonas aeruginosa PA01
accuguuccagcaacgccuc

SEQ ID NO: 3434639 - RNA, 21 nt, Pseudomonas aeruginosa PA01
accuguucggcgcugaccucg

SEQ ID NO: 3434640 - RNA, 24 nt, Pseudomonas aeruginosa PA01
accuguugcagagcggccaggucg

SEQ ID NO: 3434641 - RNA, 18 nt, Pseudomonas aeruginosa PA01
accuuagacccacugaag

SEQ ID NO: 3434642 - RNA, 11 nt, Pseudomonas aeruginosa PA01
accuucaccac

SEQ ID NO: 3434643 - RNA, 14 nt, Pseudomonas aeruginosa PA01
accuucaccggcac

SEQ ID NO: 3434644 - RNA, 21 nt, Pseudomonas aeruginosa PA01
accuucagauacuccagcagc

SEQ ID NO: 3434645 - RNA, 14 nt, Pseudomonas aeruginosa PA01
accuucagcaccug

SEQ ID NO: 3434646 - RNA, 15 nt, Pseudomonas aeruginosa PA01
accuucagcaccugc

SEQ ID NO: 3434647 - RNA, 16 nt, Pseudomonas aeruginosa PA01
accuucaucaggcggc

SEQ ID NO: 3434648 - RNA, 14 nt, Pseudomonas aeruginosa PA01
accuuccgccagca

SEQ ID NO: 3434649 - RNA, 16 nt, Pseudomonas aeruginosa PA01
accuuccgccagcagg

SEQ ID NO: 3434650 - RNA, 13 nt, Pseudomonas aeruginosa PA01
accuuccugccag

SEQ ID NO: 3434651 - RNA, 17 nt, Pseudomonas aeruginosa PA01
accuucgaucacccggu

SEQ ID NO: 3434652 - RNA, 23 nt, Pseudomonas aeruginosa PA01
accuucgaucaccuuaguuauca

SEQ ID NO: 3434653 - RNA, 15 nt, Pseudomonas aeruginosa PA01
accuucgcccgcugc

SEQ ID NO: 3434654 - RNA, 16 nt, Pseudomonas aeruginosa PA01
accuucgcccucagca

SEQ ID NO: 3434655 - RNA, 23 nt, Pseudomonas aeruginosa PA01
accuucgcccucagcagcgccgc

SEQ ID NO: 3434656 - RNA, 16 nt, Pseudomonas aeruginosa PA01
accuucuccgaccagg

SEQ ID NO: 3434657 - RNA, 18 nt, Pseudomonas aeruginosa PA01
accuucucguccuccucg

SEQ ID NO: 3434658 - RNA, 20 nt, Pseudomonas aeruginosa PA01
accuucugcaccgugcgcgc

SEQ ID NO: 3434659 - RNA, 18 nt, Pseudomonas aeruginosa PA01
accuugacgaagccggcg

SEQ ID NO: 3434660 - RNA, 19 nt, Pseudomonas aeruginosa PA01
accuugcacauccagcccu

SEQ ID NO: 3434661 - RNA, 22 nt, Pseudomonas aeruginosa PA01
accuugcccgaggugucgccgc

SEQ ID NO: 3434662 - RNA, 18 nt, Pseudomonas aeruginosa PA01
accuugcccucggcgccc

SEQ ID NO: 3434663 - RNA, 16 nt, Pseudomonas aeruginosa PA01
accuugcccuugaagc

SEQ ID NO: 3434664 - RNA, 22 nt, Pseudomonas aeruginosa PA01
accuugccgacgccgcggccgg

SEQ ID NO: 3434665 - RNA, 18 nt, Pseudomonas aeruginosa PA01
accuugccgcgcccggcc

SEQ ID NO: 3434666 - RNA, 14 nt, Pseudomonas aeruginosa PA01
accuugccguugcu

SEQ ID NO: 3434667 - RNA, 16 nt, Pseudomonas aeruginosa PA01
accuugcgaaaagccc

SEQ ID NO: 3434668 - RNA, 19 nt, Pseudomonas aeruginosa PA01
accuugcgaaaagcccgcc

SEQ ID NO: 3434669 - RNA, 21 nt, Pseudomonas aeruginosa PA01
accuugcgaaaagcccgccac

SEQ ID NO: 3434670 - RNA, 17 nt, Pseudomonas aeruginosa PA01
accuugcgcaccgccug

SEQ ID NO: 3434671 - RNA, 20 nt, Pseudomonas aeruginosa PA01
accuugcggaacccgcgcag

SEQ ID NO: 3434672 - RNA, 14 nt, Pseudomonas aeruginosa PA01
accuugcggccguu

SEQ ID NO: 3434673 - RNA, 18 nt, Pseudomonas aeruginosa PA01
accuugcuggacaagguu

SEQ ID NO: 3434674 - RNA, 20 nt, Pseudomonas aeruginosa PA01
accuuggcacgaacccaggc

SEQ ID NO: 3434675 - RNA, 22 nt, Pseudomonas aeruginosa PA01
accuuggugaugaagucggcgu

SEQ ID NO: 3434676 - RNA, 15 nt, Pseudomonas aeruginosa PA01
accuuguacggcagc

SEQ ID NO: 3434677 - RNA, 20 nt, Pseudomonas aeruginosa PA01
accuuguacggcagcggcgu

SEQ ID NO: 3434678 - RNA, 14 nt, Pseudomonas aeruginosa PA01
accuuguccaggcg

SEQ ID NO: 3434679 - RNA, 17 nt, Pseudomonas aeruginosa PA01
accuuguccaggcgcug

SEQ ID NO: 3434680 - RNA, 20 nt, Pseudomonas aeruginosa PA01
accuuguccaggcgcugcuc

SEQ ID NO: 3434681 - RNA, 18 nt, Pseudomonas aeruginosa PA01
accuuuagggauggauac

SEQ ID NO: 3434682 - RNA, 11 nt, Pseudomonas aeruginosa PA01
accuuucuccc

SEQ ID NO: 3434683 - RNA, 14 nt, Pseudomonas aeruginosa PA01
acgaaaaagcccgg

SEQ ID NO: 3434684 - RNA, 16 nt, Pseudomonas aeruginosa PA01
acgaaaaagcccggcg

SEQ ID NO: 3434685 - RNA, 16 nt, Pseudomonas aeruginosa PA01
acgaaaaaggcgcgcc

SEQ ID NO: 3434686 - RNA, 17 nt, Pseudomonas aeruginosa PA01
acgaaaaaggcgcgccg

SEQ ID NO: 3434687 - RNA, 18 nt, Pseudomonas aeruginosa PA01
acgaaaaaggcgcgccgg

SEQ ID NO: 3434688 - RNA, 20 nt, Pseudomonas aeruginosa PA01
acgaaaacggcgcccgaggg

SEQ ID NO: 3434689 - RNA, 18 nt, Pseudomonas aeruginosa PA01
acgaaacggugacgggca

SEQ ID NO: 3434690 - RNA, 19 nt, Pseudomonas aeruginosa PA01
acgaaacucaucaggcugc

SEQ ID NO: 3434691 - RNA, 15 nt, Pseudomonas aeruginosa PA01
acgaaagaagccgca

SEQ ID NO: 3434692 - RNA, 21 nt, Pseudomonas aeruginosa PA01
acgaaagacgcugcgaccugg

SEQ ID NO: 3434693 - RNA, 18 nt, Pseudomonas aeruginosa PA01
acgaaagccaugcccaga

SEQ ID NO: 3434694 - RNA, 17 nt, Pseudomonas aeruginosa PA01
acgaaaggccgcgccgg

SEQ ID NO: 3434695 - RNA, 17 nt, Pseudomonas aeruginosa PA01
acgaaauagucgcgggc

SEQ ID NO: 3434696 - RNA, 19 nt, Pseudomonas aeruginosa PA01
acgaaauagucgcgggccu

SEQ ID NO: 3434697 - RNA, 15 nt, Pseudomonas aeruginosa PA01
acgaacagccagagg

SEQ ID NO: 3434698 - RNA, 20 nt, Pseudomonas aeruginosa PA01
acgaacaggcugugcgccag

SEQ ID NO: 3434699 - RNA, 13 nt, Pseudomonas aeruginosa PA01
acgaacaucgcca

SEQ ID NO: 3434700 - RNA, 19 nt, Pseudomonas aeruginosa PA01
acgaacaucgccagcgcca

SEQ ID NO: 3434701 - RNA, 18 nt, Pseudomonas aeruginosa PA01
acgaaccccgggccgcgc

SEQ ID NO: 3434702 - RNA, 21 nt, Pseudomonas aeruginosa PA01
acgaacggaucgcucucgcgc

SEQ ID NO: 3434703 - RNA, 22 nt, Pseudomonas aeruginosa PA01
acgaacucaacgaagugaagcg

SEQ ID NO: 3434704 - RNA, 14 nt, Pseudomonas aeruginosa PA01
acgaacucgacgcg

SEQ ID NO: 3434705 - RNA, 18 nt, Pseudomonas aeruginosa PA01
acgaacucgacgcgccag

SEQ ID NO: 3434706 - RNA, 17 nt, Pseudomonas aeruginosa PA01
acgaagaaccccggcuc

SEQ ID NO: 3434707 - RNA, 14 nt, Pseudomonas aeruginosa PA01
acgaagaacgccag

SEQ ID NO: 3434708 - RNA, 17 nt, Pseudomonas aeruginosa PA01
acgaagaagccggcccc

SEQ ID NO: 3434709 - RNA, 22 nt, Pseudomonas aeruginosa PA01
acgaagacccccugcggcccga

SEQ ID NO: 3434710 - RNA, 20 nt, Pseudomonas aeruginosa PA01
acgaagaguaaaugcuugaa

SEQ ID NO: 3434711 - RNA, 16 nt, Pseudomonas aeruginosa PA01
acgaagcccaggcuga

SEQ ID NO: 3434712 - RNA, 17 nt, Pseudomonas aeruginosa PA01
acgaagccgauugccag

SEQ ID NO: 3434713 - RNA, 22 nt, Pseudomonas aeruginosa PA01
acgaagcgaccgaucaugcccu

SEQ ID NO: 3434714 - RNA, 16 nt, Pseudomonas aeruginosa PA01
acgaagcgacugcgcu

SEQ ID NO: 3434715 - RNA, 21 nt, Pseudomonas aeruginosa PA01
acgaagcgcccucgcugagca

SEQ ID NO: 3434716 - RNA, 13 nt, Pseudomonas aeruginosa PA01
acgaagcgccggc

SEQ ID NO: 3434717 - RNA, 14 nt, Pseudomonas aeruginosa PA01
acgaagcgccggcg

SEQ ID NO: 3434718 - RNA, 19 nt, Pseudomonas aeruginosa PA01
acgaagcgccggcggccug

SEQ ID NO: 3434719 - RNA, 22 nt, Pseudomonas aeruginosa PA01
acgaagcgccggcggccugccc

SEQ ID NO: 3434720 - RNA, 23 nt, Pseudomonas aeruginosa PA01
acgaagcggucgccggcgcgcac

SEQ ID NO: 3434721 - RNA, 18 nt, Pseudomonas aeruginosa PA01
acgaagcucgggguuuuu

SEQ ID NO: 3434722 - RNA, 18 nt, Pseudomonas aeruginosa PA01
acgaaggcggcagcggug

SEQ ID NO: 3434723 - RNA, 14 nt, Pseudomonas aeruginosa PA01
acgaaggcuggagc

SEQ ID NO: 3434724 - RNA, 22 nt, Pseudomonas aeruginosa PA01
acgaaggcuggagcgcugcgga

SEQ ID NO: 3434725 - RNA, 23 nt, Pseudomonas aeruginosa PA01
acgaaggcuggagcgcugcggaa

SEQ ID NO: 3434726 - RNA, 14 nt, Pseudomonas aeruginosa PA01
acgaagggcucagc

SEQ ID NO: 3434727 - RNA, 18 nt, Pseudomonas aeruginosa PA01
acgaagggcucagcccag

SEQ ID NO: 3434728 - RNA, 22 nt, Pseudomonas aeruginosa PA01
acgaagggcucagcccaggcgc

SEQ ID NO: 3434729 - RNA, 23 nt, Pseudomonas aeruginosa PA01
acgaagggcucagcccaggcgcc

SEQ ID NO: 3434730 - RNA, 14 nt, Pseudomonas aeruginosa PA01
acgaagucgccggc

SEQ ID NO: 3434731 - RNA, 15 nt, Pseudomonas aeruginosa PA01
acgaagucgccggca

SEQ ID NO: 3434732 - RNA, 19 nt, Pseudomonas aeruginosa PA01
acgaagugaccgcgcgcca

SEQ ID NO: 3434733 - RNA, 18 nt, Pseudomonas aeruginosa PA01
acgaaguguuacagcagg

SEQ ID NO: 3434734 - RNA, 20 nt, Pseudomonas aeruginosa PA01
acgaaguuggcggccgacgg

SEQ ID NO: 3434735 - RNA, 14 nt, Pseudomonas aeruginosa PA01
acgaauggcuucuu

SEQ ID NO: 3434736 - RNA, 15 nt, Pseudomonas aeruginosa PA01
acgacagccccggcc

SEQ ID NO: 3434737 - RNA, 20 nt, Pseudomonas aeruginosa PA01
acgacagccccggcccgguc

SEQ ID NO: 3434738 - RNA, 22 nt, Pseudomonas aeruginosa PA01
acgacagcgaaugcuugccggc

SEQ ID NO: 3434739 - RNA, 11 nt, Pseudomonas aeruginosa PA01
acgacaggcgg

SEQ ID NO: 3434740 - RNA, 21 nt, Pseudomonas aeruginosa PA01
acgacaggcggcgggccggcg

SEQ ID NO: 3434741 - RNA, 23 nt, Pseudomonas aeruginosa PA01
acgacaggcggcgggccggcguc

SEQ ID NO: 3434742 - RNA, 12 nt, Pseudomonas aeruginosa PA01
acgacaggcugg

SEQ ID NO: 3434743 - RNA, 23 nt, Pseudomonas aeruginosa PA01
acgacaucgacgcccucggcgac

SEQ ID NO: 3434744 - RNA, 12 nt, Pseudomonas aeruginosa PA01
acgaccacgccu

SEQ ID NO: 3434745 - RNA, 20 nt, Pseudomonas aeruginosa PA01
acgaccgcccaggcugccgc

SEQ ID NO: 3434746 - RNA, 23 nt, Pseudomonas aeruginosa PA01
acgaccgcccaggcugccgccgc

SEQ ID NO: 3434747 - RNA, 22 nt, Pseudomonas aeruginosa PA01
acgaccgguagccaugaucacg

SEQ ID NO: 3434748 - RNA, 15 nt, Pseudomonas aeruginosa PA01
acgacgaaaggccgc

SEQ ID NO: 3434749 - RNA, 14 nt, Pseudomonas aeruginosa PA01
acgacgaagcgccg

SEQ ID NO: 3434750 - RNA, 16 nt, Pseudomonas aeruginosa PA01
acgacgaagcgccggc

SEQ ID NO: 3434751 - RNA, 18 nt, Pseudomonas aeruginosa PA01
acgacgaagcgccggcgg

SEQ ID NO: 3434752 - RNA, 22 nt, Pseudomonas aeruginosa PA01
acgacgaagugaccgcgcgcca

SEQ ID NO: 3434753 - RNA, 23 nt, Pseudomonas aeruginosa PA01
acgacgaagugaccgcgcgccau

SEQ ID NO: 3434754 - RNA, 14 nt, Pseudomonas aeruginosa PA01
acgacgcacucaua

SEQ ID NO: 3434755 - RNA, 19 nt, Pseudomonas aeruginosa PA01
acgacgccggugccaggac

SEQ ID NO: 3434756 - RNA, 13 nt, Pseudomonas aeruginosa PA01
acgacgcuggccu

SEQ ID NO: 3434757 - RNA, 16 nt, Pseudomonas aeruginosa PA01
acgacgcuggccugcc

SEQ ID NO: 3434758 - RNA, 15 nt, Pseudomonas aeruginosa PA01
acgacgggagcgcga

SEQ ID NO: 3434759 - RNA, 14 nt, Pseudomonas aeruginosa PA01
acgacgucggcggc

SEQ ID NO: 3434760 - RNA, 19 nt, Pseudomonas aeruginosa PA01
acgacgugcccauuuucca

SEQ ID NO: 3434761 - RNA, 12 nt, Pseudomonas aeruginosa PA01
acgacuccagcu

SEQ ID NO: 3434762 - RNA, 22 nt, Pseudomonas aeruginosa PA01
acgacuccagcuucuucugcag

SEQ ID NO: 3434763 - RNA, 19 nt, Pseudomonas aeruginosa PA01
acgacugcacgcagacguc

SEQ ID NO: 3434764 - RNA, 23 nt, Pseudomonas aeruginosa PA01
acgacuucggcgacagccgggca

SEQ ID NO: 3434765 - RNA, 19 nt, Pseudomonas aeruginosa PA01
acgagaaaaagcccggcau

SEQ ID NO: 3434766 - RNA, 14 nt, Pseudomonas aeruginosa PA01
acgagaagccgauc

SEQ ID NO: 3434767 - RNA, 18 nt, Pseudomonas aeruginosa PA01
acgagaagccgaucaggu

SEQ ID NO: 3434768 - RNA, 14 nt, Pseudomonas aeruginosa PA01
acgagacgccgagg

SEQ ID NO: 3434769 - RNA, 16 nt, Pseudomonas aeruginosa PA01
acgagaucgagcgcgc

SEQ ID NO: 3434770 - RNA, 17 nt, Pseudomonas aeruginosa PA01
acgagauugaugaagcg

SEQ ID NO: 3434771 - RNA, 20 nt, Pseudomonas aeruginosa PA01
acgagauugaugaagcgcug

SEQ ID NO: 3434772 - RNA, 14 nt, Pseudomonas aeruginosa PA01
acgagcccaggcag

SEQ ID NO: 3434773 - RNA, 21 nt, Pseudomonas aeruginosa PA01
acgaggaacgccucgcagagc

SEQ ID NO: 3434774 - RNA, 22 nt, Pseudomonas aeruginosa PA01
acgaggaacgccucgcagagcg

SEQ ID NO: 3434775 - RNA, 13 nt, Pseudomonas aeruginosa PA01
acgaggaaggcgc

SEQ ID NO: 3434776 - RNA, 16 nt, Pseudomonas aeruginosa PA01
acgaggaaggcgcgca

SEQ ID NO: 3434777 - RNA, 22 nt, Pseudomonas aeruginosa PA01
acgaggaaggcgcgcaccagcg

SEQ ID NO: 3434778 - RNA, 15 nt, Pseudomonas aeruginosa PA01
acgaggacgccgccg

SEQ ID NO: 3434779 - RNA, 19 nt, Pseudomonas aeruginosa PA01
acgaggcgcggcggaggcc

SEQ ID NO: 3434780 - RNA, 16 nt, Pseudomonas aeruginosa PA01
acgaggcgggcuggaa

SEQ ID NO: 3434781 - RNA, 12 nt, Pseudomonas aeruginosa PA01
acgagguugcuc

SEQ ID NO: 3434782 - RNA, 14 nt, Pseudomonas aeruginosa PA01
acgaguugggcgac

SEQ ID NO: 3434783 - RNA, 15 nt, Pseudomonas aeruginosa PA01
acgauaccgccgccg

SEQ ID NO: 3434784 - RNA, 16 nt, Pseudomonas aeruginosa PA01
acgauaccgccgccgg

SEQ ID NO: 3434785 - RNA, 16 nt, Pseudomonas aeruginosa PA01
acgauacgcucggcgu

SEQ ID NO: 3434786 - RNA, 15 nt, Pseudomonas aeruginosa PA01
acgauauacaaagca

SEQ ID NO: 3434787 - RNA, 16 nt, Pseudomonas aeruginosa PA01
acgauaucggcgccgg

SEQ ID NO: 3434788 - RNA, 14 nt, Pseudomonas aeruginosa PA01
acgaucacccccag

SEQ ID NO: 3434789 - RNA, 17 nt, Pseudomonas aeruginosa PA01
acgaucacucccugcuc

SEQ ID NO: 3434790 - RNA, 15 nt, Pseudomonas aeruginosa PA01
acgaucagccagggc

SEQ ID NO: 3434791 - RNA, 15 nt, Pseudomonas aeruginosa PA01
acgaucagcccgccg

SEQ ID NO: 3434792 - RNA, 16 nt, Pseudomonas aeruginosa PA01
acgaucagcccgccgg

SEQ ID NO: 3434793 - RNA, 23 nt, Pseudomonas aeruginosa PA01
acgaucauggugaagcccaccac

SEQ ID NO: 3434794 - RNA, 22 nt, Pseudomonas aeruginosa PA01
acgaucgcggcgacgaucaccc

SEQ ID NO: 3434795 - RNA, 20 nt, Pseudomonas aeruginosa PA01
acgaucggcaccaucaccga

SEQ ID NO: 3434796 - RNA, 23 nt, Pseudomonas aeruginosa PA01
acgaucucccgcgauucgccggg

SEQ ID NO: 3434797 - RNA, 18 nt, Pseudomonas aeruginosa PA01
acgaucuccugcugggcg

SEQ ID NO: 3434798 - RNA, 13 nt, Pseudomonas aeruginosa PA01
acgaucugcgccg

SEQ ID NO: 3434799 - RNA, 21 nt, Pseudomonas aeruginosa PA01
acgaucugcuugcgcgccgcc

SEQ ID NO: 3434800 - RNA, 23 nt, Pseudomonas aeruginosa PA01
acgaucugcuugcgcgccgccgc

SEQ ID NO: 3434801 - RNA, 16 nt, Pseudomonas aeruginosa PA01
acgaucuucugcaccc

SEQ ID NO: 3434802 - RNA, 13 nt, Pseudomonas aeruginosa PA01
acgaugcagggcu

SEQ ID NO: 3434803 - RNA, 16 nt, Pseudomonas aeruginosa PA01
acgaugcagggcugcu

SEQ ID NO: 3434804 - RNA, 16 nt, Pseudomonas aeruginosa PA01
acgaugccgaucucgc

SEQ ID NO: 3434805 - RNA, 19 nt, Pseudomonas aeruginosa PA01
acgaugccgaucucgccca

SEQ ID NO: 3434806 - RNA, 20 nt, Pseudomonas aeruginosa PA01
acgaugccgaucucgcccag

SEQ ID NO: 3434807 - RNA, 13 nt, Pseudomonas aeruginosa PA01
acgaugccgccgc

SEQ ID NO: 3434808 - RNA, 18 nt, Pseudomonas aeruginosa PA01
acgaugccguucaggcgc

SEQ ID NO: 3434809 - RNA, 19 nt, Pseudomonas aeruginosa PA01
acgaugccguucucgguga

SEQ ID NO: 3434810 - RNA, 13 nt, Pseudomonas aeruginosa PA01
acgaugcgcccca

SEQ ID NO: 3434811 - RNA, 20 nt, Pseudomonas aeruginosa PA01
acgaugcucgguugccaggc

SEQ ID NO: 3434812 - RNA, 21 nt, Pseudomonas aeruginosa PA01
acgaugcucgguugccaggcc

SEQ ID NO: 3434813 - RNA, 18 nt, Pseudomonas aeruginosa PA01
acgauggccagcccggag

SEQ ID NO: 3434814 - RNA, 13 nt, Pseudomonas aeruginosa PA01
acgauggccgccg

SEQ ID NO: 3434815 - RNA, 22 nt, Pseudomonas aeruginosa PA01
acgauggccggcagcagcgcca

SEQ ID NO: 3434816 - RNA, 23 nt, Pseudomonas aeruginosa PA01
acgauggccggcagcagcgccag

SEQ ID NO: 3434817 - RNA, 16 nt, Pseudomonas aeruginosa PA01
acgaugguggucggca

SEQ ID NO: 3434818 - RNA, 21 nt, Pseudomonas aeruginosa PA01
acgauguucgaggcgccgacc

SEQ ID NO: 3434819 - RNA, 17 nt, Pseudomonas aeruginosa PA01
acgcaaacgccauccgc

SEQ ID NO: 3434820 - RNA, 16 nt, Pseudomonas aeruginosa PA01
acgcaacccgcccggc

SEQ ID NO: 3434821 - RNA, 13 nt, Pseudomonas aeruginosa PA01
acgcaagugcccu

SEQ ID NO: 3434822 - RNA, 15 nt, Pseudomonas aeruginosa PA01
acgcaagugcccugg

SEQ ID NO: 3434823 - RNA, 20 nt, Pseudomonas aeruginosa PA01
acgcaauccucggugcgcac

SEQ ID NO: 3434824 - RNA, 16 nt, Pseudomonas aeruginosa PA01
acgcacaaugaaaaag

SEQ ID NO: 3434825 - RNA, 17 nt, Pseudomonas aeruginosa PA01
acgcaccaccaggucga

SEQ ID NO: 3434826 - RNA, 17 nt, Pseudomonas aeruginosa PA01
acgcaccagcucccggc

SEQ ID NO: 3434827 - RNA, 12 nt, Pseudomonas aeruginosa PA01
acgcacucauag

SEQ ID NO: 3434828 - RNA, 22 nt, Pseudomonas aeruginosa PA01
acgcacucauagcucagcugga

SEQ ID NO: 3434829 - RNA, 17 nt, Pseudomonas aeruginosa PA01
acgcacugguugaagcg

SEQ ID NO: 3434830 - RNA, 15 nt, Pseudomonas aeruginosa PA01
acgcacuucguccgc

SEQ ID NO: 3434831 - RNA, 12 nt, Pseudomonas aeruginosa PA01
acgcagaaggcg

SEQ ID NO: 3434832 - RNA, 21 nt, Pseudomonas aeruginosa PA01
acgcagagcggcaggccgccg

SEQ ID NO: 3434833 - RNA, 14 nt, Pseudomonas aeruginosa PA01
acgcagcacggcgg

SEQ ID NO: 3434834 - RNA, 15 nt, Pseudomonas aeruginosa PA01
acgcagcacggcggc

SEQ ID NO: 3434835 - RNA, 17 nt, Pseudomonas aeruginosa PA01
acgcagcagagguagag

SEQ ID NO: 3434836 - RNA, 11 nt, Pseudomonas aeruginosa PA01
acgcagcagcu

SEQ ID NO: 3434837 - RNA, 18 nt, Pseudomonas aeruginosa PA01
acgcagcagcuucggcgc

SEQ ID NO: 3434838 - RNA, 20 nt, Pseudomonas aeruginosa PA01
acgcagcagcuucggcgcga

SEQ ID NO: 3434839 - RNA, 13 nt, Pseudomonas aeruginosa PA01
acgcagcaggcga

SEQ ID NO: 3434840 - RNA, 19 nt, Pseudomonas aeruginosa PA01
acgcagccacccgcgggca

SEQ ID NO: 3434841 - RNA, 23 nt, Pseudomonas aeruginosa PA01
acgcagccacccgcgggcagcag

SEQ ID NO: 3434842 - RNA, 21 nt, Pseudomonas aeruginosa PA01
acgcagccgggccgcagcgca

SEQ ID NO: 3434843 - RNA, 16 nt, Pseudomonas aeruginosa PA01
acgcagcgcgcgccga

SEQ ID NO: 3434844 - RNA, 18 nt, Pseudomonas aeruginosa PA01
acgcagcgcgcgucggcg

SEQ ID NO: 3434845 - RNA, 22 nt, Pseudomonas aeruginosa PA01
acgcagcgggucgaucaggcgc

SEQ ID NO: 3434846 - RNA, 14 nt, Pseudomonas aeruginosa PA01
acgcagcucugcga

SEQ ID NO: 3434847 - RNA, 22 nt, Pseudomonas aeruginosa PA01
acgcagcucugcgaucagggcc

SEQ ID NO: 3434848 - RNA, 17 nt, Pseudomonas aeruginosa PA01
acgcaggaacagcuccu

SEQ ID NO: 3434849 - RNA, 14 nt, Pseudomonas aeruginosa PA01
acgcaggccagcgc

SEQ ID NO: 3434850 - RNA, 15 nt, Pseudomonas aeruginosa PA01
acgcaggccagcgcc

SEQ ID NO: 3434851 - RNA, 19 nt, Pseudomonas aeruginosa PA01
acgcaggccagcgccaggg

SEQ ID NO: 3434852 - RNA, 19 nt, Pseudomonas aeruginosa PA01
acgcaggcgcauggcguuc

SEQ ID NO: 3434853 - RNA, 13 nt, Pseudomonas aeruginosa PA01
acgcaggcgcugg

SEQ ID NO: 3434854 - RNA, 17 nt, Pseudomonas aeruginosa PA01
acgcaggcuuuccagcc

SEQ ID NO: 3434855 - RNA, 20 nt, Pseudomonas aeruginosa PA01
acgcaggcuuuccagcccgg

SEQ ID NO: 3434856 - RNA, 22 nt, Pseudomonas aeruginosa PA01
acgcaggcuuuccagcccggcg

SEQ ID NO: 3434857 - RNA, 21 nt, Pseudomonas aeruginosa PA01
acgcagggccggaugccaccg

SEQ ID NO: 3434858 - RNA, 22 nt, Pseudomonas aeruginosa PA01
acgcagggccggaugccaccgc

SEQ ID NO: 3434859 - RNA, 14 nt, Pseudomonas aeruginosa PA01
acgcagggcggcgc

SEQ ID NO: 3434860 - RNA, 20 nt, Pseudomonas aeruginosa PA01
acgcagggcgguacgccgcg

SEQ ID NO: 3434861 - RNA, 17 nt, Pseudomonas aeruginosa PA01
acgcaggggcaccggcg

SEQ ID NO: 3434862 - RNA, 18 nt, Pseudomonas aeruginosa PA01
acgcaggggcaccggcgg

SEQ ID NO: 3434863 - RNA, 20 nt, Pseudomonas aeruginosa PA01
acgcaguacagcugcaccgc

SEQ ID NO: 3434864 - RNA, 22 nt, Pseudomonas aeruginosa PA01
acgcaguucgcgggccgcggcg

SEQ ID NO: 3434865 - RNA, 23 nt, Pseudomonas aeruginosa PA01
acgcauagcgcgcuguagccggc

SEQ ID NO: 3434866 - RNA, 14 nt, Pseudomonas aeruginosa PA01
acgcaucugcucga

SEQ ID NO: 3434867 - RNA, 14 nt, Pseudomonas aeruginosa PA01
acgcaugcgcggcg

SEQ ID NO: 3434868 - RNA, 16 nt, Pseudomonas aeruginosa PA01
acgcauguucaugcgc

SEQ ID NO: 3434869 - RNA, 14 nt, Pseudomonas aeruginosa PA01
acgccacaggcguu

SEQ ID NO: 3434870 - RNA, 21 nt, Pseudomonas aeruginosa PA01
acgccacaggcguuauccgcc

SEQ ID NO: 3434871 - RNA, 13 nt, Pseudomonas aeruginosa PA01
acgccaccagcca

SEQ ID NO: 3434872 - RNA, 14 nt, Pseudomonas aeruginosa PA01
acgccaccagccag

SEQ ID NO: 3434873 - RNA, 15 nt, Pseudomonas aeruginosa PA01
acgccaccagccagg

SEQ ID NO: 3434874 - RNA, 20 nt, Pseudomonas aeruginosa PA01
acgccaccagccaggcggcc

SEQ ID NO: 3434875 - RNA, 13 nt, Pseudomonas aeruginosa PA01
acgccaccaggcc

SEQ ID NO: 3434876 - RNA, 15 nt, Pseudomonas aeruginosa PA01
acgccaccaggccgc

SEQ ID NO: 3434877 - RNA, 23 nt, Pseudomonas aeruginosa PA01
acgccaccaggccgcugccgccg

SEQ ID NO: 3434878 - RNA, 19 nt, Pseudomonas aeruginosa PA01
acgccaccagggccuugcc

SEQ ID NO: 3434879 - RNA, 13 nt, Pseudomonas aeruginosa PA01
acgccacccgcau

SEQ ID NO: 3434880 - RNA, 16 nt, Pseudomonas aeruginosa PA01
acgccagaagcgacug

SEQ ID NO: 3434881 - RNA, 15 nt, Pseudomonas aeruginosa PA01
acgccagcaggcgca

SEQ ID NO: 3434882 - RNA, 16 nt, Pseudomonas aeruginosa PA01
acgccagcaggcgcag

SEQ ID NO: 3434883 - RNA, 18 nt, Pseudomonas aeruginosa PA01
acgccagcaggcgcaggu

SEQ ID NO: 3434884 - RNA, 22 nt, Pseudomonas aeruginosa PA01
acgccagcaggcgcaggucggc

SEQ ID NO: 3434885 - RNA, 11 nt, Pseudomonas aeruginosa PA01
acgccagccca

SEQ ID NO: 3434886 - RNA, 16 nt, Pseudomonas aeruginosa PA01
acgccagcccucgccc

SEQ ID NO: 3434887 - RNA, 17 nt, Pseudomonas aeruginosa PA01
acgccagcggcgaucgc

SEQ ID NO: 3434888 - RNA, 23 nt, Pseudomonas aeruginosa PA01
acgccagcggcgaucgccugguc

SEQ ID NO: 3434889 - RNA, 24 nt, Pseudomonas aeruginosa PA01
acgccagcggcgaucgccuggucg

SEQ ID NO: 3434890 - RNA, 16 nt, Pseudomonas aeruginosa PA01
acgccaggaucggcau

SEQ ID NO: 3434891 - RNA, 22 nt, Pseudomonas aeruginosa PA01
acgccaggcagucguaggucug

SEQ ID NO: 3434892 - RNA, 12 nt, Pseudomonas aeruginosa PA01
acgccaggccgc

SEQ ID NO: 3434893 - RNA, 13 nt, Pseudomonas aeruginosa PA01
acgccaggcgucc

SEQ ID NO: 3434894 - RNA, 19 nt, Pseudomonas aeruginosa PA01
acgccaggcugucagggcg

SEQ ID NO: 3434895 - RNA, 17 nt, Pseudomonas aeruginosa PA01
acgccauacugggcggc

SEQ ID NO: 3434896 - RNA, 16 nt, Pseudomonas aeruginosa PA01
acgccauaggcggcgc

SEQ ID NO: 3434897 - RNA, 13 nt, Pseudomonas aeruginosa PA01
acgccauccgccu

SEQ ID NO: 3434898 - RNA, 18 nt, Pseudomonas aeruginosa PA01
acgccauccgccuucuuu

SEQ ID NO: 3434899 - RNA, 15 nt, Pseudomonas aeruginosa PA01
acgccauccuucggc

SEQ ID NO: 3434900 - RNA, 21 nt, Pseudomonas aeruginosa PA01
acgccauucgaauggcgccgg

SEQ ID NO: 3434901 - RNA, 15 nt, Pseudomonas aeruginosa PA01
acgcccagcagggcc

SEQ ID NO: 3434902 - RNA, 21 nt, Pseudomonas aeruginosa PA01
acgcccagcagggccagccag

SEQ ID NO: 3434903 - RNA, 23 nt, Pseudomonas aeruginosa PA01
acgcccagcagggccagccagag

SEQ ID NO: 3434904 - RNA, 14 nt, Pseudomonas aeruginosa PA01
acgcccaggcgcuc

SEQ ID NO: 3434905 - RNA, 21 nt, Pseudomonas aeruginosa PA01
acgcccaguugcgccgccugc

SEQ ID NO: 3434906 - RNA, 22 nt, Pseudomonas aeruginosa PA01
acgcccaguugcgccgccugcg

SEQ ID NO: 3434907 - RNA, 16 nt, Pseudomonas aeruginosa PA01
acgcccaucuucaggc

SEQ ID NO: 3434908 - RNA, 16 nt, Pseudomonas aeruginosa PA01
acgcccaugccuugca

SEQ ID NO: 3434909 - RNA, 21 nt, Pseudomonas aeruginosa PA01
acgcccauguagaccaccagc

SEQ ID NO: 3434910 - RNA, 22 nt, Pseudomonas aeruginosa PA01
acgcccauguagaccaccagcg

SEQ ID NO: 3434911 - RNA, 14 nt, Pseudomonas aeruginosa PA01
acgccccagcgcau

SEQ ID NO: 3434912 - RNA, 17 nt, Pseudomonas aeruginosa PA01
acgccccagcgcaucgc

SEQ ID NO: 3434913 - RNA, 22 nt, Pseudomonas aeruginosa PA01
acgccccguuugccgucggcgc

SEQ ID NO: 3434914 - RNA, 21 nt, Pseudomonas aeruginosa PA01
acgccccuccuucgagccugg

SEQ ID NO: 3434915 - RNA, 21 nt, Pseudomonas aeruginosa PA01
acgcccgaggcguuauccgcc

SEQ ID NO: 3434916 - RNA, 19 nt, Pseudomonas aeruginosa PA01
acgcccgcagccacggcac

SEQ ID NO: 3434917 - RNA, 18 nt, Pseudomonas aeruginosa PA01
acgcccgcagccagccuc

SEQ ID NO: 3434918 - RNA, 20 nt, Pseudomonas aeruginosa PA01
acgcccgcgagccguccugc

SEQ ID NO: 3434919 - RNA, 19 nt, Pseudomonas aeruginosa PA01
acgcccgcggcagcagcca

SEQ ID NO: 3434920 - RNA, 21 nt, Pseudomonas aeruginosa PA01
acgcccgcggcguuauccgcc

SEQ ID NO: 3434921 - RNA, 23 nt, Pseudomonas aeruginosa PA01
acgcccgcgguauucuccagcag

SEQ ID NO: 3434922 - RNA, 18 nt, Pseudomonas aeruginosa PA01
acgcccgcuugcgccgcc

SEQ ID NO: 3434923 - RNA, 23 nt, Pseudomonas aeruginosa PA01
acgcccgcuugcgccgccucgcg

SEQ ID NO: 3434924 - RNA, 16 nt, Pseudomonas aeruginosa PA01
acgcccggcacucgcc

SEQ ID NO: 3434925 - RNA, 21 nt, Pseudomonas aeruginosa PA01
acgcccggcagaugccgggcg

SEQ ID NO: 3434926 - RNA, 13 nt, Pseudomonas aeruginosa PA01
acgcccggcaucu

SEQ ID NO: 3434927 - RNA, 21 nt, Pseudomonas aeruginosa PA01
acgcccggcaucugccgggcg

SEQ ID NO: 3434928 - RNA, 17 nt, Pseudomonas aeruginosa PA01
acgcccggugucgacga

SEQ ID NO: 3434929 - RNA, 18 nt, Pseudomonas aeruginosa PA01
acgcccggugucgacgac

SEQ ID NO: 3434930 - RNA, 12 nt, Pseudomonas aeruginosa PA01
acgcccuccagc

SEQ ID NO: 3434931 - RNA, 14 nt, Pseudomonas aeruginosa PA01
acgcccuccagcac

SEQ ID NO: 3434932 - RNA, 17 nt, Pseudomonas aeruginosa PA01
acgcccuccagcaccgc

SEQ ID NO: 3434933 - RNA, 23 nt, Pseudomonas aeruginosa PA01
acgcccuccagcaccgccuggcg

SEQ ID NO: 3434934 - RNA, 13 nt, Pseudomonas aeruginosa PA01
acgcccucggcga

SEQ ID NO: 3434935 - RNA, 20 nt, Pseudomonas aeruginosa PA01
acgcccucucaggagcgccg

SEQ ID NO: 3434936 - RNA, 23 nt, Pseudomonas aeruginosa PA01
acgcccugaggcuuuccugcgcc

SEQ ID NO: 3434937 - RNA, 13 nt, Pseudomonas aeruginosa PA01
acgcccugcgcca

SEQ ID NO: 3434938 - RNA, 20 nt, Pseudomonas aeruginosa PA01
acgcccugcgccagcaucgc

SEQ ID NO: 3434939 - RNA, 22 nt, Pseudomonas aeruginosa PA01
acgcccugcgccagcaucgcau

SEQ ID NO: 3434940 - RNA, 12 nt, Pseudomonas aeruginosa PA01
acgcccuggagc

SEQ ID NO: 3434941 - RNA, 20 nt, Pseudomonas aeruginosa PA01
acgcccuggcgcuugggcgc

SEQ ID NO: 3434942 - RNA, 14 nt, Pseudomonas aeruginosa PA01
acgcccugggacag

SEQ ID NO: 3434943 - RNA, 17 nt, Pseudomonas aeruginosa PA01
acgcccugggacaggcg

SEQ ID NO: 3434944 - RNA, 14 nt, Pseudomonas aeruginosa PA01
acgcccugggcgac

SEQ ID NO: 3434945 - RNA, 20 nt, Pseudomonas aeruginosa PA01
acgcccuugcggcgcggccc

SEQ ID NO: 3434946 - RNA, 18 nt, Pseudomonas aeruginosa PA01
acgcccuugcuguucgcc

SEQ ID NO: 3434947 - RNA, 17 nt, Pseudomonas aeruginosa PA01
acgccgaaacgccgacg

SEQ ID NO: 3434948 - RNA, 16 nt, Pseudomonas aeruginosa PA01
acgccgaagccgcugg

SEQ ID NO: 3434949 - RNA, 15 nt, Pseudomonas aeruginosa PA01
acgccgaaguccugc

SEQ ID NO: 3434950 - RNA, 15 nt, Pseudomonas aeruginosa PA01
acgccgaagucggcg

SEQ ID NO: 3434951 - RNA, 24 nt, Pseudomonas aeruginosa PA01
acgccgaaguucuucagcagcaug

SEQ ID NO: 3434952 - RNA, 16 nt, Pseudomonas aeruginosa PA01
acgccgacaggccggu

SEQ ID NO: 3434953 - RNA, 22 nt, Pseudomonas aeruginosa PA01
acgccgacaggccggugccgcc

SEQ ID NO: 3434954 - RNA, 21 nt, Pseudomonas aeruginosa PA01
acgccgacccuagggucggcg

SEQ ID NO: 3434955 - RNA, 22 nt, Pseudomonas aeruginosa PA01
acgccgacccuagggucggcgu

SEQ ID NO: 3434956 - RNA, 23 nt, Pseudomonas aeruginosa PA01
acgccgacggacguccuccugga

SEQ ID NO: 3434957 - RNA, 14 nt, Pseudomonas aeruginosa PA01
acgccgacggcgug

SEQ ID NO: 3434958 - RNA, 19 nt, Pseudomonas aeruginosa PA01
acgccgacggcgugccgug

SEQ ID NO: 3434959 - RNA, 17 nt, Pseudomonas aeruginosa PA01
acgccgagaacgcggcg

SEQ ID NO: 3434960 - RNA, 18 nt, Pseudomonas aeruginosa PA01
acgccgagaacgcggcga

SEQ ID NO: 3434961 - RNA, 16 nt, Pseudomonas aeruginosa PA01
acgccgagcagcacca

SEQ ID NO: 3434962 - RNA, 15 nt, Pseudomonas aeruginosa PA01
acgccgagcugacca

SEQ ID NO: 3434963 - RNA, 14 nt, Pseudomonas aeruginosa PA01
acgccgaggcugcg

SEQ ID NO: 3434964 - RNA, 13 nt, Pseudomonas aeruginosa PA01
acgccgagggcgc

SEQ ID NO: 3434965 - RNA, 17 nt, Pseudomonas aeruginosa PA01
acgccgagggcgcggcg

SEQ ID NO: 3434966 - RNA, 14 nt, Pseudomonas aeruginosa PA01
acgccgauaccggc

SEQ ID NO: 3434967 - RNA, 14 nt, Pseudomonas aeruginosa PA01
acgccgauggcguu

SEQ ID NO: 3434968 - RNA, 21 nt, Pseudomonas aeruginosa PA01
acgccgauggcguuauucgcc

SEQ ID NO: 3434969 - RNA, 21 nt, Pseudomonas aeruginosa PA01
acgccgccccagccucggcag

SEQ ID NO: 3434970 - RNA, 18 nt, Pseudomonas aeruginosa PA01
acgccgcccccagcgcgc

SEQ ID NO: 3434971 - RNA, 19 nt, Pseudomonas aeruginosa PA01
acgccgcccgucgcgccgg

SEQ ID NO: 3434972 - RNA, 20 nt, Pseudomonas aeruginosa PA01
acgccgcccgucgcgccggc

SEQ ID NO: 3434973 - RNA, 21 nt, Pseudomonas aeruginosa PA01
acgccgcccgucgcgccggcc

SEQ ID NO: 3434974 - RNA, 12 nt, Pseudomonas aeruginosa PA01
acgccgccggcg

SEQ ID NO: 3434975 - RNA, 12 nt, Pseudomonas aeruginosa PA01
acgccgccugcg

SEQ ID NO: 3434976 - RNA, 15 nt, Pseudomonas aeruginosa PA01
acgccgccugcgccu

SEQ ID NO: 3434977 - RNA, 16 nt, Pseudomonas aeruginosa PA01
acgccgccugcgccuc

SEQ ID NO: 3434978 - RNA, 17 nt, Pseudomonas aeruginosa PA01
acgccgccugcgccucg

SEQ ID NO: 3434979 - RNA, 18 nt, Pseudomonas aeruginosa PA01
acgccgcgaagcccagcg

SEQ ID NO: 3434980 - RNA, 20 nt, Pseudomonas aeruginosa PA01
acgccgcgaagcccagcgcc

SEQ ID NO: 3434981 - RNA, 13 nt, Pseudomonas aeruginosa PA01
acgccgcgcugca

SEQ ID NO: 3434982 - RNA, 19 nt, Pseudomonas aeruginosa PA01
acgccgcgcugcaagggca

SEQ ID NO: 3434983 - RNA, 16 nt, Pseudomonas aeruginosa PA01
acgccgcgcugcgcca

SEQ ID NO: 3434984 - RNA, 18 nt, Pseudomonas aeruginosa PA01
acgccgcggaaggcccgc

SEQ ID NO: 3434985 - RNA, 15 nt, Pseudomonas aeruginosa PA01
acgccgcggccggcg

SEQ ID NO: 3434986 - RNA, 13 nt, Pseudomonas aeruginosa PA01
acgccgcggcuga

SEQ ID NO: 3434987 - RNA, 22 nt, Pseudomonas aeruginosa PA01
acgccgcggguuccucacggcg

SEQ ID NO: 3434988 - RNA, 23 nt, Pseudomonas aeruginosa PA01
acgccgcggguuccucacggcgc

SEQ ID NO: 3434989 - RNA, 18 nt, Pseudomonas aeruginosa PA01
acgccgcucuaucagggu

SEQ ID NO: 3434990 - RNA, 18 nt, Pseudomonas aeruginosa PA01
acgccgcucugcccgacc

SEQ ID NO: 3434991 - RNA, 21 nt, Pseudomonas aeruginosa PA01
acgccgcuggaaccggccggc

SEQ ID NO: 3434992 - RNA, 16 nt, Pseudomonas aeruginosa PA01
acgccgcuggcggcgc

SEQ ID NO: 3434993 - RNA, 21 nt, Pseudomonas aeruginosa PA01
acgccgcuggcguuauucgcc

SEQ ID NO: 3434994 - RNA, 21 nt, Pseudomonas aeruginosa PA01
acgccgcugucguccagcggg

SEQ ID NO: 3434995 - RNA, 23 nt, Pseudomonas aeruginosa PA01
acgccgcugucguccagcgggua

SEQ ID NO: 3434996 - RNA, 21 nt, Pseudomonas aeruginosa PA01
acgccgcuuacccagguaagc

SEQ ID NO: 3434997 - RNA, 17 nt, Pseudomonas aeruginosa PA01
acgccggacgcaccagc

SEQ ID NO: 3434998 - RNA, 19 nt, Pseudomonas aeruginosa PA01
acgccggacgcaccagcag

SEQ ID NO: 3434999 - RNA, 12 nt, Pseudomonas aeruginosa PA01
acgccggcaggu

SEQ ID NO: 3435000 - RNA, 14 nt, Pseudomonas aeruginosa PA01
acgccggcagguug

SEQ ID NO: 3435001 - RNA, 12 nt, Pseudomonas aeruginosa PA01
acgccggccucg

SEQ ID NO: 3435002 - RNA, 14 nt, Pseudomonas aeruginosa PA01
acgccggccucgcg

SEQ ID NO: 3435003 - RNA, 22 nt, Pseudomonas aeruginosa PA01
acgccgggaauccccaguagcg

SEQ ID NO: 3435004 - RNA, 17 nt, Pseudomonas aeruginosa PA01
acgccgggcaacgccag

SEQ ID NO: 3435005 - RNA, 20 nt, Pseudomonas aeruginosa PA01
acgccgggcugguucagcgg

SEQ ID NO: 3435006 - RNA, 16 nt, Pseudomonas aeruginosa PA01
acgccgggggucgcgg

SEQ ID NO: 3435007 - RNA, 18 nt, Pseudomonas aeruginosa PA01
acgccggucucgauggca

SEQ ID NO: 3435008 - RNA, 14 nt, Pseudomonas aeruginosa PA01
acgccggucucggc

SEQ ID NO: 3435009 - RNA, 16 nt, Pseudomonas aeruginosa PA01
acgccggucucggcga

SEQ ID NO: 3435010 - RNA, 17 nt, Pseudomonas aeruginosa PA01
acgccggucucggcgau

SEQ ID NO: 3435011 - RNA, 18 nt, Pseudomonas aeruginosa PA01
acgccggugccaggacca

SEQ ID NO: 3435012 - RNA, 21 nt, Pseudomonas aeruginosa PA01
acgccggugccaggaccagcc

SEQ ID NO: 3435013 - RNA, 22 nt, Pseudomonas aeruginosa PA01
acgccggugccaggaccagccc

SEQ ID NO: 3435014 - RNA, 14 nt, Pseudomonas aeruginosa PA01
acgccgguggccag

SEQ ID NO: 3435015 - RNA, 21 nt, Pseudomonas aeruginosa PA01
acgccgguggcguuauccgcc

SEQ ID NO: 3435016 - RNA, 22 nt, Pseudomonas aeruginosa PA01
acgccgguggcguuauccgccc

SEQ ID NO: 3435017 - RNA, 14 nt, Pseudomonas aeruginosa PA01
acgccguagcgcag

SEQ ID NO: 3435018 - RNA, 18 nt, Pseudomonas aeruginosa PA01
acgccguccaccagccag

SEQ ID NO: 3435019 - RNA, 16 nt, Pseudomonas aeruginosa PA01
acgccgucgccgcuga

SEQ ID NO: 3435020 - RNA, 21 nt, Pseudomonas aeruginosa PA01
acgccgucgccgcugaugcgc

SEQ ID NO: 3435021 - RNA, 17 nt, Pseudomonas aeruginosa PA01
acgccgugcaucaccgg

SEQ ID NO: 3435022 - RNA, 22 nt, Pseudomonas aeruginosa PA01
acgccgugcaucaccggcagca

SEQ ID NO: 3435023 - RNA, 16 nt, Pseudomonas aeruginosa PA01
acgccguggaccagga

SEQ ID NO: 3435024 - RNA, 22 nt, Pseudomonas aeruginosa PA01
acgccguggaccaggaucaccu

SEQ ID NO: 3435025 - RNA, 14 nt, Pseudomonas aeruginosa PA01
acgccguucagggu

SEQ ID NO: 3435026 - RNA, 14 nt, Pseudomonas aeruginosa PA01
acgccguuggcguu

SEQ ID NO: 3435027 - RNA, 21 nt, Pseudomonas aeruginosa PA01
acgccguuguugaccgcagga

SEQ ID NO: 3435028 - RNA, 14 nt, Pseudomonas aeruginosa PA01
acgccuauggcguu

SEQ ID NO: 3435029 - RNA, 23 nt, Pseudomonas aeruginosa PA01
acgccucaaggcaucgcgaaaac

SEQ ID NO: 3435030 - RNA, 19 nt, Pseudomonas aeruginosa PA01
acgccucgcagagcgccag

SEQ ID NO: 3435031 - RNA, 21 nt, Pseudomonas aeruginosa PA01
acgccucgcagagcgccagcc

SEQ ID NO: 3435032 - RNA, 23 nt, Pseudomonas aeruginosa PA01
acgccucgcggcuaucgaucacu

SEQ ID NO: 3435033 - RNA, 12 nt, Pseudomonas aeruginosa PA01
acgccucggcgc

SEQ ID NO: 3435034 - RNA, 14 nt, Pseudomonas aeruginosa PA01
acgccucggcgcga

SEQ ID NO: 3435035 - RNA, 21 nt, Pseudomonas aeruginosa PA01
acgccucgucggaggcgagga

SEQ ID NO: 3435036 - RNA, 19 nt, Pseudomonas aeruginosa PA01
acgccugcaucucuuccuc

SEQ ID NO: 3435037 - RNA, 15 nt, Pseudomonas aeruginosa PA01
acgccuggcggcugg

SEQ ID NO: 3435038 - RNA, 19 nt, Pseudomonas aeruginosa PA01
acgccuggcggcuggcgug

SEQ ID NO: 3435039 - RNA, 17 nt, Pseudomonas aeruginosa PA01
acgccugucgcuccggc

SEQ ID NO: 3435040 - RNA, 20 nt, Pseudomonas aeruginosa PA01
acgccugucggcacgacacc

SEQ ID NO: 3435041 - RNA, 17 nt, Pseudomonas aeruginosa PA01
acgccuuccagaucguc

SEQ ID NO: 3435042 - RNA, 19 nt, Pseudomonas aeruginosa PA01
acgccuuccagaucgucuu

SEQ ID NO: 3435043 - RNA, 17 nt, Pseudomonas aeruginosa PA01
acgccuucgcggccgag

SEQ ID NO: 3435044 - RNA, 18 nt, Pseudomonas aeruginosa PA01
acgccuugcagcaccgcc

SEQ ID NO: 3435045 - RNA, 24 nt, Pseudomonas aeruginosa PA01
acgccuugcagcaccgccuggucg

SEQ ID NO: 3435046 - RNA, 15 nt, Pseudomonas aeruginosa PA01
acgccuugcccggcg

SEQ ID NO: 3435047 - RNA, 22 nt, Pseudomonas aeruginosa PA01
acgcgaaugcccggcagcgccg

SEQ ID NO: 3435048 - RNA, 13 nt, Pseudomonas aeruginosa PA01
acgcgaccagcgc

SEQ ID NO: 3435049 - RNA, 14 nt, Pseudomonas aeruginosa PA01
acgcgaccagcgcc

SEQ ID NO: 3435050 - RNA, 15 nt, Pseudomonas aeruginosa PA01
acgcgaccagcgcca

SEQ ID NO: 3435051 - RNA, 18 nt, Pseudomonas aeruginosa PA01
acgcgaccagcgccaggc

SEQ ID NO: 3435052 - RNA, 21 nt, Pseudomonas aeruginosa PA01
acgcgaccagcgccaggcgcg

SEQ ID NO: 3435053 - RNA, 16 nt, Pseudomonas aeruginosa PA01
acgcgaccggucaggc

SEQ ID NO: 3435054 - RNA, 19 nt, Pseudomonas aeruginosa PA01
acgcgaccuccggcgccag

SEQ ID NO: 3435055 - RNA, 21 nt, Pseudomonas aeruginosa PA01
acgcgaccuccggcgccaggc

SEQ ID NO: 3435056 - RNA, 22 nt, Pseudomonas aeruginosa PA01
acgcgaccuccggcgccaggcc

SEQ ID NO: 3435057 - RNA, 16 nt, Pseudomonas aeruginosa PA01
acgcgagaagccgccc

SEQ ID NO: 3435058 - RNA, 15 nt, Pseudomonas aeruginosa PA01
acgcgauauccgcca

SEQ ID NO: 3435059 - RNA, 17 nt, Pseudomonas aeruginosa PA01
acgcgauauccgccagg

SEQ ID NO: 3435060 - RNA, 21 nt, Pseudomonas aeruginosa PA01
acgcgaucgcggccagccgcu

SEQ ID NO: 3435061 - RNA, 14 nt, Pseudomonas aeruginosa PA01
acgcgcaagccagc

SEQ ID NO: 3435062 - RNA, 15 nt, Pseudomonas aeruginosa PA01
acgcgcaagccagcc

SEQ ID NO: 3435063 - RNA, 17 nt, Pseudomonas aeruginosa PA01
acgcgcaagccagccau

SEQ ID NO: 3435064 - RNA, 13 nt, Pseudomonas aeruginosa PA01
acgcgcagcgccg

SEQ ID NO: 3435065 - RNA, 13 nt, Pseudomonas aeruginosa PA01
acgcgcaggccgg

SEQ ID NO: 3435066 - RNA, 14 nt, Pseudomonas aeruginosa PA01
acgcgcaggccggu

SEQ ID NO: 3435067 - RNA, 18 nt, Pseudomonas aeruginosa PA01
acgcgcagggucaggccc

SEQ ID NO: 3435068 - RNA, 16 nt, Pseudomonas aeruginosa PA01
acgcgcaugucgaggu

SEQ ID NO: 3435069 - RNA, 15 nt, Pseudomonas aeruginosa PA01
acgcgccacgcagga

SEQ ID NO: 3435070 - RNA, 16 nt, Pseudomonas aeruginosa PA01
acgcgccacggaaggc

SEQ ID NO: 3435071 - RNA, 19 nt, Pseudomonas aeruginosa PA01
acgcgccacggaaggccac

SEQ ID NO: 3435072 - RNA, 23 nt, Pseudomonas aeruginosa PA01
acgcgccacggaaggccacgccg

SEQ ID NO: 3435073 - RNA, 18 nt, Pseudomonas aeruginosa PA01
acgcgccaggugcgcugg

SEQ ID NO: 3435074 - RNA, 12 nt, Pseudomonas aeruginosa PA01
acgcgccggguc

SEQ ID NO: 3435075 - RNA, 21 nt, Pseudomonas aeruginosa PA01
acgcgccuccggcagcgucgg

SEQ ID NO: 3435076 - RNA, 17 nt, Pseudomonas aeruginosa PA01
acgcgccugcuucaggu

SEQ ID NO: 3435077 - RNA, 21 nt, Pseudomonas aeruginosa PA01
acgcgccugcuucagguagug

SEQ ID NO: 3435078 - RNA, 13 nt, Pseudomonas aeruginosa PA01
acgcgccuggccg

SEQ ID NO: 3435079 - RNA, 15 nt, Pseudomonas aeruginosa PA01
acgcgcgcucucgcc

SEQ ID NO: 3435080 - RNA, 18 nt, Pseudomonas aeruginosa PA01
acgcgcgcucucgccggc

SEQ ID NO: 3435081 - RNA, 22 nt, Pseudomonas aeruginosa PA01
acgcgcgcucucgccggccugg

SEQ ID NO: 3435082 - RNA, 21 nt, Pseudomonas aeruginosa PA01
acgcgcggaccuucgacggca

SEQ ID NO: 3435083 - RNA, 14 nt, Pseudomonas aeruginosa PA01
acgcgcggcugcuu

SEQ ID NO: 3435084 - RNA, 17 nt, Pseudomonas aeruginosa PA01
acgcgcggcugcuugcc

SEQ ID NO: 3435085 - RNA, 18 nt, Pseudomonas aeruginosa PA01
acgcgcggcugcuugccg

SEQ ID NO: 3435086 - RNA, 23 nt, Pseudomonas aeruginosa PA01
acgcgcuggaccauggccggcgu

SEQ ID NO: 3435087 - RNA, 19 nt, Pseudomonas aeruginosa PA01
acgcgcuuguccuccagcu

SEQ ID NO: 3435088 - RNA, 14 nt, Pseudomonas aeruginosa PA01
acgcggacagccug

SEQ ID NO: 3435089 - RNA, 16 nt, Pseudomonas aeruginosa PA01
acgcggacagccuggg

SEQ ID NO: 3435090 - RNA, 23 nt, Pseudomonas aeruginosa PA01
acgcggaccuugucgccggugag

SEQ ID NO: 3435091 - RNA, 16 nt, Pseudomonas aeruginosa PA01
acgcggagcaggcgga

SEQ ID NO: 3435092 - RNA, 18 nt, Pseudomonas aeruginosa PA01
acgcggagcaggcggaga

SEQ ID NO: 3435093 - RNA, 18 nt, Pseudomonas aeruginosa PA01
acgcggauaucgcuggcg

SEQ ID NO: 3435094 - RNA, 20 nt, Pseudomonas aeruginosa PA01
acgcggauaucgcuggcgcc

SEQ ID NO: 3435095 - RNA, 22 nt, Pseudomonas aeruginosa PA01
acgcggauaucgcuggcgccca

SEQ ID NO: 3435096 - RNA, 21 nt, Pseudomonas aeruginosa PA01
acgcggaucuggcccuuuucc

SEQ ID NO: 3435097 - RNA, 17 nt, Pseudomonas aeruginosa PA01
acgcggaugcccugguc

SEQ ID NO: 3435098 - RNA, 20 nt, Pseudomonas aeruginosa PA01
acgcggaugcccuggucggc

SEQ ID NO: 3435099 - RNA, 23 nt, Pseudomonas aeruginosa PA01
acgcggaugcccuggucggcggu

SEQ ID NO: 3435100 - RNA, 18 nt, Pseudomonas aeruginosa PA01
acgcggauuggccgggcc

SEQ ID NO: 3435101 - RNA, 16 nt, Pseudomonas aeruginosa PA01
acgcggcaccgcuuuc

SEQ ID NO: 3435102 - RNA, 14 nt, Pseudomonas aeruginosa PA01
acgcggccagcagc

SEQ ID NO: 3435103 - RNA, 12 nt, Pseudomonas aeruginosa PA01
acgcggccuggg

SEQ ID NO: 3435104 - RNA, 16 nt, Pseudomonas aeruginosa PA01
acgcggccugggccga

SEQ ID NO: 3435105 - RNA, 19 nt, Pseudomonas aeruginosa PA01
acgcggccugggccgaagg

SEQ ID NO: 3435106 - RNA, 21 nt, Pseudomonas aeruginosa PA01
acgcggccugggccgaaggcc

SEQ ID NO: 3435107 - RNA, 14 nt, Pseudomonas aeruginosa PA01
acgcggcgaagggc

SEQ ID NO: 3435108 - RNA, 15 nt, Pseudomonas aeruginosa PA01
acgcggcgaagggcg

SEQ ID NO: 3435109 - RNA, 23 nt, Pseudomonas aeruginosa PA01
acgcggcggcuccggcgccaggc

SEQ ID NO: 3435110 - RNA, 20 nt, Pseudomonas aeruginosa PA01
acgcggcguggucuccgugc

SEQ ID NO: 3435111 - RNA, 15 nt, Pseudomonas aeruginosa PA01
acgcgggccucugcc

SEQ ID NO: 3435112 - RNA, 18 nt, Pseudomonas aeruginosa PA01
acgcgggccucugccucg

SEQ ID NO: 3435113 - RNA, 20 nt, Pseudomonas aeruginosa PA01
acgcggguaauccaucgcuu

SEQ ID NO: 3435114 - RNA, 15 nt, Pseudomonas aeruginosa PA01
acgcggugccauucg

SEQ ID NO: 3435115 - RNA, 17 nt, Pseudomonas aeruginosa PA01
acgcgguuauccgccgc

SEQ ID NO: 3435116 - RNA, 21 nt, Pseudomonas aeruginosa PA01
acgcgguuccacucccaugcc

SEQ ID NO: 3435117 - RNA, 16 nt, Pseudomonas aeruginosa PA01
acgcguacgacuucgg

SEQ ID NO: 3435118 - RNA, 18 nt, Pseudomonas aeruginosa PA01
acgcguacgacuucggcg

SEQ ID NO: 3435119 - RNA, 13 nt, Pseudomonas aeruginosa PA01
acgcgugaagcug

SEQ ID NO: 3435120 - RNA, 15 nt, Pseudomonas aeruginosa PA01
acgcgugaagcugga

SEQ ID NO: 3435121 - RNA, 15 nt, Pseudomonas aeruginosa PA01
acgcgugauacagcu

SEQ ID NO: 3435122 - RNA, 20 nt, Pseudomonas aeruginosa PA01
acgcgugauacagcucgcug

SEQ ID NO: 3435123 - RNA, 17 nt, Pseudomonas aeruginosa PA01
acgcguucccccguggc

SEQ ID NO: 3435124 - RNA, 20 nt, Pseudomonas aeruginosa PA01
acgcguucccccguggcgac

SEQ ID NO: 3435125 - RNA, 13 nt, Pseudomonas aeruginosa PA01
acgcguucggcga

SEQ ID NO: 3435126 - RNA, 22 nt, Pseudomonas aeruginosa PA01
acgcguucggcgaugccgcgcc

SEQ ID NO: 3435127 - RNA, 22 nt, Pseudomonas aeruginosa PA01
acgcguugcuuguguccgccga

SEQ ID NO: 3435128 - RNA, 13 nt, Pseudomonas aeruginosa PA01
acgcucaccacca

SEQ ID NO: 3435129 - RNA, 15 nt, Pseudomonas aeruginosa PA01
acgcucaccaccacc

SEQ ID NO: 3435130 - RNA, 17 nt, Pseudomonas aeruginosa PA01
acgcucaccaccaccgc

SEQ ID NO: 3435131 - RNA, 19 nt, Pseudomonas aeruginosa PA01
acgcucaccaccaccgcgc

SEQ ID NO: 3435132 - RNA, 23 nt, Pseudomonas aeruginosa PA01
acgcucaccggucgagagggaua

SEQ ID NO: 3435133 - RNA, 17 nt, Pseudomonas aeruginosa PA01
acgcucagcacccuggc

SEQ ID NO: 3435134 - RNA, 21 nt, Pseudomonas aeruginosa PA01
acgcucagccccgaucgccuc

SEQ ID NO: 3435135 - RNA, 12 nt, Pseudomonas aeruginosa PA01
acgcucaggcca

SEQ ID NO: 3435136 - RNA, 17 nt, Pseudomonas aeruginosa PA01
acgcucagugcgccggg

SEQ ID NO: 3435137 - RNA, 23 nt, Pseudomonas aeruginosa PA01
acgcuccagcggcagcucggcga

SEQ ID NO: 3435138 - RNA, 13 nt, Pseudomonas aeruginosa PA01
acgcuccaggugc

SEQ ID NO: 3435139 - RNA, 14 nt, Pseudomonas aeruginosa PA01
acgcuccugcgccg

SEQ ID NO: 3435140 - RNA, 17 nt, Pseudomonas aeruginosa PA01
acgcuccugcgccggcu

SEQ ID NO: 3435141 - RNA, 22 nt, Pseudomonas aeruginosa PA01
acgcuccuggaagaacaggcgc

SEQ ID NO: 3435142 - RNA, 18 nt, Pseudomonas aeruginosa PA01
acgcucgacauugcugcc

SEQ ID NO: 3435143 - RNA, 14 nt, Pseudomonas aeruginosa PA01
acgcucgccgacgg

SEQ ID NO: 3435144 - RNA, 16 nt, Pseudomonas aeruginosa PA01
acgcucgcggcauccc

SEQ ID NO: 3435145 - RNA, 16 nt, Pseudomonas aeruginosa PA01
acgcucggcuucgcgu

SEQ ID NO: 3435146 - RNA, 20 nt, Pseudomonas aeruginosa PA01
acgcucggggugcgcggcga

SEQ ID NO: 3435147 - RNA, 23 nt, Pseudomonas aeruginosa PA01
acgcucuccgucaaugcggccug

SEQ ID NO: 3435148 - RNA, 17 nt, Pseudomonas aeruginosa PA01
acgcucucgaacagcag

SEQ ID NO: 3435149 - RNA, 19 nt, Pseudomonas aeruginosa PA01
acgcucucgaacagcagca

SEQ ID NO: 3435150 - RNA, 15 nt, Pseudomonas aeruginosa PA01
acgcucuucaccucg

SEQ ID NO: 3435151 - RNA, 14 nt, Pseudomonas aeruginosa PA01
acgcucuucuuaca

SEQ ID NO: 3435152 - RNA, 17 nt, Pseudomonas aeruginosa PA01
acgcugaagaucgccac

SEQ ID NO: 3435153 - RNA, 17 nt, Pseudomonas aeruginosa PA01
acgcugacgccggcacc

SEQ ID NO: 3435154 - RNA, 24 nt, Pseudomonas aeruginosa PA01
acgcugaggaucacgauggccggc

SEQ ID NO: 3435155 - RNA, 15 nt, Pseudomonas aeruginosa PA01
acgcugaggcucagc

SEQ ID NO: 3435156 - RNA, 21 nt, Pseudomonas aeruginosa PA01
acgcugaugaugccgcggcga

SEQ ID NO: 3435157 - RNA, 15 nt, Pseudomonas aeruginosa PA01
acgcugaugccggcg

SEQ ID NO: 3435158 - RNA, 17 nt, Pseudomonas aeruginosa PA01
acgcugcaauucgucgg

SEQ ID NO: 3435159 - RNA, 21 nt, Pseudomonas aeruginosa PA01
acgcugcaauucgucggccug

SEQ ID NO: 3435160 - RNA, 22 nt, Pseudomonas aeruginosa PA01
acgcugcaauucgucggccugc

SEQ ID NO: 3435161 - RNA, 20 nt, Pseudomonas aeruginosa PA01
acgcugccagcaggccgagc

SEQ ID NO: 3435162 - RNA, 14 nt, Pseudomonas aeruginosa PA01
acgcugccagguug

SEQ ID NO: 3435163 - RNA, 17 nt, Pseudomonas aeruginosa PA01
acgcugcccagcccgcc

SEQ ID NO: 3435164 - RNA, 14 nt, Pseudomonas aeruginosa PA01
acgcugcgaccugg

SEQ ID NO: 3435165 - RNA, 18 nt, Pseudomonas aeruginosa PA01
acgcugcgaccuggcgcc

SEQ ID NO: 3435166 - RNA, 13 nt, Pseudomonas aeruginosa PA01
acgcugcgccggc

SEQ ID NO: 3435167 - RNA, 14 nt, Pseudomonas aeruginosa PA01
acgcugcgccggcg

SEQ ID NO: 3435168 - RNA, 15 nt, Pseudomonas aeruginosa PA01
acgcugcugccggcc

SEQ ID NO: 3435169 - RNA, 16 nt, Pseudomonas aeruginosa PA01
acgcuggcgaggacgc

SEQ ID NO: 3435170 - RNA, 15 nt, Pseudomonas aeruginosa PA01
acgcuggcggccgag

SEQ ID NO: 3435171 - RNA, 20 nt, Pseudomonas aeruginosa PA01
acgcuggcggccgaguucgc

SEQ ID NO: 3435172 - RNA, 19 nt, Pseudomonas aeruginosa PA01
acgcugggacggcugccca

SEQ ID NO: 3435173 - RNA, 19 nt, Pseudomonas aeruginosa PA01
acgcugggcugggucggcu

SEQ ID NO: 3435174 - RNA, 14 nt, Pseudomonas aeruginosa PA01
acgcuggucaggcu

SEQ ID NO: 3435175 - RNA, 15 nt, Pseudomonas aeruginosa PA01
acgcuggucaggcug

SEQ ID NO: 3435176 - RNA, 16 nt, Pseudomonas aeruginosa PA01
acgcuggucaggcuga

SEQ ID NO: 3435177 - RNA, 19 nt, Pseudomonas aeruginosa PA01
acgcuguagaccagcuuga

SEQ ID NO: 3435178 - RNA, 13 nt, Pseudomonas aeruginosa PA01
acgcugucgugga

SEQ ID NO: 3435179 - RNA, 14 nt, Pseudomonas aeruginosa PA01
acgcugucguggac

SEQ ID NO: 3435180 - RNA, 21 nt, Pseudomonas aeruginosa PA01
acgcugucguggacgccggug

SEQ ID NO: 3435181 - RNA, 17 nt, Pseudomonas aeruginosa PA01
acgcuguugguguugau

SEQ ID NO: 3435182 - RNA, 13 nt, Pseudomonas aeruginosa PA01
acgcuucgaagcu

SEQ ID NO: 3435183 - RNA, 23 nt, Pseudomonas aeruginosa PA01
acgcuucgaagcucucgccgcgc

SEQ ID NO: 3435184 - RNA, 15 nt, Pseudomonas aeruginosa PA01
acgcuucugcgccuc

SEQ ID NO: 3435185 - RNA, 14 nt, Pseudomonas aeruginosa PA01
acgcuugagcuggc

SEQ ID NO: 3435186 - RNA, 19 nt, Pseudomonas aeruginosa PA01
acgcuugcguuccuccucg

SEQ ID NO: 3435187 - RNA, 20 nt, Pseudomonas aeruginosa PA01
acgcuugcguuccuccucgu

SEQ ID NO: 3435188 - RNA, 23 nt, Pseudomonas aeruginosa PA01
acgcuuggcgaucacggcgcccc

SEQ ID NO: 3435189 - RNA, 17 nt, Pseudomonas aeruginosa PA01
acggaaacgacaggcug

SEQ ID NO: 3435190 - RNA, 21 nt, Pseudomonas aeruginosa PA01
acggaacaugguguugggcag

SEQ ID NO: 3435191 - RNA, 15 nt, Pseudomonas aeruginosa PA01
acggaacgucggccu

SEQ ID NO: 3435192 - RNA, 18 nt, Pseudomonas aeruginosa PA01
acggaagcauggccggcu

SEQ ID NO: 3435193 - RNA, 23 nt, Pseudomonas aeruginosa PA01
acggaagcgcugcucgaccaccu

SEQ ID NO: 3435194 - RNA, 18 nt, Pseudomonas aeruginosa PA01
acggaaggccacgccgcc

SEQ ID NO: 3435195 - RNA, 12 nt, Pseudomonas aeruginosa PA01
acggaaggucgc

SEQ ID NO: 3435196 - RNA, 22 nt, Pseudomonas aeruginosa PA01
acggaaugucgucgucgaagcu

SEQ ID NO: 3435197 - RNA, 18 nt, Pseudomonas aeruginosa PA01
acggaccgcgacaacccu

SEQ ID NO: 3435198 - RNA, 17 nt, Pseudomonas aeruginosa PA01
acggagaagggcgcgcc

SEQ ID NO: 3435199 - RNA, 16 nt, Pseudomonas aeruginosa PA01
acggauaacggcagcc

SEQ ID NO: 3435200 - RNA, 13 nt, Pseudomonas aeruginosa PA01
acggauaggcggc

SEQ ID NO: 3435201 - RNA, 15 nt, Pseudomonas aeruginosa PA01
acggauaggcggcgg

SEQ ID NO: 3435202 - RNA, 16 nt, Pseudomonas aeruginosa PA01
acggaucacgaucgcg

SEQ ID NO: 3435203 - RNA, 17 nt, Pseudomonas aeruginosa PA01
acggaucgcgcugggcg

SEQ ID NO: 3435204 - RNA, 22 nt, Pseudomonas aeruginosa PA01
acggaucgcgcugggcgcagcc

SEQ ID NO: 3435205 - RNA, 19 nt, Pseudomonas aeruginosa PA01
acggaucgcgucgcaggcg

SEQ ID NO: 3435206 - RNA, 19 nt, Pseudomonas aeruginosa PA01
acggaucgcucucgcgcuu

SEQ ID NO: 3435207 - RNA, 20 nt, Pseudomonas aeruginosa PA01
acggaucgggcuucggcagc

SEQ ID NO: 3435208 - RNA, 16 nt, Pseudomonas aeruginosa PA01
acggaugcccagccuc

SEQ ID NO: 3435209 - RNA, 18 nt, Pseudomonas aeruginosa PA01
acggcaaggaccugcugc

SEQ ID NO: 3435210 - RNA, 21 nt, Pseudomonas aeruginosa PA01
acggcaaggaccugcugcccg

SEQ ID NO: 3435211 - RNA, 22 nt, Pseudomonas aeruginosa PA01
acggcaaguucgcauaggcggc

SEQ ID NO: 3435212 - RNA, 17 nt, Pseudomonas aeruginosa PA01
acggcacacgucggcau

SEQ ID NO: 3435213 - RNA, 13 nt, Pseudomonas aeruginosa PA01
acggcaccaccac

SEQ ID NO: 3435214 - RNA, 15 nt, Pseudomonas aeruginosa PA01
acggcaccaccaccg

SEQ ID NO: 3435215 - RNA, 16 nt, Pseudomonas aeruginosa PA01
acggcaccaccaccga

SEQ ID NO: 3435216 - RNA, 14 nt, Pseudomonas aeruginosa PA01
acggcacggggcgc

SEQ ID NO: 3435217 - RNA, 15 nt, Pseudomonas aeruginosa PA01
acggcacggggcgcc

SEQ ID NO: 3435218 - RNA, 22 nt, Pseudomonas aeruginosa PA01
acggcagccgcguugucccugu

SEQ ID NO: 3435219 - RNA, 23 nt, Pseudomonas aeruginosa PA01
acggcagccgcguugucccuguc

SEQ ID NO: 3435220 - RNA, 21 nt, Pseudomonas aeruginosa PA01
acggcaggccagcagguagcc

SEQ ID NO: 3435221 - RNA, 23 nt, Pseudomonas aeruginosa PA01
acggcaggggcuuucuucgccug

SEQ ID NO: 3435222 - RNA, 18 nt, Pseudomonas aeruginosa PA01
acggcaggguagccacgc

SEQ ID NO: 3435223 - RNA, 20 nt, Pseudomonas aeruginosa PA01
acggcaggguagccacgccg

SEQ ID NO: 3435224 - RNA, 14 nt, Pseudomonas aeruginosa PA01
acggcagggucagc

SEQ ID NO: 3435225 - RNA, 18 nt, Pseudomonas aeruginosa PA01
acggcagggucagccgau

SEQ ID NO: 3435226 - RNA, 12 nt, Pseudomonas aeruginosa PA01
acggcagguggc

SEQ ID NO: 3435227 - RNA, 20 nt, Pseudomonas aeruginosa PA01
acggcagguggucguugcgc

SEQ ID NO: 3435228 - RNA, 21 nt, Pseudomonas aeruginosa PA01
acggcauaaccgucgcuggag

SEQ ID NO: 3435229 - RNA, 14 nt, Pseudomonas aeruginosa PA01
acggcaucaccggc

SEQ ID NO: 3435230 - RNA, 15 nt, Pseudomonas aeruginosa PA01
acggcaucgauccgc

SEQ ID NO: 3435231 - RNA, 20 nt, Pseudomonas aeruginosa PA01
acggcaucggagaccacggu

SEQ ID NO: 3435232 - RNA, 19 nt, Pseudomonas aeruginosa PA01
acggcaucucgauggugaa

SEQ ID NO: 3435233 - RNA, 24 nt, Pseudomonas aeruginosa PA01
acggcauuccugguccagccagcc

SEQ ID NO: 3435234 - RNA, 23 nt, Pseudomonas aeruginosa PA01
acggcauucucucuucagcaggg

SEQ ID NO: 3435235 - RNA, 21 nt, Pseudomonas aeruginosa PA01
acggcauuggagaugaucagc

SEQ ID NO: 3435236 - RNA, 20 nt, Pseudomonas aeruginosa PA01
acggccaggccacggccggc

SEQ ID NO: 3435237 - RNA, 18 nt, Pseudomonas aeruginosa PA01
acggccauaauggccgcu

SEQ ID NO: 3435238 - RNA, 14 nt, Pseudomonas aeruginosa PA01
acggcccgccccgc

SEQ ID NO: 3435239 - RNA, 21 nt, Pseudomonas aeruginosa PA01
acggccgcugcgcaggccgag

SEQ ID NO: 3435240 - RNA, 20 nt, Pseudomonas aeruginosa PA01
acggccgcuugaucuugucc

SEQ ID NO: 3435241 - RNA, 22 nt, Pseudomonas aeruginosa PA01
acggccggcgaggcguuccagg

SEQ ID NO: 3435242 - RNA, 15 nt, Pseudomonas aeruginosa PA01
acggccggcucggug

SEQ ID NO: 3435243 - RNA, 13 nt, Pseudomonas aeruginosa PA01
acggccggggcgg

SEQ ID NO: 3435244 - RNA, 19 nt, Pseudomonas aeruginosa PA01
acggccgucccagguuggc

SEQ ID NO: 3435245 - RNA, 21 nt, Pseudomonas aeruginosa PA01
acggccucgcgugcgcuggua

SEQ ID NO: 3435246 - RNA, 15 nt, Pseudomonas aeruginosa PA01
acggccuucggcagg

SEQ ID NO: 3435247 - RNA, 22 nt, Pseudomonas aeruginosa PA01
acggccuuggucucgcgggcga

SEQ ID NO: 3435248 - RNA, 21 nt, Pseudomonas aeruginosa PA01
acggcgaaaccggccagcgcg

SEQ ID NO: 3435249 - RNA, 23 nt, Pseudomonas aeruginosa PA01
acggcgaagccgcgcccggccuc

SEQ ID NO: 3435250 - RNA, 16 nt, Pseudomonas aeruginosa PA01
acggcgaaucgucgau

SEQ ID NO: 3435251 - RNA, 22 nt, Pseudomonas aeruginosa PA01
acggcgacccgaaggucgccgu

SEQ ID NO: 3435252 - RNA, 14 nt, Pseudomonas aeruginosa PA01
acggcgacccgcac

SEQ ID NO: 3435253 - RNA, 18 nt, Pseudomonas aeruginosa PA01
acggcgacccgccguucg

SEQ ID NO: 3435254 - RNA, 21 nt, Pseudomonas aeruginosa PA01
acggcgacgcugucguggacg

SEQ ID NO: 3435255 - RNA, 23 nt, Pseudomonas aeruginosa PA01
acggcgagacuaccgaucggcug

SEQ ID NO: 3435256 - RNA, 17 nt, Pseudomonas aeruginosa PA01
acggcgagagcgccgac

SEQ ID NO: 3435257 - RNA, 17 nt, Pseudomonas aeruginosa PA01
acggcgauacccaggcc

SEQ ID NO: 3435258 - RNA, 21 nt, Pseudomonas aeruginosa PA01
acggcgauacccaggccgucg

SEQ ID NO: 3435259 - RNA, 23 nt, Pseudomonas aeruginosa PA01
acggcgcagcagggcgucggcgu

SEQ ID NO: 3435260 - RNA, 21 nt, Pseudomonas aeruginosa PA01
acggcgcaggcuuggucaggg

SEQ ID NO: 3435261 - RNA, 14 nt, Pseudomonas aeruginosa PA01
acggcgcauaucca

SEQ ID NO: 3435262 - RNA, 20 nt, Pseudomonas aeruginosa PA01
acggcgcaucgucgaugcgu

SEQ ID NO: 3435263 - RNA, 11 nt, Pseudomonas aeruginosa PA01
acggcgccccg

SEQ ID NO: 3435264 - RNA, 17 nt, Pseudomonas aeruginosa PA01
acggcgcccgagggcgc

SEQ ID NO: 3435265 - RNA, 19 nt, Pseudomonas aeruginosa PA01
acggcgcccgagggcgccg

SEQ ID NO: 3435266 - RNA, 14 nt, Pseudomonas aeruginosa PA01
acggcgccgcugcc

SEQ ID NO: 3435267 - RNA, 15 nt, Pseudomonas aeruginosa PA01
acggcgccuucccag

SEQ ID NO: 3435268 - RNA, 17 nt, Pseudomonas aeruginosa PA01
acggcgcgcuccggcgc

SEQ ID NO: 3435269 - RNA, 21 nt, Pseudomonas aeruginosa PA01
acggcgcgcuccggcgcgcca

SEQ ID NO: 3435270 - RNA, 13 nt, Pseudomonas aeruginosa PA01
acggcgcggugag

SEQ ID NO: 3435271 - RNA, 21 nt, Pseudomonas aeruginosa PA01
acggcgcggugagggcgacgu

SEQ ID NO: 3435272 - RNA, 16 nt, Pseudomonas aeruginosa PA01
acggcgcgucggcggu

SEQ ID NO: 3435273 - RNA, 16 nt, Pseudomonas aeruginosa PA01
acggcgcgucuccaug

SEQ ID NO: 3435274 - RNA, 19 nt, Pseudomonas aeruginosa PA01
acggcgcugaacagcuggc

SEQ ID NO: 3435275 - RNA, 20 nt, Pseudomonas aeruginosa PA01
acggcgcugaacagcuggcg

SEQ ID NO: 3435276 - RNA, 20 nt, Pseudomonas aeruginosa PA01
acggcgcuuucaucaggcgc

SEQ ID NO: 3435277 - RNA, 21 nt, Pseudomonas aeruginosa PA01
acggcgcuuucaucaggcgcu

SEQ ID NO: 3435278 - RNA, 15 nt, Pseudomonas aeruginosa PA01
acggcggaaggcggc

SEQ ID NO: 3435279 - RNA, 18 nt, Pseudomonas aeruginosa PA01
acggcggaauuccugcuc

SEQ ID NO: 3435280 - RNA, 22 nt, Pseudomonas aeruginosa PA01
acggcggacugcucgccgccgg

SEQ ID NO: 3435281 - RNA, 16 nt, Pseudomonas aeruginosa PA01
acggcggauaaccgcg

SEQ ID NO: 3435282 - RNA, 18 nt, Pseudomonas aeruginosa PA01
acggcggauaacgccguu

SEQ ID NO: 3435283 - RNA, 22 nt, Pseudomonas aeruginosa PA01
acggcggauugacgauggccag

SEQ ID NO: 3435284 - RNA, 14 nt, Pseudomonas aeruginosa PA01
acggcggcaacgac

SEQ ID NO: 3435285 - RNA, 18 nt, Pseudomonas aeruginosa PA01
acggcggcgaccccgauc

SEQ ID NO: 3435286 - RNA, 18 nt, Pseudomonas aeruginosa PA01
acggcgggccgcucagga

SEQ ID NO: 3435287 - RNA, 22 nt, Pseudomonas aeruginosa PA01
acggcggguugaccccgagguc

SEQ ID NO: 3435288 - RNA, 15 nt, Pseudomonas aeruginosa PA01
acggcguaccaggau

SEQ ID NO: 3435289 - RNA, 21 nt, Pseudomonas aeruginosa PA01
acggcgugagggucgcgccga

SEQ ID NO: 3435290 - RNA, 23 nt, Pseudomonas aeruginosa PA01
acggcgugccguggcucggcggc

SEQ ID NO: 3435291 - RNA, 17 nt, Pseudomonas aeruginosa PA01
acggcguuauccgccgc

SEQ ID NO: 3435292 - RNA, 14 nt, Pseudomonas aeruginosa PA01
acggcguucggggc

SEQ ID NO: 3435293 - RNA, 19 nt, Pseudomonas aeruginosa PA01
acggcguucggggcccucc

SEQ ID NO: 3435294 - RNA, 20 nt, Pseudomonas aeruginosa PA01
acggcucagaacagcggcag

SEQ ID NO: 3435295 - RNA, 15 nt, Pseudomonas aeruginosa PA01
acggcucgccgggua

SEQ ID NO: 3435296 - RNA, 14 nt, Pseudomonas aeruginosa PA01
acggcucuuccccu

SEQ ID NO: 3435297 - RNA, 22 nt, Pseudomonas aeruginosa PA01
acggcugagaccuuccugccag

SEQ ID NO: 3435298 - RNA, 16 nt, Pseudomonas aeruginosa PA01
acggcugaggcuggcg

SEQ ID NO: 3435299 - RNA, 20 nt, Pseudomonas aeruginosa PA01
acggcugaggcuggcgaccg

SEQ ID NO: 3435300 - RNA, 15 nt, Pseudomonas aeruginosa PA01
acggcugcccaacug

SEQ ID NO: 3435301 - RNA, 16 nt, Pseudomonas aeruginosa PA01
acggcugcuccggauc

SEQ ID NO: 3435302 - RNA, 14 nt, Pseudomonas aeruginosa PA01
acggcuggucggcu

SEQ ID NO: 3435303 - RNA, 15 nt, Pseudomonas aeruginosa PA01
acggcuguugucgaa

SEQ ID NO: 3435304 - RNA, 15 nt, Pseudomonas aeruginosa PA01
acggcuucagcgcca

SEQ ID NO: 3435305 - RNA, 16 nt, Pseudomonas aeruginosa PA01
acggcuucagcgccag

SEQ ID NO: 3435306 - RNA, 18 nt, Pseudomonas aeruginosa PA01
acggcuucagcgccaggc

SEQ ID NO: 3435307 - RNA, 20 nt, Pseudomonas aeruginosa PA01
acggcuucgaccacgacccg

SEQ ID NO: 3435308 - RNA, 22 nt, Pseudomonas aeruginosa PA01
acggcuucgcagaugucgguca

SEQ ID NO: 3435309 - RNA, 15 nt, Pseudomonas aeruginosa PA01
acggcuugaggaagu

SEQ ID NO: 3435310 - RNA, 14 nt, Pseudomonas aeruginosa PA01
acggcuugccggua

SEQ ID NO: 3435311 - RNA, 21 nt, Pseudomonas aeruginosa PA01
acggcuugccgguagggcgaa

SEQ ID NO: 3435312 - RNA, 14 nt, Pseudomonas aeruginosa PA01
acggcuugcugaca

SEQ ID NO: 3435313 - RNA, 22 nt, Pseudomonas aeruginosa PA01
acggcuugucggguagggcgaa

SEQ ID NO: 3435314 - RNA, 17 nt, Pseudomonas aeruginosa PA01
acggcuuguucagcucg

SEQ ID NO: 3435315 - RNA, 21 nt, Pseudomonas aeruginosa PA01
acggcuuguucagcucggcgu

SEQ ID NO: 3435316 - RNA, 15 nt, Pseudomonas aeruginosa PA01
acgggaagcgaacca

SEQ ID NO: 3435317 - RNA, 15 nt, Pseudomonas aeruginosa PA01
acgggaaguaggccu

SEQ ID NO: 3435318 - RNA, 22 nt, Pseudomonas aeruginosa PA01
acgggaaguaggccuggccgcc

SEQ ID NO: 3435319 - RNA, 17 nt, Pseudomonas aeruginosa PA01
acgggagcgcgaggcgc

SEQ ID NO: 3435320 - RNA, 11 nt, Pseudomonas aeruginosa PA01
acgggccgcgc

SEQ ID NO: 3435321 - RNA, 13 nt, Pseudomonas aeruginosa PA01
acgggccgcgccg

SEQ ID NO: 3435322 - RNA, 13 nt, Pseudomonas aeruginosa PA01
acgggccuguuga

SEQ ID NO: 3435323 - RNA, 17 nt, Pseudomonas aeruginosa PA01
acgggcgacccaggccg

SEQ ID NO: 3435324 - RNA, 19 nt, Pseudomonas aeruginosa PA01
acgggcgacccaggccgac

SEQ ID NO: 3435325 - RNA, 23 nt, Pseudomonas aeruginosa PA01
acgggcgaggcuaacgccgagga

SEQ ID NO: 3435326 - RNA, 14 nt, Pseudomonas aeruginosa PA01
acgggcgccagcgg

SEQ ID NO: 3435327 - RNA, 16 nt, Pseudomonas aeruginosa PA01
acgggcgccagcgguu

SEQ ID NO: 3435328 - RNA, 13 nt, Pseudomonas aeruginosa PA01
acgggcgccaggg

SEQ ID NO: 3435329 - RNA, 14 nt, Pseudomonas aeruginosa PA01
acgggcguugccgg

SEQ ID NO: 3435330 - RNA, 17 nt, Pseudomonas aeruginosa PA01
acgggcguugccggcau

SEQ ID NO: 3435331 - RNA, 14 nt, Pseudomonas aeruginosa PA01
acgggcucacccac

SEQ ID NO: 3435332 - RNA, 18 nt, Pseudomonas aeruginosa PA01
acggggacaugucgaggg

SEQ ID NO: 3435333 - RNA, 12 nt, Pseudomonas aeruginosa PA01
acggggaucacu

SEQ ID NO: 3435334 - RNA, 20 nt, Pseudomonas aeruginosa PA01
acggggaucacucgccgccg

SEQ ID NO: 3435335 - RNA, 18 nt, Pseudomonas aeruginosa PA01
acggggccccucgccgug

SEQ ID NO: 3435336 - RNA, 16 nt, Pseudomonas aeruginosa PA01
acggggcgccuguccg

SEQ ID NO: 3435337 - RNA, 14 nt, Pseudomonas aeruginosa PA01
acgggucgcagccg

SEQ ID NO: 3435338 - RNA, 17 nt, Pseudomonas aeruginosa PA01
acgggucgcagccgagc

SEQ ID NO: 3435339 - RNA, 23 nt, Pseudomonas aeruginosa PA01
acgggucgucgcccuggccgauc

SEQ ID NO: 3435340 - RNA, 15 nt, Pseudomonas aeruginosa PA01
acgggugccggagaa

SEQ ID NO: 3435341 - RNA, 19 nt, Pseudomonas aeruginosa PA01
acgggugcguccauccagg

SEQ ID NO: 3435342 - RNA, 23 nt, Pseudomonas aeruginosa PA01
acgggugcugaagauaucgccuu

SEQ ID NO: 3435343 - RNA, 14 nt, Pseudomonas aeruginosa PA01
acgggugcugcgga

SEQ ID NO: 3435344 - RNA, 17 nt, Pseudomonas aeruginosa PA01
acggguguuucggccgc

SEQ ID NO: 3435345 - RNA, 21 nt, Pseudomonas aeruginosa PA01
acggguguuucggccgcugcc

SEQ ID NO: 3435346 - RNA, 22 nt, Pseudomonas aeruginosa PA01
acggguguuucggccgcugccg

SEQ ID NO: 3435347 - RNA, 20 nt, Pseudomonas aeruginosa PA01
acggguugaucagguucggc

SEQ ID NO: 3435348 - RNA, 13 nt, Pseudomonas aeruginosa PA01
acgguaaaacaag

SEQ ID NO: 3435349 - RNA, 17 nt, Pseudomonas aeruginosa PA01
acgguagagacggcggc

SEQ ID NO: 3435350 - RNA, 17 nt, Pseudomonas aeruginosa PA01
acgguagcccgcggcga

SEQ ID NO: 3435351 - RNA, 13 nt, Pseudomonas aeruginosa PA01
acgguagcggcag

SEQ ID NO: 3435352 - RNA, 17 nt, Pseudomonas aeruginosa PA01
acgguagcggcaggagc

SEQ ID NO: 3435353 - RNA, 13 nt, Pseudomonas aeruginosa PA01
acgguagguagcg

SEQ ID NO: 3435354 - RNA, 19 nt, Pseudomonas aeruginosa PA01
acgguagguagcguugcgc

SEQ ID NO: 3435355 - RNA, 23 nt, Pseudomonas aeruginosa PA01
acgguccaggaucauccgcacca

SEQ ID NO: 3435356 - RNA, 21 nt, Pseudomonas aeruginosa PA01
acgguccugcggaucgaggaa

SEQ ID NO: 3435357 - RNA, 22 nt, Pseudomonas aeruginosa PA01
acggucgaggcggagaagccgc

SEQ ID NO: 3435358 - RNA, 22 nt, Pseudomonas aeruginosa PA01
acggucuugcgcuugccggccg

SEQ ID NO: 3435359 - RNA, 17 nt, Pseudomonas aeruginosa PA01
acggugaaccaggcgcc

SEQ ID NO: 3435360 - RNA, 14 nt, Pseudomonas aeruginosa PA01
acggugacacccug

SEQ ID NO: 3435361 - RNA, 23 nt, Pseudomonas aeruginosa PA01
acggugacacccugccgcgccgg

SEQ ID NO: 3435362 - RNA, 15 nt, Pseudomonas aeruginosa PA01
acggugaucaggcgc

SEQ ID NO: 3435363 - RNA, 17 nt, Pseudomonas aeruginosa PA01
acggugaucaggcgcuu

SEQ ID NO: 3435364 - RNA, 23 nt, Pseudomonas aeruginosa PA01
acggugaucgccgcgagguggau

SEQ ID NO: 3435365 - RNA, 19 nt, Pseudomonas aeruginosa PA01
acggugcagccacccagca

SEQ ID NO: 3435366 - RNA, 14 nt, Pseudomonas aeruginosa PA01
acggugguggaagu

SEQ ID NO: 3435367 - RNA, 17 nt, Pseudomonas aeruginosa PA01
acgguguugccgugguc

SEQ ID NO: 3435368 - RNA, 14 nt, Pseudomonas aeruginosa PA01
acgguucagcagcg

SEQ ID NO: 3435369 - RNA, 21 nt, Pseudomonas aeruginosa PA01
acgguuggccagcgaacgcac

SEQ ID NO: 3435370 - RNA, 23 nt, Pseudomonas aeruginosa PA01
acgguuggccucggcccgguuuu

SEQ ID NO: 3435371 - RNA, 15 nt, Pseudomonas aeruginosa PA01
acgguugucgaugcg

SEQ ID NO: 3435372 - RNA, 16 nt, Pseudomonas aeruginosa PA01
acgguugucgaugcgc

SEQ ID NO: 3435373 - RNA, 18 nt, Pseudomonas aeruginosa PA01
acgguugucgaugcgccc

SEQ ID NO: 3435374 - RNA, 14 nt, Pseudomonas aeruginosa PA01
acgguuucaggccu

SEQ ID NO: 3435375 - RNA, 14 nt, Pseudomonas aeruginosa PA01
acguaaucgccauu

SEQ ID NO: 3435376 - RNA, 15 nt, Pseudomonas aeruginosa PA01
acguaauucgcugac

SEQ ID NO: 3435377 - RNA, 13 nt, Pseudomonas aeruginosa PA01
acguacuccagca

SEQ ID NO: 3435378 - RNA, 19 nt, Pseudomonas aeruginosa PA01
acguacucgucgcucuggg

SEQ ID NO: 3435379 - RNA, 16 nt, Pseudomonas aeruginosa PA01
acguagaggaucucgc

SEQ ID NO: 3435380 - RNA, 13 nt, Pseudomonas aeruginosa PA01
acguagccggcgu

SEQ ID NO: 3435381 - RNA, 19 nt, Pseudomonas aeruginosa PA01
acguaggacaggucggugu

SEQ ID NO: 3435382 - RNA, 20 nt, Pseudomonas aeruginosa PA01
acguaguaggcgcggguggc

SEQ ID NO: 3435383 - RNA, 17 nt, Pseudomonas aeruginosa PA01
acguaucccagcgcgug

SEQ ID NO: 3435384 - RNA, 14 nt, Pseudomonas aeruginosa PA01
acgucaccguccuu

SEQ ID NO: 3435385 - RNA, 15 nt, Pseudomonas aeruginosa PA01
acgucaccguccuuc

SEQ ID NO: 3435386 - RNA, 18 nt, Pseudomonas aeruginosa PA01
acgucacggauaggcggc

SEQ ID NO: 3435387 - RNA, 20 nt, Pseudomonas aeruginosa PA01
acgucacggauaggcggcgg

SEQ ID NO: 3435388 - RNA, 16 nt, Pseudomonas aeruginosa PA01
acguccacugcguccu

SEQ ID NO: 3435389 - RNA, 19 nt, Pseudomonas aeruginosa PA01
acguccagaugaaacugcc

SEQ ID NO: 3435390 - RNA, 22 nt, Pseudomonas aeruginosa PA01
acguccagaugaaacugcccgg

SEQ ID NO: 3435391 - RNA, 15 nt, Pseudomonas aeruginosa PA01
acguccagggcacca

SEQ ID NO: 3435392 - RNA, 18 nt, Pseudomonas aeruginosa PA01
acguccagggcaccacgg

SEQ ID NO: 3435393 - RNA, 19 nt, Pseudomonas aeruginosa PA01
acguccagggcaccacgga

SEQ ID NO: 3435394 - RNA, 21 nt, Pseudomonas aeruginosa PA01
acguccggcgagaaaggcugc

SEQ ID NO: 3435395 - RNA, 22 nt, Pseudomonas aeruginosa PA01
acguccggcgagaaaggcugcu

SEQ ID NO: 3435396 - RNA, 13 nt, Pseudomonas aeruginosa PA01
acguccggcgucc

SEQ ID NO: 3435397 - RNA, 16 nt, Pseudomonas aeruginosa PA01
acguccuacgaaggca

SEQ ID NO: 3435398 - RNA, 13 nt, Pseudomonas aeruginosa PA01
acguccuccagga

SEQ ID NO: 3435399 - RNA, 21 nt, Pseudomonas aeruginosa PA01
acguccucgaugcccgccucg

SEQ ID NO: 3435400 - RNA, 15 nt, Pseudomonas aeruginosa PA01
acguccucgcgccgc

SEQ ID NO: 3435401 - RNA, 21 nt, Pseudomonas aeruginosa PA01
acguccuggccgagccgcuug

SEQ ID NO: 3435402 - RNA, 16 nt, Pseudomonas aeruginosa PA01
acgucgaaaccgaacg

SEQ ID NO: 3435403 - RNA, 16 nt, Pseudomonas aeruginosa PA01
acgucgacuucgucga

SEQ ID NO: 3435404 - RNA, 17 nt, Pseudomonas aeruginosa PA01
acgucgacuucgucgaa

SEQ ID NO: 3435405 - RNA, 22 nt, Pseudomonas aeruginosa PA01
acgucgaggaaggccaggucgc

SEQ ID NO: 3435406 - RNA, 14 nt, Pseudomonas aeruginosa PA01
acgucgagguaguc

SEQ ID NO: 3435407 - RNA, 17 nt, Pseudomonas aeruginosa PA01
acgucgauauccagcgg

SEQ ID NO: 3435408 - RNA, 19 nt, Pseudomonas aeruginosa PA01
acgucgauauccagcggca

SEQ ID NO: 3435409 - RNA, 21 nt, Pseudomonas aeruginosa PA01
acgucgauauugccgcgggua

SEQ ID NO: 3435410 - RNA, 23 nt, Pseudomonas aeruginosa PA01
acgucgaucugcucguccaggcc

SEQ ID NO: 3435411 - RNA, 20 nt, Pseudomonas aeruginosa PA01
acgucgaugccuucggcggc

SEQ ID NO: 3435412 - RNA, 15 nt, Pseudomonas aeruginosa PA01
acgucgccccagccu

SEQ ID NO: 3435413 - RNA, 14 nt, Pseudomonas aeruginosa PA01
acgucgccccaggg

SEQ ID NO: 3435414 - RNA, 16 nt, Pseudomonas aeruginosa PA01
acgucgccgaccaggc

SEQ ID NO: 3435415 - RNA, 17 nt, Pseudomonas aeruginosa PA01
acgucgccgaccaggcg

SEQ ID NO: 3435416 - RNA, 16 nt, Pseudomonas aeruginosa PA01
acgucgcgcaccuggc

SEQ ID NO: 3435417 - RNA, 20 nt, Pseudomonas aeruginosa PA01
acgucgcgcaccuggcgguc

SEQ ID NO: 3435418 - RNA, 23 nt, Pseudomonas aeruginosa PA01
acgucgcggauguucaccagguu

SEQ ID NO: 3435419 - RNA, 14 nt, Pseudomonas aeruginosa PA01
acgucggcgcgcau

SEQ ID NO: 3435420 - RNA, 13 nt, Pseudomonas aeruginosa PA01
acgucggcggcgg

SEQ ID NO: 3435421 - RNA, 12 nt, Pseudomonas aeruginosa PA01
acgucggcgucc

SEQ ID NO: 3435422 - RNA, 18 nt, Pseudomonas aeruginosa PA01
acgucguagccaggcacc

SEQ ID NO: 3435423 - RNA, 15 nt, Pseudomonas aeruginosa PA01
acgucguaggccgag

SEQ ID NO: 3435424 - RNA, 14 nt, Pseudomonas aeruginosa PA01
acgucguccggcgc

SEQ ID NO: 3435425 - RNA, 19 nt, Pseudomonas aeruginosa PA01
acgucguugggccccaccg

SEQ ID NO: 3435426 - RNA, 18 nt, Pseudomonas aeruginosa PA01
acgucguuucucggcgau

SEQ ID NO: 3435427 - RNA, 12 nt, Pseudomonas aeruginosa PA01
acgucucggcga

SEQ ID NO: 3435428 - RNA, 22 nt, Pseudomonas aeruginosa PA01
acgucuguugcgguggugucug

SEQ ID NO: 3435429 - RNA, 14 nt, Pseudomonas aeruginosa PA01
acgucuucaggcgc

SEQ ID NO: 3435430 - RNA, 15 nt, Pseudomonas aeruginosa PA01
acgucuucaggcgcu

SEQ ID NO: 3435431 - RNA, 15 nt, Pseudomonas aeruginosa PA01
acgucuugcaggcuc

SEQ ID NO: 3435432 - RNA, 18 nt, Pseudomonas aeruginosa PA01
acgugaagccccuggcgc

SEQ ID NO: 3435433 - RNA, 19 nt, Pseudomonas aeruginosa PA01
acgugaccguccagcgcgc

SEQ ID NO: 3435434 - RNA, 15 nt, Pseudomonas aeruginosa PA01
acgugcaccaucgca

SEQ ID NO: 3435435 - RNA, 17 nt, Pseudomonas aeruginosa PA01
acgugcacgccgugcau

SEQ ID NO: 3435436 - RNA, 23 nt, Pseudomonas aeruginosa PA01
acgugcacgccgugcaucaccgg

SEQ ID NO: 3435437 - RNA, 17 nt, Pseudomonas aeruginosa PA01
acgugcaggaucaccug

SEQ ID NO: 3435438 - RNA, 19 nt, Pseudomonas aeruginosa PA01
acgugcaggaucaccugcu

SEQ ID NO: 3435439 - RNA, 14 nt, Pseudomonas aeruginosa PA01
acgugcggccugca

SEQ ID NO: 3435440 - RNA, 19 nt, Pseudomonas aeruginosa PA01
acgugcggggugcgcugga

SEQ ID NO: 3435441 - RNA, 22 nt, Pseudomonas aeruginosa PA01
acgugcucgcggaccagcuccg

SEQ ID NO: 3435442 - RNA, 14 nt, Pseudomonas aeruginosa PA01
acguggcauucguc

SEQ ID NO: 3435443 - RNA, 16 nt, Pseudomonas aeruginosa PA01
acguggcauucgucgc

SEQ ID NO: 3435444 - RNA, 19 nt, Pseudomonas aeruginosa PA01
acguggcauucgucgccgc

SEQ ID NO: 3435445 - RNA, 16 nt, Pseudomonas aeruginosa PA01
acguggccggcgcgga

SEQ ID NO: 3435446 - RNA, 21 nt, Pseudomonas aeruginosa PA01
acgugggccugcuccucggca

SEQ ID NO: 3435447 - RNA, 23 nt, Pseudomonas aeruginosa PA01
acguggugauacguccguucagg

SEQ ID NO: 3435448 - RNA, 21 nt, Pseudomonas aeruginosa PA01
acguguucgcagucgcuuccg

SEQ ID NO: 3435449 - RNA, 18 nt, Pseudomonas aeruginosa PA01
acguucaggcuguugccc

SEQ ID NO: 3435450 - RNA, 18 nt, Pseudomonas aeruginosa PA01
acguucaguucugggcgg

SEQ ID NO: 3435451 - RNA, 18 nt, Pseudomonas aeruginosa PA01
acguucugcccgccggcg

SEQ ID NO: 3435452 - RNA, 19 nt, Pseudomonas aeruginosa PA01
acguucuugaccuucugca

SEQ ID NO: 3435453 - RNA, 17 nt, Pseudomonas aeruginosa PA01
acguugaacacaucgac

SEQ ID NO: 3435454 - RNA, 23 nt, Pseudomonas aeruginosa PA01
acguugccgcgcgggccggcgau

SEQ ID NO: 3435455 - RNA, 20 nt, Pseudomonas aeruginosa PA01
acguugcgccgcagcggcgu

SEQ ID NO: 3435456 - RNA, 14 nt, Pseudomonas aeruginosa PA01
acguugcugcccug

SEQ ID NO: 3435457 - RNA, 15 nt, Pseudomonas aeruginosa PA01
acguugcugcccugg

SEQ ID NO: 3435458 - RNA, 21 nt, Pseudomonas aeruginosa PA01
acguugcugcccuggcgcgcg

SEQ ID NO: 3435459 - RNA, 21 nt, Pseudomonas aeruginosa PA01
acguuggccgucuccaggcgc

SEQ ID NO: 3435460 - RNA, 13 nt, Pseudomonas aeruginosa PA01
acguuguugccca

SEQ ID NO: 3435461 - RNA, 12 nt, Pseudomonas aeruginosa PA01
acuacaggaccu

SEQ ID NO: 3435462 - RNA, 20 nt, Pseudomonas aeruginosa PA01
acuaccagguucugccagag

SEQ ID NO: 3435463 - RNA, 20 nt, Pseudomonas aeruginosa PA01
acuaccgccgagggcgccag

SEQ ID NO: 3435464 - RNA, 22 nt, Pseudomonas aeruginosa PA01
acuaccuggggauggccggcgc

SEQ ID NO: 3435465 - RNA, 15 nt, Pseudomonas aeruginosa PA01
acuagcccucgaccu

SEQ ID NO: 3435466 - RNA, 16 nt, Pseudomonas aeruginosa PA01
acuagcccucgaccug

SEQ ID NO: 3435467 - RNA, 19 nt, Pseudomonas aeruginosa PA01
acuagcccucgaccuggcu

SEQ ID NO: 3435468 - RNA, 18 nt, Pseudomonas aeruginosa PA01
acucacggaugccgggcg

SEQ ID NO: 3435469 - RNA, 21 nt, Pseudomonas aeruginosa PA01
acucaggaaaaaacgccgguc

SEQ ID NO: 3435470 - RNA, 13 nt, Pseudomonas aeruginosa PA01
acucauagcucag

SEQ ID NO: 3435471 - RNA, 14 nt, Pseudomonas aeruginosa PA01
acucauagcucagc

SEQ ID NO: 3435472 - RNA, 18 nt, Pseudomonas aeruginosa PA01
acucauagcucagcugga

SEQ ID NO: 3435473 - RNA, 17 nt, Pseudomonas aeruginosa PA01
acucaucaggcugccga

SEQ ID NO: 3435474 - RNA, 18 nt, Pseudomonas aeruginosa PA01
acucaucaggcugccgag

SEQ ID NO: 3435475 - RNA, 20 nt, Pseudomonas aeruginosa PA01
acucaucaggcugccgagca

SEQ ID NO: 3435476 - RNA, 12 nt, Pseudomonas aeruginosa PA01
acucaugcaggc

SEQ ID NO: 3435477 - RNA, 14 nt, Pseudomonas aeruginosa PA01
acucaugcaggccg

SEQ ID NO: 3435478 - RNA, 15 nt, Pseudomonas aeruginosa PA01
acucaugcaggccga

SEQ ID NO: 3435479 - RNA, 20 nt, Pseudomonas aeruginosa PA01
acucauggccgcagcggcug

SEQ ID NO: 3435480 - RNA, 15 nt, Pseudomonas aeruginosa PA01
acuccacacggaaca

SEQ ID NO: 3435481 - RNA, 18 nt, Pseudomonas aeruginosa PA01
acuccagauagugcggcc

SEQ ID NO: 3435482 - RNA, 16 nt, Pseudomonas aeruginosa PA01
acuccagcaacggcau

SEQ ID NO: 3435483 - RNA, 18 nt, Pseudomonas aeruginosa PA01
acuccagcaacggcaucg

SEQ ID NO: 3435484 - RNA, 13 nt, Pseudomonas aeruginosa PA01
acuccagcggggu

SEQ ID NO: 3435485 - RNA, 16 nt, Pseudomonas aeruginosa PA01
acuccagcgggguggc

SEQ ID NO: 3435486 - RNA, 22 nt, Pseudomonas aeruginosa PA01
acuccaggcggcgguagccgag

SEQ ID NO: 3435487 - RNA, 15 nt, Pseudomonas aeruginosa PA01
acuccauaguagaga

SEQ ID NO: 3435488 - RNA, 15 nt, Pseudomonas aeruginosa PA01
acuccaucucgcggc

SEQ ID NO: 3435489 - RNA, 16 nt, Pseudomonas aeruginosa PA01
acuccaucucgcggcg

SEQ ID NO: 3435490 - RNA, 14 nt, Pseudomonas aeruginosa PA01
acuccccagcaggc

SEQ ID NO: 3435491 - RNA, 19 nt, Pseudomonas aeruginosa PA01
acucccggcccuugagcau

SEQ ID NO: 3435492 - RNA, 23 nt, Pseudomonas aeruginosa PA01
acucccggcccuugagcauggcg

SEQ ID NO: 3435493 - RNA, 12 nt, Pseudomonas aeruginosa PA01
acucccggccug

SEQ ID NO: 3435494 - RNA, 13 nt, Pseudomonas aeruginosa PA01
acucccggccugg

SEQ ID NO: 3435495 - RNA, 22 nt, Pseudomonas aeruginosa PA01
acucccggccuggugacccgga

SEQ ID NO: 3435496 - RNA, 19 nt, Pseudomonas aeruginosa PA01
acucccguccagcgcuuga

SEQ ID NO: 3435497 - RNA, 19 nt, Pseudomonas aeruginosa PA01
acuccgagcaggacagcag

SEQ ID NO: 3435498 - RNA, 17 nt, Pseudomonas aeruginosa PA01
acuccgagggccgcgcc

SEQ ID NO: 3435499 - RNA, 18 nt, Pseudomonas aeruginosa PA01
acuccgagggccgcgccg

SEQ ID NO: 3435500 - RNA, 20 nt, Pseudomonas aeruginosa PA01
acuccgagggccgcgccgac

SEQ ID NO: 3435501 - RNA, 21 nt, Pseudomonas aeruginosa PA01
acuccgagggccgcgccgacc

SEQ ID NO: 3435502 - RNA, 20 nt, Pseudomonas aeruginosa PA01
acuccgccacccgcuccggc

SEQ ID NO: 3435503 - RNA, 14 nt, Pseudomonas aeruginosa PA01
acuccgccagcacc

SEQ ID NO: 3435504 - RNA, 12 nt, Pseudomonas aeruginosa PA01
acuccgccagcu

SEQ ID NO: 3435505 - RNA, 15 nt, Pseudomonas aeruginosa PA01
acuccgccagcuugu

SEQ ID NO: 3435506 - RNA, 22 nt, Pseudomonas aeruginosa PA01
acuccgccagcuuguccgccgg

SEQ ID NO: 3435507 - RNA, 12 nt, Pseudomonas aeruginosa PA01
acuccgccaggc

SEQ ID NO: 3435508 - RNA, 23 nt, Pseudomonas aeruginosa PA01
acuccgcccaguucuucgccgcc

SEQ ID NO: 3435509 - RNA, 20 nt, Pseudomonas aeruginosa PA01
acuccgccgcuuccgccggc

SEQ ID NO: 3435510 - RNA, 14 nt, Pseudomonas aeruginosa PA01
acuccgccugucca

SEQ ID NO: 3435511 - RNA, 15 nt, Pseudomonas aeruginosa PA01
acuccggaggcgcac

SEQ ID NO: 3435512 - RNA, 21 nt, Pseudomonas aeruginosa PA01
acuccggaggcgcacaggcgg

SEQ ID NO: 3435513 - RNA, 18 nt, Pseudomonas aeruginosa PA01
acuccggcagcacccgca

SEQ ID NO: 3435514 - RNA, 21 nt, Pseudomonas aeruginosa PA01
acuccggcagcacccgcacca

SEQ ID NO: 3435515 - RNA, 14 nt, Pseudomonas aeruginosa PA01
acuccggcaggcgc

SEQ ID NO: 3435516 - RNA, 15 nt, Pseudomonas aeruginosa PA01
acuccggcgcagccc

SEQ ID NO: 3435517 - RNA, 18 nt, Pseudomonas aeruginosa PA01
acuccgggaacagcccgu

SEQ ID NO: 3435518 - RNA, 21 nt, Pseudomonas aeruginosa PA01
acuccggguugaccgccagac

SEQ ID NO: 3435519 - RNA, 16 nt, Pseudomonas aeruginosa PA01
acuccggugucaggcc

SEQ ID NO: 3435520 - RNA, 17 nt, Pseudomonas aeruginosa PA01
acuccguccagugcggc

SEQ ID NO: 3435521 - RNA, 15 nt, Pseudomonas aeruginosa PA01
acuccugcaaacggg

SEQ ID NO: 3435522 - RNA, 14 nt, Pseudomonas aeruginosa PA01
acucgaaggccagc

SEQ ID NO: 3435523 - RNA, 16 nt, Pseudomonas aeruginosa PA01
acucgaaggccagcuc

SEQ ID NO: 3435524 - RNA, 17 nt, Pseudomonas aeruginosa PA01
acucgaaggccagcucg

SEQ ID NO: 3435525 - RNA, 14 nt, Pseudomonas aeruginosa PA01
acucgacgcgccag

SEQ ID NO: 3435526 - RNA, 21 nt, Pseudomonas aeruginosa PA01
acucgacgcgccaggugcgcu

SEQ ID NO: 3435527 - RNA, 14 nt, Pseudomonas aeruginosa PA01
acucgacgcugccc

SEQ ID NO: 3435528 - RNA, 19 nt, Pseudomonas aeruginosa PA01
acucgacgcugcccagccc

SEQ ID NO: 3435529 - RNA, 18 nt, Pseudomonas aeruginosa PA01
acucgaugaaaccggccu

SEQ ID NO: 3435530 - RNA, 15 nt, Pseudomonas aeruginosa PA01
acucgaugaacagcg

SEQ ID NO: 3435531 - RNA, 15 nt, Pseudomonas aeruginosa PA01
acucgaugaacgccc

SEQ ID NO: 3435532 - RNA, 15 nt, Pseudomonas aeruginosa PA01
acucgaugcgcagcu

SEQ ID NO: 3435533 - RNA, 15 nt, Pseudomonas aeruginosa PA01
acucgcagccgcgcu

SEQ ID NO: 3435534 - RNA, 15 nt, Pseudomonas aeruginosa PA01
acucgccagcgcgcg

SEQ ID NO: 3435535 - RNA, 22 nt, Pseudomonas aeruginosa PA01
acucgcccgaccccacgccggc

SEQ ID NO: 3435536 - RNA, 13 nt, Pseudomonas aeruginosa PA01
acucgccgaccag

SEQ ID NO: 3435537 - RNA, 14 nt, Pseudomonas aeruginosa PA01
acucgccgccgaca

SEQ ID NO: 3435538 - RNA, 11 nt, Pseudomonas aeruginosa PA01
acucgccggca

SEQ ID NO: 3435539 - RNA, 18 nt, Pseudomonas aeruginosa PA01
acucgccgggcgucugcc

SEQ ID NO: 3435540 - RNA, 20 nt, Pseudomonas aeruginosa PA01
acucgccgggcgucugcccg

SEQ ID NO: 3435541 - RNA, 16 nt, Pseudomonas aeruginosa PA01
acucgcgacgggugcg

SEQ ID NO: 3435542 - RNA, 18 nt, Pseudomonas aeruginosa PA01
acucgcgagauggcgucg

SEQ ID NO: 3435543 - RNA, 13 nt, Pseudomonas aeruginosa PA01
acucgcgagcugg

SEQ ID NO: 3435544 - RNA, 15 nt, Pseudomonas aeruginosa PA01
acucgcgagcuggcg

SEQ ID NO: 3435545 - RNA, 16 nt, Pseudomonas aeruginosa PA01
acucgcgagcuggcgc

SEQ ID NO: 3435546 - RNA, 17 nt, Pseudomonas aeruginosa PA01
acucgcgagcuggcgcc

SEQ ID NO: 3435547 - RNA, 17 nt, Pseudomonas aeruginosa PA01
acucgcgaucgaucggc

SEQ ID NO: 3435548 - RNA, 13 nt, Pseudomonas aeruginosa PA01
acucgcggucccg

SEQ ID NO: 3435549 - RNA, 21 nt, Pseudomonas aeruginosa PA01
acucgcuccuccgggcgugcc

SEQ ID NO: 3435550 - RNA, 16 nt, Pseudomonas aeruginosa PA01
acucgcugccggcgcg

SEQ ID NO: 3435551 - RNA, 17 nt, Pseudomonas aeruginosa PA01
acucgcugccggcgcgc

SEQ ID NO: 3435552 - RNA, 20 nt, Pseudomonas aeruginosa PA01
acucgcugccggcgcgcacg

SEQ ID NO: 3435553 - RNA, 17 nt, Pseudomonas aeruginosa PA01
acucgcugggcgccggc

SEQ ID NO: 3435554 - RNA, 13 nt, Pseudomonas aeruginosa PA01
acucggacggcuc

SEQ ID NO: 3435555 - RNA, 19 nt, Pseudomonas aeruginosa PA01
acucggccagcaaugcccg

SEQ ID NO: 3435556 - RNA, 13 nt, Pseudomonas aeruginosa PA01
acucggccaggcg

SEQ ID NO: 3435557 - RNA, 15 nt, Pseudomonas aeruginosa PA01
acucggccaggcgcc

SEQ ID NO: 3435558 - RNA, 17 nt, Pseudomonas aeruginosa PA01
acucggccaggcgccag

SEQ ID NO: 3435559 - RNA, 19 nt, Pseudomonas aeruginosa PA01
acucggccaggcgccaggg

SEQ ID NO: 3435560 - RNA, 13 nt, Pseudomonas aeruginosa PA01
acucggccucggc

SEQ ID NO: 3435561 - RNA, 15 nt, Pseudomonas aeruginosa PA01
acucggccuggaacc

SEQ ID NO: 3435562 - RNA, 13 nt, Pseudomonas aeruginosa PA01
acucggcgccgau

SEQ ID NO: 3435563 - RNA, 15 nt, Pseudomonas aeruginosa PA01
acucggcgcugccgg

SEQ ID NO: 3435564 - RNA, 22 nt, Pseudomonas aeruginosa PA01
acucggcggggcgcagcaggau

SEQ ID NO: 3435565 - RNA, 19 nt, Pseudomonas aeruginosa PA01
acucggcugcaacgccgcg

SEQ ID NO: 3435566 - RNA, 22 nt, Pseudomonas aeruginosa PA01
acucguagucgaucaggaacac

SEQ ID NO: 3435567 - RNA, 21 nt, Pseudomonas aeruginosa PA01
acucguccggucgcaccgcca

SEQ ID NO: 3435568 - RNA, 12 nt, Pseudomonas aeruginosa PA01
acucgucgccaa

SEQ ID NO: 3435569 - RNA, 21 nt, Pseudomonas aeruginosa PA01
acucgucgccccacagcggug

SEQ ID NO: 3435570 - RNA, 20 nt, Pseudomonas aeruginosa PA01
acucgucguccagcggcucg

SEQ ID NO: 3435571 - RNA, 16 nt, Pseudomonas aeruginosa PA01
acucgugcuccaccuc

SEQ ID NO: 3435572 - RNA, 13 nt, Pseudomonas aeruginosa PA01
acucgugggccgg

SEQ ID NO: 3435573 - RNA, 17 nt, Pseudomonas aeruginosa PA01
acucguguuccggcagg

SEQ ID NO: 3435574 - RNA, 14 nt, Pseudomonas aeruginosa PA01
acucguugcacgca

SEQ ID NO: 3435575 - RNA, 21 nt, Pseudomonas aeruginosa PA01
acucuccaggucggucggcgg

SEQ ID NO: 3435576 - RNA, 22 nt, Pseudomonas aeruginosa PA01
acucuccaggucggucggcggc

SEQ ID NO: 3435577 - RNA, 11 nt, Pseudomonas aeruginosa PA01
acucuucaguc

SEQ ID NO: 3435578 - RNA, 22 nt, Pseudomonas aeruginosa PA01
acucuuccagggucggcaccga

SEQ ID NO: 3435579 - RNA, 23 nt, Pseudomonas aeruginosa PA01
acugaacucgguguagcugaggc

SEQ ID NO: 3435580 - RNA, 18 nt, Pseudomonas aeruginosa PA01
acugaacuggaucggccc

SEQ ID NO: 3435581 - RNA, 20 nt, Pseudomonas aeruginosa PA01
acugaagagugggcggggua

SEQ ID NO: 3435582 - RNA, 14 nt, Pseudomonas aeruginosa PA01
acugaccaccagga

SEQ ID NO: 3435583 - RNA, 21 nt, Pseudomonas aeruginosa PA01
acugaccacgcagagcggcag

SEQ ID NO: 3435584 - RNA, 17 nt, Pseudomonas aeruginosa PA01
acugacgaaggcuggag

SEQ ID NO: 3435585 - RNA, 21 nt, Pseudomonas aeruginosa PA01
acugacgcgcagcgccgccgc

SEQ ID NO: 3435586 - RNA, 12 nt, Pseudomonas aeruginosa PA01
acugacggcgga

SEQ ID NO: 3435587 - RNA, 23 nt, Pseudomonas aeruginosa PA01
acugacgguggaggcgggcucac

SEQ ID NO: 3435588 - RNA, 13 nt, Pseudomonas aeruginosa PA01
acugagggucagc

SEQ ID NO: 3435589 - RNA, 21 nt, Pseudomonas aeruginosa PA01
acugagggucagccgcaggcc

SEQ ID NO: 3435590 - RNA, 14 nt, Pseudomonas aeruginosa PA01
acugauauccgcuc

SEQ ID NO: 3435591 - RNA, 21 nt, Pseudomonas aeruginosa PA01
acugauaucguuguucagcag

SEQ ID NO: 3435592 - RNA, 14 nt, Pseudomonas aeruginosa PA01
acugcaacuggccg

SEQ ID NO: 3435593 - RNA, 19 nt, Pseudomonas aeruginosa PA01
acugcacgcagacgucgag

SEQ ID NO: 3435594 - RNA, 19 nt, Pseudomonas aeruginosa PA01
acugcacgcccaggcgcuc

SEQ ID NO: 3435595 - RNA, 20 nt, Pseudomonas aeruginosa PA01
acugcacgcccaucgccacc

SEQ ID NO: 3435596 - RNA, 23 nt, Pseudomonas aeruginosa PA01
acugcacgcccaucgccaccagc

SEQ ID NO: 3435597 - RNA, 22 nt, Pseudomonas aeruginosa PA01
acugcaugucgcugagcggcug

SEQ ID NO: 3435598 - RNA, 22 nt, Pseudomonas aeruginosa PA01
acugcccagcgccgccagcagg

SEQ ID NO: 3435599 - RNA, 13 nt, Pseudomonas aeruginosa PA01
acugccgacggcg

SEQ ID NO: 3435600 - RNA, 16 nt, Pseudomonas aeruginosa PA01
acugccgacggcggcg

SEQ ID NO: 3435601 - RNA, 13 nt, Pseudomonas aeruginosa PA01
acugccgaugguc

SEQ ID NO: 3435602 - RNA, 16 nt, Pseudomonas aeruginosa PA01
acugccgccucagcga

SEQ ID NO: 3435603 - RNA, 19 nt, Pseudomonas aeruginosa PA01
acugccgcuaucgcuggcg

SEQ ID NO: 3435604 - RNA, 21 nt, Pseudomonas aeruginosa PA01
acugccgcuaucgcuggcgca

SEQ ID NO: 3435605 - RNA, 22 nt, Pseudomonas aeruginosa PA01
acugccgcuaucgcuggcgcag

SEQ ID NO: 3435606 - RNA, 19 nt, Pseudomonas aeruginosa PA01
acugccgggccagcuccag

SEQ ID NO: 3435607 - RNA, 23 nt, Pseudomonas aeruginosa PA01
acugccugcagguagcgcugcgc

SEQ ID NO: 3435608 - RNA, 14 nt, Pseudomonas aeruginosa PA01
acugccuggcaggu

SEQ ID NO: 3435609 - RNA, 20 nt, Pseudomonas aeruginosa PA01
acugcgagcaccaugccgau

SEQ ID NO: 3435610 - RNA, 15 nt, Pseudomonas aeruginosa PA01
acugcgcaggcuggu

SEQ ID NO: 3435611 - RNA, 12 nt, Pseudomonas aeruginosa PA01
acugcgccagcc

SEQ ID NO: 3435612 - RNA, 22 nt, Pseudomonas aeruginosa PA01
acugcgccaguuccuucgccga

SEQ ID NO: 3435613 - RNA, 20 nt, Pseudomonas aeruginosa PA01
acugcgccaugccguucagg

SEQ ID NO: 3435614 - RNA, 23 nt, Pseudomonas aeruginosa PA01
acugcgccaugccguucaggccg

SEQ ID NO: 3435615 - RNA, 12 nt, Pseudomonas aeruginosa PA01
acugcgcgggca

SEQ ID NO: 3435616 - RNA, 23 nt, Pseudomonas aeruginosa PA01
acugcgcgggcaugcaccuacca

SEQ ID NO: 3435617 - RNA, 18 nt, Pseudomonas aeruginosa PA01
acugcgguuuuccugccc

SEQ ID NO: 3435618 - RNA, 20 nt, Pseudomonas aeruginosa PA01
acugcgguuuuccugccccg

SEQ ID NO: 3435619 - RNA, 22 nt, Pseudomonas aeruginosa PA01
acugcgguuuuccugccccgug

SEQ ID NO: 3435620 - RNA, 23 nt, Pseudomonas aeruginosa PA01
acugcguggguagccauggcgga

SEQ ID NO: 3435621 - RNA, 17 nt, Pseudomonas aeruginosa PA01
acugcucgccgccggcg

SEQ ID NO: 3435622 - RNA, 21 nt, Pseudomonas aeruginosa PA01
acugcucgccgccggcgagga

SEQ ID NO: 3435623 - RNA, 21 nt, Pseudomonas aeruginosa PA01
acugcucgggcgucuccugcc

SEQ ID NO: 3435624 - RNA, 20 nt, Pseudomonas aeruginosa PA01
acugcucgguauggcugcug

SEQ ID NO: 3435625 - RNA, 13 nt, Pseudomonas aeruginosa PA01
acugcugcugcgg

SEQ ID NO: 3435626 - RNA, 21 nt, Pseudomonas aeruginosa PA01
acugcugcugcggggccugcu

SEQ ID NO: 3435627 - RNA, 16 nt, Pseudomonas aeruginosa PA01
acugcuggacggcgga

SEQ ID NO: 3435628 - RNA, 21 nt, Pseudomonas aeruginosa PA01
acugcuucaggcgcgcggcca

SEQ ID NO: 3435629 - RNA, 20 nt, Pseudomonas aeruginosa PA01
acugcuugccgagcugggcg

SEQ ID NO: 3435630 - RNA, 19 nt, Pseudomonas aeruginosa PA01
acugcuuggccaggcgcuu

SEQ ID NO: 3435631 - RNA, 13 nt, Pseudomonas aeruginosa PA01
acuggaaacgccc

SEQ ID NO: 3435632 - RNA, 21 nt, Pseudomonas aeruginosa PA01
acuggaacagcgcgucacucg

SEQ ID NO: 3435633 - RNA, 14 nt, Pseudomonas aeruginosa PA01
acuggaagaaggcg

SEQ ID NO: 3435634 - RNA, 15 nt, Pseudomonas aeruginosa PA01
acuggaagccugcca

SEQ ID NO: 3435635 - RNA, 22 nt, Pseudomonas aeruginosa PA01
acuggaagccugccagaccgag

SEQ ID NO: 3435636 - RNA, 13 nt, Pseudomonas aeruginosa PA01
acuggaaggccgc

SEQ ID NO: 3435637 - RNA, 18 nt, Pseudomonas aeruginosa PA01
acuggaaggccgcgccga

SEQ ID NO: 3435638 - RNA, 21 nt, Pseudomonas aeruginosa PA01
acuggauacgcuuggccaggu

SEQ ID NO: 3435639 - RNA, 18 nt, Pseudomonas aeruginosa PA01
acuggaugucgcuggcca

SEQ ID NO: 3435640 - RNA, 18 nt, Pseudomonas aeruginosa PA01
acuggauucggccugccg

SEQ ID NO: 3435641 - RNA, 18 nt, Pseudomonas aeruginosa PA01
acuggccagcaccagucc

SEQ ID NO: 3435642 - RNA, 23 nt, Pseudomonas aeruginosa PA01
acuggccagcaccagucccuggc

SEQ ID NO: 3435643 - RNA, 20 nt, Pseudomonas aeruginosa PA01
acuggcccucucucgccucg

SEQ ID NO: 3435644 - RNA, 17 nt, Pseudomonas aeruginosa PA01
acuggcgaaugccuucg

SEQ ID NO: 3435645 - RNA, 20 nt, Pseudomonas aeruginosa PA01
acuggcgauggaugacccgc

SEQ ID NO: 3435646 - RNA, 13 nt, Pseudomonas aeruginosa PA01
acuggcgccaggc

SEQ ID NO: 3435647 - RNA, 14 nt, Pseudomonas aeruginosa PA01
acuggcgcugcgcg

SEQ ID NO: 3435648 - RNA, 17 nt, Pseudomonas aeruginosa PA01
acuggcggaccgccucg

SEQ ID NO: 3435649 - RNA, 18 nt, Pseudomonas aeruginosa PA01
acuggcggaccgccucga

SEQ ID NO: 3435650 - RNA, 19 nt, Pseudomonas aeruginosa PA01
acuggcggaccgccucgac

SEQ ID NO: 3435651 - RNA, 22 nt, Pseudomonas aeruginosa PA01
acuggcggaucuucgccuccuu

SEQ ID NO: 3435652 - RNA, 16 nt, Pseudomonas aeruginosa PA01
acuggcggcugggcug

SEQ ID NO: 3435653 - RNA, 20 nt, Pseudomonas aeruginosa PA01
acuggcguagggcgaauaac

SEQ ID NO: 3435654 - RNA, 19 nt, Pseudomonas aeruginosa PA01
acugggaauggcgaugccg

SEQ ID NO: 3435655 - RNA, 16 nt, Pseudomonas aeruginosa PA01
acuggggcaugggcgc

SEQ ID NO: 3435656 - RNA, 19 nt, Pseudomonas aeruginosa PA01
acugguaggacagggccag

SEQ ID NO: 3435657 - RNA, 22 nt, Pseudomonas aeruginosa PA01
acugguccggguuggcgcaggc

SEQ ID NO: 3435658 - RNA, 19 nt, Pseudomonas aeruginosa PA01
acugguccugcggcggcag

SEQ ID NO: 3435659 - RNA, 16 nt, Pseudomonas aeruginosa PA01
acuggucgcagccgcg

SEQ ID NO: 3435660 - RNA, 13 nt, Pseudomonas aeruginosa PA01
acuggucgcgcgc

SEQ ID NO: 3435661 - RNA, 17 nt, Pseudomonas aeruginosa PA01
acuggucgcuccagccc

SEQ ID NO: 3435662 - RNA, 18 nt, Pseudomonas aeruginosa PA01
acuggucgcuccagcccc

SEQ ID NO: 3435663 - RNA, 18 nt, Pseudomonas aeruginosa PA01
acugguggcgaacagcac

SEQ ID NO: 3435664 - RNA, 19 nt, Pseudomonas aeruginosa PA01
acugguuggccgccuggcg

SEQ ID NO: 3435665 - RNA, 22 nt, Pseudomonas aeruginosa PA01
acugguuggccgccuggcgcau

SEQ ID NO: 3435666 - RNA, 16 nt, Pseudomonas aeruginosa PA01
acuguaccgcucugca

SEQ ID NO: 3435667 - RNA, 12 nt, Pseudomonas aeruginosa PA01
acugucggcgga

SEQ ID NO: 3435668 - RNA, 13 nt, Pseudomonas aeruginosa PA01
acugucucgccga

SEQ ID NO: 3435669 - RNA, 23 nt, Pseudomonas aeruginosa PA01
acuguucggucgguugcggccug

SEQ ID NO: 3435670 - RNA, 19 nt, Pseudomonas aeruginosa PA01
acuguuuuccauggcgagu

SEQ ID NO: 3435671 - RNA, 15 nt, Pseudomonas aeruginosa PA01
acuucaagcuggcgc

SEQ ID NO: 3435672 - RNA, 19 nt, Pseudomonas aeruginosa PA01
acuucagcgcauacgaaaa

SEQ ID NO: 3435673 - RNA, 11 nt, Pseudomonas aeruginosa PA01
acuucaggccg

SEQ ID NO: 3435674 - RNA, 13 nt, Pseudomonas aeruginosa PA01
acuucaggccggc

SEQ ID NO: 3435675 - RNA, 16 nt, Pseudomonas aeruginosa PA01
acuucaggccggcgcc

SEQ ID NO: 3435676 - RNA, 17 nt, Pseudomonas aeruginosa PA01
acuucaggccggcgccg

SEQ ID NO: 3435677 - RNA, 15 nt, Pseudomonas aeruginosa PA01
acuuccagcugccag

SEQ ID NO: 3435678 - RNA, 11 nt, Pseudomonas aeruginosa PA01
acuuccaggcg

SEQ ID NO: 3435679 - RNA, 20 nt, Pseudomonas aeruginosa PA01
acuuccagguagcccaccuc

SEQ ID NO: 3435680 - RNA, 16 nt, Pseudomonas aeruginosa PA01
acuuccaucagcucca

SEQ ID NO: 3435681 - RNA, 15 nt, Pseudomonas aeruginosa PA01
agaagccggccccug

SEQ ID NO: 3435682 - RNA, 18 nt, Pseudomonas aeruginosa PA01
agaagccggggcaggcau

SEQ ID NO: 3435683 - RNA, 12 nt, Pseudomonas aeruginosa PA01
agaagcgcucgu

SEQ ID NO: 3435684 - RNA, 14 nt, Pseudomonas aeruginosa PA01
agaagcggccgacc

SEQ ID NO: 3435685 - RNA, 17 nt, Pseudomonas aeruginosa PA01
agaagcguucgccgagg

SEQ ID NO: 3435686 - RNA, 13 nt, Pseudomonas aeruginosa PA01
agaaggccagggc

SEQ ID NO: 3435687 - RNA, 17 nt, Pseudomonas aeruginosa PA01
agaaggcugccgggcuc

SEQ ID NO: 3435688 - RNA, 19 nt, Pseudomonas aeruginosa PA01
agaaggggagccgaggcuc

SEQ ID NO: 3435689 - RNA, 22 nt, Pseudomonas aeruginosa PA01
agaagguaucggccauggccga

SEQ ID NO: 3435690 - RNA, 22 nt, Pseudomonas aeruginosa PA01
agaaggucaccgcucgccagau

SEQ ID NO: 3435691 - RNA, 14 nt, Pseudomonas aeruginosa PA01
agaaggugcccagc

SEQ ID NO: 3435692 - RNA, 18 nt, Pseudomonas aeruginosa PA01
agaaggugcccagcggcg

SEQ ID NO: 3435693 - RNA, 20 nt, Pseudomonas aeruginosa PA01
agaagguucucggccaccac

SEQ ID NO: 3435694 - RNA, 22 nt, Pseudomonas aeruginosa PA01
agaagguucucggccaccacca

SEQ ID NO: 3435695 - RNA, 13 nt, Pseudomonas aeruginosa PA01
agaagucccagcg

SEQ ID NO: 3435696 - RNA, 14 nt, Pseudomonas aeruginosa PA01
agaauaccgccagc

SEQ ID NO: 3435697 - RNA, 15 nt, Pseudomonas aeruginosa PA01
agaaucgcagccaug

SEQ ID NO: 3435698 - RNA, 18 nt, Pseudomonas aeruginosa PA01
agaaucgccgaggcgucg

SEQ ID NO: 3435699 - RNA, 15 nt, Pseudomonas aeruginosa PA01
agaaugaaaaaggga

SEQ ID NO: 3435700 - RNA, 18 nt, Pseudomonas aeruginosa PA01
agaaugccuucaccggcg

SEQ ID NO: 3435701 - RNA, 21 nt, Pseudomonas aeruginosa PA01
agaauggcguggcuuggcccu

SEQ ID NO: 3435702 - RNA, 14 nt, Pseudomonas aeruginosa PA01
agaauuccagcagg

SEQ ID NO: 3435703 - RNA, 18 nt, Pseudomonas aeruginosa PA01
agacaggaaucgacccag

SEQ ID NO: 3435704 - RNA, 22 nt, Pseudomonas aeruginosa PA01
agacaggaaucgacccagccgc

SEQ ID NO: 3435705 - RNA, 17 nt, Pseudomonas aeruginosa PA01
agacaggccuccagcaa

SEQ ID NO: 3435706 - RNA, 23 nt, Pseudomonas aeruginosa PA01
agacaggccuccagcaacgccgc

SEQ ID NO: 3435707 - RNA, 15 nt, Pseudomonas aeruginosa PA01
agacaggccugugga

SEQ ID NO: 3435708 - RNA, 18 nt, Pseudomonas aeruginosa PA01
agacagguacucggcccg

SEQ ID NO: 3435709 - RNA, 15 nt, Pseudomonas aeruginosa PA01
agaccaacugcgccc

SEQ ID NO: 3435710 - RNA, 22 nt, Pseudomonas aeruginosa PA01
agaccaacugcgcccccagcgc

SEQ ID NO: 3435711 - RNA, 19 nt, Pseudomonas aeruginosa PA01
agaccaaggcauugcgcuu

SEQ ID NO: 3435712 - RNA, 15 nt, Pseudomonas aeruginosa PA01
agaccaccagcagca

SEQ ID NO: 3435713 - RNA, 20 nt, Pseudomonas aeruginosa PA01
agaccaccagcagcagcggu

SEQ ID NO: 3435714 - RNA, 19 nt, Pseudomonas aeruginosa PA01
agaccaccagcaggaucga

SEQ ID NO: 3435715 - RNA, 13 nt, Pseudomonas aeruginosa PA01
agaccaccagcgu

SEQ ID NO: 3435716 - RNA, 14 nt, Pseudomonas aeruginosa PA01
agaccaccaugguc

SEQ ID NO: 3435717 - RNA, 18 nt, Pseudomonas aeruginosa PA01
agaccaccucgacggcga

SEQ ID NO: 3435718 - RNA, 13 nt, Pseudomonas aeruginosa PA01
agaccacgcccug

SEQ ID NO: 3435719 - RNA, 17 nt, Pseudomonas aeruginosa PA01
agaccacgcccugcgcc

SEQ ID NO: 3435720 - RNA, 20 nt, Pseudomonas aeruginosa PA01
agaccacgcccugcgccagc

SEQ ID NO: 3435721 - RNA, 12 nt, Pseudomonas aeruginosa PA01
agaccagcagcg

SEQ ID NO: 3435722 - RNA, 15 nt, Pseudomonas aeruginosa PA01
agaccagcagcggca

SEQ ID NO: 3435723 - RNA, 12 nt, Pseudomonas aeruginosa PA01
agaccagcagga

SEQ ID NO: 3435724 - RNA, 13 nt, Pseudomonas aeruginosa PA01
agaccagcccugg

SEQ ID NO: 3435725 - RNA, 15 nt, Pseudomonas aeruginosa PA01
agaccagcccuggcg

SEQ ID NO: 3435726 - RNA, 14 nt, Pseudomonas aeruginosa PA01
agaccagcgcaagc

SEQ ID NO: 3435727 - RNA, 24 nt, Pseudomonas aeruginosa PA01
agaccagcgcaagcggcggcuuca

SEQ ID NO: 3435728 - RNA, 17 nt, Pseudomonas aeruginosa PA01
agaccaggaaggccggg

SEQ ID NO: 3435729 - RNA, 19 nt, Pseudomonas aeruginosa PA01
agaccaggaaggccgggcc

SEQ ID NO: 3435730 - RNA, 20 nt, Pseudomonas aeruginosa PA01
agaccaggaaggccgggccc

SEQ ID NO: 3435731 - RNA, 15 nt, Pseudomonas aeruginosa PA01
agaccagggugggga

SEQ ID NO: 3435732 - RNA, 12 nt, Pseudomonas aeruginosa PA01
agaccaucagcu

SEQ ID NO: 3435733 - RNA, 19 nt, Pseudomonas aeruginosa PA01
agaccaucgccggcgagcc

SEQ ID NO: 3435734 - RNA, 14 nt, Pseudomonas aeruginosa PA01
agaccaucugccag

SEQ ID NO: 3435735 - RNA, 20 nt, Pseudomonas aeruginosa PA01
agaccaucuggaucaggaag

SEQ ID NO: 3435736 - RNA, 16 nt, Pseudomonas aeruginosa PA01
agacccaggugcgcag

SEQ ID NO: 3435737 - RNA, 19 nt, Pseudomonas aeruginosa PA01
agacccaggugcgcaggcg

SEQ ID NO: 3435738 - RNA, 17 nt, Pseudomonas aeruginosa PA01
agacccccugccgcccu

SEQ ID NO: 3435739 - RNA, 12 nt, Pseudomonas aeruginosa PA01
agaccccggcga

SEQ ID NO: 3435740 - RNA, 13 nt, Pseudomonas aeruginosa PA01
agacccuggcgcu

SEQ ID NO: 3435741 - RNA, 21 nt, Pseudomonas aeruginosa PA01
agacccuggcgcugucgcccg

SEQ ID NO: 3435742 - RNA, 13 nt, Pseudomonas aeruginosa PA01
agacccugggcca

SEQ ID NO: 3435743 - RNA, 18 nt, Pseudomonas aeruginosa PA01
agaccgagauuggccgcc

SEQ ID NO: 3435744 - RNA, 14 nt, Pseudomonas aeruginosa PA01
agaccgauccagca

SEQ ID NO: 3435745 - RNA, 17 nt, Pseudomonas aeruginosa PA01
agaccgcagcccaguuc

SEQ ID NO: 3435746 - RNA, 15 nt, Pseudomonas aeruginosa PA01
agaccgcagccggcg

SEQ ID NO: 3435747 - RNA, 23 nt, Pseudomonas aeruginosa PA01
agaccgcucgucaggcgcucagg

SEQ ID NO: 3435748 - RNA, 17 nt, Pseudomonas aeruginosa PA01
agaccggcagcgccgcc

SEQ ID NO: 3435749 - RNA, 22 nt, Pseudomonas aeruginosa PA01
agaccggcgccccugcggcgcc

SEQ ID NO: 3435750 - RNA, 19 nt, Pseudomonas aeruginosa PA01
agaccggcuccagggcgaa

SEQ ID NO: 3435751 - RNA, 14 nt, Pseudomonas aeruginosa PA01
agaccgugccgccg

SEQ ID NO: 3435752 - RNA, 20 nt, Pseudomonas aeruginosa PA01
agaccuccagguaggcgccc

SEQ ID NO: 3435753 - RNA, 21 nt, Pseudomonas aeruginosa PA01
agaccucgaaguccugcagga

SEQ ID NO: 3435754 - RNA, 14 nt, Pseudomonas aeruginosa PA01
agaccucgcccauc

SEQ ID NO: 3435755 - RNA, 23 nt, Pseudomonas aeruginosa PA01
agaccucgcugacuuccaucagc

SEQ ID NO: 3435756 - RNA, 13 nt, Pseudomonas aeruginosa PA01
agaccugcagcag

SEQ ID NO: 3435757 - RNA, 14 nt, Pseudomonas aeruginosa PA01
agaccugcagcagg

SEQ ID NO: 3435758 - RNA, 15 nt, Pseudomonas aeruginosa PA01
agaccugccgcccgg

SEQ ID NO: 3435759 - RNA, 16 nt, Pseudomonas aeruginosa PA01
agaccugccgcccggc

SEQ ID NO: 3435760 - RNA, 19 nt, Pseudomonas aeruginosa PA01
agaccugccgcccggccag

SEQ ID NO: 3435761 - RNA, 21 nt, Pseudomonas aeruginosa PA01
agaccugccgcccggccaggc

SEQ ID NO: 3435762 - RNA, 11 nt, Pseudomonas aeruginosa PA01
agaccuggccg

SEQ ID NO: 3435763 - RNA, 15 nt, Pseudomonas aeruginosa PA01
agaccuguucgcgcc

SEQ ID NO: 3435764 - RNA, 16 nt, Pseudomonas aeruginosa PA01
agaccuguucgcgccc

SEQ ID NO: 3435765 - RNA, 19 nt, Pseudomonas aeruginosa PA01
agaccuguugcagagcggc

SEQ ID NO: 3435766 - RNA, 23 nt, Pseudomonas aeruginosa PA01
agaccuguugcagagcggccagg

SEQ ID NO: 3435767 - RNA, 17 nt, Pseudomonas aeruginosa PA01
agaccuuccagccgcgc

SEQ ID NO: 3435768 - RNA, 24 nt, Pseudomonas aeruginosa PA01
agaccuuccagccgcgcgcgucga

SEQ ID NO: 3435769 - RNA, 17 nt, Pseudomonas aeruginosa PA01
agaccuuccugccagcg

SEQ ID NO: 3435770 - RNA, 16 nt, Pseudomonas aeruginosa PA01
agacgaaguuggcggc

SEQ ID NO: 3435771 - RNA, 15 nt, Pseudomonas aeruginosa PA01
agacgaucagcagga

SEQ ID NO: 3435772 - RNA, 20 nt, Pseudomonas aeruginosa PA01
agacgaucagcaggaugcag

SEQ ID NO: 3435773 - RNA, 22 nt, Pseudomonas aeruginosa PA01
agacgaucagcggcccgagcag

SEQ ID NO: 3435774 - RNA, 17 nt, Pseudomonas aeruginosa PA01
agacgaucuccugcugg

SEQ ID NO: 3435775 - RNA, 15 nt, Pseudomonas aeruginosa PA01
agacgcaccgagggc

SEQ ID NO: 3435776 - RNA, 17 nt, Pseudomonas aeruginosa PA01
agacgcaccgagggcau

SEQ ID NO: 3435777 - RNA, 20 nt, Pseudomonas aeruginosa PA01
agacgcagccguuggccagc

SEQ ID NO: 3435778 - RNA, 13 nt, Pseudomonas aeruginosa PA01
agacgcagcgcua

SEQ ID NO: 3435779 - RNA, 14 nt, Pseudomonas aeruginosa PA01
agacgcaggcaggu

SEQ ID NO: 3435780 - RNA, 23 nt, Pseudomonas aeruginosa PA01
agacgcaggguucggggaacagc

SEQ ID NO: 3435781 - RNA, 17 nt, Pseudomonas aeruginosa PA01
agacgcaggugcccugg

SEQ ID NO: 3435782 - RNA, 15 nt, Pseudomonas aeruginosa PA01
agacgccagccgccc

SEQ ID NO: 3435783 - RNA, 16 nt, Pseudomonas aeruginosa PA01
agacgccagccgcccu

SEQ ID NO: 3435784 - RNA, 18 nt, Pseudomonas aeruginosa PA01
agauagggcaucagcccc

SEQ ID NO: 3435785 - RNA, 21 nt, Pseudomonas aeruginosa PA01
agauaucgccuuccucggcga

SEQ ID NO: 3435786 - RNA, 14 nt, Pseudomonas aeruginosa PA01
agaucaccggggcc

SEQ ID NO: 3435787 - RNA, 21 nt, Pseudomonas aeruginosa PA01
agaucagcgcggugagcaggg

SEQ ID NO: 3435788 - RNA, 22 nt, Pseudomonas aeruginosa PA01
agaucagcgcggugagcagggu

SEQ ID NO: 3435789 - RNA, 17 nt, Pseudomonas aeruginosa PA01
agaucagcggaccggug

SEQ ID NO: 3435790 - RNA, 12 nt, Pseudomonas aeruginosa PA01
agaucaggccgg

SEQ ID NO: 3435791 - RNA, 15 nt, Pseudomonas aeruginosa PA01
agaucaggccggcgu

SEQ ID NO: 3435792 - RNA, 12 nt, Pseudomonas aeruginosa PA01
agaucaggcugg

SEQ ID NO: 3435793 - RNA, 13 nt, Pseudomonas aeruginosa PA01
agaucaucugggu

SEQ ID NO: 3435794 - RNA, 21 nt, Pseudomonas aeruginosa PA01
agaucauguagagcaggcugc

SEQ ID NO: 3435795 - RNA, 13 nt, Pseudomonas aeruginosa PA01
agauccagcggca

SEQ ID NO: 3435796 - RNA, 19 nt, Pseudomonas aeruginosa PA01
agauccccugcaggacccg

SEQ ID NO: 3435797 - RNA, 21 nt, Pseudomonas aeruginosa PA01
agauccgccgugaggcgcgcg

SEQ ID NO: 3435798 - RNA, 14 nt, Pseudomonas aeruginosa PA01
agauccgcuccagg

SEQ ID NO: 3435799 - RNA, 15 nt, Pseudomonas aeruginosa PA01
agauccgcuccaggc

SEQ ID NO: 3435800 - RNA, 19 nt, Pseudomonas aeruginosa PA01
agauccuggccggcggcgu

SEQ ID NO: 3435801 - RNA, 15 nt, Pseudomonas aeruginosa PA01
agaucgacaggccgc

SEQ ID NO: 3435802 - RNA, 15 nt, Pseudomonas aeruginosa PA01
agaucgagcgcgccc

SEQ ID NO: 3435803 - RNA, 21 nt, Pseudomonas aeruginosa PA01
agaucgcauuguugcggucgc

SEQ ID NO: 3435804 - RNA, 15 nt, Pseudomonas aeruginosa PA01
agaucgccagcgcca

SEQ ID NO: 3435805 - RNA, 13 nt, Pseudomonas aeruginosa PA01
agaucgccagcuc

SEQ ID NO: 3435806 - RNA, 16 nt, Pseudomonas aeruginosa PA01
agaucgccagcucgcc

SEQ ID NO: 3435807 - RNA, 14 nt, Pseudomonas aeruginosa PA01
agaucgcccagcgg

SEQ ID NO: 3435808 - RNA, 14 nt, Pseudomonas aeruginosa PA01
agaucgccgcgccg

SEQ ID NO: 3435809 - RNA, 20 nt, Pseudomonas aeruginosa PA01
agaucgccgcguagcgccag

SEQ ID NO: 3435810 - RNA, 23 nt, Pseudomonas aeruginosa PA01
agaucgccgcguagcgccaggcc

SEQ ID NO: 3435811 - RNA, 16 nt, Pseudomonas aeruginosa PA01
agaucgccugcuggcc

SEQ ID NO: 3435812 - RNA, 17 nt, Pseudomonas aeruginosa PA01
agaucgccugcuggccg

SEQ ID NO: 3435813 - RNA, 15 nt, Pseudomonas aeruginosa PA01
agaucgcgccgagcu

SEQ ID NO: 3435814 - RNA, 15 nt, Pseudomonas aeruginosa PA01
agaucgcguccaggg

SEQ ID NO: 3435815 - RNA, 20 nt, Pseudomonas aeruginosa PA01
agaucggcagcaucagccgc

SEQ ID NO: 3435816 - RNA, 21 nt, Pseudomonas aeruginosa PA01
agaucggcgcgcagggccagc

SEQ ID NO: 3435817 - RNA, 13 nt, Pseudomonas aeruginosa PA01
agaucggcggcgc

SEQ ID NO: 3435818 - RNA, 14 nt, Pseudomonas aeruginosa PA01
agaucggcggcgcg

SEQ ID NO: 3435819 - RNA, 16 nt, Pseudomonas aeruginosa PA01
agaucggcggcgcggc

SEQ ID NO: 3435820 - RNA, 17 nt, Pseudomonas aeruginosa PA01
agaucggcggcgcggcg

SEQ ID NO: 3435821 - RNA, 18 nt, Pseudomonas aeruginosa PA01
agaucggcggcgcggcgu

SEQ ID NO: 3435822 - RNA, 14 nt, Pseudomonas aeruginosa PA01
agaucugcaccgcc

SEQ ID NO: 3435823 - RNA, 23 nt, Pseudomonas aeruginosa PA01
agaucugcaccgcccagccgagg

SEQ ID NO: 3435824 - RNA, 15 nt, Pseudomonas aeruginosa PA01
agaucugugcggugc

SEQ ID NO: 3435825 - RNA, 14 nt, Pseudomonas aeruginosa PA01
agaugaaacugccc

SEQ ID NO: 3435826 - RNA, 16 nt, Pseudomonas aeruginosa PA01
agaugaaacugcccgg

SEQ ID NO: 3435827 - RNA, 16 nt, Pseudomonas aeruginosa PA01
agaugaagcgccgcag

SEQ ID NO: 3435828 - RNA, 15 nt, Pseudomonas aeruginosa PA01
agaugaucgccaccg

SEQ ID NO: 3435829 - RNA, 15 nt, Pseudomonas aeruginosa PA01
agaugcacaccagcu

SEQ ID NO: 3435830 - RNA, 16 nt, Pseudomonas aeruginosa PA01
agaugcaccggccacu

SEQ ID NO: 3435831 - RNA, 19 nt, Pseudomonas aeruginosa PA01
agaugccacugacgcgcag

SEQ ID NO: 3435832 - RNA, 15 nt, Pseudomonas aeruginosa PA01
agaugcccuugccgg

SEQ ID NO: 3435833 - RNA, 23 nt, Pseudomonas aeruginosa PA01
agaugccgcccugcggcaggcgc

SEQ ID NO: 3435834 - RNA, 15 nt, Pseudomonas aeruginosa PA01
agaugcgcgucgccg

SEQ ID NO: 3435835 - RNA, 12 nt, Pseudomonas aeruginosa PA01
agaugcggcugu

SEQ ID NO: 3435836 - RNA, 19 nt, Pseudomonas aeruginosa PA01
agaugcggcugugcucgag

SEQ ID NO: 3435837 - RNA, 14 nt, Pseudomonas aeruginosa PA01
agaugcucgcgcag

SEQ ID NO: 3435838 - RNA, 17 nt, Pseudomonas aeruginosa PA01
agaugcugcgggcgccg

SEQ ID NO: 3435839 - RNA, 20 nt, Pseudomonas aeruginosa PA01
agaugcugcgggcgccgccg

SEQ ID NO: 3435840 - RNA, 12 nt, Pseudomonas aeruginosa PA01
agauggcacagu

SEQ ID NO: 3435841 - RNA, 18 nt, Pseudomonas aeruginosa PA01
agauggcuaaacaagcca

SEQ ID NO: 3435842 - RNA, 22 nt, Pseudomonas aeruginosa PA01
agauggcuaaacaagccaccuu

SEQ ID NO: 3435843 - RNA, 18 nt, Pseudomonas aeruginosa PA01
agauggcuggucaggcug

SEQ ID NO: 3435844 - RNA, 20 nt, Pseudomonas aeruginosa PA01
agauggguaucaugcgcccc

SEQ ID NO: 3435845 - RNA, 23 nt, Pseudomonas aeruginosa PA01
agauguccaucagccgcgcgcug

SEQ ID NO: 3435846 - RNA, 16 nt, Pseudomonas aeruginosa PA01
agauguucgccgccgc

SEQ ID NO: 3435847 - RNA, 21 nt, Pseudomonas aeruginosa PA01
agauuauauaggguuucucgc

SEQ ID NO: 3435848 - RNA, 19 nt, Pseudomonas aeruginosa PA01
agauuccuggaccccgccc

SEQ ID NO: 3435849 - RNA, 20 nt, Pseudomonas aeruginosa PA01
agauugucgcgauccaccgc

SEQ ID NO: 3435850 - RNA, 16 nt, Pseudomonas aeruginosa PA01
agcaaacccgggccca

SEQ ID NO: 3435851 - RNA, 16 nt, Pseudomonas aeruginosa PA01
agcaacaccgcgcaga

SEQ ID NO: 3435852 - RNA, 23 nt, Pseudomonas aeruginosa PA01
agcaacaccgcgcagaugaucgc

SEQ ID NO: 3435853 - RNA, 15 nt, Pseudomonas aeruginosa PA01
agcaacaccggaagc

SEQ ID NO: 3435854 - RNA, 18 nt, Pseudomonas aeruginosa PA01
agcaacagcgucgccaac

SEQ ID NO: 3435855 - RNA, 18 nt, Pseudomonas aeruginosa PA01
agcaacaguugccgcagc

SEQ ID NO: 3435856 - RNA, 20 nt, Pseudomonas aeruginosa PA01
agcaacaguugccgcagcag

SEQ ID NO: 3435857 - RNA, 22 nt, Pseudomonas aeruginosa PA01
agcaacaguugccgcagcagcg

SEQ ID NO: 3435858 - RNA, 15 nt, Pseudomonas aeruginosa PA01
agcaacccaugccgc

SEQ ID NO: 3435859 - RNA, 19 nt, Pseudomonas aeruginosa PA01
agcaacccaugccgcaagc

SEQ ID NO: 3435860 - RNA, 15 nt, Pseudomonas aeruginosa PA01
agcaacgccgccccc

SEQ ID NO: 3435861 - RNA, 15 nt, Pseudomonas aeruginosa PA01
agcaacgccuucugc

SEQ ID NO: 3435862 - RNA, 17 nt, Pseudomonas aeruginosa PA01
agcaacgcgacgaucuc

SEQ ID NO: 3435863 - RNA, 18 nt, Pseudomonas aeruginosa PA01
agcaacgcgugauacagc

SEQ ID NO: 3435864 - RNA, 11 nt, Pseudomonas aeruginosa PA01
agcaacggcau

SEQ ID NO: 3435865 - RNA, 14 nt, Pseudomonas aeruginosa PA01
agcaacucgccgcc

SEQ ID NO: 3435866 - RNA, 15 nt, Pseudomonas aeruginosa PA01
agcaacucgccgccg

SEQ ID NO: 3435867 - RNA, 17 nt, Pseudomonas aeruginosa PA01
agcaagaguguucccuc

SEQ ID NO: 3435868 - RNA, 20 nt, Pseudomonas aeruginosa PA01
agcaagaguguucccucagg

SEQ ID NO: 3435869 - RNA, 16 nt, Pseudomonas aeruginosa PA01
agcaagccgcagcgcc

SEQ ID NO: 3435870 - RNA, 19 nt, Pseudomonas aeruginosa PA01
agcaagucgaacaggcccu

SEQ ID NO: 3435871 - RNA, 14 nt, Pseudomonas aeruginosa PA01
agcaauacccgccg

SEQ ID NO: 3435872 - RNA, 16 nt, Pseudomonas aeruginosa PA01
agcaaugccagcgcca

SEQ ID NO: 3435873 - RNA, 17 nt, Pseudomonas aeruginosa PA01
agcaaugccagcgccac

SEQ ID NO: 3435874 - RNA, 21 nt, Pseudomonas aeruginosa PA01
agcaaugccagcgccacgccg

SEQ ID NO: 3435875 - RNA, 15 nt, Pseudomonas aeruginosa PA01
agcaaugcccagcgc

SEQ ID NO: 3435876 - RNA, 16 nt, Pseudomonas aeruginosa PA01
agcaaugcccagcgca

SEQ ID NO: 3435877 - RNA, 17 nt, Pseudomonas aeruginosa PA01
agcaaugcccgcgccug

SEQ ID NO: 3435878 - RNA, 17 nt, Pseudomonas aeruginosa PA01
agcaauuccgcagccuu

SEQ ID NO: 3435879 - RNA, 21 nt, Pseudomonas aeruginosa PA01
agcaauucgugugggugcuug

SEQ ID NO: 3435880 - RNA, 20 nt, Pseudomonas aeruginosa PA01
agcaauugccagaggcugcg

SEQ ID NO: 3435881 - RNA, 22 nt, Pseudomonas aeruginosa PA01
agcaauugccgcugcacgccuu

SEQ ID NO: 3435882 - RNA, 14 nt, Pseudomonas aeruginosa PA01
agcaauugccggcg

SEQ ID NO: 3435883 - RNA, 15 nt, Pseudomonas aeruginosa PA01
agcacagccccagcc

SEQ ID NO: 3435884 - RNA, 17 nt, Pseudomonas aeruginosa PA01
agcacagccccagccuc

SEQ ID NO: 3435885 - RNA, 22 nt, Pseudomonas aeruginosa PA01
agcaccaccacucgcgagcugg

SEQ ID NO: 3435886 - RNA, 23 nt, Pseudomonas aeruginosa PA01
agcaccaccacucgcgagcuggc

SEQ ID NO: 3435887 - RNA, 20 nt, Pseudomonas aeruginosa PA01
agcacuucccaggugcccug

SEQ ID NO: 3435888 - RNA, 21 nt, Pseudomonas aeruginosa PA01
agcacuucccaggugcccugg

SEQ ID NO: 3435889 - RNA, 22 nt, Pseudomonas aeruginosa PA01
agcacuucccaggugcccugga

SEQ ID NO: 3435890 - RNA, 23 nt, Pseudomonas aeruginosa PA01
agcacuucccaggugcccuggaa

SEQ ID NO: 3435891 - RNA, 17 nt, Pseudomonas aeruginosa PA01
agcacuucggcgcgcgg

SEQ ID NO: 3435892 - RNA, 22 nt, Pseudomonas aeruginosa PA01
agcacuucggcgcgcggcagca

SEQ ID NO: 3435893 - RNA, 14 nt, Pseudomonas aeruginosa PA01
agcagaaccgccag

SEQ ID NO: 3435894 - RNA, 15 nt, Pseudomonas aeruginosa PA01
agcagaaccgccagc

SEQ ID NO: 3435895 - RNA, 16 nt, Pseudomonas aeruginosa PA01
agcagaaccgccagca

SEQ ID NO: 3435896 - RNA, 14 nt, Pseudomonas aeruginosa PA01
agcagaacgccccg

SEQ ID NO: 3435897 - RNA, 22 nt, Pseudomonas aeruginosa PA01
agcagacacaaaaaacccggcg

SEQ ID NO: 3435898 - RNA, 18 nt, Pseudomonas aeruginosa PA01
agcagacgcuccuuguag

SEQ ID NO: 3435899 - RNA, 15 nt, Pseudomonas aeruginosa PA01
agcagacggcacgac

SEQ ID NO: 3435900 - RNA, 19 nt, Pseudomonas aeruginosa PA01
agcagacggcacgacgccg

SEQ ID NO: 3435901 - RNA, 15 nt, Pseudomonas aeruginosa PA01
agcagagggcguccu

SEQ ID NO: 3435902 - RNA, 12 nt, Pseudomonas aeruginosa PA01
agcagagucgcc

SEQ ID NO: 3435903 - RNA, 22 nt, Pseudomonas aeruginosa PA01
agcagaguuuagccgccagugc

SEQ ID NO: 3435904 - RNA, 18 nt, Pseudomonas aeruginosa PA01
agcagcaacagcgccgcg

SEQ ID NO: 3435905 - RNA, 19 nt, Pseudomonas aeruginosa PA01
agcagcaacggacguucca

SEQ ID NO: 3435906 - RNA, 19 nt, Pseudomonas aeruginosa PA01
agcagcaccaucagccagc

SEQ ID NO: 3435907 - RNA, 21 nt, Pseudomonas aeruginosa PA01
agcagcaccaucagccagccc

SEQ ID NO: 3435908 - RNA, 22 nt, Pseudomonas aeruginosa PA01
agcagcaccaucagccagccca

SEQ ID NO: 3435909 - RNA, 13 nt, Pseudomonas aeruginosa PA01
agcagcacggcga

SEQ ID NO: 3435910 - RNA, 14 nt, Pseudomonas aeruginosa PA01
agcagcacggcgac

SEQ ID NO: 3435911 - RNA, 20 nt, Pseudomonas aeruginosa PA01
agcagcagaagggcggagaa

SEQ ID NO: 3435912 - RNA, 14 nt, Pseudomonas aeruginosa PA01
agcagcagcgccau

SEQ ID NO: 3435913 - RNA, 18 nt, Pseudomonas aeruginosa PA01
agcagcagcgccaugcug

SEQ ID NO: 3435914 - RNA, 12 nt, Pseudomonas aeruginosa PA01
agcagcaggccg

SEQ ID NO: 3435915 - RNA, 15 nt, Pseudomonas aeruginosa PA01
agcagcaggccggcg

SEQ ID NO: 3435916 - RNA, 16 nt, Pseudomonas aeruginosa PA01
agcagcaggccggcga

SEQ ID NO: 3435917 - RNA, 13 nt, Pseudomonas aeruginosa PA01
agcagcaggcgcu

SEQ ID NO: 3435918 - RNA, 19 nt, Pseudomonas aeruginosa PA01
agcagcaggcgcucgggga

SEQ ID NO: 3435919 - RNA, 19 nt, Pseudomonas aeruginosa PA01
agcagcaggucgucggcga

SEQ ID NO: 3435920 - RNA, 20 nt, Pseudomonas aeruginosa PA01
agcagcagguugaccccgcg

SEQ ID NO: 3435921 - RNA, 14 nt, Pseudomonas aeruginosa PA01
agcagcaugccgcu

SEQ ID NO: 3435922 - RNA, 15 nt, Pseudomonas aeruginosa PA01
agcagcaugccgcuc

SEQ ID NO: 3435923 - RNA, 23 nt, Pseudomonas aeruginosa PA01
agcagcaugccgcucugccagaa

SEQ ID NO: 3435924 - RNA, 16 nt, Pseudomonas aeruginosa PA01
agcagcaugggauggc

SEQ ID NO: 3435925 - RNA, 21 nt, Pseudomonas aeruginosa PA01
agcagccaaccgucgcccugg

SEQ ID NO: 3435926 - RNA, 18 nt, Pseudomonas aeruginosa PA01
agcagccaaggaugcgcc

SEQ ID NO: 3435927 - RNA, 19 nt, Pseudomonas aeruginosa PA01
agcagccaaggaugcgcca

SEQ ID NO: 3435928 - RNA, 22 nt, Pseudomonas aeruginosa PA01
agcagccaaggaugcgccagcg

SEQ ID NO: 3435929 - RNA, 18 nt, Pseudomonas aeruginosa PA01
agcagccacgggacuuca

SEQ ID NO: 3435930 - RNA, 22 nt, Pseudomonas aeruginosa PA01
agcagccaggcgaagcggcugg

SEQ ID NO: 3435931 - RNA, 14 nt, Pseudomonas aeruginosa PA01
agcagcccagcgcu

SEQ ID NO: 3435932 - RNA, 19 nt, Pseudomonas aeruginosa PA01
agcagccccgaggccagca

SEQ ID NO: 3435933 - RNA, 21 nt, Pseudomonas aeruginosa PA01
agcagccccgaggccagcagg

SEQ ID NO: 3435934 - RNA, 23 nt, Pseudomonas aeruginosa PA01
agcagccccgaggccagcaggcc

SEQ ID NO: 3435935 - RNA, 12 nt, Pseudomonas aeruginosa PA01
agcagcccggcc

SEQ ID NO: 3435936 - RNA, 15 nt, Pseudomonas aeruginosa PA01
agcagcccggccugg

SEQ ID NO: 3435937 - RNA, 14 nt, Pseudomonas aeruginosa PA01
agcagccgcaggau

SEQ ID NO: 3435938 - RNA, 14 nt, Pseudomonas aeruginosa PA01
agcagccguauggc

SEQ ID NO: 3435939 - RNA, 19 nt, Pseudomonas aeruginosa PA01
agcagccguauggccccuc

SEQ ID NO: 3435940 - RNA, 16 nt, Pseudomonas aeruginosa PA01
agcagccguccagcuu

SEQ ID NO: 3435941 - RNA, 19 nt, Pseudomonas aeruginosa PA01
agcagccucaguggaucgu

SEQ ID NO: 3435942 - RNA, 19 nt, Pseudomonas aeruginosa PA01
agcagcgaacgccgcagcu

SEQ ID NO: 3435943 - RNA, 14 nt, Pseudomonas aeruginosa PA01
agcagcgaccugac

SEQ ID NO: 3435944 - RNA, 17 nt, Pseudomonas aeruginosa PA01
agcagcgacucgcuggg

SEQ ID NO: 3435945 - RNA, 19 nt, Pseudomonas aeruginosa PA01
agcagcgacucgcugggcg

SEQ ID NO: 3435946 - RNA, 20 nt, Pseudomonas aeruginosa PA01
agcagcgacucgcugggcgc

SEQ ID NO: 3435947 - RNA, 16 nt, Pseudomonas aeruginosa PA01
agcagcgcaccauccu

SEQ ID NO: 3435948 - RNA, 15 nt, Pseudomonas aeruginosa PA01
agcagcgccacgcug

SEQ ID NO: 3435949 - RNA, 22 nt, Pseudomonas aeruginosa PA01
agcagcgccagcaggucgcgcu

SEQ ID NO: 3435950 - RNA, 18 nt, Pseudomonas aeruginosa PA01
agcagcgccagccagggu

SEQ ID NO: 3435951 - RNA, 13 nt, Pseudomonas aeruginosa PA01
agcagcgccaggg

SEQ ID NO: 3435952 - RNA, 14 nt, Pseudomonas aeruginosa PA01
agcagcgccagggc

SEQ ID NO: 3435953 - RNA, 13 nt, Pseudomonas aeruginosa PA01
agcagcgccgccc

SEQ ID NO: 3435954 - RNA, 22 nt, Pseudomonas aeruginosa PA01
agcagcgccucggcaucgacca

SEQ ID NO: 3435955 - RNA, 17 nt, Pseudomonas aeruginosa PA01
agcagcgcgcggcucgg

SEQ ID NO: 3435956 - RNA, 23 nt, Pseudomonas aeruginosa PA01
agcagcgcgcggcucggcgggcu

SEQ ID NO: 3435957 - RNA, 12 nt, Pseudomonas aeruginosa PA01
agcagcgcggcg

SEQ ID NO: 3435958 - RNA, 15 nt, Pseudomonas aeruginosa PA01
agcagcgcggcggcg

SEQ ID NO: 3435959 - RNA, 19 nt, Pseudomonas aeruginosa PA01
agcagcgcggcggcggcca

SEQ ID NO: 3435960 - RNA, 22 nt, Pseudomonas aeruginosa PA01
agcagcgcggcggcggccagca

SEQ ID NO: 3435961 - RNA, 24 nt, Pseudomonas aeruginosa PA01
agcagcgcggcggcggccagcagc

SEQ ID NO: 3435962 - RNA, 21 nt, Pseudomonas aeruginosa PA01
agcagcgcucacgcaccucgu

SEQ ID NO: 3435963 - RNA, 15 nt, Pseudomonas aeruginosa PA01
agcagcgcugaucac

SEQ ID NO: 3435964 - RNA, 15 nt, Pseudomonas aeruginosa PA01
agcagcgcugcguag

SEQ ID NO: 3435965 - RNA, 23 nt, Pseudomonas aeruginosa PA01
agcagcggaaaugcucgccgucc

SEQ ID NO: 3435966 - RNA, 15 nt, Pseudomonas aeruginosa PA01
agcagcggacgcagc

SEQ ID NO: 3435967 - RNA, 16 nt, Pseudomonas aeruginosa PA01
agcagcggcaaaggcc

SEQ ID NO: 3435968 - RNA, 14 nt, Pseudomonas aeruginosa PA01
agcagcggcaccag

SEQ ID NO: 3435969 - RNA, 16 nt, Pseudomonas aeruginosa PA01
agcagcggcaccagca

SEQ ID NO: 3435970 - RNA, 12 nt, Pseudomonas aeruginosa PA01
agcagcggcacg

SEQ ID NO: 3435971 - RNA, 21 nt, Pseudomonas aeruginosa PA01
agcagcggcgacaccgccagc

SEQ ID NO: 3435972 - RNA, 23 nt, Pseudomonas aeruginosa PA01
agcagcggcgacaccgccagcac

SEQ ID NO: 3435973 - RNA, 13 nt, Pseudomonas aeruginosa PA01
agcagcggcgcca

SEQ ID NO: 3435974 - RNA, 20 nt, Pseudomonas aeruginosa PA01
agcagcggcgcuuuccacuc

SEQ ID NO: 3435975 - RNA, 14 nt, Pseudomonas aeruginosa PA01
agcagcggcucacg

SEQ ID NO: 3435976 - RNA, 23 nt, Pseudomonas aeruginosa PA01
agcagcggcucacgccccagcgc

SEQ ID NO: 3435977 - RNA, 22 nt, Pseudomonas aeruginosa PA01
agcagcgggcguccggcgagca

SEQ ID NO: 3435978 - RNA, 20 nt, Pseudomonas aeruginosa PA01
agcagcgucguagagcgugc

SEQ ID NO: 3435979 - RNA, 14 nt, Pseudomonas aeruginosa PA01
agcagcuccgggcu

SEQ ID NO: 3435980 - RNA, 12 nt, Pseudomonas aeruginosa PA01
agcagcucgccg

SEQ ID NO: 3435981 - RNA, 14 nt, Pseudomonas aeruginosa PA01
agcagcucgccgcu

SEQ ID NO: 3435982 - RNA, 21 nt, Pseudomonas aeruginosa PA01
agcagcucgccgcuacccagg

SEQ ID NO: 3435983 - RNA, 15 nt, Pseudomonas aeruginosa PA01
agcagcucgccggcg

SEQ ID NO: 3435984 - RNA, 15 nt, Pseudomonas aeruginosa PA01
agcagcucguccaug

SEQ ID NO: 3435985 - RNA, 13 nt, Pseudomonas aeruginosa PA01
agcagcuugccgg

SEQ ID NO: 3435986 - RNA, 16 nt, Pseudomonas aeruginosa PA01
agcagcuugcgcgagu

SEQ ID NO: 3435987 - RNA, 22 nt, Pseudomonas aeruginosa PA01
agcaggaacucgaucagcgcgg

SEQ ID NO: 3435988 - RNA, 17 nt, Pseudomonas aeruginosa PA01
agcaggaagaagccgau

SEQ ID NO: 3435989 - RNA, 14 nt, Pseudomonas aeruginosa PA01
aaagcccggccgcu

SEQ ID NO: 3435990 - RNA, 22 nt, Pseudomonas aeruginosa PA01
aaagccggcgcaugcgccggcu

SEQ ID NO: 3435991 - RNA, 17 nt, Pseudomonas aeruginosa PA01
aaagccuggagcagggc

SEQ ID NO: 3435992 - RNA, 15 nt, Pseudomonas aeruginosa PA01
aaagccuggccggcg

SEQ ID NO: 3435993 - RNA, 22 nt, Pseudomonas aeruginosa PA01
aaagcgccuucugcgugggcaa

SEQ ID NO: 3435994 - RNA, 22 nt, Pseudomonas aeruginosa PA01
aaagcggugccgcguagggcga

SEQ ID NO: 3435995 - RNA, 14 nt, Pseudomonas aeruginosa PA01
aaagcgucagcgcg

SEQ ID NO: 3435996 - RNA, 19 nt, Pseudomonas aeruginosa PA01
aaagcuccucggccuugcu

SEQ ID NO: 3435997 - RNA, 23 nt, Pseudomonas aeruginosa PA01
aaagcucgcgcaagcgcccggcg

SEQ ID NO: 3435998 - RNA, 23 nt, Pseudomonas aeruginosa PA01
aaaggauuuccgcggccggcagg

SEQ ID NO: 3435999 - RNA, 23 nt, Pseudomonas aeruginosa PA01
aaaggccuguccgaagacaggcc

SEQ ID NO: 3436000 - RNA, 22 nt, Pseudomonas aeruginosa PA01
aaaggcgcgccgguuucgaccg

SEQ ID NO: 3436001 - RNA, 23 nt, Pseudomonas aeruginosa PA01
aaaggcucuugggcucugccuuc

SEQ ID NO: 3436002 - RNA, 19 nt, Pseudomonas aeruginosa PA01
aaagggaugccgccggcau

SEQ ID NO: 3436003 - RNA, 15 nt, Pseudomonas aeruginosa PA01
aaagggcagcggcga

SEQ ID NO: 3436004 - RNA, 18 nt, Pseudomonas aeruginosa PA01
aaaggggaugccauggca

SEQ ID NO: 3436005 - RNA, 15 nt, Pseudomonas aeruginosa PA01
aaaguuuuucgcggc

SEQ ID NO: 3436006 - RNA, 13 nt, Pseudomonas aeruginosa PA01
aaauaccccgggu

SEQ ID NO: 3436007 - RNA, 15 nt, Pseudomonas aeruginosa PA01
aaauacucgucgacg

SEQ ID NO: 3436008 - RNA, 14 nt, Pseudomonas aeruginosa PA01
aaauccaccagcac

SEQ ID NO: 3436009 - RNA, 22 nt, Pseudomonas aeruginosa PA01
aaauccaccuugccgcgcccgg

SEQ ID NO: 3436010 - RNA, 15 nt, Pseudomonas aeruginosa PA01
aaauccgccgcgcac

SEQ ID NO: 3436011 - RNA, 15 nt, Pseudomonas aeruginosa PA01
aaaucgagcugcucg

SEQ ID NO: 3436012 - RNA, 15 nt, Pseudomonas aeruginosa PA01
aaaugaaaaaggccg

SEQ ID NO: 3436013 - RNA, 16 nt, Pseudomonas aeruginosa PA01
aaaugccgcaaacccc

SEQ ID NO: 3436014 - RNA, 15 nt, Pseudomonas aeruginosa PA01
aaaugccgcacccca

SEQ ID NO: 3436015 - RNA, 13 nt, Pseudomonas aeruginosa PA01
aaaugcugcaggc

SEQ ID NO: 3436016 - RNA, 18 nt, Pseudomonas aeruginosa PA01
aaaugcuugaaaaucaag

SEQ ID NO: 3436017 - RNA, 14 nt, Pseudomonas aeruginosa PA01
aaauggcaacccag

SEQ ID NO: 3436018 - RNA, 20 nt, Pseudomonas aeruginosa PA01
aaauggccgcuucaagcggc

SEQ ID NO: 3436019 - RNA, 13 nt, Pseudomonas aeruginosa PA01
aaauggcgcgccu

SEQ ID NO: 3436020 - RNA, 16 nt, Pseudomonas aeruginosa PA01
aaauucaaucagggca

SEQ ID NO: 3436021 - RNA, 14 nt, Pseudomonas aeruginosa PA01
aaauucagcgcuuc

SEQ ID NO: 3436022 - RNA, 18 nt, Pseudomonas aeruginosa PA01
aacacacgcuucugcugg

SEQ ID NO: 3436023 - RNA, 18 nt, Pseudomonas aeruginosa PA01
aacacauagaccagcagc

SEQ ID NO: 3436024 - RNA, 23 nt, Pseudomonas aeruginosa PA01
aacaccacaaggugggcagcagc

SEQ ID NO: 3436025 - RNA, 17 nt, Pseudomonas aeruginosa PA01
aacaccgcgcagaugau

SEQ ID NO: 3436026 - RNA, 19 nt, Pseudomonas aeruginosa PA01
aacaccgggccgccggcga

SEQ ID NO: 3436027 - RNA, 18 nt, Pseudomonas aeruginosa PA01
aacaccuggcgcucgccg

SEQ ID NO: 3436028 - RNA, 20 nt, Pseudomonas aeruginosa PA01
aacacguagcgcaggucgcu

SEQ ID NO: 3436029 - RNA, 16 nt, Pseudomonas aeruginosa PA01
aacacuguggagucga

SEQ ID NO: 3436030 - RNA, 16 nt, Pseudomonas aeruginosa PA01
aacagcaacaccgcgc

SEQ ID NO: 3436031 - RNA, 19 nt, Pseudomonas aeruginosa PA01
aacagcaccgagcaggcac

SEQ ID NO: 3436032 - RNA, 23 nt, Pseudomonas aeruginosa PA01
aacagcaccuuggccaugggcac

SEQ ID NO: 3436033 - RNA, 10 nt, Pseudomonas aeruginosa PA01
aacagcagca

SEQ ID NO: 3436034 - RNA, 11 nt, Pseudomonas aeruginosa PA01
aacagcagcaa

SEQ ID NO: 3436035 - RNA, 13 nt, Pseudomonas aeruginosa PA01
aacagcagccagg

SEQ ID NO: 3436036 - RNA, 23 nt, Pseudomonas aeruginosa PA01
aacagccagaggucgagcugggu

SEQ ID NO: 3436037 - RNA, 18 nt, Pseudomonas aeruginosa PA01
aacagccgcagcggcaug

SEQ ID NO: 3436038 - RNA, 13 nt, Pseudomonas aeruginosa PA01
aacagccgcccca

SEQ ID NO: 3436039 - RNA, 23 nt, Pseudomonas aeruginosa PA01
aacagccgccccaccaccaucgc

SEQ ID NO: 3436040 - RNA, 13 nt, Pseudomonas aeruginosa PA01
aacagccggcggg

SEQ ID NO: 3436041 - RNA, 16 nt, Pseudomonas aeruginosa PA01
aacagcgccgcgcgcu

SEQ ID NO: 3436042 - RNA, 15 nt, Pseudomonas aeruginosa PA01
aacagcgccgcggcu

SEQ ID NO: 3436043 - RNA, 12 nt, Pseudomonas aeruginosa PA01
aacagcgccgga

SEQ ID NO: 3436044 - RNA, 14 nt, Pseudomonas aeruginosa PA01
aacagcgcgaacag

SEQ ID NO: 3436045 - RNA, 13 nt, Pseudomonas aeruginosa PA01
aacagcgcggcgg

SEQ ID NO: 3436046 - RNA, 14 nt, Pseudomonas aeruginosa PA01
aacagcggcccgag

SEQ ID NO: 3436047 - RNA, 18 nt, Pseudomonas aeruginosa PA01
aacagcgggucgcggcug

SEQ ID NO: 3436048 - RNA, 21 nt, Pseudomonas aeruginosa PA01
aacagcggugugcucaggcga

SEQ ID NO: 3436049 - RNA, 17 nt, Pseudomonas aeruginosa PA01
aacagcuccgguacccg

SEQ ID NO: 3436050 - RNA, 16 nt, Pseudomonas aeruginosa PA01
aacagcuccuccagcg

SEQ ID NO: 3436051 - RNA, 20 nt, Pseudomonas aeruginosa PA01
aacagcuccuccagcguggc

SEQ ID NO: 3436052 - RNA, 16 nt, Pseudomonas aeruginosa PA01
aacagcuugacgaucu

SEQ ID NO: 3436053 - RNA, 20 nt, Pseudomonas aeruginosa PA01
aacagcuugccgcugcgcau

SEQ ID NO: 3436054 - RNA, 21 nt, Pseudomonas aeruginosa PA01
aacaggaaacucacccuggca

SEQ ID NO: 3436055 - RNA, 20 nt, Pseudomonas aeruginosa PA01
aacaggcaaagaccgaccag

SEQ ID NO: 3436056 - RNA, 14 nt, Pseudomonas aeruginosa PA01
aacaggcagcgggc

SEQ ID NO: 3436057 - RNA, 16 nt, Pseudomonas aeruginosa PA01
aacaggcgcuucagcu

SEQ ID NO: 3436058 - RNA, 20 nt, Pseudomonas aeruginosa PA01
aacaggcuggcgucgacgcc

SEQ ID NO: 3436059 - RNA, 18 nt, Pseudomonas aeruginosa PA01
aacaggcugugcgccagg

SEQ ID NO: 3436060 - RNA, 21 nt, Pseudomonas aeruginosa PA01
aacagggcauuggccaucagc

SEQ ID NO: 3436061 - RNA, 15 nt, Pseudomonas aeruginosa PA01
aacagggcgagcagg

SEQ ID NO: 3436062 - RNA, 17 nt, Pseudomonas aeruginosa PA01
aacagggcgagcagggc

SEQ ID NO: 3436063 - RNA, 21 nt, Pseudomonas aeruginosa PA01
aacagggguucgaguccccua

SEQ ID NO: 3436064 - RNA, 16 nt, Pseudomonas aeruginosa PA01
aacaggguggugucgu

SEQ ID NO: 3436065 - RNA, 17 nt, Pseudomonas aeruginosa PA01
aacagguagcuggaaag

SEQ ID NO: 3436066 - RNA, 17 nt, Pseudomonas aeruginosa PA01
aacaggucaacaagaau

SEQ ID NO: 3436067 - RNA, 13 nt, Pseudomonas aeruginosa PA01
aacaggucgaggg

SEQ ID NO: 3436068 - RNA, 16 nt, Pseudomonas aeruginosa PA01
aacagucgucgcgcag

SEQ ID NO: 3436069 - RNA, 19 nt, Pseudomonas aeruginosa PA01
aacaguggguaggccaggc

SEQ ID NO: 3436070 - RNA, 20 nt, Pseudomonas aeruginosa PA01
aacaguggguaggccaggca

SEQ ID NO: 3436071 - RNA, 13 nt, Pseudomonas aeruginosa PA01
aacaguugagcug

SEQ ID NO: 3436072 - RNA, 14 nt, Pseudomonas aeruginosa PA01
aacaguugccgcag

SEQ ID NO: 3436073 - RNA, 20 nt, Pseudomonas aeruginosa PA01
aacaucagcagcgccagcag

SEQ ID NO: 3436074 - RNA, 14 nt, Pseudomonas aeruginosa PA01
aacaucgccagcgc

SEQ ID NO: 3436075 - RNA, 22 nt, Pseudomonas aeruginosa PA01
aacaucgccugcuuggcggcgg

SEQ ID NO: 3436076 - RNA, 16 nt, Pseudomonas aeruginosa PA01
aacauggcgucggcga

SEQ ID NO: 3436077 - RNA, 13 nt, Pseudomonas aeruginosa PA01
aaccacaccugca

SEQ ID NO: 3436078 - RNA, 18 nt, Pseudomonas aeruginosa PA01
aaccacaggagcacggcc

SEQ ID NO: 3436079 - RNA, 21 nt, Pseudomonas aeruginosa PA01
aaccacgacgaagcgccggcg

SEQ ID NO: 3436080 - RNA, 13 nt, Pseudomonas aeruginosa PA01
aaccacuccagcg

SEQ ID NO: 3436081 - RNA, 14 nt, Pseudomonas aeruginosa PA01
aaccacuccgccac

SEQ ID NO: 3436082 - RNA, 13 nt, Pseudomonas aeruginosa PA01
aaccacucggcgc

SEQ ID NO: 3436083 - RNA, 21 nt, Pseudomonas aeruginosa PA01
aaccagauccgggaaggccug

SEQ ID NO: 3436084 - RNA, 20 nt, Pseudomonas aeruginosa PA01
aaccagcagcaggucgucgg

SEQ ID NO: 3436085 - RNA, 20 nt, Pseudomonas aeruginosa PA01
aaccaggcaauggccggcgg

SEQ ID NO: 3436086 - RNA, 21 nt, Pseudomonas aeruginosa PA01
aaccaggcaauggccggcggg

SEQ ID NO: 3436087 - RNA, 18 nt, Pseudomonas aeruginosa PA01
aaccaggcggugucgcgg

SEQ ID NO: 3436088 - RNA, 17 nt, Pseudomonas aeruginosa PA01
aaccagggacgcccgga

SEQ ID NO: 3436089 - RNA, 17 nt, Pseudomonas aeruginosa PA01
aaccaggggucgacgca

SEQ ID NO: 3436090 - RNA, 14 nt, Pseudomonas aeruginosa PA01
aaccaguccagcac

SEQ ID NO: 3436091 - RNA, 15 nt, Pseudomonas aeruginosa PA01
aaccaguccagcacg

SEQ ID NO: 3436092 - RNA, 21 nt, Pseudomonas aeruginosa PA01
aacgcccugacccgcaccggc

SEQ ID NO: 3436093 - RNA, 22 nt, Pseudomonas aeruginosa PA01
aacgccgacaggccggugccgc

SEQ ID NO: 3436094 - RNA, 18 nt, Pseudomonas aeruginosa PA01
aacgccgacggcgugccg

SEQ ID NO: 3436095 - RNA, 17 nt, Pseudomonas aeruginosa PA01
aacgccgagaacgcggc

SEQ ID NO: 3436096 - RNA, 17 nt, Pseudomonas aeruginosa PA01
aacgccgcagcucggcc

SEQ ID NO: 3436097 - RNA, 19 nt, Pseudomonas aeruginosa PA01
aacgccgcccccagcgcgc

SEQ ID NO: 3436098 - RNA, 22 nt, Pseudomonas aeruginosa PA01
aacgccgcccccagcgcgccgc

SEQ ID NO: 3436099 - RNA, 17 nt, Pseudomonas aeruginosa PA01
aacgccgcccgucgcgc

SEQ ID NO: 3436100 - RNA, 19 nt, Pseudomonas aeruginosa PA01
aacgccgcccgucgcgccg

SEQ ID NO: 3436101 - RNA, 17 nt, Pseudomonas aeruginosa PA01
aacgccgcgcaccucga

SEQ ID NO: 3436102 - RNA, 17 nt, Pseudomonas aeruginosa PA01
aacgccggcgaucgccg

SEQ ID NO: 3436103 - RNA, 18 nt, Pseudomonas aeruginosa PA01
aacgccggcgaucgccgg

SEQ ID NO: 3436104 - RNA, 20 nt, Pseudomonas aeruginosa PA01
aacgccggcgaucgccggcg

SEQ ID NO: 3436105 - RNA, 21 nt, Pseudomonas aeruginosa PA01
aacgccggcgaucgccggcgu

SEQ ID NO: 3436106 - RNA, 24 nt, Pseudomonas aeruginosa PA01
aacgccgggcaacgccaggccgcu

SEQ ID NO: 3436107 - RNA, 18 nt, Pseudomonas aeruginosa PA01
aacgccgggucuucagug

SEQ ID NO: 3436108 - RNA, 15 nt, Pseudomonas aeruginosa PA01
aacgccgguggcguu

SEQ ID NO: 3436109 - RNA, 13 nt, Pseudomonas aeruginosa PA01
aacgccguuggcg

SEQ ID NO: 3436110 - RNA, 22 nt, Pseudomonas aeruginosa PA01
aacgccucgcagagcgccagcc

SEQ ID NO: 3436111 - RNA, 13 nt, Pseudomonas aeruginosa PA01
aacgccugggcgu

SEQ ID NO: 3436112 - RNA, 23 nt, Pseudomonas aeruginosa PA01
aacgccuggugcaggucgcgcgg

SEQ ID NO: 3436113 - RNA, 17 nt, Pseudomonas aeruginosa PA01
aacgccugucgcuccgg

SEQ ID NO: 3436114 - RNA, 20 nt, Pseudomonas aeruginosa PA01
aacgccugucgcuccggcag

SEQ ID NO: 3436115 - RNA, 16 nt, Pseudomonas aeruginosa PA01
aacgcgaaugcccggc

SEQ ID NO: 3436116 - RNA, 17 nt, Pseudomonas aeruginosa PA01
aacgcgaaugcccggca

SEQ ID NO: 3436117 - RNA, 19 nt, Pseudomonas aeruginosa PA01
aacgcgaaugcccggcagc

SEQ ID NO: 3436118 - RNA, 13 nt, Pseudomonas aeruginosa PA01
aacgcgaggucuc

SEQ ID NO: 3436119 - RNA, 13 nt, Pseudomonas aeruginosa PA01
aacgcgcccacuc

SEQ ID NO: 3436120 - RNA, 16 nt, Pseudomonas aeruginosa PA01
aacgcgcccacuccuc

SEQ ID NO: 3436121 - RNA, 13 nt, Pseudomonas aeruginosa PA01
aacgcgcccggcc

SEQ ID NO: 3436122 - RNA, 18 nt, Pseudomonas aeruginosa PA01
aacgcgcccggccaggcc

SEQ ID NO: 3436123 - RNA, 20 nt, Pseudomonas aeruginosa PA01
aacgcgcccggccaggccgc

SEQ ID NO: 3436124 - RNA, 22 nt, Pseudomonas aeruginosa PA01
aacgcgcccggccaggccgccc

SEQ ID NO: 3436125 - RNA, 18 nt, Pseudomonas aeruginosa PA01
aacgcgccgucgcgaccu

SEQ ID NO: 3436126 - RNA, 17 nt, Pseudomonas aeruginosa PA01
aacgcgcgcucucgccg

SEQ ID NO: 3436127 - RNA, 22 nt, Pseudomonas aeruginosa PA01
aacgcgcggaccuucgacggca

SEQ ID NO: 3436128 - RNA, 23 nt, Pseudomonas aeruginosa PA01
aacgcgcggaccuucgacggcag

SEQ ID NO: 3436129 - RNA, 15 nt, Pseudomonas aeruginosa PA01
aacgcgcugacggca

SEQ ID NO: 3436130 - RNA, 17 nt, Pseudomonas aeruginosa PA01
aacgcggagcaggcgga

SEQ ID NO: 3436131 - RNA, 17 nt, Pseudomonas aeruginosa PA01
aacgcggauacuccuuc

SEQ ID NO: 3436132 - RNA, 14 nt, Pseudomonas aeruginosa PA01
aacgcggccagcag

SEQ ID NO: 3436133 - RNA, 15 nt, Pseudomonas aeruginosa PA01
aacgcggccagcagc

SEQ ID NO: 3436134 - RNA, 16 nt, Pseudomonas aeruginosa PA01
aacgcggccagcagca

SEQ ID NO: 3436135 - RNA, 17 nt, Pseudomonas aeruginosa PA01
aacgcggguugcccggc

SEQ ID NO: 3436136 - RNA, 17 nt, Pseudomonas aeruginosa PA01
aacgcgugaagcuggag

SEQ ID NO: 3436137 - RNA, 22 nt, Pseudomonas aeruginosa PA01
aacgcgugaagcuggagcagca

SEQ ID NO: 3436138 - RNA, 20 nt, Pseudomonas aeruginosa PA01
aacgcuccuucgguaccugg

SEQ ID NO: 3436139 - RNA, 12 nt, Pseudomonas aeruginosa PA01
aacgcucggcgu

SEQ ID NO: 3436140 - RNA, 22 nt, Pseudomonas aeruginosa PA01
aacgcugcaauucgucggccug

SEQ ID NO: 3436141 - RNA, 13 nt, Pseudomonas aeruginosa PA01
aacgcuguagaau

SEQ ID NO: 3436142 - RNA, 15 nt, Pseudomonas aeruginosa PA01
aacgcuguagaaugc

SEQ ID NO: 3436143 - RNA, 14 nt, Pseudomonas aeruginosa PA01
aacgcuuccagcac

SEQ ID NO: 3436144 - RNA, 17 nt, Pseudomonas aeruginosa PA01
aacgcuuccagcaccuc

SEQ ID NO: 3436145 - RNA, 17 nt, Pseudomonas aeruginosa PA01
aacgcuugagccccggc

SEQ ID NO: 3436146 - RNA, 16 nt, Pseudomonas aeruginosa PA01
aacggaaaaaggcgcc

SEQ ID NO: 3436147 - RNA, 22 nt, Pseudomonas aeruginosa PA01
aacggaucgcgucgcaggcgau

SEQ ID NO: 3436148 - RNA, 19 nt, Pseudomonas aeruginosa PA01
aacggcagccgcguugucc

SEQ ID NO: 3436149 - RNA, 12 nt, Pseudomonas aeruginosa PA01
aacggcagcgcu

SEQ ID NO: 3436150 - RNA, 21 nt, Pseudomonas aeruginosa PA01
aacggccaggucuucuggaaa

SEQ ID NO: 3436151 - RNA, 12 nt, Pseudomonas aeruginosa PA01
aacggcccucac

SEQ ID NO: 3436152 - RNA, 12 nt, Pseudomonas aeruginosa PA01
aacggcgaccgc

SEQ ID NO: 3436153 - RNA, 19 nt, Pseudomonas aeruginosa PA01
aacggcgaccgcuggacca

SEQ ID NO: 3436154 - RNA, 22 nt, Pseudomonas aeruginosa PA01
aacggcgcuuucaucaggcgcu

SEQ ID NO: 3436155 - RNA, 17 nt, Pseudomonas aeruginosa PA01
aacggcggauaaccgcg

SEQ ID NO: 3436156 - RNA, 18 nt, Pseudomonas aeruginosa PA01
aacggcggaucgaucagc

SEQ ID NO: 3436157 - RNA, 21 nt, Pseudomonas aeruginosa PA01
aacggcggaucgaucagcagc

SEQ ID NO: 3436158 - RNA, 19 nt, Pseudomonas aeruginosa PA01
aacggcgugagggucgcgc

SEQ ID NO: 3436159 - RNA, 21 nt, Pseudomonas aeruginosa PA01
aacggcgugagggucgcgccg

SEQ ID NO: 3436160 - RNA, 13 nt, Pseudomonas aeruginosa PA01
aacggcgugccgg

SEQ ID NO: 3436161 - RNA, 23 nt, Pseudomonas aeruginosa PA01
aacggcgugccgggcagugcgcc

SEQ ID NO: 3436162 - RNA, 17 nt, Pseudomonas aeruginosa PA01
aacggcguguccagggu

SEQ ID NO: 3436163 - RNA, 12 nt, Pseudomonas aeruginosa PA01
aacggcuggucg

SEQ ID NO: 3436164 - RNA, 13 nt, Pseudomonas aeruginosa PA01
aacggcuggucgg

SEQ ID NO: 3436165 - RNA, 16 nt, Pseudomonas aeruginosa PA01
aacggcuugaggaaaa

SEQ ID NO: 3436166 - RNA, 12 nt, Pseudomonas aeruginosa PA01
aacgggaaguag

SEQ ID NO: 3436167 - RNA, 12 nt, Pseudomonas aeruginosa PA01
aacgggacaggu

SEQ ID NO: 3436168 - RNA, 17 nt, Pseudomonas aeruginosa PA01
aacgggacgccuggcgu

SEQ ID NO: 3436169 - RNA, 19 nt, Pseudomonas aeruginosa PA01
aacgggcccugccagagga

SEQ ID NO: 3436170 - RNA, 17 nt, Pseudomonas aeruginosa PA01
aacgggcgcucuggccg

SEQ ID NO: 3436171 - RNA, 12 nt, Pseudomonas aeruginosa PA01
aacgggcggcgg

SEQ ID NO: 3436172 - RNA, 18 nt, Pseudomonas aeruginosa PA01
aacggggccuucgggccc

SEQ ID NO: 3436173 - RNA, 15 nt, Pseudomonas aeruginosa PA01
aacggguccuuggca

SEQ ID NO: 3436174 - RNA, 15 nt, Pseudomonas aeruginosa PA01
aacgguagcccgcgg

SEQ ID NO: 3436175 - RNA, 14 nt, Pseudomonas aeruginosa PA01
aacgguccagggcc

SEQ ID NO: 3436176 - RNA, 20 nt, Pseudomonas aeruginosa PA01
aacgguugucgaugcgcccg

SEQ ID NO: 3436177 - RNA, 16 nt, Pseudomonas aeruginosa PA01
aacgucuucaggcgcu

SEQ ID NO: 3436178 - RNA, 13 nt, Pseudomonas aeruginosa PA01
aacgugcggccug

SEQ ID NO: 3436179 - RNA, 23 nt, Pseudomonas aeruginosa PA01
aacguuuccaugcgguguuuccu

SEQ ID NO: 3436180 - RNA, 17 nt, Pseudomonas aeruginosa PA01
aacucacccuggcaccg

SEQ ID NO: 3436181 - RNA, 14 nt, Pseudomonas aeruginosa PA01
aacucagucgaggu

SEQ ID NO: 3436182 - RNA, 16 nt, Pseudomonas aeruginosa PA01
aacucaucaggcugcc

SEQ ID NO: 3436183 - RNA, 20 nt, Pseudomonas aeruginosa PA01
aacuccaccgguuucgccag

SEQ ID NO: 3436184 - RNA, 21 nt, Pseudomonas aeruginosa PA01
aacuccaccgguuucgccagu

SEQ ID NO: 3436185 - RNA, 23 nt, Pseudomonas aeruginosa PA01
aacuccagagccaugggccggcc

SEQ ID NO: 3436186 - RNA, 15 nt, Pseudomonas aeruginosa PA01
aacuccgccagcacc

SEQ ID NO: 3436187 - RNA, 22 nt, Pseudomonas aeruginosa PA01
aacuccgccagcaccacccggc

SEQ ID NO: 3436188 - RNA, 23 nt, Pseudomonas aeruginosa PA01
aacuccuccucgcuccagaggaa

SEQ ID NO: 3436189 - RNA, 21 nt, Pseudomonas aeruginosa PA01
aacucgaaggccagcucgucg

SEQ ID NO: 3436190 - RNA, 17 nt, Pseudomonas aeruginosa PA01
aacucgaucagcgcggc

SEQ ID NO: 3436191 - RNA, 15 nt, Pseudomonas aeruginosa PA01
aacucgccgccgaca

SEQ ID NO: 3436192 - RNA, 16 nt, Pseudomonas aeruginosa PA01
aacucgcgggcgcgca

SEQ ID NO: 3436193 - RNA, 12 nt, Pseudomonas aeruginosa PA01
aacucggcgccg

SEQ ID NO: 3436194 - RNA, 12 nt, Pseudomonas aeruginosa PA01
aagccccagccc

SEQ ID NO: 3436195 - RNA, 18 nt, Pseudomonas aeruginosa PA01
aagccccagccuccaccc

SEQ ID NO: 3436196 - RNA, 14 nt, Pseudomonas aeruginosa PA01
aagccccaguccuc

SEQ ID NO: 3436197 - RNA, 16 nt, Pseudomonas aeruginosa PA01
aagccccgccaaggcg

SEQ ID NO: 3436198 - RNA, 13 nt, Pseudomonas aeruginosa PA01
aagccccgcgaac

SEQ ID NO: 3436199 - RNA, 14 nt, Pseudomonas aeruginosa PA01
aagccccgcgaacg

SEQ ID NO: 3436200 - RNA, 18 nt, Pseudomonas aeruginosa PA01
aagccccggcaucgccgg

SEQ ID NO: 3436201 - RNA, 19 nt, Pseudomonas aeruginosa PA01
aagccccuggcgcugggcc

SEQ ID NO: 3436202 - RNA, 19 nt, Pseudomonas aeruginosa PA01
aagcccgcacgaggcgggc

SEQ ID NO: 3436203 - RNA, 14 nt, Pseudomonas aeruginosa PA01
aagcccgccaggug

SEQ ID NO: 3436204 - RNA, 18 nt, Pseudomonas aeruginosa PA01
aagcccgccagguggcgg

SEQ ID NO: 3436205 - RNA, 18 nt, Pseudomonas aeruginosa PA01
aagcccggcauucgccgg

SEQ ID NO: 3436206 - RNA, 21 nt, Pseudomonas aeruginosa PA01
aagcccggcauucgccgggcu

SEQ ID NO: 3436207 - RNA, 22 nt, Pseudomonas aeruginosa PA01
aagcccggccuggugccgggcu

SEQ ID NO: 3436208 - RNA, 14 nt, Pseudomonas aeruginosa PA01
aagcccggcgaaug

SEQ ID NO: 3436209 - RNA, 21 nt, Pseudomonas aeruginosa PA01
aagcccggcgagagcguccgg

SEQ ID NO: 3436210 - RNA, 22 nt, Pseudomonas aeruginosa PA01
aagcccgugggaucgccacgcc

SEQ ID NO: 3436211 - RNA, 15 nt, Pseudomonas aeruginosa PA01
aagcccugcuggcgc

SEQ ID NO: 3436212 - RNA, 21 nt, Pseudomonas aeruginosa PA01
aagcccugcuggcgcagccag

SEQ ID NO: 3436213 - RNA, 15 nt, Pseudomonas aeruginosa PA01
aagccgacgccgagc

SEQ ID NO: 3436214 - RNA, 16 nt, Pseudomonas aeruginosa PA01
aagccgacgccgagca

SEQ ID NO: 3436215 - RNA, 17 nt, Pseudomonas aeruginosa PA01
aagccgacgccgagcag

SEQ ID NO: 3436216 - RNA, 15 nt, Pseudomonas aeruginosa PA01
aagccgagcugccgg

SEQ ID NO: 3436217 - RNA, 12 nt, Pseudomonas aeruginosa PA01
aagccgaucacc

SEQ ID NO: 3436218 - RNA, 22 nt, Pseudomonas aeruginosa PA01
aagccgaucaggucgcgcgccu

SEQ ID NO: 3436219 - RNA, 20 nt, Pseudomonas aeruginosa PA01
aagccgaugaaauagccggc

SEQ ID NO: 3436220 - RNA, 21 nt, Pseudomonas aeruginosa PA01
aagccgaugaaauagccggcg

SEQ ID NO: 3436221 - RNA, 12 nt, Pseudomonas aeruginosa PA01
aagccgcagcgc

SEQ ID NO: 3436222 - RNA, 13 nt, Pseudomonas aeruginosa PA01
aagccgcagcgcc

SEQ ID NO: 3436223 - RNA, 20 nt, Pseudomonas aeruginosa PA01
aagccgccgcccagcagcac

SEQ ID NO: 3436224 - RNA, 18 nt, Pseudomonas aeruginosa PA01
aagccgccgccgcgccgg

SEQ ID NO: 3436225 - RNA, 16 nt, Pseudomonas aeruginosa PA01
aagccgcgcagcacuu

SEQ ID NO: 3436226 - RNA, 18 nt, Pseudomonas aeruginosa PA01
aagccgcgccccagcggc

SEQ ID NO: 3436227 - RNA, 22 nt, Pseudomonas aeruginosa PA01
aagccgcgccccagcggcaggc

SEQ ID NO: 3436228 - RNA, 17 nt, Pseudomonas aeruginosa PA01
aagccgcgcccggccuc

SEQ ID NO: 3436229 - RNA, 14 nt, Pseudomonas aeruginosa PA01
aagccgcgcgccga

SEQ ID NO: 3436230 - RNA, 13 nt, Pseudomonas aeruginosa PA01
aagccgcgcucgc

SEQ ID NO: 3436231 - RNA, 21 nt, Pseudomonas aeruginosa PA01
aagccgcucggcguagccggc

SEQ ID NO: 3436232 - RNA, 19 nt, Pseudomonas aeruginosa PA01
aagccgcugaccucgguga

SEQ ID NO: 3436233 - RNA, 14 nt, Pseudomonas aeruginosa PA01
aagccggaagcgcu

SEQ ID NO: 3436234 - RNA, 18 nt, Pseudomonas aeruginosa PA01
aagccggaagcgcucgcg

SEQ ID NO: 3436235 - RNA, 16 nt, Pseudomonas aeruginosa PA01
aagccggaggcagcga

SEQ ID NO: 3436236 - RNA, 20 nt, Pseudomonas aeruginosa PA01
aagccggccccugggccggc

SEQ ID NO: 3436237 - RNA, 19 nt, Pseudomonas aeruginosa PA01
aagccggcgcaugcgccgg

SEQ ID NO: 3436238 - RNA, 20 nt, Pseudomonas aeruginosa PA01
aagccggcgcaugcgccggc

SEQ ID NO: 3436239 - RNA, 14 nt, Pseudomonas aeruginosa PA01
aagccggcggcgcg

SEQ ID NO: 3436240 - RNA, 16 nt, Pseudomonas aeruginosa PA01
aagccgggaagccgcu

SEQ ID NO: 3436241 - RNA, 17 nt, Pseudomonas aeruginosa PA01
aagccgggaagccgcuc

SEQ ID NO: 3436242 - RNA, 23 nt, Pseudomonas aeruginosa PA01
aagccggggcaggcaugcggccc

SEQ ID NO: 3436243 - RNA, 15 nt, Pseudomonas aeruginosa PA01
aagccguggcgggcc

SEQ ID NO: 3436244 - RNA, 21 nt, Pseudomonas aeruginosa PA01
aagccguuguagaucggcagc

SEQ ID NO: 3436245 - RNA, 15 nt, Pseudomonas aeruginosa PA01
aagccuggccggcga

SEQ ID NO: 3436246 - RNA, 14 nt, Pseudomonas aeruginosa PA01
aagccuucgucgau

SEQ ID NO: 3436247 - RNA, 18 nt, Pseudomonas aeruginosa PA01
aagcgacugcgcuggccg

SEQ ID NO: 3436248 - RNA, 22 nt, Pseudomonas aeruginosa PA01
aagcgaguccgacccgcuccgg

SEQ ID NO: 3436249 - RNA, 20 nt, Pseudomonas aeruginosa PA01
aagcgaucggaagaucgccc

SEQ ID NO: 3436250 - RNA, 21 nt, Pseudomonas aeruginosa PA01
aagcgaucuccugccgcggcg

SEQ ID NO: 3436251 - RNA, 22 nt, Pseudomonas aeruginosa PA01
aagcgaucuccugccgcggcga

SEQ ID NO: 3436252 - RNA, 19 nt, Pseudomonas aeruginosa PA01
aagcgauuccaugggcaga

SEQ ID NO: 3436253 - RNA, 16 nt, Pseudomonas aeruginosa PA01
aagcgcaccaccugca

SEQ ID NO: 3436254 - RNA, 23 nt, Pseudomonas aeruginosa PA01
aagcgcagcuccggcagcagggu

SEQ ID NO: 3436255 - RNA, 22 nt, Pseudomonas aeruginosa PA01
aagcgcaggccgccggcggcca

SEQ ID NO: 3436256 - RNA, 11 nt, Pseudomonas aeruginosa PA01
aagcgcaggcg

SEQ ID NO: 3436257 - RNA, 19 nt, Pseudomonas aeruginosa PA01
aagcgcaggcggcuggcgc

SEQ ID NO: 3436258 - RNA, 18 nt, Pseudomonas aeruginosa PA01
aagcgcaggcugcgggcg

SEQ ID NO: 3436259 - RNA, 18 nt, Pseudomonas aeruginosa PA01
aagcgcagguagcggcga

SEQ ID NO: 3436260 - RNA, 20 nt, Pseudomonas aeruginosa PA01
aagcgcagguagcggcgaag

SEQ ID NO: 3436261 - RNA, 17 nt, Pseudomonas aeruginosa PA01
aagcgcaggugcaccgc

SEQ ID NO: 3436262 - RNA, 20 nt, Pseudomonas aeruginosa PA01
aagcgcaguacccggccgcc

SEQ ID NO: 3436263 - RNA, 14 nt, Pseudomonas aeruginosa PA01
aagcgcccgcgcau

SEQ ID NO: 3436264 - RNA, 20 nt, Pseudomonas aeruginosa PA01
aagcgcccggcgaacagcgc

SEQ ID NO: 3436265 - RNA, 12 nt, Pseudomonas aeruginosa PA01
aagcgccgggcc

SEQ ID NO: 3436266 - RNA, 16 nt, Pseudomonas aeruginosa PA01
aagcgccgggccgcau

SEQ ID NO: 3436267 - RNA, 13 nt, Pseudomonas aeruginosa PA01
aagcgccuucugc

SEQ ID NO: 3436268 - RNA, 16 nt, Pseudomonas aeruginosa PA01
aagcgcggcucgggga

SEQ ID NO: 3436269 - RNA, 13 nt, Pseudomonas aeruginosa PA01
aagcgcuccggca

SEQ ID NO: 3436270 - RNA, 22 nt, Pseudomonas aeruginosa PA01
aagcgcucgacauacuccgccg

SEQ ID NO: 3436271 - RNA, 16 nt, Pseudomonas aeruginosa PA01
aagcgcucggccugcg

SEQ ID NO: 3436272 - RNA, 19 nt, Pseudomonas aeruginosa PA01
aagcgcucggccugcgucg

SEQ ID NO: 3436273 - RNA, 16 nt, Pseudomonas aeruginosa PA01
aagcgcucggucagcu

SEQ ID NO: 3436274 - RNA, 17 nt, Pseudomonas aeruginosa PA01
aagcgcucggucagcuc

SEQ ID NO: 3436275 - RNA, 19 nt, Pseudomonas aeruginosa PA01
aagcgcugcugggcggcga

SEQ ID NO: 3436276 - RNA, 16 nt, Pseudomonas aeruginosa PA01
aagcggaagccgggaa

SEQ ID NO: 3436277 - RNA, 22 nt, Pseudomonas aeruginosa PA01
aagcggcaauguccgagcaggu

SEQ ID NO: 3436278 - RNA, 17 nt, Pseudomonas aeruginosa PA01
aagcggccgaccaggcc

SEQ ID NO: 3436279 - RNA, 16 nt, Pseudomonas aeruginosa PA01
aagcggcgacgccacc

SEQ ID NO: 3436280 - RNA, 19 nt, Pseudomonas aeruginosa PA01
aagcggcgacgccacccgc

SEQ ID NO: 3436281 - RNA, 20 nt, Pseudomonas aeruginosa PA01
aagcggcggcuucagccaga

SEQ ID NO: 3436282 - RNA, 14 nt, Pseudomonas aeruginosa PA01
aagcggcucggcca

SEQ ID NO: 3436283 - RNA, 17 nt, Pseudomonas aeruginosa PA01
aagcggcucggccaggg

SEQ ID NO: 3436284 - RNA, 22 nt, Pseudomonas aeruginosa PA01
aagcggcucggccagggccgcu

SEQ ID NO: 3436285 - RNA, 16 nt, Pseudomonas aeruginosa PA01
aagcgggccucggcgg

SEQ ID NO: 3436286 - RNA, 23 nt, Pseudomonas aeruginosa PA01
aagcgggcuuuuucguuggccag

SEQ ID NO: 3436287 - RNA, 13 nt, Pseudomonas aeruginosa PA01
aagcggucgccgg

SEQ ID NO: 3436288 - RNA, 15 nt, Pseudomonas aeruginosa PA01
aagcggucgccggcg

SEQ ID NO: 3436289 - RNA, 17 nt, Pseudomonas aeruginosa PA01
aagcggucguagcccau

SEQ ID NO: 3436290 - RNA, 19 nt, Pseudomonas aeruginosa PA01
aagcggucguagcccaugg

SEQ ID NO: 3436291 - RNA, 16 nt, Pseudomonas aeruginosa PA01
aagcgguuagccggcg

SEQ ID NO: 3436292 - RNA, 17 nt, Pseudomonas aeruginosa PA01
aagcgguuagccggcga

SEQ ID NO: 3436293 - RNA, 19 nt, Pseudomonas aeruginosa PA01
aagcgucacucccaggcug

SEQ ID NO: 3436294 - RNA, 14 nt, Pseudomonas aeruginosa PA01
aagcgucagcgcgc

SEQ ID NO: 3436295 - RNA, 16 nt, Pseudomonas aeruginosa PA01
aagcgucagcgcgcca

SEQ ID NO: 3436296 - RNA, 17 nt, Pseudomonas aeruginosa PA01
aaggucggcgcaagcgg

SEQ ID NO: 3436297 - RNA, 15 nt, Pseudomonas aeruginosa PA01
aaggucggcggcagc

SEQ ID NO: 3436298 - RNA, 14 nt, Pseudomonas aeruginosa PA01
aaggugcaggccgc

SEQ ID NO: 3436299 - RNA, 14 nt, Pseudomonas aeruginosa PA01
aagguggcgaccug

SEQ ID NO: 3436300 - RNA, 13 nt, Pseudomonas aeruginosa PA01
aaggugugcaggu

SEQ ID NO: 3436301 - RNA, 14 nt, Pseudomonas aeruginosa PA01
aaguaccgccggca

SEQ ID NO: 3436302 - RNA, 14 nt, Pseudomonas aeruginosa PA01
aaguagaagcgcgc

SEQ ID NO: 3436303 - RNA, 19 nt, Pseudomonas aeruginosa PA01
aaguagcgacggaagcccu

SEQ ID NO: 3436304 - RNA, 15 nt, Pseudomonas aeruginosa PA01
aaguaggccuggccg

SEQ ID NO: 3436305 - RNA, 23 nt, Pseudomonas aeruginosa PA01
aaguagugcagcugcgagaacag

SEQ ID NO: 3436306 - RNA, 19 nt, Pseudomonas aeruginosa PA01
aaguccaccaggcgccggg

SEQ ID NO: 3436307 - RNA, 22 nt, Pseudomonas aeruginosa PA01
aagucgaacuucacguccagcu

SEQ ID NO: 3436308 - RNA, 14 nt, Pseudomonas aeruginosa PA01
aagucgaagcagcc

SEQ ID NO: 3436309 - RNA, 15 nt, Pseudomonas aeruginosa PA01
aagucgcccgccggc

SEQ ID NO: 3436310 - RNA, 16 nt, Pseudomonas aeruginosa PA01
aagucgcccgccggcg

SEQ ID NO: 3436311 - RNA, 17 nt, Pseudomonas aeruginosa PA01
aagucgcccgccggcgu

SEQ ID NO: 3436312 - RNA, 19 nt, Pseudomonas aeruginosa PA01
aagucgccgucguccgggu

SEQ ID NO: 3436313 - RNA, 13 nt, Pseudomonas aeruginosa PA01
aagucggccgccc

SEQ ID NO: 3436314 - RNA, 16 nt, Pseudomonas aeruginosa PA01
aagucggcgagccggc

SEQ ID NO: 3436315 - RNA, 17 nt, Pseudomonas aeruginosa PA01
aagucggcgagccggcg

SEQ ID NO: 3436316 - RNA, 21 nt, Pseudomonas aeruginosa PA01
aagucguucccggccuggcgc

SEQ ID NO: 3436317 - RNA, 18 nt, Pseudomonas aeruginosa PA01
aagucguuguacuggccg

SEQ ID NO: 3436318 - RNA, 21 nt, Pseudomonas aeruginosa PA01
aagucguuguacuggccgaaa

SEQ ID NO: 3436319 - RNA, 18 nt, Pseudomonas aeruginosa PA01
aagucugugaucaggcug

SEQ ID NO: 3436320 - RNA, 20 nt, Pseudomonas aeruginosa PA01
aagucuuucagcuucagggu

SEQ ID NO: 3436321 - RNA, 15 nt, Pseudomonas aeruginosa PA01
aagugaagcgaucca

SEQ ID NO: 3436322 - RNA, 14 nt, Pseudomonas aeruginosa PA01
aagugaccgcgcgc

SEQ ID NO: 3436323 - RNA, 17 nt, Pseudomonas aeruginosa PA01
aagugcagggcguccag

SEQ ID NO: 3436324 - RNA, 21 nt, Pseudomonas aeruginosa PA01
aagugcagggcguccaguagc

SEQ ID NO: 3436325 - RNA, 21 nt, Pseudomonas aeruginosa PA01
aagugcgcugcuugaacaccu

SEQ ID NO: 3436326 - RNA, 16 nt, Pseudomonas aeruginosa PA01
aagugcggggugaucu

SEQ ID NO: 3436327 - RNA, 14 nt, Pseudomonas aeruginosa PA01
aagugggucgccgu

SEQ ID NO: 3436328 - RNA, 14 nt, Pseudomonas aeruginosa PA01
aaguguuacagcag

SEQ ID NO: 3436329 - RNA, 19 nt, Pseudomonas aeruginosa PA01
aaguuacugauuugauuga

SEQ ID NO: 3436330 - RNA, 15 nt, Pseudomonas aeruginosa PA01
aaguucccgccgcuc

SEQ ID NO: 3436331 - RNA, 23 nt, Pseudomonas aeruginosa PA01
aaguucccgccgcucugcuggcc

SEQ ID NO: 3436332 - RNA, 16 nt, Pseudomonas aeruginosa PA01
aaguucgcauaggcgg

SEQ ID NO: 3436333 - RNA, 15 nt, Pseudomonas aeruginosa PA01
aaguucuccagcaag

SEQ ID NO: 3436334 - RNA, 16 nt, Pseudomonas aeruginosa PA01
aaguucuccagcaagc

SEQ ID NO: 3436335 - RNA, 17 nt, Pseudomonas aeruginosa PA01
aaguucuccagcaagcc

SEQ ID NO: 3436336 - RNA, 18 nt, Pseudomonas aeruginosa PA01
aaguugcaggccagcgcc

SEQ ID NO: 3436337 - RNA, 15 nt, Pseudomonas aeruginosa PA01
aaguugccgccgcug

SEQ ID NO: 3436338 - RNA, 19 nt, Pseudomonas aeruginosa PA01
aaguugccgccgcuggccu

SEQ ID NO: 3436339 - RNA, 15 nt, Pseudomonas aeruginosa PA01
aaguugcgcacccgc

SEQ ID NO: 3436340 - RNA, 23 nt, Pseudomonas aeruginosa PA01
aaguugcgcagcaacuggucgcc

SEQ ID NO: 3436341 - RNA, 18 nt, Pseudomonas aeruginosa PA01
aauacaccgcugcgccgc

SEQ ID NO: 3436342 - RNA, 18 nt, Pseudomonas aeruginosa PA01
aauaccacguggccggcg

SEQ ID NO: 3436343 - RNA, 15 nt, Pseudomonas aeruginosa PA01
aauacccgccgcugg

SEQ ID NO: 3436344 - RNA, 11 nt, Pseudomonas aeruginosa PA01
aauaccgccag

SEQ ID NO: 3436345 - RNA, 20 nt, Pseudomonas aeruginosa PA01
aauaccgcgcgcgcaaggcc

SEQ ID NO: 3436346 - RNA, 14 nt, Pseudomonas aeruginosa PA01
aauacggcuccggc

SEQ ID NO: 3436347 - RNA, 17 nt, Pseudomonas aeruginosa PA01
aauacucgucgacggcc

SEQ ID NO: 3436348 - RNA, 13 nt, Pseudomonas aeruginosa PA01
aauagccucagua

SEQ ID NO: 3436349 - RNA, 18 nt, Pseudomonas aeruginosa PA01
aauagcgccgcaggcgcu

SEQ ID NO: 3436350 - RNA, 18 nt, Pseudomonas aeruginosa PA01
aauagugcagcuccaccg

SEQ ID NO: 3436351 - RNA, 16 nt, Pseudomonas aeruginosa PA01
aaucaaaaccagccuu

SEQ ID NO: 3436352 - RNA, 12 nt, Pseudomonas aeruginosa PA01
aaucaccgccac

SEQ ID NO: 3436353 - RNA, 17 nt, Pseudomonas aeruginosa PA01
aaucaucgcgucgccga

SEQ ID NO: 3436354 - RNA, 15 nt, Pseudomonas aeruginosa PA01
aaucaucggcccugg

SEQ ID NO: 3436355 - RNA, 16 nt, Pseudomonas aeruginosa PA01
aauccagggagaacag

SEQ ID NO: 3436356 - RNA, 15 nt, Pseudomonas aeruginosa PA01
aaucccagcucgccg

SEQ ID NO: 3436357 - RNA, 13 nt, Pseudomonas aeruginosa PA01
aauccccaguagc

SEQ ID NO: 3436358 - RNA, 19 nt, Pseudomonas aeruginosa PA01
aauccgcuucguugccaua

SEQ ID NO: 3436359 - RNA, 12 nt, Pseudomonas aeruginosa PA01
aauccggcgcug

SEQ ID NO: 3436360 - RNA, 17 nt, Pseudomonas aeruginosa PA01
aauccggcgcugccgaa

SEQ ID NO: 3436361 - RNA, 20 nt, Pseudomonas aeruginosa PA01
aauccggcuggcgccggugc

SEQ ID NO: 3436362 - RNA, 16 nt, Pseudomonas aeruginosa PA01
aauccuccagccggcg

SEQ ID NO: 3436363 - RNA, 15 nt, Pseudomonas aeruginosa PA01
aauccuccgccagcg

SEQ ID NO: 3436364 - RNA, 16 nt, Pseudomonas aeruginosa PA01
aauccucggugcgcac

SEQ ID NO: 3436365 - RNA, 17 nt, Pseudomonas aeruginosa PA01
aauccuuccgucgucac

SEQ ID NO: 3436366 - RNA, 16 nt, Pseudomonas aeruginosa PA01
aauccuucgcggcggc

SEQ ID NO: 3436367 - RNA, 22 nt, Pseudomonas aeruginosa PA01
aaucgagcgccaggaacgccuc

SEQ ID NO: 3436368 - RNA, 21 nt, Pseudomonas aeruginosa PA01
aaucgagcugcucgauggcgg

SEQ ID NO: 3436369 - RNA, 14 nt, Pseudomonas aeruginosa PA01
aaucgaugucgcgg

SEQ ID NO: 3436370 - RNA, 15 nt, Pseudomonas aeruginosa PA01
aaucgccagcaggcu

SEQ ID NO: 3436371 - RNA, 18 nt, Pseudomonas aeruginosa PA01
aaucgcccaccaggucgc

SEQ ID NO: 3436372 - RNA, 15 nt, Pseudomonas aeruginosa PA01
aaucgccgucaccgc

SEQ ID NO: 3436373 - RNA, 20 nt, Pseudomonas aeruginosa PA01
aaucgccucccuggcgacgu

SEQ ID NO: 3436374 - RNA, 22 nt, Pseudomonas aeruginosa PA01
aaucgccucccuggcgacgucc

SEQ ID NO: 3436375 - RNA, 20 nt, Pseudomonas aeruginosa PA01
aaucgcgcaacggcagcgcu

SEQ ID NO: 3436376 - RNA, 23 nt, Pseudomonas aeruginosa PA01
aaucgcuggcggaaaagcccgcu

SEQ ID NO: 3436377 - RNA, 22 nt, Pseudomonas aeruginosa PA01
aaucggcgagccgcagcggcuc

SEQ ID NO: 3436378 - RNA, 23 nt, Pseudomonas aeruginosa PA01
aaucggucgcccucggccaggca

SEQ ID NO: 3436379 - RNA, 23 nt, Pseudomonas aeruginosa PA01
aaucgucgccggaggggcggccg

SEQ ID NO: 3436380 - RNA, 21 nt, Pseudomonas aeruginosa PA01
aaucugcagggcaucgcgcau

SEQ ID NO: 3436381 - RNA, 15 nt, Pseudomonas aeruginosa PA01
aaucugcgccaggug

SEQ ID NO: 3436382 - RNA, 12 nt, Pseudomonas aeruginosa PA01
aaugaaaaaggg

SEQ ID NO: 3436383 - RNA, 13 nt, Pseudomonas aeruginosa PA01
aaugaagaagccc

SEQ ID NO: 3436384 - RNA, 18 nt, Pseudomonas aeruginosa PA01
aaugacuccggucaaggc

SEQ ID NO: 3436385 - RNA, 16 nt, Pseudomonas aeruginosa PA01
aaugagaggugggccg

SEQ ID NO: 3436386 - RNA, 15 nt, Pseudomonas aeruginosa PA01
aaugcaccugcgccc

SEQ ID NO: 3436387 - RNA, 16 nt, Pseudomonas aeruginosa PA01
aaugcaccugcgcccc

SEQ ID NO: 3436388 - RNA, 17 nt, Pseudomonas aeruginosa PA01
aaugcaccugcgccccg

SEQ ID NO: 3436389 - RNA, 18 nt, Pseudomonas aeruginosa PA01
aaugccagcgccacgccg

SEQ ID NO: 3436390 - RNA, 15 nt, Pseudomonas aeruginosa PA01
aaugcccagcgcagg

SEQ ID NO: 3436391 - RNA, 16 nt, Pseudomonas aeruginosa PA01
aaugcccagcgcaggc

SEQ ID NO: 3436392 - RNA, 18 nt, Pseudomonas aeruginosa PA01
aaugcccggcagcgccgg

SEQ ID NO: 3436393 - RNA, 22 nt, Pseudomonas aeruginosa PA01
aaugcccggcagcgccgggcau

SEQ ID NO: 3436394 - RNA, 13 nt, Pseudomonas aeruginosa PA01
aaugcccuuggcu

SEQ ID NO: 3436395 - RNA, 19 nt, Pseudomonas aeruginosa PA01
aaugccggccggggccggc

SEQ ID NO: 3436396 - RNA, 21 nt, Pseudomonas aeruginosa PA01
aaugccggccggggccggcac

SEQ ID NO: 3436397 - RNA, 22 nt, Pseudomonas aeruginosa PA01
aaugccgggcuuuuucauuucc

SEQ ID NO: 3436398 - RNA, 21 nt, Pseudomonas aeruginosa PA01
aaugcguggguccacgccggg

SEQ ID NO: 3436399 - RNA, 21 nt, Pseudomonas aeruginosa PA01
acaccguggaaaccucgccga

SEQ ID NO: 3436400 - RNA, 17 nt, Pseudomonas aeruginosa PA01
acaccguguugaucgcc

SEQ ID NO: 3436401 - RNA, 15 nt, Pseudomonas aeruginosa PA01
acaccugcaacgccc

SEQ ID NO: 3436402 - RNA, 14 nt, Pseudomonas aeruginosa PA01
acaccugcguggcg

SEQ ID NO: 3436403 - RNA, 19 nt, Pseudomonas aeruginosa PA01
acaccuggucuucgguggc

SEQ ID NO: 3436404 - RNA, 21 nt, Pseudomonas aeruginosa PA01
acaccuggucuucgguggcgg

SEQ ID NO: 3436405 - RNA, 14 nt, Pseudomonas aeruginosa PA01
acaccuuggcgcga

SEQ ID NO: 3436406 - RNA, 14 nt, Pseudomonas aeruginosa PA01
acacgaauggcuuc

SEQ ID NO: 3436407 - RNA, 19 nt, Pseudomonas aeruginosa PA01
acacgcacucauagcucag

SEQ ID NO: 3436408 - RNA, 13 nt, Pseudomonas aeruginosa PA01
acacgcaggcgcc

SEQ ID NO: 3436409 - RNA, 16 nt, Pseudomonas aeruginosa PA01
acacgcccggcacucg

SEQ ID NO: 3436410 - RNA, 18 nt, Pseudomonas aeruginosa PA01
acacgcuucugcuggccg

SEQ ID NO: 3436411 - RNA, 20 nt, Pseudomonas aeruginosa PA01
acacgcuucugcuggccgcg

SEQ ID NO: 3436412 - RNA, 23 nt, Pseudomonas aeruginosa PA01
acacgcuucugcuggccgcgcag

SEQ ID NO: 3436413 - RNA, 20 nt, Pseudomonas aeruginosa PA01
acacgucggcgcgcaucugg

SEQ ID NO: 3436414 - RNA, 19 nt, Pseudomonas aeruginosa PA01
acacgugccccaggccgaa

SEQ ID NO: 3436415 - RNA, 13 nt, Pseudomonas aeruginosa PA01
acacguucaggcg

SEQ ID NO: 3436416 - RNA, 18 nt, Pseudomonas aeruginosa PA01
acacuuccuucucccggc

SEQ ID NO: 3436417 - RNA, 21 nt, Pseudomonas aeruginosa PA01
acagaaacaaagagcccgccu

SEQ ID NO: 3436418 - RNA, 16 nt, Pseudomonas aeruginosa PA01
acagaaguugcuggcg

SEQ ID NO: 3436419 - RNA, 14 nt, Pseudomonas aeruginosa PA01
acagagcggccggc

SEQ ID NO: 3436420 - RNA, 15 nt, Pseudomonas aeruginosa PA01
acagagcggccggcg

SEQ ID NO: 3436421 - RNA, 16 nt, Pseudomonas aeruginosa PA01
acagagcggccggcgc

SEQ ID NO: 3436422 - RNA, 15 nt, Pseudomonas aeruginosa PA01
acagaggaaggcgcc

SEQ ID NO: 3436423 - RNA, 18 nt, Pseudomonas aeruginosa PA01
acagaucgccagcucgcc

SEQ ID NO: 3436424 - RNA, 19 nt, Pseudomonas aeruginosa PA01
acagaucgccagcucgccg

SEQ ID NO: 3436425 - RNA, 18 nt, Pseudomonas aeruginosa PA01
acagcaaagcgcagguag

SEQ ID NO: 3436426 - RNA, 13 nt, Pseudomonas aeruginosa PA01
acagcaacaccgc

SEQ ID NO: 3436427 - RNA, 13 nt, Pseudomonas aeruginosa PA01
acagcaccacgcu

SEQ ID NO: 3436428 - RNA, 16 nt, Pseudomonas aeruginosa PA01
acagcacccaggcgac

SEQ ID NO: 3436429 - RNA, 20 nt, Pseudomonas aeruginosa PA01
acagcacccgguagccgauc

SEQ ID NO: 3436430 - RNA, 15 nt, Pseudomonas aeruginosa PA01
acagcaccgagcagg

SEQ ID NO: 3436431 - RNA, 17 nt, Pseudomonas aeruginosa PA01
acagcaccgagcaggca

SEQ ID NO: 3436432 - RNA, 20 nt, Pseudomonas aeruginosa PA01
acagcaccgagcaggcaccc

SEQ ID NO: 3436433 - RNA, 16 nt, Pseudomonas aeruginosa PA01
acagcacgagcuuggc

SEQ ID NO: 3436434 - RNA, 16 nt, Pseudomonas aeruginosa PA01
acagcacgauggcgag

SEQ ID NO: 3436435 - RNA, 15 nt, Pseudomonas aeruginosa PA01
acagcagcaagccga

SEQ ID NO: 3436436 - RNA, 23 nt, Pseudomonas aeruginosa PA01
acagcagccaaggaugcgccagc

SEQ ID NO: 3436437 - RNA, 14 nt, Pseudomonas aeruginosa PA01
acagcagccaggcg

SEQ ID NO: 3436438 - RNA, 13 nt, Pseudomonas aeruginosa PA01
acagcagcgccag

SEQ ID NO: 3436439 - RNA, 15 nt, Pseudomonas aeruginosa PA01
acagcagcggcacca

SEQ ID NO: 3436440 - RNA, 14 nt, Pseudomonas aeruginosa PA01
acagcagcucgccg

SEQ ID NO: 3436441 - RNA, 18 nt, Pseudomonas aeruginosa PA01
acagcaggagaagcgccu

SEQ ID NO: 3436442 - RNA, 15 nt, Pseudomonas aeruginosa PA01
acagcaggagcgcca

SEQ ID NO: 3436443 - RNA, 16 nt, Pseudomonas aeruginosa PA01
acagcaggagcgccau

SEQ ID NO: 3436444 - RNA, 20 nt, Pseudomonas aeruginosa PA01
acagcaggagcgccaucagc

SEQ ID NO: 3436445 - RNA, 13 nt, Pseudomonas aeruginosa PA01
acagcaggcaggc

SEQ ID NO: 3436446 - RNA, 19 nt, Pseudomonas aeruginosa PA01
acagcagggaggcgcacau

SEQ ID NO: 3436447 - RNA, 16 nt, Pseudomonas aeruginosa PA01
acagcagguagaccac

SEQ ID NO: 3436448 - RNA, 22 nt, Pseudomonas aeruginosa PA01
acagccacucuagugaaagucc

SEQ ID NO: 3436449 - RNA, 21 nt, Pseudomonas aeruginosa PA01
acagccagcgguugagcaggg

SEQ ID NO: 3436450 - RNA, 21 nt, Pseudomonas aeruginosa PA01
acagccaggggcacgcuggcg

SEQ ID NO: 3436451 - RNA, 23 nt, Pseudomonas aeruginosa PA01
acagccaggggcacgcuggcgag

SEQ ID NO: 3436452 - RNA, 20 nt, Pseudomonas aeruginosa PA01
acagccaguaguccuccgcg

SEQ ID NO: 3436453 - RNA, 17 nt, Pseudomonas aeruginosa PA01
acagccauagcgccggc

SEQ ID NO: 3436454 - RNA, 17 nt, Pseudomonas aeruginosa PA01
acagccauagugcuggg

SEQ ID NO: 3436455 - RNA, 13 nt, Pseudomonas aeruginosa PA01
acagccccagccu

SEQ ID NO: 3436456 - RNA, 22 nt, Pseudomonas aeruginosa PA01
acagccccagccucggcagggc

SEQ ID NO: 3436457 - RNA, 23 nt, Pseudomonas aeruginosa PA01
acagccccagccucggcagggcg

SEQ ID NO: 3436458 - RNA, 13 nt, Pseudomonas aeruginosa PA01
acagcccccaggc

SEQ ID NO: 3436459 - RNA, 17 nt, Pseudomonas aeruginosa PA01
acagcccccgccggccg

SEQ ID NO: 3436460 - RNA, 13 nt, Pseudomonas aeruginosa PA01
acagcccgcgccg

SEQ ID NO: 3436461 - RNA, 14 nt, Pseudomonas aeruginosa PA01
acagcccgcgccgc

SEQ ID NO: 3436462 - RNA, 17 nt, Pseudomonas aeruginosa PA01
acagcccgcgccgcgag

SEQ ID NO: 3436463 - RNA, 18 nt, Pseudomonas aeruginosa PA01
acagcccgucgcgcgccg

SEQ ID NO: 3436464 - RNA, 14 nt, Pseudomonas aeruginosa PA01
acagccgcagcggc

SEQ ID NO: 3436465 - RNA, 15 nt, Pseudomonas aeruginosa PA01
acagccgguugcguu

SEQ ID NO: 3436466 - RNA, 15 nt, Pseudomonas aeruginosa PA01
acagccugggcggcu

SEQ ID NO: 3436467 - RNA, 22 nt, Pseudomonas aeruginosa PA01
acagccugggcggcuuccugcu

SEQ ID NO: 3436468 - RNA, 16 nt, Pseudomonas aeruginosa PA01
acagcgaagcuggcgc

SEQ ID NO: 3436469 - RNA, 22 nt, Pseudomonas aeruginosa PA01
acagcgaaugcuugccggcgcc

SEQ ID NO: 3436470 - RNA, 23 nt, Pseudomonas aeruginosa PA01
acagcgaaugcuugccggcgccu

SEQ ID NO: 3436471 - RNA, 18 nt, Pseudomonas aeruginosa PA01
acagcgacucgcugccgg

SEQ ID NO: 3436472 - RNA, 21 nt, Pseudomonas aeruginosa PA01
acagcgacucgcugccggcgc

SEQ ID NO: 3436473 - RNA, 19 nt, Pseudomonas aeruginosa PA01
acagcgagaccucgcccau

SEQ ID NO: 3436474 - RNA, 16 nt, Pseudomonas aeruginosa PA01
acagcgagaggggcgc

SEQ ID NO: 3436475 - RNA, 22 nt, Pseudomonas aeruginosa PA01
acagcgccacggccagcaggau

SEQ ID NO: 3436476 - RNA, 21 nt, Pseudomonas aeruginosa PA01
acagcgcccagacacgccuca

SEQ ID NO: 3436477 - RNA, 14 nt, Pseudomonas aeruginosa PA01
acagcgccgcgcgc

SEQ ID NO: 3436478 - RNA, 19 nt, Pseudomonas aeruginosa PA01
acagcgccuggucggcggc

SEQ ID NO: 3436479 - RNA, 14 nt, Pseudomonas aeruginosa PA01
acagcgcuuccugg

SEQ ID NO: 3436480 - RNA, 16 nt, Pseudomonas aeruginosa PA01
acagcgcuuccuggga

SEQ ID NO: 3436481 - RNA, 14 nt, Pseudomonas aeruginosa PA01
acagcggcuggccc

SEQ ID NO: 3436482 - RNA, 13 nt, Pseudomonas aeruginosa PA01
acagcggcuggcg

SEQ ID NO: 3436483 - RNA, 15 nt, Pseudomonas aeruginosa PA01
acagcggcuggcgcu

SEQ ID NO: 3436484 - RNA, 14 nt, Pseudomonas aeruginosa PA01
acagcgggucggcg

SEQ ID NO: 3436485 - RNA, 23 nt, Pseudomonas aeruginosa PA01
acagcgucugggugaccagcagg

SEQ ID NO: 3436486 - RNA, 16 nt, Pseudomonas aeruginosa PA01
acagcguggccagcgc

SEQ ID NO: 3436487 - RNA, 18 nt, Pseudomonas aeruginosa PA01
acagcguggccagcgccc

SEQ ID NO: 3436488 - RNA, 19 nt, Pseudomonas aeruginosa PA01
acagcguucacgcgaccac

SEQ ID NO: 3436489 - RNA, 21 nt, Pseudomonas aeruginosa PA01
acagcucaccccaggaaaaca

SEQ ID NO: 3436490 - RNA, 15 nt, Pseudomonas aeruginosa PA01
acagcuccuccagcc

SEQ ID NO: 3436491 - RNA, 17 nt, Pseudomonas aeruginosa PA01
acagcucgcgggacagc

SEQ ID NO: 3436492 - RNA, 13 nt, Pseudomonas aeruginosa PA01
acagcucguccuu

SEQ ID NO: 3436493 - RNA, 17 nt, Pseudomonas aeruginosa PA01
acagcucguggcuggcg

SEQ ID NO: 3436494 - RNA, 21 nt, Pseudomonas aeruginosa PA01
acagcucguggcuggcgccgc

SEQ ID NO: 3436495 - RNA, 17 nt, Pseudomonas aeruginosa PA01
acagcucuggggucagu

SEQ ID NO: 3436496 - RNA, 20 nt, Pseudomonas aeruginosa PA01
acagcuggcgcgucgcugcc

SEQ ID NO: 3436497 - RNA, 13 nt, Pseudomonas aeruginosa PA01
acagcuucaggcg

SEQ ID NO: 3436498 - RNA, 14 nt, Pseudomonas aeruginosa PA01
acagcuucaggcgc

SEQ ID NO: 3436499 - RNA, 15 nt, Pseudomonas aeruginosa PA01
acagcuucaggcgca

SEQ ID NO: 3436500 - RNA, 16 nt, Pseudomonas aeruginosa PA01
acagcuugaaccgcga

SEQ ID NO: 3436501 - RNA, 21 nt, Pseudomonas aeruginosa PA01
acagcuugacgaucuucugca

SEQ ID NO: 3436502 - RNA, 16 nt, Pseudomonas aeruginosa PA01
acauggugggcgccgc

SEQ ID NO: 3436503 - RNA, 17 nt, Pseudomonas aeruginosa PA01
acauuaauugcgagcga

SEQ ID NO: 3436504 - RNA, 17 nt, Pseudomonas aeruginosa PA01
acauugcugccgaggcc

SEQ ID NO: 3436505 - RNA, 18 nt, Pseudomonas aeruginosa PA01
accaacggcguguccagg

SEQ ID NO: 3436506 - RNA, 14 nt, Pseudomonas aeruginosa PA01
accaacuuucccuc

SEQ ID NO: 3436507 - RNA, 16 nt, Pseudomonas aeruginosa PA01
accaagcggauguucu

SEQ ID NO: 3436508 - RNA, 21 nt, Pseudomonas aeruginosa PA01
accaagcggauguucuucacc

SEQ ID NO: 3436509 - RNA, 22 nt, Pseudomonas aeruginosa PA01
accaagcggauguucuucaccu

SEQ ID NO: 3436510 - RNA, 11 nt, Pseudomonas aeruginosa PA01
accacacaugc

SEQ ID NO: 3436511 - RNA, 15 nt, Pseudomonas aeruginosa PA01
accacaccaggucgc

SEQ ID NO: 3436512 - RNA, 14 nt, Pseudomonas aeruginosa PA01
accacagcaccacg

SEQ ID NO: 3436513 - RNA, 15 nt, Pseudomonas aeruginosa PA01
accacaggcggcgga

SEQ ID NO: 3436514 - RNA, 18 nt, Pseudomonas aeruginosa PA01
accacaggcggcggaaga

SEQ ID NO: 3436515 - RNA, 22 nt, Pseudomonas aeruginosa PA01
accacaggcggcggaagaagcc

SEQ ID NO: 3436516 - RNA, 16 nt, Pseudomonas aeruginosa PA01
accacaugggcgaccg

SEQ ID NO: 3436517 - RNA, 13 nt, Pseudomonas aeruginosa PA01
accaccaccgcgc

SEQ ID NO: 3436518 - RNA, 17 nt, Pseudomonas aeruginosa PA01
accaccacgacguugcc

SEQ ID NO: 3436519 - RNA, 15 nt, Pseudomonas aeruginosa PA01
accaccacgaucugc

SEQ ID NO: 3436520 - RNA, 20 nt, Pseudomonas aeruginosa PA01
accaccacgucgaugccuuc

SEQ ID NO: 3436521 - RNA, 12 nt, Pseudomonas aeruginosa PA01
accaccagcagc

SEQ ID NO: 3436522 - RNA, 13 nt, Pseudomonas aeruginosa PA01
accaccagcagca

SEQ ID NO: 3436523 - RNA, 19 nt, Pseudomonas aeruginosa PA01
accaccagcaggcccaguu

SEQ ID NO: 3436524 - RNA, 17 nt, Pseudomonas aeruginosa PA01
accaccagcaucaccac

SEQ ID NO: 3436525 - RNA, 20 nt, Pseudomonas aeruginosa PA01
accaccagcaucagcaggaa

SEQ ID NO: 3436526 - RNA, 13 nt, Pseudomonas aeruginosa PA01
accaccagcgccg

SEQ ID NO: 3436527 - RNA, 13 nt, Pseudomonas aeruginosa PA01
accaccaggaagc

SEQ ID NO: 3436528 - RNA, 17 nt, Pseudomonas aeruginosa PA01
accaccaggaaggcguc

SEQ ID NO: 3436529 - RNA, 20 nt, Pseudomonas aeruginosa PA01
accaccaggaaggcgucgcc

SEQ ID NO: 3436530 - RNA, 13 nt, Pseudomonas aeruginosa PA01
accaccaggucgg

SEQ ID NO: 3436531 - RNA, 17 nt, Pseudomonas aeruginosa PA01
accaccaggucggcgcg

SEQ ID NO: 3436532 - RNA, 13 nt, Pseudomonas aeruginosa PA01
accaccaucaccg

SEQ ID NO: 3436533 - RNA, 14 nt, Pseudomonas aeruginosa PA01
accaccaucaccgc

SEQ ID NO: 3436534 - RNA, 15 nt, Pseudomonas aeruginosa PA01
accaccauggucuuu

SEQ ID NO: 3436535 - RNA, 20 nt, Pseudomonas aeruginosa PA01
accaccauggucuuuccuuu

SEQ ID NO: 3436536 - RNA, 17 nt, Pseudomonas aeruginosa PA01
accaccaugugcuggcg

SEQ ID NO: 3436537 - RNA, 18 nt, Pseudomonas aeruginosa PA01
accaccaugugcuggcgg

SEQ ID NO: 3436538 - RNA, 19 nt, Pseudomonas aeruginosa PA01
accaccaugugcuggcgga

SEQ ID NO: 3436539 - RNA, 18 nt, Pseudomonas aeruginosa PA01
accaccauuuccagcaac

SEQ ID NO: 3436540 - RNA, 13 nt, Pseudomonas aeruginosa PA01
accacccagccgc

SEQ ID NO: 3436541 - RNA, 16 nt, Pseudomonas aeruginosa PA01
accacccgcagccccg

SEQ ID NO: 3436542 - RNA, 13 nt, Pseudomonas aeruginosa PA01
accacccggcggu

SEQ ID NO: 3436543 - RNA, 14 nt, Pseudomonas aeruginosa PA01
accacccggcugca

SEQ ID NO: 3436544 - RNA, 13 nt, Pseudomonas aeruginosa PA01
accacccggugca

SEQ ID NO: 3436545 - RNA, 15 nt, Pseudomonas aeruginosa PA01
accacccuguccugc

SEQ ID NO: 3436546 - RNA, 14 nt, Pseudomonas aeruginosa PA01
accaccgacaggcc

SEQ ID NO: 3436547 - RNA, 18 nt, Pseudomonas aeruginosa PA01
accaccgacaggccgacc

SEQ ID NO: 3436548 - RNA, 19 nt, Pseudomonas aeruginosa PA01
accaccgagagcggcgcca

SEQ ID NO: 3436549 - RNA, 23 nt, Pseudomonas aeruginosa PA01
accaccgagagcggcgccaggcg

SEQ ID NO: 3436550 - RNA, 12 nt, Pseudomonas aeruginosa PA01
accaccgccagg

SEQ ID NO: 3436551 - RNA, 20 nt, Pseudomonas aeruginosa PA01
accaccgccaggcuggccac

SEQ ID NO: 3436552 - RNA, 19 nt, Pseudomonas aeruginosa PA01
accaccgccgccagcaacg

SEQ ID NO: 3436553 - RNA, 12 nt, Pseudomonas aeruginosa PA01
accaccgccggg

SEQ ID NO: 3436554 - RNA, 16 nt, Pseudomonas aeruginosa PA01
accaccgcgaauccgc

SEQ ID NO: 3436555 - RNA, 20 nt, Pseudomonas aeruginosa PA01
accaccggaccgggcgccuc

SEQ ID NO: 3436556 - RNA, 15 nt, Pseudomonas aeruginosa PA01
accaccggcuggcgg

SEQ ID NO: 3436557 - RNA, 19 nt, Pseudomonas aeruginosa PA01
accaccgggccgucgggca

SEQ ID NO: 3436558 - RNA, 16 nt, Pseudomonas aeruginosa PA01
accaccgucuggcgca

SEQ ID NO: 3436559 - RNA, 17 nt, Pseudomonas aeruginosa PA01
accaccgugaccagcau

SEQ ID NO: 3436560 - RNA, 21 nt, Pseudomonas aeruginosa PA01
accaccgugaccagcauggcg

SEQ ID NO: 3436561 - RNA, 19 nt, Pseudomonas aeruginosa PA01
accaccgugcccgccggcg

SEQ ID NO: 3436562 - RNA, 21 nt, Pseudomonas aeruginosa PA01
accaccgugcccgccggcgcg

SEQ ID NO: 3436563 - RNA, 16 nt, Pseudomonas aeruginosa PA01
accaccguggcgccgg

SEQ ID NO: 3436564 - RNA, 18 nt, Pseudomonas aeruginosa PA01
accaccguggcgccggcg

SEQ ID NO: 3436565 - RNA, 21 nt, Pseudomonas aeruginosa PA01
accaccguggcgccggcgcgc

SEQ ID NO: 3436566 - RNA, 16 nt, Pseudomonas aeruginosa PA01
accaccucgacggcga

SEQ ID NO: 3436567 - RNA, 13 nt, Pseudomonas aeruginosa PA01
accaccucgccaa

SEQ ID NO: 3436568 - RNA, 15 nt, Pseudomonas aeruginosa PA01
accaccucgccaagc

SEQ ID NO: 3436569 - RNA, 16 nt, Pseudomonas aeruginosa PA01
accaccucggcgucgg

SEQ ID NO: 3436570 - RNA, 14 nt, Pseudomonas aeruginosa PA01
accaccugcaugcu

SEQ ID NO: 3436571 - RNA, 17 nt, Pseudomonas aeruginosa PA01
accaccuggauggugcc

SEQ ID NO: 3436572 - RNA, 14 nt, Pseudomonas aeruginosa PA01
accaccuucaggcu

SEQ ID NO: 3436573 - RNA, 15 nt, Pseudomonas aeruginosa PA01
accacgaagcgaccg

SEQ ID NO: 3436574 - RNA, 20 nt, Pseudomonas aeruginosa PA01
accacgaccgcguccaugcc

SEQ ID NO: 3436575 - RNA, 23 nt, Pseudomonas aeruginosa PA01
accacgacgaagcgccggcggcc

SEQ ID NO: 3436576 - RNA, 19 nt, Pseudomonas aeruginosa PA01
accacgacguugcccuugu

SEQ ID NO: 3436577 - RNA, 15 nt, Pseudomonas aeruginosa PA01
accacgaucagcucg

SEQ ID NO: 3436578 - RNA, 16 nt, Pseudomonas aeruginosa PA01
accacgaucaggcccu

SEQ ID NO: 3436579 - RNA, 13 nt, Pseudomonas aeruginosa PA01
accacgaucucgg

SEQ ID NO: 3436580 - RNA, 17 nt, Pseudomonas aeruginosa PA01
accacgcagccacccgc

SEQ ID NO: 3436581 - RNA, 14 nt, Pseudomonas aeruginosa PA01
accacgcaggccag

SEQ ID NO: 3436582 - RNA, 19 nt, Pseudomonas aeruginosa PA01
accacgcaggccagcgcca

SEQ ID NO: 3436583 - RNA, 14 nt, Pseudomonas aeruginosa PA01
accacgcaggcgcg

SEQ ID NO: 3436584 - RNA, 23 nt, Pseudomonas aeruginosa PA01
accacgcccgcgguauucuccag

SEQ ID NO: 3436585 - RNA, 17 nt, Pseudomonas aeruginosa PA01
accacgcccugcgccag

SEQ ID NO: 3436586 - RNA, 18 nt, Pseudomonas aeruginosa PA01
accacgcccugcgccagc

SEQ ID NO: 3436587 - RNA, 17 nt, Pseudomonas aeruginosa PA01
accacgcgauauccgcc

SEQ ID NO: 3436588 - RNA, 14 nt, Pseudomonas aeruginosa PA01
accacgcgcaagcc

SEQ ID NO: 3436589 - RNA, 17 nt, Pseudomonas aeruginosa PA01
accacgcgcaagccagc

SEQ ID NO: 3436590 - RNA, 18 nt, Pseudomonas aeruginosa PA01
accacgcgcaagccagcc

SEQ ID NO: 3436591 - RNA, 16 nt, Pseudomonas aeruginosa PA01
accacgcucuugaucg

SEQ ID NO: 3436592 - RNA, 14 nt, Pseudomonas aeruginosa PA01
accacggcgaagcc

SEQ ID NO: 3436593 - RNA, 16 nt, Pseudomonas aeruginosa PA01
accacggcgaagccgc

SEQ ID NO: 3436594 - RNA, 18 nt, Pseudomonas aeruginosa PA01
accacggcgaagccgcgc

SEQ ID NO: 3436595 - RNA, 19 nt, Pseudomonas aeruginosa PA01
accacggcgaagccgcgcc

SEQ ID NO: 3436596 - RNA, 12 nt, Pseudomonas aeruginosa PA01
accacggcgagg

SEQ ID NO: 3436597 - RNA, 19 nt, Pseudomonas aeruginosa PA01
accacggugaucaggcgcu

SEQ ID NO: 3436598 - RNA, 22 nt, Pseudomonas aeruginosa PA01
accacgguguugccguggucgc

SEQ ID NO: 3436599 - RNA, 22 nt, Pseudomonas aeruginosa PA01
accacguccagaugaaacugcc

SEQ ID NO: 3436600 - RNA, 18 nt, Pseudomonas aeruginosa PA01
accacguggccggcgcgg

SEQ ID NO: 3436601 - RNA, 13 nt, Pseudomonas aeruginosa PA01
accacguucggcg

SEQ ID NO: 3436602 - RNA, 18 nt, Pseudomonas aeruginosa PA01
accacguugcgccgcagc

SEQ ID NO: 3436603 - RNA, 19 nt, Pseudomonas aeruginosa PA01
accacguugcgccgcagca

SEQ ID NO: 3436604 - RNA, 12 nt, Pseudomonas aeruginosa PA01
accacuccagcg

SEQ ID NO: 3436605 - RNA, 15 nt, Pseudomonas aeruginosa PA01
accacucucuugccc

SEQ ID NO: 3436606 - RNA, 13 nt, Pseudomonas aeruginosa PA01
accagcgcgcagc

SEQ ID NO: 3436607 - RNA, 15 nt, Pseudomonas aeruginosa PA01
accagcgcgcgcugg

SEQ ID NO: 3436608 - RNA, 16 nt, Pseudomonas aeruginosa PA01
accagcgcgcgcuggc

SEQ ID NO: 3436609 - RNA, 18 nt, Pseudomonas aeruginosa PA01
accagcgcgcgcuggcgc

SEQ ID NO: 3436610 - RNA, 13 nt, Pseudomonas aeruginosa PA01
accagcgcgucga

SEQ ID NO: 3436611 - RNA, 16 nt, Pseudomonas aeruginosa PA01
accagcgcugccucgg

SEQ ID NO: 3436612 - RNA, 18 nt, Pseudomonas aeruginosa PA01
accagcgcuucggcggcu

SEQ ID NO: 3436613 - RNA, 19 nt, Pseudomonas aeruginosa PA01
accagcggaccgucgggca

SEQ ID NO: 3436614 - RNA, 16 nt, Pseudomonas aeruginosa PA01
accagcggcgagcagg

SEQ ID NO: 3436615 - RNA, 12 nt, Pseudomonas aeruginosa PA01
accagcggcugg

SEQ ID NO: 3436616 - RNA, 15 nt, Pseudomonas aeruginosa PA01
accagcggcuggcug

SEQ ID NO: 3436617 - RNA, 17 nt, Pseudomonas aeruginosa PA01
accagcgggucgucgaa

SEQ ID NO: 3436618 - RNA, 21 nt, Pseudomonas aeruginosa PA01
accagcggguucuugaagaag

SEQ ID NO: 3436619 - RNA, 17 nt, Pseudomonas aeruginosa PA01
accagcgguacguagcg

SEQ ID NO: 3436620 - RNA, 16 nt, Pseudomonas aeruginosa PA01
accagcgucgccaggc

SEQ ID NO: 3436621 - RNA, 17 nt, Pseudomonas aeruginosa PA01
accagcgucgccaggcc

SEQ ID NO: 3436622 - RNA, 23 nt, Pseudomonas aeruginosa PA01
accagcgucgcgcgugccccgug

SEQ ID NO: 3436623 - RNA, 23 nt, Pseudomonas aeruginosa PA01
accagcgugggcaacaggccgau

SEQ ID NO: 3436624 - RNA, 16 nt, Pseudomonas aeruginosa PA01
accagcgugguaccgc

SEQ ID NO: 3436625 - RNA, 13 nt, Pseudomonas aeruginosa PA01
accagcucagcuc

SEQ ID NO: 3436626 - RNA, 15 nt, Pseudomonas aeruginosa PA01
accagcucagcucca

SEQ ID NO: 3436627 - RNA, 23 nt, Pseudomonas aeruginosa PA01
accagcucagcuccaggccgcgg

SEQ ID NO: 3436628 - RNA, 12 nt, Pseudomonas aeruginosa PA01
accagcuccccg

SEQ ID NO: 3436629 - RNA, 11 nt, Pseudomonas aeruginosa PA01
accagcucgaa

SEQ ID NO: 3436630 - RNA, 14 nt, Pseudomonas aeruginosa PA01
accagcucgaagcc

SEQ ID NO: 3436631 - RNA, 20 nt, Pseudomonas aeruginosa PA01
accagcucgaagccgccguu

SEQ ID NO: 3436632 - RNA, 18 nt, Pseudomonas aeruginosa PA01
accagcuucaaccguggc

SEQ ID NO: 3436633 - RNA, 15 nt, Pseudomonas aeruginosa PA01
accagcuuguggccg

SEQ ID NO: 3436634 - RNA, 19 nt, Pseudomonas aeruginosa PA01
accaggaagcgucgugcgc

SEQ ID NO: 3436635 - RNA, 18 nt, Pseudomonas aeruginosa PA01
accaggaagcucggcagc

SEQ ID NO: 3436636 - RNA, 15 nt, Pseudomonas aeruginosa PA01
accaggaaggccggg

SEQ ID NO: 3436637 - RNA, 17 nt, Pseudomonas aeruginosa PA01
accaggaaggccgggcc

SEQ ID NO: 3436638 - RNA, 19 nt, Pseudomonas aeruginosa PA01
accaggaauuccuggccgg

SEQ ID NO: 3436639 - RNA, 13 nt, Pseudomonas aeruginosa PA01
accaggaccagcg

SEQ ID NO: 3436640 - RNA, 14 nt, Pseudomonas aeruginosa PA01
accaggaccagcgc

SEQ ID NO: 3436641 - RNA, 15 nt, Pseudomonas aeruginosa PA01
accaggaccagcgcc

SEQ ID NO: 3436642 - RNA, 17 nt, Pseudomonas aeruginosa PA01
accaggaccagcgccug

SEQ ID NO: 3436643 - RNA, 17 nt, Pseudomonas aeruginosa PA01
accaggacccagaugau

SEQ ID NO: 3436644 - RNA, 14 nt, Pseudomonas aeruginosa PA01
accaggagcgccag

SEQ ID NO: 3436645 - RNA, 16 nt, Pseudomonas aeruginosa PA01
accaggagcgccagca

SEQ ID NO: 3436646 - RNA, 18 nt, Pseudomonas aeruginosa PA01
accaggagcgccagcacc

SEQ ID NO: 3436647 - RNA, 14 nt, Pseudomonas aeruginosa PA01
accaggaucaccuu

SEQ ID NO: 3436648 - RNA, 17 nt, Pseudomonas aeruginosa PA01
accaggaucgccgggcu

SEQ ID NO: 3436649 - RNA, 17 nt, Pseudomonas aeruginosa PA01
accaggaugcccugcuc

SEQ ID NO: 3436650 - RNA, 14 nt, Pseudomonas aeruginosa PA01
accaggccaccggu

SEQ ID NO: 3436651 - RNA, 12 nt, Pseudomonas aeruginosa PA01
accaggccaggc

SEQ ID NO: 3436652 - RNA, 14 nt, Pseudomonas aeruginosa PA01
accaggccaggcug

SEQ ID NO: 3436653 - RNA, 20 nt, Pseudomonas aeruginosa PA01
accaggccauagcgcgccgg

SEQ ID NO: 3436654 - RNA, 21 nt, Pseudomonas aeruginosa PA01
accaggccauagcgcgccggg

SEQ ID NO: 3436655 - RNA, 23 nt, Pseudomonas aeruginosa PA01
accaggccaucgaaaucgcccac

SEQ ID NO: 3436656 - RNA, 15 nt, Pseudomonas aeruginosa PA01
accaggcccgccggu

SEQ ID NO: 3436657 - RNA, 13 nt, Pseudomonas aeruginosa PA01
accaggccgagca

SEQ ID NO: 3436658 - RNA, 22 nt, Pseudomonas aeruginosa PA01
accaggccgagcaggaagaagc

SEQ ID NO: 3436659 - RNA, 16 nt, Pseudomonas aeruginosa PA01
accaggccgccaugcu

SEQ ID NO: 3436660 - RNA, 21 nt, Pseudomonas aeruginosa PA01
accaggccgccaugcucggcc

SEQ ID NO: 3436661 - RNA, 16 nt, Pseudomonas aeruginosa PA01
accaggccgcugccgc

SEQ ID NO: 3436662 - RNA, 17 nt, Pseudomonas aeruginosa PA01
accaggccggcggccga

SEQ ID NO: 3436663 - RNA, 20 nt, Pseudomonas aeruginosa PA01
accaggccucccagccgugg

SEQ ID NO: 3436664 - RNA, 14 nt, Pseudomonas aeruginosa PA01
accaggcgccaggg

SEQ ID NO: 3436665 - RNA, 22 nt, Pseudomonas aeruginosa PA01
accaggcgccagggacgcgcag

SEQ ID NO: 3436666 - RNA, 16 nt, Pseudomonas aeruginosa PA01
accaggcgccgaugcc

SEQ ID NO: 3436667 - RNA, 20 nt, Pseudomonas aeruginosa PA01
accaggcgccgaugcccagg

SEQ ID NO: 3436668 - RNA, 13 nt, Pseudomonas aeruginosa PA01
accaggcggccga

SEQ ID NO: 3436669 - RNA, 15 nt, Pseudomonas aeruginosa PA01
accaggcggccggug

SEQ ID NO: 3436670 - RNA, 19 nt, Pseudomonas aeruginosa PA01
accaggcgguacaccgcca

SEQ ID NO: 3436671 - RNA, 19 nt, Pseudomonas aeruginosa PA01
accaggcgguuggcccgcg

SEQ ID NO: 3436672 - RNA, 23 nt, Pseudomonas aeruginosa PA01
accaggcgguuggcccgcgccgu

SEQ ID NO: 3436673 - RNA, 21 nt, Pseudomonas aeruginosa PA01
accaggcgucgcaccugggac

SEQ ID NO: 3436674 - RNA, 24 nt, Pseudomonas aeruginosa PA01
accaggcguuccaccaggcgucgc

SEQ ID NO: 3436675 - RNA, 16 nt, Pseudomonas aeruginosa PA01
accaggcucgccccgg

SEQ ID NO: 3436676 - RNA, 20 nt, Pseudomonas aeruginosa PA01
accaggcucgccccggcggc

SEQ ID NO: 3436677 - RNA, 22 nt, Pseudomonas aeruginosa PA01
accaggcucgccccggcggcga

SEQ ID NO: 3436678 - RNA, 15 nt, Pseudomonas aeruginosa PA01
accaggcugaucagc

SEQ ID NO: 3436679 - RNA, 16 nt, Pseudomonas aeruginosa PA01
accaggcugccgccgu

SEQ ID NO: 3436680 - RNA, 21 nt, Pseudomonas aeruginosa PA01
accaggcuggccaguugcgcu

SEQ ID NO: 3436681 - RNA, 17 nt, Pseudomonas aeruginosa PA01
accaggcuuacccgcga

SEQ ID NO: 3436682 - RNA, 20 nt, Pseudomonas aeruginosa PA01
accaggcuuacccgcgacca

SEQ ID NO: 3436683 - RNA, 17 nt, Pseudomonas aeruginosa PA01
accagggaagcgcgcgc

SEQ ID NO: 3436684 - RNA, 19 nt, Pseudomonas aeruginosa PA01
accagggaagcgcgcgcca

SEQ ID NO: 3436685 - RNA, 17 nt, Pseudomonas aeruginosa PA01
accagggcauccagggu

SEQ ID NO: 3436686 - RNA, 13 nt, Pseudomonas aeruginosa PA01
accagggccagga

SEQ ID NO: 3436687 - RNA, 14 nt, Pseudomonas aeruginosa PA01
accagggccagggc

SEQ ID NO: 3436688 - RNA, 13 nt, Pseudomonas aeruginosa PA01
accagggccgggu

SEQ ID NO: 3436689 - RNA, 20 nt, Pseudomonas aeruginosa PA01
accagggccucggggccguc

SEQ ID NO: 3436690 - RNA, 14 nt, Pseudomonas aeruginosa PA01
accagggcgauggu

SEQ ID NO: 3436691 - RNA, 17 nt, Pseudomonas aeruginosa PA01
accagggcgggccgcuc

SEQ ID NO: 3436692 - RNA, 21 nt, Pseudomonas aeruginosa PA01
accagggcgggccgcucgcgc

SEQ ID NO: 3436693 - RNA, 16 nt, Pseudomonas aeruginosa PA01
accagggcucggacga

SEQ ID NO: 3436694 - RNA, 18 nt, Pseudomonas aeruginosa PA01
accagggcuucgcgcaga

SEQ ID NO: 3436695 - RNA, 22 nt, Pseudomonas aeruginosa PA01
accaggggauggucggugaccc

SEQ ID NO: 3436696 - RNA, 15 nt, Pseudomonas aeruginosa PA01
accagggggcgacau

SEQ ID NO: 3436697 - RNA, 21 nt, Pseudomonas aeruginosa PA01
accaggggucgacgcagggcg

SEQ ID NO: 3436698 - RNA, 21 nt, Pseudomonas aeruginosa PA01
accagggucacgccgcggcug

SEQ ID NO: 3436699 - RNA, 15 nt, Pseudomonas aeruginosa PA01
accagggucgggccg

SEQ ID NO: 3436700 - RNA, 19 nt, Pseudomonas aeruginosa PA01
accagggucgggccgcgcu

SEQ ID NO: 3436701 - RNA, 22 nt, Pseudomonas aeruginosa PA01
accagggucgggccgcgcucgg

SEQ ID NO: 3436702 - RNA, 17 nt, Pseudomonas aeruginosa PA01
accagggucuccaggac

SEQ ID NO: 3436703 - RNA, 16 nt, Pseudomonas aeruginosa PA01
accagggugcgaugga

SEQ ID NO: 3436704 - RNA, 13 nt, Pseudomonas aeruginosa PA01
accagggugcgcu

SEQ ID NO: 3436705 - RNA, 23 nt, Pseudomonas aeruginosa PA01
accagguacggaucgguccccuc

SEQ ID NO: 3436706 - RNA, 17 nt, Pseudomonas aeruginosa PA01
accagguagagcagccc

SEQ ID NO: 3436707 - RNA, 20 nt, Pseudomonas aeruginosa PA01
accagguccggcagcgccuu

SEQ ID NO: 3436708 - RNA, 20 nt, Pseudomonas aeruginosa PA01
accaggucgcggaucaggcu

SEQ ID NO: 3436709 - RNA, 20 nt, Pseudomonas aeruginosa PA01
acccaguugggccaggaggc

SEQ ID NO: 3436710 - RNA, 16 nt, Pseudomonas aeruginosa PA01
acccaucugccggcca

SEQ ID NO: 3436711 - RNA, 20 nt, Pseudomonas aeruginosa PA01
acccaugaaaaaggccgguc

SEQ ID NO: 3436712 - RNA, 15 nt, Pseudomonas aeruginosa PA01
acccaugccgcaagc

SEQ ID NO: 3436713 - RNA, 13 nt, Pseudomonas aeruginosa PA01
acccauggcgcga

SEQ ID NO: 3436714 - RNA, 16 nt, Pseudomonas aeruginosa PA01
acccauucgaugccgc

SEQ ID NO: 3436715 - RNA, 15 nt, Pseudomonas aeruginosa PA01
accccaccggucuug

SEQ ID NO: 3436716 - RNA, 20 nt, Pseudomonas aeruginosa PA01
accccaccggucuuggcgcg

SEQ ID NO: 3436717 - RNA, 14 nt, Pseudomonas aeruginosa PA01
accccacgccggcc

SEQ ID NO: 3436718 - RNA, 21 nt, Pseudomonas aeruginosa PA01
accccaggaaaacaucacggc

SEQ ID NO: 3436719 - RNA, 15 nt, Pseudomonas aeruginosa PA01
accccaggggucggc

SEQ ID NO: 3436720 - RNA, 16 nt, Pseudomonas aeruginosa PA01
accccaggggucggca

SEQ ID NO: 3436721 - RNA, 16 nt, Pseudomonas aeruginosa PA01
accccauccucgccgg

SEQ ID NO: 3436722 - RNA, 19 nt, Pseudomonas aeruginosa PA01
accccauguaccucuggcu

SEQ ID NO: 3436723 - RNA, 13 nt, Pseudomonas aeruginosa PA01
acccccagcaggc

SEQ ID NO: 3436724 - RNA, 14 nt, Pseudomonas aeruginosa PA01
acccccagcaggcc

SEQ ID NO: 3436725 - RNA, 15 nt, Pseudomonas aeruginosa PA01
acccccagcccggcc

SEQ ID NO: 3436726 - RNA, 17 nt, Pseudomonas aeruginosa PA01
acccccaucgcccgcag

SEQ ID NO: 3436727 - RNA, 15 nt, Pseudomonas aeruginosa PA01
accccccaauugccg

SEQ ID NO: 3436728 - RNA, 19 nt, Pseudomonas aeruginosa PA01
acccccgcaaccgcugccg

SEQ ID NO: 3436729 - RNA, 24 nt, Pseudomonas aeruginosa PA01
acccccgcaaccgcugccgccguc

SEQ ID NO: 3436730 - RNA, 15 nt, Pseudomonas aeruginosa PA01
acccccggcccggcc

SEQ ID NO: 3436731 - RNA, 17 nt, Pseudomonas aeruginosa PA01
acccccggcccggccau

SEQ ID NO: 3436732 - RNA, 14 nt, Pseudomonas aeruginosa PA01
acccccugccgccc

SEQ ID NO: 3436733 - RNA, 14 nt, Pseudomonas aeruginosa PA01
acccccugcgcgga

SEQ ID NO: 3436734 - RNA, 22 nt, Pseudomonas aeruginosa PA01
acccccugcgcggacguaacgg

SEQ ID NO: 3436735 - RNA, 19 nt, Pseudomonas aeruginosa PA01
accccgaaaccggcgaugc

SEQ ID NO: 3436736 - RNA, 21 nt, Pseudomonas aeruginosa PA01
accccgaaaccggcgaugcuc

SEQ ID NO: 3436737 - RNA, 15 nt, Pseudomonas aeruginosa PA01
accccgaccagcgcg

SEQ ID NO: 3436738 - RNA, 16 nt, Pseudomonas aeruginosa PA01
accccgaccagcgcgc

SEQ ID NO: 3436739 - RNA, 18 nt, Pseudomonas aeruginosa PA01
accccgaccaggucgcug

SEQ ID NO: 3436740 - RNA, 19 nt, Pseudomonas aeruginosa PA01
accccgacgcuguugccgg

SEQ ID NO: 3436741 - RNA, 20 nt, Pseudomonas aeruginosa PA01
accccgacgcuguugccggc

SEQ ID NO: 3436742 - RNA, 13 nt, Pseudomonas aeruginosa PA01
accccgagcccgg

SEQ ID NO: 3436743 - RNA, 13 nt, Pseudomonas aeruginosa PA01
accccgaucaccg

SEQ ID NO: 3436744 - RNA, 16 nt, Pseudomonas aeruginosa PA01
accccgaucaccggau

SEQ ID NO: 3436745 - RNA, 18 nt, Pseudomonas aeruginosa PA01
accccgcaaccgcagacu

SEQ ID NO: 3436746 - RNA, 22 nt, Pseudomonas aeruginosa PA01
accccgcccaugaaaaauggcc

SEQ ID NO: 3436747 - RNA, 19 nt, Pseudomonas aeruginosa PA01
accccgcccuuggcggcgc

SEQ ID NO: 3436748 - RNA, 21 nt, Pseudomonas aeruginosa PA01
accccgcccuuggcggcgcca

SEQ ID NO: 3436749 - RNA, 15 nt, Pseudomonas aeruginosa PA01
accccgccgcuggcg

SEQ ID NO: 3436750 - RNA, 18 nt, Pseudomonas aeruginosa PA01
accccgccgcuggcggca

SEQ ID NO: 3436751 - RNA, 12 nt, Pseudomonas aeruginosa PA01
accccgccggcg

SEQ ID NO: 3436752 - RNA, 15 nt, Pseudomonas aeruginosa PA01
accccgcggguggca

SEQ ID NO: 3436753 - RNA, 14 nt, Pseudomonas aeruginosa PA01
accccggccuccag

SEQ ID NO: 3436754 - RNA, 18 nt, Pseudomonas aeruginosa PA01
accccggccuccaggcug

SEQ ID NO: 3436755 - RNA, 15 nt, Pseudomonas aeruginosa PA01
accccggccuggcgc

SEQ ID NO: 3436756 - RNA, 14 nt, Pseudomonas aeruginosa PA01
accccggccuggcu

SEQ ID NO: 3436757 - RNA, 18 nt, Pseudomonas aeruginosa PA01
accccggccuggcuggcc

SEQ ID NO: 3436758 - RNA, 22 nt, Pseudomonas aeruginosa PA01
accccggccuggcuggccuugu

SEQ ID NO: 3436759 - RNA, 22 nt, Pseudomonas aeruginosa PA01
accccggcgaucuucagguagg

SEQ ID NO: 3436760 - RNA, 16 nt, Pseudomonas aeruginosa PA01
accccggcgaugcugc

SEQ ID NO: 3436761 - RNA, 18 nt, Pseudomonas aeruginosa PA01
accccgggguucugcgag

SEQ ID NO: 3436762 - RNA, 17 nt, Pseudomonas aeruginosa PA01
accccggucaggccgau

SEQ ID NO: 3436763 - RNA, 22 nt, Pseudomonas aeruginosa PA01
accccggucaggccgaucacca

SEQ ID NO: 3436764 - RNA, 18 nt, Pseudomonas aeruginosa PA01
accccggucauggugccg

SEQ ID NO: 3436765 - RNA, 15 nt, Pseudomonas aeruginosa PA01
accccggugugcgcu

SEQ ID NO: 3436766 - RNA, 18 nt, Pseudomonas aeruginosa PA01
accccgguugugcgcccg

SEQ ID NO: 3436767 - RNA, 17 nt, Pseudomonas aeruginosa PA01
accccguuguacccggc

SEQ ID NO: 3436768 - RNA, 20 nt, Pseudomonas aeruginosa PA01
accccucggcuaaccgccuu

SEQ ID NO: 3436769 - RNA, 21 nt, Pseudomonas aeruginosa PA01
accccugggaugccgccaagc

SEQ ID NO: 3436770 - RNA, 23 nt, Pseudomonas aeruginosa PA01
accccugggaugccgccaagccc

SEQ ID NO: 3436771 - RNA, 14 nt, Pseudomonas aeruginosa PA01
accccuuccccccg

SEQ ID NO: 3436772 - RNA, 14 nt, Pseudomonas aeruginosa PA01
accccuucgagcaa

SEQ ID NO: 3436773 - RNA, 21 nt, Pseudomonas aeruginosa PA01
accccuucgagcaacacaugc

SEQ ID NO: 3436774 - RNA, 18 nt, Pseudomonas aeruginosa PA01
accccuugcagccagccg

SEQ ID NO: 3436775 - RNA, 21 nt, Pseudomonas aeruginosa PA01
accccuugcagccagccgucg

SEQ ID NO: 3436776 - RNA, 21 nt, Pseudomonas aeruginosa PA01
acccgaaagccgaagcgcgag

SEQ ID NO: 3436777 - RNA, 22 nt, Pseudomonas aeruginosa PA01
acccgaaagccgaagcgcgagu

SEQ ID NO: 3436778 - RNA, 14 nt, Pseudomonas aeruginosa PA01
acccgacaggcagc

SEQ ID NO: 3436779 - RNA, 15 nt, Pseudomonas aeruginosa PA01
acccgacaggcagcg

SEQ ID NO: 3436780 - RNA, 14 nt, Pseudomonas aeruginosa PA01
acccgcaacaccug

SEQ ID NO: 3436781 - RNA, 13 nt, Pseudomonas aeruginosa PA01
acccgcaccagcc

SEQ ID NO: 3436782 - RNA, 14 nt, Pseudomonas aeruginosa PA01
acccgcaccagccg

SEQ ID NO: 3436783 - RNA, 17 nt, Pseudomonas aeruginosa PA01
acccgcaccuggaccgg

SEQ ID NO: 3436784 - RNA, 16 nt, Pseudomonas aeruginosa PA01
acccgcacggcgacgc

SEQ ID NO: 3436785 - RNA, 18 nt, Pseudomonas aeruginosa PA01
acccgcacguugaggucg

SEQ ID NO: 3436786 - RNA, 15 nt, Pseudomonas aeruginosa PA01
acccgcagccccgcc

SEQ ID NO: 3436787 - RNA, 19 nt, Pseudomonas aeruginosa PA01
acccgcagccccgccggaa

SEQ ID NO: 3436788 - RNA, 14 nt, Pseudomonas aeruginosa PA01
acccgcagcggcag

SEQ ID NO: 3436789 - RNA, 21 nt, Pseudomonas aeruginosa PA01
acccgcagcggcagcggcucg

SEQ ID NO: 3436790 - RNA, 18 nt, Pseudomonas aeruginosa PA01
acccgcagggcucgugcc

SEQ ID NO: 3436791 - RNA, 18 nt, Pseudomonas aeruginosa PA01
acccgcaguuccuugggc

SEQ ID NO: 3436792 - RNA, 19 nt, Pseudomonas aeruginosa PA01
acccgccccugcuccucgc

SEQ ID NO: 3436793 - RNA, 17 nt, Pseudomonas aeruginosa PA01
acccgcccgccguccuc

SEQ ID NO: 3436794 - RNA, 22 nt, Pseudomonas aeruginosa PA01
acccgcccgccgucgcccaugu

SEQ ID NO: 3436795 - RNA, 18 nt, Pseudomonas aeruginosa PA01
acccgcccucguggcggg

SEQ ID NO: 3436796 - RNA, 19 nt, Pseudomonas aeruginosa PA01
acccgcccuugcucgcggc

SEQ ID NO: 3436797 - RNA, 18 nt, Pseudomonas aeruginosa PA01
acccgccgaccggacucc

SEQ ID NO: 3436798 - RNA, 18 nt, Pseudomonas aeruginosa PA01
acccgccguucgcccgcc

SEQ ID NO: 3436799 - RNA, 17 nt, Pseudomonas aeruginosa PA01
acccgccucaaggugaa

SEQ ID NO: 3436800 - RNA, 22 nt, Pseudomonas aeruginosa PA01
acccgccucaccccacgggcga

SEQ ID NO: 3436801 - RNA, 15 nt, Pseudomonas aeruginosa PA01
acccgccucgucgcc

SEQ ID NO: 3436802 - RNA, 20 nt, Pseudomonas aeruginosa PA01
acccgccucgucgccaugcg

SEQ ID NO: 3436803 - RNA, 21 nt, Pseudomonas aeruginosa PA01
acccgccucgucgccaugcgg

SEQ ID NO: 3436804 - RNA, 10 nt, Pseudomonas aeruginosa PA01
acccgcgaag

SEQ ID NO: 3436805 - RNA, 13 nt, Pseudomonas aeruginosa PA01
acccgcgaagccu

SEQ ID NO: 3436806 - RNA, 15 nt, Pseudomonas aeruginosa PA01
acccgcgaggccggc

SEQ ID NO: 3436807 - RNA, 14 nt, Pseudomonas aeruginosa PA01
acccgcgccgccgc

SEQ ID NO: 3436808 - RNA, 22 nt, Pseudomonas aeruginosa PA01
acccgcgccgccgcggccagcc

SEQ ID NO: 3436809 - RNA, 11 nt, Pseudomonas aeruginosa PA01
acccgcgccgg

SEQ ID NO: 3436810 - RNA, 20 nt, Pseudomonas aeruginosa PA01
acccgcgccggcagcucggc

SEQ ID NO: 3436811 - RNA, 15 nt, Pseudomonas aeruginosa PA01
acccgcgccugcagg

SEQ ID NO: 3436812 - RNA, 14 nt, Pseudomonas aeruginosa PA01
accgaacaggcgac

SEQ ID NO: 3436813 - RNA, 13 nt, Pseudomonas aeruginosa PA01
accgaacggugca

SEQ ID NO: 3436814 - RNA, 16 nt, Pseudomonas aeruginosa PA01
accgaaggcaacagcc

SEQ ID NO: 3436815 - RNA, 23 nt, Pseudomonas aeruginosa PA01
accgaagguacugccgcuaucgc

SEQ ID NO: 3436816 - RNA, 17 nt, Pseudomonas aeruginosa PA01
accgacacgcacucaua

SEQ ID NO: 3436817 - RNA, 16 nt, Pseudomonas aeruginosa PA01
accgacaggccgacca

SEQ ID NO: 3436818 - RNA, 13 nt, Pseudomonas aeruginosa PA01
accgacaguccca

SEQ ID NO: 3436819 - RNA, 18 nt, Pseudomonas aeruginosa PA01
accgacaugccccgccga

SEQ ID NO: 3436820 - RNA, 19 nt, Pseudomonas aeruginosa PA01
accgacaugccccgccgac

SEQ ID NO: 3436821 - RNA, 15 nt, Pseudomonas aeruginosa PA01
accgacccucggcga

SEQ ID NO: 3436822 - RNA, 18 nt, Pseudomonas aeruginosa PA01
accgacgccgccugcgcc

SEQ ID NO: 3436823 - RNA, 20 nt, Pseudomonas aeruginosa PA01
accgacgccgccugcgccuc

SEQ ID NO: 3436824 - RNA, 20 nt, Pseudomonas aeruginosa PA01
accgacgccggacgcaccag

SEQ ID NO: 3436825 - RNA, 22 nt, Pseudomonas aeruginosa PA01
accgacgccggacgcaccagca

SEQ ID NO: 3436826 - RNA, 18 nt, Pseudomonas aeruginosa PA01
accgacgcucgcggcauc

SEQ ID NO: 3436827 - RNA, 22 nt, Pseudomonas aeruginosa PA01
accgacgcucgcggcaucccgc

SEQ ID NO: 3436828 - RNA, 19 nt, Pseudomonas aeruginosa PA01
accgacgggucgccauggu

SEQ ID NO: 3436829 - RNA, 17 nt, Pseudomonas aeruginosa PA01
accgacggucggcaggu

SEQ ID NO: 3436830 - RNA, 21 nt, Pseudomonas aeruginosa PA01
accgacgugcaaaugcgcaac

SEQ ID NO: 3436831 - RNA, 15 nt, Pseudomonas aeruginosa PA01
accgagacccuggcg

SEQ ID NO: 3436832 - RNA, 17 nt, Pseudomonas aeruginosa PA01
accgagacccuggcgcu

SEQ ID NO: 3436833 - RNA, 15 nt, Pseudomonas aeruginosa PA01
accgagacgcccugg

SEQ ID NO: 3436834 - RNA, 17 nt, Pseudomonas aeruginosa PA01
accgagacgcccuggau

SEQ ID NO: 3436835 - RNA, 21 nt, Pseudomonas aeruginosa PA01
accgagacgugaagccccugg

SEQ ID NO: 3436836 - RNA, 14 nt, Pseudomonas aeruginosa PA01
accgagaucaccuu

SEQ ID NO: 3436837 - RNA, 15 nt, Pseudomonas aeruginosa PA01
accgagcaugcgcgg

SEQ ID NO: 3436838 - RNA, 22 nt, Pseudomonas aeruginosa PA01
accgagccguugugcagguacg

SEQ ID NO: 3436839 - RNA, 16 nt, Pseudomonas aeruginosa PA01
accgagcgcaguucgu

SEQ ID NO: 3436840 - RNA, 15 nt, Pseudomonas aeruginosa PA01
accgaggaucggcac

SEQ ID NO: 3436841 - RNA, 22 nt, Pseudomonas aeruginosa PA01
accgaggcgaacggcagguggu

SEQ ID NO: 3436842 - RNA, 12 nt, Pseudomonas aeruginosa PA01
accgaggcgcgc

SEQ ID NO: 3436843 - RNA, 14 nt, Pseudomonas aeruginosa PA01
accgaggcgcgccg

SEQ ID NO: 3436844 - RNA, 15 nt, Pseudomonas aeruginosa PA01
accgaggcgcgccga

SEQ ID NO: 3436845 - RNA, 19 nt, Pseudomonas aeruginosa PA01
accgaggcgcgccgacagc

SEQ ID NO: 3436846 - RNA, 20 nt, Pseudomonas aeruginosa PA01
accgagggcauuuccugggu

SEQ ID NO: 3436847 - RNA, 17 nt, Pseudomonas aeruginosa PA01
accgagggugcagagca

SEQ ID NO: 3436848 - RNA, 21 nt, Pseudomonas aeruginosa PA01
accgagguagucccagaccac

SEQ ID NO: 3436849 - RNA, 13 nt, Pseudomonas aeruginosa PA01
accgagucggcaa

SEQ ID NO: 3436850 - RNA, 17 nt, Pseudomonas aeruginosa PA01
accgaguggcgcagcgc

SEQ ID NO: 3436851 - RNA, 21 nt, Pseudomonas aeruginosa PA01
accgaguggcgcagcgcccga

SEQ ID NO: 3436852 - RNA, 18 nt, Pseudomonas aeruginosa PA01
accgaguugaccagcaug

SEQ ID NO: 3436853 - RNA, 23 nt, Pseudomonas aeruginosa PA01
accgaguuucccggcgcggccga

SEQ ID NO: 3436854 - RNA, 17 nt, Pseudomonas aeruginosa PA01
accgauauaggcgacga

SEQ ID NO: 3436855 - RNA, 20 nt, Pseudomonas aeruginosa PA01
accgauaucucccaacuggu

SEQ ID NO: 3436856 - RNA, 12 nt, Pseudomonas aeruginosa PA01
accgauccagca

SEQ ID NO: 3436857 - RNA, 17 nt, Pseudomonas aeruginosa PA01
accgaucgcccgcgccu

SEQ ID NO: 3436858 - RNA, 20 nt, Pseudomonas aeruginosa PA01
accgaucgcccgcgccucga

SEQ ID NO: 3436859 - RNA, 13 nt, Pseudomonas aeruginosa PA01
accgauucgccgg

SEQ ID NO: 3436860 - RNA, 17 nt, Pseudomonas aeruginosa PA01
accgcaaccgguccucg

SEQ ID NO: 3436861 - RNA, 18 nt, Pseudomonas aeruginosa PA01
accgcaaccgguccucgc

SEQ ID NO: 3436862 - RNA, 19 nt, Pseudomonas aeruginosa PA01
accgcaagggugcucagga

SEQ ID NO: 3436863 - RNA, 13 nt, Pseudomonas aeruginosa PA01
accgcaccgccag

SEQ ID NO: 3436864 - RNA, 14 nt, Pseudomonas aeruginosa PA01
accgcaccgccagc

SEQ ID NO: 3436865 - RNA, 15 nt, Pseudomonas aeruginosa PA01
accgcaccgccagcg

SEQ ID NO: 3436866 - RNA, 12 nt, Pseudomonas aeruginosa PA01
accgcaccuggu

SEQ ID NO: 3436867 - RNA, 15 nt, Pseudomonas aeruginosa PA01
accgcaccuggugga

SEQ ID NO: 3436868 - RNA, 23 nt, Pseudomonas aeruginosa PA01
accgcacggccgucacggccucc

SEQ ID NO: 3436869 - RNA, 23 nt, Pseudomonas aeruginosa PA01
accgcagccggcgaacagguagc

SEQ ID NO: 3436870 - RNA, 15 nt, Pseudomonas aeruginosa PA01
accgcaucgaagcgc

SEQ ID NO: 3436871 - RNA, 23 nt, Pseudomonas aeruginosa PA01
accgcaucgaaggcgccggcaug

SEQ ID NO: 3436872 - RNA, 15 nt, Pseudomonas aeruginosa PA01
accgccaaggccucg

SEQ ID NO: 3436873 - RNA, 18 nt, Pseudomonas aeruginosa PA01
accgccaaggccucggca

SEQ ID NO: 3436874 - RNA, 19 nt, Pseudomonas aeruginosa PA01
accgccaaggccucggcau

SEQ ID NO: 3436875 - RNA, 16 nt, Pseudomonas aeruginosa PA01
accgccaaggucgguc

SEQ ID NO: 3436876 - RNA, 23 nt, Pseudomonas aeruginosa PA01
accgccaaggucggucucgccac

SEQ ID NO: 3436877 - RNA, 17 nt, Pseudomonas aeruginosa PA01
accgccaccagcgaguc

SEQ ID NO: 3436878 - RNA, 14 nt, Pseudomonas aeruginosa PA01
accgccaccccgcc

SEQ ID NO: 3436879 - RNA, 17 nt, Pseudomonas aeruginosa PA01
accgccaccccgccggc

SEQ ID NO: 3436880 - RNA, 18 nt, Pseudomonas aeruginosa PA01
accgccaccccgccggcg

SEQ ID NO: 3436881 - RNA, 14 nt, Pseudomonas aeruginosa PA01
accgccaccgccgg

SEQ ID NO: 3436882 - RNA, 18 nt, Pseudomonas aeruginosa PA01
accgccagacaggccagc

SEQ ID NO: 3436883 - RNA, 20 nt, Pseudomonas aeruginosa PA01
accgccagacaggccagcuc

SEQ ID NO: 3436884 - RNA, 12 nt, Pseudomonas aeruginosa PA01
accgccagcagu

SEQ ID NO: 3436885 - RNA, 14 nt, Pseudomonas aeruginosa PA01
accgccagcgcacc

SEQ ID NO: 3436886 - RNA, 11 nt, Pseudomonas aeruginosa PA01
accgccagcgg

SEQ ID NO: 3436887 - RNA, 19 nt, Pseudomonas aeruginosa PA01
accgccaggaccucgaagc

SEQ ID NO: 3436888 - RNA, 22 nt, Pseudomonas aeruginosa PA01
accgccaggaccucgaagcugg

SEQ ID NO: 3436889 - RNA, 20 nt, Pseudomonas aeruginosa PA01
accgccaggccgacccgcag

SEQ ID NO: 3436890 - RNA, 11 nt, Pseudomonas aeruginosa PA01
accgccaggcg

SEQ ID NO: 3436891 - RNA, 13 nt, Pseudomonas aeruginosa PA01
accgccaggcggc

SEQ ID NO: 3436892 - RNA, 15 nt, Pseudomonas aeruginosa PA01
accgccaggcggccg

SEQ ID NO: 3436893 - RNA, 17 nt, Pseudomonas aeruginosa PA01
accgccaggcggccgcu

SEQ ID NO: 3436894 - RNA, 14 nt, Pseudomonas aeruginosa PA01
accgccagggcgcu

SEQ ID NO: 3436895 - RNA, 18 nt, Pseudomonas aeruginosa PA01
accgccagggcgcucacc

SEQ ID NO: 3436896 - RNA, 20 nt, Pseudomonas aeruginosa PA01
accgccagggcgcucaccga

SEQ ID NO: 3436897 - RNA, 22 nt, Pseudomonas aeruginosa PA01
accgccagggcgcucaccgagg

SEQ ID NO: 3436898 - RNA, 20 nt, Pseudomonas aeruginosa PA01
accgccaggguguuguucgc

SEQ ID NO: 3436899 - RNA, 13 nt, Pseudomonas aeruginosa PA01
accgccaucagca

SEQ ID NO: 3436900 - RNA, 15 nt, Pseudomonas aeruginosa PA01
accgccauggcgcug

SEQ ID NO: 3436901 - RNA, 16 nt, Pseudomonas aeruginosa PA01
accgccauggcgcuga

SEQ ID NO: 3436902 - RNA, 15 nt, Pseudomonas aeruginosa PA01
accgcccacccugcg

SEQ ID NO: 3436903 - RNA, 18 nt, Pseudomonas aeruginosa PA01
accgcccacccugcgcga

SEQ ID NO: 3436904 - RNA, 19 nt, Pseudomonas aeruginosa PA01
accgcccacccugcgcgag

SEQ ID NO: 3436905 - RNA, 21 nt, Pseudomonas aeruginosa PA01
accgcccacccugcgcgagga

SEQ ID NO: 3436906 - RNA, 16 nt, Pseudomonas aeruginosa PA01
accgcccagccgaggu

SEQ ID NO: 3436907 - RNA, 14 nt, Pseudomonas aeruginosa PA01
accgcccaggcugc

SEQ ID NO: 3436908 - RNA, 20 nt, Pseudomonas aeruginosa PA01
accgcccaggcugccgccgc

SEQ ID NO: 3436909 - RNA, 22 nt, Pseudomonas aeruginosa PA01
accgcccaggcugccgccgccg

SEQ ID NO: 3436910 - RNA, 13 nt, Pseudomonas aeruginosa PA01
accgcccccggcg

SEQ ID NO: 3436911 - RNA, 14 nt, Pseudomonas aeruginosa PA01
accgcccccggcgc

SEQ ID NO: 3436912 - RNA, 16 nt, Pseudomonas aeruginosa PA01
accgcccccggcgcca

SEQ ID NO: 3436913 - RNA, 17 nt, Pseudomonas aeruginosa PA01
accgcccccggcgccac

SEQ ID NO: 3436914 - RNA, 19 nt, Pseudomonas aeruginosa PA01
accgcccgccucaggccgg

SEQ ID NO: 3436915 - RNA, 22 nt, Pseudomonas aeruginosa PA01
accgcucgcgguuauccgccgc

SEQ ID NO: 3436916 - RNA, 15 nt, Pseudomonas aeruginosa PA01
accgcucgucaggcg

SEQ ID NO: 3436917 - RNA, 23 nt, Pseudomonas aeruginosa PA01
accgcucgucaggcgcucaggga

SEQ ID NO: 3436918 - RNA, 23 nt, Pseudomonas aeruginosa PA01
accgcucucgaggacgugcacca

SEQ ID NO: 3436919 - RNA, 12 nt, Pseudomonas aeruginosa PA01
accgcucugcac

SEQ ID NO: 3436920 - RNA, 13 nt, Pseudomonas aeruginosa PA01
accgcugccgccg

SEQ ID NO: 3436921 - RNA, 14 nt, Pseudomonas aeruginosa PA01
accgcugccgccgu

SEQ ID NO: 3436922 - RNA, 12 nt, Pseudomonas aeruginosa PA01
accgcugcgccg

SEQ ID NO: 3436923 - RNA, 17 nt, Pseudomonas aeruginosa PA01
accgcugcgccgccguc

SEQ ID NO: 3436924 - RNA, 22 nt, Pseudomonas aeruginosa PA01
accgcugcgcgggucuugccgg

SEQ ID NO: 3436925 - RNA, 13 nt, Pseudomonas aeruginosa PA01
accgcugcggccg

SEQ ID NO: 3436926 - RNA, 16 nt, Pseudomonas aeruginosa PA01
accgcugcggccggcg

SEQ ID NO: 3436927 - RNA, 18 nt, Pseudomonas aeruginosa PA01
accgcugcggccggcgcg

SEQ ID NO: 3436928 - RNA, 19 nt, Pseudomonas aeruginosa PA01
accgcugcggccggcgcgu

SEQ ID NO: 3436929 - RNA, 17 nt, Pseudomonas aeruginosa PA01
accgcugcgugccaggg

SEQ ID NO: 3436930 - RNA, 15 nt, Pseudomonas aeruginosa PA01
accgcuggcgcuggg

SEQ ID NO: 3436931 - RNA, 18 nt, Pseudomonas aeruginosa PA01
accgcugggacggcggcu

SEQ ID NO: 3436932 - RNA, 14 nt, Pseudomonas aeruginosa PA01
accgcuggucggca

SEQ ID NO: 3436933 - RNA, 15 nt, Pseudomonas aeruginosa PA01
accgcuggucggcau

SEQ ID NO: 3436934 - RNA, 15 nt, Pseudomonas aeruginosa PA01
accgcuuccugggcu

SEQ ID NO: 3436935 - RNA, 16 nt, Pseudomonas aeruginosa PA01
accgcuucgagcaccc

SEQ ID NO: 3436936 - RNA, 21 nt, Pseudomonas aeruginosa PA01
accgcuucgcggaucaacgcc

SEQ ID NO: 3436937 - RNA, 15 nt, Pseudomonas aeruginosa PA01
accgcuugccagccg

SEQ ID NO: 3436938 - RNA, 17 nt, Pseudomonas aeruginosa PA01
accgcuugccagccgcu

SEQ ID NO: 3436939 - RNA, 23 nt, Pseudomonas aeruginosa PA01
accgcuugcggucauccgccggc

SEQ ID NO: 3436940 - RNA, 17 nt, Pseudomonas aeruginosa PA01
accgcuuucaccagggu

SEQ ID NO: 3436941 - RNA, 17 nt, Pseudomonas aeruginosa PA01
accgcuuucagcgccgc

SEQ ID NO: 3436942 - RNA, 19 nt, Pseudomonas aeruginosa PA01
accgcuuucguagggcgaa

SEQ ID NO: 3436943 - RNA, 14 nt, Pseudomonas aeruginosa PA01
accggaaccggggu

SEQ ID NO: 3436944 - RNA, 24 nt, Pseudomonas aeruginosa PA01
accggaagcgaucuccugccgcgg

SEQ ID NO: 3436945 - RNA, 21 nt, Pseudomonas aeruginosa PA01
accggaaucacgucgaucugc

SEQ ID NO: 3436946 - RNA, 16 nt, Pseudomonas aeruginosa PA01
accggaccgggcgccu

SEQ ID NO: 3436947 - RNA, 17 nt, Pseudomonas aeruginosa PA01
accggacggcugaggcu

SEQ ID NO: 3436948 - RNA, 14 nt, Pseudomonas aeruginosa PA01
accggaucgcccug

SEQ ID NO: 3436949 - RNA, 17 nt, Pseudomonas aeruginosa PA01
accggaucgcccuggcg

SEQ ID NO: 3436950 - RNA, 21 nt, Pseudomonas aeruginosa PA01
accggaucgcccuggcgccag

SEQ ID NO: 3436951 - RNA, 22 nt, Pseudomonas aeruginosa PA01
accggaucgcccuggcgccagc

SEQ ID NO: 3436952 - RNA, 17 nt, Pseudomonas aeruginosa PA01
accggauguucgaaggc

SEQ ID NO: 3436953 - RNA, 15 nt, Pseudomonas aeruginosa PA01
accggcaaggcgcug

SEQ ID NO: 3436954 - RNA, 16 nt, Pseudomonas aeruginosa PA01
accggcaaggcggccu

SEQ ID NO: 3436955 - RNA, 13 nt, Pseudomonas aeruginosa PA01
accggcagcagcg

SEQ ID NO: 3436956 - RNA, 16 nt, Pseudomonas aeruginosa PA01
accggcagcgccgcca

SEQ ID NO: 3436957 - RNA, 19 nt, Pseudomonas aeruginosa PA01
accggcagcgccgccagca

SEQ ID NO: 3436958 - RNA, 21 nt, Pseudomonas aeruginosa PA01
accggcagcgccgccagcagg

SEQ ID NO: 3436959 - RNA, 22 nt, Pseudomonas aeruginosa PA01
accggcagcgccgccagcagga

SEQ ID NO: 3436960 - RNA, 15 nt, Pseudomonas aeruginosa PA01
accggcaggaucggc

SEQ ID NO: 3436961 - RNA, 22 nt, Pseudomonas aeruginosa PA01
accggcagggcgauccgcccgc

SEQ ID NO: 3436962 - RNA, 19 nt, Pseudomonas aeruginosa PA01
accggcagggucacgccgg

SEQ ID NO: 3436963 - RNA, 14 nt, Pseudomonas aeruginosa PA01
accggcaggucggg

SEQ ID NO: 3436964 - RNA, 21 nt, Pseudomonas aeruginosa PA01
accggcagucccugccagggg

SEQ ID NO: 3436965 - RNA, 23 nt, Pseudomonas aeruginosa PA01
accggcagucccugccaggggcu

SEQ ID NO: 3436966 - RNA, 17 nt, Pseudomonas aeruginosa PA01
accggcauguagcgcgc

SEQ ID NO: 3436967 - RNA, 21 nt, Pseudomonas aeruginosa PA01
accggccacucgcagccgcgc

SEQ ID NO: 3436968 - RNA, 12 nt, Pseudomonas aeruginosa PA01
accggccagcgc

SEQ ID NO: 3436969 - RNA, 14 nt, Pseudomonas aeruginosa PA01
accggccagcgcgg

SEQ ID NO: 3436970 - RNA, 16 nt, Pseudomonas aeruginosa PA01
accggccaggcgcugg

SEQ ID NO: 3436971 - RNA, 18 nt, Pseudomonas aeruginosa PA01
accggccaucagcaccag

SEQ ID NO: 3436972 - RNA, 22 nt, Pseudomonas aeruginosa PA01
accggcccggagaucgccgcgc

SEQ ID NO: 3436973 - RNA, 13 nt, Pseudomonas aeruginosa PA01
accggccgcagca

SEQ ID NO: 3436974 - RNA, 22 nt, Pseudomonas aeruginosa PA01
accggccgcagcagguucgaau

SEQ ID NO: 3436975 - RNA, 14 nt, Pseudomonas aeruginosa PA01
accggccggcaggc

SEQ ID NO: 3436976 - RNA, 17 nt, Pseudomonas aeruginosa PA01
accggccucgacaucgu

SEQ ID NO: 3436977 - RNA, 22 nt, Pseudomonas aeruginosa PA01
accggccucgacaucgucucgc

SEQ ID NO: 3436978 - RNA, 18 nt, Pseudomonas aeruginosa PA01
accggccugucacgccgg

SEQ ID NO: 3436979 - RNA, 19 nt, Pseudomonas aeruginosa PA01
accggccugucacgccggg

SEQ ID NO: 3436980 - RNA, 23 nt, Pseudomonas aeruginosa PA01
accggccuuuuucaugggugcug

SEQ ID NO: 3436981 - RNA, 17 nt, Pseudomonas aeruginosa PA01
accggcgaaccagugca

SEQ ID NO: 3436982 - RNA, 18 nt, Pseudomonas aeruginosa PA01
accggcgaaccagugcac

SEQ ID NO: 3436983 - RNA, 17 nt, Pseudomonas aeruginosa PA01
accggcgaccaccgccg

SEQ ID NO: 3436984 - RNA, 18 nt, Pseudomonas aeruginosa PA01
accggcgaccaccgccgg

SEQ ID NO: 3436985 - RNA, 20 nt, Pseudomonas aeruginosa PA01
accggcgacgaaagacgcug

SEQ ID NO: 3436986 - RNA, 15 nt, Pseudomonas aeruginosa PA01
accggcgagcaacgc

SEQ ID NO: 3436987 - RNA, 18 nt, Pseudomonas aeruginosa PA01
accggcgaugcucagcgc

SEQ ID NO: 3436988 - RNA, 20 nt, Pseudomonas aeruginosa PA01
accggcgaugcucagcgccg

SEQ ID NO: 3436989 - RNA, 15 nt, Pseudomonas aeruginosa PA01
accggcgauggccgg

SEQ ID NO: 3436990 - RNA, 23 nt, Pseudomonas aeruginosa PA01
accggcgauggccggcaccagca

SEQ ID NO: 3436991 - RNA, 14 nt, Pseudomonas aeruginosa PA01
accggcgccacccu

SEQ ID NO: 3436992 - RNA, 13 nt, Pseudomonas aeruginosa PA01
accggcgccccug

SEQ ID NO: 3436993 - RNA, 18 nt, Pseudomonas aeruginosa PA01
accggcgccccugcggcg

SEQ ID NO: 3436994 - RNA, 18 nt, Pseudomonas aeruginosa PA01
accggcgccgccuggccg

SEQ ID NO: 3436995 - RNA, 13 nt, Pseudomonas aeruginosa PA01
accggcgccggga

SEQ ID NO: 3436996 - RNA, 19 nt, Pseudomonas aeruginosa PA01
accggcgccgggaucaccu

SEQ ID NO: 3436997 - RNA, 21 nt, Pseudomonas aeruginosa PA01
accggcgcgccggacaggcca

SEQ ID NO: 3436998 - RNA, 12 nt, Pseudomonas aeruginosa PA01
accggcgcgccu

SEQ ID NO: 3436999 - RNA, 16 nt, Pseudomonas aeruginosa PA01
accggcgcggccagcu

SEQ ID NO: 3437000 - RNA, 18 nt, Pseudomonas aeruginosa PA01
accggcggauaacgccug

SEQ ID NO: 3437001 - RNA, 19 nt, Pseudomonas aeruginosa PA01
accggcggauaacgccugc

SEQ ID NO: 3437002 - RNA, 22 nt, Pseudomonas aeruginosa PA01
accggcggauuacuccgccggc

SEQ ID NO: 3437003 - RNA, 14 nt, Pseudomonas aeruginosa PA01
accggcggcgccag

SEQ ID NO: 3437004 - RNA, 17 nt, Pseudomonas aeruginosa PA01
accggcggcgccaggcc

SEQ ID NO: 3437005 - RNA, 19 nt, Pseudomonas aeruginosa PA01
accggcggcgccaggccgg

SEQ ID NO: 3437006 - RNA, 22 nt, Pseudomonas aeruginosa PA01
accggcggcgccaggccggcga

SEQ ID NO: 3437007 - RNA, 23 nt, Pseudomonas aeruginosa PA01
accggcgggcucgcaaucagcgc

SEQ ID NO: 3437008 - RNA, 19 nt, Pseudomonas aeruginosa PA01
accggcguccacuccggca

SEQ ID NO: 3437009 - RNA, 20 nt, Pseudomonas aeruginosa PA01
accggcguccacuccggcag

SEQ ID NO: 3437010 - RNA, 18 nt, Pseudomonas aeruginosa PA01
accggcguuauccgccga

SEQ ID NO: 3437011 - RNA, 17 nt, Pseudomonas aeruginosa PA01
accggcuccagggcgaa

SEQ ID NO: 3437012 - RNA, 23 nt, Pseudomonas aeruginosa PA01
accggcucgucggcguugcugau

SEQ ID NO: 3437013 - RNA, 11 nt, Pseudomonas aeruginosa PA01
accggcuggcc

SEQ ID NO: 3437014 - RNA, 13 nt, Pseudomonas aeruginosa PA01
accggcuggccgc

SEQ ID NO: 3437015 - RNA, 14 nt, Pseudomonas aeruginosa PA01
accggcuggcggcu

SEQ ID NO: 3437016 - RNA, 15 nt, Pseudomonas aeruginosa PA01
accggcuucuggaag

SEQ ID NO: 3437017 - RNA, 20 nt, Pseudomonas aeruginosa PA01
accuccuugggaucggcgau

SEQ ID NO: 3437018 - RNA, 14 nt, Pseudomonas aeruginosa PA01
accucgaaccccug

SEQ ID NO: 3437019 - RNA, 16 nt, Pseudomonas aeruginosa PA01
accucgaaccccuggc

SEQ ID NO: 3437020 - RNA, 17 nt, Pseudomonas aeruginosa PA01
accucgaaccccuggcg

SEQ ID NO: 3437021 - RNA, 22 nt, Pseudomonas aeruginosa PA01
accucgaaccccuggcgcucga

SEQ ID NO: 3437022 - RNA, 19 nt, Pseudomonas aeruginosa PA01
accucgaagcccagcgccu

SEQ ID NO: 3437023 - RNA, 17 nt, Pseudomonas aeruginosa PA01
accucgaaggugugcag

SEQ ID NO: 3437024 - RNA, 16 nt, Pseudomonas aeruginosa PA01
accucgacccuggcgc

SEQ ID NO: 3437025 - RNA, 21 nt, Pseudomonas aeruginosa PA01
accucgacccuggcgccgacc

SEQ ID NO: 3437026 - RNA, 15 nt, Pseudomonas aeruginosa PA01
accucgaccgcgccg

SEQ ID NO: 3437027 - RNA, 17 nt, Pseudomonas aeruginosa PA01
accucgaccgcgccggc

SEQ ID NO: 3437028 - RNA, 19 nt, Pseudomonas aeruginosa PA01
accucgaccgcgccggcga

SEQ ID NO: 3437029 - RNA, 15 nt, Pseudomonas aeruginosa PA01
accucgacgcccgcu

SEQ ID NO: 3437030 - RNA, 13 nt, Pseudomonas aeruginosa PA01
accucgacggcga

SEQ ID NO: 3437031 - RNA, 19 nt, Pseudomonas aeruginosa PA01
accucgagcaggccgagga

SEQ ID NO: 3437032 - RNA, 22 nt, Pseudomonas aeruginosa PA01
accucgauggcguguucgucga

SEQ ID NO: 3437033 - RNA, 17 nt, Pseudomonas aeruginosa PA01
accucgcccaucgccag

SEQ ID NO: 3437034 - RNA, 23 nt, Pseudomonas aeruginosa PA01
accucgccgaucuccuccgcccc

SEQ ID NO: 3437035 - RNA, 12 nt, Pseudomonas aeruginosa PA01
accucgccgguc

SEQ ID NO: 3437036 - RNA, 19 nt, Pseudomonas aeruginosa PA01
accucgcgggaacggcgua

SEQ ID NO: 3437037 - RNA, 22 nt, Pseudomonas aeruginosa PA01
accucgcugacuuccaucagcu

SEQ ID NO: 3437038 - RNA, 13 nt, Pseudomonas aeruginosa PA01
accucggccaggc

SEQ ID NO: 3437039 - RNA, 14 nt, Pseudomonas aeruginosa PA01
accucggccaggcg

SEQ ID NO: 3437040 - RNA, 18 nt, Pseudomonas aeruginosa PA01
accucggccaggcgguuc

SEQ ID NO: 3437041 - RNA, 13 nt, Pseudomonas aeruginosa PA01
accucggccgcca

SEQ ID NO: 3437042 - RNA, 20 nt, Pseudomonas aeruginosa PA01
accucggcggucagguugac

SEQ ID NO: 3437043 - RNA, 16 nt, Pseudomonas aeruginosa PA01
accucgguagccggcc

SEQ ID NO: 3437044 - RNA, 17 nt, Pseudomonas aeruginosa PA01
accucgguagccggcca

SEQ ID NO: 3437045 - RNA, 13 nt, Pseudomonas aeruginosa PA01
accucggugagga

SEQ ID NO: 3437046 - RNA, 22 nt, Pseudomonas aeruginosa PA01
accucguaggccgacucgcgau

SEQ ID NO: 3437047 - RNA, 19 nt, Pseudomonas aeruginosa PA01
accucgucgagcagcgcgc

SEQ ID NO: 3437048 - RNA, 18 nt, Pseudomonas aeruginosa PA01
accucguugcaggcacgg

SEQ ID NO: 3437049 - RNA, 17 nt, Pseudomonas aeruginosa PA01
accucguuucccggcgc

SEQ ID NO: 3437050 - RNA, 19 nt, Pseudomonas aeruginosa PA01
accucguuucccggcgcgg

SEQ ID NO: 3437051 - RNA, 20 nt, Pseudomonas aeruginosa PA01
accucuccccagacccucuc

SEQ ID NO: 3437052 - RNA, 18 nt, Pseudomonas aeruginosa PA01
accucugcguucugcugc

SEQ ID NO: 3437053 - RNA, 16 nt, Pseudomonas aeruginosa PA01
accucuggcugaagac

SEQ ID NO: 3437054 - RNA, 23 nt, Pseudomonas aeruginosa PA01
accugaacgcgcccggccaggcc

SEQ ID NO: 3437055 - RNA, 22 nt, Pseudomonas aeruginosa PA01
accugagaucagcgcccggcac

SEQ ID NO: 3437056 - RNA, 13 nt, Pseudomonas aeruginosa PA01
accugcaacgccc

SEQ ID NO: 3437057 - RNA, 19 nt, Pseudomonas aeruginosa PA01
accugcaacgcccgcgagc

SEQ ID NO: 3437058 - RNA, 16 nt, Pseudomonas aeruginosa PA01
accugcaacucggcgc

SEQ ID NO: 3437059 - RNA, 16 nt, Pseudomonas aeruginosa PA01
accugcaacucggcgu

SEQ ID NO: 3437060 - RNA, 16 nt, Pseudomonas aeruginosa PA01
accugcaaggcgguga

SEQ ID NO: 3437061 - RNA, 18 nt, Pseudomonas aeruginosa PA01
accugcaauuccaccggc

SEQ ID NO: 3437062 - RNA, 15 nt, Pseudomonas aeruginosa PA01
accugcagcgccucg

SEQ ID NO: 3437063 - RNA, 19 nt, Pseudomonas aeruginosa PA01
accugcaucaccaggcugc

SEQ ID NO: 3437064 - RNA, 23 nt, Pseudomonas aeruginosa PA01
accugcaucaccaggcugccgcc

SEQ ID NO: 3437065 - RNA, 22 nt, Pseudomonas aeruginosa PA01
accugcaucacguacggcgccu

SEQ ID NO: 3437066 - RNA, 19 nt, Pseudomonas aeruginosa PA01
accugccccgggcgccggg

SEQ ID NO: 3437067 - RNA, 21 nt, Pseudomonas aeruginosa PA01
accugccccgggcgccggguc

SEQ ID NO: 3437068 - RNA, 16 nt, Pseudomonas aeruginosa PA01
accugccgcccggcca

SEQ ID NO: 3437069 - RNA, 20 nt, Pseudomonas aeruginosa PA01
accugccgcccggccaggcc

SEQ ID NO: 3437070 - RNA, 14 nt, Pseudomonas aeruginosa PA01
accugccggcacgc

SEQ ID NO: 3437071 - RNA, 17 nt, Pseudomonas aeruginosa PA01
accugccgguaguagcg

SEQ ID NO: 3437072 - RNA, 20 nt, Pseudomonas aeruginosa PA01
accugccgucacuugaaguc

SEQ ID NO: 3437073 - RNA, 17 nt, Pseudomonas aeruginosa PA01
accugccugcgcagggc

SEQ ID NO: 3437074 - RNA, 13 nt, Pseudomonas aeruginosa PA01
accugcggguggc

SEQ ID NO: 3437075 - RNA, 18 nt, Pseudomonas aeruginosa PA01
accugcggugucccuucu

SEQ ID NO: 3437076 - RNA, 22 nt, Pseudomonas aeruginosa PA01
accugcggugucccuucuuuuu

SEQ ID NO: 3437077 - RNA, 23 nt, Pseudomonas aeruginosa PA01
accugcguggcgaacgcccggcu

SEQ ID NO: 3437078 - RNA, 15 nt, Pseudomonas aeruginosa PA01
accugcucacggccg

SEQ ID NO: 3437079 - RNA, 17 nt, Pseudomonas aeruginosa PA01
accugcucacggccgaa

SEQ ID NO: 3437080 - RNA, 21 nt, Pseudomonas aeruginosa PA01
accugcucacggccgaacaga

SEQ ID NO: 3437081 - RNA, 13 nt, Pseudomonas aeruginosa PA01
accugcucgaacc

SEQ ID NO: 3437082 - RNA, 18 nt, Pseudomonas aeruginosa PA01
accugcucgcgcaccgcg

SEQ ID NO: 3437083 - RNA, 19 nt, Pseudomonas aeruginosa PA01
accugcucgcgcaccgcgg

SEQ ID NO: 3437084 - RNA, 15 nt, Pseudomonas aeruginosa PA01
accugcucgcggguc

SEQ ID NO: 3437085 - RNA, 14 nt, Pseudomonas aeruginosa PA01
accugcucgcugaa

SEQ ID NO: 3437086 - RNA, 13 nt, Pseudomonas aeruginosa PA01
accugcucgucga

SEQ ID NO: 3437087 - RNA, 13 nt, Pseudomonas aeruginosa PA01
accugcugcccgg

SEQ ID NO: 3437088 - RNA, 16 nt, Pseudomonas aeruginosa PA01
accugcugcccggcau

SEQ ID NO: 3437089 - RNA, 17 nt, Pseudomonas aeruginosa PA01
accugcugggccagcgc

SEQ ID NO: 3437090 - RNA, 15 nt, Pseudomonas aeruginosa PA01
accuggaacuugcug

SEQ ID NO: 3437091 - RNA, 16 nt, Pseudomonas aeruginosa PA01
accuggauaucaccuc

SEQ ID NO: 3437092 - RNA, 16 nt, Pseudomonas aeruginosa PA01
accuggaucgccaggc

SEQ ID NO: 3437093 - RNA, 21 nt, Pseudomonas aeruginosa PA01
accuggcagguaucgcugggc

SEQ ID NO: 3437094 - RNA, 14 nt, Pseudomonas aeruginosa PA01
accuggcagugcgc

SEQ ID NO: 3437095 - RNA, 15 nt, Pseudomonas aeruginosa PA01
accuggcagugcgcc

SEQ ID NO: 3437096 - RNA, 18 nt, Pseudomonas aeruginosa PA01
accuggcagugcgccggc

SEQ ID NO: 3437097 - RNA, 13 nt, Pseudomonas aeruginosa PA01
accuggccacgcc

SEQ ID NO: 3437098 - RNA, 14 nt, Pseudomonas aeruginosa PA01
accuggccacgccc

SEQ ID NO: 3437099 - RNA, 18 nt, Pseudomonas aeruginosa PA01
accuggccacgcccggug

SEQ ID NO: 3437100 - RNA, 20 nt, Pseudomonas aeruginosa PA01
accuggccauucgcuucggc

SEQ ID NO: 3437101 - RNA, 17 nt, Pseudomonas aeruginosa PA01
accuggccgcguucgcc

SEQ ID NO: 3437102 - RNA, 20 nt, Pseudomonas aeruginosa PA01
accuggccgcguucgccgag

SEQ ID NO: 3437103 - RNA, 23 nt, Pseudomonas aeruginosa PA01
accuggccgcguucgccgaggcg

SEQ ID NO: 3437104 - RNA, 17 nt, Pseudomonas aeruginosa PA01
accuggccgcuguggaa

SEQ ID NO: 3437105 - RNA, 12 nt, Pseudomonas aeruginosa PA01
accuggccggcg

SEQ ID NO: 3437106 - RNA, 13 nt, Pseudomonas aeruginosa PA01
accuggccggcga

SEQ ID NO: 3437107 - RNA, 16 nt, Pseudomonas aeruginosa PA01
accuggccggcgaccu

SEQ ID NO: 3437108 - RNA, 14 nt, Pseudomonas aeruginosa PA01
accuggccgucccu

SEQ ID NO: 3437109 - RNA, 17 nt, Pseudomonas aeruginosa PA01
accuggcgcagguagaa

SEQ ID NO: 3437110 - RNA, 23 nt, Pseudomonas aeruginosa PA01
accuggcgcucgccgugggaguc

SEQ ID NO: 3437111 - RNA, 19 nt, Pseudomonas aeruginosa PA01
accuggcgguacagccccc

SEQ ID NO: 3437112 - RNA, 22 nt, Pseudomonas aeruginosa PA01
accuggcggucgccgccggcga

SEQ ID NO: 3437113 - RNA, 16 nt, Pseudomonas aeruginosa PA01
accuggcuccacugcu

SEQ ID NO: 3437114 - RNA, 18 nt, Pseudomonas aeruginosa PA01
accuggcuccacugcuug

SEQ ID NO: 3437115 - RNA, 20 nt, Pseudomonas aeruginosa PA01
accuggcuccacugcuuggc

SEQ ID NO: 3437116 - RNA, 17 nt, Pseudomonas aeruginosa PA01
accuggcucuguuccuc

SEQ ID NO: 3437117 - RNA, 22 nt, Pseudomonas aeruginosa PA01
accuggcucuguuccucggcgg

SEQ ID NO: 3437118 - RNA, 17 nt, Pseudomonas aeruginosa PA01
accugggacucccgcag

SEQ ID NO: 3437119 - RNA, 13 nt, Pseudomonas aeruginosa PA01
acgaacaguucga

SEQ ID NO: 3437120 - RNA, 20 nt, Pseudomonas aeruginosa PA01
acgaacaguucgaugggccg

SEQ ID NO: 3437121 - RNA, 17 nt, Pseudomonas aeruginosa PA01
acgaacaucgccagcgc

SEQ ID NO: 3437122 - RNA, 13 nt, Pseudomonas aeruginosa PA01
acgaaccauugcg

SEQ ID NO: 3437123 - RNA, 14 nt, Pseudomonas aeruginosa PA01
acgaaccccgggcc

SEQ ID NO: 3437124 - RNA, 21 nt, Pseudomonas aeruginosa PA01
acgaaccccgggccgcgcaca

SEQ ID NO: 3437125 - RNA, 20 nt, Pseudomonas aeruginosa PA01
acgaacggcaucuucaaucg

SEQ ID NO: 3437126 - RNA, 22 nt, Pseudomonas aeruginosa PA01
acgaacucgacgcgccaggugc

SEQ ID NO: 3437127 - RNA, 17 nt, Pseudomonas aeruginosa PA01
acgaacuucagggcucc

SEQ ID NO: 3437128 - RNA, 14 nt, Pseudomonas aeruginosa PA01
acgaagaaccccgg

SEQ ID NO: 3437129 - RNA, 15 nt, Pseudomonas aeruginosa PA01
acgaagaaccccggc

SEQ ID NO: 3437130 - RNA, 20 nt, Pseudomonas aeruginosa PA01
acgaagaacggcgcggucuc

SEQ ID NO: 3437131 - RNA, 16 nt, Pseudomonas aeruginosa PA01
acgaagaagccggccc

SEQ ID NO: 3437132 - RNA, 18 nt, Pseudomonas aeruginosa PA01
acgaagaccuugaacucg

SEQ ID NO: 3437133 - RNA, 15 nt, Pseudomonas aeruginosa PA01
acgaagcccaggcug

SEQ ID NO: 3437134 - RNA, 13 nt, Pseudomonas aeruginosa PA01
acgaagcgacugc

SEQ ID NO: 3437135 - RNA, 23 nt, Pseudomonas aeruginosa PA01
acgaagcgacugcgcuggccgag

SEQ ID NO: 3437136 - RNA, 21 nt, Pseudomonas aeruginosa PA01
acgaagcgccggcggccugcc

SEQ ID NO: 3437137 - RNA, 16 nt, Pseudomonas aeruginosa PA01
acgaaggccuccucgu

SEQ ID NO: 3437138 - RNA, 12 nt, Pseudomonas aeruginosa PA01
acgaaggcgcgc

SEQ ID NO: 3437139 - RNA, 22 nt, Pseudomonas aeruginosa PA01
acgaaggcgcgcucgaucaggu

SEQ ID NO: 3437140 - RNA, 19 nt, Pseudomonas aeruginosa PA01
acgaaggcuggagcgcugc

SEQ ID NO: 3437141 - RNA, 22 nt, Pseudomonas aeruginosa PA01
acgaagguaucgaagucgccau

SEQ ID NO: 3437142 - RNA, 13 nt, Pseudomonas aeruginosa PA01
acgaaggucggcg

SEQ ID NO: 3437143 - RNA, 15 nt, Pseudomonas aeruginosa PA01
acgaaggucggcggc

SEQ ID NO: 3437144 - RNA, 19 nt, Pseudomonas aeruginosa PA01
acgaagguuucguccccuu

SEQ ID NO: 3437145 - RNA, 13 nt, Pseudomonas aeruginosa PA01
acgaagucgccgg

SEQ ID NO: 3437146 - RNA, 22 nt, Pseudomonas aeruginosa PA01
acgaagugauggaagagcgccg

SEQ ID NO: 3437147 - RNA, 18 nt, Pseudomonas aeruginosa PA01
acgaaguugagcaccggc

SEQ ID NO: 3437148 - RNA, 19 nt, Pseudomonas aeruginosa PA01
acgaaguugagcaccggca

SEQ ID NO: 3437149 - RNA, 21 nt, Pseudomonas aeruginosa PA01
acgaaguugcaggccagcgcc

SEQ ID NO: 3437150 - RNA, 17 nt, Pseudomonas aeruginosa PA01
acgaaguuggcggccga

SEQ ID NO: 3437151 - RNA, 14 nt, Pseudomonas aeruginosa PA01
acgacaacccugac

SEQ ID NO: 3437152 - RNA, 22 nt, Pseudomonas aeruginosa PA01
acgacaccugcaacgcccgcga

SEQ ID NO: 3437153 - RNA, 13 nt, Pseudomonas aeruginosa PA01
acgacagccccgg

SEQ ID NO: 3437154 - RNA, 22 nt, Pseudomonas aeruginosa PA01
acgacaguaccuuccauuucga

SEQ ID NO: 3437155 - RNA, 15 nt, Pseudomonas aeruginosa PA01
acgacaucgacgccc

SEQ ID NO: 3437156 - RNA, 16 nt, Pseudomonas aeruginosa PA01
acgaccacaucggcca

SEQ ID NO: 3437157 - RNA, 17 nt, Pseudomonas aeruginosa PA01
acgaccacaucggccag

SEQ ID NO: 3437158 - RNA, 16 nt, Pseudomonas aeruginosa PA01
acgacccugcuggccg

SEQ ID NO: 3437159 - RNA, 18 nt, Pseudomonas aeruginosa PA01
acgacccugcuggccggu

SEQ ID NO: 3437160 - RNA, 16 nt, Pseudomonas aeruginosa PA01
acgaccgcccaggcug

SEQ ID NO: 3437161 - RNA, 17 nt, Pseudomonas aeruginosa PA01
acgaccgcccaggcugc

SEQ ID NO: 3437162 - RNA, 21 nt, Pseudomonas aeruginosa PA01
acgaccgcccaggcugccgcc

SEQ ID NO: 3437163 - RNA, 23 nt, Pseudomonas aeruginosa PA01
acgaccggaagguugucgaagcg

SEQ ID NO: 3437164 - RNA, 13 nt, Pseudomonas aeruginosa PA01
acgaccuguugaa

SEQ ID NO: 3437165 - RNA, 18 nt, Pseudomonas aeruginosa PA01
acgaccuucuccgaccag

SEQ ID NO: 3437166 - RNA, 19 nt, Pseudomonas aeruginosa PA01
acgacgaaagaagccgcac

SEQ ID NO: 3437167 - RNA, 13 nt, Pseudomonas aeruginosa PA01
acgacgaaaggcc

SEQ ID NO: 3437168 - RNA, 15 nt, Pseudomonas aeruginosa PA01
acgacgaagcgccgg

SEQ ID NO: 3437169 - RNA, 21 nt, Pseudomonas aeruginosa PA01
acgacgaagcgccggcggccu

SEQ ID NO: 3437170 - RNA, 12 nt, Pseudomonas aeruginosa PA01
acgacgccggug

SEQ ID NO: 3437171 - RNA, 21 nt, Pseudomonas aeruginosa PA01
acgacgggagcgcgaggcgca

SEQ ID NO: 3437172 - RNA, 13 nt, Pseudomonas aeruginosa PA01
acgacgucggcgg

SEQ ID NO: 3437173 - RNA, 12 nt, Pseudomonas aeruginosa PA01
acgacgugccca

SEQ ID NO: 3437174 - RNA, 12 nt, Pseudomonas aeruginosa PA01
acgacucacccg

SEQ ID NO: 3437175 - RNA, 14 nt, Pseudomonas aeruginosa PA01
acgacucacccgcu

SEQ ID NO: 3437176 - RNA, 13 nt, Pseudomonas aeruginosa PA01
acgacucgucgcc

SEQ ID NO: 3437177 - RNA, 20 nt, Pseudomonas aeruginosa PA01
acgacugcggcagcuuggcg

SEQ ID NO: 3437178 - RNA, 19 nt, Pseudomonas aeruginosa PA01
acgagacguugacgaucgc

SEQ ID NO: 3437179 - RNA, 21 nt, Pseudomonas aeruginosa PA01
acgagagguugcuguagaaug

SEQ ID NO: 3437180 - RNA, 18 nt, Pseudomonas aeruginosa PA01
acgagaucgagcgcgccc

SEQ ID NO: 3437181 - RNA, 18 nt, Pseudomonas aeruginosa PA01
acgagauugaugaagcgc

SEQ ID NO: 3437182 - RNA, 16 nt, Pseudomonas aeruginosa PA01
acgagcagcucgccgg

SEQ ID NO: 3437183 - RNA, 19 nt, Pseudomonas aeruginosa PA01
acgagcagcucgccggcgu

SEQ ID NO: 3437184 - RNA, 20 nt, Pseudomonas aeruginosa PA01
acgagcagcucgccggcguc

SEQ ID NO: 3437185 - RNA, 17 nt, Pseudomonas aeruginosa PA01
acgagccgagcaggcca

SEQ ID NO: 3437186 - RNA, 18 nt, Pseudomonas aeruginosa PA01
acgagccgagcaggccac

SEQ ID NO: 3437187 - RNA, 17 nt, Pseudomonas aeruginosa PA01
acgagccgcgacgcgac

SEQ ID NO: 3437188 - RNA, 17 nt, Pseudomonas aeruginosa PA01
acgagccgcugcggcuc

SEQ ID NO: 3437189 - RNA, 22 nt, Pseudomonas aeruginosa PA01
acgagccgcugcggcucgccga

SEQ ID NO: 3437190 - RNA, 17 nt, Pseudomonas aeruginosa PA01
acgagccggacggcggc

SEQ ID NO: 3437191 - RNA, 18 nt, Pseudomonas aeruginosa PA01
acgagccggacggcggcg

SEQ ID NO: 3437192 - RNA, 18 nt, Pseudomonas aeruginosa PA01
acgagcuuggccacuccg

SEQ ID NO: 3437193 - RNA, 22 nt, Pseudomonas aeruginosa PA01
acgagcuuggccacuccgggcu

SEQ ID NO: 3437194 - RNA, 23 nt, Pseudomonas aeruginosa PA01
acgagcuuggccacuccgggcug

SEQ ID NO: 3437195 - RNA, 17 nt, Pseudomonas aeruginosa PA01
acgaggaacgccucgca

SEQ ID NO: 3437196 - RNA, 17 nt, Pseudomonas aeruginosa PA01
acgaggaaggcgcgcac

SEQ ID NO: 3437197 - RNA, 16 nt, Pseudomonas aeruginosa PA01
acgaggaugucggcga

SEQ ID NO: 3437198 - RNA, 22 nt, Pseudomonas aeruginosa PA01
acgaggauuuccgcgcccggcu

SEQ ID NO: 3437199 - RNA, 23 nt, Pseudomonas aeruginosa PA01
acgaggauuuccgcgcccggcug

SEQ ID NO: 3437200 - RNA, 21 nt, Pseudomonas aeruginosa PA01
acgaggcgacccgggucaggc

SEQ ID NO: 3437201 - RNA, 16 nt, Pseudomonas aeruginosa PA01
acgaggcgaggguggc

SEQ ID NO: 3437202 - RNA, 21 nt, Pseudomonas aeruginosa PA01
acgaggcgaggguggcgccca

SEQ ID NO: 3437203 - RNA, 18 nt, Pseudomonas aeruginosa PA01
acgagguacaacggcauc

SEQ ID NO: 3437204 - RNA, 22 nt, Pseudomonas aeruginosa PA01
acgagguagaaauagaagguca

SEQ ID NO: 3437205 - RNA, 12 nt, Pseudomonas aeruginosa PA01
acgagucgaggc

SEQ ID NO: 3437206 - RNA, 17 nt, Pseudomonas aeruginosa PA01
acgauauugaacaccug

SEQ ID NO: 3437207 - RNA, 19 nt, Pseudomonas aeruginosa PA01
acgaucacccccagcgagc

SEQ ID NO: 3437208 - RNA, 16 nt, Pseudomonas aeruginosa PA01
acgaucagcaggaugc

SEQ ID NO: 3437209 - RNA, 14 nt, Pseudomonas aeruginosa PA01
acgaucagccaggg

SEQ ID NO: 3437210 - RNA, 23 nt, Pseudomonas aeruginosa PA01
acgaucagccagggcaacgccag

SEQ ID NO: 3437211 - RNA, 11 nt, Pseudomonas aeruginosa PA01
acgaucagccc

SEQ ID NO: 3437212 - RNA, 17 nt, Pseudomonas aeruginosa PA01
acgaucagcggcccgag

SEQ ID NO: 3437213 - RNA, 20 nt, Pseudomonas aeruginosa PA01
acgaucagcggcccgagcag

SEQ ID NO: 3437214 - RNA, 22 nt, Pseudomonas aeruginosa PA01
acgaucagcggcccgagcaggc

SEQ ID NO: 3437215 - RNA, 21 nt, Pseudomonas aeruginosa PA01
acgaucagcucguugcccggc

SEQ ID NO: 3437216 - RNA, 14 nt, Pseudomonas aeruginosa PA01
acgaucaggcccuu

SEQ ID NO: 3437217 - RNA, 12 nt, Pseudomonas aeruginosa PA01
acgaucaggugc

SEQ ID NO: 3437218 - RNA, 12 nt, Pseudomonas aeruginosa PA01
acgaucccggcg

SEQ ID NO: 3437219 - RNA, 14 nt, Pseudomonas aeruginosa PA01
acgaucccggcggu

SEQ ID NO: 3437220 - RNA, 16 nt, Pseudomonas aeruginosa PA01
acgaucucaucgccca

SEQ ID NO: 3437221 - RNA, 21 nt, Pseudomonas aeruginosa PA01
acgccccuagaccaacugcgc

SEQ ID NO: 3437222 - RNA, 22 nt, Pseudomonas aeruginosa PA01
acgccccuagaccaacugcgcc

SEQ ID NO: 3437223 - RNA, 14 nt, Pseudomonas aeruginosa PA01
acgccccuccuucg

SEQ ID NO: 3437224 - RNA, 17 nt, Pseudomonas aeruginosa PA01
acgccccuccuucgagc

SEQ ID NO: 3437225 - RNA, 23 nt, Pseudomonas aeruginosa PA01
acgccccuccuucgagccuggcc

SEQ ID NO: 3437226 - RNA, 16 nt, Pseudomonas aeruginosa PA01
acgcccgcagccagcc

SEQ ID NO: 3437227 - RNA, 15 nt, Pseudomonas aeruginosa PA01
acgcccgccguggcg

SEQ ID NO: 3437228 - RNA, 16 nt, Pseudomonas aeruginosa PA01
acgcccgcuugcgccg

SEQ ID NO: 3437229 - RNA, 20 nt, Pseudomonas aeruginosa PA01
acgcccgcuugcgccgccuc

SEQ ID NO: 3437230 - RNA, 21 nt, Pseudomonas aeruginosa PA01
acgcccgcuugcgccgccucg

SEQ ID NO: 3437231 - RNA, 15 nt, Pseudomonas aeruginosa PA01
acgcccggagcgcga

SEQ ID NO: 3437232 - RNA, 17 nt, Pseudomonas aeruginosa PA01
acgcccggcacucgccg

SEQ ID NO: 3437233 - RNA, 21 nt, Pseudomonas aeruginosa PA01
acgcccggcacucgccgggcg

SEQ ID NO: 3437234 - RNA, 20 nt, Pseudomonas aeruginosa PA01
acgcccggcuuuccucggcc

SEQ ID NO: 3437235 - RNA, 21 nt, Pseudomonas aeruginosa PA01
acgcccggcuuuccucggcca

SEQ ID NO: 3437236 - RNA, 13 nt, Pseudomonas aeruginosa PA01
acgcccuccagca

SEQ ID NO: 3437237 - RNA, 18 nt, Pseudomonas aeruginosa PA01
acgcccuccagcaccgcc

SEQ ID NO: 3437238 - RNA, 11 nt, Pseudomonas aeruginosa PA01
acgcccucggc

SEQ ID NO: 3437239 - RNA, 12 nt, Pseudomonas aeruginosa PA01
acgcccucggcg

SEQ ID NO: 3437240 - RNA, 14 nt, Pseudomonas aeruginosa PA01
acgcccucggcgac

SEQ ID NO: 3437241 - RNA, 17 nt, Pseudomonas aeruginosa PA01
acgcccugcaccuuggg

SEQ ID NO: 3437242 - RNA, 14 nt, Pseudomonas aeruginosa PA01
acgcccugcgccag

SEQ ID NO: 3437243 - RNA, 13 nt, Pseudomonas aeruginosa PA01
acgcccuggauga

SEQ ID NO: 3437244 - RNA, 16 nt, Pseudomonas aeruginosa PA01
acgcccugggacaggc

SEQ ID NO: 3437245 - RNA, 17 nt, Pseudomonas aeruginosa PA01
acgcccuguucggcggg

SEQ ID NO: 3437246 - RNA, 23 nt, Pseudomonas aeruginosa PA01
acgcccuguuucggguccaggcg

SEQ ID NO: 3437247 - RNA, 15 nt, Pseudomonas aeruginosa PA01
acgccgaacccgccu

SEQ ID NO: 3437248 - RNA, 16 nt, Pseudomonas aeruginosa PA01
acgccgaacccgccuc

SEQ ID NO: 3437249 - RNA, 16 nt, Pseudomonas aeruginosa PA01
acgccgaagucggcga

SEQ ID NO: 3437250 - RNA, 17 nt, Pseudomonas aeruginosa PA01
acgccgaagucggcgag

SEQ ID NO: 3437251 - RNA, 13 nt, Pseudomonas aeruginosa PA01
acgccgaaguucu

SEQ ID NO: 3437252 - RNA, 18 nt, Pseudomonas aeruginosa PA01
acgccgaaguucuucagc

SEQ ID NO: 3437253 - RNA, 23 nt, Pseudomonas aeruginosa PA01
acgccgaaguucuucagcagcau

SEQ ID NO: 3437254 - RNA, 20 nt, Pseudomonas aeruginosa PA01
acgccgacccuagggucggc

SEQ ID NO: 3437255 - RNA, 15 nt, Pseudomonas aeruginosa PA01
acgccgaccgacugg

SEQ ID NO: 3437256 - RNA, 22 nt, Pseudomonas aeruginosa PA01
acgccgagaacgcggcgaaggg

SEQ ID NO: 3437257 - RNA, 18 nt, Pseudomonas aeruginosa PA01
acgccgagcaacggcagc

SEQ ID NO: 3437258 - RNA, 20 nt, Pseudomonas aeruginosa PA01
acgccgagcaacggcagcau

SEQ ID NO: 3437259 - RNA, 14 nt, Pseudomonas aeruginosa PA01
acgccgagcagcac

SEQ ID NO: 3437260 - RNA, 19 nt, Pseudomonas aeruginosa PA01
acgccgagcagcaccaggc

SEQ ID NO: 3437261 - RNA, 21 nt, Pseudomonas aeruginosa PA01
acgccgagcaugaugcaggca

SEQ ID NO: 3437262 - RNA, 18 nt, Pseudomonas aeruginosa PA01
acgccgagccagccgcgg

SEQ ID NO: 3437263 - RNA, 20 nt, Pseudomonas aeruginosa PA01
acgccgagcugaccaccagg

SEQ ID NO: 3437264 - RNA, 19 nt, Pseudomonas aeruginosa PA01
acgccgaggagacgcggca

SEQ ID NO: 3437265 - RNA, 20 nt, Pseudomonas aeruginosa PA01
acgccgaggagacgcggcau

SEQ ID NO: 3437266 - RNA, 19 nt, Pseudomonas aeruginosa PA01
acgccgaggcugcgggcga

SEQ ID NO: 3437267 - RNA, 23 nt, Pseudomonas aeruginosa PA01
acgccgagggcgcggcgccagcg

SEQ ID NO: 3437268 - RNA, 18 nt, Pseudomonas aeruginosa PA01
acgccgauaccggccucg

SEQ ID NO: 3437269 - RNA, 20 nt, Pseudomonas aeruginosa PA01
acgccgauaccggccucgau

SEQ ID NO: 3437270 - RNA, 13 nt, Pseudomonas aeruginosa PA01
acgccgaucaccc

SEQ ID NO: 3437271 - RNA, 15 nt, Pseudomonas aeruginosa PA01
acgccgaucaccccg

SEQ ID NO: 3437272 - RNA, 14 nt, Pseudomonas aeruginosa PA01
acgccgaucccggc

SEQ ID NO: 3437273 - RNA, 18 nt, Pseudomonas aeruginosa PA01
acgccgaucccggcggcg

SEQ ID NO: 3437274 - RNA, 19 nt, Pseudomonas aeruginosa PA01
acgccgaucccggcggcga

SEQ ID NO: 3437275 - RNA, 20 nt, Pseudomonas aeruginosa PA01
acgccgaucccggcggcgac

SEQ ID NO: 3437276 - RNA, 16 nt, Pseudomonas aeruginosa PA01
acgccgaugcucggug

SEQ ID NO: 3437277 - RNA, 15 nt, Pseudomonas aeruginosa PA01
acgccgcagcucggc

SEQ ID NO: 3437278 - RNA, 13 nt, Pseudomonas aeruginosa PA01
acgccgcaggcgu

SEQ ID NO: 3437279 - RNA, 21 nt, Pseudomonas aeruginosa PA01
acgccgcaggcguuauccgcc

SEQ ID NO: 3437280 - RNA, 14 nt, Pseudomonas aeruginosa PA01
acgccgccccagcc

SEQ ID NO: 3437281 - RNA, 16 nt, Pseudomonas aeruginosa PA01
acgccgccccagccuc

SEQ ID NO: 3437282 - RNA, 19 nt, Pseudomonas aeruginosa PA01
acgccgccccagccucggc

SEQ ID NO: 3437283 - RNA, 17 nt, Pseudomonas aeruginosa PA01
acgccgcccccagcgcg

SEQ ID NO: 3437284 - RNA, 22 nt, Pseudomonas aeruginosa PA01
acgccgcccccagcgcgccgcc

SEQ ID NO: 3437285 - RNA, 17 nt, Pseudomonas aeruginosa PA01
acgccgcccgucgcgcc

SEQ ID NO: 3437286 - RNA, 22 nt, Pseudomonas aeruginosa PA01
acgccgcccgucgcgccggcca

SEQ ID NO: 3437287 - RNA, 22 nt, Pseudomonas aeruginosa PA01
acgccgccgagcaugcgggcga

SEQ ID NO: 3437288 - RNA, 14 nt, Pseudomonas aeruginosa PA01
acgccgccugcgcc

SEQ ID NO: 3437289 - RNA, 19 nt, Pseudomonas aeruginosa PA01
acgccgccugcgccucggc

SEQ ID NO: 3437290 - RNA, 18 nt, Pseudomonas aeruginosa PA01
acgccgcgaaauggcaga

SEQ ID NO: 3437291 - RNA, 21 nt, Pseudomonas aeruginosa PA01
acgccgcgaagcccagcgccg

SEQ ID NO: 3437292 - RNA, 17 nt, Pseudomonas aeruginosa PA01
acgccgcgaccgaagcc

SEQ ID NO: 3437293 - RNA, 20 nt, Pseudomonas aeruginosa PA01
acgccgcgauggcucgcggc

SEQ ID NO: 3437294 - RNA, 23 nt, Pseudomonas aeruginosa PA01
acgccgcgauggcucgcggcgcu

SEQ ID NO: 3437295 - RNA, 22 nt, Pseudomonas aeruginosa PA01
acgccgcgccaaugccuuccga

SEQ ID NO: 3437296 - RNA, 20 nt, Pseudomonas aeruginosa PA01
acgccgcgcugcgccaggcc

SEQ ID NO: 3437297 - RNA, 14 nt, Pseudomonas aeruginosa PA01
acgccgcggaaggc

SEQ ID NO: 3437298 - RNA, 22 nt, Pseudomonas aeruginosa PA01
acgccgcggaaggcccgcgagc

SEQ ID NO: 3437299 - RNA, 15 nt, Pseudomonas aeruginosa PA01
acgccgcggcugaug

SEQ ID NO: 3437300 - RNA, 16 nt, Pseudomonas aeruginosa PA01
acgccgcggcugaugc

SEQ ID NO: 3437301 - RNA, 22 nt, Pseudomonas aeruginosa PA01
acgccgcgucccugcacaggga

SEQ ID NO: 3437302 - RNA, 19 nt, Pseudomonas aeruginosa PA01
acgccgcucugcccgaccg

SEQ ID NO: 3437303 - RNA, 12 nt, Pseudomonas aeruginosa PA01
acgccgcuggcg

SEQ ID NO: 3437304 - RNA, 13 nt, Pseudomonas aeruginosa PA01
acgccgcuggcgg

SEQ ID NO: 3437305 - RNA, 17 nt, Pseudomonas aeruginosa PA01
acgccgcuggcggcgcu

SEQ ID NO: 3437306 - RNA, 16 nt, Pseudomonas aeruginosa PA01
acgccgcugucgucca

SEQ ID NO: 3437307 - RNA, 22 nt, Pseudomonas aeruginosa PA01
acgccgcuuacccagguaagcg

SEQ ID NO: 3437308 - RNA, 22 nt, Pseudomonas aeruginosa PA01
acgccggcccgugcccguccua

SEQ ID NO: 3437309 - RNA, 20 nt, Pseudomonas aeruginosa PA01
acgccggccggcucagcgcu

SEQ ID NO: 3437310 - RNA, 13 nt, Pseudomonas aeruginosa PA01
acgccggccucgc

SEQ ID NO: 3437311 - RNA, 15 nt, Pseudomonas aeruginosa PA01
acgccggccucgcgc

SEQ ID NO: 3437312 - RNA, 17 nt, Pseudomonas aeruginosa PA01
acgccggccucgcgcaa

SEQ ID NO: 3437313 - RNA, 22 nt, Pseudomonas aeruginosa PA01
acgccggcuuccaccagacgca

SEQ ID NO: 3437314 - RNA, 19 nt, Pseudomonas aeruginosa PA01
acgccgggcaacgccaggc

SEQ ID NO: 3437315 - RNA, 14 nt, Pseudomonas aeruginosa PA01
acgccgggggucgc

SEQ ID NO: 3437316 - RNA, 17 nt, Pseudomonas aeruginosa PA01
acgccggucucgauggc

SEQ ID NO: 3437317 - RNA, 15 nt, Pseudomonas aeruginosa PA01
acgccggugccagga

SEQ ID NO: 3437318 - RNA, 16 nt, Pseudomonas aeruginosa PA01
acgccgguggccaggc

SEQ ID NO: 3437319 - RNA, 17 nt, Pseudomonas aeruginosa PA01
acgccgguggccaggcu

SEQ ID NO: 3437320 - RNA, 20 nt, Pseudomonas aeruginosa PA01
acgccgguggcguuauucgc

SEQ ID NO: 3437321 - RNA, 15 nt, Pseudomonas aeruginosa PA01
acgccguagcggccu

SEQ ID NO: 3437322 - RNA, 21 nt, Pseudomonas aeruginosa PA01
acgccguccaccagccagcuc

SEQ ID NO: 3437323 - RNA, 22 nt, Pseudomonas aeruginosa PA01
acgcuccuuguagaacggcggc

SEQ ID NO: 3437324 - RNA, 13 nt, Pseudomonas aeruginosa PA01
acgcucgccgacg

SEQ ID NO: 3437325 - RNA, 19 nt, Pseudomonas aeruginosa PA01
acgcucgcggcaucccgcc

SEQ ID NO: 3437326 - RNA, 14 nt, Pseudomonas aeruginosa PA01
acgcucggccagcg

SEQ ID NO: 3437327 - RNA, 17 nt, Pseudomonas aeruginosa PA01
acgcucggcgucgucga

SEQ ID NO: 3437328 - RNA, 18 nt, Pseudomonas aeruginosa PA01
acgcucggcgucgucgau

SEQ ID NO: 3437329 - RNA, 21 nt, Pseudomonas aeruginosa PA01
acgcucggggugcgcggcgaa

SEQ ID NO: 3437330 - RNA, 14 nt, Pseudomonas aeruginosa PA01
acgcucugcucggc

SEQ ID NO: 3437331 - RNA, 20 nt, Pseudomonas aeruginosa PA01
acgcucuggccguucuccag

SEQ ID NO: 3437332 - RNA, 17 nt, Pseudomonas aeruginosa PA01
acgcucuucaccucgau

SEQ ID NO: 3437333 - RNA, 15 nt, Pseudomonas aeruginosa PA01
acgcugaagaucgcc

SEQ ID NO: 3437334 - RNA, 15 nt, Pseudomonas aeruginosa PA01
acgcugacgccggca

SEQ ID NO: 3437335 - RNA, 17 nt, Pseudomonas aeruginosa PA01
acgcugaggaucacgau

SEQ ID NO: 3437336 - RNA, 20 nt, Pseudomonas aeruginosa PA01
acgcugaggaucacgauggc

SEQ ID NO: 3437337 - RNA, 21 nt, Pseudomonas aeruginosa PA01
acgcugaggcucagcgcgccg

SEQ ID NO: 3437338 - RNA, 17 nt, Pseudomonas aeruginosa PA01
acgcugaucaucagcag

SEQ ID NO: 3437339 - RNA, 19 nt, Pseudomonas aeruginosa PA01
acgcugaucaucagcaggg

SEQ ID NO: 3437340 - RNA, 20 nt, Pseudomonas aeruginosa PA01
acgcugaucaucagcagggu

SEQ ID NO: 3437341 - RNA, 22 nt, Pseudomonas aeruginosa PA01
acgcugaucaucgagaacaggu

SEQ ID NO: 3437342 - RNA, 14 nt, Pseudomonas aeruginosa PA01
acgcugaugaugcc

SEQ ID NO: 3437343 - RNA, 16 nt, Pseudomonas aeruginosa PA01
acgcugaugccggcga

SEQ ID NO: 3437344 - RNA, 18 nt, Pseudomonas aeruginosa PA01
acgcugcaauucgucggc

SEQ ID NO: 3437345 - RNA, 20 nt, Pseudomonas aeruginosa PA01
acgcugcaauucgucggccu

SEQ ID NO: 3437346 - RNA, 22 nt, Pseudomonas aeruginosa PA01
acgcugcaugcggaacaccgcc

SEQ ID NO: 3437347 - RNA, 20 nt, Pseudomonas aeruginosa PA01
acgcugcauguccgcaggca

SEQ ID NO: 3437348 - RNA, 13 nt, Pseudomonas aeruginosa PA01
acgcugccagcag

SEQ ID NO: 3437349 - RNA, 14 nt, Pseudomonas aeruginosa PA01
acgcugccagcagg

SEQ ID NO: 3437350 - RNA, 16 nt, Pseudomonas aeruginosa PA01
acgcugccagcaggcc

SEQ ID NO: 3437351 - RNA, 21 nt, Pseudomonas aeruginosa PA01
acgcugccagcaggccgagcc

SEQ ID NO: 3437352 - RNA, 13 nt, Pseudomonas aeruginosa PA01
acgcugcccagcc

SEQ ID NO: 3437353 - RNA, 16 nt, Pseudomonas aeruginosa PA01
acgcugcccagcccgc

SEQ ID NO: 3437354 - RNA, 13 nt, Pseudomonas aeruginosa PA01
acgcugccgagga

SEQ ID NO: 3437355 - RNA, 19 nt, Pseudomonas aeruginosa PA01
acgcugccgaggaacucgc

SEQ ID NO: 3437356 - RNA, 15 nt, Pseudomonas aeruginosa PA01
acgcugcgaccuggc

SEQ ID NO: 3437357 - RNA, 21 nt, Pseudomonas aeruginosa PA01
acgcugcgccggcgcugcgag

SEQ ID NO: 3437358 - RNA, 17 nt, Pseudomonas aeruginosa PA01
acgcugcggaucaacuc

SEQ ID NO: 3437359 - RNA, 21 nt, Pseudomonas aeruginosa PA01
acgcugcggaucaacuccgcc

SEQ ID NO: 3437360 - RNA, 20 nt, Pseudomonas aeruginosa PA01
acgcugcuaggcuggaagcc

SEQ ID NO: 3437361 - RNA, 18 nt, Pseudomonas aeruginosa PA01
acgcugcucgacggcacc

SEQ ID NO: 3437362 - RNA, 16 nt, Pseudomonas aeruginosa PA01
acgcugcucgcagccg

SEQ ID NO: 3437363 - RNA, 19 nt, Pseudomonas aeruginosa PA01
acgcugcucgcagccggug

SEQ ID NO: 3437364 - RNA, 14 nt, Pseudomonas aeruginosa PA01
acgcugcugccggc

SEQ ID NO: 3437365 - RNA, 20 nt, Pseudomonas aeruginosa PA01
acgcugcuugcgcaccuccu

SEQ ID NO: 3437366 - RNA, 21 nt, Pseudomonas aeruginosa PA01
acgcugcuugcgcaccuccuu

SEQ ID NO: 3437367 - RNA, 15 nt, Pseudomonas aeruginosa PA01
acgcuggccugccga

SEQ ID NO: 3437368 - RNA, 19 nt, Pseudomonas aeruginosa PA01
acgcuggcgagaauggcga

SEQ ID NO: 3437369 - RNA, 20 nt, Pseudomonas aeruginosa PA01
acgcuggcgauaucgaaggc

SEQ ID NO: 3437370 - RNA, 17 nt, Pseudomonas aeruginosa PA01
acgcuggcgaucaugcc

SEQ ID NO: 3437371 - RNA, 16 nt, Pseudomonas aeruginosa PA01
acgcugggacggcugc

SEQ ID NO: 3437372 - RNA, 18 nt, Pseudomonas aeruginosa PA01
acgcugggacggcugccc

SEQ ID NO: 3437373 - RNA, 21 nt, Pseudomonas aeruginosa PA01
acgcuggucaggcugacgucg

SEQ ID NO: 3437374 - RNA, 15 nt, Pseudomonas aeruginosa PA01
acgcuggugccgacg

SEQ ID NO: 3437375 - RNA, 15 nt, Pseudomonas aeruginosa PA01
acgcuguagaaugcg

SEQ ID NO: 3437376 - RNA, 15 nt, Pseudomonas aeruginosa PA01
acgcuguagaccagc

SEQ ID NO: 3437377 - RNA, 13 nt, Pseudomonas aeruginosa PA01
acgcuuccagcac

SEQ ID NO: 3437378 - RNA, 19 nt, Pseudomonas aeruginosa PA01
acgcuucgaagcucucgcc

SEQ ID NO: 3437379 - RNA, 17 nt, Pseudomonas aeruginosa PA01
acgcuucgcagcauucg

SEQ ID NO: 3437380 - RNA, 15 nt, Pseudomonas aeruginosa PA01
acgcuucuccucggc

SEQ ID NO: 3437381 - RNA, 18 nt, Pseudomonas aeruginosa PA01
acgcuucuccucggccga

SEQ ID NO: 3437382 - RNA, 19 nt, Pseudomonas aeruginosa PA01
acgcuucugcgccuccucg

SEQ ID NO: 3437383 - RNA, 23 nt, Pseudomonas aeruginosa PA01
acgcuucugcgccuccucggcgg

SEQ ID NO: 3437384 - RNA, 16 nt, Pseudomonas aeruginosa PA01
acgcuucugcuggccg

SEQ ID NO: 3437385 - RNA, 21 nt, Pseudomonas aeruginosa PA01
acgcuucugcuggccgcgcag

SEQ ID NO: 3437386 - RNA, 17 nt, Pseudomonas aeruginosa PA01
acgcuugagccccggca

SEQ ID NO: 3437387 - RNA, 18 nt, Pseudomonas aeruginosa PA01
acgcuugagccccggcag

SEQ ID NO: 3437388 - RNA, 20 nt, Pseudomonas aeruginosa PA01
acgcuugagccccggcaggc

SEQ ID NO: 3437389 - RNA, 17 nt, Pseudomonas aeruginosa PA01
acgcuugagcuggcgcu

SEQ ID NO: 3437390 - RNA, 20 nt, Pseudomonas aeruginosa PA01
acgcuuggcgaucacggcgc

SEQ ID NO: 3437391 - RNA, 23 nt, Pseudomonas aeruginosa PA01
acgcuuuggauggagcacagcca

SEQ ID NO: 3437392 - RNA, 21 nt, Pseudomonas aeruginosa PA01
acggaacaggagccaucgcuc

SEQ ID NO: 3437393 - RNA, 13 nt, Pseudomonas aeruginosa PA01
acggaagcgcugc

SEQ ID NO: 3437394 - RNA, 15 nt, Pseudomonas aeruginosa PA01
acggaagcggccgag

SEQ ID NO: 3437395 - RNA, 14 nt, Pseudomonas aeruginosa PA01
acggacccgcucgg

SEQ ID NO: 3437396 - RNA, 14 nt, Pseudomonas aeruginosa PA01
acggacgcgacgcc

SEQ ID NO: 3437397 - RNA, 19 nt, Pseudomonas aeruginosa PA01
acggacguuccaccuggcg

SEQ ID NO: 3437398 - RNA, 22 nt, Pseudomonas aeruginosa PA01
acggagaagcguccgagguggc

SEQ ID NO: 3437399 - RNA, 18 nt, Pseudomonas aeruginosa PA01
acggagagcagcagcucg

SEQ ID NO: 3437400 - RNA, 21 nt, Pseudomonas aeruginosa PA01
acggagucggugugaccuuca

SEQ ID NO: 3437401 - RNA, 16 nt, Pseudomonas aeruginosa PA01
acggauagcgauaggc

SEQ ID NO: 3437402 - RNA, 16 nt, Pseudomonas aeruginosa PA01
acggauaggcggcgga

SEQ ID NO: 3437403 - RNA, 24 nt, Pseudomonas aeruginosa PA01
acggaucgguccccuccagguagg

SEQ ID NO: 3437404 - RNA, 17 nt, Pseudomonas aeruginosa PA01
acggcaacgucgcggau

SEQ ID NO: 3437405 - RNA, 16 nt, Pseudomonas aeruginosa PA01
acggcaaggaccugcu

SEQ ID NO: 3437406 - RNA, 22 nt, Pseudomonas aeruginosa PA01
acggcaaggaccugcugcccgg

SEQ ID NO: 3437407 - RNA, 15 nt, Pseudomonas aeruginosa PA01
acggcacacgucggc

SEQ ID NO: 3437408 - RNA, 18 nt, Pseudomonas aeruginosa PA01
acggcacacgucggcauc

SEQ ID NO: 3437409 - RNA, 12 nt, Pseudomonas aeruginosa PA01
acggcaccacca

SEQ ID NO: 3437410 - RNA, 17 nt, Pseudomonas aeruginosa PA01
acggcaccaccaccgac

SEQ ID NO: 3437411 - RNA, 13 nt, Pseudomonas aeruginosa PA01
acggcaccagcgc

SEQ ID NO: 3437412 - RNA, 22 nt, Pseudomonas aeruginosa PA01
acggcaccagcgcgucgaagcc

SEQ ID NO: 3437413 - RNA, 15 nt, Pseudomonas aeruginosa PA01
acggcacgaccuucu

SEQ ID NO: 3437414 - RNA, 15 nt, Pseudomonas aeruginosa PA01
acggcacgacgccgg

SEQ ID NO: 3437415 - RNA, 13 nt, Pseudomonas aeruginosa PA01
acggcagccgcgu

SEQ ID NO: 3437416 - RNA, 22 nt, Pseudomonas aeruginosa PA01
acggcagcggcgugaagccgcc

SEQ ID NO: 3437417 - RNA, 23 nt, Pseudomonas aeruginosa PA01
acggcagcgucucagcccucggc

SEQ ID NO: 3437418 - RNA, 20 nt, Pseudomonas aeruginosa PA01
acggcagcuggauccgugcc

SEQ ID NO: 3437419 - RNA, 15 nt, Pseudomonas aeruginosa PA01
acggcaggcaaaaaa

SEQ ID NO: 3437420 - RNA, 10 nt, Pseudomonas aeruginosa PA01
acggcaggcc

SEQ ID NO: 3437421 - RNA, 13 nt, Pseudomonas aeruginosa PA01
acggcaggccagc

SEQ ID NO: 3437422 - RNA, 16 nt, Pseudomonas aeruginosa PA01
acggcaggccagcagg

SEQ ID NO: 3437423 - RNA, 20 nt, Pseudomonas aeruginosa PA01
acggcaggccagcagguagc

SEQ ID NO: 3437424 - RNA, 22 nt, Pseudomonas aeruginosa PA01
acggcaggggcuuucuucgccu

SEQ ID NO: 3437425 - RNA, 13 nt, Pseudomonas aeruginosa PA01
acggcugaggcug

SEQ ID NO: 3437426 - RNA, 15 nt, Pseudomonas aeruginosa PA01
acggcugaggcuggc

SEQ ID NO: 3437427 - RNA, 18 nt, Pseudomonas aeruginosa PA01
acggcugaggcuggcgac

SEQ ID NO: 3437428 - RNA, 12 nt, Pseudomonas aeruginosa PA01
acggcugccggu

SEQ ID NO: 3437429 - RNA, 13 nt, Pseudomonas aeruginosa PA01
acggcugccggua

SEQ ID NO: 3437430 - RNA, 18 nt, Pseudomonas aeruginosa PA01
acggcugccgguacgcac

SEQ ID NO: 3437431 - RNA, 14 nt, Pseudomonas aeruginosa PA01
acggcugcuccgga

SEQ ID NO: 3437432 - RNA, 13 nt, Pseudomonas aeruginosa PA01
acggcuggucggc

SEQ ID NO: 3437433 - RNA, 22 nt, Pseudomonas aeruginosa PA01
acggcuguugucgaacagguag

SEQ ID NO: 3437434 - RNA, 19 nt, Pseudomonas aeruginosa PA01
acggcuucagcgccaggcc

SEQ ID NO: 3437435 - RNA, 14 nt, Pseudomonas aeruginosa PA01
acggcuucgcagau

SEQ ID NO: 3437436 - RNA, 13 nt, Pseudomonas aeruginosa PA01
acggcuugaggaa

SEQ ID NO: 3437437 - RNA, 22 nt, Pseudomonas aeruginosa PA01
acggcuugaucacgccgaagcc

SEQ ID NO: 3437438 - RNA, 15 nt, Pseudomonas aeruginosa PA01
acggcuugucgggua

SEQ ID NO: 3437439 - RNA, 19 nt, Pseudomonas aeruginosa PA01
acggcuuguucagcucggc

SEQ ID NO: 3437440 - RNA, 17 nt, Pseudomonas aeruginosa PA01
acgggaagcgaaccagg

SEQ ID NO: 3437441 - RNA, 14 nt, Pseudomonas aeruginosa PA01
acgggacgccaggc

SEQ ID NO: 3437442 - RNA, 15 nt, Pseudomonas aeruginosa PA01
acgggacgccaggcg

SEQ ID NO: 3437443 - RNA, 18 nt, Pseudomonas aeruginosa PA01
acgggacuuuccgaagcc

SEQ ID NO: 3437444 - RNA, 18 nt, Pseudomonas aeruginosa PA01
acgggagcgcgaggcgca

SEQ ID NO: 3437445 - RNA, 22 nt, Pseudomonas aeruginosa PA01
acgggagcgcgaggcgcaggca

SEQ ID NO: 3437446 - RNA, 17 nt, Pseudomonas aeruginosa PA01
acgggcaucgucgaagg

SEQ ID NO: 3437447 - RNA, 21 nt, Pseudomonas aeruginosa PA01
acgggcauugucccugcggga

SEQ ID NO: 3437448 - RNA, 16 nt, Pseudomonas aeruginosa PA01
acgggccgcgccgcaa

SEQ ID NO: 3437449 - RNA, 21 nt, Pseudomonas aeruginosa PA01
acgggcgaagacgaaguuggc

SEQ ID NO: 3437450 - RNA, 16 nt, Pseudomonas aeruginosa PA01
acgggcgacccaggcc

SEQ ID NO: 3437451 - RNA, 19 nt, Pseudomonas aeruginosa PA01
acgggcgcucuggccgcgc

SEQ ID NO: 3437452 - RNA, 23 nt, Pseudomonas aeruginosa PA01
acgggcggccgacgugcacccgc

SEQ ID NO: 3437453 - RNA, 17 nt, Pseudomonas aeruginosa PA01
acgggcgguaugccgga

SEQ ID NO: 3437454 - RNA, 13 nt, Pseudomonas aeruginosa PA01
acgggcguugccg

SEQ ID NO: 3437455 - RNA, 16 nt, Pseudomonas aeruginosa PA01
acgggcugccagcaua

SEQ ID NO: 3437456 - RNA, 17 nt, Pseudomonas aeruginosa PA01
acggggcugcggccucg

SEQ ID NO: 3437457 - RNA, 20 nt, Pseudomonas aeruginosa PA01
acggguagagcgggccguug

SEQ ID NO: 3437458 - RNA, 14 nt, Pseudomonas aeruginosa PA01
acgggucaguccuu

SEQ ID NO: 3437459 - RNA, 15 nt, Pseudomonas aeruginosa PA01
acgggucgcagccga

SEQ ID NO: 3437460 - RNA, 21 nt, Pseudomonas aeruginosa PA01
acgggucgcagccgagccccc

SEQ ID NO: 3437461 - RNA, 15 nt, Pseudomonas aeruginosa PA01
acgggucgggucgag

SEQ ID NO: 3437462 - RNA, 15 nt, Pseudomonas aeruginosa PA01
acgggucgucgcccu

SEQ ID NO: 3437463 - RNA, 21 nt, Pseudomonas aeruginosa PA01
acgggugcugaagauaucgcc

SEQ ID NO: 3437464 - RNA, 15 nt, Pseudomonas aeruginosa PA01
acggguugaucaggu

SEQ ID NO: 3437465 - RNA, 16 nt, Pseudomonas aeruginosa PA01
acggguuucgcugcug

SEQ ID NO: 3437466 - RNA, 15 nt, Pseudomonas aeruginosa PA01
acggucagcucggca

SEQ ID NO: 3437467 - RNA, 19 nt, Pseudomonas aeruginosa PA01
acggucagcucggcaucgu

SEQ ID NO: 3437468 - RNA, 14 nt, Pseudomonas aeruginosa PA01
acggucauggccag

SEQ ID NO: 3437469 - RNA, 14 nt, Pseudomonas aeruginosa PA01
acgguccaggauca

SEQ ID NO: 3437470 - RNA, 19 nt, Pseudomonas aeruginosa PA01
acgguccaggaucauccgc

SEQ ID NO: 3437471 - RNA, 15 nt, Pseudomonas aeruginosa PA01
acgguccagggccgc

SEQ ID NO: 3437472 - RNA, 22 nt, Pseudomonas aeruginosa PA01
acgguccccaguagcaucccca

SEQ ID NO: 3437473 - RNA, 22 nt, Pseudomonas aeruginosa PA01
acggucucgccgccgagcaggc

SEQ ID NO: 3437474 - RNA, 15 nt, Pseudomonas aeruginosa PA01
acggucugccagcuc

SEQ ID NO: 3437475 - RNA, 23 nt, Pseudomonas aeruginosa PA01
acggucuugcgcuugccggccgc

SEQ ID NO: 3437476 - RNA, 16 nt, Pseudomonas aeruginosa PA01
acggucuuggcggcga

SEQ ID NO: 3437477 - RNA, 13 nt, Pseudomonas aeruginosa PA01
acggugaaccagg

SEQ ID NO: 3437478 - RNA, 16 nt, Pseudomonas aeruginosa PA01
acggugaaccaggcgc

SEQ ID NO: 3437479 - RNA, 19 nt, Pseudomonas aeruginosa PA01
acggugaaccaggcgccga

SEQ ID NO: 3437480 - RNA, 12 nt, Pseudomonas aeruginosa PA01
acggugaccuug

SEQ ID NO: 3437481 - RNA, 21 nt, Pseudomonas aeruginosa PA01
acggugacguuggccggggua

SEQ ID NO: 3437482 - RNA, 14 nt, Pseudomonas aeruginosa PA01
acggugcagccacc

SEQ ID NO: 3437483 - RNA, 20 nt, Pseudomonas aeruginosa PA01
acggugcagccacccagcag

SEQ ID NO: 3437484 - RNA, 22 nt, Pseudomonas aeruginosa PA01
acggugcagccacccagcagca

SEQ ID NO: 3437485 - RNA, 14 nt, Pseudomonas aeruginosa PA01
acggugcaggccga

SEQ ID NO: 3437486 - RNA, 15 nt, Pseudomonas aeruginosa PA01
acggugccauccgca

SEQ ID NO: 3437487 - RNA, 23 nt, Pseudomonas aeruginosa PA01
acgguggaccaacgggcugccag

SEQ ID NO: 3437488 - RNA, 15 nt, Pseudomonas aeruginosa PA01
acgguggaggcgggc

SEQ ID NO: 3437489 - RNA, 21 nt, Pseudomonas aeruginosa PA01
acgguguuguggcuggccucg

SEQ ID NO: 3437490 - RNA, 22 nt, Pseudomonas aeruginosa PA01
acgguguuguggcuggccucgg

SEQ ID NO: 3437491 - RNA, 15 nt, Pseudomonas aeruginosa PA01
acgguucagcagcgg

SEQ ID NO: 3437492 - RNA, 17 nt, Pseudomonas aeruginosa PA01
acgguucagcagcggca

SEQ ID NO: 3437493 - RNA, 15 nt, Pseudomonas aeruginosa PA01
acgguuggccagcga

SEQ ID NO: 3437494 - RNA, 13 nt, Pseudomonas aeruginosa PA01
acgguuggccucg

SEQ ID NO: 3437495 - RNA, 15 nt, Pseudomonas aeruginosa PA01
acguagaugccggug

SEQ ID NO: 3437496 - RNA, 23 nt, Pseudomonas aeruginosa PA01
acguagccgcccuuuuccggaua

SEQ ID NO: 3437497 - RNA, 16 nt, Pseudomonas aeruginosa PA01
acguagcgcaggucgc

SEQ ID NO: 3437498 - RNA, 17 nt, Pseudomonas aeruginosa PA01
acguaggagccggccag

SEQ ID NO: 3437499 - RNA, 19 nt, Pseudomonas aeruginosa PA01
acguaggagccggccaggc

SEQ ID NO: 3437500 - RNA, 13 nt, Pseudomonas aeruginosa PA01
acguaggcggcga

SEQ ID NO: 3437501 - RNA, 22 nt, Pseudomonas aeruginosa PA01
acguaggcggcgaaggccgcuu

SEQ ID NO: 3437502 - RNA, 22 nt, Pseudomonas aeruginosa PA01
acguaguaggcgcggguggcgu

SEQ ID NO: 3437503 - RNA, 18 nt, Pseudomonas aeruginosa PA01
acguaguugacccgcccc

SEQ ID NO: 3437504 - RNA, 12 nt, Pseudomonas aeruginosa PA01
acgucaggcugu

SEQ ID NO: 3437505 - RNA, 14 nt, Pseudomonas aeruginosa PA01
acguccagcggcau

SEQ ID NO: 3437506 - RNA, 22 nt, Pseudomonas aeruginosa PA01
acguccggcgucccgcaguagc

SEQ ID NO: 3437507 - RNA, 13 nt, Pseudomonas aeruginosa PA01
acguccuccaggc

SEQ ID NO: 3437508 - RNA, 15 nt, Pseudomonas aeruginosa PA01
acguccuccaggcuc

SEQ ID NO: 3437509 - RNA, 18 nt, Pseudomonas aeruginosa PA01
acguccucgaugcccgcc

SEQ ID NO: 3437510 - RNA, 16 nt, Pseudomonas aeruginosa PA01
acguccucgcgccgcu

SEQ ID NO: 3437511 - RNA, 22 nt, Pseudomonas aeruginosa PA01
acguccuggccgagccgcuugg

SEQ ID NO: 3437512 - RNA, 17 nt, Pseudomonas aeruginosa PA01
acgucgacgcagcgcgc

SEQ ID NO: 3437513 - RNA, 23 nt, Pseudomonas aeruginosa PA01
acgucgagaccgaccgacuuggc

SEQ ID NO: 3437514 - RNA, 14 nt, Pseudomonas aeruginosa PA01
acgucgauauugcc

SEQ ID NO: 3437515 - RNA, 22 nt, Pseudomonas aeruginosa PA01
acgucgaucugcucguccaggc

SEQ ID NO: 3437516 - RNA, 19 nt, Pseudomonas aeruginosa PA01
acgucgaugccuucggcgg

SEQ ID NO: 3437517 - RNA, 20 nt, Pseudomonas aeruginosa PA01
acgucgcagguaacccgcgg

SEQ ID NO: 3437518 - RNA, 15 nt, Pseudomonas aeruginosa PA01
acgucgccccaggga

SEQ ID NO: 3437519 - RNA, 12 nt, Pseudomonas aeruginosa PA01
acgucgccgacc

SEQ ID NO: 3437520 - RNA, 13 nt, Pseudomonas aeruginosa PA01
acgucgccgacca

SEQ ID NO: 3437521 - RNA, 17 nt, Pseudomonas aeruginosa PA01
acgucgcgcaccuggcg

SEQ ID NO: 3437522 - RNA, 18 nt, Pseudomonas aeruginosa PA01
acgucgcgcaccuggcgg

SEQ ID NO: 3437523 - RNA, 20 nt, Pseudomonas aeruginosa PA01
acgucgcggauguucaccag

SEQ ID NO: 3437524 - RNA, 14 nt, Pseudomonas aeruginosa PA01
acgucggcccgguu

SEQ ID NO: 3437525 - RNA, 14 nt, Pseudomonas aeruginosa PA01
acgucggcggcgga

SEQ ID NO: 3437526 - RNA, 23 nt, Pseudomonas aeruginosa PA01
acgucggcggcggauaacgccug

SEQ ID NO: 3437527 - RNA, 17 nt, Pseudomonas aeruginosa PA01
acgucggcggggugauc

SEQ ID NO: 3437528 - RNA, 12 nt, Pseudomonas aeruginosa PA01
acucgaaaaugu

SEQ ID NO: 3437529 - RNA, 21 nt, Pseudomonas aeruginosa PA01
acucgaaggccagcucgucgc

SEQ ID NO: 3437530 - RNA, 19 nt, Pseudomonas aeruginosa PA01
acucgacaggccauucuuc

SEQ ID NO: 3437531 - RNA, 20 nt, Pseudomonas aeruginosa PA01
acucgacaggccauucuucu

SEQ ID NO: 3437532 - RNA, 16 nt, Pseudomonas aeruginosa PA01
acucgacgcgccaggu

SEQ ID NO: 3437533 - RNA, 22 nt, Pseudomonas aeruginosa PA01
acucgacgcugcccagcccgcc

SEQ ID NO: 3437534 - RNA, 16 nt, Pseudomonas aeruginosa PA01
acucgagcaccaccac

SEQ ID NO: 3437535 - RNA, 15 nt, Pseudomonas aeruginosa PA01
acucgaucagcgcgg

SEQ ID NO: 3437536 - RNA, 17 nt, Pseudomonas aeruginosa PA01
acucgaugaacgcccug

SEQ ID NO: 3437537 - RNA, 13 nt, Pseudomonas aeruginosa PA01
acucgauggcgcg

SEQ ID NO: 3437538 - RNA, 14 nt, Pseudomonas aeruginosa PA01
acucgauggcgcgg

SEQ ID NO: 3437539 - RNA, 14 nt, Pseudomonas aeruginosa PA01
acucgcagccgcgc

SEQ ID NO: 3437540 - RNA, 19 nt, Pseudomonas aeruginosa PA01
acucgcagccgcgcucggc

SEQ ID NO: 3437541 - RNA, 14 nt, Pseudomonas aeruginosa PA01
acucgccagcgcgc

SEQ ID NO: 3437542 - RNA, 21 nt, Pseudomonas aeruginosa PA01
acucgcccgaccccacgccgg

SEQ ID NO: 3437543 - RNA, 13 nt, Pseudomonas aeruginosa PA01
acucgcccggcuc

SEQ ID NO: 3437544 - RNA, 20 nt, Pseudomonas aeruginosa PA01
acucgccgccgacacccgcg

SEQ ID NO: 3437545 - RNA, 17 nt, Pseudomonas aeruginosa PA01
acucgccggcgaucucc

SEQ ID NO: 3437546 - RNA, 18 nt, Pseudomonas aeruginosa PA01
acucgcgagcuggcgccg

SEQ ID NO: 3437547 - RNA, 20 nt, Pseudomonas aeruginosa PA01
acucgcgagcuggcgccguc

SEQ ID NO: 3437548 - RNA, 22 nt, Pseudomonas aeruginosa PA01
acucgcgagcuggcgccgucau

SEQ ID NO: 3437549 - RNA, 16 nt, Pseudomonas aeruginosa PA01
acucgcgggcgcgcag

SEQ ID NO: 3437550 - RNA, 14 nt, Pseudomonas aeruginosa PA01
acucgcugccggcg

SEQ ID NO: 3437551 - RNA, 15 nt, Pseudomonas aeruginosa PA01
acucgcugggcgccg

SEQ ID NO: 3437552 - RNA, 19 nt, Pseudomonas aeruginosa PA01
acucgcugggcgccggcag

SEQ ID NO: 3437553 - RNA, 21 nt, Pseudomonas aeruginosa PA01
acucgcuguccaugaagacgu

SEQ ID NO: 3437554 - RNA, 21 nt, Pseudomonas aeruginosa PA01
acucggccagcaaugcccgcg

SEQ ID NO: 3437555 - RNA, 18 nt, Pseudomonas aeruginosa PA01
acucggcccgggccuggu

SEQ ID NO: 3437556 - RNA, 15 nt, Pseudomonas aeruginosa PA01
acucggccucggcgu

SEQ ID NO: 3437557 - RNA, 22 nt, Pseudomonas aeruginosa PA01
acucggccucggcgucgcgcag

SEQ ID NO: 3437558 - RNA, 13 nt, Pseudomonas aeruginosa PA01
acucggcgaccac

SEQ ID NO: 3437559 - RNA, 18 nt, Pseudomonas aeruginosa PA01
acucggcgaccacccggc

SEQ ID NO: 3437560 - RNA, 19 nt, Pseudomonas aeruginosa PA01
acucggcgaccacccggcg

SEQ ID NO: 3437561 - RNA, 21 nt, Pseudomonas aeruginosa PA01
acucggcgcccagggcuucgc

SEQ ID NO: 3437562 - RNA, 15 nt, Pseudomonas aeruginosa PA01
acucggcggcgagcg

SEQ ID NO: 3437563 - RNA, 16 nt, Pseudomonas aeruginosa PA01
acucggcggcgagcgc

SEQ ID NO: 3437564 - RNA, 19 nt, Pseudomonas aeruginosa PA01
acucggcggcgagcgccgc

SEQ ID NO: 3437565 - RNA, 15 nt, Pseudomonas aeruginosa PA01
acucggcggggcgca

SEQ ID NO: 3437566 - RNA, 19 nt, Pseudomonas aeruginosa PA01
acucggcggggcgcagcag

SEQ ID NO: 3437567 - RNA, 23 nt, Pseudomonas aeruginosa PA01
acucggcggggcgcagcaggauc

SEQ ID NO: 3437568 - RNA, 15 nt, Pseudomonas aeruginosa PA01
acucggcgucgcgcu

SEQ ID NO: 3437569 - RNA, 12 nt, Pseudomonas aeruginosa PA01
acucggcgugcc

SEQ ID NO: 3437570 - RNA, 22 nt, Pseudomonas aeruginosa PA01
acucggcgugccgggccggcca

SEQ ID NO: 3437571 - RNA, 23 nt, Pseudomonas aeruginosa PA01
acucgguguagcugaggccguag

SEQ ID NO: 3437572 - RNA, 23 nt, Pseudomonas aeruginosa PA01
acucguagggguaggggucggcc

SEQ ID NO: 3437573 - RNA, 13 nt, Pseudomonas aeruginosa PA01
acucgucgcccca

SEQ ID NO: 3437574 - RNA, 18 nt, Pseudomonas aeruginosa PA01
acucguguuccggcagga

SEQ ID NO: 3437575 - RNA, 21 nt, Pseudomonas aeruginosa PA01
acucguugcacgcaggccgcu

SEQ ID NO: 3437576 - RNA, 17 nt, Pseudomonas aeruginosa PA01
acucucuugcccauaua

SEQ ID NO: 3437577 - RNA, 18 nt, Pseudomonas aeruginosa PA01
acucugguagcugcggcc

SEQ ID NO: 3437578 - RNA, 18 nt, Pseudomonas aeruginosa PA01
acucuuccagggucggca

SEQ ID NO: 3437579 - RNA, 15 nt, Pseudomonas aeruginosa PA01
acugaagacccggcg

SEQ ID NO: 3437580 - RNA, 22 nt, Pseudomonas aeruginosa PA01
acugaagagugggcgggguaau

SEQ ID NO: 3437581 - RNA, 12 nt, Pseudomonas aeruginosa PA01
acugaccaccag

SEQ ID NO: 3437582 - RNA, 12 nt, Pseudomonas aeruginosa PA01
acugaccacgca

SEQ ID NO: 3437583 - RNA, 17 nt, Pseudomonas aeruginosa PA01
acugacgcgcagcgccg

SEQ ID NO: 3437584 - RNA, 20 nt, Pseudomonas aeruginosa PA01
acugacgcgcagcgccgccg

SEQ ID NO: 3437585 - RNA, 13 nt, Pseudomonas aeruginosa PA01
acugacgguggag

SEQ ID NO: 3437586 - RNA, 20 nt, Pseudomonas aeruginosa PA01
acugagcgugacccgcgcuu

SEQ ID NO: 3437587 - RNA, 21 nt, Pseudomonas aeruginosa PA01
acugagcuuaaggcagguuuc

SEQ ID NO: 3437588 - RNA, 17 nt, Pseudomonas aeruginosa PA01
acugauaccgcuggcca

SEQ ID NO: 3437589 - RNA, 23 nt, Pseudomonas aeruginosa PA01
acugauaucguuguucagcaggg

SEQ ID NO: 3437590 - RNA, 20 nt, Pseudomonas aeruginosa PA01
acugauuugauugaaaaaau

SEQ ID NO: 3437591 - RNA, 12 nt, Pseudomonas aeruginosa PA01
acugcagcuugu

SEQ ID NO: 3437592 - RNA, 15 nt, Pseudomonas aeruginosa PA01
acugcaugaccucca

SEQ ID NO: 3437593 - RNA, 21 nt, Pseudomonas aeruginosa PA01
acugccaggagcacgccgugc

SEQ ID NO: 3437594 - RNA, 21 nt, Pseudomonas aeruginosa PA01
acugccaggguaccguugcgc

SEQ ID NO: 3437595 - RNA, 14 nt, Pseudomonas aeruginosa PA01
acugcccagcgccg

SEQ ID NO: 3437596 - RNA, 15 nt, Pseudomonas aeruginosa PA01
acugcccagcgccgc

SEQ ID NO: 3437597 - RNA, 17 nt, Pseudomonas aeruginosa PA01
acugcccagcgccgcca

SEQ ID NO: 3437598 - RNA, 13 nt, Pseudomonas aeruginosa PA01
acugcccggcucg

SEQ ID NO: 3437599 - RNA, 18 nt, Pseudomonas aeruginosa PA01
acugccgauggucucucu

SEQ ID NO: 3437600 - RNA, 13 nt, Pseudomonas aeruginosa PA01
acugccgcccgcu

SEQ ID NO: 3437601 - RNA, 20 nt, Pseudomonas aeruginosa PA01
acugccgcuaucgcuggcgc

SEQ ID NO: 3437602 - RNA, 22 nt, Pseudomonas aeruginosa PA01
acugccgggccagcuccagcac

SEQ ID NO: 3437603 - RNA, 17 nt, Pseudomonas aeruginosa PA01
acugccggucggccuug

SEQ ID NO: 3437604 - RNA, 14 nt, Pseudomonas aeruginosa PA01
acugccgucggcgc

SEQ ID NO: 3437605 - RNA, 21 nt, Pseudomonas aeruginosa PA01
acugcgagccgacuuccagcu

SEQ ID NO: 3437606 - RNA, 22 nt, Pseudomonas aeruginosa PA01
acugcgagccgacuuccagcuu

SEQ ID NO: 3437607 - RNA, 19 nt, Pseudomonas aeruginosa PA01
acugcgaggcggugcagcg

SEQ ID NO: 3437608 - RNA, 22 nt, Pseudomonas aeruginosa PA01
acugcgauggaacgagcgcgac

SEQ ID NO: 3437609 - RNA, 23 nt, Pseudomonas aeruginosa PA01
acugcgccaguuccuucgccgaa

SEQ ID NO: 3437610 - RNA, 17 nt, Pseudomonas aeruginosa PA01
acugcgcccccagcgcc

SEQ ID NO: 3437611 - RNA, 18 nt, Pseudomonas aeruginosa PA01
acugcgcccccagcgccc

SEQ ID NO: 3437612 - RNA, 19 nt, Pseudomonas aeruginosa PA01
acugcgcccccagcgcccg

SEQ ID NO: 3437613 - RNA, 20 nt, Pseudomonas aeruginosa PA01
acugcgcccccagcgcccgc

SEQ ID NO: 3437614 - RNA, 14 nt, Pseudomonas aeruginosa PA01
acugcgcgccaguc

SEQ ID NO: 3437615 - RNA, 23 nt, Pseudomonas aeruginosa PA01
acugcgcuggccgagcugccgca

SEQ ID NO: 3437616 - RNA, 16 nt, Pseudomonas aeruginosa PA01
acugcggggcgcucag

SEQ ID NO: 3437617 - RNA, 19 nt, Pseudomonas aeruginosa PA01
acugcgguuuuccugcccc

SEQ ID NO: 3437618 - RNA, 20 nt, Pseudomonas aeruginosa PA01
acugcguggguagccauggc

SEQ ID NO: 3437619 - RNA, 19 nt, Pseudomonas aeruginosa PA01
acugcucgaacugcuccug

SEQ ID NO: 3437620 - RNA, 21 nt, Pseudomonas aeruginosa PA01
acugcucgaucaaccccugga

SEQ ID NO: 3437621 - RNA, 22 nt, Pseudomonas aeruginosa PA01
acugcugcugcggggccugcug

SEQ ID NO: 3437622 - RNA, 21 nt, Pseudomonas aeruginosa PA01
acugcuggguacgguuggcca

SEQ ID NO: 3437623 - RNA, 16 nt, Pseudomonas aeruginosa PA01
acugcuuaccuugccg

SEQ ID NO: 3437624 - RNA, 16 nt, Pseudomonas aeruginosa PA01
acugcuucaggcgcgc

SEQ ID NO: 3437625 - RNA, 17 nt, Pseudomonas aeruginosa PA01
acugcuucaggcgcgcg

SEQ ID NO: 3437626 - RNA, 18 nt, Pseudomonas aeruginosa PA01
acugcuugccgagcuggg

SEQ ID NO: 3437627 - RNA, 16 nt, Pseudomonas aeruginosa PA01
acugcuuggccaggcg

SEQ ID NO: 3437628 - RNA, 17 nt, Pseudomonas aeruginosa PA01
acugcuuggccaggcgc

SEQ ID NO: 3437629 - RNA, 16 nt, Pseudomonas aeruginosa PA01
acuggaagaaggcgau

SEQ ID NO: 3437630 - RNA, 16 nt, Pseudomonas aeruginosa PA01
agaaaaggcccgcuga

SEQ ID NO: 3437631 - RNA, 14 nt, Pseudomonas aeruginosa PA01
agaaaaggccgcgu

SEQ ID NO: 3437632 - RNA, 23 nt, Pseudomonas aeruginosa PA01
agaaaccgaaguagucgccccgg

SEQ ID NO: 3437633 - RNA, 22 nt, Pseudomonas aeruginosa PA01
agaaaccgaucagcaccgccac

SEQ ID NO: 3437634 - RNA, 20 nt, Pseudomonas aeruginosa PA01
agaaacgcagggccucuucg

SEQ ID NO: 3437635 - RNA, 21 nt, Pseudomonas aeruginosa PA01
agaaacgcgccuccggcagcg

SEQ ID NO: 3437636 - RNA, 14 nt, Pseudomonas aeruginosa PA01
agaaacggcugccg

SEQ ID NO: 3437637 - RNA, 19 nt, Pseudomonas aeruginosa PA01
agaaacgguggaggcgucg

SEQ ID NO: 3437638 - RNA, 20 nt, Pseudomonas aeruginosa PA01
agaaacgguggaggcgucgg

SEQ ID NO: 3437639 - RNA, 11 nt, Pseudomonas aeruginosa PA01
agaaacugcag

SEQ ID NO: 3437640 - RNA, 17 nt, Pseudomonas aeruginosa PA01
agaaacuuucuucgcca

SEQ ID NO: 3437641 - RNA, 17 nt, Pseudomonas aeruginosa PA01
agaaauccaccuugccg

SEQ ID NO: 3437642 - RNA, 21 nt, Pseudomonas aeruginosa PA01
agaaauccggcuggcgccggu

SEQ ID NO: 3437643 - RNA, 22 nt, Pseudomonas aeruginosa PA01
agaaauccggcuggcgccggug

SEQ ID NO: 3437644 - RNA, 19 nt, Pseudomonas aeruginosa PA01
agaaauccuccggacgccg

SEQ ID NO: 3437645 - RNA, 13 nt, Pseudomonas aeruginosa PA01
agaacacccgggu

SEQ ID NO: 3437646 - RNA, 14 nt, Pseudomonas aeruginosa PA01
agaacaccugcgug

SEQ ID NO: 3437647 - RNA, 19 nt, Pseudomonas aeruginosa PA01
agaacacgccccagaagcc

SEQ ID NO: 3437648 - RNA, 19 nt, Pseudomonas aeruginosa PA01
agaacacggcuucgcagau

SEQ ID NO: 3437649 - RNA, 22 nt, Pseudomonas aeruginosa PA01
agaacagcaaagcgcagguagc

SEQ ID NO: 3437650 - RNA, 12 nt, Pseudomonas aeruginosa PA01
agaacagcagcg

SEQ ID NO: 3437651 - RNA, 13 nt, Pseudomonas aeruginosa PA01
agaacagcagggu

SEQ ID NO: 3437652 - RNA, 15 nt, Pseudomonas aeruginosa PA01
agaacagcaggguca

SEQ ID NO: 3437653 - RNA, 20 nt, Pseudomonas aeruginosa PA01
agaacagcgagaccucgccc

SEQ ID NO: 3437654 - RNA, 21 nt, Pseudomonas aeruginosa PA01
agaacaggcgcuucagcucga

SEQ ID NO: 3437655 - RNA, 14 nt, Pseudomonas aeruginosa PA01
agaacaggcugccg

SEQ ID NO: 3437656 - RNA, 17 nt, Pseudomonas aeruginosa PA01
agaacaggcugccgcag

SEQ ID NO: 3437657 - RNA, 22 nt, Pseudomonas aeruginosa PA01
agaacaucgcccauugccgggc

SEQ ID NO: 3437658 - RNA, 22 nt, Pseudomonas aeruginosa PA01
agaaccaccgguuugcugaccg

SEQ ID NO: 3437659 - RNA, 20 nt, Pseudomonas aeruginosa PA01
agaaccagacgcucggccag

SEQ ID NO: 3437660 - RNA, 22 nt, Pseudomonas aeruginosa PA01
agaaccccggccaugagccggg

SEQ ID NO: 3437661 - RNA, 13 nt, Pseudomonas aeruginosa PA01
agaaccccggcuc

SEQ ID NO: 3437662 - RNA, 15 nt, Pseudomonas aeruginosa PA01
agaaccgccagcagu

SEQ ID NO: 3437663 - RNA, 20 nt, Pseudomonas aeruginosa PA01
agaacgaaaaaggcgcgccg

SEQ ID NO: 3437664 - RNA, 14 nt, Pseudomonas aeruginosa PA01
agaacgccaggauc

SEQ ID NO: 3437665 - RNA, 19 nt, Pseudomonas aeruginosa PA01
agaacgccaggaucggcau

SEQ ID NO: 3437666 - RNA, 14 nt, Pseudomonas aeruginosa PA01
agaacgccgacccu

SEQ ID NO: 3437667 - RNA, 21 nt, Pseudomonas aeruginosa PA01
agaacgcggaaaccugcaacu

SEQ ID NO: 3437668 - RNA, 21 nt, Pseudomonas aeruginosa PA01
agaacgcguaggggaccaccc

SEQ ID NO: 3437669 - RNA, 16 nt, Pseudomonas aeruginosa PA01
agaacguugcccaccg

SEQ ID NO: 3437670 - RNA, 21 nt, Pseudomonas aeruginosa PA01
agaacucguccggucgcaccg

SEQ ID NO: 3437671 - RNA, 19 nt, Pseudomonas aeruginosa PA01
agaacugccgggccagcuc

SEQ ID NO: 3437672 - RNA, 15 nt, Pseudomonas aeruginosa PA01
agaacugcucggcgu

SEQ ID NO: 3437673 - RNA, 16 nt, Pseudomonas aeruginosa PA01
agaacuuuucccagcg

SEQ ID NO: 3437674 - RNA, 21 nt, Pseudomonas aeruginosa PA01
agaagaacggacgcgacgccu

SEQ ID NO: 3437675 - RNA, 19 nt, Pseudomonas aeruginosa PA01
agaagacgcccagcagggc

SEQ ID NO: 3437676 - RNA, 17 nt, Pseudomonas aeruginosa PA01
agaagaucagcgcggug

SEQ ID NO: 3437677 - RNA, 20 nt, Pseudomonas aeruginosa PA01
agaagaucgccugcuggccg

SEQ ID NO: 3437678 - RNA, 16 nt, Pseudomonas aeruginosa PA01
agaagccgaccuugcg

SEQ ID NO: 3437679 - RNA, 22 nt, Pseudomonas aeruginosa PA01
agaagccgaucaccaccagcau

SEQ ID NO: 3437680 - RNA, 20 nt, Pseudomonas aeruginosa PA01
agaagccgcacuuccaggcg

SEQ ID NO: 3437681 - RNA, 21 nt, Pseudomonas aeruginosa PA01
agaagccgcacuuccaggcgc

SEQ ID NO: 3437682 - RNA, 19 nt, Pseudomonas aeruginosa PA01
agaagccgcacuuccaggu

SEQ ID NO: 3437683 - RNA, 15 nt, Pseudomonas aeruginosa PA01
agaagccgcugaccu

SEQ ID NO: 3437684 - RNA, 15 nt, Pseudomonas aeruginosa PA01
agaagcgcaccaccu

SEQ ID NO: 3437685 - RNA, 23 nt, Pseudomonas aeruginosa PA01
agaagcgcaccaccugcaugcuu

SEQ ID NO: 3437686 - RNA, 20 nt, Pseudomonas aeruginosa PA01
agaagcgcgcgguacccagc

SEQ ID NO: 3437687 - RNA, 19 nt, Pseudomonas aeruginosa PA01
agaagcggccgaccaggcc

SEQ ID NO: 3437688 - RNA, 19 nt, Pseudomonas aeruginosa PA01
agaagcugccccacaggcc

SEQ ID NO: 3437689 - RNA, 16 nt, Pseudomonas aeruginosa PA01
agaaggcgaucaucgc

SEQ ID NO: 3437690 - RNA, 21 nt, Pseudomonas aeruginosa PA01
agaaggcguccaccggcgccc

SEQ ID NO: 3437691 - RNA, 17 nt, Pseudomonas aeruginosa PA01
agaaggcguccagggcu

SEQ ID NO: 3437692 - RNA, 13 nt, Pseudomonas aeruginosa PA01
agaaggucaccgc

SEQ ID NO: 3437693 - RNA, 13 nt, Pseudomonas aeruginosa PA01
agaaggugcccag

SEQ ID NO: 3437694 - RNA, 20 nt, Pseudomonas aeruginosa PA01
agaaggugcccagcggcgcc

SEQ ID NO: 3437695 - RNA, 21 nt, Pseudomonas aeruginosa PA01
agaaggugcccagcggcgccu

SEQ ID NO: 3437696 - RNA, 21 nt, Pseudomonas aeruginosa PA01
agaaguaaucaccuuccucgc

SEQ ID NO: 3437697 - RNA, 20 nt, Pseudomonas aeruginosa PA01
agaaguauuucaaccaggcg

SEQ ID NO: 3437698 - RNA, 12 nt, Pseudomonas aeruginosa PA01
agaagucccagc

SEQ ID NO: 3437699 - RNA, 19 nt, Pseudomonas aeruginosa PA01
agaagucguccucgcccug

SEQ ID NO: 3437700 - RNA, 13 nt, Pseudomonas aeruginosa PA01
agaaguugcuggc

SEQ ID NO: 3437701 - RNA, 19 nt, Pseudomonas aeruginosa PA01
agaauaccgccagcucgcu

SEQ ID NO: 3437702 - RNA, 23 nt, Pseudomonas aeruginosa PA01
agaaugcgcggccucgguugaga

SEQ ID NO: 3437703 - RNA, 17 nt, Pseudomonas aeruginosa PA01
agaauucgcguccacca

SEQ ID NO: 3437704 - RNA, 15 nt, Pseudomonas aeruginosa PA01
agacacaaaaaaccc

SEQ ID NO: 3437705 - RNA, 18 nt, Pseudomonas aeruginosa PA01
agacacgaaaaagccggc

SEQ ID NO: 3437706 - RNA, 20 nt, Pseudomonas aeruginosa PA01
agacagcccuccaaagaaaa

SEQ ID NO: 3437707 - RNA, 21 nt, Pseudomonas aeruginosa PA01
agacaggaaucgacccagccg

SEQ ID NO: 3437708 - RNA, 13 nt, Pseudomonas aeruginosa PA01
agaccaccagcag

SEQ ID NO: 3437709 - RNA, 19 nt, Pseudomonas aeruginosa PA01
agaccacccggcugcaugc

SEQ ID NO: 3437710 - RNA, 19 nt, Pseudomonas aeruginosa PA01
agaccaccgacggcuccgg

SEQ ID NO: 3437711 - RNA, 18 nt, Pseudomonas aeruginosa PA01
agaccaccgugcgcaccu

SEQ ID NO: 3437712 - RNA, 12 nt, Pseudomonas aeruginosa PA01
agaccacgcagg

SEQ ID NO: 3437713 - RNA, 13 nt, Pseudomonas aeruginosa PA01
agaccacgcaggc

SEQ ID NO: 3437714 - RNA, 15 nt, Pseudomonas aeruginosa PA01
agaccacgcaggcca

SEQ ID NO: 3437715 - RNA, 17 nt, Pseudomonas aeruginosa PA01
agaccacgcaggccagc

SEQ ID NO: 3437716 - RNA, 20 nt, Pseudomonas aeruginosa PA01
agaccacgcaggccagcgcc

SEQ ID NO: 3437717 - RNA, 20 nt, Pseudomonas aeruginosa PA01
agaccagcagcgcaccaucc

SEQ ID NO: 3437718 - RNA, 21 nt, Pseudomonas aeruginosa PA01
agaccagcagcggcagccacu

SEQ ID NO: 3437719 - RNA, 22 nt, Pseudomonas aeruginosa PA01
agaccagcagcggcagccacuc

SEQ ID NO: 3437720 - RNA, 14 nt, Pseudomonas aeruginosa PA01
agaccagcgaaccg

SEQ ID NO: 3437721 - RNA, 16 nt, Pseudomonas aeruginosa PA01
agaccaggccgagcag

SEQ ID NO: 3437722 - RNA, 18 nt, Pseudomonas aeruginosa PA01
agaccaggccgagcagga

SEQ ID NO: 3437723 - RNA, 19 nt, Pseudomonas aeruginosa PA01
agaccaggccgagcaggaa

SEQ ID NO: 3437724 - RNA, 14 nt, Pseudomonas aeruginosa PA01
agaccagucggccg

SEQ ID NO: 3437725 - RNA, 15 nt, Pseudomonas aeruginosa PA01
agaccaucugccagc

SEQ ID NO: 3437726 - RNA, 21 nt, Pseudomonas aeruginosa PA01
agacccgcaacaccuguaccu

SEQ ID NO: 3437727 - RNA, 13 nt, Pseudomonas aeruginosa PA01
agacccucucccu

SEQ ID NO: 3437728 - RNA, 17 nt, Pseudomonas aeruginosa PA01
agacccugcacaucacc

SEQ ID NO: 3437729 - RNA, 12 nt, Pseudomonas aeruginosa PA01
agacccugggcc

SEQ ID NO: 3437730 - RNA, 20 nt, Pseudomonas aeruginosa PA01
agacccugggccaacgguag

SEQ ID NO: 3437731 - RNA, 21 nt, Pseudomonas aeruginosa PA01
agaccgacccucauggaaacc

SEQ ID NO: 3437732 - RNA, 15 nt, Pseudomonas aeruginosa PA01
agaggaugccggccu

SEQ ID NO: 3437733 - RNA, 17 nt, Pseudomonas aeruginosa PA01
agaggcaacaccaucgg

SEQ ID NO: 3437734 - RNA, 21 nt, Pseudomonas aeruginosa PA01
agaggcaacaccaucggcccc

SEQ ID NO: 3437735 - RNA, 21 nt, Pseudomonas aeruginosa PA01
agaggcauucaucaccagcuc

SEQ ID NO: 3437736 - RNA, 18 nt, Pseudomonas aeruginosa PA01
agaggcguucaugaaagc

SEQ ID NO: 3437737 - RNA, 15 nt, Pseudomonas aeruginosa PA01
agaggcucagccgau

SEQ ID NO: 3437738 - RNA, 15 nt, Pseudomonas aeruginosa PA01
agaggcucggcggcc

SEQ ID NO: 3437739 - RNA, 16 nt, Pseudomonas aeruginosa PA01
agaggcucggcggcca

SEQ ID NO: 3437740 - RNA, 15 nt, Pseudomonas aeruginosa PA01
agaggcugcgcucca

SEQ ID NO: 3437741 - RNA, 19 nt, Pseudomonas aeruginosa PA01
agaggcugcgcuccaggcg

SEQ ID NO: 3437742 - RNA, 16 nt, Pseudomonas aeruginosa PA01
agaggcuguagcgcuc

SEQ ID NO: 3437743 - RNA, 14 nt, Pseudomonas aeruginosa PA01
agagggcggcgacc

SEQ ID NO: 3437744 - RNA, 20 nt, Pseudomonas aeruginosa PA01
agagggcggcgaccggccuc

SEQ ID NO: 3437745 - RNA, 19 nt, Pseudomonas aeruginosa PA01
agagggcguagugcaucag

SEQ ID NO: 3437746 - RNA, 15 nt, Pseudomonas aeruginosa PA01
agagggucagcaggc

SEQ ID NO: 3437747 - RNA, 20 nt, Pseudomonas aeruginosa PA01
agagggucagcaggcugccg

SEQ ID NO: 3437748 - RNA, 20 nt, Pseudomonas aeruginosa PA01
agagggucagccggccgauc

SEQ ID NO: 3437749 - RNA, 12 nt, Pseudomonas aeruginosa PA01
agagggugaggc

SEQ ID NO: 3437750 - RNA, 16 nt, Pseudomonas aeruginosa PA01
agaggucgagcugggu

SEQ ID NO: 3437751 - RNA, 12 nt, Pseudomonas aeruginosa PA01
agaggucgccga

SEQ ID NO: 3437752 - RNA, 14 nt, Pseudomonas aeruginosa PA01
agaggucggcgcgc

SEQ ID NO: 3437753 - RNA, 19 nt, Pseudomonas aeruginosa PA01
agaggucggcgcgcccggc

SEQ ID NO: 3437754 - RNA, 13 nt, Pseudomonas aeruginosa PA01
agagguugccgug

SEQ ID NO: 3437755 - RNA, 14 nt, Pseudomonas aeruginosa PA01
agagguugcuguag

SEQ ID NO: 3437756 - RNA, 17 nt, Pseudomonas aeruginosa PA01
agagugcccaggcgcug

SEQ ID NO: 3437757 - RNA, 19 nt, Pseudomonas aeruginosa PA01
agagugcccaggcgcuggc

SEQ ID NO: 3437758 - RNA, 20 nt, Pseudomonas aeruginosa PA01
agagugcccaggcgcuggcg

SEQ ID NO: 3437759 - RNA, 16 nt, Pseudomonas aeruginosa PA01
agagugcgcagcagcg

SEQ ID NO: 3437760 - RNA, 17 nt, Pseudomonas aeruginosa PA01
agagugcgcagcagcgu

SEQ ID NO: 3437761 - RNA, 13 nt, Pseudomonas aeruginosa PA01
agaguucggcugc

SEQ ID NO: 3437762 - RNA, 17 nt, Pseudomonas aeruginosa PA01
agaguuugccgaacugc

SEQ ID NO: 3437763 - RNA, 22 nt, Pseudomonas aeruginosa PA01
agaguuugccgaacugcagggc

SEQ ID NO: 3437764 - RNA, 21 nt, Pseudomonas aeruginosa PA01
agauacgcuccggugccaggg

SEQ ID NO: 3437765 - RNA, 16 nt, Pseudomonas aeruginosa PA01
agauacuccagcagcg

SEQ ID NO: 3437766 - RNA, 13 nt, Pseudomonas aeruginosa PA01
agauagucgccgu

SEQ ID NO: 3437767 - RNA, 20 nt, Pseudomonas aeruginosa PA01
agauauaacgcgagccacau

SEQ ID NO: 3437768 - RNA, 13 nt, Pseudomonas aeruginosa PA01
agaucaccaccac

SEQ ID NO: 3437769 - RNA, 17 nt, Pseudomonas aeruginosa PA01
agaucaggccggcgucg

SEQ ID NO: 3437770 - RNA, 18 nt, Pseudomonas aeruginosa PA01
agaucauguagagcaggc

SEQ ID NO: 3437771 - RNA, 20 nt, Pseudomonas aeruginosa PA01
agaucauguagagcaggcug

SEQ ID NO: 3437772 - RNA, 15 nt, Pseudomonas aeruginosa PA01
agauccgccagcaga

SEQ ID NO: 3437773 - RNA, 24 nt, Pseudomonas aeruginosa PA01
agauccgccgugaggcgcgcgccg

SEQ ID NO: 3437774 - RNA, 17 nt, Pseudomonas aeruginosa PA01
agauccgcuccaggcug

SEQ ID NO: 3437775 - RNA, 12 nt, Pseudomonas aeruginosa PA01
agauccuggccg

SEQ ID NO: 3437776 - RNA, 13 nt, Pseudomonas aeruginosa PA01
agaucgagcgcgc

SEQ ID NO: 3437777 - RNA, 22 nt, Pseudomonas aeruginosa PA01
agaucgaugcuguggguggugc

SEQ ID NO: 3437778 - RNA, 15 nt, Pseudomonas aeruginosa PA01
agaucgccaccccgc

SEQ ID NO: 3437779 - RNA, 21 nt, Pseudomonas aeruginosa PA01
agaucgccaccccgccgcugg

SEQ ID NO: 3437780 - RNA, 16 nt, Pseudomonas aeruginosa PA01
agaucgccagcgccag

SEQ ID NO: 3437781 - RNA, 18 nt, Pseudomonas aeruginosa PA01
agaucgccagcgccagca

SEQ ID NO: 3437782 - RNA, 21 nt, Pseudomonas aeruginosa PA01
agaucgccagcgccagcaggu

SEQ ID NO: 3437783 - RNA, 22 nt, Pseudomonas aeruginosa PA01
agaucgccagcgccagcaggua

SEQ ID NO: 3437784 - RNA, 21 nt, Pseudomonas aeruginosa PA01
agaucgccagcucgccgcgcu

SEQ ID NO: 3437785 - RNA, 13 nt, Pseudomonas aeruginosa PA01
agaucgcccgcag

SEQ ID NO: 3437786 - RNA, 15 nt, Pseudomonas aeruginosa PA01
agaucgccgcgccgu

SEQ ID NO: 3437787 - RNA, 22 nt, Pseudomonas aeruginosa PA01
agaucgccguguugaugccgau

SEQ ID NO: 3437788 - RNA, 12 nt, Pseudomonas aeruginosa PA01
agaucgcgccga

SEQ ID NO: 3437789 - RNA, 14 nt, Pseudomonas aeruginosa PA01
agaucgcgccgagc

SEQ ID NO: 3437790 - RNA, 19 nt, Pseudomonas aeruginosa PA01
agaucgcgccgagcuggcg

SEQ ID NO: 3437791 - RNA, 23 nt, Pseudomonas aeruginosa PA01
agaucgcgccgagcuggcgcgcg

SEQ ID NO: 3437792 - RNA, 16 nt, Pseudomonas aeruginosa PA01
agaucgcguccagggu

SEQ ID NO: 3437793 - RNA, 18 nt, Pseudomonas aeruginosa PA01
agaucgcguuugccgucc

SEQ ID NO: 3437794 - RNA, 17 nt, Pseudomonas aeruginosa PA01
agaucggcagcaucagc

SEQ ID NO: 3437795 - RNA, 19 nt, Pseudomonas aeruginosa PA01
agaucggcagcaucagccg

SEQ ID NO: 3437796 - RNA, 21 nt, Pseudomonas aeruginosa PA01
agaucggcagcaucagccgcg

SEQ ID NO: 3437797 - RNA, 14 nt, Pseudomonas aeruginosa PA01
agaucggcgcgcag

SEQ ID NO: 3437798 - RNA, 22 nt, Pseudomonas aeruginosa PA01
agaucggcgcgcagggccagca

SEQ ID NO: 3437799 - RNA, 12 nt, Pseudomonas aeruginosa PA01
agaucggcggcg

SEQ ID NO: 3437800 - RNA, 12 nt, Pseudomonas aeruginosa PA01
agaucggucacc

SEQ ID NO: 3437801 - RNA, 19 nt, Pseudomonas aeruginosa PA01
agaucggugcgggcagaca

SEQ ID NO: 3437802 - RNA, 22 nt, Pseudomonas aeruginosa PA01
agaucgucuuucucgaucucgu

SEQ ID NO: 3437803 - RNA, 22 nt, Pseudomonas aeruginosa PA01
agaucuccacccguucgccggc

SEQ ID NO: 3437804 - RNA, 19 nt, Pseudomonas aeruginosa PA01
agaucugcaccaggcucgc

SEQ ID NO: 3437805 - RNA, 12 nt, Pseudomonas aeruginosa PA01
agaucugcaccg

SEQ ID NO: 3437806 - RNA, 20 nt, Pseudomonas aeruginosa PA01
agaucugcaccgcccagccg

SEQ ID NO: 3437807 - RNA, 16 nt, Pseudomonas aeruginosa PA01
agaucugcgaauagac

SEQ ID NO: 3437808 - RNA, 15 nt, Pseudomonas aeruginosa PA01
agaucuucaggccga

SEQ ID NO: 3437809 - RNA, 17 nt, Pseudomonas aeruginosa PA01
agaucuuuucgauggug

SEQ ID NO: 3437810 - RNA, 17 nt, Pseudomonas aeruginosa PA01
agaugacgauggccgcc

SEQ ID NO: 3437811 - RNA, 21 nt, Pseudomonas aeruginosa PA01
agaugacgauggccgccgccg

SEQ ID NO: 3437812 - RNA, 18 nt, Pseudomonas aeruginosa PA01
agaugaucaggccgagca

SEQ ID NO: 3437813 - RNA, 13 nt, Pseudomonas aeruginosa PA01
agaugcacaccag

SEQ ID NO: 3437814 - RNA, 16 nt, Pseudomonas aeruginosa PA01
agaugcacaccagcuc

SEQ ID NO: 3437815 - RNA, 18 nt, Pseudomonas aeruginosa PA01
agaugcacaccagcuccc

SEQ ID NO: 3437816 - RNA, 14 nt, Pseudomonas aeruginosa PA01
agaugcagcaggua

SEQ ID NO: 3437817 - RNA, 19 nt, Pseudomonas aeruginosa PA01
agaugcagcgucgcgcguc

SEQ ID NO: 3437818 - RNA, 14 nt, Pseudomonas aeruginosa PA01
agaugccacugacg

SEQ ID NO: 3437819 - RNA, 24 nt, Pseudomonas aeruginosa PA01
agaugccacugacgcgcagcgccg

SEQ ID NO: 3437820 - RNA, 17 nt, Pseudomonas aeruginosa PA01
agaugccgaacaccugc

SEQ ID NO: 3437821 - RNA, 19 nt, Pseudomonas aeruginosa PA01
agaugccgcccugcggcag

SEQ ID NO: 3437822 - RNA, 22 nt, Pseudomonas aeruginosa PA01
agaugccggugcuggugcggcc

SEQ ID NO: 3437823 - RNA, 23 nt, Pseudomonas aeruginosa PA01
agaugcguccguugaggcguucg

SEQ ID NO: 3437824 - RNA, 16 nt, Pseudomonas aeruginosa PA01
agaugcucaggcgcug

SEQ ID NO: 3437825 - RNA, 20 nt, Pseudomonas aeruginosa PA01
agaugcuccagggagcgcuc

SEQ ID NO: 3437826 - RNA, 22 nt, Pseudomonas aeruginosa PA01
agaugcuccagggagcgcucgc

SEQ ID NO: 3437827 - RNA, 19 nt, Pseudomonas aeruginosa PA01
agaugcugcgggcgccgcc

SEQ ID NO: 3437828 - RNA, 19 nt, Pseudomonas aeruginosa PA01
agaugcuugcacaccuggu

SEQ ID NO: 3437829 - RNA, 17 nt, Pseudomonas aeruginosa PA01
agauggcacaguuccug

SEQ ID NO: 3437830 - RNA, 15 nt, Pseudomonas aeruginosa PA01
agauggcuaaacaag

SEQ ID NO: 3437831 - RNA, 16 nt, Pseudomonas aeruginosa PA01
agauggcuggucaggc

SEQ ID NO: 3437832 - RNA, 15 nt, Pseudomonas aeruginosa PA01
agauggucagcaacu

SEQ ID NO: 3437833 - RNA, 18 nt, Pseudomonas aeruginosa PA01
agauggucgaaccagcuc

SEQ ID NO: 3437834 - RNA, 17 nt, Pseudomonas aeruginosa PA01
agauguagucgacgccg

SEQ ID NO: 3437835 - RNA, 21 nt, Pseudomonas aeruginosa PA01
agcaccuugagggccuuggcc

SEQ ID NO: 3437836 - RNA, 23 nt, Pseudomonas aeruginosa PA01
agcaccuugagggccuuggccuc

SEQ ID NO: 3437837 - RNA, 17 nt, Pseudomonas aeruginosa PA01
agcacgaaagcguucuu

SEQ ID NO: 3437838 - RNA, 17 nt, Pseudomonas aeruginosa PA01
agcacgaugcacaggcg

SEQ ID NO: 3437839 - RNA, 21 nt, Pseudomonas aeruginosa PA01
agcacgcccaguugcgccgcc

SEQ ID NO: 3437840 - RNA, 19 nt, Pseudomonas aeruginosa PA01
agcacgccgagcaacggca

SEQ ID NO: 3437841 - RNA, 22 nt, Pseudomonas aeruginosa PA01
agcacgccgagcaacggcagca

SEQ ID NO: 3437842 - RNA, 22 nt, Pseudomonas aeruginosa PA01
agcacgccgcgaccgaagccgc

SEQ ID NO: 3437843 - RNA, 13 nt, Pseudomonas aeruginosa PA01
agcacgccgugca

SEQ ID NO: 3437844 - RNA, 17 nt, Pseudomonas aeruginosa PA01
agcacgcggagggcggc

SEQ ID NO: 3437845 - RNA, 13 nt, Pseudomonas aeruginosa PA01
agcacgcguccga

SEQ ID NO: 3437846 - RNA, 16 nt, Pseudomonas aeruginosa PA01
agcacgcguccgacca

SEQ ID NO: 3437847 - RNA, 16 nt, Pseudomonas aeruginosa PA01
agcacgcuggcgucgg

SEQ ID NO: 3437848 - RNA, 13 nt, Pseudomonas aeruginosa PA01
agcacggccucgc

SEQ ID NO: 3437849 - RNA, 14 nt, Pseudomonas aeruginosa PA01
agcacggccucgcg

SEQ ID NO: 3437850 - RNA, 22 nt, Pseudomonas aeruginosa PA01
agcacggccucgcgugcgcugg

SEQ ID NO: 3437851 - RNA, 20 nt, Pseudomonas aeruginosa PA01
agcacggcgaacaccgggcc

SEQ ID NO: 3437852 - RNA, 18 nt, Pseudomonas aeruginosa PA01
agcacggcgacggugccg

SEQ ID NO: 3437853 - RNA, 20 nt, Pseudomonas aeruginosa PA01
agcacggcgauacccaggcc

SEQ ID NO: 3437854 - RNA, 12 nt, Pseudomonas aeruginosa PA01
agcacggcggcu

SEQ ID NO: 3437855 - RNA, 15 nt, Pseudomonas aeruginosa PA01
agcacgguccgcgaa

SEQ ID NO: 3437856 - RNA, 15 nt, Pseudomonas aeruginosa PA01
agcacggugaaccag

SEQ ID NO: 3437857 - RNA, 19 nt, Pseudomonas aeruginosa PA01
agcacggugaaccaggcgc

SEQ ID NO: 3437858 - RNA, 20 nt, Pseudomonas aeruginosa PA01
agcacggugaaccaggcgcc

SEQ ID NO: 3437859 - RNA, 22 nt, Pseudomonas aeruginosa PA01
agcacggugaaccaggcgccga

SEQ ID NO: 3437860 - RNA, 18 nt, Pseudomonas aeruginosa PA01
agcacggugcuggcgucg

SEQ ID NO: 3437861 - RNA, 19 nt, Pseudomonas aeruginosa PA01
agcacguagccgcccuuuu

SEQ ID NO: 3437862 - RNA, 20 nt, Pseudomonas aeruginosa PA01
agcacguagccgcccuuuuc

SEQ ID NO: 3437863 - RNA, 12 nt, Pseudomonas aeruginosa PA01
agcacgucgagc

SEQ ID NO: 3437864 - RNA, 11 nt, Pseudomonas aeruginosa PA01
agcacgucgau

SEQ ID NO: 3437865 - RNA, 22 nt, Pseudomonas aeruginosa PA01
agcacgucgauauccagcggca

SEQ ID NO: 3437866 - RNA, 23 nt, Pseudomonas aeruginosa PA01
agcacgucgauauccagcggcag

SEQ ID NO: 3437867 - RNA, 17 nt, Pseudomonas aeruginosa PA01
agcacgucguccagcgc

SEQ ID NO: 3437868 - RNA, 14 nt, Pseudomonas aeruginosa PA01
agcacgucuugcag

SEQ ID NO: 3437869 - RNA, 15 nt, Pseudomonas aeruginosa PA01
agcacgucuugcagg

SEQ ID NO: 3437870 - RNA, 16 nt, Pseudomonas aeruginosa PA01
agcacgucuugcaggc

SEQ ID NO: 3437871 - RNA, 18 nt, Pseudomonas aeruginosa PA01
agcacgucuugcaggcuc

SEQ ID NO: 3437872 - RNA, 23 nt, Pseudomonas aeruginosa PA01
agcacguugccauccagcgccug

SEQ ID NO: 3437873 - RNA, 15 nt, Pseudomonas aeruginosa PA01
agcacugguggacgg

SEQ ID NO: 3437874 - RNA, 16 nt, Pseudomonas aeruginosa PA01
agcacuucccaggugc

SEQ ID NO: 3437875 - RNA, 16 nt, Pseudomonas aeruginosa PA01
agcacuucggcgcgcg

SEQ ID NO: 3437876 - RNA, 19 nt, Pseudomonas aeruginosa PA01
agcacuucggcgcgcggca

SEQ ID NO: 3437877 - RNA, 21 nt, Pseudomonas aeruginosa PA01
agcagaaagccccugccgcgg

SEQ ID NO: 3437878 - RNA, 13 nt, Pseudomonas aeruginosa PA01
agcagaaccgcca

SEQ ID NO: 3437879 - RNA, 18 nt, Pseudomonas aeruginosa PA01
agcagaaccgccagcagu

SEQ ID NO: 3437880 - RNA, 19 nt, Pseudomonas aeruginosa PA01
agcagaaccgccagcagug

SEQ ID NO: 3437881 - RNA, 19 nt, Pseudomonas aeruginosa PA01
agcagaacuugcgcaccgc

SEQ ID NO: 3437882 - RNA, 21 nt, Pseudomonas aeruginosa PA01
agcagaaguuguucgaugcgu

SEQ ID NO: 3437883 - RNA, 20 nt, Pseudomonas aeruginosa PA01
agcagacggcacgacgccgg

SEQ ID NO: 3437884 - RNA, 13 nt, Pseudomonas aeruginosa PA01
agcagagcgccac

SEQ ID NO: 3437885 - RNA, 16 nt, Pseudomonas aeruginosa PA01
agcagagggucgccag

SEQ ID NO: 3437886 - RNA, 18 nt, Pseudomonas aeruginosa PA01
agcagagggucgccagcg

SEQ ID NO: 3437887 - RNA, 14 nt, Pseudomonas aeruginosa PA01
agcagagucgccgg

SEQ ID NO: 3437888 - RNA, 15 nt, Pseudomonas aeruginosa PA01
agcagcaacagcgcc

SEQ ID NO: 3437889 - RNA, 16 nt, Pseudomonas aeruginosa PA01
agcagcaacagcgccg

SEQ ID NO: 3437890 - RNA, 16 nt, Pseudomonas aeruginosa PA01
agcagcaccacggcga

SEQ ID NO: 3437891 - RNA, 23 nt, Pseudomonas aeruginosa PA01
agcagcaccacggcgauggucag

SEQ ID NO: 3437892 - RNA, 15 nt, Pseudomonas aeruginosa PA01
agcagcaccagcacc

SEQ ID NO: 3437893 - RNA, 17 nt, Pseudomonas aeruginosa PA01
agcagcaccagcaccag

SEQ ID NO: 3437894 - RNA, 12 nt, Pseudomonas aeruginosa PA01
agcagcaccagg

SEQ ID NO: 3437895 - RNA, 14 nt, Pseudomonas aeruginosa PA01
agcagcaccaggcu

SEQ ID NO: 3437896 - RNA, 17 nt, Pseudomonas aeruginosa PA01
agcagcaccaggcuggc

SEQ ID NO: 3437897 - RNA, 19 nt, Pseudomonas aeruginosa PA01
agcagcaccaggcuggcca

SEQ ID NO: 3437898 - RNA, 14 nt, Pseudomonas aeruginosa PA01
agcagcaccaucag

SEQ ID NO: 3437899 - RNA, 16 nt, Pseudomonas aeruginosa PA01
agcagcaccaucagcc

SEQ ID NO: 3437900 - RNA, 19 nt, Pseudomonas aeruginosa PA01
agcagcaccgcgagcaugc

SEQ ID NO: 3437901 - RNA, 15 nt, Pseudomonas aeruginosa PA01
agcagcacgcccugg

SEQ ID NO: 3437902 - RNA, 12 nt, Pseudomonas aeruginosa PA01
agcagcacggug

SEQ ID NO: 3437903 - RNA, 21 nt, Pseudomonas aeruginosa PA01
agcagcacgguguuguggcug

SEQ ID NO: 3437904 - RNA, 16 nt, Pseudomonas aeruginosa PA01
agcagcaggcgcucgg

SEQ ID NO: 3437905 - RNA, 22 nt, Pseudomonas aeruginosa PA01
agcagcaugaugccgaggcggc

SEQ ID NO: 3437906 - RNA, 18 nt, Pseudomonas aeruginosa PA01
agcagcaugucgccgggg

SEQ ID NO: 3437907 - RNA, 23 nt, Pseudomonas aeruginosa PA01
agcagccaaccgucgcccuggug

SEQ ID NO: 3437908 - RNA, 18 nt, Pseudomonas aeruginosa PA01
agcagccaagccaccagc

SEQ ID NO: 3437909 - RNA, 20 nt, Pseudomonas aeruginosa PA01
agcagccaaggaugcgccag

SEQ ID NO: 3437910 - RNA, 23 nt, Pseudomonas aeruginosa PA01
agcagccaaggaugcgccagcgg

SEQ ID NO: 3437911 - RNA, 16 nt, Pseudomonas aeruginosa PA01
agcagccacgggacuu

SEQ ID NO: 3437912 - RNA, 19 nt, Pseudomonas aeruginosa PA01
agcagccaggccuugugcg

SEQ ID NO: 3437913 - RNA, 12 nt, Pseudomonas aeruginosa PA01
agcagccaggcg

SEQ ID NO: 3437914 - RNA, 13 nt, Pseudomonas aeruginosa PA01
agcagccaggcga

SEQ ID NO: 3437915 - RNA, 14 nt, Pseudomonas aeruginosa PA01
agcagccaggcgaa

SEQ ID NO: 3437916 - RNA, 17 nt, Pseudomonas aeruginosa PA01
agcagccaggcgaaggc

SEQ ID NO: 3437917 - RNA, 22 nt, Pseudomonas aeruginosa PA01
agcagccauagcaauacaacca

SEQ ID NO: 3437918 - RNA, 21 nt, Pseudomonas aeruginosa PA01
agcagccauggcuggugcggg

SEQ ID NO: 3437919 - RNA, 12 nt, Pseudomonas aeruginosa PA01
agcagcccagcg

SEQ ID NO: 3437920 - RNA, 22 nt, Pseudomonas aeruginosa PA01
agcagcccagcgcuuccucggg

SEQ ID NO: 3437921 - RNA, 14 nt, Pseudomonas aeruginosa PA01
agcagcccggccug

SEQ ID NO: 3437922 - RNA, 16 nt, Pseudomonas aeruginosa PA01
agcagcccggccugga

SEQ ID NO: 3437923 - RNA, 19 nt, Pseudomonas aeruginosa PA01
agcagcccgggcaacugcc

SEQ ID NO: 3437924 - RNA, 21 nt, Pseudomonas aeruginosa PA01
agcagccgacgauccggccga

SEQ ID NO: 3437925 - RNA, 12 nt, Pseudomonas aeruginosa PA01
agcagccgcagg

SEQ ID NO: 3437926 - RNA, 20 nt, Pseudomonas aeruginosa PA01
agcagccgcaggaugccgcc

SEQ ID NO: 3437927 - RNA, 22 nt, Pseudomonas aeruginosa PA01
agcagccgcaggaugccgccug

SEQ ID NO: 3437928 - RNA, 16 nt, Pseudomonas aeruginosa PA01
agcagccguauggccc

SEQ ID NO: 3437929 - RNA, 23 nt, Pseudomonas aeruginosa PA01
agcagcgaacgccgcagcucggc

SEQ ID NO: 3437930 - RNA, 23 nt, Pseudomonas aeruginosa PA01
agcagcgacucgcugggcgccgg

SEQ ID NO: 3437931 - RNA, 16 nt, Pseudomonas aeruginosa PA01
agcagcgccacgcuga

SEQ ID NO: 3437932 - RNA, 19 nt, Pseudomonas aeruginosa PA01
agcagcgccagcaggucgc

SEQ ID NO: 3437933 - RNA, 14 nt, Pseudomonas aeruginosa PA01
agcagcgccagcca

SEQ ID NO: 3437934 - RNA, 16 nt, Pseudomonas aeruginosa PA01
agcagcgccagccagg

SEQ ID NO: 3437935 - RNA, 19 nt, Pseudomonas aeruginosa PA01
agcagcgccagggcccaca

SEQ ID NO: 3437936 - RNA, 21 nt, Pseudomonas aeruginosa PA01
agcagcgccaguacuccgagg

SEQ ID NO: 3437937 - RNA, 20 nt, Pseudomonas aeruginosa PA01
agcagggcgaugaacaccgc

SEQ ID NO: 3437938 - RNA, 15 nt, Pseudomonas aeruginosa PA01
agcagggcgaugccg

SEQ ID NO: 3437939 - RNA, 15 nt, Pseudomonas aeruginosa PA01
agcagggcgauggcc

SEQ ID NO: 3437940 - RNA, 12 nt, Pseudomonas aeruginosa PA01
agcagggcgucg

SEQ ID NO: 3437941 - RNA, 22 nt, Pseudomonas aeruginosa PA01
agcagggcgucgcccucggcgc

SEQ ID NO: 3437942 - RNA, 15 nt, Pseudomonas aeruginosa PA01
agcagggcgucggcg

SEQ ID NO: 3437943 - RNA, 16 nt, Pseudomonas aeruginosa PA01
agcagggggacgaaaa

SEQ ID NO: 3437944 - RNA, 15 nt, Pseudomonas aeruginosa PA01
agcaggguaccgcug

SEQ ID NO: 3437945 - RNA, 18 nt, Pseudomonas aeruginosa PA01
agcaggguaccgcuggcg

SEQ ID NO: 3437946 - RNA, 20 nt, Pseudomonas aeruginosa PA01
agcagggucacgccgaucac

SEQ ID NO: 3437947 - RNA, 21 nt, Pseudomonas aeruginosa PA01
agcagggucacgccgaucacc

SEQ ID NO: 3437948 - RNA, 17 nt, Pseudomonas aeruginosa PA01
agcagggucagcagcgc

SEQ ID NO: 3437949 - RNA, 17 nt, Pseudomonas aeruginosa PA01
agcagggucgcgagcag

SEQ ID NO: 3437950 - RNA, 18 nt, Pseudomonas aeruginosa PA01
agcagggucgcgagcagg

SEQ ID NO: 3437951 - RNA, 15 nt, Pseudomonas aeruginosa PA01
agcagggucgggguc

SEQ ID NO: 3437952 - RNA, 18 nt, Pseudomonas aeruginosa PA01
agcagggucucgcugcug

SEQ ID NO: 3437953 - RNA, 19 nt, Pseudomonas aeruginosa PA01
agcagggucuucaggcgcc

SEQ ID NO: 3437954 - RNA, 15 nt, Pseudomonas aeruginosa PA01
agcagggugaagcug

SEQ ID NO: 3437955 - RNA, 20 nt, Pseudomonas aeruginosa PA01
agcagggugaagcugcggcu

SEQ ID NO: 3437956 - RNA, 23 nt, Pseudomonas aeruginosa PA01
agcagggugacggugaucgccgc

SEQ ID NO: 3437957 - RNA, 13 nt, Pseudomonas aeruginosa PA01
agcagggugcggg

SEQ ID NO: 3437958 - RNA, 14 nt, Pseudomonas aeruginosa PA01
agcaggguggccag

SEQ ID NO: 3437959 - RNA, 15 nt, Pseudomonas aeruginosa PA01
agcaggguggccagg

SEQ ID NO: 3437960 - RNA, 18 nt, Pseudomonas aeruginosa PA01
agcaggguggccaggguc

SEQ ID NO: 3437961 - RNA, 20 nt, Pseudomonas aeruginosa PA01
agcaggguggccaggguccg

SEQ ID NO: 3437962 - RNA, 14 nt, Pseudomonas aeruginosa PA01
agcaggguguugau

SEQ ID NO: 3437963 - RNA, 21 nt, Pseudomonas aeruginosa PA01
agcaggguguugaucaccgcg

SEQ ID NO: 3437964 - RNA, 24 nt, Pseudomonas aeruginosa PA01
agcagguagaccacgcaggccagc

SEQ ID NO: 3437965 - RNA, 20 nt, Pseudomonas aeruginosa PA01
agcagguagccaggggucag

SEQ ID NO: 3437966 - RNA, 18 nt, Pseudomonas aeruginosa PA01
agcagguagugcggcggg

SEQ ID NO: 3437967 - RNA, 12 nt, Pseudomonas aeruginosa PA01
agcaggucacgc

SEQ ID NO: 3437968 - RNA, 22 nt, Pseudomonas aeruginosa PA01
agcaggucacgcccugcaccuu

SEQ ID NO: 3437969 - RNA, 14 nt, Pseudomonas aeruginosa PA01
agcaggucgagcag

SEQ ID NO: 3437970 - RNA, 12 nt, Pseudomonas aeruginosa PA01
agcaggucgagg

SEQ ID NO: 3437971 - RNA, 13 nt, Pseudomonas aeruginosa PA01
agcaggucgaggg

SEQ ID NO: 3437972 - RNA, 16 nt, Pseudomonas aeruginosa PA01
agcaggucgcgcuggg

SEQ ID NO: 3437973 - RNA, 19 nt, Pseudomonas aeruginosa PA01
agcaggucgcgcugggcga

SEQ ID NO: 3437974 - RNA, 11 nt, Pseudomonas aeruginosa PA01
agcaggucggc

SEQ ID NO: 3437975 - RNA, 14 nt, Pseudomonas aeruginosa PA01
agcaggucggcagc

SEQ ID NO: 3437976 - RNA, 13 nt, Pseudomonas aeruginosa PA01
agcaggucggccu

SEQ ID NO: 3437977 - RNA, 18 nt, Pseudomonas aeruginosa PA01
agcaggucggccugcugc

SEQ ID NO: 3437978 - RNA, 15 nt, Pseudomonas aeruginosa PA01
agcaggucggcgcga

SEQ ID NO: 3437979 - RNA, 13 nt, Pseudomonas aeruginosa PA01
agcaggucgucgg

SEQ ID NO: 3437980 - RNA, 14 nt, Pseudomonas aeruginosa PA01
agcaggucucaccg

SEQ ID NO: 3437981 - RNA, 20 nt, Pseudomonas aeruginosa PA01
agcagguggcgcacugccag

SEQ ID NO: 3437982 - RNA, 14 nt, Pseudomonas aeruginosa PA01
agcagguggcuggu

SEQ ID NO: 3437983 - RNA, 17 nt, Pseudomonas aeruginosa PA01
agcagguggcuggucag

SEQ ID NO: 3437984 - RNA, 18 nt, Pseudomonas aeruginosa PA01
agcagguggucgaugggc

SEQ ID NO: 3437985 - RNA, 15 nt, Pseudomonas aeruginosa PA01
agcagguuccuccug

SEQ ID NO: 3437986 - RNA, 19 nt, Pseudomonas aeruginosa PA01
agcagguuccuccugggcc

SEQ ID NO: 3437987 - RNA, 16 nt, Pseudomonas aeruginosa PA01
agcagguugcuggcga

SEQ ID NO: 3437988 - RNA, 15 nt, Pseudomonas aeruginosa PA01
agcagguuggucugc

SEQ ID NO: 3437989 - RNA, 16 nt, Pseudomonas aeruginosa PA01
agcagguuggucugcu

SEQ ID NO: 3437990 - RNA, 17 nt, Pseudomonas aeruginosa PA01
agcagguuggucugcuc

SEQ ID NO: 3437991 - RNA, 17 nt, Pseudomonas aeruginosa PA01
agcagucgcacagccag

SEQ ID NO: 3437992 - RNA, 18 nt, Pseudomonas aeruginosa PA01
agcagucgcacagccagg

SEQ ID NO: 3437993 - RNA, 23 nt, Pseudomonas aeruginosa PA01
agcagucgcacagccaggggcac

SEQ ID NO: 3437994 - RNA, 12 nt, Pseudomonas aeruginosa PA01
agcagucgccug

SEQ ID NO: 3437995 - RNA, 20 nt, Pseudomonas aeruginosa PA01
agcagucguugacggugcug

SEQ ID NO: 3437996 - RNA, 16 nt, Pseudomonas aeruginosa PA01
agcaguuccaggcguc

SEQ ID NO: 3437997 - RNA, 18 nt, Pseudomonas aeruginosa PA01
agcaguuccaggcguccg

SEQ ID NO: 3437998 - RNA, 12 nt, Pseudomonas aeruginosa PA01
agcaguuccccc

SEQ ID NO: 3437999 - RNA, 17 nt, Pseudomonas aeruginosa PA01
agcaguucccccagcac

SEQ ID NO: 3438000 - RNA, 21 nt, Pseudomonas aeruginosa PA01
agcaguucccccagcaccugg

SEQ ID NO: 3438001 - RNA, 21 nt, Pseudomonas aeruginosa PA01
agcaguugcaacagcgcggcg

SEQ ID NO: 3438002 - RNA, 19 nt, Pseudomonas aeruginosa PA01
agcaguugcgggcgcaggu

SEQ ID NO: 3438003 - RNA, 22 nt, Pseudomonas aeruginosa PA01
agcaguugcuggaugucggcga

SEQ ID NO: 3438004 - RNA, 17 nt, Pseudomonas aeruginosa PA01
agcaucaccgcggugga

SEQ ID NO: 3438005 - RNA, 13 nt, Pseudomonas aeruginosa PA01
agcaucaggcgcu

SEQ ID NO: 3438006 - RNA, 14 nt, Pseudomonas aeruginosa PA01
agcaucaggcgcuc

SEQ ID NO: 3438007 - RNA, 23 nt, Pseudomonas aeruginosa PA01
agcaucaggcgcuccgggcucca

SEQ ID NO: 3438008 - RNA, 22 nt, Pseudomonas aeruginosa PA01
agcaucaugaucugguagacca

SEQ ID NO: 3438009 - RNA, 20 nt, Pseudomonas aeruginosa PA01
agcauccacagggucggcag

SEQ ID NO: 3438010 - RNA, 22 nt, Pseudomonas aeruginosa PA01
agcauccagguaaaggccacca

SEQ ID NO: 3438011 - RNA, 20 nt, Pseudomonas aeruginosa PA01
agcaucgccggcagcgccgc

SEQ ID NO: 3438012 - RNA, 14 nt, Pseudomonas aeruginosa PA01
agcaucucgccggc

SEQ ID NO: 3438013 - RNA, 17 nt, Pseudomonas aeruginosa PA01
agcaucucggccaggcc

SEQ ID NO: 3438014 - RNA, 19 nt, Pseudomonas aeruginosa PA01
agcaucucggugcgcccca

SEQ ID NO: 3438015 - RNA, 15 nt, Pseudomonas aeruginosa PA01
agcaucugccgggcg

SEQ ID NO: 3438016 - RNA, 15 nt, Pseudomonas aeruginosa PA01
agcaucugcuggucc

SEQ ID NO: 3438017 - RNA, 19 nt, Pseudomonas aeruginosa PA01
agcaucugggucuucagcu

SEQ ID NO: 3438018 - RNA, 17 nt, Pseudomonas aeruginosa PA01
agcaugaagugccauug

SEQ ID NO: 3438019 - RNA, 21 nt, Pseudomonas aeruginosa PA01
agcaugaugcaggcagugugc

SEQ ID NO: 3438020 - RNA, 14 nt, Pseudomonas aeruginosa PA01
agcaugauggugcc

SEQ ID NO: 3438021 - RNA, 21 nt, Pseudomonas aeruginosa PA01
agcaugcccagcguggccagc

SEQ ID NO: 3438022 - RNA, 18 nt, Pseudomonas aeruginosa PA01
agcaugccgaggaacgcc

SEQ ID NO: 3438023 - RNA, 22 nt, Pseudomonas aeruginosa PA01
agcaugccgaggaacgccgaca

SEQ ID NO: 3438024 - RNA, 18 nt, Pseudomonas aeruginosa PA01
agcaugcucgggcugccg

SEQ ID NO: 3438025 - RNA, 19 nt, Pseudomonas aeruginosa PA01
agcauggcgggccauugca

SEQ ID NO: 3438026 - RNA, 22 nt, Pseudomonas aeruginosa PA01
agcauggcgggccauugcaggu

SEQ ID NO: 3438027 - RNA, 15 nt, Pseudomonas aeruginosa PA01
agcaugggauggcgc

SEQ ID NO: 3438028 - RNA, 16 nt, Pseudomonas aeruginosa PA01
agcauggugaaaccga

SEQ ID NO: 3438029 - RNA, 14 nt, Pseudomonas aeruginosa PA01
agcaugucgccggg

SEQ ID NO: 3438030 - RNA, 20 nt, Pseudomonas aeruginosa PA01
agcaugucgcugaaacgcgc

SEQ ID NO: 3438031 - RNA, 20 nt, Pseudomonas aeruginosa PA01
agcauuccucagcgccggua

SEQ ID NO: 3438032 - RNA, 14 nt, Pseudomonas aeruginosa PA01
agcauucuggaugc

SEQ ID NO: 3438033 - RNA, 14 nt, Pseudomonas aeruginosa PA01
agcauuucuucacc

SEQ ID NO: 3438034 - RNA, 21 nt, Pseudomonas aeruginosa PA01
agccaacccucggaugccgca

SEQ ID NO: 3438035 - RNA, 18 nt, Pseudomonas aeruginosa PA01
agccaaccgucgcccugg

SEQ ID NO: 3438036 - RNA, 21 nt, Pseudomonas aeruginosa PA01
agccaaccgucgcccuggugc

SEQ ID NO: 3438037 - RNA, 14 nt, Pseudomonas aeruginosa PA01
agccaacgcccggg

SEQ ID NO: 3438038 - RNA, 18 nt, Pseudomonas aeruginosa PA01
agccaacgcccgggccgg

SEQ ID NO: 3438039 - RNA, 14 nt, Pseudomonas aeruginosa PA01
agccaagccaccag

SEQ ID NO: 3438040 - RNA, 18 nt, Pseudomonas aeruginosa PA01
agccccagcccagggcga

SEQ ID NO: 3438041 - RNA, 15 nt, Pseudomonas aeruginosa PA01
agccccagccucggc

SEQ ID NO: 3438042 - RNA, 16 nt, Pseudomonas aeruginosa PA01
agccccaugccguuca

SEQ ID NO: 3438043 - RNA, 13 nt, Pseudomonas aeruginosa PA01
agcccccaggcac

SEQ ID NO: 3438044 - RNA, 21 nt, Pseudomonas aeruginosa PA01
agcccccaugaaaaaggcgcc

SEQ ID NO: 3438045 - RNA, 17 nt, Pseudomonas aeruginosa PA01
agcccccggcgcccaga

SEQ ID NO: 3438046 - RNA, 22 nt, Pseudomonas aeruginosa PA01
agcccccggcgcccagaaaaaa

SEQ ID NO: 3438047 - RNA, 15 nt, Pseudomonas aeruginosa PA01
agccccgaggccagc

SEQ ID NO: 3438048 - RNA, 16 nt, Pseudomonas aeruginosa PA01
agccccgaggccagca

SEQ ID NO: 3438049 - RNA, 19 nt, Pseudomonas aeruginosa PA01
agccccgaggccagcaggc

SEQ ID NO: 3438050 - RNA, 15 nt, Pseudomonas aeruginosa PA01
agccccgcaucgcgg

SEQ ID NO: 3438051 - RNA, 21 nt, Pseudomonas aeruginosa PA01
agccccgcguucgcggggcuu

SEQ ID NO: 3438052 - RNA, 21 nt, Pseudomonas aeruginosa PA01
agccccgcuucggcggggcuu

SEQ ID NO: 3438053 - RNA, 21 nt, Pseudomonas aeruginosa PA01
agccccggcaggcaggccugg

SEQ ID NO: 3438054 - RNA, 11 nt, Pseudomonas aeruginosa PA01
agccccggcau

SEQ ID NO: 3438055 - RNA, 18 nt, Pseudomonas aeruginosa PA01
agccccggcaucgccggg

SEQ ID NO: 3438056 - RNA, 18 nt, Pseudomonas aeruginosa PA01
agccccgguuacucgccg

SEQ ID NO: 3438057 - RNA, 21 nt, Pseudomonas aeruginosa PA01
agccccucgccauucucgcca

SEQ ID NO: 3438058 - RNA, 23 nt, Pseudomonas aeruginosa PA01
agccccucgcgcaucuggcugcg

SEQ ID NO: 3438059 - RNA, 24 nt, Pseudomonas aeruginosa PA01
agccccugcgaccgugaggcgcag

SEQ ID NO: 3438060 - RNA, 13 nt, Pseudomonas aeruginosa PA01
agccccugcgccu

SEQ ID NO: 3438061 - RNA, 14 nt, Pseudomonas aeruginosa PA01
agccccugcgccuc

SEQ ID NO: 3438062 - RNA, 13 nt, Pseudomonas aeruginosa PA01
agccccuggcgcu

SEQ ID NO: 3438063 - RNA, 21 nt, Pseudomonas aeruginosa PA01
agccccuugcgcucuggcgca

SEQ ID NO: 3438064 - RNA, 16 nt, Pseudomonas aeruginosa PA01
agcccgagugcgccca

SEQ ID NO: 3438065 - RNA, 19 nt, Pseudomonas aeruginosa PA01
agcccgagugcgcccagca

SEQ ID NO: 3438066 - RNA, 21 nt, Pseudomonas aeruginosa PA01
agcccgauccguagggcgaau

SEQ ID NO: 3438067 - RNA, 20 nt, Pseudomonas aeruginosa PA01
agcccgcaauccgaccgggg

SEQ ID NO: 3438068 - RNA, 21 nt, Pseudomonas aeruginosa PA01
agcccgcaauccgaccgggga

SEQ ID NO: 3438069 - RNA, 21 nt, Pseudomonas aeruginosa PA01
agcccgcacgaggcgggcugg

SEQ ID NO: 3438070 - RNA, 22 nt, Pseudomonas aeruginosa PA01
agcccgccaccgacccucggcg

SEQ ID NO: 3438071 - RNA, 23 nt, Pseudomonas aeruginosa PA01
agcccgccaccgacccucggcga

SEQ ID NO: 3438072 - RNA, 16 nt, Pseudomonas aeruginosa PA01
agcccgccaccuggcg

SEQ ID NO: 3438073 - RNA, 17 nt, Pseudomonas aeruginosa PA01
agcccgccaccuggcgg

SEQ ID NO: 3438074 - RNA, 19 nt, Pseudomonas aeruginosa PA01
agcccgccaccuggcgggc

SEQ ID NO: 3438075 - RNA, 18 nt, Pseudomonas aeruginosa PA01
agcccgccagguggcggg

SEQ ID NO: 3438076 - RNA, 19 nt, Pseudomonas aeruginosa PA01
agcccgccagguggcgggc

SEQ ID NO: 3438077 - RNA, 21 nt, Pseudomonas aeruginosa PA01
agcccgccuugauggcgggcu

SEQ ID NO: 3438078 - RNA, 17 nt, Pseudomonas aeruginosa PA01
agcccgcgccgcgaggg

SEQ ID NO: 3438079 - RNA, 19 nt, Pseudomonas aeruginosa PA01
agcccgcgcgacagcucug

SEQ ID NO: 3438080 - RNA, 20 nt, Pseudomonas aeruginosa PA01
agcccgcgcgacagcucugg

SEQ ID NO: 3438081 - RNA, 17 nt, Pseudomonas aeruginosa PA01
agcccgcgcucggccgc

SEQ ID NO: 3438082 - RNA, 23 nt, Pseudomonas aeruginosa PA01
agcccgcgcucggccgccuggcg

SEQ ID NO: 3438083 - RNA, 16 nt, Pseudomonas aeruginosa PA01
agcccgcggcgagcag

SEQ ID NO: 3438084 - RNA, 23 nt, Pseudomonas aeruginosa PA01
agcccgcggcgagcagcggcgcu

SEQ ID NO: 3438085 - RNA, 14 nt, Pseudomonas aeruginosa PA01
agcccgcugaccgg

SEQ ID NO: 3438086 - RNA, 18 nt, Pseudomonas aeruginosa PA01
agcccgcuuuccccggcg

SEQ ID NO: 3438087 - RNA, 15 nt, Pseudomonas aeruginosa PA01
agcccggcagcuccc

SEQ ID NO: 3438088 - RNA, 16 nt, Pseudomonas aeruginosa PA01
agcccggcaggucgag

SEQ ID NO: 3438089 - RNA, 19 nt, Pseudomonas aeruginosa PA01
agcccggcaggucgaggac

SEQ ID NO: 3438090 - RNA, 15 nt, Pseudomonas aeruginosa PA01
agcccggccgcugcc

SEQ ID NO: 3438091 - RNA, 18 nt, Pseudomonas aeruginosa PA01
agcccggccgcugccggg

SEQ ID NO: 3438092 - RNA, 14 nt, Pseudomonas aeruginosa PA01
agcccggccucgcc

SEQ ID NO: 3438093 - RNA, 16 nt, Pseudomonas aeruginosa PA01
agcccggccucgccgg

SEQ ID NO: 3438094 - RNA, 17 nt, Pseudomonas aeruginosa PA01
agcccggccucgccggu

SEQ ID NO: 3438095 - RNA, 12 nt, Pseudomonas aeruginosa PA01
agcccggccugg

SEQ ID NO: 3438096 - RNA, 21 nt, Pseudomonas aeruginosa PA01
agcccggccuggaucucugcg

SEQ ID NO: 3438097 - RNA, 13 nt, Pseudomonas aeruginosa PA01
agcccggcgagag

SEQ ID NO: 3438098 - RNA, 18 nt, Pseudomonas aeruginosa PA01
agcccggcgagagcgucc

SEQ ID NO: 3438099 - RNA, 13 nt, Pseudomonas aeruginosa PA01
agcccggcggcgg

SEQ ID NO: 3438100 - RNA, 20 nt, Pseudomonas aeruginosa PA01
agcccggcgugggcggucgg

SEQ ID NO: 3438101 - RNA, 18 nt, Pseudomonas aeruginosa PA01
agcccgggcaacugccga

SEQ ID NO: 3438102 - RNA, 19 nt, Pseudomonas aeruginosa PA01
agcccgggcaacugccgau

SEQ ID NO: 3438103 - RNA, 18 nt, Pseudomonas aeruginosa PA01
agcccggguugcccucgc

SEQ ID NO: 3438104 - RNA, 22 nt, Pseudomonas aeruginosa PA01
agcccggguugcccucgcagcc

SEQ ID NO: 3438105 - RNA, 23 nt, Pseudomonas aeruginosa PA01
agcccgguccguccagcgcgccc

SEQ ID NO: 3438106 - RNA, 15 nt, Pseudomonas aeruginosa PA01
agcccgguucagcgg

SEQ ID NO: 3438107 - RNA, 21 nt, Pseudomonas aeruginosa PA01
agcccguagucguucagcgcc

SEQ ID NO: 3438108 - RNA, 22 nt, Pseudomonas aeruginosa PA01
agcccguagucguucagcgccu

SEQ ID NO: 3438109 - RNA, 14 nt, Pseudomonas aeruginosa PA01
agcccgucgaagcc

SEQ ID NO: 3438110 - RNA, 20 nt, Pseudomonas aeruginosa PA01
agcccgucgaagccaggcac

SEQ ID NO: 3438111 - RNA, 21 nt, Pseudomonas aeruginosa PA01
agcccgugggaucgccacgcc

SEQ ID NO: 3438112 - RNA, 24 nt, Pseudomonas aeruginosa PA01
agcccgugggaucgccacgccggc

SEQ ID NO: 3438113 - RNA, 20 nt, Pseudomonas aeruginosa PA01
agcccguguucggccagccg

SEQ ID NO: 3438114 - RNA, 23 nt, Pseudomonas aeruginosa PA01
agcccguugcgguagugcccggu

SEQ ID NO: 3438115 - RNA, 14 nt, Pseudomonas aeruginosa PA01
agcccucgaccugg

SEQ ID NO: 3438116 - RNA, 12 nt, Pseudomonas aeruginosa PA01
agcccucggccc

SEQ ID NO: 3438117 - RNA, 14 nt, Pseudomonas aeruginosa PA01
agcccucggcccgg

SEQ ID NO: 3438118 - RNA, 16 nt, Pseudomonas aeruginosa PA01
agcccugcaaagcggc

SEQ ID NO: 3438119 - RNA, 18 nt, Pseudomonas aeruginosa PA01
agcccugcugcucgccau

SEQ ID NO: 3438120 - RNA, 13 nt, Pseudomonas aeruginosa PA01
agcccugcuggcg

SEQ ID NO: 3438121 - RNA, 21 nt, Pseudomonas aeruginosa PA01
agcccugcuggcgcagccagg

SEQ ID NO: 3438122 - RNA, 23 nt, Pseudomonas aeruginosa PA01
agcccugcuggcgcagccaggcg

SEQ ID NO: 3438123 - RNA, 17 nt, Pseudomonas aeruginosa PA01
agcccuggaaaggccuc

SEQ ID NO: 3438124 - RNA, 19 nt, Pseudomonas aeruginosa PA01
agcccuggcgcagacaggc

SEQ ID NO: 3438125 - RNA, 18 nt, Pseudomonas aeruginosa PA01
agcccuggcguggccggc

SEQ ID NO: 3438126 - RNA, 16 nt, Pseudomonas aeruginosa PA01
agcccugggcgaugcg

SEQ ID NO: 3438127 - RNA, 21 nt, Pseudomonas aeruginosa PA01
agcccugguaggugcgcuggc

SEQ ID NO: 3438128 - RNA, 16 nt, Pseudomonas aeruginosa PA01
agcccugguggugauc

SEQ ID NO: 3438129 - RNA, 13 nt, Pseudomonas aeruginosa PA01
agcccuucgacgu

SEQ ID NO: 3438130 - RNA, 14 nt, Pseudomonas aeruginosa PA01
agcccuucgcgcuc

SEQ ID NO: 3438131 - RNA, 16 nt, Pseudomonas aeruginosa PA01
agcccuucgcgcucga

SEQ ID NO: 3438132 - RNA, 15 nt, Pseudomonas aeruginosa PA01
agcccuucuccgcca

SEQ ID NO: 3438133 - RNA, 17 nt, Pseudomonas aeruginosa PA01
agcccuucuccgccagc

SEQ ID NO: 3438134 - RNA, 19 nt, Pseudomonas aeruginosa PA01
agcccuucuccgccagcca

SEQ ID NO: 3438135 - RNA, 23 nt, Pseudomonas aeruginosa PA01
agcccuucuccgccagccagccg

SEQ ID NO: 3438136 - RNA, 23 nt, Pseudomonas aeruginosa PA01
agcccuucugucuuguccucauc

SEQ ID NO: 3438137 - RNA, 14 nt, Pseudomonas aeruginosa PA01
agcccuugauccac

SEQ ID NO: 3438138 - RNA, 14 nt, Pseudomonas aeruginosa PA01
agcccuugcaaccg

SEQ ID NO: 3438139 - RNA, 20 nt, Pseudomonas aeruginosa PA01
agcccuuuucaauuccgccg

SEQ ID NO: 3438140 - RNA, 21 nt, Pseudomonas aeruginosa PA01
agcccuuuucaauuccgccgc

SEQ ID NO: 3438141 - RNA, 22 nt, Pseudomonas aeruginosa PA01
agcccuuuucaauuccgccgcg

SEQ ID NO: 3438142 - RNA, 12 nt, Pseudomonas aeruginosa PA01
agccgaacuccg

SEQ ID NO: 3438143 - RNA, 21 nt, Pseudomonas aeruginosa PA01
agccgaacuccgccagcacca

SEQ ID NO: 3438144 - RNA, 20 nt, Pseudomonas aeruginosa PA01
agccgaagucggcguagugc

SEQ ID NO: 3438145 - RNA, 16 nt, Pseudomonas aeruginosa PA01
agccgacauccugucg

SEQ ID NO: 3438146 - RNA, 20 nt, Pseudomonas aeruginosa PA01
agccgacauccugucgaggc

SEQ ID NO: 3438147 - RNA, 14 nt, Pseudomonas aeruginosa PA01
agccgaccaccuuc

SEQ ID NO: 3438148 - RNA, 19 nt, Pseudomonas aeruginosa PA01
agccgaccaccuucaggcu

SEQ ID NO: 3438149 - RNA, 20 nt, Pseudomonas aeruginosa PA01
agccgaccaccuucaggcug

SEQ ID NO: 3438150 - RNA, 13 nt, Pseudomonas aeruginosa PA01
agccgaccggcgc

SEQ ID NO: 3438151 - RNA, 18 nt, Pseudomonas aeruginosa PA01
agccgaccggcgccggga

SEQ ID NO: 3438152 - RNA, 13 nt, Pseudomonas aeruginosa PA01
agccgacuggcgg

SEQ ID NO: 3438153 - RNA, 18 nt, Pseudomonas aeruginosa PA01
agccgagcaacucggcgg

SEQ ID NO: 3438154 - RNA, 19 nt, Pseudomonas aeruginosa PA01
agccgagcaacucggcggc

SEQ ID NO: 3438155 - RNA, 14 nt, Pseudomonas aeruginosa PA01
agccgagcaggcca

SEQ ID NO: 3438156 - RNA, 21 nt, Pseudomonas aeruginosa PA01
agccgagcaugucgcuccaga

SEQ ID NO: 3438157 - RNA, 19 nt, Pseudomonas aeruginosa PA01
agccgagcccccauaccgc

SEQ ID NO: 3438158 - RNA, 14 nt, Pseudomonas aeruginosa PA01
agccgagcugccgg

SEQ ID NO: 3438159 - RNA, 15 nt, Pseudomonas aeruginosa PA01
agccgagcugccggg

SEQ ID NO: 3438160 - RNA, 16 nt, Pseudomonas aeruginosa PA01
agccgaggcagccguc

SEQ ID NO: 3438161 - RNA, 13 nt, Pseudomonas aeruginosa PA01
agccgaggcggcc

SEQ ID NO: 3438162 - RNA, 14 nt, Pseudomonas aeruginosa PA01
agccgaggcggccg

SEQ ID NO: 3438163 - RNA, 18 nt, Pseudomonas aeruginosa PA01
agccgaggcuuuccagca

SEQ ID NO: 3438164 - RNA, 20 nt, Pseudomonas aeruginosa PA01
agccgaggcuuuccagcagg

SEQ ID NO: 3438165 - RNA, 17 nt, Pseudomonas aeruginosa PA01
agccgaggucgccgcca

SEQ ID NO: 3438166 - RNA, 23 nt, Pseudomonas aeruginosa PA01
agccgaggugguauugcagcucg

SEQ ID NO: 3438167 - RNA, 21 nt, Pseudomonas aeruginosa PA01
agccgagguucuugcccagca

SEQ ID NO: 3438168 - RNA, 22 nt, Pseudomonas aeruginosa PA01
agccgagguucuugcccagcaa

SEQ ID NO: 3438169 - RNA, 15 nt, Pseudomonas aeruginosa PA01
agccgauacccuggg

SEQ ID NO: 3438170 - RNA, 23 nt, Pseudomonas aeruginosa PA01
agccgauacccugggagccgccg

SEQ ID NO: 3438171 - RNA, 20 nt, Pseudomonas aeruginosa PA01
agccgaucaacgcggccagc

SEQ ID NO: 3438172 - RNA, 17 nt, Pseudomonas aeruginosa PA01
agccgaucaccaccagc

SEQ ID NO: 3438173 - RNA, 16 nt, Pseudomonas aeruginosa PA01
agccgaucaccagcaa

SEQ ID NO: 3438174 - RNA, 17 nt, Pseudomonas aeruginosa PA01
agccgaucaccagcaau

SEQ ID NO: 3438175 - RNA, 13 nt, Pseudomonas aeruginosa PA01
agccgaucggcau

SEQ ID NO: 3438176 - RNA, 20 nt, Pseudomonas aeruginosa PA01
agccgaugaaauagccggcg

SEQ ID NO: 3438177 - RNA, 23 nt, Pseudomonas aeruginosa PA01
agccgaugcucgcgccagcccca

SEQ ID NO: 3438178 - RNA, 12 nt, Pseudomonas aeruginosa PA01
agccgcaaggcc

SEQ ID NO: 3438179 - RNA, 15 nt, Pseudomonas aeruginosa PA01
agccgcaaggccagg

SEQ ID NO: 3438180 - RNA, 16 nt, Pseudomonas aeruginosa PA01
agccgcaaggccaggg

SEQ ID NO: 3438181 - RNA, 20 nt, Pseudomonas aeruginosa PA01
agccgcaaggccagggcggc

SEQ ID NO: 3438182 - RNA, 21 nt, Pseudomonas aeruginosa PA01
agccgcaaggccagggcggcg

SEQ ID NO: 3438183 - RNA, 13 nt, Pseudomonas aeruginosa PA01
agccgcacuucca

SEQ ID NO: 3438184 - RNA, 18 nt, Pseudomonas aeruginosa PA01
agccgcacuuccaggcgc

SEQ ID NO: 3438185 - RNA, 14 nt, Pseudomonas aeruginosa PA01
agccgcagaugcuc

SEQ ID NO: 3438186 - RNA, 15 nt, Pseudomonas aeruginosa PA01
agccgcagcccgguc

SEQ ID NO: 3438187 - RNA, 13 nt, Pseudomonas aeruginosa PA01
agccgcagcgccc

SEQ ID NO: 3438188 - RNA, 15 nt, Pseudomonas aeruginosa PA01
agccgcagcgccccu

SEQ ID NO: 3438189 - RNA, 20 nt, Pseudomonas aeruginosa PA01
agccgcagcgccccucccag

SEQ ID NO: 3438190 - RNA, 22 nt, Pseudomonas aeruginosa PA01
agccgcagcgccccucccagcc

SEQ ID NO: 3438191 - RNA, 20 nt, Pseudomonas aeruginosa PA01
agccgcaggaugccgccugc

SEQ ID NO: 3438192 - RNA, 15 nt, Pseudomonas aeruginosa PA01
agccgcaggcugccg

SEQ ID NO: 3438193 - RNA, 21 nt, Pseudomonas aeruginosa PA01
agccgcaggcugccguccagg

SEQ ID NO: 3438194 - RNA, 11 nt, Pseudomonas aeruginosa PA01
agccgcagggu

SEQ ID NO: 3438195 - RNA, 16 nt, Pseudomonas aeruginosa PA01
agccgcaguccagggc

SEQ ID NO: 3438196 - RNA, 18 nt, Pseudomonas aeruginosa PA01
agccgcaguccagggcga

SEQ ID NO: 3438197 - RNA, 18 nt, Pseudomonas aeruginosa PA01
agccgccaucaccagcgg

SEQ ID NO: 3438198 - RNA, 13 nt, Pseudomonas aeruginosa PA01
agccgcccaccgc

SEQ ID NO: 3438199 - RNA, 18 nt, Pseudomonas aeruginosa PA01
agccgcccacgggcggcu

SEQ ID NO: 3438200 - RNA, 21 nt, Pseudomonas aeruginosa PA01
agccgccccaccaccaucgcc

SEQ ID NO: 3438201 - RNA, 15 nt, Pseudomonas aeruginosa PA01
agccgcccucggggc

SEQ ID NO: 3438202 - RNA, 22 nt, Pseudomonas aeruginosa PA01
agccgcccucggggccgagguc

SEQ ID NO: 3438203 - RNA, 21 nt, Pseudomonas aeruginosa PA01
agccgcccuggcucugggcca

SEQ ID NO: 3438204 - RNA, 23 nt, Pseudomonas aeruginosa PA01
agccgcccuuuuccggauacaug

SEQ ID NO: 3438205 - RNA, 21 nt, Pseudomonas aeruginosa PA01
agccgccgaagggccgcaggu

SEQ ID NO: 3438206 - RNA, 15 nt, Pseudomonas aeruginosa PA01
agccgccgcccagca

SEQ ID NO: 3438207 - RNA, 17 nt, Pseudomonas aeruginosa PA01
agccgccgcccagcagc

SEQ ID NO: 3438208 - RNA, 19 nt, Pseudomonas aeruginosa PA01
agccgccgccgagaacccg

SEQ ID NO: 3438209 - RNA, 17 nt, Pseudomonas aeruginosa PA01
agccgccgcugcaccga

SEQ ID NO: 3438210 - RNA, 20 nt, Pseudomonas aeruginosa PA01
agccgccgggacccugguag

SEQ ID NO: 3438211 - RNA, 16 nt, Pseudomonas aeruginosa PA01
agccgccgggcggcgu

SEQ ID NO: 3438212 - RNA, 18 nt, Pseudomonas aeruginosa PA01
agccgccguugaugacga

SEQ ID NO: 3438213 - RNA, 23 nt, Pseudomonas aeruginosa PA01
agccgccguugaugacgaacugc

SEQ ID NO: 3438214 - RNA, 14 nt, Pseudomonas aeruginosa PA01
agccgccugcggcg

SEQ ID NO: 3438215 - RNA, 18 nt, Pseudomonas aeruginosa PA01
agccgccuucgggcggcu

SEQ ID NO: 3438216 - RNA, 21 nt, Pseudomonas aeruginosa PA01
agccgccuucgggcggcuugu

SEQ ID NO: 3438217 - RNA, 20 nt, Pseudomonas aeruginosa PA01
agccgcgacgacugcggcag

SEQ ID NO: 3438218 - RNA, 17 nt, Pseudomonas aeruginosa PA01
agccgcgacggcugcuc

SEQ ID NO: 3438219 - RNA, 19 nt, Pseudomonas aeruginosa PA01
agccgcgacggcugcuccg

SEQ ID NO: 3438220 - RNA, 24 nt, Pseudomonas aeruginosa PA01
agccgcgcaaccguuccagcgccu

SEQ ID NO: 3438221 - RNA, 22 nt, Pseudomonas aeruginosa PA01
agccgcgccaucggucgcgccc

SEQ ID NO: 3438222 - RNA, 12 nt, Pseudomonas aeruginosa PA01
agccgcgcccca

SEQ ID NO: 3438223 - RNA, 14 nt, Pseudomonas aeruginosa PA01
agccgcgccggccg

SEQ ID NO: 3438224 - RNA, 19 nt, Pseudomonas aeruginosa PA01
agccgcgccggccguccca

SEQ ID NO: 3438225 - RNA, 18 nt, Pseudomonas aeruginosa PA01
agccgcgccuucgagcgc

SEQ ID NO: 3438226 - RNA, 22 nt, Pseudomonas aeruginosa PA01
agccgcgccuucgagcgcgguu

SEQ ID NO: 3438227 - RNA, 13 nt, Pseudomonas aeruginosa PA01
agccgcgcgccga

SEQ ID NO: 3438228 - RNA, 22 nt, Pseudomonas aeruginosa PA01
agccgcgcgccgaguuggccca

SEQ ID NO: 3438229 - RNA, 21 nt, Pseudomonas aeruginosa PA01
agccgcgcggcauagcgcagc

SEQ ID NO: 3438230 - RNA, 14 nt, Pseudomonas aeruginosa PA01
agccgcggaucacc

SEQ ID NO: 3438231 - RNA, 12 nt, Pseudomonas aeruginosa PA01
agccgcggccgg

SEQ ID NO: 3438232 - RNA, 20 nt, Pseudomonas aeruginosa PA01
agccgcggccggggaacagg

SEQ ID NO: 3438233 - RNA, 22 nt, Pseudomonas aeruginosa PA01
agccgcggccguuguccagggu

SEQ ID NO: 3438234 - RNA, 14 nt, Pseudomonas aeruginosa PA01
agccgcgugcgcgc

SEQ ID NO: 3438235 - RNA, 19 nt, Pseudomonas aeruginosa PA01
agccgcgugcgcgccgccg

SEQ ID NO: 3438236 - RNA, 22 nt, Pseudomonas aeruginosa PA01
agccgcgugcgcgccgccgggc

SEQ ID NO: 3438237 - RNA, 23 nt, Pseudomonas aeruginosa PA01
agccgcgugcgcgccgccgggcg

SEQ ID NO: 3438238 - RNA, 18 nt, Pseudomonas aeruginosa PA01
agccgcucgcguccgcag

SEQ ID NO: 3438239 - RNA, 13 nt, Pseudomonas aeruginosa PA01
agccgcucggcgg

SEQ ID NO: 3438240 - RNA, 21 nt, Pseudomonas aeruginosa PA01
agccgcucggcguagccggcg

SEQ ID NO: 3438241 - RNA, 17 nt, Pseudomonas aeruginosa PA01
agccgcugcagggcggc

SEQ ID NO: 3438242 - RNA, 17 nt, Pseudomonas aeruginosa PA01
agccgcugcggcucgcc

SEQ ID NO: 3438243 - RNA, 20 nt, Pseudomonas aeruginosa PA01
agccgcugcggcucgccgau

SEQ ID NO: 3438244 - RNA, 15 nt, Pseudomonas aeruginosa PA01
agccguucgcuggac

SEQ ID NO: 3438245 - RNA, 20 nt, Pseudomonas aeruginosa PA01
agccguucgcuggacaggcg

SEQ ID NO: 3438246 - RNA, 22 nt, Pseudomonas aeruginosa PA01
agccguugaaacgcucggcguc

SEQ ID NO: 3438247 - RNA, 17 nt, Pseudomonas aeruginosa PA01
agccguugaggccgucg

SEQ ID NO: 3438248 - RNA, 14 nt, Pseudomonas aeruginosa PA01
agccguuggccagc

SEQ ID NO: 3438249 - RNA, 15 nt, Pseudomonas aeruginosa PA01
agccguuggccagca

SEQ ID NO: 3438250 - RNA, 16 nt, Pseudomonas aeruginosa PA01
agccguuggccagcag

SEQ ID NO: 3438251 - RNA, 18 nt, Pseudomonas aeruginosa PA01
agccguuggccagcaggc

SEQ ID NO: 3438252 - RNA, 19 nt, Pseudomonas aeruginosa PA01
agccguuguagaucggcag

SEQ ID NO: 3438253 - RNA, 18 nt, Pseudomonas aeruginosa PA01
agccuaccauuagaggaa

SEQ ID NO: 3438254 - RNA, 16 nt, Pseudomonas aeruginosa PA01
agccucaagccucgcc

SEQ ID NO: 3438255 - RNA, 12 nt, Pseudomonas aeruginosa PA01
agccucacccug

SEQ ID NO: 3438256 - RNA, 14 nt, Pseudomonas aeruginosa PA01
agccucacccugcu

SEQ ID NO: 3438257 - RNA, 18 nt, Pseudomonas aeruginosa PA01
agccucacccugcugggc

SEQ ID NO: 3438258 - RNA, 20 nt, Pseudomonas aeruginosa PA01
agccucacccugcugggcgg

SEQ ID NO: 3438259 - RNA, 16 nt, Pseudomonas aeruginosa PA01
agccucaggcgcugcg

SEQ ID NO: 3438260 - RNA, 21 nt, Pseudomonas aeruginosa PA01
agccucaggcgcugcgcggcc

SEQ ID NO: 3438261 - RNA, 14 nt, Pseudomonas aeruginosa PA01
agccuccacccgga

SEQ ID NO: 3438262 - RNA, 14 nt, Pseudomonas aeruginosa PA01
agccuccagcagcu

SEQ ID NO: 3438263 - RNA, 11 nt, Pseudomonas aeruginosa PA01
agccuccagcg

SEQ ID NO: 3438264 - RNA, 15 nt, Pseudomonas aeruginosa PA01
agccuccuccggcuc

SEQ ID NO: 3438265 - RNA, 22 nt, Pseudomonas aeruginosa PA01
agccuccuccggcucgcugacg

SEQ ID NO: 3438266 - RNA, 14 nt, Pseudomonas aeruginosa PA01
agccucggcagggc

SEQ ID NO: 3438267 - RNA, 21 nt, Pseudomonas aeruginosa PA01
agccucggcagggcgcccgcc

SEQ ID NO: 3438268 - RNA, 12 nt, Pseudomonas aeruginosa PA01
agccucggcgaa

SEQ ID NO: 3438269 - RNA, 15 nt, Pseudomonas aeruginosa PA01
agccucggcgaaguc

SEQ ID NO: 3438270 - RNA, 17 nt, Pseudomonas aeruginosa PA01
agccucuaaggaaaaac

SEQ ID NO: 3438271 - RNA, 22 nt, Pseudomonas aeruginosa PA01
agccucuaaggaaaaacccggc

SEQ ID NO: 3438272 - RNA, 14 nt, Pseudomonas aeruginosa PA01
agccugcagccagc

SEQ ID NO: 3438273 - RNA, 21 nt, Pseudomonas aeruginosa PA01
agccugccgggcaagcucgac

SEQ ID NO: 3438274 - RNA, 23 nt, Pseudomonas aeruginosa PA01
agccugccgggcaagcucgacga

SEQ ID NO: 3438275 - RNA, 15 nt, Pseudomonas aeruginosa PA01
agccugcggccagcg

SEQ ID NO: 3438276 - RNA, 13 nt, Pseudomonas aeruginosa PA01
agccugcggcgag

SEQ ID NO: 3438277 - RNA, 16 nt, Pseudomonas aeruginosa PA01
agccugcgugagcugg

SEQ ID NO: 3438278 - RNA, 22 nt, Pseudomonas aeruginosa PA01
agccugcgugagcugggcaggc

SEQ ID NO: 3438279 - RNA, 14 nt, Pseudomonas aeruginosa PA01
agccugcuggccug

SEQ ID NO: 3438280 - RNA, 16 nt, Pseudomonas aeruginosa PA01
agccugcuggccuggg

SEQ ID NO: 3438281 - RNA, 18 nt, Pseudomonas aeruginosa PA01
agccugcuggccugggac

SEQ ID NO: 3438282 - RNA, 17 nt, Pseudomonas aeruginosa PA01
agccuggagcagggcgc

SEQ ID NO: 3438283 - RNA, 21 nt, Pseudomonas aeruginosa PA01
agccuggauacgggcgccagg

SEQ ID NO: 3438284 - RNA, 12 nt, Pseudomonas aeruginosa PA01
agccuggccagc

SEQ ID NO: 3438285 - RNA, 22 nt, Pseudomonas aeruginosa PA01
agccuggccagcgcuucgcgau

SEQ ID NO: 3438286 - RNA, 14 nt, Pseudomonas aeruginosa PA01
agccuggccaggcg

SEQ ID NO: 3438287 - RNA, 15 nt, Pseudomonas aeruginosa PA01
agccuggccaggcgc

SEQ ID NO: 3438288 - RNA, 16 nt, Pseudomonas aeruginosa PA01
agccuggccaggcgcu

SEQ ID NO: 3438289 - RNA, 19 nt, Pseudomonas aeruginosa PA01
agccuggcgcgcugcggca

SEQ ID NO: 3438290 - RNA, 18 nt, Pseudomonas aeruginosa PA01
agccuggcgucgcacugc

SEQ ID NO: 3438291 - RNA, 13 nt, Pseudomonas aeruginosa PA01
agccugggcggcu

SEQ ID NO: 3438292 - RNA, 16 nt, Pseudomonas aeruginosa PA01
agccuucagcacggcg

SEQ ID NO: 3438293 - RNA, 14 nt, Pseudomonas aeruginosa PA01
agccuucccggcgc

SEQ ID NO: 3438294 - RNA, 15 nt, Pseudomonas aeruginosa PA01
agccuuccggcacca

SEQ ID NO: 3438295 - RNA, 18 nt, Pseudomonas aeruginosa PA01
agccuuccuucucgaagc

SEQ ID NO: 3438296 - RNA, 19 nt, Pseudomonas aeruginosa PA01
agccuuccuucucgaagcc

SEQ ID NO: 3438297 - RNA, 14 nt, Pseudomonas aeruginosa PA01
agccuucgagccac

SEQ ID NO: 3438298 - RNA, 16 nt, Pseudomonas aeruginosa PA01
agccuucgagccacuc

SEQ ID NO: 3438299 - RNA, 22 nt, Pseudomonas aeruginosa PA01
agccuucgcaaagcgagcgccc

SEQ ID NO: 3438300 - RNA, 12 nt, Pseudomonas aeruginosa PA01
agccuucgcccg

SEQ ID NO: 3438301 - RNA, 21 nt, Pseudomonas aeruginosa PA01
agccuucgucgaugaacagcg

SEQ ID NO: 3438302 - RNA, 19 nt, Pseudomonas aeruginosa PA01
agccuugcuggacuucccg

SEQ ID NO: 3438303 - RNA, 14 nt, Pseudomonas aeruginosa PA01
agccuuggccacgg

SEQ ID NO: 3438304 - RNA, 19 nt, Pseudomonas aeruginosa PA01
agccuuuuuugugcccgcc

SEQ ID NO: 3438305 - RNA, 15 nt, Pseudomonas aeruginosa PA01
agcgaaacggcgcug

SEQ ID NO: 3438306 - RNA, 22 nt, Pseudomonas aeruginosa PA01
agcgaacccaggccgcgcagca

SEQ ID NO: 3438307 - RNA, 13 nt, Pseudomonas aeruginosa PA01
agcgaaccgccgg

SEQ ID NO: 3438308 - RNA, 14 nt, Pseudomonas aeruginosa PA01
agcgaaccgccggc

SEQ ID NO: 3438309 - RNA, 17 nt, Pseudomonas aeruginosa PA01
agcgaacgacagcgaau

SEQ ID NO: 3438310 - RNA, 21 nt, Pseudomonas aeruginosa PA01
agcgaacgggcguugccggca

SEQ ID NO: 3438311 - RNA, 13 nt, Pseudomonas aeruginosa PA01
agcgaagcuggcg

SEQ ID NO: 3438312 - RNA, 18 nt, Pseudomonas aeruginosa PA01
agcgaaggcuccgcugcu

SEQ ID NO: 3438313 - RNA, 16 nt, Pseudomonas aeruginosa PA01
agcgaagugcgcugcu

SEQ ID NO: 3438314 - RNA, 19 nt, Pseudomonas aeruginosa PA01
agcgaagugcgcugcuuga

SEQ ID NO: 3438315 - RNA, 15 nt, Pseudomonas aeruginosa PA01
agcgaagugggggca

SEQ ID NO: 3438316 - RNA, 16 nt, Pseudomonas aeruginosa PA01
agcgaauacaccgagc

SEQ ID NO: 3438317 - RNA, 18 nt, Pseudomonas aeruginosa PA01
agcgaauacaccgagcgc

SEQ ID NO: 3438318 - RNA, 21 nt, Pseudomonas aeruginosa PA01
agcgaaugcuugccggcgccu

SEQ ID NO: 3438319 - RNA, 15 nt, Pseudomonas aeruginosa PA01
agcgaauggacaggc

SEQ ID NO: 3438320 - RNA, 15 nt, Pseudomonas aeruginosa PA01
agcgacagcauggcc

SEQ ID NO: 3438321 - RNA, 22 nt, Pseudomonas aeruginosa PA01
agcgacaggcccuugaacaggc

SEQ ID NO: 3438322 - RNA, 21 nt, Pseudomonas aeruginosa PA01
agcgaccaccaccaggucggc

SEQ ID NO: 3438323 - RNA, 14 nt, Pseudomonas aeruginosa PA01
agcgaccaguugcu

SEQ ID NO: 3438324 - RNA, 13 nt, Pseudomonas aeruginosa PA01
agcgacccgcuga

SEQ ID NO: 3438325 - RNA, 17 nt, Pseudomonas aeruginosa PA01
agcgacccgcugaagga

SEQ ID NO: 3438326 - RNA, 19 nt, Pseudomonas aeruginosa PA01
agcgacccuucaacggcga

SEQ ID NO: 3438327 - RNA, 20 nt, Pseudomonas aeruginosa PA01
agcgacccuucaacggcgac

SEQ ID NO: 3438328 - RNA, 21 nt, Pseudomonas aeruginosa PA01
agcgacccuucaacggcgacc

SEQ ID NO: 3438329 - RNA, 16 nt, Pseudomonas aeruginosa PA01
agcgaccgaucaugcc

SEQ ID NO: 3438330 - RNA, 16 nt, Pseudomonas aeruginosa PA01
agcgaccggauggcuc

SEQ ID NO: 3438331 - RNA, 16 nt, Pseudomonas aeruginosa PA01
agcgacgacuugccca

SEQ ID NO: 3438332 - RNA, 17 nt, Pseudomonas aeruginosa PA01
agcgacgccgcgauggc

SEQ ID NO: 3438333 - RNA, 21 nt, Pseudomonas aeruginosa PA01
agcgacggaaggugcgguuga

SEQ ID NO: 3438334 - RNA, 19 nt, Pseudomonas aeruginosa PA01
agcgacggugauagagcac

SEQ ID NO: 3438335 - RNA, 13 nt, Pseudomonas aeruginosa PA01
agcgacguggcag

SEQ ID NO: 3438336 - RNA, 13 nt, Pseudomonas aeruginosa PA01
agcgacuccagcc

SEQ ID NO: 3438337 - RNA, 15 nt, Pseudomonas aeruginosa PA01
agcgacuccgccagu

SEQ ID NO: 3438338 - RNA, 19 nt, Pseudomonas aeruginosa PA01
agcgacuccgggaacagcc

SEQ ID NO: 3438339 - RNA, 23 nt, Pseudomonas aeruginosa PA01
agcgacuccgggaacagcccguc

SEQ ID NO: 3438340 - RNA, 15 nt, Pseudomonas aeruginosa PA01
agcgacucgaugcgc

SEQ ID NO: 3438341 - RNA, 15 nt, Pseudomonas aeruginosa PA01
agcgacucgcucgcu

SEQ ID NO: 3438342 - RNA, 21 nt, Pseudomonas aeruginosa PA01
agcgacucgcugccggcgcgc

SEQ ID NO: 3438343 - RNA, 17 nt, Pseudomonas aeruginosa PA01
agcgacugcgcuggccg

SEQ ID NO: 3438344 - RNA, 20 nt, Pseudomonas aeruginosa PA01
agcgacugcgcuggccgagc

SEQ ID NO: 3438345 - RNA, 13 nt, Pseudomonas aeruginosa PA01
agcgacuguccaa

SEQ ID NO: 3438346 - RNA, 23 nt, Pseudomonas aeruginosa PA01
agcgagaacuugccggcgccauc

SEQ ID NO: 3438347 - RNA, 19 nt, Pseudomonas aeruginosa PA01
agcgccagccagcgcggcu

SEQ ID NO: 3438348 - RNA, 13 nt, Pseudomonas aeruginosa PA01
agcgccagccagg

SEQ ID NO: 3438349 - RNA, 14 nt, Pseudomonas aeruginosa PA01
agcgccagccaggg

SEQ ID NO: 3438350 - RNA, 17 nt, Pseudomonas aeruginosa PA01
agcgccagccaggguac

SEQ ID NO: 3438351 - RNA, 12 nt, Pseudomonas aeruginosa PA01
agcgccaggaac

SEQ ID NO: 3438352 - RNA, 22 nt, Pseudomonas aeruginosa PA01
agcgccaggaagccgcgcccca

SEQ ID NO: 3438353 - RNA, 13 nt, Pseudomonas aeruginosa PA01
agcgccaggagca

SEQ ID NO: 3438354 - RNA, 14 nt, Pseudomonas aeruginosa PA01
agcgccaggagcag

SEQ ID NO: 3438355 - RNA, 16 nt, Pseudomonas aeruginosa PA01
agcgccaggagcaggg

SEQ ID NO: 3438356 - RNA, 17 nt, Pseudomonas aeruginosa PA01
agcgccaggagcagggc

SEQ ID NO: 3438357 - RNA, 18 nt, Pseudomonas aeruginosa PA01
agcgccaggccgaucagc

SEQ ID NO: 3438358 - RNA, 13 nt, Pseudomonas aeruginosa PA01
agcgccaggccgc

SEQ ID NO: 3438359 - RNA, 14 nt, Pseudomonas aeruginosa PA01
agcgccaggccgcc

SEQ ID NO: 3438360 - RNA, 14 nt, Pseudomonas aeruginosa PA01
agcgccagggccag

SEQ ID NO: 3438361 - RNA, 14 nt, Pseudomonas aeruginosa PA01
agcgccagguaguc

SEQ ID NO: 3438362 - RNA, 18 nt, Pseudomonas aeruginosa PA01
agcgccagguaguccagc

SEQ ID NO: 3438363 - RNA, 21 nt, Pseudomonas aeruginosa PA01
agcgccaguuggacgcggccu

SEQ ID NO: 3438364 - RNA, 22 nt, Pseudomonas aeruginosa PA01
agcgccaguuggacgcggccug

SEQ ID NO: 3438365 - RNA, 16 nt, Pseudomonas aeruginosa PA01
agcgccaucagcgacc

SEQ ID NO: 3438366 - RNA, 14 nt, Pseudomonas aeruginosa PA01
agcgccaucaggcc

SEQ ID NO: 3438367 - RNA, 15 nt, Pseudomonas aeruginosa PA01
agcgccaucaggccc

SEQ ID NO: 3438368 - RNA, 19 nt, Pseudomonas aeruginosa PA01
agcgccaugcucuucaggc

SEQ ID NO: 3438369 - RNA, 23 nt, Pseudomonas aeruginosa PA01
agcgcccagacacgccucaaggc

SEQ ID NO: 3438370 - RNA, 13 nt, Pseudomonas aeruginosa PA01
agcgcccaggugc

SEQ ID NO: 3438371 - RNA, 20 nt, Pseudomonas aeruginosa PA01
agcgccccagcaccucgccg

SEQ ID NO: 3438372 - RNA, 15 nt, Pseudomonas aeruginosa PA01
agcgccccgccuacc

SEQ ID NO: 3438373 - RNA, 21 nt, Pseudomonas aeruginosa PA01
agcgccccgccuaccggggcg

SEQ ID NO: 3438374 - RNA, 18 nt, Pseudomonas aeruginosa PA01
agcgccccuuggccagca

SEQ ID NO: 3438375 - RNA, 19 nt, Pseudomonas aeruginosa PA01
agcgccccuuggccagcac

SEQ ID NO: 3438376 - RNA, 21 nt, Pseudomonas aeruginosa PA01
agcgccccuuggccagcacca

SEQ ID NO: 3438377 - RNA, 14 nt, Pseudomonas aeruginosa PA01
agcgcccgacggcu

SEQ ID NO: 3438378 - RNA, 19 nt, Pseudomonas aeruginosa PA01
agcgcccgagucccuugcg

SEQ ID NO: 3438379 - RNA, 21 nt, Pseudomonas aeruginosa PA01
agcgcccgagucccuugcggc

SEQ ID NO: 3438380 - RNA, 18 nt, Pseudomonas aeruginosa PA01
agcgcccgauaggcgccg

SEQ ID NO: 3438381 - RNA, 21 nt, Pseudomonas aeruginosa PA01
agcgcccgauaggcgccggcg

SEQ ID NO: 3438382 - RNA, 16 nt, Pseudomonas aeruginosa PA01
agcgcccgcgcaugga

SEQ ID NO: 3438383 - RNA, 21 nt, Pseudomonas aeruginosa PA01
agcgcccggcaaucaggcgcg

SEQ ID NO: 3438384 - RNA, 12 nt, Pseudomonas aeruginosa PA01
agcgcccggcga

SEQ ID NO: 3438385 - RNA, 14 nt, Pseudomonas aeruginosa PA01
agcgcccggcgaac

SEQ ID NO: 3438386 - RNA, 19 nt, Pseudomonas aeruginosa PA01
agcgcccggcgaacagcgc

SEQ ID NO: 3438387 - RNA, 11 nt, Pseudomonas aeruginosa PA01
agcgcccggcu

SEQ ID NO: 3438388 - RNA, 15 nt, Pseudomonas aeruginosa PA01
agcgcccucgcugag

SEQ ID NO: 3438389 - RNA, 22 nt, Pseudomonas aeruginosa PA01
agcgcccucgcugagcaggaac

SEQ ID NO: 3438390 - RNA, 22 nt, Pseudomonas aeruginosa PA01
agcgccgaacaggguugggcga

SEQ ID NO: 3438391 - RNA, 13 nt, Pseudomonas aeruginosa PA01
agcgccgaaggcg

SEQ ID NO: 3438392 - RNA, 18 nt, Pseudomonas aeruginosa PA01
agcgccgaggucuuggcc

SEQ ID NO: 3438393 - RNA, 19 nt, Pseudomonas aeruginosa PA01
agcgccgaggucuuggcca

SEQ ID NO: 3438394 - RNA, 23 nt, Pseudomonas aeruginosa PA01
agcgccgaggucuuggccagccg

SEQ ID NO: 3438395 - RNA, 15 nt, Pseudomonas aeruginosa PA01
agcgccgcaggcgcu

SEQ ID NO: 3438396 - RNA, 21 nt, Pseudomonas aeruginosa PA01
agcgccgcaguuguuccucgc

SEQ ID NO: 3438397 - RNA, 13 nt, Pseudomonas aeruginosa PA01
agcgccgccaccg

SEQ ID NO: 3438398 - RNA, 15 nt, Pseudomonas aeruginosa PA01
agcgccgccagcagg

SEQ ID NO: 3438399 - RNA, 22 nt, Pseudomonas aeruginosa PA01
agcgccgccagcaggucggccu

SEQ ID NO: 3438400 - RNA, 14 nt, Pseudomonas aeruginosa PA01
agcgccgccaggca

SEQ ID NO: 3438401 - RNA, 16 nt, Pseudomonas aeruginosa PA01
agcgccgccaggcaga

SEQ ID NO: 3438402 - RNA, 14 nt, Pseudomonas aeruginosa PA01
agcgccgccaggcg

SEQ ID NO: 3438403 - RNA, 16 nt, Pseudomonas aeruginosa PA01
agcgccgccaggcgcg

SEQ ID NO: 3438404 - RNA, 17 nt, Pseudomonas aeruginosa PA01
agcgccgccaggcgcgu

SEQ ID NO: 3438405 - RNA, 20 nt, Pseudomonas aeruginosa PA01
agcgccgccaguucgcgcag

SEQ ID NO: 3438406 - RNA, 22 nt, Pseudomonas aeruginosa PA01
agcgccgccaguucgcgcaggu

SEQ ID NO: 3438407 - RNA, 13 nt, Pseudomonas aeruginosa PA01
agcgccgcccugu

SEQ ID NO: 3438408 - RNA, 20 nt, Pseudomonas aeruginosa PA01
agcgccgcccuguucgucug

SEQ ID NO: 3438409 - RNA, 14 nt, Pseudomonas aeruginosa PA01
agcgccgccgcguc

SEQ ID NO: 3438410 - RNA, 20 nt, Pseudomonas aeruginosa PA01
agcgccgccgcgucgucggc

SEQ ID NO: 3438411 - RNA, 20 nt, Pseudomonas aeruginosa PA01
agcgccgccgguaucccggc

SEQ ID NO: 3438412 - RNA, 13 nt, Pseudomonas aeruginosa PA01
agcgccgccucga

SEQ ID NO: 3438413 - RNA, 23 nt, Pseudomonas aeruginosa PA01
agcgccgccucgaaggccggcaa

SEQ ID NO: 3438414 - RNA, 14 nt, Pseudomonas aeruginosa PA01
agcgccgccugcug

SEQ ID NO: 3438415 - RNA, 15 nt, Pseudomonas aeruginosa PA01
agcgccgccugcugg

SEQ ID NO: 3438416 - RNA, 17 nt, Pseudomonas aeruginosa PA01
agcgccgccugcuggcu

SEQ ID NO: 3438417 - RNA, 18 nt, Pseudomonas aeruginosa PA01
agcgccgccugcuggcug

SEQ ID NO: 3438418 - RNA, 16 nt, Pseudomonas aeruginosa PA01
agcgccgccuugagcg

SEQ ID NO: 3438419 - RNA, 23 nt, Pseudomonas aeruginosa PA01
agcgccgccuugagcggcgcccu

SEQ ID NO: 3438420 - RNA, 15 nt, Pseudomonas aeruginosa PA01
agcgccgcgcggcaa

SEQ ID NO: 3438421 - RNA, 13 nt, Pseudomonas aeruginosa PA01
agcgccgcggccc

SEQ ID NO: 3438422 - RNA, 15 nt, Pseudomonas aeruginosa PA01
agcgccgcggcccgg

SEQ ID NO: 3438423 - RNA, 23 nt, Pseudomonas aeruginosa PA01
agcgccgcggcccggcgcugccc

SEQ ID NO: 3438424 - RNA, 22 nt, Pseudomonas aeruginosa PA01
agcgccgcggcgaacaucaucc

SEQ ID NO: 3438425 - RNA, 15 nt, Pseudomonas aeruginosa PA01
agcgccgcggcgacc

SEQ ID NO: 3438426 - RNA, 16 nt, Pseudomonas aeruginosa PA01
agcgccgcggcgacca

SEQ ID NO: 3438427 - RNA, 16 nt, Pseudomonas aeruginosa PA01
agcgccgcggcggcgu

SEQ ID NO: 3438428 - RNA, 15 nt, Pseudomonas aeruginosa PA01
agcgccgcggcuggc

SEQ ID NO: 3438429 - RNA, 17 nt, Pseudomonas aeruginosa PA01
agcgccgcggcuggcca

SEQ ID NO: 3438430 - RNA, 23 nt, Pseudomonas aeruginosa PA01
agcgccgcggcuggccauccgcc

SEQ ID NO: 3438431 - RNA, 19 nt, Pseudomonas aeruginosa PA01
agcgccgcggugucggcga

SEQ ID NO: 3438432 - RNA, 13 nt, Pseudomonas aeruginosa PA01
agcgccgcuccuc

SEQ ID NO: 3438433 - RNA, 18 nt, Pseudomonas aeruginosa PA01
agcgccgcuccuccucgc

SEQ ID NO: 3438434 - RNA, 14 nt, Pseudomonas aeruginosa PA01
agcgccggcaccga

SEQ ID NO: 3438435 - RNA, 15 nt, Pseudomonas aeruginosa PA01
agcgccggcaccgag

SEQ ID NO: 3438436 - RNA, 20 nt, Pseudomonas aeruginosa PA01
agcgccggcaccgaggagaa

SEQ ID NO: 3438437 - RNA, 11 nt, Pseudomonas aeruginosa PA01
agcgccggcgg

SEQ ID NO: 3438438 - RNA, 14 nt, Pseudomonas aeruginosa PA01
agcgccggcggccu

SEQ ID NO: 3438439 - RNA, 15 nt, Pseudomonas aeruginosa PA01
agcgccggcggccug

SEQ ID NO: 3438440 - RNA, 19 nt, Pseudomonas aeruginosa PA01
agcgccggcggccugcccc

SEQ ID NO: 3438441 - RNA, 16 nt, Pseudomonas aeruginosa PA01
agcgccggcggcgcgu

SEQ ID NO: 3438442 - RNA, 11 nt, Pseudomonas aeruginosa PA01
agcgccgggca

SEQ ID NO: 3438443 - RNA, 11 nt, Pseudomonas aeruginosa PA01
agcgccggguc

SEQ ID NO: 3438444 - RNA, 18 nt, Pseudomonas aeruginosa PA01
agcgccguacgcaccgcg

SEQ ID NO: 3438445 - RNA, 21 nt, Pseudomonas aeruginosa PA01
agcgccguucacgccuggcgg

SEQ ID NO: 3438446 - RNA, 19 nt, Pseudomonas aeruginosa PA01
agcgccguugccgaugccg

SEQ ID NO: 3438447 - RNA, 21 nt, Pseudomonas aeruginosa PA01
agcgccguugccgaugccgga

SEQ ID NO: 3438448 - RNA, 13 nt, Pseudomonas aeruginosa PA01
agcgccuccagca

SEQ ID NO: 3438449 - RNA, 20 nt, Pseudomonas aeruginosa PA01
agcgccuccucuaccaggcg

SEQ ID NO: 3438450 - RNA, 18 nt, Pseudomonas aeruginosa PA01
agcggcagcggcucguca

SEQ ID NO: 3438451 - RNA, 17 nt, Pseudomonas aeruginosa PA01
agcggcagcucggcgac

SEQ ID NO: 3438452 - RNA, 16 nt, Pseudomonas aeruginosa PA01
agcggcaggagcauga

SEQ ID NO: 3438453 - RNA, 23 nt, Pseudomonas aeruginosa PA01
agcggcaggagcguugcgggcag

SEQ ID NO: 3438454 - RNA, 15 nt, Pseudomonas aeruginosa PA01
agcggcaggcacgcu

SEQ ID NO: 3438455 - RNA, 19 nt, Pseudomonas aeruginosa PA01
agcggcaggcacgcugcca

SEQ ID NO: 3438456 - RNA, 16 nt, Pseudomonas aeruginosa PA01
agcggcaggccacggc

SEQ ID NO: 3438457 - RNA, 19 nt, Pseudomonas aeruginosa PA01
agcggcaggccacggccgc

SEQ ID NO: 3438458 - RNA, 17 nt, Pseudomonas aeruginosa PA01
agcggcaggccgccgau

SEQ ID NO: 3438459 - RNA, 18 nt, Pseudomonas aeruginosa PA01
agcggcaggccgccgauc

SEQ ID NO: 3438460 - RNA, 12 nt, Pseudomonas aeruginosa PA01
agcggcagggcg

SEQ ID NO: 3438461 - RNA, 14 nt, Pseudomonas aeruginosa PA01
agcggcagggcggc

SEQ ID NO: 3438462 - RNA, 17 nt, Pseudomonas aeruginosa PA01
agcggcaggugguaagc

SEQ ID NO: 3438463 - RNA, 16 nt, Pseudomonas aeruginosa PA01
agcggcaugcccugcc

SEQ ID NO: 3438464 - RNA, 17 nt, Pseudomonas aeruginosa PA01
agcggcaugcccugccg

SEQ ID NO: 3438465 - RNA, 14 nt, Pseudomonas aeruginosa PA01
agcggccacggcgg

SEQ ID NO: 3438466 - RNA, 15 nt, Pseudomonas aeruginosa PA01
agcggccacggcgga

SEQ ID NO: 3438467 - RNA, 20 nt, Pseudomonas aeruginosa PA01
agcggccagggcgaggccgc

SEQ ID NO: 3438468 - RNA, 16 nt, Pseudomonas aeruginosa PA01
agcggcccgagcaggc

SEQ ID NO: 3438469 - RNA, 17 nt, Pseudomonas aeruginosa PA01
agcggcccgagcaggcu

SEQ ID NO: 3438470 - RNA, 15 nt, Pseudomonas aeruginosa PA01
agcggcccgaggguc

SEQ ID NO: 3438471 - RNA, 23 nt, Pseudomonas aeruginosa PA01
agcggcccgcggucacucggccu

SEQ ID NO: 3438472 - RNA, 23 nt, Pseudomonas aeruginosa PA01
agcggcccuugucgccgcugggc

SEQ ID NO: 3438473 - RNA, 17 nt, Pseudomonas aeruginosa PA01
agcggccgaccaggccg

SEQ ID NO: 3438474 - RNA, 19 nt, Pseudomonas aeruginosa PA01
agcggccgagcaggcgcgc

SEQ ID NO: 3438475 - RNA, 20 nt, Pseudomonas aeruginosa PA01
agcggccgagcaggcgcgcc

SEQ ID NO: 3438476 - RNA, 20 nt, Pseudomonas aeruginosa PA01
agcggccgcgagcgcggccg

SEQ ID NO: 3438477 - RNA, 22 nt, Pseudomonas aeruginosa PA01
agcggccgcgagcgcggccggc

SEQ ID NO: 3438478 - RNA, 15 nt, Pseudomonas aeruginosa PA01
agcggcgaagcgcag

SEQ ID NO: 3438479 - RNA, 18 nt, Pseudomonas aeruginosa PA01
agcggcgacaccgccagc

SEQ ID NO: 3438480 - RNA, 19 nt, Pseudomonas aeruginosa PA01
agcggcgacaccgccagca

SEQ ID NO: 3438481 - RNA, 16 nt, Pseudomonas aeruginosa PA01
agcggcgacgccaccc

SEQ ID NO: 3438482 - RNA, 18 nt, Pseudomonas aeruginosa PA01
agcggcgacgccacccgc

SEQ ID NO: 3438483 - RNA, 21 nt, Pseudomonas aeruginosa PA01
agcggcgccagcuccagcgcc

SEQ ID NO: 3438484 - RNA, 13 nt, Pseudomonas aeruginosa PA01
agcggcgccaggc

SEQ ID NO: 3438485 - RNA, 22 nt, Pseudomonas aeruginosa PA01
agcggcgccaggcguuccagcu

SEQ ID NO: 3438486 - RNA, 22 nt, Pseudomonas aeruginosa PA01
agcggcgcccuggcucuugccg

SEQ ID NO: 3438487 - RNA, 23 nt, Pseudomonas aeruginosa PA01
agcggcgccucgaagcggaucuc

SEQ ID NO: 3438488 - RNA, 13 nt, Pseudomonas aeruginosa PA01
agcggcgcgaagu

SEQ ID NO: 3438489 - RNA, 14 nt, Pseudomonas aeruginosa PA01
agcggcgcgaaguc

SEQ ID NO: 3438490 - RNA, 16 nt, Pseudomonas aeruginosa PA01
agcggcgcgaggccgu

SEQ ID NO: 3438491 - RNA, 20 nt, Pseudomonas aeruginosa PA01
agcggcgcuugcgggcgcgc

SEQ ID NO: 3438492 - RNA, 17 nt, Pseudomonas aeruginosa PA01
agcggcggauacaggcg

SEQ ID NO: 3438493 - RNA, 18 nt, Pseudomonas aeruginosa PA01
agcggcggauacaggcgc

SEQ ID NO: 3438494 - RNA, 18 nt, Pseudomonas aeruginosa PA01
agcggcggcacgaccaca

SEQ ID NO: 3438495 - RNA, 14 nt, Pseudomonas aeruginosa PA01
agcggcggccgucg

SEQ ID NO: 3438496 - RNA, 15 nt, Pseudomonas aeruginosa PA01
agcggcggcgccggc

SEQ ID NO: 3438497 - RNA, 17 nt, Pseudomonas aeruginosa PA01
agcggcgguacauggcc

SEQ ID NO: 3438498 - RNA, 19 nt, Pseudomonas aeruginosa PA01
agcggcgguacauggccuu

SEQ ID NO: 3438499 - RNA, 17 nt, Pseudomonas aeruginosa PA01
agcggcgguagcuccag

SEQ ID NO: 3438500 - RNA, 14 nt, Pseudomonas aeruginosa PA01
agcggcggugcgcc

SEQ ID NO: 3438501 - RNA, 15 nt, Pseudomonas aeruginosa PA01
agcggcggugcgccg

SEQ ID NO: 3438502 - RNA, 23 nt, Pseudomonas aeruginosa PA01
agcggcguaugcgccuccaggua

SEQ ID NO: 3438503 - RNA, 16 nt, Pseudomonas aeruginosa PA01
agcggcgugaagccgc

SEQ ID NO: 3438504 - RNA, 18 nt, Pseudomonas aeruginosa PA01
agcggcgugaagccgccg

SEQ ID NO: 3438505 - RNA, 22 nt, Pseudomonas aeruginosa PA01
agcggcguuucuuuuugccggu

SEQ ID NO: 3438506 - RNA, 16 nt, Pseudomonas aeruginosa PA01
agcggcuccuggaugc

SEQ ID NO: 3438507 - RNA, 21 nt, Pseudomonas aeruginosa PA01
agcggcucgccgaaaggccgu

SEQ ID NO: 3438508 - RNA, 13 nt, Pseudomonas aeruginosa PA01
agcggcucggcca

SEQ ID NO: 3438509 - RNA, 15 nt, Pseudomonas aeruginosa PA01
agcggcucggccagg

SEQ ID NO: 3438510 - RNA, 21 nt, Pseudomonas aeruginosa PA01
agcggcucggccagggccgcu

SEQ ID NO: 3438511 - RNA, 21 nt, Pseudomonas aeruginosa PA01
agcggcucgucaucguccagc

SEQ ID NO: 3438512 - RNA, 17 nt, Pseudomonas aeruginosa PA01
agcggcugccgaggcug

SEQ ID NO: 3438513 - RNA, 18 nt, Pseudomonas aeruginosa PA01
agcggcuggcccucggcg

SEQ ID NO: 3438514 - RNA, 13 nt, Pseudomonas aeruginosa PA01
agcggcuggccgu

SEQ ID NO: 3438515 - RNA, 12 nt, Pseudomonas aeruginosa PA01
agcggcuggcga

SEQ ID NO: 3438516 - RNA, 20 nt, Pseudomonas aeruginosa PA01
agcggcuggcgaugcugacc

SEQ ID NO: 3438517 - RNA, 23 nt, Pseudomonas aeruginosa PA01
agcggcuggcgcuugccgcgccc

SEQ ID NO: 3438518 - RNA, 23 nt, Pseudomonas aeruginosa PA01
agcggcugguggccguugagcac

SEQ ID NO: 3438519 - RNA, 15 nt, Pseudomonas aeruginosa PA01
agcggcuguugccgg

SEQ ID NO: 3438520 - RNA, 15 nt, Pseudomonas aeruginosa PA01
agcggcuugcagucg

SEQ ID NO: 3438521 - RNA, 16 nt, Pseudomonas aeruginosa PA01
agcggcuugcagucga

SEQ ID NO: 3438522 - RNA, 17 nt, Pseudomonas aeruginosa PA01
agcggcuuguccuggcg

SEQ ID NO: 3438523 - RNA, 15 nt, Pseudomonas aeruginosa PA01
agcgggaaggucggc

SEQ ID NO: 3438524 - RNA, 21 nt, Pseudomonas aeruginosa PA01
agcgggaaggucggcagcagc

SEQ ID NO: 3438525 - RNA, 17 nt, Pseudomonas aeruginosa PA01
agcgggacgaugccgau

SEQ ID NO: 3438526 - RNA, 16 nt, Pseudomonas aeruginosa PA01
agcgggcaaccuugca

SEQ ID NO: 3438527 - RNA, 15 nt, Pseudomonas aeruginosa PA01
agcgggccagcagcu

SEQ ID NO: 3438528 - RNA, 12 nt, Pseudomonas aeruginosa PA01
agcgggccaggc

SEQ ID NO: 3438529 - RNA, 13 nt, Pseudomonas aeruginosa PA01
agcgggccaggcg

SEQ ID NO: 3438530 - RNA, 21 nt, Pseudomonas aeruginosa PA01
agcgggccgagggugaucagc

SEQ ID NO: 3438531 - RNA, 16 nt, Pseudomonas aeruginosa PA01
agcgggccgauccgcg

SEQ ID NO: 3438532 - RNA, 15 nt, Pseudomonas aeruginosa PA01
agcgggccucggcgg

SEQ ID NO: 3438533 - RNA, 17 nt, Pseudomonas aeruginosa PA01
agcgggccuucgccagc

SEQ ID NO: 3438534 - RNA, 20 nt, Pseudomonas aeruginosa PA01
agcgggccuucgccagcggc

SEQ ID NO: 3438535 - RNA, 16 nt, Pseudomonas aeruginosa PA01
agcgggcgagggcggc

SEQ ID NO: 3438536 - RNA, 13 nt, Pseudomonas aeruginosa PA01
agcgggcgccgga

SEQ ID NO: 3438537 - RNA, 13 nt, Pseudomonas aeruginosa PA01
agcgggcgcggua

SEQ ID NO: 3438538 - RNA, 20 nt, Pseudomonas aeruginosa PA01
agcgggcgguagaucuccac

SEQ ID NO: 3438539 - RNA, 20 nt, Pseudomonas aeruginosa PA01
agcgggcugucguccugggu

SEQ ID NO: 3438540 - RNA, 23 nt, Pseudomonas aeruginosa PA01
agcggggaaaccuucgguggcga

SEQ ID NO: 3438541 - RNA, 23 nt, Pseudomonas aeruginosa PA01
agcggggcuuuuuccaacgcgcg

SEQ ID NO: 3438542 - RNA, 23 nt, Pseudomonas aeruginosa PA01
agcggggcuuuuuuaugcgacug

SEQ ID NO: 3438543 - RNA, 14 nt, Pseudomonas aeruginosa PA01
agcgggguggcgcg

SEQ ID NO: 3438544 - RNA, 15 nt, Pseudomonas aeruginosa PA01
agcggguaacccagg

SEQ ID NO: 3438545 - RNA, 20 nt, Pseudomonas aeruginosa PA01
agcggguaguagaucagcuu

SEQ ID NO: 3438546 - RNA, 23 nt, Pseudomonas aeruginosa PA01
agcggguauugcagacgcugccg

SEQ ID NO: 3438547 - RNA, 18 nt, Pseudomonas aeruginosa PA01
agcgggucagcagcaccg

SEQ ID NO: 3438548 - RNA, 16 nt, Pseudomonas aeruginosa PA01
agcgggucgagccagg

SEQ ID NO: 3438549 - RNA, 18 nt, Pseudomonas aeruginosa PA01
agcgggucgagccaggcg

SEQ ID NO: 3438550 - RNA, 19 nt, Pseudomonas aeruginosa PA01
agcgggucgagccaggcgu

SEQ ID NO: 3438551 - RNA, 19 nt, Pseudomonas aeruginosa PA01
agcgggucgaucaggcgca

SEQ ID NO: 3438552 - RNA, 17 nt, Pseudomonas aeruginosa PA01
agcguuguccucggcgg

SEQ ID NO: 3438553 - RNA, 19 nt, Pseudomonas aeruginosa PA01
agcguuguccucggcggcu

SEQ ID NO: 3438554 - RNA, 19 nt, Pseudomonas aeruginosa PA01
agcguuguguagucauggc

SEQ ID NO: 3438555 - RNA, 19 nt, Pseudomonas aeruginosa PA01
agcguuguucuucgacgcu

SEQ ID NO: 3438556 - RNA, 23 nt, Pseudomonas aeruginosa PA01
agcguuuuuggcaaaccucccgg

SEQ ID NO: 3438557 - RNA, 15 nt, Pseudomonas aeruginosa PA01
agcuaccggcagggu

SEQ ID NO: 3438558 - RNA, 17 nt, Pseudomonas aeruginosa PA01
agcuaguuauugaagug

SEQ ID NO: 3438559 - RNA, 12 nt, Pseudomonas aeruginosa PA01
agcucagcaggu

SEQ ID NO: 3438560 - RNA, 13 nt, Pseudomonas aeruginosa PA01
agcucagcagguc

SEQ ID NO: 3438561 - RNA, 15 nt, Pseudomonas aeruginosa PA01
agcucagcaggucgc

SEQ ID NO: 3438562 - RNA, 16 nt, Pseudomonas aeruginosa PA01
agcucagcaggucgcg

SEQ ID NO: 3438563 - RNA, 16 nt, Pseudomonas aeruginosa PA01
agcucagcuccaggcc

SEQ ID NO: 3438564 - RNA, 20 nt, Pseudomonas aeruginosa PA01
agcucagcuccaggccgcgg

SEQ ID NO: 3438565 - RNA, 12 nt, Pseudomonas aeruginosa PA01
agcucagcugga

SEQ ID NO: 3438566 - RNA, 16 nt, Pseudomonas aeruginosa PA01
agcucagcuggauaga

SEQ ID NO: 3438567 - RNA, 19 nt, Pseudomonas aeruginosa PA01
agcucagcuggauagagua

SEQ ID NO: 3438568 - RNA, 23 nt, Pseudomonas aeruginosa PA01
agcucagcuggauagaguacucg

SEQ ID NO: 3438569 - RNA, 21 nt, Pseudomonas aeruginosa PA01
agcucagcugggagagcaucu

SEQ ID NO: 3438570 - RNA, 17 nt, Pseudomonas aeruginosa PA01
agcucagucgguagagc

SEQ ID NO: 3438571 - RNA, 21 nt, Pseudomonas aeruginosa PA01
agcucagucgguagagcaaau

SEQ ID NO: 3438572 - RNA, 16 nt, Pseudomonas aeruginosa PA01
agcucauaggucaggu

SEQ ID NO: 3438573 - RNA, 13 nt, Pseudomonas aeruginosa PA01
agcucauggagca

SEQ ID NO: 3438574 - RNA, 16 nt, Pseudomonas aeruginosa PA01
agcucauggagcaaca

SEQ ID NO: 3438575 - RNA, 17 nt, Pseudomonas aeruginosa PA01
agcucauggagcaacag

SEQ ID NO: 3438576 - RNA, 13 nt, Pseudomonas aeruginosa PA01
agcuccaccaaau

SEQ ID NO: 3438577 - RNA, 21 nt, Pseudomonas aeruginosa PA01
agcuccaccaaauugccggga

SEQ ID NO: 3438578 - RNA, 10 nt, Pseudomonas aeruginosa PA01
agcuccagca

SEQ ID NO: 3438579 - RNA, 15 nt, Pseudomonas aeruginosa PA01
agcuccagcaccggc

SEQ ID NO: 3438580 - RNA, 11 nt, Pseudomonas aeruginosa PA01
agcuccagcag

SEQ ID NO: 3438581 - RNA, 12 nt, Pseudomonas aeruginosa PA01
agcuccagcagu

SEQ ID NO: 3438582 - RNA, 20 nt, Pseudomonas aeruginosa PA01
agcuccagcggaaucgcgcc

SEQ ID NO: 3438583 - RNA, 13 nt, Pseudomonas aeruginosa PA01
agcuccagggcug

SEQ ID NO: 3438584 - RNA, 14 nt, Pseudomonas aeruginosa PA01
agcucccaggcguc

SEQ ID NO: 3438585 - RNA, 20 nt, Pseudomonas aeruginosa PA01
agcucccaggcgucgccgac

SEQ ID NO: 3438586 - RNA, 13 nt, Pseudomonas aeruginosa PA01
agcuccccgccgc

SEQ ID NO: 3438587 - RNA, 18 nt, Pseudomonas aeruginosa PA01
agcuccccgccgccaggc

SEQ ID NO: 3438588 - RNA, 17 nt, Pseudomonas aeruginosa PA01
agcuccccgucccucag

SEQ ID NO: 3438589 - RNA, 19 nt, Pseudomonas aeruginosa PA01
agcuccccgucccucaggu

SEQ ID NO: 3438590 - RNA, 15 nt, Pseudomonas aeruginosa PA01
agcucccugauccgc

SEQ ID NO: 3438591 - RNA, 15 nt, Pseudomonas aeruginosa PA01
agcucccugccgccc

SEQ ID NO: 3438592 - RNA, 19 nt, Pseudomonas aeruginosa PA01
agcucccuugccgccgguu

SEQ ID NO: 3438593 - RNA, 22 nt, Pseudomonas aeruginosa PA01
agcuccgccugaccgcugauga

SEQ ID NO: 3438594 - RNA, 15 nt, Pseudomonas aeruginosa PA01
agcuccggcgggcgg

SEQ ID NO: 3438595 - RNA, 22 nt, Pseudomonas aeruginosa PA01
agcuccgggcuggccaccagca

SEQ ID NO: 3438596 - RNA, 21 nt, Pseudomonas aeruginosa PA01
agcuccgucuguucggccagg

SEQ ID NO: 3438597 - RNA, 17 nt, Pseudomonas aeruginosa PA01
agcuccuccagcguggc

SEQ ID NO: 3438598 - RNA, 20 nt, Pseudomonas aeruginosa PA01
agcuccuccagcguggcgga

SEQ ID NO: 3438599 - RNA, 11 nt, Pseudomonas aeruginosa PA01
agcuccucggc

SEQ ID NO: 3438600 - RNA, 15 nt, Pseudomonas aeruginosa PA01
agcuccucggccuug

SEQ ID NO: 3438601 - RNA, 22 nt, Pseudomonas aeruginosa PA01
agcuccucggccuugcuggcga

SEQ ID NO: 3438602 - RNA, 15 nt, Pseudomonas aeruginosa PA01
agcuccuugcucucg

SEQ ID NO: 3438603 - RNA, 20 nt, Pseudomonas aeruginosa PA01
agcuccuugcucucgcgcac

SEQ ID NO: 3438604 - RNA, 18 nt, Pseudomonas aeruginosa PA01
agcucgaaauccggugcc

SEQ ID NO: 3438605 - RNA, 15 nt, Pseudomonas aeruginosa PA01
agcucgaagccgccg

SEQ ID NO: 3438606 - RNA, 16 nt, Pseudomonas aeruginosa PA01
agcucgaagccgccgu

SEQ ID NO: 3438607 - RNA, 14 nt, Pseudomonas aeruginosa PA01
agcucgacccgccc

SEQ ID NO: 3438608 - RNA, 17 nt, Pseudomonas aeruginosa PA01
agcucgacccgcccgcc

SEQ ID NO: 3438609 - RNA, 21 nt, Pseudomonas aeruginosa PA01
agcucgaccuugcccuugaag

SEQ ID NO: 3438610 - RNA, 11 nt, Pseudomonas aeruginosa PA01
agcucgaucac

SEQ ID NO: 3438611 - RNA, 18 nt, Pseudomonas aeruginosa PA01
agcucgaucagcccgcca

SEQ ID NO: 3438612 - RNA, 19 nt, Pseudomonas aeruginosa PA01
agcucgaucucauggucgg

SEQ ID NO: 3438613 - RNA, 12 nt, Pseudomonas aeruginosa PA01
agcucgcccgcc

SEQ ID NO: 3438614 - RNA, 13 nt, Pseudomonas aeruginosa PA01
agcucgcccgccu

SEQ ID NO: 3438615 - RNA, 18 nt, Pseudomonas aeruginosa PA01
agcucgccgagguugcug

SEQ ID NO: 3438616 - RNA, 20 nt, Pseudomonas aeruginosa PA01
agcucgccgagguugcugcg

SEQ ID NO: 3438617 - RNA, 16 nt, Pseudomonas aeruginosa PA01
agcucgccgcuccaca

SEQ ID NO: 3438618 - RNA, 19 nt, Pseudomonas aeruginosa PA01
agcucgccgcuccacaccc

SEQ ID NO: 3438619 - RNA, 19 nt, Pseudomonas aeruginosa PA01
agcucgccggcguccuccu

SEQ ID NO: 3438620 - RNA, 20 nt, Pseudomonas aeruginosa PA01
agcucgcgcaagcgcccggc

SEQ ID NO: 3438621 - RNA, 21 nt, Pseudomonas aeruginosa PA01
agcucgcgcaagcgcccggcg

SEQ ID NO: 3438622 - RNA, 18 nt, Pseudomonas aeruginosa PA01
agcucgcgguaggccagc

SEQ ID NO: 3438623 - RNA, 17 nt, Pseudomonas aeruginosa PA01
agcucgcuaugcagcag

SEQ ID NO: 3438624 - RNA, 19 nt, Pseudomonas aeruginosa PA01
agcucgcuaugcagcaggu

SEQ ID NO: 3438625 - RNA, 16 nt, Pseudomonas aeruginosa PA01
agcucgcuguccagca

SEQ ID NO: 3438626 - RNA, 13 nt, Pseudomonas aeruginosa PA01
agcucgcugucgc

SEQ ID NO: 3438627 - RNA, 16 nt, Pseudomonas aeruginosa PA01
agcucgcugucgccga

SEQ ID NO: 3438628 - RNA, 19 nt, Pseudomonas aeruginosa PA01
agcucgcugucgccgagca

SEQ ID NO: 3438629 - RNA, 20 nt, Pseudomonas aeruginosa PA01
agcucgcugucgccgagcac

SEQ ID NO: 3438630 - RNA, 18 nt, Pseudomonas aeruginosa PA01
agcucggacaagggccag

SEQ ID NO: 3438631 - RNA, 22 nt, Pseudomonas aeruginosa PA01
agcucggacaagggccagagca

SEQ ID NO: 3438632 - RNA, 19 nt, Pseudomonas aeruginosa PA01
agcucggcacgcagcagcu

SEQ ID NO: 3438633 - RNA, 20 nt, Pseudomonas aeruginosa PA01
agcucggcacgcagcagcuu

SEQ ID NO: 3438634 - RNA, 18 nt, Pseudomonas aeruginosa PA01
agcucggccaucagcgcc

SEQ ID NO: 3438635 - RNA, 19 nt, Pseudomonas aeruginosa PA01
agcucggccaucagcgcca

SEQ ID NO: 3438636 - RNA, 20 nt, Pseudomonas aeruginosa PA01
agcucggccaucagcgccag

SEQ ID NO: 3438637 - RNA, 18 nt, Pseudomonas aeruginosa PA01
agcucggccgagggcagc

SEQ ID NO: 3438638 - RNA, 12 nt, Pseudomonas aeruginosa PA01
agcucggccgcu

SEQ ID NO: 3438639 - RNA, 12 nt, Pseudomonas aeruginosa PA01
agcucggccugg

SEQ ID NO: 3438640 - RNA, 15 nt, Pseudomonas aeruginosa PA01
agcucggccuggucc

SEQ ID NO: 3438641 - RNA, 17 nt, Pseudomonas aeruginosa PA01
agcucggccugguccgg

SEQ ID NO: 3438642 - RNA, 13 nt, Pseudomonas aeruginosa PA01
agcucggcgagga

SEQ ID NO: 3438643 - RNA, 22 nt, Pseudomonas aeruginosa PA01
agcucggcgauccgcgcuuccg

SEQ ID NO: 3438644 - RNA, 15 nt, Pseudomonas aeruginosa PA01
agcucggcgaugccg

SEQ ID NO: 3438645 - RNA, 22 nt, Pseudomonas aeruginosa PA01
agcucggcgaugccgccgggca

SEQ ID NO: 3438646 - RNA, 14 nt, Pseudomonas aeruginosa PA01
agcucggcgauggc

SEQ ID NO: 3438647 - RNA, 18 nt, Pseudomonas aeruginosa PA01
agcucggcgauggcgcgc

SEQ ID NO: 3438648 - RNA, 16 nt, Pseudomonas aeruginosa PA01
agcucggcgcccuggc

SEQ ID NO: 3438649 - RNA, 19 nt, Pseudomonas aeruginosa PA01
agcucggcgcccuggccgc

SEQ ID NO: 3438650 - RNA, 21 nt, Pseudomonas aeruginosa PA01
agcucggcgcccuggccgcca

SEQ ID NO: 3438651 - RNA, 19 nt, Pseudomonas aeruginosa PA01
agcucggcgggacggcgca

SEQ ID NO: 3438652 - RNA, 21 nt, Pseudomonas aeruginosa PA01
agcucggcguagcgcugggcu

SEQ ID NO: 3438653 - RNA, 18 nt, Pseudomonas aeruginosa PA01
agcucggucagcggcgca

SEQ ID NO: 3438654 - RNA, 18 nt, Pseudomonas aeruginosa PA01
agcucggugagcaggcgc

SEQ ID NO: 3438655 - RNA, 21 nt, Pseudomonas aeruginosa PA01
agcuucagaccgacacguuca

SEQ ID NO: 3438656 - RNA, 14 nt, Pseudomonas aeruginosa PA01
agcuucagccgacc

SEQ ID NO: 3438657 - RNA, 14 nt, Pseudomonas aeruginosa PA01
agcuucaggcgcac

SEQ ID NO: 3438658 - RNA, 20 nt, Pseudomonas aeruginosa PA01
agcuucaggcgcacuacgcc

SEQ ID NO: 3438659 - RNA, 12 nt, Pseudomonas aeruginosa PA01
agcuucagggug

SEQ ID NO: 3438660 - RNA, 19 nt, Pseudomonas aeruginosa PA01
agcuucaucgaggugcuug

SEQ ID NO: 3438661 - RNA, 17 nt, Pseudomonas aeruginosa PA01
agcuuccaggcgcgcug

SEQ ID NO: 3438662 - RNA, 13 nt, Pseudomonas aeruginosa PA01
agcuucgccgccc

SEQ ID NO: 3438663 - RNA, 14 nt, Pseudomonas aeruginosa PA01
agcuucgccgcccu

SEQ ID NO: 3438664 - RNA, 15 nt, Pseudomonas aeruginosa PA01
agcuucgccgcccug

SEQ ID NO: 3438665 - RNA, 15 nt, Pseudomonas aeruginosa PA01
agcuucgccgcgcaa

SEQ ID NO: 3438666 - RNA, 22 nt, Pseudomonas aeruginosa PA01
agcuucgccgcgcaagcucguc

SEQ ID NO: 3438667 - RNA, 15 nt, Pseudomonas aeruginosa PA01
agcuucgucgcgcag

SEQ ID NO: 3438668 - RNA, 18 nt, Pseudomonas aeruginosa PA01
agcuucgucgcgcaggcg

SEQ ID NO: 3438669 - RNA, 20 nt, Pseudomonas aeruginosa PA01
agcuucgucgcgcaggcggg

SEQ ID NO: 3438670 - RNA, 22 nt, Pseudomonas aeruginosa PA01
agcuucgucgcgcaggcgggcg

SEQ ID NO: 3438671 - RNA, 23 nt, Pseudomonas aeruginosa PA01
agcuucgucgcgcaggcgggcgg

SEQ ID NO: 3438672 - RNA, 17 nt, Pseudomonas aeruginosa PA01
agcuucuacuucggcuu

SEQ ID NO: 3438673 - RNA, 18 nt, Pseudomonas aeruginosa PA01
agcuucucgucgccgccg

SEQ ID NO: 3438674 - RNA, 22 nt, Pseudomonas aeruginosa PA01
agcuucucuuucaccuggucgc

SEQ ID NO: 3438675 - RNA, 23 nt, Pseudomonas aeruginosa PA01
agcuucucuuucaccuggucgcc

SEQ ID NO: 3438676 - RNA, 19 nt, Pseudomonas aeruginosa PA01
agcuucuucagcagcgggc

SEQ ID NO: 3438677 - RNA, 22 nt, Pseudomonas aeruginosa PA01
agcuucuucggcagccauuuua

SEQ ID NO: 3438678 - RNA, 16 nt, Pseudomonas aeruginosa PA01
agcuucuugccuucca

SEQ ID NO: 3438679 - RNA, 18 nt, Pseudomonas aeruginosa PA01
agcuugaccuugccgccg

SEQ ID NO: 3438680 - RNA, 18 nt, Pseudomonas aeruginosa PA01
agcuugauguaggacagg

SEQ ID NO: 3438681 - RNA, 20 nt, Pseudomonas aeruginosa PA01
agcuugcaauccgugcgccg

SEQ ID NO: 3438682 - RNA, 20 nt, Pseudomonas aeruginosa PA01
agcuugccgcaggucuuguc

SEQ ID NO: 3438683 - RNA, 14 nt, Pseudomonas aeruginosa PA01
agcuugccgcugcg

SEQ ID NO: 3438684 - RNA, 13 nt, Pseudomonas aeruginosa PA01
agcuugccuucca

SEQ ID NO: 3438685 - RNA, 16 nt, Pseudomonas aeruginosa PA01
agcuugcgccagagca

SEQ ID NO: 3438686 - RNA, 18 nt, Pseudomonas aeruginosa PA01
agcuugcgccagagcagg

SEQ ID NO: 3438687 - RNA, 22 nt, Pseudomonas aeruginosa PA01
agcuugcuggcguucucggcca

SEQ ID NO: 3438688 - RNA, 17 nt, Pseudomonas aeruginosa PA01
agcuuggcacggccggc

SEQ ID NO: 3438689 - RNA, 16 nt, Pseudomonas aeruginosa PA01
agcuuggccagcaggc

SEQ ID NO: 3438690 - RNA, 22 nt, Pseudomonas aeruginosa PA01
agcuuggccagcaggccgagcg

SEQ ID NO: 3438691 - RNA, 12 nt, Pseudomonas aeruginosa PA01
agcuuggcccug

SEQ ID NO: 3438692 - RNA, 15 nt, Pseudomonas aeruginosa PA01
agcuuggcccuggcc

SEQ ID NO: 3438693 - RNA, 19 nt, Pseudomonas aeruginosa PA01
agcuuggcgaauagccggc

SEQ ID NO: 3438694 - RNA, 20 nt, Pseudomonas aeruginosa PA01
agcuuggcgaauagccggcg

SEQ ID NO: 3438695 - RNA, 16 nt, Pseudomonas aeruginosa PA01
agcuugggauggccag

SEQ ID NO: 3438696 - RNA, 17 nt, Pseudomonas aeruginosa PA01
agcuugggauggccagc

SEQ ID NO: 3438697 - RNA, 20 nt, Pseudomonas aeruginosa PA01
agcuugguauccaccucgcc

SEQ ID NO: 3438698 - RNA, 21 nt, Pseudomonas aeruginosa PA01
agcuuguaguagcgcccgacg

SEQ ID NO: 3438699 - RNA, 13 nt, Pseudomonas aeruginosa PA01
agcuuguccacgc

SEQ ID NO: 3438700 - RNA, 22 nt, Pseudomonas aeruginosa PA01
agcuugugggcaugcucggcca

SEQ ID NO: 3438701 - RNA, 23 nt, Pseudomonas aeruginosa PA01
agcuugugggcaugcucggccag

SEQ ID NO: 3438702 - RNA, 17 nt, Pseudomonas aeruginosa PA01
agcuuguggucguggcg

SEQ ID NO: 3438703 - RNA, 18 nt, Pseudomonas aeruginosa PA01
agcuuguggucguggcgg

SEQ ID NO: 3438704 - RNA, 18 nt, Pseudomonas aeruginosa PA01
agcuuguugcgcaggcga

SEQ ID NO: 3438705 - RNA, 15 nt, Pseudomonas aeruginosa PA01
agcuuguuggccagc

SEQ ID NO: 3438706 - RNA, 17 nt, Pseudomonas aeruginosa PA01
agcuuguuggccagcag

SEQ ID NO: 3438707 - RNA, 12 nt, Pseudomonas aeruginosa PA01
agcuuuccaggg

SEQ ID NO: 3438708 - RNA, 16 nt, Pseudomonas aeruginosa PA01
agcuuugcagggcgau

SEQ ID NO: 3438709 - RNA, 20 nt, Pseudomonas aeruginosa PA01
agcuuugcgcagccacccgc

SEQ ID NO: 3438710 - RNA, 16 nt, Pseudomonas aeruginosa PA01
aggaaaaggauuuccg

SEQ ID NO: 3438711 - RNA, 13 nt, Pseudomonas aeruginosa PA01
aggaaacccaugc

SEQ ID NO: 3438712 - RNA, 13 nt, Pseudomonas aeruginosa PA01
aggaacacccaga

SEQ ID NO: 3438713 - RNA, 13 nt, Pseudomonas aeruginosa PA01
aggaacacccggu

SEQ ID NO: 3438714 - RNA, 14 nt, Pseudomonas aeruginosa PA01
aggaacacccgguc

SEQ ID NO: 3438715 - RNA, 14 nt, Pseudomonas aeruginosa PA01
aggaacagcgagag

SEQ ID NO: 3438716 - RNA, 13 nt, Pseudomonas aeruginosa PA01
aggaacaggucga

SEQ ID NO: 3438717 - RNA, 14 nt, Pseudomonas aeruginosa PA01
aggaacagguucgg

SEQ ID NO: 3438718 - RNA, 19 nt, Pseudomonas aeruginosa PA01
aggaacagguucggcaggc

SEQ ID NO: 3438719 - RNA, 20 nt, Pseudomonas aeruginosa PA01
aggaacagguucggcaggcc

SEQ ID NO: 3438720 - RNA, 11 nt, Pseudomonas aeruginosa PA01
aggaacaguug

SEQ ID NO: 3438721 - RNA, 16 nt, Pseudomonas aeruginosa PA01
aggaacauccgcggcc

SEQ ID NO: 3438722 - RNA, 22 nt, Pseudomonas aeruginosa PA01
aggaaccaggggucgacgcagg

SEQ ID NO: 3438723 - RNA, 18 nt, Pseudomonas aeruginosa PA01
aggaacccaaucacaacg

SEQ ID NO: 3438724 - RNA, 17 nt, Pseudomonas aeruginosa PA01
aggaaccgacgcgcagg

SEQ ID NO: 3438725 - RNA, 22 nt, Pseudomonas aeruginosa PA01
aggaacgcccgcggcagcagcc

SEQ ID NO: 3438726 - RNA, 16 nt, Pseudomonas aeruginosa PA01
aggaacuggaagccug

SEQ ID NO: 3438727 - RNA, 14 nt, Pseudomonas aeruginosa PA01
aggaagaaggcguc

SEQ ID NO: 3438728 - RNA, 13 nt, Pseudomonas aeruginosa PA01
aggaagagcagcg

SEQ ID NO: 3438729 - RNA, 13 nt, Pseudomonas aeruginosa PA01
aggaagagcaggc

SEQ ID NO: 3438730 - RNA, 14 nt, Pseudomonas aeruginosa PA01
aggaagagcccgcc

SEQ ID NO: 3438731 - RNA, 17 nt, Pseudomonas aeruginosa PA01
aggaagagcccgccacg

SEQ ID NO: 3438732 - RNA, 12 nt, Pseudomonas aeruginosa PA01
aggaagccgacc

SEQ ID NO: 3438733 - RNA, 13 nt, Pseudomonas aeruginosa PA01
aggaagccgacca

SEQ ID NO: 3438734 - RNA, 13 nt, Pseudomonas aeruginosa PA01
aggaagccgaccg

SEQ ID NO: 3438735 - RNA, 17 nt, Pseudomonas aeruginosa PA01
aggaagccgaccggcgc

SEQ ID NO: 3438736 - RNA, 15 nt, Pseudomonas aeruginosa PA01
aggaagcgccgggcc

SEQ ID NO: 3438737 - RNA, 18 nt, Pseudomonas aeruginosa PA01
aggaagcgccgggccgca

SEQ ID NO: 3438738 - RNA, 22 nt, Pseudomonas aeruginosa PA01
aggaagcgucgugcgccggccu

SEQ ID NO: 3438739 - RNA, 16 nt, Pseudomonas aeruginosa PA01
aggaagcugcgcucgg

SEQ ID NO: 3438740 - RNA, 14 nt, Pseudomonas aeruginosa PA01
aggaaggccagcag

SEQ ID NO: 3438741 - RNA, 15 nt, Pseudomonas aeruginosa PA01
aggaaggccagcagg

SEQ ID NO: 3438742 - RNA, 21 nt, Pseudomonas aeruginosa PA01
aggaaggccaggucgcccacc

SEQ ID NO: 3438743 - RNA, 14 nt, Pseudomonas aeruginosa PA01
aggaaggccgggcc

SEQ ID NO: 3438744 - RNA, 22 nt, Pseudomonas aeruginosa PA01
aggaaggccuggaacaccaggc

SEQ ID NO: 3438745 - RNA, 15 nt, Pseudomonas aeruginosa PA01
aggaaggcgccggca

SEQ ID NO: 3438746 - RNA, 16 nt, Pseudomonas aeruginosa PA01
aggaaggcuuccggcu

SEQ ID NO: 3438747 - RNA, 16 nt, Pseudomonas aeruginosa PA01
aggaagucggcggccg

SEQ ID NO: 3438748 - RNA, 13 nt, Pseudomonas aeruginosa PA01
aggaaguggaucg

SEQ ID NO: 3438749 - RNA, 17 nt, Pseudomonas aeruginosa PA01
aggaaguggaucggccc

SEQ ID NO: 3438750 - RNA, 14 nt, Pseudomonas aeruginosa PA01
aggaaguggccggu

SEQ ID NO: 3438751 - RNA, 18 nt, Pseudomonas aeruginosa PA01
aggaaguucacguaggag

SEQ ID NO: 3438752 - RNA, 20 nt, Pseudomonas aeruginosa PA01
aggaaguugcgcagcaacug

SEQ ID NO: 3438753 - RNA, 13 nt, Pseudomonas aeruginosa PA01
aggaaucuucggc

SEQ ID NO: 3438754 - RNA, 17 nt, Pseudomonas aeruginosa PA01
aggaaucuucggcgccc

SEQ ID NO: 3438755 - RNA, 15 nt, Pseudomonas aeruginosa PA01
aggaauuccuggccg

SEQ ID NO: 3438756 - RNA, 22 nt, Pseudomonas aeruginosa PA01
aggaauucgggaagggaucgac

SEQ ID NO: 3438757 - RNA, 21 nt, Pseudomonas aeruginosa PA01
aggacaacacuuccucguggg

SEQ ID NO: 3438758 - RNA, 22 nt, Pseudomonas aeruginosa PA01
aggaucuucuccgauuccugcg

SEQ ID NO: 3438759 - RNA, 15 nt, Pseudomonas aeruginosa PA01
aggaugaccaggcug

SEQ ID NO: 3438760 - RNA, 16 nt, Pseudomonas aeruginosa PA01
aggaugaugacgaggg

SEQ ID NO: 3438761 - RNA, 16 nt, Pseudomonas aeruginosa PA01
aggaugcaaccgcccu

SEQ ID NO: 3438762 - RNA, 18 nt, Pseudomonas aeruginosa PA01
aggaugcagucggcaccg

SEQ ID NO: 3438763 - RNA, 22 nt, Pseudomonas aeruginosa PA01
aggaugcagucggcaccgaucg

SEQ ID NO: 3438764 - RNA, 15 nt, Pseudomonas aeruginosa PA01
aggaugccggccucg

SEQ ID NO: 3438765 - RNA, 21 nt, Pseudomonas aeruginosa PA01
aggaugccguacuugaaggug

SEQ ID NO: 3438766 - RNA, 14 nt, Pseudomonas aeruginosa PA01
aggaugcgccagcg

SEQ ID NO: 3438767 - RNA, 15 nt, Pseudomonas aeruginosa PA01
aggaugcgccagcgg

SEQ ID NO: 3438768 - RNA, 16 nt, Pseudomonas aeruginosa PA01
aggaugcugcacagcc

SEQ ID NO: 3438769 - RNA, 15 nt, Pseudomonas aeruginosa PA01
aggauggacagcuug

SEQ ID NO: 3438770 - RNA, 21 nt, Pseudomonas aeruginosa PA01
aggaugggcgaagccggcggc

SEQ ID NO: 3438771 - RNA, 17 nt, Pseudomonas aeruginosa PA01
aggauggucaggccggc

SEQ ID NO: 3438772 - RNA, 20 nt, Pseudomonas aeruginosa PA01
aggaugucggcgaacuggcc

SEQ ID NO: 3438773 - RNA, 18 nt, Pseudomonas aeruginosa PA01
aggauguugaacaggcuc

SEQ ID NO: 3438774 - RNA, 20 nt, Pseudomonas aeruginosa PA01
aggauucagcaggaauucgg

SEQ ID NO: 3438775 - RNA, 15 nt, Pseudomonas aeruginosa PA01
aggauucgccagccu

SEQ ID NO: 3438776 - RNA, 21 nt, Pseudomonas aeruginosa PA01
aggauuuccgcgcccggcugg

SEQ ID NO: 3438777 - RNA, 21 nt, Pseudomonas aeruginosa PA01
aggauuuucuccggcgccggg

SEQ ID NO: 3438778 - RNA, 23 nt, Pseudomonas aeruginosa PA01
aggauuuucuccggcgccgggcu

SEQ ID NO: 3438779 - RNA, 17 nt, Pseudomonas aeruginosa PA01
aggcaaagcgcgggcug

SEQ ID NO: 3438780 - RNA, 23 nt, Pseudomonas aeruginosa PA01
aggcaaagcgcgggcugccccuc

SEQ ID NO: 3438781 - RNA, 18 nt, Pseudomonas aeruginosa PA01
aggcaacaccaucggccc

SEQ ID NO: 3438782 - RNA, 15 nt, Pseudomonas aeruginosa PA01
aggcaacagcccgcg

SEQ ID NO: 3438783 - RNA, 14 nt, Pseudomonas aeruginosa PA01
aggcaacggagcug

SEQ ID NO: 3438784 - RNA, 19 nt, Pseudomonas aeruginosa PA01
aggcaacggagcugguacg

SEQ ID NO: 3438785 - RNA, 22 nt, Pseudomonas aeruginosa PA01
aggcaagacgaaagagcccggc

SEQ ID NO: 3438786 - RNA, 23 nt, Pseudomonas aeruginosa PA01
aggcaagcgcaugaggcuggcca

SEQ ID NO: 3438787 - RNA, 16 nt, Pseudomonas aeruginosa PA01
aggcaauggccggcgg

SEQ ID NO: 3438788 - RNA, 14 nt, Pseudomonas aeruginosa PA01
aggcacacgcccgg

SEQ ID NO: 3438789 - RNA, 13 nt, Pseudomonas aeruginosa PA01
aggcacaggaccc

SEQ ID NO: 3438790 - RNA, 13 nt, Pseudomonas aeruginosa PA01
aggcaccaccgcc

SEQ ID NO: 3438791 - RNA, 18 nt, Pseudomonas aeruginosa PA01
aggcaccaccgccgccag

SEQ ID NO: 3438792 - RNA, 22 nt, Pseudomonas aeruginosa PA01
aggcaccaccgccgccagcaac

SEQ ID NO: 3438793 - RNA, 20 nt, Pseudomonas aeruginosa PA01
aggcacgaaccguccgcagc

SEQ ID NO: 3438794 - RNA, 14 nt, Pseudomonas aeruginosa PA01
aggcacgcugccag

SEQ ID NO: 3438795 - RNA, 21 nt, Pseudomonas aeruginosa PA01
aggcacgcugccagcaggccg

SEQ ID NO: 3438796 - RNA, 14 nt, Pseudomonas aeruginosa PA01
aggcagaccagcgc

SEQ ID NO: 3438797 - RNA, 12 nt, Pseudomonas aeruginosa PA01
aggcagaccagg

SEQ ID NO: 3438798 - RNA, 16 nt, Pseudomonas aeruginosa PA01
aggcagaccaggccga

SEQ ID NO: 3438799 - RNA, 18 nt, Pseudomonas aeruginosa PA01
aggcagaccaggccgagc

SEQ ID NO: 3438800 - RNA, 16 nt, Pseudomonas aeruginosa PA01
aggcagaucgcgccga

SEQ ID NO: 3438801 - RNA, 16 nt, Pseudomonas aeruginosa PA01
aggcagcagagcgcca

SEQ ID NO: 3438802 - RNA, 13 nt, Pseudomonas aeruginosa PA01
aggcagccggcca

SEQ ID NO: 3438803 - RNA, 18 nt, Pseudomonas aeruginosa PA01
aggcagccggccaugcug

SEQ ID NO: 3438804 - RNA, 14 nt, Pseudomonas aeruginosa PA01
aggcagccgucggu

SEQ ID NO: 3438805 - RNA, 17 nt, Pseudomonas aeruginosa PA01
aggcagcgaucgccgcc

SEQ ID NO: 3438806 - RNA, 11 nt, Pseudomonas aeruginosa PA01
aggcagcgccg

SEQ ID NO: 3438807 - RNA, 14 nt, Pseudomonas aeruginosa PA01
aggcagcgccgccc

SEQ ID NO: 3438808 - RNA, 17 nt, Pseudomonas aeruginosa PA01
aggcagcgggccaggcg

SEQ ID NO: 3438809 - RNA, 16 nt, Pseudomonas aeruginosa PA01
aggcaggcauggugga

SEQ ID NO: 3438810 - RNA, 15 nt, Pseudomonas aeruginosa PA01
aggcaggccugggca

SEQ ID NO: 3438811 - RNA, 20 nt, Pseudomonas aeruginosa PA01
aggcaggcgaugaccgcccc

SEQ ID NO: 3438812 - RNA, 15 nt, Pseudomonas aeruginosa PA01
aggcaggcgcggcau

SEQ ID NO: 3438813 - RNA, 24 nt, Pseudomonas aeruginosa PA01
aggcagucccagaaggccagggca

SEQ ID NO: 3438814 - RNA, 21 nt, Pseudomonas aeruginosa PA01
aggcagucguaggucugcccg

SEQ ID NO: 3438815 - RNA, 15 nt, Pseudomonas aeruginosa PA01
aggcagugccgggcg

SEQ ID NO: 3438816 - RNA, 20 nt, Pseudomonas aeruginosa PA01
aggcaguggcgccagccagc

SEQ ID NO: 3438817 - RNA, 16 nt, Pseudomonas aeruginosa PA01
aggcauccagcaccgc

SEQ ID NO: 3438818 - RNA, 17 nt, Pseudomonas aeruginosa PA01
aggcauccagcaccgcu

SEQ ID NO: 3438819 - RNA, 22 nt, Pseudomonas aeruginosa PA01
aggcauccccggaccagggcgc

SEQ ID NO: 3438820 - RNA, 17 nt, Pseudomonas aeruginosa PA01
aggcaucgacgccagcg

SEQ ID NO: 3438821 - RNA, 18 nt, Pseudomonas aeruginosa PA01
aggcaucgacgccagcgg

SEQ ID NO: 3438822 - RNA, 16 nt, Pseudomonas aeruginosa PA01
aggcaugcccaggcuc

SEQ ID NO: 3438823 - RNA, 14 nt, Pseudomonas aeruginosa PA01
aggcaugcggcccc

SEQ ID NO: 3438824 - RNA, 23 nt, Pseudomonas aeruginosa PA01
aggcaugcggccccggcgcucgc

SEQ ID NO: 3438825 - RNA, 23 nt, Pseudomonas aeruginosa PA01
aggcauucucgcgacccuggccg

SEQ ID NO: 3438826 - RNA, 22 nt, Pseudomonas aeruginosa PA01
aggcauugcacaacgggugcug

SEQ ID NO: 3438827 - RNA, 16 nt, Pseudomonas aeruginosa PA01
aggcauugccguccgu

SEQ ID NO: 3438828 - RNA, 16 nt, Pseudomonas aeruginosa PA01
aggccaaccaccccga

SEQ ID NO: 3438829 - RNA, 16 nt, Pseudomonas aeruginosa PA01
aggccaagucggccgc

SEQ ID NO: 3438830 - RNA, 22 nt, Pseudomonas aeruginosa PA01
aggccaagucggccgcccagcg

SEQ ID NO: 3438831 - RNA, 23 nt, Pseudomonas aeruginosa PA01
aggccaagucggccgcccagcgg

SEQ ID NO: 3438832 - RNA, 17 nt, Pseudomonas aeruginosa PA01
aggccaccaucgcggcg

SEQ ID NO: 3438833 - RNA, 22 nt, Pseudomonas aeruginosa PA01
aggccaccaucgcggcgauggc

SEQ ID NO: 3438834 - RNA, 14 nt, Pseudomonas aeruginosa PA01
aggccacccgccuc

SEQ ID NO: 3438835 - RNA, 13 nt, Pseudomonas aeruginosa PA01
aggccaccggugg

SEQ ID NO: 3438836 - RNA, 16 nt, Pseudomonas aeruginosa PA01
aggccacgccgccguc

SEQ ID NO: 3438837 - RNA, 14 nt, Pseudomonas aeruginosa PA01
aggccacggccgcu

SEQ ID NO: 3438838 - RNA, 15 nt, Pseudomonas aeruginosa PA01
aggccacggccggcg

SEQ ID NO: 3438839 - RNA, 13 nt, Pseudomonas aeruginosa PA01
aggccacggcgga

SEQ ID NO: 3438840 - RNA, 16 nt, Pseudomonas aeruginosa PA01
aggccagcaccucgac

SEQ ID NO: 3438841 - RNA, 13 nt, Pseudomonas aeruginosa PA01
aggccagcaggua

SEQ ID NO: 3438842 - RNA, 22 nt, Pseudomonas aeruginosa PA01
aggccagcagguagccugcggc

SEQ ID NO: 3438843 - RNA, 22 nt, Pseudomonas aeruginosa PA01
aggccagccaacugcuucaggc

SEQ ID NO: 3438844 - RNA, 12 nt, Pseudomonas aeruginosa PA01
aggccagcccca

SEQ ID NO: 3438845 - RNA, 12 nt, Pseudomonas aeruginosa PA01
aggccagcgcca

SEQ ID NO: 3438846 - RNA, 17 nt, Pseudomonas aeruginosa PA01
aggccagcgccagguug

SEQ ID NO: 3438847 - RNA, 22 nt, Pseudomonas aeruginosa PA01
aggccagcggcauccgccgcug

SEQ ID NO: 3438848 - RNA, 21 nt, Pseudomonas aeruginosa PA01
aggccagcggcuccucggccu

SEQ ID NO: 3438849 - RNA, 18 nt, Pseudomonas aeruginosa PA01
aggccagcuuccaggcgc

SEQ ID NO: 3438850 - RNA, 18 nt, Pseudomonas aeruginosa PA01
aggccagcuugucggccu

SEQ ID NO: 3438851 - RNA, 17 nt, Pseudomonas aeruginosa PA01
aggccaggaucgucggc

SEQ ID NO: 3438852 - RNA, 19 nt, Pseudomonas aeruginosa PA01
aggccaggcaaucgaucgc

SEQ ID NO: 3438853 - RNA, 13 nt, Pseudomonas aeruginosa PA01
aggccaggcccca

SEQ ID NO: 3438854 - RNA, 13 nt, Pseudomonas aeruginosa PA01
aggccaggccggc

SEQ ID NO: 3438855 - RNA, 16 nt, Pseudomonas aeruginosa PA01
aggccaggccggcgcc

SEQ ID NO: 3438856 - RNA, 16 nt, Pseudomonas aeruginosa PA01
aggccaggcgauacgc

SEQ ID NO: 3438857 - RNA, 18 nt, Pseudomonas aeruginosa PA01
aggccaggcgcagugccu

SEQ ID NO: 3438858 - RNA, 19 nt, Pseudomonas aeruginosa PA01
aggccaggcucgguucugc

SEQ ID NO: 3438859 - RNA, 13 nt, Pseudomonas aeruginosa PA01
aggccaugagguu

SEQ ID NO: 3438860 - RNA, 18 nt, Pseudomonas aeruginosa PA01
aggccaugagguuggcca

SEQ ID NO: 3438861 - RNA, 19 nt, Pseudomonas aeruginosa PA01
aggccgccaugcucggcca

SEQ ID NO: 3438862 - RNA, 16 nt, Pseudomonas aeruginosa PA01
aggccgcccagcgcag

SEQ ID NO: 3438863 - RNA, 14 nt, Pseudomonas aeruginosa PA01
aggccgcccaggac

SEQ ID NO: 3438864 - RNA, 21 nt, Pseudomonas aeruginosa PA01
aggccgcccuugaccccaccg

SEQ ID NO: 3438865 - RNA, 15 nt, Pseudomonas aeruginosa PA01
aggccgccgaagaac

SEQ ID NO: 3438866 - RNA, 22 nt, Pseudomonas aeruginosa PA01
aggccgccgaagaacucggcgc

SEQ ID NO: 3438867 - RNA, 19 nt, Pseudomonas aeruginosa PA01
aggccgccgauccaggaac

SEQ ID NO: 3438868 - RNA, 15 nt, Pseudomonas aeruginosa PA01
aggccgccgcgucga

SEQ ID NO: 3438869 - RNA, 19 nt, Pseudomonas aeruginosa PA01
aggccgccgcgucgaagcu

SEQ ID NO: 3438870 - RNA, 19 nt, Pseudomonas aeruginosa PA01
aggccgccgcgugccgccg

SEQ ID NO: 3438871 - RNA, 16 nt, Pseudomonas aeruginosa PA01
aggccgccggcgaccg

SEQ ID NO: 3438872 - RNA, 13 nt, Pseudomonas aeruginosa PA01
aggccgccggcgg

SEQ ID NO: 3438873 - RNA, 21 nt, Pseudomonas aeruginosa PA01
aggccgccguagaguucggcu

SEQ ID NO: 3438874 - RNA, 23 nt, Pseudomonas aeruginosa PA01
aggccgccguagaguucggcugc

SEQ ID NO: 3438875 - RNA, 15 nt, Pseudomonas aeruginosa PA01
aggccgcgcagcaac

SEQ ID NO: 3438876 - RNA, 20 nt, Pseudomonas aeruginosa PA01
aggccgcgcagcaacggcgc

SEQ ID NO: 3438877 - RNA, 23 nt, Pseudomonas aeruginosa PA01
aggccgcggagcaccgcgccuuc

SEQ ID NO: 3438878 - RNA, 15 nt, Pseudomonas aeruginosa PA01
aggccgcggcccugc

SEQ ID NO: 3438879 - RNA, 20 nt, Pseudomonas aeruginosa PA01
aggccgcucaccgccacccc

SEQ ID NO: 3438880 - RNA, 15 nt, Pseudomonas aeruginosa PA01
aggccgcugccgccg

SEQ ID NO: 3438881 - RNA, 16 nt, Pseudomonas aeruginosa PA01
aggccgcugccugucg

SEQ ID NO: 3438882 - RNA, 21 nt, Pseudomonas aeruginosa PA01
aggccgcugccugucgcagcg

SEQ ID NO: 3438883 - RNA, 21 nt, Pseudomonas aeruginosa PA01
aggccgcuggcgacgcuuucc

SEQ ID NO: 3438884 - RNA, 15 nt, Pseudomonas aeruginosa PA01
aggccgcuggcggcg

SEQ ID NO: 3438885 - RNA, 18 nt, Pseudomonas aeruginosa PA01
aggccgcuuacgcggccu

SEQ ID NO: 3438886 - RNA, 21 nt, Pseudomonas aeruginosa PA01
aggccgcuuccggcccggcca

SEQ ID NO: 3438887 - RNA, 23 nt, Pseudomonas aeruginosa PA01
aggccggcaugcagguggcgcuc

SEQ ID NO: 3438888 - RNA, 14 nt, Pseudomonas aeruginosa PA01
aggccggccaggga

SEQ ID NO: 3438889 - RNA, 13 nt, Pseudomonas aeruginosa PA01
aggccggccucca

SEQ ID NO: 3438890 - RNA, 18 nt, Pseudomonas aeruginosa PA01
aggccggccuccagcgcc

SEQ ID NO: 3438891 - RNA, 19 nt, Pseudomonas aeruginosa PA01
aggccggccuccagcgccu

SEQ ID NO: 3438892 - RNA, 19 nt, Pseudomonas aeruginosa PA01
aggccggcgaccagcgucg

SEQ ID NO: 3438893 - RNA, 20 nt, Pseudomonas aeruginosa PA01
aggccggcgaccagcgucgc

SEQ ID NO: 3438894 - RNA, 19 nt, Pseudomonas aeruginosa PA01
aggccggcgagggcggcga

SEQ ID NO: 3438895 - RNA, 20 nt, Pseudomonas aeruginosa PA01
aggccggcgagggcggcgac

SEQ ID NO: 3438896 - RNA, 21 nt, Pseudomonas aeruginosa PA01
aggccggcgagggcggcgacc

SEQ ID NO: 3438897 - RNA, 18 nt, Pseudomonas aeruginosa PA01
aggccggcgcaucgucga

SEQ ID NO: 3438898 - RNA, 14 nt, Pseudomonas aeruginosa PA01
aggccggcgccgau

SEQ ID NO: 3438899 - RNA, 16 nt, Pseudomonas aeruginosa PA01
aggccggcgccgccga

SEQ ID NO: 3438900 - RNA, 13 nt, Pseudomonas aeruginosa PA01
aggccggcgccuu

SEQ ID NO: 3438901 - RNA, 16 nt, Pseudomonas aeruginosa PA01
aggccggcgccuugcg

SEQ ID NO: 3438902 - RNA, 22 nt, Pseudomonas aeruginosa PA01
aggccggcggccgaggcuuccu

SEQ ID NO: 3438903 - RNA, 17 nt, Pseudomonas aeruginosa PA01
aggccggcgugcccauc

SEQ ID NO: 3438904 - RNA, 19 nt, Pseudomonas aeruginosa PA01
aggccgggaauggagaugc

SEQ ID NO: 3438905 - RNA, 15 nt, Pseudomonas aeruginosa PA01
aggccgggcccuggg

SEQ ID NO: 3438906 - RNA, 14 nt, Pseudomonas aeruginosa PA01
aggccgggcggcgg

SEQ ID NO: 3438907 - RNA, 16 nt, Pseudomonas aeruginosa PA01
aggccgggcuggccac

SEQ ID NO: 3438908 - RNA, 18 nt, Pseudomonas aeruginosa PA01
aggccgggucgcagccgg

SEQ ID NO: 3438909 - RNA, 23 nt, Pseudomonas aeruginosa PA01
aggccggugcagaagacgcccag

SEQ ID NO: 3438910 - RNA, 15 nt, Pseudomonas aeruginosa PA01
aggccggugccgccg

SEQ ID NO: 3438911 - RNA, 16 nt, Pseudomonas aeruginosa PA01
aggccggugccgccgg

SEQ ID NO: 3438912 - RNA, 16 nt, Pseudomonas aeruginosa PA01
aggccgguugcgaccg

SEQ ID NO: 3438913 - RNA, 19 nt, Pseudomonas aeruginosa PA01
aggccguagaccaccagca

SEQ ID NO: 3438914 - RNA, 13 nt, Pseudomonas aeruginosa PA01
aggccguaggcga

SEQ ID NO: 3438915 - RNA, 21 nt, Pseudomonas aeruginosa PA01
aggccguaggcgauggccugg

SEQ ID NO: 3438916 - RNA, 21 nt, Pseudomonas aeruginosa PA01
aggccguccuugaguagcugg

SEQ ID NO: 3438917 - RNA, 22 nt, Pseudomonas aeruginosa PA01
aggccgucgagggcaaaggcgc

SEQ ID NO: 3438918 - RNA, 14 nt, Pseudomonas aeruginosa PA01
aggccgucgcugcc

SEQ ID NO: 3438919 - RNA, 16 nt, Pseudomonas aeruginosa PA01
aggccgugccagagcu

SEQ ID NO: 3438920 - RNA, 17 nt, Pseudomonas aeruginosa PA01
aggccgugccagagcuu

SEQ ID NO: 3438921 - RNA, 16 nt, Pseudomonas aeruginosa PA01
aggccgugggccggcg

SEQ ID NO: 3438922 - RNA, 21 nt, Pseudomonas aeruginosa PA01
aggccgugggccggcgcgccg

SEQ ID NO: 3438923 - RNA, 14 nt, Pseudomonas aeruginosa PA01
aggccgugguggca

SEQ ID NO: 3438924 - RNA, 18 nt, Pseudomonas aeruginosa PA01
aggccuacuucucgacga

SEQ ID NO: 3438925 - RNA, 17 nt, Pseudomonas aeruginosa PA01
aggccucccagccgugg

SEQ ID NO: 3438926 - RNA, 19 nt, Pseudomonas aeruginosa PA01
aggccuccucguaggcguc

SEQ ID NO: 3438927 - RNA, 19 nt, Pseudomonas aeruginosa PA01
aggccucgaugaucgccgg

SEQ ID NO: 3438928 - RNA, 20 nt, Pseudomonas aeruginosa PA01
aggccucgaugaucgccggg

SEQ ID NO: 3438929 - RNA, 19 nt, Pseudomonas aeruginosa PA01
aggccucggcauccucgcc

SEQ ID NO: 3438930 - RNA, 13 nt, Pseudomonas aeruginosa PA01
aggccucggccug

SEQ ID NO: 3438931 - RNA, 17 nt, Pseudomonas aeruginosa PA01
aggccucggccuggucg

SEQ ID NO: 3438932 - RNA, 13 nt, Pseudomonas aeruginosa PA01
aggccucggcgau

SEQ ID NO: 3438933 - RNA, 17 nt, Pseudomonas aeruginosa PA01
aggccucggcgaugccg

SEQ ID NO: 3438934 - RNA, 20 nt, Pseudomonas aeruginosa PA01
aggccucggcgaugccggag

SEQ ID NO: 3438935 - RNA, 21 nt, Pseudomonas aeruginosa PA01
aggccucggucaggcgcuggu

SEQ ID NO: 3438936 - RNA, 22 nt, Pseudomonas aeruginosa PA01
aggccucgguggcccacuccag

SEQ ID NO: 3438937 - RNA, 19 nt, Pseudomonas aeruginosa PA01
aggccucgucgaucucgcc

SEQ ID NO: 3438938 - RNA, 22 nt, Pseudomonas aeruginosa PA01
aggccucgucguucagcccacc

SEQ ID NO: 3438939 - RNA, 19 nt, Pseudomonas aeruginosa PA01
aggccugacgcaagcgcuc

SEQ ID NO: 3438940 - RNA, 18 nt, Pseudomonas aeruginosa PA01
aggccuggaacaccaggc

SEQ ID NO: 3438941 - RNA, 19 nt, Pseudomonas aeruginosa PA01
aggccuggaacaccaggcc

SEQ ID NO: 3438942 - RNA, 18 nt, Pseudomonas aeruginosa PA01
aggccuggagcgccucga

SEQ ID NO: 3438943 - RNA, 20 nt, Pseudomonas aeruginosa PA01
aggccuggcccuggcgcagg

SEQ ID NO: 3438944 - RNA, 17 nt, Pseudomonas aeruginosa PA01
aggccuggccguugcgc

SEQ ID NO: 3438945 - RNA, 22 nt, Pseudomonas aeruginosa PA01
aggccuggccguugcgcaggcg

SEQ ID NO: 3438946 - RNA, 17 nt, Pseudomonas aeruginosa PA01
aggccuggcgcaacagg

SEQ ID NO: 3438947 - RNA, 20 nt, Pseudomonas aeruginosa PA01
aggccuggcgcaacaggcgc

SEQ ID NO: 3438948 - RNA, 22 nt, Pseudomonas aeruginosa PA01
aggccugggcguacaggcccca

SEQ ID NO: 3438949 - RNA, 15 nt, Pseudomonas aeruginosa PA01
aggccugggucacca

SEQ ID NO: 3438950 - RNA, 18 nt, Pseudomonas aeruginosa PA01
aggccugggucaccagca

SEQ ID NO: 3438951 - RNA, 22 nt, Pseudomonas aeruginosa PA01
aggccugguagaucugugcggu

SEQ ID NO: 3438952 - RNA, 17 nt, Pseudomonas aeruginosa PA01
aggccugguccuuauuc

SEQ ID NO: 3438953 - RNA, 14 nt, Pseudomonas aeruginosa PA01
aggccuguccgaag

SEQ ID NO: 3438954 - RNA, 22 nt, Pseudomonas aeruginosa PA01
aggccuguccgaagacaggccu

SEQ ID NO: 3438955 - RNA, 13 nt, Pseudomonas aeruginosa PA01
aggccuucgacgg

SEQ ID NO: 3438956 - RNA, 20 nt, Pseudomonas aeruginosa PA01
aggccuucgccgaccagguc

SEQ ID NO: 3438957 - RNA, 13 nt, Pseudomonas aeruginosa PA01
aggccuucggcgc

SEQ ID NO: 3438958 - RNA, 15 nt, Pseudomonas aeruginosa PA01
aggccuugcagcaac

SEQ ID NO: 3438959 - RNA, 19 nt, Pseudomonas aeruginosa PA01
aggccuugcagcaacucgc

SEQ ID NO: 3438960 - RNA, 19 nt, Pseudomonas aeruginosa PA01
aggccuugcagggccgcca

SEQ ID NO: 3438961 - RNA, 19 nt, Pseudomonas aeruginosa PA01
aggccuugcgcggcgccgg

SEQ ID NO: 3438962 - RNA, 20 nt, Pseudomonas aeruginosa PA01
aggccuuggaggaucgagcc

SEQ ID NO: 3438963 - RNA, 19 nt, Pseudomonas aeruginosa PA01
aggcgcccuugacguucag

SEQ ID NO: 3438964 - RNA, 22 nt, Pseudomonas aeruginosa PA01
aggcgcccuugacguucaggcu

SEQ ID NO: 3438965 - RNA, 16 nt, Pseudomonas aeruginosa PA01
aggcgccgaugcccag

SEQ ID NO: 3438966 - RNA, 18 nt, Pseudomonas aeruginosa PA01
aggcgccgaugcccaggc

SEQ ID NO: 3438967 - RNA, 17 nt, Pseudomonas aeruginosa PA01
aggcgccgauggcuguc

SEQ ID NO: 3438968 - RNA, 17 nt, Pseudomonas aeruginosa PA01
aggcgccgcgcauccuc

SEQ ID NO: 3438969 - RNA, 18 nt, Pseudomonas aeruginosa PA01
aggcgccggaccaacugc

SEQ ID NO: 3438970 - RNA, 13 nt, Pseudomonas aeruginosa PA01
aggcgccggcauu

SEQ ID NO: 3438971 - RNA, 13 nt, Pseudomonas aeruginosa PA01
aggcgccggccgg

SEQ ID NO: 3438972 - RNA, 16 nt, Pseudomonas aeruginosa PA01
aggcgccggccucgca

SEQ ID NO: 3438973 - RNA, 12 nt, Pseudomonas aeruginosa PA01
aggcgccggcgg

SEQ ID NO: 3438974 - RNA, 21 nt, Pseudomonas aeruginosa PA01
aggcgccggcggaucagcccg

SEQ ID NO: 3438975 - RNA, 12 nt, Pseudomonas aeruginosa PA01
aggcgccgggua

SEQ ID NO: 3438976 - RNA, 13 nt, Pseudomonas aeruginosa PA01
aggcgccuuccag

SEQ ID NO: 3438977 - RNA, 15 nt, Pseudomonas aeruginosa PA01
aggcgccuuccaggc

SEQ ID NO: 3438978 - RNA, 22 nt, Pseudomonas aeruginosa PA01
aggcgccuuccaggcgugccug

SEQ ID NO: 3438979 - RNA, 23 nt, Pseudomonas aeruginosa PA01
aggcgccuuccaggcgugccugu

SEQ ID NO: 3438980 - RNA, 19 nt, Pseudomonas aeruginosa PA01
aggcgcgaucgcguuccag

SEQ ID NO: 3438981 - RNA, 16 nt, Pseudomonas aeruginosa PA01
aggcgcgcaccagcgg

SEQ ID NO: 3438982 - RNA, 14 nt, Pseudomonas aeruginosa PA01
aggcgcgcaccugc

SEQ ID NO: 3438983 - RNA, 13 nt, Pseudomonas aeruginosa PA01
aggcgcgcagggc

SEQ ID NO: 3438984 - RNA, 14 nt, Pseudomonas aeruginosa PA01
aggcgcgcagggcc

SEQ ID NO: 3438985 - RNA, 16 nt, Pseudomonas aeruginosa PA01
aggcgcgccacgcaau

SEQ ID NO: 3438986 - RNA, 12 nt, Pseudomonas aeruginosa PA01
aggcgcgccgac

SEQ ID NO: 3438987 - RNA, 12 nt, Pseudomonas aeruginosa PA01
aggcgcgccggu

SEQ ID NO: 3438988 - RNA, 11 nt, Pseudomonas aeruginosa PA01
aggcgcgccug

SEQ ID NO: 3438989 - RNA, 22 nt, Pseudomonas aeruginosa PA01
aggcgcgccuggaucagcgccu

SEQ ID NO: 3438990 - RNA, 14 nt, Pseudomonas aeruginosa PA01
aggcgcgccuggcc

SEQ ID NO: 3438991 - RNA, 16 nt, Pseudomonas aeruginosa PA01
aggcgcgccuggcccu

SEQ ID NO: 3438992 - RNA, 14 nt, Pseudomonas aeruginosa PA01
aggcgcgccuggua

SEQ ID NO: 3438993 - RNA, 15 nt, Pseudomonas aeruginosa PA01
aggcgcgcgccgaac

SEQ ID NO: 3438994 - RNA, 16 nt, Pseudomonas aeruginosa PA01
aggcgcgcgccgaacu

SEQ ID NO: 3438995 - RNA, 15 nt, Pseudomonas aeruginosa PA01
aggcgcgcggccagc

SEQ ID NO: 3438996 - RNA, 16 nt, Pseudomonas aeruginosa PA01
aggcgcgcggccagcg

SEQ ID NO: 3438997 - RNA, 16 nt, Pseudomonas aeruginosa PA01
aggcgcgcucgaucag

SEQ ID NO: 3438998 - RNA, 18 nt, Pseudomonas aeruginosa PA01
aggcgcgcucgaucaggu

SEQ ID NO: 3438999 - RNA, 12 nt, Pseudomonas aeruginosa PA01
aggcgcgcucgg

SEQ ID NO: 3439000 - RNA, 18 nt, Pseudomonas aeruginosa PA01
aggcgcggcggaagaaua

SEQ ID NO: 3439001 - RNA, 17 nt, Pseudomonas aeruginosa PA01
aggcgcgggcuggccac

SEQ ID NO: 3439002 - RNA, 18 nt, Pseudomonas aeruginosa PA01
aggcgcgggcuggccacc

SEQ ID NO: 3439003 - RNA, 13 nt, Pseudomonas aeruginosa PA01
aggcgcggggcga

SEQ ID NO: 3439004 - RNA, 20 nt, Pseudomonas aeruginosa PA01
aggcgcggggcgaggucggc

SEQ ID NO: 3439005 - RNA, 15 nt, Pseudomonas aeruginosa PA01
aggcgcggguggcgu

SEQ ID NO: 3439006 - RNA, 16 nt, Pseudomonas aeruginosa PA01
aggcgcgucuccagcu

SEQ ID NO: 3439007 - RNA, 19 nt, Pseudomonas aeruginosa PA01
aggcgcguugcuuccaggc

SEQ ID NO: 3439008 - RNA, 20 nt, Pseudomonas aeruginosa PA01
aggcgcguugcuuccaggca

SEQ ID NO: 3439009 - RNA, 15 nt, Pseudomonas aeruginosa PA01
aggcgcuauccgccg

SEQ ID NO: 3439010 - RNA, 18 nt, Pseudomonas aeruginosa PA01
aggcgcuauccgccguua

SEQ ID NO: 3439011 - RNA, 16 nt, Pseudomonas aeruginosa PA01
aggcgcucaacgccuc

SEQ ID NO: 3439012 - RNA, 18 nt, Pseudomonas aeruginosa PA01
aggcgcucagggaaugga

SEQ ID NO: 3439013 - RNA, 19 nt, Pseudomonas aeruginosa PA01
aggcgcuccaccagggccu

SEQ ID NO: 3439014 - RNA, 14 nt, Pseudomonas aeruginosa PA01
aggcgcuccaccgc

SEQ ID NO: 3439015 - RNA, 15 nt, Pseudomonas aeruginosa PA01
aggcgcuccaccgcc

SEQ ID NO: 3439016 - RNA, 16 nt, Pseudomonas aeruginosa PA01
aggcgcuccaccgccc

SEQ ID NO: 3439017 - RNA, 19 nt, Pseudomonas aeruginosa PA01
aggcgcuccaccgcccccg

SEQ ID NO: 3439018 - RNA, 21 nt, Pseudomonas aeruginosa PA01
aggcgcuccaccgcccccggc

SEQ ID NO: 3439019 - RNA, 23 nt, Pseudomonas aeruginosa PA01
aggcgcuccaccgcccccggcgc

SEQ ID NO: 3439020 - RNA, 16 nt, Pseudomonas aeruginosa PA01
aggcgcuccggaacgc

SEQ ID NO: 3439021 - RNA, 15 nt, Pseudomonas aeruginosa PA01
aggcgcuccuccagc

SEQ ID NO: 3439022 - RNA, 19 nt, Pseudomonas aeruginosa PA01
aggcgcuccuccagcgccg

SEQ ID NO: 3439023 - RNA, 18 nt, Pseudomonas aeruginosa PA01
aggcgcuccuggugcggc

SEQ ID NO: 3439024 - RNA, 20 nt, Pseudomonas aeruginosa PA01
aggcgcuccuugagcagcuc

SEQ ID NO: 3439025 - RNA, 19 nt, Pseudomonas aeruginosa PA01
aggcgcucgacgaucaggu

SEQ ID NO: 3439026 - RNA, 23 nt, Pseudomonas aeruginosa PA01
aggcgcucgacgaucaggugcag

SEQ ID NO: 3439027 - RNA, 20 nt, Pseudomonas aeruginosa PA01
aggcgcucgcgggccgccug

SEQ ID NO: 3439028 - RNA, 22 nt, Pseudomonas aeruginosa PA01
aggcgcucgcgggccgccuggu

SEQ ID NO: 3439029 - RNA, 23 nt, Pseudomonas aeruginosa PA01
aggcgcucgcgggccgccugguc

SEQ ID NO: 3439030 - RNA, 14 nt, Pseudomonas aeruginosa PA01
aggcgcucggcgac

SEQ ID NO: 3439031 - RNA, 15 nt, Pseudomonas aeruginosa PA01
aggcgcucggggaug

SEQ ID NO: 3439032 - RNA, 16 nt, Pseudomonas aeruginosa PA01
aggcgcucucgccgcc

SEQ ID NO: 3439033 - RNA, 17 nt, Pseudomonas aeruginosa PA01
aggcgcucucgccgccu

SEQ ID NO: 3439034 - RNA, 18 nt, Pseudomonas aeruginosa PA01
aggcgcucucgccgccuu

SEQ ID NO: 3439035 - RNA, 22 nt, Pseudomonas aeruginosa PA01
aggcgcucucgccgccuucggc

SEQ ID NO: 3439036 - RNA, 22 nt, Pseudomonas aeruginosa PA01
aggcgcucuucacuuccagcug

SEQ ID NO: 3439037 - RNA, 20 nt, Pseudomonas aeruginosa PA01
aggcgcugcaaucgcugccg

SEQ ID NO: 3439038 - RNA, 22 nt, Pseudomonas aeruginosa PA01
aggcgcugcaaucgcugccggu

SEQ ID NO: 3439039 - RNA, 21 nt, Pseudomonas aeruginosa PA01
aggcgcugccguagaggucgc

SEQ ID NO: 3439040 - RNA, 17 nt, Pseudomonas aeruginosa PA01
aggcgcugcgcggccug

SEQ ID NO: 3439041 - RNA, 21 nt, Pseudomonas aeruginosa PA01
aggcgcugcgguaccagcgca

SEQ ID NO: 3439042 - RNA, 14 nt, Pseudomonas aeruginosa PA01
aggcgcuggccagc

SEQ ID NO: 3439043 - RNA, 22 nt, Pseudomonas aeruginosa PA01
aggcgcuggccagcgcuuccac

SEQ ID NO: 3439044 - RNA, 13 nt, Pseudomonas aeruginosa PA01
aggcgcuggcgcc

SEQ ID NO: 3439045 - RNA, 14 nt, Pseudomonas aeruginosa PA01
aggcgcuggcgccg

SEQ ID NO: 3439046 - RNA, 19 nt, Pseudomonas aeruginosa PA01
aggcgcuggcgcuguaggc

SEQ ID NO: 3439047 - RNA, 23 nt, Pseudomonas aeruginosa PA01
aggcgcuggcgcuguaggcgagc

SEQ ID NO: 3439048 - RNA, 17 nt, Pseudomonas aeruginosa PA01
aggcgcugguccagcac

SEQ ID NO: 3439049 - RNA, 21 nt, Pseudomonas aeruginosa PA01
aggcgcugguccagcacgcug

SEQ ID NO: 3439050 - RNA, 22 nt, Pseudomonas aeruginosa PA01
aggcgcuggugcugcuccauca

SEQ ID NO: 3439051 - RNA, 19 nt, Pseudomonas aeruginosa PA01
aggcgcuguccuguggcgc

SEQ ID NO: 3439052 - RNA, 20 nt, Pseudomonas aeruginosa PA01
aggcgcuguccuguggcgcu

SEQ ID NO: 3439053 - RNA, 22 nt, Pseudomonas aeruginosa PA01
aggcgcuguccuguggcgcuuc

SEQ ID NO: 3439054 - RNA, 17 nt, Pseudomonas aeruginosa PA01
aggcgcuucagcucgag

SEQ ID NO: 3439055 - RNA, 17 nt, Pseudomonas aeruginosa PA01
aggcgcuuucccgcuuc

SEQ ID NO: 3439056 - RNA, 13 nt, Pseudomonas aeruginosa PA01
aggcggaacggcu

SEQ ID NO: 3439057 - RNA, 24 nt, Pseudomonas aeruginosa PA01
aggcggaacggcucgcgaccgaga

SEQ ID NO: 3439058 - RNA, 20 nt, Pseudomonas aeruginosa PA01
aggcggaagaaaagaaggcg

SEQ ID NO: 3439059 - RNA, 19 nt, Pseudomonas aeruginosa PA01
aggcggacacgcaggcgcc

SEQ ID NO: 3439060 - RNA, 15 nt, Pseudomonas aeruginosa PA01
aggcggagaagccgc

SEQ ID NO: 3439061 - RNA, 17 nt, Pseudomonas aeruginosa PA01
aggcggagcaugguguc

SEQ ID NO: 3439062 - RNA, 18 nt, Pseudomonas aeruginosa PA01
aggcggaguagccggcgg

SEQ ID NO: 3439063 - RNA, 20 nt, Pseudomonas aeruginosa PA01
aggcggaguagccggcggcg

SEQ ID NO: 3439064 - RNA, 21 nt, Pseudomonas aeruginosa PA01
aggcggaguagccggcggcga

SEQ ID NO: 3439065 - RNA, 22 nt, Pseudomonas aeruginosa PA01
aggcucccccgcgccgccggau

SEQ ID NO: 3439066 - RNA, 19 nt, Pseudomonas aeruginosa PA01
aggcucgccccggcggcga

SEQ ID NO: 3439067 - RNA, 13 nt, Pseudomonas aeruginosa PA01
aggcucgccgcca

SEQ ID NO: 3439068 - RNA, 20 nt, Pseudomonas aeruginosa PA01
aggcucgccggguuguccag

SEQ ID NO: 3439069 - RNA, 23 nt, Pseudomonas aeruginosa PA01
aggcucgccggguuguccaggcg

SEQ ID NO: 3439070 - RNA, 20 nt, Pseudomonas aeruginosa PA01
aggcucggccuguaccgcuu

SEQ ID NO: 3439071 - RNA, 12 nt, Pseudomonas aeruginosa PA01
aggcucggcggc

SEQ ID NO: 3439072 - RNA, 15 nt, Pseudomonas aeruginosa PA01
aggcucggcggccau

SEQ ID NO: 3439073 - RNA, 19 nt, Pseudomonas aeruginosa PA01
aggcucggcggccauugcc

SEQ ID NO: 3439074 - RNA, 19 nt, Pseudomonas aeruginosa PA01
aggcucgguucugcgcacc

SEQ ID NO: 3439075 - RNA, 20 nt, Pseudomonas aeruginosa PA01
aggcucgguucugcgcacca

SEQ ID NO: 3439076 - RNA, 13 nt, Pseudomonas aeruginosa PA01
aggcucucgcgca

SEQ ID NO: 3439077 - RNA, 13 nt, Pseudomonas aeruginosa PA01
aggcucuucucga

SEQ ID NO: 3439078 - RNA, 18 nt, Pseudomonas aeruginosa PA01
aggcucuugggcucugcc

SEQ ID NO: 3439079 - RNA, 19 nt, Pseudomonas aeruginosa PA01
aggcucuugggcucugccu

SEQ ID NO: 3439080 - RNA, 23 nt, Pseudomonas aeruginosa PA01
aggcucuugggcucugccuucag

SEQ ID NO: 3439081 - RNA, 15 nt, Pseudomonas aeruginosa PA01
aggcugaaaaaaggg

SEQ ID NO: 3439082 - RNA, 16 nt, Pseudomonas aeruginosa PA01
aggcugaaaaaagggg

SEQ ID NO: 3439083 - RNA, 18 nt, Pseudomonas aeruginosa PA01
aggcugaagcggccgccg

SEQ ID NO: 3439084 - RNA, 21 nt, Pseudomonas aeruginosa PA01
aggcugacccggucgcugacc

SEQ ID NO: 3439085 - RNA, 21 nt, Pseudomonas aeruginosa PA01
aggcugaccgcgugggccggc

SEQ ID NO: 3439086 - RNA, 18 nt, Pseudomonas aeruginosa PA01
aggcugacgucgacgcag

SEQ ID NO: 3439087 - RNA, 16 nt, Pseudomonas aeruginosa PA01
aggcugaucagcccgc

SEQ ID NO: 3439088 - RNA, 16 nt, Pseudomonas aeruginosa PA01
aggcugaucggcgcgc

SEQ ID NO: 3439089 - RNA, 18 nt, Pseudomonas aeruginosa PA01
aggcugaucggcgcgccg

SEQ ID NO: 3439090 - RNA, 17 nt, Pseudomonas aeruginosa PA01
aggcugaucugccggua

SEQ ID NO: 3439091 - RNA, 15 nt, Pseudomonas aeruginosa PA01
aggcugaucuugccg

SEQ ID NO: 3439092 - RNA, 15 nt, Pseudomonas aeruginosa PA01
aggcugcaucggcuc

SEQ ID NO: 3439093 - RNA, 23 nt, Pseudomonas aeruginosa PA01
aggcugcaucggcucggcaagcg

SEQ ID NO: 3439094 - RNA, 13 nt, Pseudomonas aeruginosa PA01
aggcugccgagca

SEQ ID NO: 3439095 - RNA, 14 nt, Pseudomonas aeruginosa PA01
aggcugccgagcag

SEQ ID NO: 3439096 - RNA, 17 nt, Pseudomonas aeruginosa PA01
aggcugccgagcagggu

SEQ ID NO: 3439097 - RNA, 15 nt, Pseudomonas aeruginosa PA01
aggcugccgccgccg

SEQ ID NO: 3439098 - RNA, 14 nt, Pseudomonas aeruginosa PA01
aggcugccgccuuc

SEQ ID NO: 3439099 - RNA, 16 nt, Pseudomonas aeruginosa PA01
aggcugccggccaggu

SEQ ID NO: 3439100 - RNA, 16 nt, Pseudomonas aeruginosa PA01
aggcugccguccaggc

SEQ ID NO: 3439101 - RNA, 18 nt, Pseudomonas aeruginosa PA01
aggcugccguccaggcgc

SEQ ID NO: 3439102 - RNA, 17 nt, Pseudomonas aeruginosa PA01
aggcugccguugcggcc

SEQ ID NO: 3439103 - RNA, 18 nt, Pseudomonas aeruginosa PA01
aggcugcgauauggccga

SEQ ID NO: 3439104 - RNA, 14 nt, Pseudomonas aeruginosa PA01
aggcugcgccgcug

SEQ ID NO: 3439105 - RNA, 20 nt, Pseudomonas aeruginosa PA01
aggcugcgccgcugcggcug

SEQ ID NO: 3439106 - RNA, 17 nt, Pseudomonas aeruginosa PA01
aggcugcgcuccaggcg

SEQ ID NO: 3439107 - RNA, 19 nt, Pseudomonas aeruginosa PA01
aggcugcgcuugcugccau

SEQ ID NO: 3439108 - RNA, 20 nt, Pseudomonas aeruginosa PA01
aggcugcggcggaaggcggc

SEQ ID NO: 3439109 - RNA, 18 nt, Pseudomonas aeruginosa PA01
aggcugcucaugccguug

SEQ ID NO: 3439110 - RNA, 18 nt, Pseudomonas aeruginosa PA01
aggcuggaagccgcgcuc

SEQ ID NO: 3439111 - RNA, 17 nt, Pseudomonas aeruginosa PA01
aggcuggccgagcgccg

SEQ ID NO: 3439112 - RNA, 20 nt, Pseudomonas aeruginosa PA01
aggcuggccgagcgccgccu

SEQ ID NO: 3439113 - RNA, 10 nt, Pseudomonas aeruginosa PA01
aggcuggccu

SEQ ID NO: 3439114 - RNA, 23 nt, Pseudomonas aeruginosa PA01
aggcuggccucguugaucggcaa

SEQ ID NO: 3439115 - RNA, 22 nt, Pseudomonas aeruginosa PA01
aggcuggcggcauaggcccggc

SEQ ID NO: 3439116 - RNA, 23 nt, Pseudomonas aeruginosa PA01
aggcuggcggcauaggcccggcg

SEQ ID NO: 3439117 - RNA, 20 nt, Pseudomonas aeruginosa PA01
aggcuggcggcaucggcgcc

SEQ ID NO: 3439118 - RNA, 13 nt, Pseudomonas aeruginosa PA01
aggcuggcggcca

SEQ ID NO: 3439119 - RNA, 16 nt, Pseudomonas aeruginosa PA01
aggcuggcggccaggg

SEQ ID NO: 3439120 - RNA, 18 nt, Pseudomonas aeruginosa PA01
aggcuggcggccagggca

SEQ ID NO: 3439121 - RNA, 16 nt, Pseudomonas aeruginosa PA01
aggcuggcgucgacgc

SEQ ID NO: 3439122 - RNA, 21 nt, Pseudomonas aeruginosa PA01
aggcugggccgaaccggggcg

SEQ ID NO: 3439123 - RNA, 19 nt, Pseudomonas aeruginosa PA01
aggcugggguugcggcgcc

SEQ ID NO: 3439124 - RNA, 23 nt, Pseudomonas aeruginosa PA01
aggcugggguugcggcgcccgcc

SEQ ID NO: 3439125 - RNA, 17 nt, Pseudomonas aeruginosa PA01
aggcuggguuggcgcga

SEQ ID NO: 3439126 - RNA, 18 nt, Pseudomonas aeruginosa PA01
aggcugguaugcagcaac

SEQ ID NO: 3439127 - RNA, 21 nt, Pseudomonas aeruginosa PA01
aggcugguggucaccgccagc

SEQ ID NO: 3439128 - RNA, 22 nt, Pseudomonas aeruginosa PA01
aggcugguggucaccgccagcg

SEQ ID NO: 3439129 - RNA, 15 nt, Pseudomonas aeruginosa PA01
aggcuguacagcagg

SEQ ID NO: 3439130 - RNA, 15 nt, Pseudomonas aeruginosa PA01
aggcuguagccggcg

SEQ ID NO: 3439131 - RNA, 16 nt, Pseudomonas aeruginosa PA01
aggcuguagccggcga

SEQ ID NO: 3439132 - RNA, 22 nt, Pseudomonas aeruginosa PA01
aggcuguagccucccgccgcgg

SEQ ID NO: 3439133 - RNA, 16 nt, Pseudomonas aeruginosa PA01
aggcugucagggcgca

SEQ ID NO: 3439134 - RNA, 19 nt, Pseudomonas aeruginosa PA01
aggcugucgcggacccgcg

SEQ ID NO: 3439135 - RNA, 21 nt, Pseudomonas aeruginosa PA01
aggcugucgucgaggguggcg

SEQ ID NO: 3439136 - RNA, 13 nt, Pseudomonas aeruginosa PA01
aggcugugcagga

SEQ ID NO: 3439137 - RNA, 22 nt, Pseudomonas aeruginosa PA01
aggcugugcaggaaggcgacga

SEQ ID NO: 3439138 - RNA, 18 nt, Pseudomonas aeruginosa PA01
aggcugugcaucugcgac

SEQ ID NO: 3439139 - RNA, 17 nt, Pseudomonas aeruginosa PA01
aggcugugccccaggca

SEQ ID NO: 3439140 - RNA, 16 nt, Pseudomonas aeruginosa PA01
aggcugugcgccaggc

SEQ ID NO: 3439141 - RNA, 17 nt, Pseudomonas aeruginosa PA01
aggcugugcgccaggcc

SEQ ID NO: 3439142 - RNA, 17 nt, Pseudomonas aeruginosa PA01
aggcuguggcgcggcug

SEQ ID NO: 3439143 - RNA, 13 nt, Pseudomonas aeruginosa PA01
aggcugugggcga

SEQ ID NO: 3439144 - RNA, 22 nt, Pseudomonas aeruginosa PA01
aggcugugggucgggucggcga

SEQ ID NO: 3439145 - RNA, 21 nt, Pseudomonas aeruginosa PA01
aggcuguugcccugggccggc

SEQ ID NO: 3439146 - RNA, 22 nt, Pseudomonas aeruginosa PA01
aggcuguugcccugggccggcg

SEQ ID NO: 3439147 - RNA, 18 nt, Pseudomonas aeruginosa PA01
aggcuguuuuuccuguga

SEQ ID NO: 3439148 - RNA, 20 nt, Pseudomonas aeruginosa PA01
aggcuuggucagggucgagu

SEQ ID NO: 3439149 - RNA, 19 nt, Pseudomonas aeruginosa PA01
aggcuuguccuuggccucc

SEQ ID NO: 3439150 - RNA, 19 nt, Pseudomonas aeruginosa PA01
aggcuuuccaccgccagca

SEQ ID NO: 3439151 - RNA, 20 nt, Pseudomonas aeruginosa PA01
aggcuuuccaccgccagcac

SEQ ID NO: 3439152 - RNA, 12 nt, Pseudomonas aeruginosa PA01
aggcuuuccagc

SEQ ID NO: 3439153 - RNA, 18 nt, Pseudomonas aeruginosa PA01
aggcuuuccagcaggcgc

SEQ ID NO: 3439154 - RNA, 20 nt, Pseudomonas aeruginosa PA01
aggcuuuccagcaggcgcuc

SEQ ID NO: 3439155 - RNA, 18 nt, Pseudomonas aeruginosa PA01
aggcuuuccagcccggcg

SEQ ID NO: 3439156 - RNA, 17 nt, Pseudomonas aeruginosa PA01
aggcuuuccgccgagcg

SEQ ID NO: 3439157 - RNA, 16 nt, Pseudomonas aeruginosa PA01
aggcuuuccugcgccu

SEQ ID NO: 3439158 - RNA, 20 nt, Pseudomonas aeruginosa PA01
agggaaaaaagggagccagg

SEQ ID NO: 3439159 - RNA, 15 nt, Pseudomonas aeruginosa PA01
agggaaacaccaggc

SEQ ID NO: 3439160 - RNA, 18 nt, Pseudomonas aeruginosa PA01
agggaaacaccaggccga

SEQ ID NO: 3439161 - RNA, 16 nt, Pseudomonas aeruginosa PA01
agggaaacacgucgau

SEQ ID NO: 3439162 - RNA, 21 nt, Pseudomonas aeruginosa PA01
agggaaacacgucgaucaccu

SEQ ID NO: 3439163 - RNA, 11 nt, Pseudomonas aeruginosa PA01
agggaaaucag

SEQ ID NO: 3439164 - RNA, 21 nt, Pseudomonas aeruginosa PA01
agggaagcgcgcgccaguccc

SEQ ID NO: 3439165 - RNA, 15 nt, Pseudomonas aeruginosa PA01
agggacaggcuagga

SEQ ID NO: 3439166 - RNA, 14 nt, Pseudomonas aeruginosa PA01
agggacgcgccggc

SEQ ID NO: 3439167 - RNA, 17 nt, Pseudomonas aeruginosa PA01
agggacggugcaggccg

SEQ ID NO: 3439168 - RNA, 13 nt, Pseudomonas aeruginosa PA01
agggagaacagca

SEQ ID NO: 3439169 - RNA, 17 nt, Pseudomonas aeruginosa PA01
agggagaacagcagggu

SEQ ID NO: 3439170 - RNA, 17 nt, Pseudomonas aeruginosa PA01
agggagcgccuggcguc

SEQ ID NO: 3439171 - RNA, 21 nt, Pseudomonas aeruginosa PA01
agggaggcgcacaucacccgg

SEQ ID NO: 3439172 - RNA, 17 nt, Pseudomonas aeruginosa PA01
agggaguccgccagccg

SEQ ID NO: 3439173 - RNA, 21 nt, Pseudomonas aeruginosa PA01
agggaguccgccagccggcug

SEQ ID NO: 3439174 - RNA, 16 nt, Pseudomonas aeruginosa PA01
agggagucgcuggcca

SEQ ID NO: 3439175 - RNA, 14 nt, Pseudomonas aeruginosa PA01
agggauaccaacuu

SEQ ID NO: 3439176 - RNA, 14 nt, Pseudomonas aeruginosa PA01
agggauacucaugc

SEQ ID NO: 3439177 - RNA, 18 nt, Pseudomonas aeruginosa PA01
agggauacucaugcaggc

SEQ ID NO: 3439178 - RNA, 17 nt, Pseudomonas aeruginosa PA01
agggaucgcgcggcugg

SEQ ID NO: 3439179 - RNA, 15 nt, Pseudomonas aeruginosa PA01
agggaucgucgccaa

SEQ ID NO: 3439180 - RNA, 13 nt, Pseudomonas aeruginosa PA01
agggaugccgccg

SEQ ID NO: 3439181 - RNA, 18 nt, Pseudomonas aeruginosa PA01
agggaugccgccggcauc

SEQ ID NO: 3439182 - RNA, 21 nt, Pseudomonas aeruginosa PA01
agggaugccggcggcaucccu

SEQ ID NO: 3439183 - RNA, 19 nt, Pseudomonas aeruginosa PA01
agggauguuccaggcccgc

SEQ ID NO: 3439184 - RNA, 13 nt, Pseudomonas aeruginosa PA01
agggauuccuugg

SEQ ID NO: 3439185 - RNA, 14 nt, Pseudomonas aeruginosa PA01
agggcaaaggcgcg

SEQ ID NO: 3439186 - RNA, 17 nt, Pseudomonas aeruginosa PA01
agggcaaaggcgcgcag

SEQ ID NO: 3439187 - RNA, 16 nt, Pseudomonas aeruginosa PA01
agggcaaucaacgcuu

SEQ ID NO: 3439188 - RNA, 19 nt, Pseudomonas aeruginosa PA01
agggcaccgacgaugggca

SEQ ID NO: 3439189 - RNA, 21 nt, Pseudomonas aeruginosa PA01
agggcaccgacgaugggcacg

SEQ ID NO: 3439190 - RNA, 19 nt, Pseudomonas aeruginosa PA01
agggcacgugcagcggcag

SEQ ID NO: 3439191 - RNA, 22 nt, Pseudomonas aeruginosa PA01
agggcacuucguccaggccgcc

SEQ ID NO: 3439192 - RNA, 10 nt, Pseudomonas aeruginosa PA01
agggcagcag

SEQ ID NO: 3439193 - RNA, 23 nt, Pseudomonas aeruginosa PA01
agggcagcaggucgcgcaguucg

SEQ ID NO: 3439194 - RNA, 12 nt, Pseudomonas aeruginosa PA01
agggcagcggcg

SEQ ID NO: 3439195 - RNA, 12 nt, Pseudomonas aeruginosa PA01
agggcaggaacc

SEQ ID NO: 3439196 - RNA, 16 nt, Pseudomonas aeruginosa PA01
agggcaggaaccagac

SEQ ID NO: 3439197 - RNA, 20 nt, Pseudomonas aeruginosa PA01
agggcagggaguccgccagc

SEQ ID NO: 3439198 - RNA, 18 nt, Pseudomonas aeruginosa PA01
agggcaguacguggcgcu

SEQ ID NO: 3439199 - RNA, 19 nt, Pseudomonas aeruginosa PA01
agggcauagaugccgcccu

SEQ ID NO: 3439200 - RNA, 20 nt, Pseudomonas aeruginosa PA01
agggcauagaugccgcccug

SEQ ID NO: 3439201 - RNA, 17 nt, Pseudomonas aeruginosa PA01
agggcauauucauagcc

SEQ ID NO: 3439202 - RNA, 21 nt, Pseudomonas aeruginosa PA01
agggcaucagccccucggcca

SEQ ID NO: 3439203 - RNA, 21 nt, Pseudomonas aeruginosa PA01
agggcauccucgcgguucugc

SEQ ID NO: 3439204 - RNA, 22 nt, Pseudomonas aeruginosa PA01
agggcauccucgcgguucugcu

SEQ ID NO: 3439205 - RNA, 14 nt, Pseudomonas aeruginosa PA01
agggcaucgacgau

SEQ ID NO: 3439206 - RNA, 15 nt, Pseudomonas aeruginosa PA01
agggcaucgccgaca

SEQ ID NO: 3439207 - RNA, 17 nt, Pseudomonas aeruginosa PA01
agggcaugaccgauggc

SEQ ID NO: 3439208 - RNA, 12 nt, Pseudomonas aeruginosa PA01
agggcauggguc

SEQ ID NO: 3439209 - RNA, 19 nt, Pseudomonas aeruginosa PA01
agggcaugggucagcgcca

SEQ ID NO: 3439210 - RNA, 17 nt, Pseudomonas aeruginosa PA01
agggcauguuggcgccu

SEQ ID NO: 3439211 - RNA, 22 nt, Pseudomonas aeruginosa PA01
agggcauuggccaucagcgccg

SEQ ID NO: 3439212 - RNA, 23 nt, Pseudomonas aeruginosa PA01
agggcauuggccaucagcgccgc

SEQ ID NO: 3439213 - RNA, 19 nt, Pseudomonas aeruginosa PA01
agggccagagcacgaaagc

SEQ ID NO: 3439214 - RNA, 16 nt, Pseudomonas aeruginosa PA01
agggccagcaacaggc

SEQ ID NO: 3439215 - RNA, 16 nt, Pseudomonas aeruginosa PA01
agggccagcagcgcug

SEQ ID NO: 3439216 - RNA, 19 nt, Pseudomonas aeruginosa PA01
agggccagcagcggcggcg

SEQ ID NO: 3439217 - RNA, 17 nt, Pseudomonas aeruginosa PA01
agggccagcgccuggcg

SEQ ID NO: 3439218 - RNA, 17 nt, Pseudomonas aeruginosa PA01
agggccagcggguugau

SEQ ID NO: 3439219 - RNA, 12 nt, Pseudomonas aeruginosa PA01
agggccaggccg

SEQ ID NO: 3439220 - RNA, 16 nt, Pseudomonas aeruginosa PA01
agggccaggccgagca

SEQ ID NO: 3439221 - RNA, 16 nt, Pseudomonas aeruginosa PA01
agggccaggccgagcg

SEQ ID NO: 3439222 - RNA, 19 nt, Pseudomonas aeruginosa PA01
agggccaggccgagcgcgc

SEQ ID NO: 3439223 - RNA, 16 nt, Pseudomonas aeruginosa PA01
agggccagggcggcgg

SEQ ID NO: 3439224 - RNA, 15 nt, Pseudomonas aeruginosa PA01
agggccaucagggcg

SEQ ID NO: 3439225 - RNA, 20 nt, Pseudomonas aeruginosa PA01
agggcccacagugccaggcu

SEQ ID NO: 3439226 - RNA, 22 nt, Pseudomonas aeruginosa PA01
agggcccauuccacgugcucgc

SEQ ID NO: 3439227 - RNA, 23 nt, Pseudomonas aeruginosa PA01
agggcccauuccacgugcucgcg

SEQ ID NO: 3439228 - RNA, 24 nt, Pseudomonas aeruginosa PA01
agggcccggggagggugccgugga

SEQ ID NO: 3439229 - RNA, 21 nt, Pseudomonas aeruginosa PA01
agggcccgugguagucgagcc

SEQ ID NO: 3439230 - RNA, 17 nt, Pseudomonas aeruginosa PA01
agggccgaggucgagga

SEQ ID NO: 3439231 - RNA, 21 nt, Pseudomonas aeruginosa PA01
agggccgccagccgccaggac

SEQ ID NO: 3439232 - RNA, 15 nt, Pseudomonas aeruginosa PA01
agggccgcgagaggu

SEQ ID NO: 3439233 - RNA, 15 nt, Pseudomonas aeruginosa PA01
agggccgcgccgacc

SEQ ID NO: 3439234 - RNA, 23 nt, Pseudomonas aeruginosa PA01
agggccgcgcugcugccauccgc

SEQ ID NO: 3439235 - RNA, 21 nt, Pseudomonas aeruginosa PA01
agggccggaucggccuuggcg

SEQ ID NO: 3439236 - RNA, 23 nt, Pseudomonas aeruginosa PA01
agggccggaugccaccgcucgag

SEQ ID NO: 3439237 - RNA, 14 nt, Pseudomonas aeruginosa PA01
agggccggcgcccu

SEQ ID NO: 3439238 - RNA, 22 nt, Pseudomonas aeruginosa PA01
agggccgguucggauccggacu

SEQ ID NO: 3439239 - RNA, 14 nt, Pseudomonas aeruginosa PA01
agggccucggcgaa

SEQ ID NO: 3439240 - RNA, 15 nt, Pseudomonas aeruginosa PA01
agggccucggggccg

SEQ ID NO: 3439241 - RNA, 14 nt, Pseudomonas aeruginosa PA01
agggccugcucagc

SEQ ID NO: 3439242 - RNA, 17 nt, Pseudomonas aeruginosa PA01
agggccugcuccagcgg

SEQ ID NO: 3439243 - RNA, 18 nt, Pseudomonas aeruginosa PA01
agggccugggcgccgcca

SEQ ID NO: 3439244 - RNA, 14 nt, Pseudomonas aeruginosa PA01
agggccuugagcac

SEQ ID NO: 3439245 - RNA, 23 nt, Pseudomonas aeruginosa PA01
agggccuugagcacgguccgcga

SEQ ID NO: 3439246 - RNA, 15 nt, Pseudomonas aeruginosa PA01
agggccuugccgcga

SEQ ID NO: 3439247 - RNA, 17 nt, Pseudomonas aeruginosa PA01
agggccuugccgcgacc

SEQ ID NO: 3439248 - RNA, 14 nt, Pseudomonas aeruginosa PA01
agggccuuggccuc

SEQ ID NO: 3439249 - RNA, 19 nt, Pseudomonas aeruginosa PA01
agggcgaacaacgccgccg

SEQ ID NO: 3439250 - RNA, 19 nt, Pseudomonas aeruginosa PA01
agggcgaaccacucggcgc

SEQ ID NO: 3439251 - RNA, 16 nt, Pseudomonas aeruginosa PA01
agggcgaaggccacca

SEQ ID NO: 3439252 - RNA, 18 nt, Pseudomonas aeruginosa PA01
agggcgaaggucugcccc

SEQ ID NO: 3439253 - RNA, 14 nt, Pseudomonas aeruginosa PA01
agggcgaagucggc

SEQ ID NO: 3439254 - RNA, 12 nt, Pseudomonas aeruginosa PA01
agggcgaauaac

SEQ ID NO: 3439255 - RNA, 21 nt, Pseudomonas aeruginosa PA01
agggcgaauaaccgcaucgcg

SEQ ID NO: 3439256 - RNA, 22 nt, Pseudomonas aeruginosa PA01
agggcgaauaaccgcaucgcgg

SEQ ID NO: 3439257 - RNA, 17 nt, Pseudomonas aeruginosa PA01
agggcgaauaaccgcuc

SEQ ID NO: 3439258 - RNA, 17 nt, Pseudomonas aeruginosa PA01
agggcgaauaacgccac

SEQ ID NO: 3439259 - RNA, 22 nt, Pseudomonas aeruginosa PA01
agggcgaauaacgccacaggcg

SEQ ID NO: 3439260 - RNA, 23 nt, Pseudomonas aeruginosa PA01
agggcgaauaacgccacaggcgu

SEQ ID NO: 3439261 - RNA, 17 nt, Pseudomonas aeruginosa PA01
agggcgaauaccagugc

SEQ ID NO: 3439262 - RNA, 19 nt, Pseudomonas aeruginosa PA01
agggcgaauaccagugccg

SEQ ID NO: 3439263 - RNA, 16 nt, Pseudomonas aeruginosa PA01
agggcgaauagcgccg

SEQ ID NO: 3439264 - RNA, 19 nt, Pseudomonas aeruginosa PA01
agggcgaccgccaggcggc

SEQ ID NO: 3439265 - RNA, 14 nt, Pseudomonas aeruginosa PA01
agggcgacgcccga

SEQ ID NO: 3439266 - RNA, 14 nt, Pseudomonas aeruginosa PA01
agggcgacgccgau

SEQ ID NO: 3439267 - RNA, 21 nt, Pseudomonas aeruginosa PA01
agggcgacguugcgcaggggc

SEQ ID NO: 3439268 - RNA, 14 nt, Pseudomonas aeruginosa PA01
agggcgacuaccag

SEQ ID NO: 3439269 - RNA, 13 nt, Pseudomonas aeruginosa PA01
aggggcucggcga

SEQ ID NO: 3439270 - RNA, 14 nt, Pseudomonas aeruginosa PA01
aggggcugaacagc

SEQ ID NO: 3439271 - RNA, 16 nt, Pseudomonas aeruginosa PA01
aggggcugaacagcgc

SEQ ID NO: 3439272 - RNA, 23 nt, Pseudomonas aeruginosa PA01
aggggcuuucuucgccuggcgcg

SEQ ID NO: 3439273 - RNA, 22 nt, Pseudomonas aeruginosa PA01
aggggcuuuuucaugagcgccc

SEQ ID NO: 3439274 - RNA, 21 nt, Pseudomonas aeruginosa PA01
aggggcuuuuucguauccgcg

SEQ ID NO: 3439275 - RNA, 16 nt, Pseudomonas aeruginosa PA01
agggggaucgcgaaga

SEQ ID NO: 3439276 - RNA, 17 nt, Pseudomonas aeruginosa PA01
agggggcgacauagcgg

SEQ ID NO: 3439277 - RNA, 23 nt, Pseudomonas aeruginosa PA01
agggggugaagcgcaggcggcug

SEQ ID NO: 3439278 - RNA, 12 nt, Pseudomonas aeruginosa PA01
aggggucgacgc

SEQ ID NO: 3439279 - RNA, 20 nt, Pseudomonas aeruginosa PA01
aggggucgacgcagggcggc

SEQ ID NO: 3439280 - RNA, 14 nt, Pseudomonas aeruginosa PA01
aggggucguugccg

SEQ ID NO: 3439281 - RNA, 14 nt, Pseudomonas aeruginosa PA01
aggggugccuugcc

SEQ ID NO: 3439282 - RNA, 14 nt, Pseudomonas aeruginosa PA01
agggguggccaggc

SEQ ID NO: 3439283 - RNA, 15 nt, Pseudomonas aeruginosa PA01
agggguggccaggcg

SEQ ID NO: 3439284 - RNA, 19 nt, Pseudomonas aeruginosa PA01
aggguaccgaaacagggcg

SEQ ID NO: 3439285 - RNA, 20 nt, Pseudomonas aeruginosa PA01
aggguaccguugcgcaggcg

SEQ ID NO: 3439286 - RNA, 14 nt, Pseudomonas aeruginosa PA01
aggguagcgccgcg

SEQ ID NO: 3439287 - RNA, 15 nt, Pseudomonas aeruginosa PA01
aggguagcgccgcgg

SEQ ID NO: 3439288 - RNA, 19 nt, Pseudomonas aeruginosa PA01
aggguauuuuccagcaggc

SEQ ID NO: 3439289 - RNA, 20 nt, Pseudomonas aeruginosa PA01
aggguauuuuccagcaggca

SEQ ID NO: 3439290 - RNA, 14 nt, Pseudomonas aeruginosa PA01
agggucacgccgau

SEQ ID NO: 3439291 - RNA, 17 nt, Pseudomonas aeruginosa PA01
agggucacgccgcggcu

SEQ ID NO: 3439292 - RNA, 17 nt, Pseudomonas aeruginosa PA01
agggucacgcugggcag

SEQ ID NO: 3439293 - RNA, 19 nt, Pseudomonas aeruginosa PA01
agggucacgcugggcaggu

SEQ ID NO: 3439294 - RNA, 15 nt, Pseudomonas aeruginosa PA01
agggucagaccagcc

SEQ ID NO: 3439295 - RNA, 12 nt, Pseudomonas aeruginosa PA01
agggucagcagc

SEQ ID NO: 3439296 - RNA, 13 nt, Pseudomonas aeruginosa PA01
agggucagcagcg

SEQ ID NO: 3439297 - RNA, 16 nt, Pseudomonas aeruginosa PA01
agggucagcagcgcca

SEQ ID NO: 3439298 - RNA, 19 nt, Pseudomonas aeruginosa PA01
agggucagcagcgccagua

SEQ ID NO: 3439299 - RNA, 16 nt, Pseudomonas aeruginosa PA01
agggucagccgcaggc

SEQ ID NO: 3439300 - RNA, 18 nt, Pseudomonas aeruginosa PA01
agggucagccgcaggccg

SEQ ID NO: 3439301 - RNA, 17 nt, Pseudomonas aeruginosa PA01
agggucagcucgacagc

SEQ ID NO: 3439302 - RNA, 21 nt, Pseudomonas aeruginosa PA01
agggucagcucgacagcgucg

SEQ ID NO: 3439303 - RNA, 15 nt, Pseudomonas aeruginosa PA01
agggucagcuugccg

SEQ ID NO: 3439304 - RNA, 19 nt, Pseudomonas aeruginosa PA01
agggucaggccgagggcug

SEQ ID NO: 3439305 - RNA, 13 nt, Pseudomonas aeruginosa PA01
agggucaggccuu

SEQ ID NO: 3439306 - RNA, 19 nt, Pseudomonas aeruginosa PA01
agggucagucgagcaguuc

SEQ ID NO: 3439307 - RNA, 18 nt, Pseudomonas aeruginosa PA01
agggucgcagcaggccgc

SEQ ID NO: 3439308 - RNA, 21 nt, Pseudomonas aeruginosa PA01
agggucgcagcaggccgcugg

SEQ ID NO: 3439309 - RNA, 15 nt, Pseudomonas aeruginosa PA01
agggucgccagcagg

SEQ ID NO: 3439310 - RNA, 11 nt, Pseudomonas aeruginosa PA01
agggucgcccg

SEQ ID NO: 3439311 - RNA, 17 nt, Pseudomonas aeruginosa PA01
agggucgcgagcagggc

SEQ ID NO: 3439312 - RNA, 18 nt, Pseudomonas aeruginosa PA01
agggucgcgagcagggcg

SEQ ID NO: 3439313 - RNA, 13 nt, Pseudomonas aeruginosa PA01
agggucgcgccgu

SEQ ID NO: 3439314 - RNA, 22 nt, Pseudomonas aeruginosa PA01
agggucgcguagaccaucgccg

SEQ ID NO: 3439315 - RNA, 19 nt, Pseudomonas aeruginosa PA01
agggucgcguuggcgugcu

SEQ ID NO: 3439316 - RNA, 19 nt, Pseudomonas aeruginosa PA01
agggucgcuuccucggcac

SEQ ID NO: 3439317 - RNA, 13 nt, Pseudomonas aeruginosa PA01
agggucggcagga

SEQ ID NO: 3439318 - RNA, 15 nt, Pseudomonas aeruginosa PA01
agggucggcccggag

SEQ ID NO: 3439319 - RNA, 21 nt, Pseudomonas aeruginosa PA01
agggucgggccgcgcucgguc

SEQ ID NO: 3439320 - RNA, 14 nt, Pseudomonas aeruginosa PA01
agggucuccaggac

SEQ ID NO: 3439321 - RNA, 12 nt, Pseudomonas aeruginosa PA01
agggucugcucg

SEQ ID NO: 3439322 - RNA, 16 nt, Pseudomonas aeruginosa PA01
agggucugcucgacga

SEQ ID NO: 3439323 - RNA, 19 nt, Pseudomonas aeruginosa PA01
agggucugcucgacgaucu

SEQ ID NO: 3439324 - RNA, 19 nt, Pseudomonas aeruginosa PA01
agggucugcuugcgcuggc

SEQ ID NO: 3439325 - RNA, 17 nt, Pseudomonas aeruginosa PA01
agggucuucaggcgccg

SEQ ID NO: 3439326 - RNA, 16 nt, Pseudomonas aeruginosa PA01
agggugaacuggccgu

SEQ ID NO: 3439327 - RNA, 14 nt, Pseudomonas aeruginosa PA01
agggugaagcugcg

SEQ ID NO: 3439328 - RNA, 21 nt, Pseudomonas aeruginosa PA01
agggugacggugaucgccgcg

SEQ ID NO: 3439329 - RNA, 16 nt, Pseudomonas aeruginosa PA01
agggugaucagcuccg

SEQ ID NO: 3439330 - RNA, 20 nt, Pseudomonas aeruginosa PA01
agggugaucgacucgauggc

SEQ ID NO: 3439331 - RNA, 14 nt, Pseudomonas aeruginosa PA01
agggugcugcccag

SEQ ID NO: 3439332 - RNA, 17 nt, Pseudomonas aeruginosa PA01
aggguggaacccauggc

SEQ ID NO: 3439333 - RNA, 14 nt, Pseudomonas aeruginosa PA01
aggguggccagggu

SEQ ID NO: 3439334 - RNA, 16 nt, Pseudomonas aeruginosa PA01
aggguggcgaccgccg

SEQ ID NO: 3439335 - RNA, 19 nt, Pseudomonas aeruginosa PA01
aggguggcgccgagcagcg

SEQ ID NO: 3439336 - RNA, 15 nt, Pseudomonas aeruginosa PA01
aggguggcgcgcacc

SEQ ID NO: 3439337 - RNA, 17 nt, Pseudomonas aeruginosa PA01
aggguggcgcgcaccac

SEQ ID NO: 3439338 - RNA, 23 nt, Pseudomonas aeruginosa PA01
aggguggcgcgcaccaccuggca

SEQ ID NO: 3439339 - RNA, 11 nt, Pseudomonas aeruginosa PA01
aggguggcgcu

SEQ ID NO: 3439340 - RNA, 18 nt, Pseudomonas aeruginosa PA01
aggguggcgcugccuucg

SEQ ID NO: 3439341 - RNA, 16 nt, Pseudomonas aeruginosa PA01
aggguggcggcggcga

SEQ ID NO: 3439342 - RNA, 18 nt, Pseudomonas aeruginosa PA01
aggguggcgggcggcccc

SEQ ID NO: 3439343 - RNA, 16 nt, Pseudomonas aeruginosa PA01
aggguggucagccagc

SEQ ID NO: 3439344 - RNA, 15 nt, Pseudomonas aeruginosa PA01
aggguggucgcgcuc

SEQ ID NO: 3439345 - RNA, 22 nt, Pseudomonas aeruginosa PA01
aggguggugucguugcgccccg

SEQ ID NO: 3439346 - RNA, 21 nt, Pseudomonas aeruginosa PA01
aggguguacuugacggcgccg

SEQ ID NO: 3439347 - RNA, 18 nt, Pseudomonas aeruginosa PA01
aggguguagguauccgcc

SEQ ID NO: 3439348 - RNA, 14 nt, Pseudomonas aeruginosa PA01
aggguucgcugccc

SEQ ID NO: 3439349 - RNA, 21 nt, Pseudomonas aeruginosa PA01
aggguucggggaacagcgcca

SEQ ID NO: 3439350 - RNA, 16 nt, Pseudomonas aeruginosa PA01
aggguugucaccggca

SEQ ID NO: 3439351 - RNA, 14 nt, Pseudomonas aeruginosa PA01
aggguuuccagcag

SEQ ID NO: 3439352 - RNA, 16 nt, Pseudomonas aeruginosa PA01
aggguuuccagcagca

SEQ ID NO: 3439353 - RNA, 20 nt, Pseudomonas aeruginosa PA01
agguaaaggccaccagagcc

SEQ ID NO: 3439354 - RNA, 18 nt, Pseudomonas aeruginosa PA01
agguaauaucacccgcac

SEQ ID NO: 3439355 - RNA, 18 nt, Pseudomonas aeruginosa PA01
agguaauguucuccuccc

SEQ ID NO: 3439356 - RNA, 16 nt, Pseudomonas aeruginosa PA01
agguacaacggcaucg

SEQ ID NO: 3439357 - RNA, 19 nt, Pseudomonas aeruginosa PA01
agguacaccaggguggcgc

SEQ ID NO: 3439358 - RNA, 12 nt, Pseudomonas aeruginosa PA01
agguacagcagc

SEQ ID NO: 3439359 - RNA, 13 nt, Pseudomonas aeruginosa PA01
agguacagccgca

SEQ ID NO: 3439360 - RNA, 16 nt, Pseudomonas aeruginosa PA01
agguaccggccaggcg

SEQ ID NO: 3439361 - RNA, 14 nt, Pseudomonas aeruginosa PA01
agguacucgccggc

SEQ ID NO: 3439362 - RNA, 15 nt, Pseudomonas aeruginosa PA01
agguacucgccggcg

SEQ ID NO: 3439363 - RNA, 16 nt, Pseudomonas aeruginosa PA01
agguacuggcgaugga

SEQ ID NO: 3439364 - RNA, 20 nt, Pseudomonas aeruginosa PA01
agguagaaauagaaggucac

SEQ ID NO: 3439365 - RNA, 21 nt, Pseudomonas aeruginosa PA01
agguagaaauagaaggucacc

SEQ ID NO: 3439366 - RNA, 18 nt, Pseudomonas aeruginosa PA01
agguagaacaggcugccg

SEQ ID NO: 3439367 - RNA, 15 nt, Pseudomonas aeruginosa PA01
agguagaagcggccg

SEQ ID NO: 3439368 - RNA, 16 nt, Pseudomonas aeruginosa PA01
agguagaccacgcagg

SEQ ID NO: 3439369 - RNA, 21 nt, Pseudomonas aeruginosa PA01
agguagaccacgcaggccagc

SEQ ID NO: 3439370 - RNA, 22 nt, Pseudomonas aeruginosa PA01
agguagaccacgcaggccagcg

SEQ ID NO: 3439371 - RNA, 14 nt, Pseudomonas aeruginosa PA01
agguagaccgccuc

SEQ ID NO: 3439372 - RNA, 17 nt, Pseudomonas aeruginosa PA01
agguugcgcuggcgcag

SEQ ID NO: 3439373 - RNA, 16 nt, Pseudomonas aeruginosa PA01
agguugcuggcgagga

SEQ ID NO: 3439374 - RNA, 20 nt, Pseudomonas aeruginosa PA01
agguugcuguagaaugcgcg

SEQ ID NO: 3439375 - RNA, 22 nt, Pseudomonas aeruginosa PA01
agguuggacagguccuggaaca

SEQ ID NO: 3439376 - RNA, 18 nt, Pseudomonas aeruginosa PA01
agguuggccuggcccggc

SEQ ID NO: 3439377 - RNA, 19 nt, Pseudomonas aeruginosa PA01
agguuggcgaacaggcagc

SEQ ID NO: 3439378 - RNA, 19 nt, Pseudomonas aeruginosa PA01
agguuggcgccgggcgcga

SEQ ID NO: 3439379 - RNA, 15 nt, Pseudomonas aeruginosa PA01
agguuggucugcucg

SEQ ID NO: 3439380 - RNA, 16 nt, Pseudomonas aeruginosa PA01
agguuggucugcucgg

SEQ ID NO: 3439381 - RNA, 20 nt, Pseudomonas aeruginosa PA01
agguuggucugcucggcgau

SEQ ID NO: 3439382 - RNA, 16 nt, Pseudomonas aeruginosa PA01
agguuguccagggcau

SEQ ID NO: 3439383 - RNA, 18 nt, Pseudomonas aeruginosa PA01
agguugugaucgaccucg

SEQ ID NO: 3439384 - RNA, 23 nt, Pseudomonas aeruginosa PA01
agguugugcucgaucaccaccac

SEQ ID NO: 3439385 - RNA, 20 nt, Pseudomonas aeruginosa PA01
agguugugguugggcaggcg

SEQ ID NO: 3439386 - RNA, 21 nt, Pseudomonas aeruginosa PA01
aguaaaacggcaggcaaaaaa

SEQ ID NO: 3439387 - RNA, 14 nt, Pseudomonas aeruginosa PA01
aguaaccaccgcuc

SEQ ID NO: 3439388 - RNA, 13 nt, Pseudomonas aeruginosa PA01
aguaacuuauuga

SEQ ID NO: 3439389 - RNA, 15 nt, Pseudomonas aeruginosa PA01
aguaagugccgacca

SEQ ID NO: 3439390 - RNA, 17 nt, Pseudomonas aeruginosa PA01
aguacagcucggcgccc

SEQ ID NO: 3439391 - RNA, 17 nt, Pseudomonas aeruginosa PA01
aguacagcugcaccgcg

SEQ ID NO: 3439392 - RNA, 15 nt, Pseudomonas aeruginosa PA01
aguacaugacgaagc

SEQ ID NO: 3439393 - RNA, 12 nt, Pseudomonas aeruginosa PA01
aguaccaccgug

SEQ ID NO: 3439394 - RNA, 22 nt, Pseudomonas aeruginosa PA01
aguaccaccgugcccgccggcg

SEQ ID NO: 3439395 - RNA, 19 nt, Pseudomonas aeruginosa PA01
aguaccagcaaugcccagc

SEQ ID NO: 3439396 - RNA, 23 nt, Pseudomonas aeruginosa PA01
aguaccagcaaugcccagcgcag

SEQ ID NO: 3439397 - RNA, 14 nt, Pseudomonas aeruginosa PA01
aguaccaggccacc

SEQ ID NO: 3439398 - RNA, 18 nt, Pseudomonas aeruginosa PA01
aguaccaggccaccggug

SEQ ID NO: 3439399 - RNA, 15 nt, Pseudomonas aeruginosa PA01
aguacccgcugguaa

SEQ ID NO: 3439400 - RNA, 14 nt, Pseudomonas aeruginosa PA01
aguaccgccggcag

SEQ ID NO: 3439401 - RNA, 19 nt, Pseudomonas aeruginosa PA01
aguaccggcagcgccgagg

SEQ ID NO: 3439402 - RNA, 20 nt, Pseudomonas aeruginosa PA01
aguaccugcucacggccgaa

SEQ ID NO: 3439403 - RNA, 16 nt, Pseudomonas aeruginosa PA01
aguaccuggcgguaca

SEQ ID NO: 3439404 - RNA, 16 nt, Pseudomonas aeruginosa PA01
aguacgaucagccagg

SEQ ID NO: 3439405 - RNA, 15 nt, Pseudomonas aeruginosa PA01
aguacggcgcgguga

SEQ ID NO: 3439406 - RNA, 15 nt, Pseudomonas aeruginosa PA01
aguacucguguucgg

SEQ ID NO: 3439407 - RNA, 14 nt, Pseudomonas aeruginosa PA01
aguacuuggccagc

SEQ ID NO: 3439408 - RNA, 16 nt, Pseudomonas aeruginosa PA01
aguacuuggccagcag

SEQ ID NO: 3439409 - RNA, 18 nt, Pseudomonas aeruginosa PA01
aguacuuggccagcagca

SEQ ID NO: 3439410 - RNA, 17 nt, Pseudomonas aeruginosa PA01
aguagaagcgcgcggua

SEQ ID NO: 3439411 - RNA, 15 nt, Pseudomonas aeruginosa PA01
aguagagaugcaccg

SEQ ID NO: 3439412 - RNA, 20 nt, Pseudomonas aeruginosa PA01
aguagagaugcaccggccac

SEQ ID NO: 3439413 - RNA, 17 nt, Pseudomonas aeruginosa PA01
aguagccggacuccgac

SEQ ID NO: 3439414 - RNA, 15 nt, Pseudomonas aeruginosa PA01
aguagccggcggcga

SEQ ID NO: 3439415 - RNA, 17 nt, Pseudomonas aeruginosa PA01
aguagccggcguuggcg

SEQ ID NO: 3439416 - RNA, 22 nt, Pseudomonas aeruginosa PA01
aguagccgguguagaucaggcu

SEQ ID NO: 3439417 - RNA, 17 nt, Pseudomonas aeruginosa PA01
aguagcguuccuggcgc

SEQ ID NO: 3439418 - RNA, 13 nt, Pseudomonas aeruginosa PA01
aguagcuggcgca

SEQ ID NO: 3439419 - RNA, 14 nt, Pseudomonas aeruginosa PA01
aguagcuggcgcag

SEQ ID NO: 3439420 - RNA, 15 nt, Pseudomonas aeruginosa PA01
aguaggccuggccgc

SEQ ID NO: 3439421 - RNA, 18 nt, Pseudomonas aeruginosa PA01
aguaggcggcggagucgu

SEQ ID NO: 3439422 - RNA, 20 nt, Pseudomonas aeruginosa PA01
aguaggcgucguacuucagc

SEQ ID NO: 3439423 - RNA, 16 nt, Pseudomonas aeruginosa PA01
aguagggacggugcag

SEQ ID NO: 3439424 - RNA, 14 nt, Pseudomonas aeruginosa PA01
aguaggggaauuuc

SEQ ID NO: 3439425 - RNA, 16 nt, Pseudomonas aeruginosa PA01
aguaggguucgccgac

SEQ ID NO: 3439426 - RNA, 20 nt, Pseudomonas aeruginosa PA01
aguagguagagaugcagcag

SEQ ID NO: 3439427 - RNA, 18 nt, Pseudomonas aeruginosa PA01
aguagguccaggcgucgg

SEQ ID NO: 3439428 - RNA, 22 nt, Pseudomonas aeruginosa PA01
aguaggucugguaguaggcgcu

SEQ ID NO: 3439429 - RNA, 22 nt, Pseudomonas aeruginosa PA01
aguaguccuccgcgcccaggcg

SEQ ID NO: 3439430 - RNA, 14 nt, Pseudomonas aeruginosa PA01
aguagugcagcugc

SEQ ID NO: 3439431 - RNA, 14 nt, Pseudomonas aeruginosa PA01
aguaguggaagccg

SEQ ID NO: 3439432 - RNA, 15 nt, Pseudomonas aeruginosa PA01
aguaucgcccuggcc

SEQ ID NO: 3439433 - RNA, 22 nt, Pseudomonas aeruginosa PA01
aguauuucucgacuuccgccuu

SEQ ID NO: 3439434 - RNA, 15 nt, Pseudomonas aeruginosa PA01
agucaggaucggcgc

SEQ ID NO: 3439435 - RNA, 19 nt, Pseudomonas aeruginosa PA01
agucaggaucggcgcccag

SEQ ID NO: 3439436 - RNA, 21 nt, Pseudomonas aeruginosa PA01
agucaggaucggcgcccagca

SEQ ID NO: 3439437 - RNA, 17 nt, Pseudomonas aeruginosa PA01
agucaggcgccggccuc

SEQ ID NO: 3439438 - RNA, 20 nt, Pseudomonas aeruginosa PA01
agucaggcgccggccucgca

SEQ ID NO: 3439439 - RNA, 16 nt, Pseudomonas aeruginosa PA01
agucaggcuccgacug

SEQ ID NO: 3439440 - RNA, 23 nt, Pseudomonas aeruginosa PA01
agucagguccuuguuccugggcg

SEQ ID NO: 3439441 - RNA, 14 nt, Pseudomonas aeruginosa PA01
aguccaccaggcgc

SEQ ID NO: 3439442 - RNA, 17 nt, Pseudomonas aeruginosa PA01
aguccaccaggcgccgg

SEQ ID NO: 3439443 - RNA, 23 nt, Pseudomonas aeruginosa PA01
aguccacggugauccgguaaugc

SEQ ID NO: 3439444 - RNA, 10 nt, Pseudomonas aeruginosa PA01
aguccagcac

SEQ ID NO: 3439445 - RNA, 16 nt, Pseudomonas aeruginosa PA01
aguccagccagugcau

SEQ ID NO: 3439446 - RNA, 19 nt, Pseudomonas aeruginosa PA01
aguccagcgagugcaggaa

SEQ ID NO: 3439447 - RNA, 13 nt, Pseudomonas aeruginosa PA01
aguccagcgccgc

SEQ ID NO: 3439448 - RNA, 17 nt, Pseudomonas aeruginosa PA01
aguccagcgccgcgcug

SEQ ID NO: 3439449 - RNA, 15 nt, Pseudomonas aeruginosa PA01
aguccagcuccucga

SEQ ID NO: 3439450 - RNA, 21 nt, Pseudomonas aeruginosa PA01
aguccagggcgguuaccaggu

SEQ ID NO: 3439451 - RNA, 16 nt, Pseudomonas aeruginosa PA01
aguccagguacaccag

SEQ ID NO: 3439452 - RNA, 18 nt, Pseudomonas aeruginosa PA01
aguccagguacaccaggg

SEQ ID NO: 3439453 - RNA, 13 nt, Pseudomonas aeruginosa PA01
aguccaucaccgc

SEQ ID NO: 3439454 - RNA, 14 nt, Pseudomonas aeruginosa PA01
aguccaucaccgcg

SEQ ID NO: 3439455 - RNA, 18 nt, Pseudomonas aeruginosa PA01
agucccauugcaucugcg

SEQ ID NO: 3439456 - RNA, 21 nt, Pseudomonas aeruginosa PA01
agucccauugcaucugcgccg

SEQ ID NO: 3439457 - RNA, 23 nt, Pseudomonas aeruginosa PA01
aguccccuaggggacgccacuuc

SEQ ID NO: 3439458 - RNA, 17 nt, Pseudomonas aeruginosa PA01
agucccgcaaagcccgc

SEQ ID NO: 3439459 - RNA, 22 nt, Pseudomonas aeruginosa PA01
agucccgccaggcgccgaucaa

SEQ ID NO: 3439460 - RNA, 19 nt, Pseudomonas aeruginosa PA01
agucccguccgcugcgcca

SEQ ID NO: 3439461 - RNA, 17 nt, Pseudomonas aeruginosa PA01
aguccgcgcgcgcgcuc

SEQ ID NO: 3439462 - RNA, 20 nt, Pseudomonas aeruginosa PA01
aguccgcgcgcgcgcuccuc

SEQ ID NO: 3439463 - RNA, 19 nt, Pseudomonas aeruginosa PA01
aguccgcugcgagcagguc

SEQ ID NO: 3439464 - RNA, 15 nt, Pseudomonas aeruginosa PA01
aguccggcaccgcuc

SEQ ID NO: 3439465 - RNA, 17 nt, Pseudomonas aeruginosa PA01
aguccggcagcacggcg

SEQ ID NO: 3439466 - RNA, 14 nt, Pseudomonas aeruginosa PA01
aguccgggcgcggc

SEQ ID NO: 3439467 - RNA, 19 nt, Pseudomonas aeruginosa PA01
aguccggguugacccagag

SEQ ID NO: 3439468 - RNA, 18 nt, Pseudomonas aeruginosa PA01
aguccggguugagcaccc

SEQ ID NO: 3439469 - RNA, 18 nt, Pseudomonas aeruginosa PA01
aguccgguagcgcgccug

SEQ ID NO: 3439470 - RNA, 18 nt, Pseudomonas aeruginosa PA01
aguccuccgcgcccaggc

SEQ ID NO: 3439471 - RNA, 22 nt, Pseudomonas aeruginosa PA01
aguccuccgcgcccaggcgcac

SEQ ID NO: 3439472 - RNA, 13 nt, Pseudomonas aeruginosa PA01
aguccugcaggau

SEQ ID NO: 3439473 - RNA, 19 nt, Pseudomonas aeruginosa PA01
aguccuggacccguugccg

SEQ ID NO: 3439474 - RNA, 15 nt, Pseudomonas aeruginosa PA01
aguccugggugucgu

SEQ ID NO: 3439475 - RNA, 21 nt, Pseudomonas aeruginosa PA01
aguggaucgcccgaacgccga

SEQ ID NO: 3439476 - RNA, 19 nt, Pseudomonas aeruginosa PA01
aguggaucggcccuucgac

SEQ ID NO: 3439477 - RNA, 14 nt, Pseudomonas aeruginosa PA01
aguggccgaaggcg

SEQ ID NO: 3439478 - RNA, 19 nt, Pseudomonas aeruginosa PA01
aguggccgaaggcgcuccc

SEQ ID NO: 3439479 - RNA, 15 nt, Pseudomonas aeruginosa PA01
aguggcgaagccagc

SEQ ID NO: 3439480 - RNA, 14 nt, Pseudomonas aeruginosa PA01
aguggcgcagcgcc

SEQ ID NO: 3439481 - RNA, 12 nt, Pseudomonas aeruginosa PA01
aguggcgccagc

SEQ ID NO: 3439482 - RNA, 14 nt, Pseudomonas aeruginosa PA01
aguggcgcggcuga

SEQ ID NO: 3439483 - RNA, 19 nt, Pseudomonas aeruginosa PA01
aguggcguuccaggcggcg

SEQ ID NO: 3439484 - RNA, 16 nt, Pseudomonas aeruginosa PA01
agugggcgaggcgcuc

SEQ ID NO: 3439485 - RNA, 18 nt, Pseudomonas aeruginosa PA01
agugggcgaggcgcucga

SEQ ID NO: 3439486 - RNA, 11 nt, Pseudomonas aeruginosa PA01
agugggcgggg

SEQ ID NO: 3439487 - RNA, 16 nt, Pseudomonas aeruginosa PA01
aguggguaggccaggc

SEQ ID NO: 3439488 - RNA, 17 nt, Pseudomonas aeruginosa PA01
aguggguaggccaggca

SEQ ID NO: 3439489 - RNA, 17 nt, Pseudomonas aeruginosa PA01
agugggucgaugcccuc

SEQ ID NO: 3439490 - RNA, 19 nt, Pseudomonas aeruginosa PA01
agugggucgaugcccucgc

SEQ ID NO: 3439491 - RNA, 13 nt, Pseudomonas aeruginosa PA01
agugggucgccgu

SEQ ID NO: 3439492 - RNA, 18 nt, Pseudomonas aeruginosa PA01
agugggucgccguggugg

SEQ ID NO: 3439493 - RNA, 18 nt, Pseudomonas aeruginosa PA01
agugguuccaggagggcu

SEQ ID NO: 3439494 - RNA, 20 nt, Pseudomonas aeruginosa PA01
agugguuccaggagggcugc

SEQ ID NO: 3439495 - RNA, 23 nt, Pseudomonas aeruginosa PA01
agugucgcgaacucggcgccgau

SEQ ID NO: 3439496 - RNA, 20 nt, Pseudomonas aeruginosa PA01
agugugccgcccugcucuug

SEQ ID NO: 3439497 - RNA, 17 nt, Pseudomonas aeruginosa PA01
agugugccggccaugca

SEQ ID NO: 3439498 - RNA, 23 nt, Pseudomonas aeruginosa PA01
agugugggacaggaagagcaggc

SEQ ID NO: 3439499 - RNA, 15 nt, Pseudomonas aeruginosa PA01
aguguuacagcagga

SEQ ID NO: 3439500 - RNA, 23 nt, Pseudomonas aeruginosa PA01
aguuaaugcuuacaagagcagac

SEQ ID NO: 3439501 - RNA, 19 nt, Pseudomonas aeruginosa PA01
aguucacauuggcuuccga

SEQ ID NO: 3439502 - RNA, 22 nt, Pseudomonas aeruginosa PA01
aguucacauuggcuuccgagca

SEQ ID NO: 3439503 - RNA, 21 nt, Pseudomonas aeruginosa PA01
aguucaccucggugagguagc

SEQ ID NO: 3439504 - RNA, 23 nt, Pseudomonas aeruginosa PA01
aguucacguaggagccggccagg

SEQ ID NO: 3439505 - RNA, 14 nt, Pseudomonas aeruginosa PA01
aguucagccacugc

SEQ ID NO: 3439506 - RNA, 15 nt, Pseudomonas aeruginosa PA01
aguucagccgguacu

SEQ ID NO: 3439507 - RNA, 22 nt, Pseudomonas aeruginosa PA01
aguucagccgguacugcgccag

SEQ ID NO: 3439508 - RNA, 16 nt, Pseudomonas aeruginosa PA01
aguucagcgcgcucgc

SEQ ID NO: 3439509 - RNA, 17 nt, Pseudomonas aeruginosa PA01
aguucagggcguagcgg

SEQ ID NO: 3439510 - RNA, 20 nt, Pseudomonas aeruginosa PA01
aguucaguagcggcagggua

SEQ ID NO: 3439511 - RNA, 16 nt, Pseudomonas aeruginosa PA01
aguucaucgagcaggu

SEQ ID NO: 3439512 - RNA, 17 nt, Pseudomonas aeruginosa PA01
aguucaucgagcaggua

SEQ ID NO: 3439513 - RNA, 14 nt, Pseudomonas aeruginosa PA01
aguuccacgaagaa

SEQ ID NO: 3439514 - RNA, 17 nt, Pseudomonas aeruginosa PA01
aguuccacgaagaacgc

SEQ ID NO: 3439515 - RNA, 13 nt, Pseudomonas aeruginosa PA01
aguuccaggucgg

SEQ ID NO: 3439516 - RNA, 16 nt, Pseudomonas aeruginosa PA01
aguuccaggucggcgg

SEQ ID NO: 3439517 - RNA, 18 nt, Pseudomonas aeruginosa PA01
aguuccgacugcgagccg

SEQ ID NO: 3439518 - RNA, 17 nt, Pseudomonas aeruginosa PA01
aguuccucgccgcugcu

SEQ ID NO: 3439519 - RNA, 15 nt, Pseudomonas aeruginosa PA01
aguuccucgcgaggg

SEQ ID NO: 3439520 - RNA, 12 nt, Pseudomonas aeruginosa PA01
aguuccugcacc

SEQ ID NO: 3439521 - RNA, 15 nt, Pseudomonas aeruginosa PA01
aguuccuucuugacc

SEQ ID NO: 3439522 - RNA, 17 nt, Pseudomonas aeruginosa PA01
aguucgaagcgccaggc

SEQ ID NO: 3439523 - RNA, 14 nt, Pseudomonas aeruginosa PA01
aguucgacccaugc

SEQ ID NO: 3439524 - RNA, 18 nt, Pseudomonas aeruginosa PA01
aguucgcauaggcggcca

SEQ ID NO: 3439525 - RNA, 21 nt, Pseudomonas aeruginosa PA01
aguucgcauaggcggccagcc

SEQ ID NO: 3439526 - RNA, 23 nt, Pseudomonas aeruginosa PA01
aguucgcauaggcggccagccuu

SEQ ID NO: 3439527 - RNA, 19 nt, Pseudomonas aeruginosa PA01
aguucgccaaaaaaagccc

SEQ ID NO: 3439528 - RNA, 20 nt, Pseudomonas aeruginosa PA01
aguucgccaaaaaaagcccc

SEQ ID NO: 3439529 - RNA, 16 nt, Pseudomonas aeruginosa PA01
aguucgccacugaacu

SEQ ID NO: 3439530 - RNA, 20 nt, Pseudomonas aeruginosa PA01
aguucgcccagcucgccgcu

SEQ ID NO: 3439531 - RNA, 13 nt, Pseudomonas aeruginosa PA01
aguucgcccgccc

SEQ ID NO: 3439532 - RNA, 13 nt, Pseudomonas aeruginosa PA01
aguucgccgccga

SEQ ID NO: 3439533 - RNA, 22 nt, Pseudomonas aeruginosa PA01
aguucgccgccgagcgccuggc

SEQ ID NO: 3439534 - RNA, 23 nt, Pseudomonas aeruginosa PA01
aguucgccgccgagcgccuggca

SEQ ID NO: 3439535 - RNA, 15 nt, Pseudomonas aeruginosa PA01
aguucgccgcgagca

SEQ ID NO: 3439536 - RNA, 13 nt, Pseudomonas aeruginosa PA01
aguucgccggcca

SEQ ID NO: 3439537 - RNA, 16 nt, Pseudomonas aeruginosa PA01
aguucgccggccaggu

SEQ ID NO: 3439538 - RNA, 19 nt, Pseudomonas aeruginosa PA01
aguucgccguucagcuccc

SEQ ID NO: 3439539 - RNA, 19 nt, Pseudomonas aeruginosa PA01
aguucgcgcaggaccuggc

SEQ ID NO: 3439540 - RNA, 20 nt, Pseudomonas aeruginosa PA01
aguucgcgcgggucgucgau

SEQ ID NO: 3439541 - RNA, 14 nt, Pseudomonas aeruginosa PA01
aguucgcggcgcag

SEQ ID NO: 3439542 - RNA, 17 nt, Pseudomonas aeruginosa PA01
aguucgcguagccccuc

SEQ ID NO: 3439543 - RNA, 14 nt, Pseudomonas aeruginosa PA01
aguucgcugaaggu

SEQ ID NO: 3439544 - RNA, 19 nt, Pseudomonas aeruginosa PA01
aguucgcugccgccgcgcu

SEQ ID NO: 3439545 - RNA, 11 nt, Pseudomonas aeruginosa PA01
aguucgcugcg

SEQ ID NO: 3439546 - RNA, 14 nt, Pseudomonas aeruginosa PA01
aguucgcugcgcgc

SEQ ID NO: 3439547 - RNA, 16 nt, Pseudomonas aeruginosa PA01
aguucggccaucagca

SEQ ID NO: 3439548 - RNA, 18 nt, Pseudomonas aeruginosa PA01
aguucggccaucagcacg

SEQ ID NO: 3439549 - RNA, 23 nt, Pseudomonas aeruginosa PA01
aguucggccaucagcacgucguc

SEQ ID NO: 3439550 - RNA, 17 nt, Pseudomonas aeruginosa PA01
aguucggcccagcagcg

SEQ ID NO: 3439551 - RNA, 20 nt, Pseudomonas aeruginosa PA01
aguucggcccagcagcgcuc

SEQ ID NO: 3439552 - RNA, 14 nt, Pseudomonas aeruginosa PA01
aguucggcgagcag

SEQ ID NO: 3439553 - RNA, 16 nt, Pseudomonas aeruginosa PA01
aguucggcgagcaggu

SEQ ID NO: 3439554 - RNA, 19 nt, Pseudomonas aeruginosa PA01
aguucggcgagcagguaga

SEQ ID NO: 3439555 - RNA, 17 nt, Pseudomonas aeruginosa PA01
aguucggggucggccug

SEQ ID NO: 3439556 - RNA, 19 nt, Pseudomonas aeruginosa PA01
aguucggggucggccugcg

SEQ ID NO: 3439557 - RNA, 20 nt, Pseudomonas aeruginosa PA01
aguucggugccgccggcgcc

SEQ ID NO: 3439558 - RNA, 15 nt, Pseudomonas aeruginosa PA01
aguucgucaaccagc

SEQ ID NO: 3439559 - RNA, 18 nt, Pseudomonas aeruginosa PA01
aguucguccaucgccagg

SEQ ID NO: 3439560 - RNA, 16 nt, Pseudomonas aeruginosa PA01
aguucgucgccacgcc

SEQ ID NO: 3439561 - RNA, 21 nt, Pseudomonas aeruginosa PA01
aguucgucgccacgcccgccg

SEQ ID NO: 3439562 - RNA, 16 nt, Pseudomonas aeruginosa PA01
aguucucgcagcaggc

SEQ ID NO: 3439563 - RNA, 18 nt, Pseudomonas aeruginosa PA01
aguucucgcagcaggcgu

SEQ ID NO: 3439564 - RNA, 18 nt, Pseudomonas aeruginosa PA01
aguucugggcggccaggu

SEQ ID NO: 3439565 - RNA, 15 nt, Pseudomonas aeruginosa PA01
aguucuucagcagca

SEQ ID NO: 3439566 - RNA, 15 nt, Pseudomonas aeruginosa PA01
aguucuucgccgccc

SEQ ID NO: 3439567 - RNA, 22 nt, Pseudomonas aeruginosa PA01
aguucuucgccgcccgcgccuc

SEQ ID NO: 3439568 - RNA, 17 nt, Pseudomonas aeruginosa PA01
aguugaccagcauguug

SEQ ID NO: 3439569 - RNA, 16 nt, Pseudomonas aeruginosa PA01
aguugagcugugguug

SEQ ID NO: 3439570 - RNA, 16 nt, Pseudomonas aeruginosa PA01
aguugaggcagguggc

SEQ ID NO: 3439571 - RNA, 15 nt, Pseudomonas aeruginosa PA01
aguugagucgcgcgc

SEQ ID NO: 3439572 - RNA, 18 nt, Pseudomonas aeruginosa PA01
aguugauggucaggcugg

SEQ ID NO: 3439573 - RNA, 11 nt, Pseudomonas aeruginosa PA01
aguugcaacag

SEQ ID NO: 3439574 - RNA, 17 nt, Pseudomonas aeruginosa PA01
aguugcaacagcgcggc

SEQ ID NO: 3439575 - RNA, 16 nt, Pseudomonas aeruginosa PA01
aguugcaggccagcgc

SEQ ID NO: 3439576 - RNA, 20 nt, Pseudomonas aeruginosa PA01
aguugcaggccagcgccagg

SEQ ID NO: 3439577 - RNA, 13 nt, Pseudomonas aeruginosa PA01
aguugcaggccgg

SEQ ID NO: 3439578 - RNA, 15 nt, Pseudomonas aeruginosa PA01
auagcgagccgcgcu

SEQ ID NO: 3439579 - RNA, 14 nt, Pseudomonas aeruginosa PA01
auagcgccacacgg

SEQ ID NO: 3439580 - RNA, 11 nt, Pseudomonas aeruginosa PA01
auagcgcgccg

SEQ ID NO: 3439581 - RNA, 13 nt, Pseudomonas aeruginosa PA01
auagcgcgccggg

SEQ ID NO: 3439582 - RNA, 18 nt, Pseudomonas aeruginosa PA01
auagcgggucaugagguu

SEQ ID NO: 3439583 - RNA, 20 nt, Pseudomonas aeruginosa PA01
auagcucagucgguagagca

SEQ ID NO: 3439584 - RNA, 21 nt, Pseudomonas aeruginosa PA01
auagcuggucaauaccacccu

SEQ ID NO: 3439585 - RNA, 21 nt, Pseudomonas aeruginosa PA01
auaggccugggcguacaggcc

SEQ ID NO: 3439586 - RNA, 14 nt, Pseudomonas aeruginosa PA01
auaggcgccagccu

SEQ ID NO: 3439587 - RNA, 17 nt, Pseudomonas aeruginosa PA01
auaggcgccggcgcgcg

SEQ ID NO: 3439588 - RNA, 18 nt, Pseudomonas aeruginosa PA01
auagggcaucagccccuc

SEQ ID NO: 3439589 - RNA, 15 nt, Pseudomonas aeruginosa PA01
auagggcggcgccac

SEQ ID NO: 3439590 - RNA, 15 nt, Pseudomonas aeruginosa PA01
auaggucaugcccag

SEQ ID NO: 3439591 - RNA, 17 nt, Pseudomonas aeruginosa PA01
auagucgccguucaggu

SEQ ID NO: 3439592 - RNA, 13 nt, Pseudomonas aeruginosa PA01
auagugcugggcg

SEQ ID NO: 3439593 - RNA, 22 nt, Pseudomonas aeruginosa PA01
auagugcugggcgaccuucagc

SEQ ID NO: 3439594 - RNA, 14 nt, Pseudomonas aeruginosa PA01
auauagcuggucaa

SEQ ID NO: 3439595 - RNA, 13 nt, Pseudomonas aeruginosa PA01
auaucgcaggcca

SEQ ID NO: 3439596 - RNA, 23 nt, Pseudomonas aeruginosa PA01
auaucgcggcgcgauauccgcca

SEQ ID NO: 3439597 - RNA, 12 nt, Pseudomonas aeruginosa PA01
auaucugggcca

SEQ ID NO: 3439598 - RNA, 22 nt, Pseudomonas aeruginosa PA01
auaucuugcgcaugguuaccuc

SEQ ID NO: 3439599 - RNA, 14 nt, Pseudomonas aeruginosa PA01
auaugccgcucagc

SEQ ID NO: 3439600 - RNA, 15 nt, Pseudomonas aeruginosa PA01
auaugccgcucagcg

SEQ ID NO: 3439601 - RNA, 22 nt, Pseudomonas aeruginosa PA01
auauggaagaggaucuccuggc

SEQ ID NO: 3439602 - RNA, 23 nt, Pseudomonas aeruginosa PA01
auauggaccggcucgucggcguu

SEQ ID NO: 3439603 - RNA, 13 nt, Pseudomonas aeruginosa PA01
auauggcuggcgc

SEQ ID NO: 3439604 - RNA, 14 nt, Pseudomonas aeruginosa PA01
auaugggugaugac

SEQ ID NO: 3439605 - RNA, 15 nt, Pseudomonas aeruginosa PA01
auaugggugaugacc

SEQ ID NO: 3439606 - RNA, 16 nt, Pseudomonas aeruginosa PA01
auaugggugaugaccc

SEQ ID NO: 3439607 - RNA, 19 nt, Pseudomonas aeruginosa PA01
auauuuuucuaaaauggcu

SEQ ID NO: 3439608 - RNA, 14 nt, Pseudomonas aeruginosa PA01
aucaaaaccagccu

SEQ ID NO: 3439609 - RNA, 17 nt, Pseudomonas aeruginosa PA01
aucaacgcggccagcag

SEQ ID NO: 3439610 - RNA, 16 nt, Pseudomonas aeruginosa PA01
aucaacgggcccugcc

SEQ ID NO: 3439611 - RNA, 20 nt, Pseudomonas aeruginosa PA01
aucaacuccgccaggcgcuc

SEQ ID NO: 3439612 - RNA, 21 nt, Pseudomonas aeruginosa PA01
aucaauugccgguagccggcg

SEQ ID NO: 3439613 - RNA, 19 nt, Pseudomonas aeruginosa PA01
aucacacuguccagggcga

SEQ ID NO: 3439614 - RNA, 20 nt, Pseudomonas aeruginosa PA01
aucaccaccaccgucuggcg

SEQ ID NO: 3439615 - RNA, 19 nt, Pseudomonas aeruginosa PA01
aucaccaccagcaucagca

SEQ ID NO: 3439616 - RNA, 14 nt, Pseudomonas aeruginosa PA01
aucaccaccagcgc

SEQ ID NO: 3439617 - RNA, 18 nt, Pseudomonas aeruginosa PA01
aucaccaccagcgccgcc

SEQ ID NO: 3439618 - RNA, 16 nt, Pseudomonas aeruginosa PA01
aucaccaccggcuggc

SEQ ID NO: 3439619 - RNA, 23 nt, Pseudomonas aeruginosa PA01
aucaccaccggcuggcggcucgg

SEQ ID NO: 3439620 - RNA, 18 nt, Pseudomonas aeruginosa PA01
aucaccaccgggaucgcu

SEQ ID NO: 3439621 - RNA, 18 nt, Pseudomonas aeruginosa PA01
aucaccacucgccagcgc

SEQ ID NO: 3439622 - RNA, 19 nt, Pseudomonas aeruginosa PA01
aucaccagcaauugccggc

SEQ ID NO: 3439623 - RNA, 20 nt, Pseudomonas aeruginosa PA01
aucaccagcaauugccggcg

SEQ ID NO: 3439624 - RNA, 13 nt, Pseudomonas aeruginosa PA01
aucaccagcgcca

SEQ ID NO: 3439625 - RNA, 14 nt, Pseudomonas aeruginosa PA01
aucaccagcgccag

SEQ ID NO: 3439626 - RNA, 14 nt, Pseudomonas aeruginosa PA01
aucaccagcgccgu

SEQ ID NO: 3439627 - RNA, 23 nt, Pseudomonas aeruginosa PA01
aucaccagcgccgucaccagcag

SEQ ID NO: 3439628 - RNA, 17 nt, Pseudomonas aeruginosa PA01
aucaccaggcugccgcc

SEQ ID NO: 3439629 - RNA, 16 nt, Pseudomonas aeruginosa PA01
aucacccccagcgagc

SEQ ID NO: 3439630 - RNA, 13 nt, Pseudomonas aeruginosa PA01
aucaccccgcaac

SEQ ID NO: 3439631 - RNA, 20 nt, Pseudomonas aeruginosa PA01
aucaccccgcaaccgcagac

SEQ ID NO: 3439632 - RNA, 15 nt, Pseudomonas aeruginosa PA01
aucaccccgcccagu

SEQ ID NO: 3439633 - RNA, 21 nt, Pseudomonas aeruginosa PA01
aucaccgcaucgaaggcgccg

SEQ ID NO: 3439634 - RNA, 19 nt, Pseudomonas aeruginosa PA01
aucaccgccaaggccucgg

SEQ ID NO: 3439635 - RNA, 15 nt, Pseudomonas aeruginosa PA01
aucaccgccuuggca

SEQ ID NO: 3439636 - RNA, 22 nt, Pseudomonas aeruginosa PA01
aucaccgccuuggcaucgccgc

SEQ ID NO: 3439637 - RNA, 21 nt, Pseudomonas aeruginosa PA01
aucaccgcgguggaggcggcg

SEQ ID NO: 3439638 - RNA, 21 nt, Pseudomonas aeruginosa PA01
aucaccgcguccauccccgcc

SEQ ID NO: 3439639 - RNA, 22 nt, Pseudomonas aeruginosa PA01
aucaccggcaggaucggcgcgg

SEQ ID NO: 3439640 - RNA, 12 nt, Pseudomonas aeruginosa PA01
aucaccggcggg

SEQ ID NO: 3439641 - RNA, 15 nt, Pseudomonas aeruginosa PA01
aucaccggcuggccc

SEQ ID NO: 3439642 - RNA, 18 nt, Pseudomonas aeruginosa PA01
aucaccggggccuucagg

SEQ ID NO: 3439643 - RNA, 14 nt, Pseudomonas aeruginosa PA01
aucaccuccuguuc

SEQ ID NO: 3439644 - RNA, 11 nt, Pseudomonas aeruginosa PA01
aucaccugcuu

SEQ ID NO: 3439645 - RNA, 15 nt, Pseudomonas aeruginosa PA01
aucaccuucaccggc

SEQ ID NO: 3439646 - RNA, 16 nt, Pseudomonas aeruginosa PA01
aucaccuucgccagca

SEQ ID NO: 3439647 - RNA, 14 nt, Pseudomonas aeruginosa PA01
aucaccuucgcccu

SEQ ID NO: 3439648 - RNA, 15 nt, Pseudomonas aeruginosa PA01
aucaccuucgcccuc

SEQ ID NO: 3439649 - RNA, 19 nt, Pseudomonas aeruginosa PA01
aucaccuugcccucgcgga

SEQ ID NO: 3439650 - RNA, 22 nt, Pseudomonas aeruginosa PA01
aucaccuugucgcaccagccuu

SEQ ID NO: 3439651 - RNA, 22 nt, Pseudomonas aeruginosa PA01
aucacgaucggcaccaucaccg

SEQ ID NO: 3439652 - RNA, 23 nt, Pseudomonas aeruginosa PA01
aucacgaucggcaccaucaccga

SEQ ID NO: 3439653 - RNA, 16 nt, Pseudomonas aeruginosa PA01
aucacgauggccggca

SEQ ID NO: 3439654 - RNA, 17 nt, Pseudomonas aeruginosa PA01
aucacgauggccggcag

SEQ ID NO: 3439655 - RNA, 18 nt, Pseudomonas aeruginosa PA01
aucacgcaagugcccugg

SEQ ID NO: 3439656 - RNA, 18 nt, Pseudomonas aeruginosa PA01
aucacgcugcucgcagcc

SEQ ID NO: 3439657 - RNA, 14 nt, Pseudomonas aeruginosa PA01
aucacguacggcgc

SEQ ID NO: 3439658 - RNA, 15 nt, Pseudomonas aeruginosa PA01
aucacguacggcgcc

SEQ ID NO: 3439659 - RNA, 19 nt, Pseudomonas aeruginosa PA01
aucacguaggacaggucgg

SEQ ID NO: 3439660 - RNA, 18 nt, Pseudomonas aeruginosa PA01
aucacgucgaucugcucg

SEQ ID NO: 3439661 - RNA, 18 nt, Pseudomonas aeruginosa PA01
aucacgucgcgcaccugg

SEQ ID NO: 3439662 - RNA, 22 nt, Pseudomonas aeruginosa PA01
aucacgucgcgcaccuggcggu

SEQ ID NO: 3439663 - RNA, 23 nt, Pseudomonas aeruginosa PA01
aucacgucgcgcaccuggcgguc

SEQ ID NO: 3439664 - RNA, 13 nt, Pseudomonas aeruginosa PA01
aucacgucggcgu

SEQ ID NO: 3439665 - RNA, 22 nt, Pseudomonas aeruginosa PA01
aucacguugaacacaucgacca

SEQ ID NO: 3439666 - RNA, 12 nt, Pseudomonas aeruginosa PA01
aucacucgccgc

SEQ ID NO: 3439667 - RNA, 14 nt, Pseudomonas aeruginosa PA01
aucacucgccgccg

SEQ ID NO: 3439668 - RNA, 15 nt, Pseudomonas aeruginosa PA01
aucacucgccgccgu

SEQ ID NO: 3439669 - RNA, 14 nt, Pseudomonas aeruginosa PA01
aucacugccuggca

SEQ ID NO: 3439670 - RNA, 15 nt, Pseudomonas aeruginosa PA01
aucagaacgaugccg

SEQ ID NO: 3439671 - RNA, 11 nt, Pseudomonas aeruginosa PA01
aucagcacaug

SEQ ID NO: 3439672 - RNA, 20 nt, Pseudomonas aeruginosa PA01
aucagcaccaggaagcccca

SEQ ID NO: 3439673 - RNA, 20 nt, Pseudomonas aeruginosa PA01
aucagcacgucguccagcgc

SEQ ID NO: 3439674 - RNA, 22 nt, Pseudomonas aeruginosa PA01
aucagcacgucguccagcgccg

SEQ ID NO: 3439675 - RNA, 13 nt, Pseudomonas aeruginosa PA01
aucagcagcagcg

SEQ ID NO: 3439676 - RNA, 14 nt, Pseudomonas aeruginosa PA01
aucagcagcgccac

SEQ ID NO: 3439677 - RNA, 15 nt, Pseudomonas aeruginosa PA01
aucagcagcgccagc

SEQ ID NO: 3439678 - RNA, 16 nt, Pseudomonas aeruginosa PA01
aucagcagcgccagca

SEQ ID NO: 3439679 - RNA, 20 nt, Pseudomonas aeruginosa PA01
aucagcaggaugcagucggc

SEQ ID NO: 3439680 - RNA, 16 nt, Pseudomonas aeruginosa PA01
aucagcagggucaggg

SEQ ID NO: 3439681 - RNA, 18 nt, Pseudomonas aeruginosa PA01
auccagggagaacagcag

SEQ ID NO: 3439682 - RNA, 20 nt, Pseudomonas aeruginosa PA01
auccagggagaacagcaggg

SEQ ID NO: 3439683 - RNA, 14 nt, Pseudomonas aeruginosa PA01
auccagggccagga

SEQ ID NO: 3439684 - RNA, 23 nt, Pseudomonas aeruginosa PA01
auccagggccgagcacaggguga

SEQ ID NO: 3439685 - RNA, 21 nt, Pseudomonas aeruginosa PA01
auccagguaaaggccaccaga

SEQ ID NO: 3439686 - RNA, 14 nt, Pseudomonas aeruginosa PA01
auccagguucaccc

SEQ ID NO: 3439687 - RNA, 17 nt, Pseudomonas aeruginosa PA01
auccagucuucgccggc

SEQ ID NO: 3439688 - RNA, 17 nt, Pseudomonas aeruginosa PA01
auccaguguggcggcgu

SEQ ID NO: 3439689 - RNA, 14 nt, Pseudomonas aeruginosa PA01
auccaguuccugca

SEQ ID NO: 3439690 - RNA, 16 nt, Pseudomonas aeruginosa PA01
aucccaggucggcggg

SEQ ID NO: 3439691 - RNA, 22 nt, Pseudomonas aeruginosa PA01
aucccaggucggcgggcaccgc

SEQ ID NO: 3439692 - RNA, 16 nt, Pseudomonas aeruginosa PA01
auccccccacccgucc

SEQ ID NO: 3439693 - RNA, 20 nt, Pseudomonas aeruginosa PA01
auccccggaccagggcgccg

SEQ ID NO: 3439694 - RNA, 22 nt, Pseudomonas aeruginosa PA01
auccccggaccagggcgccggg

SEQ ID NO: 3439695 - RNA, 23 nt, Pseudomonas aeruginosa PA01
auccccggaccagggcgccgggc

SEQ ID NO: 3439696 - RNA, 16 nt, Pseudomonas aeruginosa PA01
auccccucccgcgcca

SEQ ID NO: 3439697 - RNA, 22 nt, Pseudomonas aeruginosa PA01
auccccucccgcgccagcgccg

SEQ ID NO: 3439698 - RNA, 23 nt, Pseudomonas aeruginosa PA01
auccccucccgcgccagcgccgc

SEQ ID NO: 3439699 - RNA, 13 nt, Pseudomonas aeruginosa PA01
auccccuccucca

SEQ ID NO: 3439700 - RNA, 15 nt, Pseudomonas aeruginosa PA01
auccccugcaggacc

SEQ ID NO: 3439701 - RNA, 21 nt, Pseudomonas aeruginosa PA01
aucccgacgcccuccagcacc

SEQ ID NO: 3439702 - RNA, 15 nt, Pseudomonas aeruginosa PA01
aucccgcgcgggccg

SEQ ID NO: 3439703 - RNA, 22 nt, Pseudomonas aeruginosa PA01
aucccgcgcgggccgaggucgc

SEQ ID NO: 3439704 - RNA, 17 nt, Pseudomonas aeruginosa PA01
aucccggcugagcgcca

SEQ ID NO: 3439705 - RNA, 20 nt, Pseudomonas aeruginosa PA01
aucccggcugagcgccaggc

SEQ ID NO: 3439706 - RNA, 21 nt, Pseudomonas aeruginosa PA01
aucccggcugagcgccaggcg

SEQ ID NO: 3439707 - RNA, 22 nt, Pseudomonas aeruginosa PA01
aucccggcugagcgccaggcgc

SEQ ID NO: 3439708 - RNA, 19 nt, Pseudomonas aeruginosa PA01
aucccgggguugcccagca

SEQ ID NO: 3439709 - RNA, 13 nt, Pseudomonas aeruginosa PA01
aucccguagaugu

SEQ ID NO: 3439710 - RNA, 22 nt, Pseudomonas aeruginosa PA01
aucccucuaucacacuguccag

SEQ ID NO: 3439711 - RNA, 14 nt, Pseudomonas aeruginosa PA01
aucccuuggcugcu

SEQ ID NO: 3439712 - RNA, 22 nt, Pseudomonas aeruginosa PA01
aucccuuuuucauucuccagcc

SEQ ID NO: 3439713 - RNA, 14 nt, Pseudomonas aeruginosa PA01
auccgacgccggcu

SEQ ID NO: 3439714 - RNA, 15 nt, Pseudomonas aeruginosa PA01
auccgacgccggcuu

SEQ ID NO: 3439715 - RNA, 16 nt, Pseudomonas aeruginosa PA01
auccgaggaugggcuu

SEQ ID NO: 3439716 - RNA, 15 nt, Pseudomonas aeruginosa PA01
auccgauuccgcgca

SEQ ID NO: 3439717 - RNA, 16 nt, Pseudomonas aeruginosa PA01
auccgcaccauccgcc

SEQ ID NO: 3439718 - RNA, 18 nt, Pseudomonas aeruginosa PA01
auccgcaccauccgccgc

SEQ ID NO: 3439719 - RNA, 16 nt, Pseudomonas aeruginosa PA01
auccgcacccgcgacu

SEQ ID NO: 3439720 - RNA, 17 nt, Pseudomonas aeruginosa PA01
auccgcacccgcgacuc

SEQ ID NO: 3439721 - RNA, 14 nt, Pseudomonas aeruginosa PA01
auccgcacccgggc

SEQ ID NO: 3439722 - RNA, 23 nt, Pseudomonas aeruginosa PA01
auccgcaguacgguucagaguga

SEQ ID NO: 3439723 - RNA, 13 nt, Pseudomonas aeruginosa PA01
auccgccagcaga

SEQ ID NO: 3439724 - RNA, 20 nt, Pseudomonas aeruginosa PA01
auccgccccaccccaggguu

SEQ ID NO: 3439725 - RNA, 15 nt, Pseudomonas aeruginosa PA01
auccgcccgaucgcc

SEQ ID NO: 3439726 - RNA, 16 nt, Pseudomonas aeruginosa PA01
auccgcccugcgcagc

SEQ ID NO: 3439727 - RNA, 19 nt, Pseudomonas aeruginosa PA01
auccgccgauugugcaggg

SEQ ID NO: 3439728 - RNA, 13 nt, Pseudomonas aeruginosa PA01
auccgccgcagac

SEQ ID NO: 3439729 - RNA, 20 nt, Pseudomonas aeruginosa PA01
auccgccgcaggaaggcgaa

SEQ ID NO: 3439730 - RNA, 18 nt, Pseudomonas aeruginosa PA01
auccgccgcuacugcgcg

SEQ ID NO: 3439731 - RNA, 23 nt, Pseudomonas aeruginosa PA01
auccgccgcucccggcuugcuga

SEQ ID NO: 3439732 - RNA, 15 nt, Pseudomonas aeruginosa PA01
auccgccgcugggga

SEQ ID NO: 3439733 - RNA, 12 nt, Pseudomonas aeruginosa PA01
auccgccgcugu

SEQ ID NO: 3439734 - RNA, 21 nt, Pseudomonas aeruginosa PA01
auccgccggccggggcgcgcc

SEQ ID NO: 3439735 - RNA, 22 nt, Pseudomonas aeruginosa PA01
auccgccggcugugcagggcag

SEQ ID NO: 3439736 - RNA, 21 nt, Pseudomonas aeruginosa PA01
auccgccgucgggcuucggug

SEQ ID NO: 3439737 - RNA, 18 nt, Pseudomonas aeruginosa PA01
auccgccgugaggcgcgc

SEQ ID NO: 3439738 - RNA, 12 nt, Pseudomonas aeruginosa PA01
auccgccgugga

SEQ ID NO: 3439739 - RNA, 23 nt, Pseudomonas aeruginosa PA01
auccgccguggaacgcaggggca

SEQ ID NO: 3439740 - RNA, 21 nt, Pseudomonas aeruginosa PA01
auccgccguuccuccucgccg

SEQ ID NO: 3439741 - RNA, 23 nt, Pseudomonas aeruginosa PA01
auccgccuucuuuucuuccgccu

SEQ ID NO: 3439742 - RNA, 17 nt, Pseudomonas aeruginosa PA01
auccgcgacaguucgcc

SEQ ID NO: 3439743 - RNA, 21 nt, Pseudomonas aeruginosa PA01
auccgcgccgaccagccgcag

SEQ ID NO: 3439744 - RNA, 13 nt, Pseudomonas aeruginosa PA01
auccgcgccggug

SEQ ID NO: 3439745 - RNA, 16 nt, Pseudomonas aeruginosa PA01
auccgcgccgguggcc

SEQ ID NO: 3439746 - RNA, 17 nt, Pseudomonas aeruginosa PA01
auccgcgccgguggcca

SEQ ID NO: 3439747 - RNA, 12 nt, Pseudomonas aeruginosa PA01
auccgcgccugc

SEQ ID NO: 3439748 - RNA, 12 nt, Pseudomonas aeruginosa PA01
auccgcgcggca

SEQ ID NO: 3439749 - RNA, 13 nt, Pseudomonas aeruginosa PA01
auccgcgcggcaa

SEQ ID NO: 3439750 - RNA, 15 nt, Pseudomonas aeruginosa PA01
auccgcggccccggc

SEQ ID NO: 3439751 - RNA, 20 nt, Pseudomonas aeruginosa PA01
auccgcggcccugcucgccg

SEQ ID NO: 3439752 - RNA, 22 nt, Pseudomonas aeruginosa PA01
auccgcggcccugcucgccggc

SEQ ID NO: 3439753 - RNA, 16 nt, Pseudomonas aeruginosa PA01
auccgcggccuuuugc

SEQ ID NO: 3439754 - RNA, 22 nt, Pseudomonas aeruginosa PA01
auccgcguggcgaugcccuggc

SEQ ID NO: 3439755 - RNA, 22 nt, Pseudomonas aeruginosa PA01
auccgcguggcgugcucggcga

SEQ ID NO: 3439756 - RNA, 22 nt, Pseudomonas aeruginosa PA01
auccgcguuaccguccgcgccg

SEQ ID NO: 3439757 - RNA, 14 nt, Pseudomonas aeruginosa PA01
auccgcuccagcag

SEQ ID NO: 3439758 - RNA, 20 nt, Pseudomonas aeruginosa PA01
auccgcuccagcgccucgac

SEQ ID NO: 3439759 - RNA, 14 nt, Pseudomonas aeruginosa PA01
auccgcuccaggcu

SEQ ID NO: 3439760 - RNA, 15 nt, Pseudomonas aeruginosa PA01
auccgcuccaggcug

SEQ ID NO: 3439761 - RNA, 13 nt, Pseudomonas aeruginosa PA01
auccgcucgaucc

SEQ ID NO: 3439762 - RNA, 20 nt, Pseudomonas aeruginosa PA01
auccgcucgaucccggcgcg

SEQ ID NO: 3439763 - RNA, 11 nt, Pseudomonas aeruginosa PA01
auccgcugcau

SEQ ID NO: 3439764 - RNA, 16 nt, Pseudomonas aeruginosa PA01
auccgcuuacuggcga

SEQ ID NO: 3439765 - RNA, 16 nt, Pseudomonas aeruginosa PA01
auccggaguucgcccg

SEQ ID NO: 3439766 - RNA, 20 nt, Pseudomonas aeruginosa PA01
auccggaguucgcccgcccc

SEQ ID NO: 3439767 - RNA, 21 nt, Pseudomonas aeruginosa PA01
auccggaguucgcccgcccca

SEQ ID NO: 3439768 - RNA, 16 nt, Pseudomonas aeruginosa PA01
auccggcaccagucgc

SEQ ID NO: 3439769 - RNA, 22 nt, Pseudomonas aeruginosa PA01
auccggccgaucuccuggcggg

SEQ ID NO: 3439770 - RNA, 14 nt, Pseudomonas aeruginosa PA01
auccggcgcugccg

SEQ ID NO: 3439771 - RNA, 14 nt, Pseudomonas aeruginosa PA01
auccggcuggcgcc

SEQ ID NO: 3439772 - RNA, 23 nt, Pseudomonas aeruginosa PA01
auccgggcccaggcuggcggcca

SEQ ID NO: 3439773 - RNA, 18 nt, Pseudomonas aeruginosa PA01
auccgggcggcgggcgca

SEQ ID NO: 3439774 - RNA, 22 nt, Pseudomonas aeruginosa PA01
auccgggcguagggcgaauaac

SEQ ID NO: 3439775 - RNA, 13 nt, Pseudomonas aeruginosa PA01
auccgggcguggg

SEQ ID NO: 3439776 - RNA, 19 nt, Pseudomonas aeruginosa PA01
auccgggcguggggcgaau

SEQ ID NO: 3439777 - RNA, 16 nt, Pseudomonas aeruginosa PA01
auccggguggagaggc

SEQ ID NO: 3439778 - RNA, 21 nt, Pseudomonas aeruginosa PA01
auccggguggagaggcgugcu

SEQ ID NO: 3439779 - RNA, 15 nt, Pseudomonas aeruginosa PA01
auccguacuggcgcc

SEQ ID NO: 3439780 - RNA, 20 nt, Pseudomonas aeruginosa PA01
auccguacuggcgccaggcc

SEQ ID NO: 3439781 - RNA, 16 nt, Pseudomonas aeruginosa PA01
auccgugacgucggcg

SEQ ID NO: 3439782 - RNA, 17 nt, Pseudomonas aeruginosa PA01
auccgugacgucggcgg

SEQ ID NO: 3439783 - RNA, 18 nt, Pseudomonas aeruginosa PA01
aucgaugaccuucgaggu

SEQ ID NO: 3439784 - RNA, 14 nt, Pseudomonas aeruginosa PA01
aucgauggcguggg

SEQ ID NO: 3439785 - RNA, 17 nt, Pseudomonas aeruginosa PA01
aucgauggucacuggcg

SEQ ID NO: 3439786 - RNA, 17 nt, Pseudomonas aeruginosa PA01
aucgauggucaggcugg

SEQ ID NO: 3439787 - RNA, 18 nt, Pseudomonas aeruginosa PA01
aucgauggucaggcuggc

SEQ ID NO: 3439788 - RNA, 21 nt, Pseudomonas aeruginosa PA01
aucgaugucguggucgccguc

SEQ ID NO: 3439789 - RNA, 18 nt, Pseudomonas aeruginosa PA01
aucgauguuuccgacccg

SEQ ID NO: 3439790 - RNA, 20 nt, Pseudomonas aeruginosa PA01
aucgauguuuccgacccgga

SEQ ID NO: 3439791 - RNA, 15 nt, Pseudomonas aeruginosa PA01
aucgcacggucgucc

SEQ ID NO: 3439792 - RNA, 12 nt, Pseudomonas aeruginosa PA01
aucgcaggccag

SEQ ID NO: 3439793 - RNA, 15 nt, Pseudomonas aeruginosa PA01
aucgcauagccggcg

SEQ ID NO: 3439794 - RNA, 18 nt, Pseudomonas aeruginosa PA01
aucgcauagccggcgcgc

SEQ ID NO: 3439795 - RNA, 20 nt, Pseudomonas aeruginosa PA01
aucgcauagccggcgcgccc

SEQ ID NO: 3439796 - RNA, 23 nt, Pseudomonas aeruginosa PA01
aucgcauagccggcgcgcccggc

SEQ ID NO: 3439797 - RNA, 15 nt, Pseudomonas aeruginosa PA01
aucgcaucggcgacc

SEQ ID NO: 3439798 - RNA, 21 nt, Pseudomonas aeruginosa PA01
aucgccaaccaguagggggug

SEQ ID NO: 3439799 - RNA, 15 nt, Pseudomonas aeruginosa PA01
aucgccaacgccacc

SEQ ID NO: 3439800 - RNA, 14 nt, Pseudomonas aeruginosa PA01
aucgccacgccggc

SEQ ID NO: 3439801 - RNA, 13 nt, Pseudomonas aeruginosa PA01
aucgccagcaauu

SEQ ID NO: 3439802 - RNA, 13 nt, Pseudomonas aeruginosa PA01
aucgccagcgcca

SEQ ID NO: 3439803 - RNA, 14 nt, Pseudomonas aeruginosa PA01
aucgccagcgccag

SEQ ID NO: 3439804 - RNA, 16 nt, Pseudomonas aeruginosa PA01
aucgccagcgccagca

SEQ ID NO: 3439805 - RNA, 22 nt, Pseudomonas aeruginosa PA01
aucgccagcgguacccgccggc

SEQ ID NO: 3439806 - RNA, 18 nt, Pseudomonas aeruginosa PA01
aucgccaggcgauccagc

SEQ ID NO: 3439807 - RNA, 22 nt, Pseudomonas aeruginosa PA01
aucgccagggucuugccgaccu

SEQ ID NO: 3439808 - RNA, 24 nt, Pseudomonas aeruginosa PA01
aucgccagggucuugccgaccuuc

SEQ ID NO: 3439809 - RNA, 16 nt, Pseudomonas aeruginosa PA01
aucgccagguggaagc

SEQ ID NO: 3439810 - RNA, 15 nt, Pseudomonas aeruginosa PA01
aucgccauggcgcug

SEQ ID NO: 3439811 - RNA, 13 nt, Pseudomonas aeruginosa PA01
aucgcccaccagg

SEQ ID NO: 3439812 - RNA, 18 nt, Pseudomonas aeruginosa PA01
aucgcccaccaggucgcc

SEQ ID NO: 3439813 - RNA, 17 nt, Pseudomonas aeruginosa PA01
aucgcccagcggcuggc

SEQ ID NO: 3439814 - RNA, 13 nt, Pseudomonas aeruginosa PA01
aucgcccagggcc

SEQ ID NO: 3439815 - RNA, 14 nt, Pseudomonas aeruginosa PA01
aucgcccagggcca

SEQ ID NO: 3439816 - RNA, 11 nt, Pseudomonas aeruginosa PA01
aucgcccauga

SEQ ID NO: 3439817 - RNA, 17 nt, Pseudomonas aeruginosa PA01
aucgcccauugccgggc

SEQ ID NO: 3439818 - RNA, 22 nt, Pseudomonas aeruginosa PA01
aucgcccgcagccacaggcgcc

SEQ ID NO: 3439819 - RNA, 24 nt, Pseudomonas aeruginosa PA01
aucgcccgcagccacaggcgccag

SEQ ID NO: 3439820 - RNA, 18 nt, Pseudomonas aeruginosa PA01
aucgcccgcaguuccucg

SEQ ID NO: 3439821 - RNA, 22 nt, Pseudomonas aeruginosa PA01
aucgcccgcaguuccucgccgc

SEQ ID NO: 3439822 - RNA, 22 nt, Pseudomonas aeruginosa PA01
aucgcccggcagcaggccgccg

SEQ ID NO: 3439823 - RNA, 14 nt, Pseudomonas aeruginosa PA01
aucgcccggcugca

SEQ ID NO: 3439824 - RNA, 21 nt, Pseudomonas aeruginosa PA01
aucgcccuggccucggcgucc

SEQ ID NO: 3439825 - RNA, 14 nt, Pseudomonas aeruginosa PA01
aucgcccuggcgcc

SEQ ID NO: 3439826 - RNA, 17 nt, Pseudomonas aeruginosa PA01
aucgcccuggcgccagc

SEQ ID NO: 3439827 - RNA, 17 nt, Pseudomonas aeruginosa PA01
aucgccgacaggucggc

SEQ ID NO: 3439828 - RNA, 23 nt, Pseudomonas aeruginosa PA01
aucgccgacaggucggccggcag

SEQ ID NO: 3439829 - RNA, 22 nt, Pseudomonas aeruginosa PA01
aucgccgccaggcagaccugca

SEQ ID NO: 3439830 - RNA, 23 nt, Pseudomonas aeruginosa PA01
aucgccgccgcagccguggcgcg

SEQ ID NO: 3439831 - RNA, 12 nt, Pseudomonas aeruginosa PA01
aucgccgccuug

SEQ ID NO: 3439832 - RNA, 15 nt, Pseudomonas aeruginosa PA01
aucgccgcgccgccg

SEQ ID NO: 3439833 - RNA, 17 nt, Pseudomonas aeruginosa PA01
aucgccgcgccgccgag

SEQ ID NO: 3439834 - RNA, 22 nt, Pseudomonas aeruginosa PA01
aucgccgcggaaaacgccgcga

SEQ ID NO: 3439835 - RNA, 13 nt, Pseudomonas aeruginosa PA01
aucgccgcggcga

SEQ ID NO: 3439836 - RNA, 20 nt, Pseudomonas aeruginosa PA01
aucgccgcggcgaagcgcuc

SEQ ID NO: 3439837 - RNA, 22 nt, Pseudomonas aeruginosa PA01
aucgccgcggcgaagcgcucga

SEQ ID NO: 3439838 - RNA, 17 nt, Pseudomonas aeruginosa PA01
aucgccgcguagcgcca

SEQ ID NO: 3439839 - RNA, 20 nt, Pseudomonas aeruginosa PA01
aucgccgcguagcgccaggc

SEQ ID NO: 3439840 - RNA, 21 nt, Pseudomonas aeruginosa PA01
aucgccgcguagcgccaggcc

SEQ ID NO: 3439841 - RNA, 16 nt, Pseudomonas aeruginosa PA01
aucgccggcagcgccg

SEQ ID NO: 3439842 - RNA, 19 nt, Pseudomonas aeruginosa PA01
aucgccggcccgcgcggca

SEQ ID NO: 3439843 - RNA, 19 nt, Pseudomonas aeruginosa PA01
aucgccggcgagccgcugg

SEQ ID NO: 3439844 - RNA, 14 nt, Pseudomonas aeruginosa PA01
aucgccgguccucg

SEQ ID NO: 3439845 - RNA, 18 nt, Pseudomonas aeruginosa PA01
aucgccgguccucgacau

SEQ ID NO: 3439846 - RNA, 15 nt, Pseudomonas aeruginosa PA01
aucgccgucaccgcg

SEQ ID NO: 3439847 - RNA, 16 nt, Pseudomonas aeruginosa PA01
aucgccguccuggaga

SEQ ID NO: 3439848 - RNA, 21 nt, Pseudomonas aeruginosa PA01
aucgccguugccuucgccguc

SEQ ID NO: 3439849 - RNA, 21 nt, Pseudomonas aeruginosa PA01
aucgccuccaccagcgccggc

SEQ ID NO: 3439850 - RNA, 19 nt, Pseudomonas aeruginosa PA01
aucgccuccacggcggccu

SEQ ID NO: 3439851 - RNA, 21 nt, Pseudomonas aeruginosa PA01
aucgccuccacggcggccucg

SEQ ID NO: 3439852 - RNA, 24 nt, Pseudomonas aeruginosa PA01
aucgccuccggcacgcugccgccg

SEQ ID NO: 3439853 - RNA, 13 nt, Pseudomonas aeruginosa PA01
aucgccucgccgg

SEQ ID NO: 3439854 - RNA, 14 nt, Pseudomonas aeruginosa PA01
aucgccucgccggc

SEQ ID NO: 3439855 - RNA, 14 nt, Pseudomonas aeruginosa PA01
aucgccucgcggac

SEQ ID NO: 3439856 - RNA, 12 nt, Pseudomonas aeruginosa PA01
aucgccucggcg

SEQ ID NO: 3439857 - RNA, 13 nt, Pseudomonas aeruginosa PA01
aucgccucggcgc

SEQ ID NO: 3439858 - RNA, 14 nt, Pseudomonas aeruginosa PA01
aucgccucggcgcg

SEQ ID NO: 3439859 - RNA, 20 nt, Pseudomonas aeruginosa PA01
aucgccucgggcgagcgcag

SEQ ID NO: 3439860 - RNA, 17 nt, Pseudomonas aeruginosa PA01
aucgccucgucgagcgc

SEQ ID NO: 3439861 - RNA, 14 nt, Pseudomonas aeruginosa PA01
aucgccugcuggcc

SEQ ID NO: 3439862 - RNA, 15 nt, Pseudomonas aeruginosa PA01
aucgccugcuggccg

SEQ ID NO: 3439863 - RNA, 13 nt, Pseudomonas aeruginosa PA01
aucgccugggccg

SEQ ID NO: 3439864 - RNA, 16 nt, Pseudomonas aeruginosa PA01
aucgccuuccucggcg

SEQ ID NO: 3439865 - RNA, 19 nt, Pseudomonas aeruginosa PA01
aucgcgaaaacucccggcc

SEQ ID NO: 3439866 - RNA, 14 nt, Pseudomonas aeruginosa PA01
aucgcgaagcgcag

SEQ ID NO: 3439867 - RNA, 16 nt, Pseudomonas aeruginosa PA01
aucgcgaucuaccugc

SEQ ID NO: 3439868 - RNA, 22 nt, Pseudomonas aeruginosa PA01
aucgcgaucuaccugcgugcgc

SEQ ID NO: 3439869 - RNA, 22 nt, Pseudomonas aeruginosa PA01
aucgcgcacuuccggacugccc

SEQ ID NO: 3439870 - RNA, 18 nt, Pseudomonas aeruginosa PA01
aucgcgcagaucgccgcg

SEQ ID NO: 3439871 - RNA, 15 nt, Pseudomonas aeruginosa PA01
aucgcgccgagcugg

SEQ ID NO: 3439872 - RNA, 20 nt, Pseudomonas aeruginosa PA01
aucgcgccgagcuggcgcgc

SEQ ID NO: 3439873 - RNA, 14 nt, Pseudomonas aeruginosa PA01
aucgcgccgccgaa

SEQ ID NO: 3439874 - RNA, 16 nt, Pseudomonas aeruginosa PA01
aucgcgccgccgaagc

SEQ ID NO: 3439875 - RNA, 20 nt, Pseudomonas aeruginosa PA01
aucgcgccgccgaagccgac

SEQ ID NO: 3439876 - RNA, 19 nt, Pseudomonas aeruginosa PA01
aucgcgccgucgcuggcga

SEQ ID NO: 3439877 - RNA, 15 nt, Pseudomonas aeruginosa PA01
aucgcgcggcuggcu

SEQ ID NO: 3439878 - RNA, 19 nt, Pseudomonas aeruginosa PA01
aucgcgcggcuggcugccc

SEQ ID NO: 3439879 - RNA, 13 nt, Pseudomonas aeruginosa PA01
aucgcgcugggcg

SEQ ID NO: 3439880 - RNA, 20 nt, Pseudomonas aeruginosa PA01
aucgcgcuuggacagcucgc

SEQ ID NO: 3439881 - RNA, 22 nt, Pseudomonas aeruginosa PA01
aucgcggccuucucgucgccgc

SEQ ID NO: 3439882 - RNA, 17 nt, Pseudomonas aeruginosa PA01
aucgcggcgacgaucac

SEQ ID NO: 3439883 - RNA, 22 nt, Pseudomonas aeruginosa PA01
aucgcggcgauggccgccagca

SEQ ID NO: 3439884 - RNA, 21 nt, Pseudomonas aeruginosa PA01
aucgcggcgcgauauccgcca

SEQ ID NO: 3439885 - RNA, 17 nt, Pseudomonas aeruginosa PA01
aucggguagagcgcggc

SEQ ID NO: 3439886 - RNA, 16 nt, Pseudomonas aeruginosa PA01
aucggucaccgugguc

SEQ ID NO: 3439887 - RNA, 18 nt, Pseudomonas aeruginosa PA01
aucggucgcccucggcca

SEQ ID NO: 3439888 - RNA, 20 nt, Pseudomonas aeruginosa PA01
aucggugaacgagcccaggc

SEQ ID NO: 3439889 - RNA, 13 nt, Pseudomonas aeruginosa PA01
aucggugagguag

SEQ ID NO: 3439890 - RNA, 21 nt, Pseudomonas aeruginosa PA01
aucggugcuuugcauggccug

SEQ ID NO: 3439891 - RNA, 13 nt, Pseudomonas aeruginosa PA01
aucgguugcgaca

SEQ ID NO: 3439892 - RNA, 23 nt, Pseudomonas aeruginosa PA01
aucgucacggcgugccgcaggcc

SEQ ID NO: 3439893 - RNA, 15 nt, Pseudomonas aeruginosa PA01
aucguccagcucggc

SEQ ID NO: 3439894 - RNA, 17 nt, Pseudomonas aeruginosa PA01
aucguccagcucggcca

SEQ ID NO: 3439895 - RNA, 20 nt, Pseudomonas aeruginosa PA01
aucgucgaaacgcuggcggc

SEQ ID NO: 3439896 - RNA, 19 nt, Pseudomonas aeruginosa PA01
aucgucgaagcucggcgcg

SEQ ID NO: 3439897 - RNA, 22 nt, Pseudomonas aeruginosa PA01
aucgucgaagggccauuguucu

SEQ ID NO: 3439898 - RNA, 14 nt, Pseudomonas aeruginosa PA01
aucgucgaugaggu

SEQ ID NO: 3439899 - RNA, 20 nt, Pseudomonas aeruginosa PA01
aucgucgaugcguccgcgca

SEQ ID NO: 3439900 - RNA, 13 nt, Pseudomonas aeruginosa PA01
aucgucgccaagc

SEQ ID NO: 3439901 - RNA, 15 nt, Pseudomonas aeruginosa PA01
aucgucgccaagccc

SEQ ID NO: 3439902 - RNA, 18 nt, Pseudomonas aeruginosa PA01
aucgucgccaagcccggc

SEQ ID NO: 3439903 - RNA, 22 nt, Pseudomonas aeruginosa PA01
aucgucgccggaggggcggccg

SEQ ID NO: 3439904 - RNA, 15 nt, Pseudomonas aeruginosa PA01
aucgucgcggcgcga

SEQ ID NO: 3439905 - RNA, 14 nt, Pseudomonas aeruginosa PA01
aucgucgcuuccgg

SEQ ID NO: 3439906 - RNA, 20 nt, Pseudomonas aeruginosa PA01
aucgucgcuuccggcgccaa

SEQ ID NO: 3439907 - RNA, 20 nt, Pseudomonas aeruginosa PA01
aucgucggcagccaucgcau

SEQ ID NO: 3439908 - RNA, 12 nt, Pseudomonas aeruginosa PA01
aucgucggcccg

SEQ ID NO: 3439909 - RNA, 22 nt, Pseudomonas aeruginosa PA01
aucgucgggacgcaugcgcggc

SEQ ID NO: 3439910 - RNA, 14 nt, Pseudomonas aeruginosa PA01
aucguggccauggg

SEQ ID NO: 3439911 - RNA, 17 nt, Pseudomonas aeruginosa PA01
aucguuguucagcaggg

SEQ ID NO: 3439912 - RNA, 16 nt, Pseudomonas aeruginosa PA01
aucuauaaugcgcccc

SEQ ID NO: 3439913 - RNA, 17 nt, Pseudomonas aeruginosa PA01
aucuauaaugcgccccc

SEQ ID NO: 3439914 - RNA, 16 nt, Pseudomonas aeruginosa PA01
aucucaucgcccauga

SEQ ID NO: 3439915 - RNA, 21 nt, Pseudomonas aeruginosa PA01
aucuccaggccgcucaccgcc

SEQ ID NO: 3439916 - RNA, 15 nt, Pseudomonas aeruginosa PA01
aucucccuauaaugc

SEQ ID NO: 3439917 - RNA, 18 nt, Pseudomonas aeruginosa PA01
aucuccgaguccugcugc

SEQ ID NO: 3439918 - RNA, 20 nt, Pseudomonas aeruginosa PA01
aucuccgaguccugcugcga

SEQ ID NO: 3439919 - RNA, 15 nt, Pseudomonas aeruginosa PA01
aucuccgcgccgggc

SEQ ID NO: 3439920 - RNA, 20 nt, Pseudomonas aeruginosa PA01
aucuccgggagcaucuggcc

SEQ ID NO: 3439921 - RNA, 21 nt, Pseudomonas aeruginosa PA01
aucuccgggagcaucuggccc

SEQ ID NO: 3439922 - RNA, 22 nt, Pseudomonas aeruginosa PA01
aucuccgggagcaucuggcccg

SEQ ID NO: 3439923 - RNA, 12 nt, Pseudomonas aeruginosa PA01
aucuccuccucg

SEQ ID NO: 3439924 - RNA, 16 nt, Pseudomonas aeruginosa PA01
aucuccuccucggcgg

SEQ ID NO: 3439925 - RNA, 17 nt, Pseudomonas aeruginosa PA01
aucuccucgacggcggg

SEQ ID NO: 3439926 - RNA, 15 nt, Pseudomonas aeruginosa PA01
aucuccucgauccgc

SEQ ID NO: 3439927 - RNA, 13 nt, Pseudomonas aeruginosa PA01
aucuccugcugga

SEQ ID NO: 3439928 - RNA, 15 nt, Pseudomonas aeruginosa PA01
aucuccugcugggcg

SEQ ID NO: 3439929 - RNA, 20 nt, Pseudomonas aeruginosa PA01
aucuccugguagaacuccuu

SEQ ID NO: 3439930 - RNA, 23 nt, Pseudomonas aeruginosa PA01
aucuccugguagaacuccuugcc

SEQ ID NO: 3439931 - RNA, 15 nt, Pseudomonas aeruginosa PA01
aucuccuguggauaa

SEQ ID NO: 3439932 - RNA, 21 nt, Pseudomonas aeruginosa PA01
aucucgaacucgaaggccagc

SEQ ID NO: 3439933 - RNA, 17 nt, Pseudomonas aeruginosa PA01
aucucgagcaugucggc

SEQ ID NO: 3439934 - RNA, 13 nt, Pseudomonas aeruginosa PA01
aucucgaucgagu

SEQ ID NO: 3439935 - RNA, 20 nt, Pseudomonas aeruginosa PA01
aucucgaucgagucgccgau

SEQ ID NO: 3439936 - RNA, 22 nt, Pseudomonas aeruginosa PA01
aucucgaugaccuugccgcgaa

SEQ ID NO: 3439937 - RNA, 23 nt, Pseudomonas aeruginosa PA01
aucucgccgaaggugcaggccgc

SEQ ID NO: 3439938 - RNA, 16 nt, Pseudomonas aeruginosa PA01
aucucgccgucggcgg

SEQ ID NO: 3439939 - RNA, 15 nt, Pseudomonas aeruginosa PA01
aucucgcggcgcggc

SEQ ID NO: 3439940 - RNA, 18 nt, Pseudomonas aeruginosa PA01
aucucgcguuccagcacc

SEQ ID NO: 3439941 - RNA, 21 nt, Pseudomonas aeruginosa PA01
aucucgcugaguuugcccagc

SEQ ID NO: 3439942 - RNA, 18 nt, Pseudomonas aeruginosa PA01
aucucggcggccaggcgg

SEQ ID NO: 3439943 - RNA, 19 nt, Pseudomonas aeruginosa PA01
aucucggcggccaggcggc

SEQ ID NO: 3439944 - RNA, 20 nt, Pseudomonas aeruginosa PA01
aucucgguguccaccaccag

SEQ ID NO: 3439945 - RNA, 22 nt, Pseudomonas aeruginosa PA01
aucucgucggcggggcgcaccg

SEQ ID NO: 3439946 - RNA, 15 nt, Pseudomonas aeruginosa PA01
aucucgugggccagc

SEQ ID NO: 3439947 - RNA, 16 nt, Pseudomonas aeruginosa PA01
aucucgugggccagca

SEQ ID NO: 3439948 - RNA, 17 nt, Pseudomonas aeruginosa PA01
aucucuacuaccgccag

SEQ ID NO: 3439949 - RNA, 21 nt, Pseudomonas aeruginosa PA01
aucucuuuuuaagagaaugcg

SEQ ID NO: 3439950 - RNA, 16 nt, Pseudomonas aeruginosa PA01
aucugcaacgcggcgu

SEQ ID NO: 3439951 - RNA, 21 nt, Pseudomonas aeruginosa PA01
aucugcaccacguucggcgcg

SEQ ID NO: 3439952 - RNA, 19 nt, Pseudomonas aeruginosa PA01
aucugcaccgcccagccga

SEQ ID NO: 3439953 - RNA, 15 nt, Pseudomonas aeruginosa PA01
aucugcaugccgucc

SEQ ID NO: 3439954 - RNA, 17 nt, Pseudomonas aeruginosa PA01
aucugccgggcgcgcug

SEQ ID NO: 3439955 - RNA, 15 nt, Pseudomonas aeruginosa PA01
aucugcgagcgcaca

SEQ ID NO: 3439956 - RNA, 13 nt, Pseudomonas aeruginosa PA01
aucugcgccaggu

SEQ ID NO: 3439957 - RNA, 14 nt, Pseudomonas aeruginosa PA01
aucugcgccaggug

SEQ ID NO: 3439958 - RNA, 23 nt, Pseudomonas aeruginosa PA01
aucugcgggaacuuggcgcgcag

SEQ ID NO: 3439959 - RNA, 21 nt, Pseudomonas aeruginosa PA01
aucugcggguugccgcagagc

SEQ ID NO: 3439960 - RNA, 13 nt, Pseudomonas aeruginosa PA01
aucugcucgucca

SEQ ID NO: 3439961 - RNA, 21 nt, Pseudomonas aeruginosa PA01
aucugcucguccaggccgcag

SEQ ID NO: 3439962 - RNA, 13 nt, Pseudomonas aeruginosa PA01
aucugcugcagca

SEQ ID NO: 3439963 - RNA, 21 nt, Pseudomonas aeruginosa PA01
aucugcugggucaucgaggcc

SEQ ID NO: 3439964 - RNA, 17 nt, Pseudomonas aeruginosa PA01
aucuggaauucgccgcg

SEQ ID NO: 3439965 - RNA, 23 nt, Pseudomonas aeruginosa PA01
aucuggaucaggaagguccaggc

SEQ ID NO: 3439966 - RNA, 22 nt, Pseudomonas aeruginosa PA01
aucuggcccuuuuccucgggga

SEQ ID NO: 3439967 - RNA, 16 nt, Pseudomonas aeruginosa PA01
aucuggcugcccaggc

SEQ ID NO: 3439968 - RNA, 17 nt, Pseudomonas aeruginosa PA01
aucuggcugucgccgau

SEQ ID NO: 3439969 - RNA, 17 nt, Pseudomonas aeruginosa PA01
aucugguagaccaccgu

SEQ ID NO: 3439970 - RNA, 14 nt, Pseudomonas aeruginosa PA01
aucugguggaacag

SEQ ID NO: 3439971 - RNA, 21 nt, Pseudomonas aeruginosa PA01
aucugucgauaccagcgccgc

SEQ ID NO: 3439972 - RNA, 14 nt, Pseudomonas aeruginosa PA01
aucuuccucggacu

SEQ ID NO: 3439973 - RNA, 16 nt, Pseudomonas aeruginosa PA01
aucuucgauugcuaca

SEQ ID NO: 3439974 - RNA, 21 nt, Pseudomonas aeruginosa PA01
aucuucguaggucaugcgugc

SEQ ID NO: 3439975 - RNA, 17 nt, Pseudomonas aeruginosa PA01
aucuucuaccuggcgcu

SEQ ID NO: 3439976 - RNA, 19 nt, Pseudomonas aeruginosa PA01
aucuucuccgauuccugcg

SEQ ID NO: 3439977 - RNA, 16 nt, Pseudomonas aeruginosa PA01
aucuucugucccggac

SEQ ID NO: 3439978 - RNA, 19 nt, Pseudomonas aeruginosa PA01
aucuugcaaucgaugucgu

SEQ ID NO: 3439979 - RNA, 21 nt, Pseudomonas aeruginosa PA01
aucuugcgcccggcgcgaccg

SEQ ID NO: 3439980 - RNA, 20 nt, Pseudomonas aeruginosa PA01
aucuuguagccguccggguc

SEQ ID NO: 3439981 - RNA, 16 nt, Pseudomonas aeruginosa PA01
aucuuguccgggaagu

SEQ ID NO: 3439982 - RNA, 15 nt, Pseudomonas aeruginosa PA01
aucuuuccuccagag

SEQ ID NO: 3439983 - RNA, 17 nt, Pseudomonas aeruginosa PA01
augaaaaacgccggcga

SEQ ID NO: 3439984 - RNA, 19 nt, Pseudomonas aeruginosa PA01
augaaaaagccccgccgaa

SEQ ID NO: 3439985 - RNA, 16 nt, Pseudomonas aeruginosa PA01
augaaaaagcccggca

SEQ ID NO: 3439986 - RNA, 17 nt, Pseudomonas aeruginosa PA01
augaaaaagcccggcaa

SEQ ID NO: 3439987 - RNA, 18 nt, Pseudomonas aeruginosa PA01
augcccagccagggccgc

SEQ ID NO: 3439988 - RNA, 12 nt, Pseudomonas aeruginosa PA01
augcccagcgca

SEQ ID NO: 3439989 - RNA, 17 nt, Pseudomonas aeruginosa PA01
augcccagcgcaggccg

SEQ ID NO: 3439990 - RNA, 21 nt, Pseudomonas aeruginosa PA01
augcccagcgcaggccgaucu

SEQ ID NO: 3439991 - RNA, 22 nt, Pseudomonas aeruginosa PA01
augcccagcguggccagcgaac

SEQ ID NO: 3439992 - RNA, 13 nt, Pseudomonas aeruginosa PA01
augcccagcuugg

SEQ ID NO: 3439993 - RNA, 13 nt, Pseudomonas aeruginosa PA01
augcccaggccgc

SEQ ID NO: 3439994 - RNA, 13 nt, Pseudomonas aeruginosa PA01
augcccagggcca

SEQ ID NO: 3439995 - RNA, 14 nt, Pseudomonas aeruginosa PA01
augccccgccgacu

SEQ ID NO: 3439996 - RNA, 15 nt, Pseudomonas aeruginosa PA01
augcccgccagcagg

SEQ ID NO: 3439997 - RNA, 14 nt, Pseudomonas aeruginosa PA01
augcccgccccgca

SEQ ID NO: 3439998 - RNA, 19 nt, Pseudomonas aeruginosa PA01
augcccgccccgcaccagc

SEQ ID NO: 3439999 - RNA, 20 nt, Pseudomonas aeruginosa PA01
augcccgccccgcaccagcc

SEQ ID NO: 3440000 - RNA, 14 nt, Pseudomonas aeruginosa PA01
augcccgccucgcg

SEQ ID NO: 3440001 - RNA, 17 nt, Pseudomonas aeruginosa PA01
augcccgcgccugggcc

SEQ ID NO: 3440002 - RNA, 19 nt, Pseudomonas aeruginosa PA01
augcccgcugggcaggugg

SEQ ID NO: 3440003 - RNA, 20 nt, Pseudomonas aeruginosa PA01
augcccgcugggcagguggu

SEQ ID NO: 3440004 - RNA, 17 nt, Pseudomonas aeruginosa PA01
augcccggccuggcguc

SEQ ID NO: 3440005 - RNA, 20 nt, Pseudomonas aeruginosa PA01
augcccggcugguugccagc

SEQ ID NO: 3440006 - RNA, 19 nt, Pseudomonas aeruginosa PA01
augcccggucaccacccag

SEQ ID NO: 3440007 - RNA, 21 nt, Pseudomonas aeruginosa PA01
augcccgucaggccuugcgcg

SEQ ID NO: 3440008 - RNA, 19 nt, Pseudomonas aeruginosa PA01
augcccgucgaccaucacc

SEQ ID NO: 3440009 - RNA, 21 nt, Pseudomonas aeruginosa PA01
augcccgucgaccaucaccag

SEQ ID NO: 3440010 - RNA, 16 nt, Pseudomonas aeruginosa PA01
augcccgugcgcugcg

SEQ ID NO: 3440011 - RNA, 15 nt, Pseudomonas aeruginosa PA01
augcccuccugggcc

SEQ ID NO: 3440012 - RNA, 20 nt, Pseudomonas aeruginosa PA01
augcccuccugggccugucg

SEQ ID NO: 3440013 - RNA, 23 nt, Pseudomonas aeruginosa PA01
augcccucgcggcggcaggccag

SEQ ID NO: 3440014 - RNA, 13 nt, Pseudomonas aeruginosa PA01
augcccugccggc

SEQ ID NO: 3440015 - RNA, 14 nt, Pseudomonas aeruginosa PA01
augcccugccggcg

SEQ ID NO: 3440016 - RNA, 23 nt, Pseudomonas aeruginosa PA01
augcccugcucuuccagcgggcg

SEQ ID NO: 3440017 - RNA, 12 nt, Pseudomonas aeruginosa PA01
augcccuggccg

SEQ ID NO: 3440018 - RNA, 21 nt, Pseudomonas aeruginosa PA01
augcccuggccgcugccgcuc

SEQ ID NO: 3440019 - RNA, 18 nt, Pseudomonas aeruginosa PA01
augcccuugaggucguug

SEQ ID NO: 3440020 - RNA, 17 nt, Pseudomonas aeruginosa PA01
augcccuuguccggccc

SEQ ID NO: 3440021 - RNA, 21 nt, Pseudomonas aeruginosa PA01
augccgaacaccugcaucacc

SEQ ID NO: 3440022 - RNA, 23 nt, Pseudomonas aeruginosa PA01
augccgaacaccugcaucaccag

SEQ ID NO: 3440023 - RNA, 23 nt, Pseudomonas aeruginosa PA01
augccgaaggcgugggcgccggc

SEQ ID NO: 3440024 - RNA, 12 nt, Pseudomonas aeruginosa PA01
augccgaccacg

SEQ ID NO: 3440025 - RNA, 15 nt, Pseudomonas aeruginosa PA01
augccgagcaucagc

SEQ ID NO: 3440026 - RNA, 18 nt, Pseudomonas aeruginosa PA01
augccgagcaucagcgac

SEQ ID NO: 3440027 - RNA, 20 nt, Pseudomonas aeruginosa PA01
augccgagcgaaaucggcag

SEQ ID NO: 3440028 - RNA, 21 nt, Pseudomonas aeruginosa PA01
augccgaggcugugggucggg

SEQ ID NO: 3440029 - RNA, 22 nt, Pseudomonas aeruginosa PA01
augccgaggcugugggucgggu

SEQ ID NO: 3440030 - RNA, 19 nt, Pseudomonas aeruginosa PA01
augccgaucaugcucggcg

SEQ ID NO: 3440031 - RNA, 22 nt, Pseudomonas aeruginosa PA01
augccgaucaugcucggcggug

SEQ ID NO: 3440032 - RNA, 15 nt, Pseudomonas aeruginosa PA01
augccgaucucgccc

SEQ ID NO: 3440033 - RNA, 15 nt, Pseudomonas aeruginosa PA01
augccgaugacaugg

SEQ ID NO: 3440034 - RNA, 22 nt, Pseudomonas aeruginosa PA01
augccgcacaggcuggccagaa

SEQ ID NO: 3440035 - RNA, 14 nt, Pseudomonas aeruginosa PA01
augccgcaccccau

SEQ ID NO: 3440036 - RNA, 14 nt, Pseudomonas aeruginosa PA01
augccgcaggaacc

SEQ ID NO: 3440037 - RNA, 13 nt, Pseudomonas aeruginosa PA01
augccgcccagca

SEQ ID NO: 3440038 - RNA, 15 nt, Pseudomonas aeruginosa PA01
augccgcccagcacc

SEQ ID NO: 3440039 - RNA, 18 nt, Pseudomonas aeruginosa PA01
augccgcccggccgcugg

SEQ ID NO: 3440040 - RNA, 14 nt, Pseudomonas aeruginosa PA01
augccgcccuccau

SEQ ID NO: 3440041 - RNA, 19 nt, Pseudomonas aeruginosa PA01
augccgcccuccaucagcg

SEQ ID NO: 3440042 - RNA, 11 nt, Pseudomonas aeruginosa PA01
augccgccgac

SEQ ID NO: 3440043 - RNA, 13 nt, Pseudomonas aeruginosa PA01
augccgccgacgc

SEQ ID NO: 3440044 - RNA, 16 nt, Pseudomonas aeruginosa PA01
augccgccgacgccgg

SEQ ID NO: 3440045 - RNA, 19 nt, Pseudomonas aeruginosa PA01
augccgccgacgccggacg

SEQ ID NO: 3440046 - RNA, 14 nt, Pseudomonas aeruginosa PA01
augccgccgccgcc

SEQ ID NO: 3440047 - RNA, 21 nt, Pseudomonas aeruginosa PA01
augccgccgccgccccagcaa

SEQ ID NO: 3440048 - RNA, 20 nt, Pseudomonas aeruginosa PA01
augccgccgggcaucaugcc

SEQ ID NO: 3440049 - RNA, 14 nt, Pseudomonas aeruginosa PA01
augccgcgagccag

SEQ ID NO: 3440050 - RNA, 13 nt, Pseudomonas aeruginosa PA01
augccgcgccgga

SEQ ID NO: 3440051 - RNA, 17 nt, Pseudomonas aeruginosa PA01
augccgcgcgccuggcu

SEQ ID NO: 3440052 - RNA, 16 nt, Pseudomonas aeruginosa PA01
augccgcggacggcac

SEQ ID NO: 3440053 - RNA, 18 nt, Pseudomonas aeruginosa PA01
augccgcggcgauaggcg

SEQ ID NO: 3440054 - RNA, 22 nt, Pseudomonas aeruginosa PA01
augccgcgucgaagucgaucac

SEQ ID NO: 3440055 - RNA, 21 nt, Pseudomonas aeruginosa PA01
augccgcuagcccugcugcuc

SEQ ID NO: 3440056 - RNA, 18 nt, Pseudomonas aeruginosa PA01
augccggaaagccuggcc

SEQ ID NO: 3440057 - RNA, 19 nt, Pseudomonas aeruginosa PA01
augccggaaagccuggccg

SEQ ID NO: 3440058 - RNA, 21 nt, Pseudomonas aeruginosa PA01
augccggaaagccuggccggc

SEQ ID NO: 3440059 - RNA, 22 nt, Pseudomonas aeruginosa PA01
augccggaaagccuggccggcg

SEQ ID NO: 3440060 - RNA, 18 nt, Pseudomonas aeruginosa PA01
augccggccaggaaggcc

SEQ ID NO: 3440061 - RNA, 20 nt, Pseudomonas aeruginosa PA01
augccggccaggaaggccgc

SEQ ID NO: 3440062 - RNA, 14 nt, Pseudomonas aeruginosa PA01
augccggccggcag

SEQ ID NO: 3440063 - RNA, 13 nt, Pseudomonas aeruginosa PA01
augccggccgggg

SEQ ID NO: 3440064 - RNA, 15 nt, Pseudomonas aeruginosa PA01
augccggccggggcc

SEQ ID NO: 3440065 - RNA, 16 nt, Pseudomonas aeruginosa PA01
augccggccggggccg

SEQ ID NO: 3440066 - RNA, 16 nt, Pseudomonas aeruginosa PA01
augccggcgucggcga

SEQ ID NO: 3440067 - RNA, 22 nt, Pseudomonas aeruginosa PA01
augccgggcuuuuucauuuccu

SEQ ID NO: 3440068 - RNA, 22 nt, Pseudomonas aeruginosa PA01
augccgggguccgccggucacc

SEQ ID NO: 3440069 - RNA, 12 nt, Pseudomonas aeruginosa PA01
augccggugcug

SEQ ID NO: 3440070 - RNA, 14 nt, Pseudomonas aeruginosa PA01
augccggugcuggu

SEQ ID NO: 3440071 - RNA, 15 nt, Pseudomonas aeruginosa PA01
augccggugcuggug

SEQ ID NO: 3440072 - RNA, 17 nt, Pseudomonas aeruginosa PA01
augccggugcuggugcg

SEQ ID NO: 3440073 - RNA, 22 nt, Pseudomonas aeruginosa PA01
augccggugcuguaguaggcgg

SEQ ID NO: 3440074 - RNA, 14 nt, Pseudomonas aeruginosa PA01
augccgguggcgcc

SEQ ID NO: 3440075 - RNA, 18 nt, Pseudomonas aeruginosa PA01
augccgguggcgcccagc

SEQ ID NO: 3440076 - RNA, 21 nt, Pseudomonas aeruginosa PA01
augccgguggcgcccagccag

SEQ ID NO: 3440077 - RNA, 17 nt, Pseudomonas aeruginosa PA01
augccguacaggucggc

SEQ ID NO: 3440078 - RNA, 18 nt, Pseudomonas aeruginosa PA01
augccguacaggucggcg

SEQ ID NO: 3440079 - RNA, 20 nt, Pseudomonas aeruginosa PA01
augccguacaggucggcgcc

SEQ ID NO: 3440080 - RNA, 16 nt, Pseudomonas aeruginosa PA01
augccguagacguagu

SEQ ID NO: 3440081 - RNA, 23 nt, Pseudomonas aeruginosa PA01
augccguagacguagucggcagu

SEQ ID NO: 3440082 - RNA, 19 nt, Pseudomonas aeruginosa PA01
augccgucgaucuugcaau

SEQ ID NO: 3440083 - RNA, 19 nt, Pseudomonas aeruginosa PA01
augccgucuucgaugaagg

SEQ ID NO: 3440084 - RNA, 20 nt, Pseudomonas aeruginosa PA01
augccgucuucgaugaaggu

SEQ ID NO: 3440085 - RNA, 12 nt, Pseudomonas aeruginosa PA01
augccguucagc

SEQ ID NO: 3440086 - RNA, 14 nt, Pseudomonas aeruginosa PA01
augccguucaggcc

SEQ ID NO: 3440087 - RNA, 18 nt, Pseudomonas aeruginosa PA01
augccguucaggccggcg

SEQ ID NO: 3440088 - RNA, 23 nt, Pseudomonas aeruginosa PA01
augccguucucccgcgcgcugug

SEQ ID NO: 3440089 - RNA, 23 nt, Pseudomonas aeruginosa PA01
auggaagagcgccgcggcggcgu

SEQ ID NO: 3440090 - RNA, 20 nt, Pseudomonas aeruginosa PA01
auggaagaggaucuccuggc

SEQ ID NO: 3440091 - RNA, 21 nt, Pseudomonas aeruginosa PA01
auggacaggcgccccuggucc

SEQ ID NO: 3440092 - RNA, 13 nt, Pseudomonas aeruginosa PA01
auggacaggucga

SEQ ID NO: 3440093 - RNA, 23 nt, Pseudomonas aeruginosa PA01
auggaccgagaccgacgcucgcg

SEQ ID NO: 3440094 - RNA, 18 nt, Pseudomonas aeruginosa PA01
auggagacggcccgcccc

SEQ ID NO: 3440095 - RNA, 21 nt, Pseudomonas aeruginosa PA01
auggagggaucgcgcggcugg

SEQ ID NO: 3440096 - RNA, 23 nt, Pseudomonas aeruginosa PA01
auggaucggcaacuggcuggccu

SEQ ID NO: 3440097 - RNA, 19 nt, Pseudomonas aeruginosa PA01
auggaucggccucgcggcg

SEQ ID NO: 3440098 - RNA, 23 nt, Pseudomonas aeruginosa PA01
auggaucucccguaccagcgcga

SEQ ID NO: 3440099 - RNA, 21 nt, Pseudomonas aeruginosa PA01
auggaucuggguuucgucgcg

SEQ ID NO: 3440100 - RNA, 23 nt, Pseudomonas aeruginosa PA01
auggauucgaaccacugcgccau

SEQ ID NO: 3440101 - RNA, 21 nt, Pseudomonas aeruginosa PA01
auggcacaguuccuguaccag

SEQ ID NO: 3440102 - RNA, 12 nt, Pseudomonas aeruginosa PA01
auggcaccugga

SEQ ID NO: 3440103 - RNA, 16 nt, Pseudomonas aeruginosa PA01
auggcagcaggcacag

SEQ ID NO: 3440104 - RNA, 22 nt, Pseudomonas aeruginosa PA01
auggccaccgaaucggacaggu

SEQ ID NO: 3440105 - RNA, 12 nt, Pseudomonas aeruginosa PA01
auggccagcccg

SEQ ID NO: 3440106 - RNA, 23 nt, Pseudomonas aeruginosa PA01
auggccagcgcguagcuuuccgc

SEQ ID NO: 3440107 - RNA, 13 nt, Pseudomonas aeruginosa PA01
auggccagggggc

SEQ ID NO: 3440108 - RNA, 21 nt, Pseudomonas aeruginosa PA01
auggccagggggccuggcucg

SEQ ID NO: 3440109 - RNA, 23 nt, Pseudomonas aeruginosa PA01
auggccagggggccuggcucgau

SEQ ID NO: 3440110 - RNA, 14 nt, Pseudomonas aeruginosa PA01
auggcccagaugau

SEQ ID NO: 3440111 - RNA, 20 nt, Pseudomonas aeruginosa PA01
auggccccggcgauccgcgc

SEQ ID NO: 3440112 - RNA, 16 nt, Pseudomonas aeruginosa PA01
auggccccuccaccuc

SEQ ID NO: 3440113 - RNA, 17 nt, Pseudomonas aeruginosa PA01
auggcccguuccaccgc

SEQ ID NO: 3440114 - RNA, 22 nt, Pseudomonas aeruginosa PA01
auggcccguuccaccgccugga

SEQ ID NO: 3440115 - RNA, 18 nt, Pseudomonas aeruginosa PA01
auggccgacccgugcgcc

SEQ ID NO: 3440116 - RNA, 21 nt, Pseudomonas aeruginosa PA01
auggccgagcccagcggcagg

SEQ ID NO: 3440117 - RNA, 15 nt, Pseudomonas aeruginosa PA01
auggccgcagcggcu

SEQ ID NO: 3440118 - RNA, 23 nt, Pseudomonas aeruginosa PA01
auggccgcagcggcuguugccgg

SEQ ID NO: 3440119 - RNA, 13 nt, Pseudomonas aeruginosa PA01
auggccgccagca

SEQ ID NO: 3440120 - RNA, 14 nt, Pseudomonas aeruginosa PA01
auggccggcaccag

SEQ ID NO: 3440121 - RNA, 16 nt, Pseudomonas aeruginosa PA01
auggccggcaccagca

SEQ ID NO: 3440122 - RNA, 13 nt, Pseudomonas aeruginosa PA01
auggccggcagca

SEQ ID NO: 3440123 - RNA, 16 nt, Pseudomonas aeruginosa PA01
auggccggcagcagcg

SEQ ID NO: 3440124 - RNA, 19 nt, Pseudomonas aeruginosa PA01
auggccggcagcagcgcca

SEQ ID NO: 3440125 - RNA, 20 nt, Pseudomonas aeruginosa PA01
auggccggcagcagcgccag

SEQ ID NO: 3440126 - RNA, 16 nt, Pseudomonas aeruginosa PA01
auggccguagccggug

SEQ ID NO: 3440127 - RNA, 17 nt, Pseudomonas aeruginosa PA01
auggccguccaggcugc

SEQ ID NO: 3440128 - RNA, 14 nt, Pseudomonas aeruginosa PA01
auggccguccucgu

SEQ ID NO: 3440129 - RNA, 20 nt, Pseudomonas aeruginosa PA01
auggccguccucgucgaggu

SEQ ID NO: 3440130 - RNA, 12 nt, Pseudomonas aeruginosa PA01
auggccuggcgc

SEQ ID NO: 3440131 - RNA, 13 nt, Pseudomonas aeruginosa PA01
auggccuggcgcu

SEQ ID NO: 3440132 - RNA, 18 nt, Pseudomonas aeruginosa PA01
auggccuggcgcucagcg

SEQ ID NO: 3440133 - RNA, 14 nt, Pseudomonas aeruginosa PA01
auggccuggucggc

SEQ ID NO: 3440134 - RNA, 16 nt, Pseudomonas aeruginosa PA01
auggccuggucggcgc

SEQ ID NO: 3440135 - RNA, 17 nt, Pseudomonas aeruginosa PA01
auggcgaagcucggccg

SEQ ID NO: 3440136 - RNA, 19 nt, Pseudomonas aeruginosa PA01
auggcgaccugguggcgcc

SEQ ID NO: 3440137 - RNA, 20 nt, Pseudomonas aeruginosa PA01
auggcgaccugguggcgccg

SEQ ID NO: 3440138 - RNA, 21 nt, Pseudomonas aeruginosa PA01
auggcgaggaugaucagggca

SEQ ID NO: 3440139 - RNA, 17 nt, Pseudomonas aeruginosa PA01
auggcgauauggccgua

SEQ ID NO: 3440140 - RNA, 13 nt, Pseudomonas aeruginosa PA01
auggcgccacucg

SEQ ID NO: 3440141 - RNA, 17 nt, Pseudomonas aeruginosa PA01
auggcgccacucggcgu

SEQ ID NO: 3440142 - RNA, 21 nt, Pseudomonas aeruginosa PA01
auggcgccacucggcgugccg

SEQ ID NO: 3440143 - RNA, 22 nt, Pseudomonas aeruginosa PA01
auggcgccacucggcgugccgg

SEQ ID NO: 3440144 - RNA, 20 nt, Pseudomonas aeruginosa PA01
auggcgccauugugcgcgcg

SEQ ID NO: 3440145 - RNA, 13 nt, Pseudomonas aeruginosa PA01
auggcgccgccga

SEQ ID NO: 3440146 - RNA, 12 nt, Pseudomonas aeruginosa PA01
auggcgccggcc

SEQ ID NO: 3440147 - RNA, 19 nt, Pseudomonas aeruginosa PA01
auggcgccggccagagcuu

SEQ ID NO: 3440148 - RNA, 15 nt, Pseudomonas aeruginosa PA01
auggcgcgcgggccu

SEQ ID NO: 3440149 - RNA, 15 nt, Pseudomonas aeruginosa PA01
auggcgcggggcccc

SEQ ID NO: 3440150 - RNA, 20 nt, Pseudomonas aeruginosa PA01
auggcgcggggccccggcaa

SEQ ID NO: 3440151 - RNA, 18 nt, Pseudomonas aeruginosa PA01
auggcgcgguccgcggua

SEQ ID NO: 3440152 - RNA, 18 nt, Pseudomonas aeruginosa PA01
auggcgcggugggccuug

SEQ ID NO: 3440153 - RNA, 22 nt, Pseudomonas aeruginosa PA01
auggcgcuccagggcgcugacc

SEQ ID NO: 3440154 - RNA, 12 nt, Pseudomonas aeruginosa PA01
auggcgcugcca

SEQ ID NO: 3440155 - RNA, 13 nt, Pseudomonas aeruginosa PA01
auggcgcugccaa

SEQ ID NO: 3440156 - RNA, 23 nt, Pseudomonas aeruginosa PA01
auggcgcuucaucuccugcugga

SEQ ID NO: 3440157 - RNA, 16 nt, Pseudomonas aeruginosa PA01
auggcgcuugcgcagc

SEQ ID NO: 3440158 - RNA, 17 nt, Pseudomonas aeruginosa PA01
auggcggacgaucacuc

SEQ ID NO: 3440159 - RNA, 22 nt, Pseudomonas aeruginosa PA01
auggcggacgaucacucccugc

SEQ ID NO: 3440160 - RNA, 19 nt, Pseudomonas aeruginosa PA01
auggcggauaaccgcaagc

SEQ ID NO: 3440161 - RNA, 21 nt, Pseudomonas aeruginosa PA01
auggcggauaaccgcaagcgg

SEQ ID NO: 3440162 - RNA, 21 nt, Pseudomonas aeruginosa PA01
auggcggauagccgcaagcgg

SEQ ID NO: 3440163 - RNA, 20 nt, Pseudomonas aeruginosa PA01
auggcggcauugagcgccag

SEQ ID NO: 3440164 - RNA, 22 nt, Pseudomonas aeruginosa PA01
auggcggcauugagcgccagca

SEQ ID NO: 3440165 - RNA, 16 nt, Pseudomonas aeruginosa PA01
auggcggcgauggacu

SEQ ID NO: 3440166 - RNA, 18 nt, Pseudomonas aeruginosa PA01
auggcggggcuucuuuua

SEQ ID NO: 3440167 - RNA, 22 nt, Pseudomonas aeruginosa PA01
auggcgguaguguugaagccgc

SEQ ID NO: 3440168 - RNA, 13 nt, Pseudomonas aeruginosa PA01
auggcggucagau

SEQ ID NO: 3440169 - RNA, 16 nt, Pseudomonas aeruginosa PA01
auggcggucgccgacc

SEQ ID NO: 3440170 - RNA, 17 nt, Pseudomonas aeruginosa PA01
auggcggucggccaggc

SEQ ID NO: 3440171 - RNA, 20 nt, Pseudomonas aeruginosa PA01
auggcggucggccaggcggc

SEQ ID NO: 3440172 - RNA, 18 nt, Pseudomonas aeruginosa PA01
auggcguagaggcucggc

SEQ ID NO: 3440173 - RNA, 17 nt, Pseudomonas aeruginosa PA01
auggcguccaccgcuuc

SEQ ID NO: 3440174 - RNA, 13 nt, Pseudomonas aeruginosa PA01
auggcgucggcga

SEQ ID NO: 3440175 - RNA, 14 nt, Pseudomonas aeruginosa PA01
auggcgucggcgau

SEQ ID NO: 3440176 - RNA, 23 nt, Pseudomonas aeruginosa PA01
auggcgugaaguagccgccggga

SEQ ID NO: 3440177 - RNA, 17 nt, Pseudomonas aeruginosa PA01
auggcguguucgucgau

SEQ ID NO: 3440178 - RNA, 23 nt, Pseudomonas aeruginosa PA01
auggcguguucgucgaucagguc

SEQ ID NO: 3440179 - RNA, 16 nt, Pseudomonas aeruginosa PA01
auggcuaaacaagcca

SEQ ID NO: 3440180 - RNA, 12 nt, Pseudomonas aeruginosa PA01
auggcuggcgcu

SEQ ID NO: 3440181 - RNA, 17 nt, Pseudomonas aeruginosa PA01
auggcuggucaggcuga

SEQ ID NO: 3440182 - RNA, 15 nt, Pseudomonas aeruginosa PA01
auggcuguagggaca

SEQ ID NO: 3440183 - RNA, 18 nt, Pseudomonas aeruginosa PA01
auggcuguagggacaggc

SEQ ID NO: 3440184 - RNA, 22 nt, Pseudomonas aeruginosa PA01
auggcuugaucgagucgccggc

SEQ ID NO: 3440185 - RNA, 18 nt, Pseudomonas aeruginosa PA01
auggcuuuccaggcgccg

SEQ ID NO: 3440186 - RNA, 19 nt, Pseudomonas aeruginosa PA01
augggaaccucggcaggcu

SEQ ID NO: 3440187 - RNA, 19 nt, Pseudomonas aeruginosa PA01
augggaacgaguugggcga

SEQ ID NO: 3440188 - RNA, 17 nt, Pseudomonas aeruginosa PA01
augggcaccgcgccggc

SEQ ID NO: 3440189 - RNA, 18 nt, Pseudomonas aeruginosa PA01
augggcaccgcgccggcg

SEQ ID NO: 3440190 - RNA, 21 nt, Pseudomonas aeruginosa PA01
augggcacgaucugcgccgca

SEQ ID NO: 3440191 - RNA, 12 nt, Pseudomonas aeruginosa PA01
auucauggcgcc

SEQ ID NO: 3440192 - RNA, 16 nt, Pseudomonas aeruginosa PA01
auuccacgucgccgac

SEQ ID NO: 3440193 - RNA, 20 nt, Pseudomonas aeruginosa PA01
auuccagaaacggcugccgg

SEQ ID NO: 3440194 - RNA, 14 nt, Pseudomonas aeruginosa PA01
auuccagcaggucg

SEQ ID NO: 3440195 - RNA, 17 nt, Pseudomonas aeruginosa PA01
auuccagcaggucggca

SEQ ID NO: 3440196 - RNA, 19 nt, Pseudomonas aeruginosa PA01
auucccgccgcuccggcug

SEQ ID NO: 3440197 - RNA, 17 nt, Pseudomonas aeruginosa PA01
auucccgcgacaacggc

SEQ ID NO: 3440198 - RNA, 20 nt, Pseudomonas aeruginosa PA01
auuccgcccauugcccggcc

SEQ ID NO: 3440199 - RNA, 14 nt, Pseudomonas aeruginosa PA01
auuccgccgcggca

SEQ ID NO: 3440200 - RNA, 14 nt, Pseudomonas aeruginosa PA01
auuccgcgcaggac

SEQ ID NO: 3440201 - RNA, 22 nt, Pseudomonas aeruginosa PA01
auuccgcgcaggaccacgcugg

SEQ ID NO: 3440202 - RNA, 20 nt, Pseudomonas aeruginosa PA01
auuccgcggcacuccggcau

SEQ ID NO: 3440203 - RNA, 20 nt, Pseudomonas aeruginosa PA01
auuccgcugaggauguagcc

SEQ ID NO: 3440204 - RNA, 14 nt, Pseudomonas aeruginosa PA01
auuccggcagcgac

SEQ ID NO: 3440205 - RNA, 18 nt, Pseudomonas aeruginosa PA01
auuccgggcacggaaucg

SEQ ID NO: 3440206 - RNA, 14 nt, Pseudomonas aeruginosa PA01
auuccuacgaaggu

SEQ ID NO: 3440207 - RNA, 20 nt, Pseudomonas aeruginosa PA01
auuccucggcgucgggcagg

SEQ ID NO: 3440208 - RNA, 22 nt, Pseudomonas aeruginosa PA01
auuccuggccggugacgaaacc

SEQ ID NO: 3440209 - RNA, 18 nt, Pseudomonas aeruginosa PA01
auuccuuccaggguuucc

SEQ ID NO: 3440210 - RNA, 21 nt, Pseudomonas aeruginosa PA01
auuccuugcgccaugcgcccg

SEQ ID NO: 3440211 - RNA, 18 nt, Pseudomonas aeruginosa PA01
auuccuuggucaggucga

SEQ ID NO: 3440212 - RNA, 15 nt, Pseudomonas aeruginosa PA01
auuccuuuaauuuca

SEQ ID NO: 3440213 - RNA, 18 nt, Pseudomonas aeruginosa PA01
auucgaacagcuugacga

SEQ ID NO: 3440214 - RNA, 17 nt, Pseudomonas aeruginosa PA01
auucgaauggcgccggc

SEQ ID NO: 3440215 - RNA, 15 nt, Pseudomonas aeruginosa PA01
auucgacccgccgac

SEQ ID NO: 3440216 - RNA, 17 nt, Pseudomonas aeruginosa PA01
auucgacccgccgacca

SEQ ID NO: 3440217 - RNA, 18 nt, Pseudomonas aeruginosa PA01
auucgacccgccgaccag

SEQ ID NO: 3440218 - RNA, 17 nt, Pseudomonas aeruginosa PA01
auucgacgcagcgcgcg

SEQ ID NO: 3440219 - RNA, 23 nt, Pseudomonas aeruginosa PA01
auucgacgcagcgcgcgccgagc

SEQ ID NO: 3440220 - RNA, 20 nt, Pseudomonas aeruginosa PA01
auucgacgguauguuucugg

SEQ ID NO: 3440221 - RNA, 19 nt, Pseudomonas aeruginosa PA01
auucgaugccgcgcgccug

SEQ ID NO: 3440222 - RNA, 22 nt, Pseudomonas aeruginosa PA01
auucgcagagaucggcggcgcg

SEQ ID NO: 3440223 - RNA, 16 nt, Pseudomonas aeruginosa PA01
auucgccagccucggc

SEQ ID NO: 3440224 - RNA, 20 nt, Pseudomonas aeruginosa PA01
auucgccccagcggucgauc

SEQ ID NO: 3440225 - RNA, 13 nt, Pseudomonas aeruginosa PA01
auucgcccuaccc

SEQ ID NO: 3440226 - RNA, 14 nt, Pseudomonas aeruginosa PA01
auucgcccuacccc

SEQ ID NO: 3440227 - RNA, 21 nt, Pseudomonas aeruginosa PA01
auucgcccuacccgacaggca

SEQ ID NO: 3440228 - RNA, 19 nt, Pseudomonas aeruginosa PA01
auucgcccuaccgcccacc

SEQ ID NO: 3440229 - RNA, 23 nt, Pseudomonas aeruginosa PA01
auucgcccuaccgcccacccugc

SEQ ID NO: 3440230 - RNA, 23 nt, Pseudomonas aeruginosa PA01
auucgcccuacggccccaggcug

SEQ ID NO: 3440231 - RNA, 22 nt, Pseudomonas aeruginosa PA01
auucgccgcgcgccaucaguuc

SEQ ID NO: 3440232 - RNA, 11 nt, Pseudomonas aeruginosa PA01
auucgccggcc

SEQ ID NO: 3440233 - RNA, 15 nt, Pseudomonas aeruginosa PA01
auucgccggccaggu

SEQ ID NO: 3440234 - RNA, 18 nt, Pseudomonas aeruginosa PA01
auucgcgcagcaggcggc

SEQ ID NO: 3440235 - RNA, 22 nt, Pseudomonas aeruginosa PA01
auucgcgcucggcgaggccggc

SEQ ID NO: 3440236 - RNA, 18 nt, Pseudomonas aeruginosa PA01
auucgcucugcgccaggc

SEQ ID NO: 3440237 - RNA, 15 nt, Pseudomonas aeruginosa PA01
auucgcugucagggc

SEQ ID NO: 3440238 - RNA, 17 nt, Pseudomonas aeruginosa PA01
auucgcugucagggcuu

SEQ ID NO: 3440239 - RNA, 16 nt, Pseudomonas aeruginosa PA01
auucgcugucgagcag

SEQ ID NO: 3440240 - RNA, 23 nt, Pseudomonas aeruginosa PA01
auucgcugucgucggcgcggccg

SEQ ID NO: 3440241 - RNA, 15 nt, Pseudomonas aeruginosa PA01
auucggccagcgcgg

SEQ ID NO: 3440242 - RNA, 13 nt, Pseudomonas aeruginosa PA01
auucggcccaugc

SEQ ID NO: 3440243 - RNA, 13 nt, Pseudomonas aeruginosa PA01
auucggccugccg

SEQ ID NO: 3440244 - RNA, 17 nt, Pseudomonas aeruginosa PA01
auucggcuuccugggcg

SEQ ID NO: 3440245 - RNA, 14 nt, Pseudomonas aeruginosa PA01
auucguccagccgc

SEQ ID NO: 3440246 - RNA, 15 nt, Pseudomonas aeruginosa PA01
auucguccagccgcc

SEQ ID NO: 3440247 - RNA, 22 nt, Pseudomonas aeruginosa PA01
auucgucgccgccgaggcgcgc

SEQ ID NO: 3440248 - RNA, 13 nt, Pseudomonas aeruginosa PA01
auucgucgccgcu

SEQ ID NO: 3440249 - RNA, 17 nt, Pseudomonas aeruginosa PA01
auucgucgcugcacgca

SEQ ID NO: 3440250 - RNA, 14 nt, Pseudomonas aeruginosa PA01
auucuccagccgca

SEQ ID NO: 3440251 - RNA, 22 nt, Pseudomonas aeruginosa PA01
auucucgcgacccuggccgcgc

SEQ ID NO: 3440252 - RNA, 15 nt, Pseudomonas aeruginosa PA01
auucucucuucagca

SEQ ID NO: 3440253 - RNA, 14 nt, Pseudomonas aeruginosa PA01
auucugcaggcgcu

SEQ ID NO: 3440254 - RNA, 15 nt, Pseudomonas aeruginosa PA01
auucugcaggcgcuc

SEQ ID NO: 3440255 - RNA, 20 nt, Pseudomonas aeruginosa PA01
auucuucaugggacaaacga

SEQ ID NO: 3440256 - RNA, 23 nt, Pseudomonas aeruginosa PA01
auucuucuccagaaucucccgca

SEQ ID NO: 3440257 - RNA, 18 nt, Pseudomonas aeruginosa PA01
auucuugauccaguagcc

SEQ ID NO: 3440258 - RNA, 16 nt, Pseudomonas aeruginosa PA01
auucuuggcucggcag

SEQ ID NO: 3440259 - RNA, 18 nt, Pseudomonas aeruginosa PA01
auugaacaccugaucgaa

SEQ ID NO: 3440260 - RNA, 18 nt, Pseudomonas aeruginosa PA01
auugaaggaacguucagu

SEQ ID NO: 3440261 - RNA, 14 nt, Pseudomonas aeruginosa PA01
auugaaggccgaca

SEQ ID NO: 3440262 - RNA, 15 nt, Pseudomonas aeruginosa PA01
auugaaguggugaug

SEQ ID NO: 3440263 - RNA, 20 nt, Pseudomonas aeruginosa PA01
auugagcgcgcccaggcagg

SEQ ID NO: 3440264 - RNA, 17 nt, Pseudomonas aeruginosa PA01
auugaugaagcgcugcu

SEQ ID NO: 3440265 - RNA, 16 nt, Pseudomonas aeruginosa PA01
auugaugcaaggacuu

SEQ ID NO: 3440266 - RNA, 22 nt, Pseudomonas aeruginosa PA01
auugcaccgcuugccagccgcu

SEQ ID NO: 3440267 - RNA, 14 nt, Pseudomonas aeruginosa PA01
auugcagcgucgac

SEQ ID NO: 3440268 - RNA, 22 nt, Pseudomonas aeruginosa PA01
auugcagcgucgacgccgagcu

SEQ ID NO: 3440269 - RNA, 20 nt, Pseudomonas aeruginosa PA01
auugcaggcccggccgccug

SEQ ID NO: 3440270 - RNA, 19 nt, Pseudomonas aeruginosa PA01
auugcagguaguccagcca

SEQ ID NO: 3440271 - RNA, 24 nt, Pseudomonas aeruginosa PA01
auugcagguaguccagccagugca

SEQ ID NO: 3440272 - RNA, 19 nt, Pseudomonas aeruginosa PA01
auugccagaggcugcgcuc

SEQ ID NO: 3440273 - RNA, 21 nt, Pseudomonas aeruginosa PA01
auugccagaggcugcgcucca

SEQ ID NO: 3440274 - RNA, 21 nt, Pseudomonas aeruginosa PA01
auugcccggccaggcgcggcg

SEQ ID NO: 3440275 - RNA, 19 nt, Pseudomonas aeruginosa PA01
auugcccgguggccuccug

SEQ ID NO: 3440276 - RNA, 20 nt, Pseudomonas aeruginosa PA01
auugcccgguggccuccugc

SEQ ID NO: 3440277 - RNA, 11 nt, Pseudomonas aeruginosa PA01
auugccgggcu

SEQ ID NO: 3440278 - RNA, 17 nt, Pseudomonas aeruginosa PA01
auugccgggcuuccugg

SEQ ID NO: 3440279 - RNA, 19 nt, Pseudomonas aeruginosa PA01
auugccgggcuuccuggcc

SEQ ID NO: 3440280 - RNA, 20 nt, Pseudomonas aeruginosa PA01
auugccgggcuuccuggccg

SEQ ID NO: 3440281 - RNA, 16 nt, Pseudomonas aeruginosa PA01
auugccgguagccggc

SEQ ID NO: 3440282 - RNA, 23 nt, Pseudomonas aeruginosa PA01
auugccgguagccggcgaucagc

SEQ ID NO: 3440283 - RNA, 22 nt, Pseudomonas aeruginosa PA01
auugccuccgcucugcuggcca

SEQ ID NO: 3440284 - RNA, 14 nt, Pseudomonas aeruginosa PA01
auugcgcccucccg

SEQ ID NO: 3440285 - RNA, 13 nt, Pseudomonas aeruginosa PA01
auugcgccgccgg

SEQ ID NO: 3440286 - RNA, 18 nt, Pseudomonas aeruginosa PA01
auugcguaacguuacgca

SEQ ID NO: 3440287 - RNA, 15 nt, Pseudomonas aeruginosa PA01
auugcuccacccgca

SEQ ID NO: 3440288 - RNA, 12 nt, Pseudomonas aeruginosa PA01
auugcugagggg

SEQ ID NO: 3440289 - RNA, 12 nt, Pseudomonas aeruginosa PA01
auugcugccacu

SEQ ID NO: 3440290 - RNA, 11 nt, Pseudomonas aeruginosa PA01
auugcugccga

SEQ ID NO: 3440291 - RNA, 22 nt, Pseudomonas aeruginosa PA01
auuggacagcaggcugccgaga

SEQ ID NO: 3440292 - RNA, 17 nt, Pseudomonas aeruginosa PA01
auuggagaugaucagca

SEQ ID NO: 3440293 - RNA, 17 nt, Pseudomonas aeruginosa PA01
caaccgcagacuccggc

SEQ ID NO: 3440294 - RNA, 19 nt, Pseudomonas aeruginosa PA01
caaccgcagacuccggcgc

SEQ ID NO: 3440295 - RNA, 15 nt, Pseudomonas aeruginosa PA01
caaccgccgccgcaa

SEQ ID NO: 3440296 - RNA, 20 nt, Pseudomonas aeruginosa PA01
caaccgcgcucggcggucag

SEQ ID NO: 3440297 - RNA, 11 nt, Pseudomonas aeruginosa PA01
caaccgcggcg

SEQ ID NO: 3440298 - RNA, 14 nt, Pseudomonas aeruginosa PA01
caaccgcggcggcc

SEQ ID NO: 3440299 - RNA, 17 nt, Pseudomonas aeruginosa PA01
caaccgcggcggccuca

SEQ ID NO: 3440300 - RNA, 13 nt, Pseudomonas aeruginosa PA01
caaccgcucgcgg

SEQ ID NO: 3440301 - RNA, 15 nt, Pseudomonas aeruginosa PA01
caaccgcugccgccg

SEQ ID NO: 3440302 - RNA, 16 nt, Pseudomonas aeruginosa PA01
caaccgcuggucggca

SEQ ID NO: 3440303 - RNA, 22 nt, Pseudomonas aeruginosa PA01
caaccgcuugcggucauccgcc

SEQ ID NO: 3440304 - RNA, 15 nt, Pseudomonas aeruginosa PA01
caaccgggcagcagc

SEQ ID NO: 3440305 - RNA, 16 nt, Pseudomonas aeruginosa PA01
caaccgggcagcagcc

SEQ ID NO: 3440306 - RNA, 14 nt, Pseudomonas aeruginosa PA01
caaccgggcaucgc

SEQ ID NO: 3440307 - RNA, 20 nt, Pseudomonas aeruginosa PA01
caaccgggcaucgccgacca

SEQ ID NO: 3440308 - RNA, 17 nt, Pseudomonas aeruginosa PA01
caaccgguuucccucga

SEQ ID NO: 3440309 - RNA, 14 nt, Pseudomonas aeruginosa PA01
caaccgucgcccug

SEQ ID NO: 3440310 - RNA, 15 nt, Pseudomonas aeruginosa PA01
caaccguuccagcgc

SEQ ID NO: 3440311 - RNA, 16 nt, Pseudomonas aeruginosa PA01
caaccguuccagcgcc

SEQ ID NO: 3440312 - RNA, 15 nt, Pseudomonas aeruginosa PA01
caaccguucugccgc

SEQ ID NO: 3440313 - RNA, 21 nt, Pseudomonas aeruginosa PA01
caaccguucugccgcagcgcc

SEQ ID NO: 3440314 - RNA, 22 nt, Pseudomonas aeruginosa PA01
caaccguucugccgcagcgccu

SEQ ID NO: 3440315 - RNA, 14 nt, Pseudomonas aeruginosa PA01
caaccucuccccag

SEQ ID NO: 3440316 - RNA, 16 nt, Pseudomonas aeruginosa PA01
caaccucuccccagac

SEQ ID NO: 3440317 - RNA, 21 nt, Pseudomonas aeruginosa PA01
caaccucuccccagacccucu

SEQ ID NO: 3440318 - RNA, 22 nt, Pseudomonas aeruginosa PA01
caaccuguggaauguccugccg

SEQ ID NO: 3440319 - RNA, 23 nt, Pseudomonas aeruginosa PA01
caaccuguggaauguccugccgc

SEQ ID NO: 3440320 - RNA, 19 nt, Pseudomonas aeruginosa PA01
caaccuugcacauccagcc

SEQ ID NO: 3440321 - RNA, 23 nt, Pseudomonas aeruginosa PA01
caacgaaaaagggcggccacccg

SEQ ID NO: 3440322 - RNA, 17 nt, Pseudomonas aeruginosa PA01
caacgaaaagagccgcg

SEQ ID NO: 3440323 - RNA, 19 nt, Pseudomonas aeruginosa PA01
caacgaaaagagccgcgcc

SEQ ID NO: 3440324 - RNA, 17 nt, Pseudomonas aeruginosa PA01
caacgaagucgcgaggu

SEQ ID NO: 3440325 - RNA, 21 nt, Pseudomonas aeruginosa PA01
caacgaaguguuacagcagga

SEQ ID NO: 3440326 - RNA, 14 nt, Pseudomonas aeruginosa PA01
caacgacagccccg

SEQ ID NO: 3440327 - RNA, 20 nt, Pseudomonas aeruginosa PA01
caacgacagccccggcccgg

SEQ ID NO: 3440328 - RNA, 16 nt, Pseudomonas aeruginosa PA01
caacgaccgcccaggc

SEQ ID NO: 3440329 - RNA, 23 nt, Pseudomonas aeruginosa PA01
caacgaccgcccaggcugccgcc

SEQ ID NO: 3440330 - RNA, 15 nt, Pseudomonas aeruginosa PA01
caacgcaggcgcaug

SEQ ID NO: 3440331 - RNA, 19 nt, Pseudomonas aeruginosa PA01
caacgcaggcgcauggcgu

SEQ ID NO: 3440332 - RNA, 13 nt, Pseudomonas aeruginosa PA01
caacgccaccgcg

SEQ ID NO: 3440333 - RNA, 16 nt, Pseudomonas aeruginosa PA01
caacgccaccgcgcgc

SEQ ID NO: 3440334 - RNA, 13 nt, Pseudomonas aeruginosa PA01
caacgccagcagg

SEQ ID NO: 3440335 - RNA, 15 nt, Pseudomonas aeruginosa PA01
caacgccagcaggcg

SEQ ID NO: 3440336 - RNA, 22 nt, Pseudomonas aeruginosa PA01
caacgccagcaggcgcaggucg

SEQ ID NO: 3440337 - RNA, 23 nt, Pseudomonas aeruginosa PA01
caacgccagcaggcgcaggucgg

SEQ ID NO: 3440338 - RNA, 22 nt, Pseudomonas aeruginosa PA01
caacgcccgcgagccguccugc

SEQ ID NO: 3440339 - RNA, 17 nt, Pseudomonas aeruginosa PA01
caacgcccgggccgggg

SEQ ID NO: 3440340 - RNA, 13 nt, Pseudomonas aeruginosa PA01
caacgccgacggc

SEQ ID NO: 3440341 - RNA, 23 nt, Pseudomonas aeruginosa PA01
caacgccgacggcgugccguggc

SEQ ID NO: 3440342 - RNA, 14 nt, Pseudomonas aeruginosa PA01
caacgccgccggcg

SEQ ID NO: 3440343 - RNA, 17 nt, Pseudomonas aeruginosa PA01
caacgccuggccacgcc

SEQ ID NO: 3440344 - RNA, 13 nt, Pseudomonas aeruginosa PA01
caacgccuggugc

SEQ ID NO: 3440345 - RNA, 22 nt, Pseudomonas aeruginosa PA01
caacgccuuccuugucgaucag

SEQ ID NO: 3440346 - RNA, 15 nt, Pseudomonas aeruginosa PA01
caacgcgcgcaggac

SEQ ID NO: 3440347 - RNA, 20 nt, Pseudomonas aeruginosa PA01
caacgcgcgcaggaccagac

SEQ ID NO: 3440348 - RNA, 19 nt, Pseudomonas aeruginosa PA01
caacgcggccagcagcacg

SEQ ID NO: 3440349 - RNA, 19 nt, Pseudomonas aeruginosa PA01
caacgcggcgucagggucg

SEQ ID NO: 3440350 - RNA, 19 nt, Pseudomonas aeruginosa PA01
caacgcgguuauccgccgc

SEQ ID NO: 3440351 - RNA, 22 nt, Pseudomonas aeruginosa PA01
caacgcgguuauccgccgcugu

SEQ ID NO: 3440352 - RNA, 14 nt, Pseudomonas aeruginosa PA01
caacgcuuccagca

SEQ ID NO: 3440353 - RNA, 16 nt, Pseudomonas aeruginosa PA01
caacggaaaaaggcgc

SEQ ID NO: 3440354 - RNA, 18 nt, Pseudomonas aeruginosa PA01
caacggaaacacagcacg

SEQ ID NO: 3440355 - RNA, 22 nt, Pseudomonas aeruginosa PA01
caacggacguuccaccuggcgc

SEQ ID NO: 3440356 - RNA, 19 nt, Pseudomonas aeruginosa PA01
caacggcgaccgcuggacc

SEQ ID NO: 3440357 - RNA, 20 nt, Pseudomonas aeruginosa PA01
caacggcgaccgcuggacca

SEQ ID NO: 3440358 - RNA, 16 nt, Pseudomonas aeruginosa PA01
caacggcgcaucgucg

SEQ ID NO: 3440359 - RNA, 13 nt, Pseudomonas aeruginosa PA01
caacggcgggccg

SEQ ID NO: 3440360 - RNA, 14 nt, Pseudomonas aeruginosa PA01
caacggcgggccgc

SEQ ID NO: 3440361 - RNA, 15 nt, Pseudomonas aeruginosa PA01
caacggcgugccggg

SEQ ID NO: 3440362 - RNA, 14 nt, Pseudomonas aeruginosa PA01
caacggcuccuuga

SEQ ID NO: 3440363 - RNA, 18 nt, Pseudomonas aeruginosa PA01
caacggcuccuugaaggc

SEQ ID NO: 3440364 - RNA, 11 nt, Pseudomonas aeruginosa PA01
caacggcuggg

SEQ ID NO: 3440365 - RNA, 23 nt, Pseudomonas aeruginosa PA01
caacggcugggucacguccaugu

SEQ ID NO: 3440366 - RNA, 14 nt, Pseudomonas aeruginosa PA01
caacgggcggcggg

SEQ ID NO: 3440367 - RNA, 15 nt, Pseudomonas aeruginosa PA01
caacgggcggcggga

SEQ ID NO: 3440368 - RNA, 22 nt, Pseudomonas aeruginosa PA01
caacgggcggcgggacuggggc

SEQ ID NO: 3440369 - RNA, 20 nt, Pseudomonas aeruginosa PA01
caacgggcucgugcccucgc

SEQ ID NO: 3440370 - RNA, 15 nt, Pseudomonas aeruginosa PA01
caacgguagcggauc

SEQ ID NO: 3440371 - RNA, 12 nt, Pseudomonas aeruginosa PA01
caacgucggcgu

SEQ ID NO: 3440372 - RNA, 17 nt, Pseudomonas aeruginosa PA01
caacgucuucaggcgcu

SEQ ID NO: 3440373 - RNA, 15 nt, Pseudomonas aeruginosa PA01
caacuccgccaggcg

SEQ ID NO: 3440374 - RNA, 14 nt, Pseudomonas aeruginosa PA01
caacucggcgccgu

SEQ ID NO: 3440375 - RNA, 21 nt, Pseudomonas aeruginosa PA01
caacucggcggcgagcgccgc

SEQ ID NO: 3440376 - RNA, 22 nt, Pseudomonas aeruginosa PA01
caacucggcggcgagcgccgcg

SEQ ID NO: 3440377 - RNA, 15 nt, Pseudomonas aeruginosa PA01
caacucgucguccag

SEQ ID NO: 3440378 - RNA, 18 nt, Pseudomonas aeruginosa PA01
caacucgucguccagcgg

SEQ ID NO: 3440379 - RNA, 20 nt, Pseudomonas aeruginosa PA01
caacucuuccagggucggca

SEQ ID NO: 3440380 - RNA, 11 nt, Pseudomonas aeruginosa PA01
caacugaccug

SEQ ID NO: 3440381 - RNA, 21 nt, Pseudomonas aeruginosa PA01
caacugacggcggaaggcggc

SEQ ID NO: 3440382 - RNA, 18 nt, Pseudomonas aeruginosa PA01
caacugaucagccgggcg

SEQ ID NO: 3440383 - RNA, 19 nt, Pseudomonas aeruginosa PA01
caacugaucagccgggcgu

SEQ ID NO: 3440384 - RNA, 13 nt, Pseudomonas aeruginosa PA01
caacugccgcccg

SEQ ID NO: 3440385 - RNA, 16 nt, Pseudomonas aeruginosa PA01
caacugccgcccgcuc

SEQ ID NO: 3440386 - RNA, 19 nt, Pseudomonas aeruginosa PA01
caacugccggucggccuug

SEQ ID NO: 3440387 - RNA, 24 nt, Pseudomonas aeruginosa PA01
caacugcgaaccgagacccuggcg

SEQ ID NO: 3440388 - RNA, 21 nt, Pseudomonas aeruginosa PA01
caacugcgccagccgacuggc

SEQ ID NO: 3440389 - RNA, 15 nt, Pseudomonas aeruginosa PA01
caacugcgcccccag

SEQ ID NO: 3440390 - RNA, 17 nt, Pseudomonas aeruginosa PA01
caacugcggggcgcuca

SEQ ID NO: 3440391 - RNA, 21 nt, Pseudomonas aeruginosa PA01
caacugcggggcgcucagggu

SEQ ID NO: 3440392 - RNA, 23 nt, Pseudomonas aeruginosa PA01
caacugcucgaacugcuccuggg

SEQ ID NO: 3440393 - RNA, 21 nt, Pseudomonas aeruginosa PA01
caacugcucgaucaaccccug

SEQ ID NO: 3440394 - RNA, 19 nt, Pseudomonas aeruginosa PA01
caacugcuuaccuugccgg

SEQ ID NO: 3440395 - RNA, 21 nt, Pseudomonas aeruginosa PA01
caagguuccagccccgccgga

SEQ ID NO: 3440396 - RNA, 15 nt, Pseudomonas aeruginosa PA01
caagguuugcgccgc

SEQ ID NO: 3440397 - RNA, 17 nt, Pseudomonas aeruginosa PA01
caagguuugcgccgccg

SEQ ID NO: 3440398 - RNA, 23 nt, Pseudomonas aeruginosa PA01
caagucggccugcaccagccagu

SEQ ID NO: 3440399 - RNA, 20 nt, Pseudomonas aeruginosa PA01
caagugcucgauggcgaagc

SEQ ID NO: 3440400 - RNA, 14 nt, Pseudomonas aeruginosa PA01
caaguggcggcuga

SEQ ID NO: 3440401 - RNA, 16 nt, Pseudomonas aeruginosa PA01
caaguugccuggcagg

SEQ ID NO: 3440402 - RNA, 15 nt, Pseudomonas aeruginosa PA01
caauacaccgcugcg

SEQ ID NO: 3440403 - RNA, 22 nt, Pseudomonas aeruginosa PA01
caauacaccgcugcgccgccgu

SEQ ID NO: 3440404 - RNA, 15 nt, Pseudomonas aeruginosa PA01
caauacccgccgcug

SEQ ID NO: 3440405 - RNA, 18 nt, Pseudomonas aeruginosa PA01
caauaccgaacaccagca

SEQ ID NO: 3440406 - RNA, 19 nt, Pseudomonas aeruginosa PA01
caauaccgaacaccagcaa

SEQ ID NO: 3440407 - RNA, 23 nt, Pseudomonas aeruginosa PA01
caaucagcgcgauuuugggcuca

SEQ ID NO: 3440408 - RNA, 22 nt, Pseudomonas aeruginosa PA01
caaucagcgggccuuuucuuug

SEQ ID NO: 3440409 - RNA, 18 nt, Pseudomonas aeruginosa PA01
caaucaggcgcgaucgcg

SEQ ID NO: 3440410 - RNA, 18 nt, Pseudomonas aeruginosa PA01
caaucagggcugggcgcc

SEQ ID NO: 3440411 - RNA, 16 nt, Pseudomonas aeruginosa PA01
caauccgggcgugggg

SEQ ID NO: 3440412 - RNA, 15 nt, Pseudomonas aeruginosa PA01
caaucgacuucccac

SEQ ID NO: 3440413 - RNA, 21 nt, Pseudomonas aeruginosa PA01
caaucgcgcaacggcagcgcu

SEQ ID NO: 3440414 - RNA, 16 nt, Pseudomonas aeruginosa PA01
caaucggucgcccucg

SEQ ID NO: 3440415 - RNA, 17 nt, Pseudomonas aeruginosa PA01
caaucggucgcccucgg

SEQ ID NO: 3440416 - RNA, 20 nt, Pseudomonas aeruginosa PA01
caaucggucgcccucggcca

SEQ ID NO: 3440417 - RNA, 19 nt, Pseudomonas aeruginosa PA01
caaucuauaaugcgccccc

SEQ ID NO: 3440418 - RNA, 14 nt, Pseudomonas aeruginosa PA01
caaugaaaaaggga

SEQ ID NO: 3440419 - RNA, 22 nt, Pseudomonas aeruginosa PA01
caaugaaaaagggaugccgccg

SEQ ID NO: 3440420 - RNA, 23 nt, Pseudomonas aeruginosa PA01
caaugaaaaagggaugccgccgg

SEQ ID NO: 3440421 - RNA, 15 nt, Pseudomonas aeruginosa PA01
caaugacggggauca

SEQ ID NO: 3440422 - RNA, 18 nt, Pseudomonas aeruginosa PA01
caaugcaccugcgccccg

SEQ ID NO: 3440423 - RNA, 13 nt, Pseudomonas aeruginosa PA01
caaugccagcgcc

SEQ ID NO: 3440424 - RNA, 13 nt, Pseudomonas aeruginosa PA01
caaugcccagcgc

SEQ ID NO: 3440425 - RNA, 17 nt, Pseudomonas aeruginosa PA01
caaugcccagcgcaggc

SEQ ID NO: 3440426 - RNA, 17 nt, Pseudomonas aeruginosa PA01
caaugcccgcgccuggg

SEQ ID NO: 3440427 - RNA, 23 nt, Pseudomonas aeruginosa PA01
caaugccgcccuccaucagcgcc

SEQ ID NO: 3440428 - RNA, 18 nt, Pseudomonas aeruginosa PA01
caaugccgcgucgaaguc

SEQ ID NO: 3440429 - RNA, 22 nt, Pseudomonas aeruginosa PA01
caaugccgucgaucuugcaauc

SEQ ID NO: 3440430 - RNA, 17 nt, Pseudomonas aeruginosa PA01
caaugccuuccgacgcc

SEQ ID NO: 3440431 - RNA, 21 nt, Pseudomonas aeruginosa PA01
caaugcggccugcaacgccgc

SEQ ID NO: 3440432 - RNA, 19 nt, Pseudomonas aeruginosa PA01
caaugcggggcguucugcu

SEQ ID NO: 3440433 - RNA, 21 nt, Pseudomonas aeruginosa PA01
caauggacaagcgucgccggc

SEQ ID NO: 3440434 - RNA, 19 nt, Pseudomonas aeruginosa PA01
caauggauguugccgccgc

SEQ ID NO: 3440435 - RNA, 15 nt, Pseudomonas aeruginosa PA01
caauggccggcgggc

SEQ ID NO: 3440436 - RNA, 21 nt, Pseudomonas aeruginosa PA01
caauggccgggcuucuucagg

SEQ ID NO: 3440437 - RNA, 13 nt, Pseudomonas aeruginosa PA01
caauggcgcagcc

SEQ ID NO: 3440438 - RNA, 15 nt, Pseudomonas aeruginosa PA01
caauggcgcagccgc

SEQ ID NO: 3440439 - RNA, 19 nt, Pseudomonas aeruginosa PA01
caauggcgcagccgcuggg

SEQ ID NO: 3440440 - RNA, 18 nt, Pseudomonas aeruginosa PA01
caauggcggaauaacuca

SEQ ID NO: 3440441 - RNA, 12 nt, Pseudomonas aeruginosa PA01
caauggggcgcu

SEQ ID NO: 3440442 - RNA, 18 nt, Pseudomonas aeruginosa PA01
caauggggcggccggcgc

SEQ ID NO: 3440443 - RNA, 13 nt, Pseudomonas aeruginosa PA01
caauuccgccgcg

SEQ ID NO: 3440444 - RNA, 16 nt, Pseudomonas aeruginosa PA01
caauucgacgccgaaa

SEQ ID NO: 3440445 - RNA, 16 nt, Pseudomonas aeruginosa PA01
caauucgcggacgccg

SEQ ID NO: 3440446 - RNA, 18 nt, Pseudomonas aeruginosa PA01
caauucgcggacgccgaa

SEQ ID NO: 3440447 - RNA, 19 nt, Pseudomonas aeruginosa PA01
caauucgcggacgccgaag

SEQ ID NO: 3440448 - RNA, 13 nt, Pseudomonas aeruginosa PA01
caauucgucggcc

SEQ ID NO: 3440449 - RNA, 15 nt, Pseudomonas aeruginosa PA01
caauucuucaagguc

SEQ ID NO: 3440450 - RNA, 20 nt, Pseudomonas aeruginosa PA01
caauugccgcugcacgccuu

SEQ ID NO: 3440451 - RNA, 18 nt, Pseudomonas aeruginosa PA01
cacaaaaaaaccgccccg

SEQ ID NO: 3440452 - RNA, 18 nt, Pseudomonas aeruginosa PA01
cacaaaaaaggcggauga

SEQ ID NO: 3440453 - RNA, 22 nt, Pseudomonas aeruginosa PA01
cacaaccagccaugcaggcugc

SEQ ID NO: 3440454 - RNA, 19 nt, Pseudomonas aeruginosa PA01
cacaacgccuuccuugucg

SEQ ID NO: 3440455 - RNA, 15 nt, Pseudomonas aeruginosa PA01
cacacaugcaggucg

SEQ ID NO: 3440456 - RNA, 19 nt, Pseudomonas aeruginosa PA01
cacacaugcaggucgugca

SEQ ID NO: 3440457 - RNA, 20 nt, Pseudomonas aeruginosa PA01
cacacaugcaggucgugcag

SEQ ID NO: 3440458 - RNA, 12 nt, Pseudomonas aeruginosa PA01
cacaccaccagc

SEQ ID NO: 3440459 - RNA, 13 nt, Pseudomonas aeruginosa PA01
cacaccagcuccc

SEQ ID NO: 3440460 - RNA, 14 nt, Pseudomonas aeruginosa PA01
cacaccaggucgcc

SEQ ID NO: 3440461 - RNA, 20 nt, Pseudomonas aeruginosa PA01
cacaccgaagucgcccgccg

SEQ ID NO: 3440462 - RNA, 19 nt, Pseudomonas aeruginosa PA01
cacaccgacaaucgccgag

SEQ ID NO: 3440463 - RNA, 13 nt, Pseudomonas aeruginosa PA01
cacaccgaccgcg

SEQ ID NO: 3440464 - RNA, 14 nt, Pseudomonas aeruginosa PA01
cacaccgaccgcga

SEQ ID NO: 3440465 - RNA, 23 nt, Pseudomonas aeruginosa PA01
cacaccgagacgugaagccccug

SEQ ID NO: 3440466 - RNA, 12 nt, Pseudomonas aeruginosa PA01
cacaccgucgaa

SEQ ID NO: 3440467 - RNA, 16 nt, Pseudomonas aeruginosa PA01
cacaccuccagcggcu

SEQ ID NO: 3440468 - RNA, 12 nt, Pseudomonas aeruginosa PA01
cacaccuggucu

SEQ ID NO: 3440469 - RNA, 13 nt, Pseudomonas aeruginosa PA01
cacacgcccggca

SEQ ID NO: 3440470 - RNA, 22 nt, Pseudomonas aeruginosa PA01
cacacgcucccaacagucgucg

SEQ ID NO: 3440471 - RNA, 17 nt, Pseudomonas aeruginosa PA01
cacacuguccagggcga

SEQ ID NO: 3440472 - RNA, 12 nt, Pseudomonas aeruginosa PA01
cacagacgcagc

SEQ ID NO: 3440473 - RNA, 14 nt, Pseudomonas aeruginosa PA01
cacagaucgccagc

SEQ ID NO: 3440474 - RNA, 16 nt, Pseudomonas aeruginosa PA01
cacagaucgccagcuc

SEQ ID NO: 3440475 - RNA, 20 nt, Pseudomonas aeruginosa PA01
cacagaucgccagcucgccg

SEQ ID NO: 3440476 - RNA, 20 nt, Pseudomonas aeruginosa PA01
cacagcaccacgcuccugga

SEQ ID NO: 3440477 - RNA, 21 nt, Pseudomonas aeruginosa PA01
cacagcaccacgcuccuggaa

SEQ ID NO: 3440478 - RNA, 23 nt, Pseudomonas aeruginosa PA01
cacagcacgagcuuggccacucc

SEQ ID NO: 3440479 - RNA, 21 nt, Pseudomonas aeruginosa PA01
cacagcgcccagacacgccuc

SEQ ID NO: 3440480 - RNA, 18 nt, Pseudomonas aeruginosa PA01
cacagcggugggaagagc

SEQ ID NO: 3440481 - RNA, 16 nt, Pseudomonas aeruginosa PA01
cacagcguggccagcg

SEQ ID NO: 3440482 - RNA, 18 nt, Pseudomonas aeruginosa PA01
cacagcguggccagcgcc

SEQ ID NO: 3440483 - RNA, 19 nt, Pseudomonas aeruginosa PA01
cacagcguggccagcgccc

SEQ ID NO: 3440484 - RNA, 20 nt, Pseudomonas aeruginosa PA01
cacagcguggccagcgccca

SEQ ID NO: 3440485 - RNA, 17 nt, Pseudomonas aeruginosa PA01
cacagcugccagccccg

SEQ ID NO: 3440486 - RNA, 16 nt, Pseudomonas aeruginosa PA01
cacaggagcacggccg

SEQ ID NO: 3440487 - RNA, 18 nt, Pseudomonas aeruginosa PA01
cacaggcccugcagcgcc

SEQ ID NO: 3440488 - RNA, 17 nt, Pseudomonas aeruginosa PA01
cacaggcccuggaucac

SEQ ID NO: 3440489 - RNA, 21 nt, Pseudomonas aeruginosa PA01
cacaggcccuggaucaccgcg

SEQ ID NO: 3440490 - RNA, 22 nt, Pseudomonas aeruginosa PA01
cacaggcccuggaucaccgcgg

SEQ ID NO: 3440491 - RNA, 12 nt, Pseudomonas aeruginosa PA01
cacaggccggcu

SEQ ID NO: 3440492 - RNA, 20 nt, Pseudomonas aeruginosa PA01
cacaggcggaaggccucggu

SEQ ID NO: 3440493 - RNA, 17 nt, Pseudomonas aeruginosa PA01
cacaggcggcucaaaga

SEQ ID NO: 3440494 - RNA, 18 nt, Pseudomonas aeruginosa PA01
cacaggcguuauccgccg

SEQ ID NO: 3440495 - RNA, 21 nt, Pseudomonas aeruginosa PA01
cacaggcguuauccgccgaua

SEQ ID NO: 3440496 - RNA, 19 nt, Pseudomonas aeruginosa PA01
cacaggcguuauccgccgc

SEQ ID NO: 3440497 - RNA, 16 nt, Pseudomonas aeruginosa PA01
caccagagccagccgc

SEQ ID NO: 3440498 - RNA, 22 nt, Pseudomonas aeruginosa PA01
caccagauggcuggucaggcug

SEQ ID NO: 3440499 - RNA, 12 nt, Pseudomonas aeruginosa PA01
caccagcaauug

SEQ ID NO: 3440500 - RNA, 21 nt, Pseudomonas aeruginosa PA01
caccagcaauugccggcguga

SEQ ID NO: 3440501 - RNA, 22 nt, Pseudomonas aeruginosa PA01
caccagcaccacccggcgcacg

SEQ ID NO: 3440502 - RNA, 18 nt, Pseudomonas aeruginosa PA01
caccagcaccugcgggcu

SEQ ID NO: 3440503 - RNA, 16 nt, Pseudomonas aeruginosa PA01
caccagcacggugcug

SEQ ID NO: 3440504 - RNA, 19 nt, Pseudomonas aeruginosa PA01
caccagcacggugcuggcg

SEQ ID NO: 3440505 - RNA, 21 nt, Pseudomonas aeruginosa PA01
caccagcacguagccgcccuu

SEQ ID NO: 3440506 - RNA, 18 nt, Pseudomonas aeruginosa PA01
caccagcacuuccggcgc

SEQ ID NO: 3440507 - RNA, 20 nt, Pseudomonas aeruginosa PA01
caccagcacuuccggcgcgg

SEQ ID NO: 3440508 - RNA, 21 nt, Pseudomonas aeruginosa PA01
caccagcacuuccggcgcgga

SEQ ID NO: 3440509 - RNA, 12 nt, Pseudomonas aeruginosa PA01
caccagcagcaa

SEQ ID NO: 3440510 - RNA, 13 nt, Pseudomonas aeruginosa PA01
caccagcagcagc

SEQ ID NO: 3440511 - RNA, 14 nt, Pseudomonas aeruginosa PA01
caccagcagcagcg

SEQ ID NO: 3440512 - RNA, 16 nt, Pseudomonas aeruginosa PA01
caccagcagccccgag

SEQ ID NO: 3440513 - RNA, 10 nt, Pseudomonas aeruginosa PA01
caccagcagg

SEQ ID NO: 3440514 - RNA, 13 nt, Pseudomonas aeruginosa PA01
caccagcaggccg

SEQ ID NO: 3440515 - RNA, 14 nt, Pseudomonas aeruginosa PA01
caccagcaggccga

SEQ ID NO: 3440516 - RNA, 12 nt, Pseudomonas aeruginosa PA01
caccagcaggcg

SEQ ID NO: 3440517 - RNA, 17 nt, Pseudomonas aeruginosa PA01
caccagcagggccaggc

SEQ ID NO: 3440518 - RNA, 12 nt, Pseudomonas aeruginosa PA01
caccagcagguc

SEQ ID NO: 3440519 - RNA, 14 nt, Pseudomonas aeruginosa PA01
caccagcaucagca

SEQ ID NO: 3440520 - RNA, 15 nt, Pseudomonas aeruginosa PA01
caccagcaucagcag

SEQ ID NO: 3440521 - RNA, 13 nt, Pseudomonas aeruginosa PA01
caccagcaugccc

SEQ ID NO: 3440522 - RNA, 14 nt, Pseudomonas aeruginosa PA01
caccagccagcccg

SEQ ID NO: 3440523 - RNA, 14 nt, Pseudomonas aeruginosa PA01
caccagccaggcgg

SEQ ID NO: 3440524 - RNA, 17 nt, Pseudomonas aeruginosa PA01
caccagccaggcggcca

SEQ ID NO: 3440525 - RNA, 12 nt, Pseudomonas aeruginosa PA01
caccagccaggu

SEQ ID NO: 3440526 - RNA, 14 nt, Pseudomonas aeruginosa PA01
caccagccaggugu

SEQ ID NO: 3440527 - RNA, 23 nt, Pseudomonas aeruginosa PA01
caccagccagguguucggccccg

SEQ ID NO: 3440528 - RNA, 11 nt, Pseudomonas aeruginosa PA01
caccagccagu

SEQ ID NO: 3440529 - RNA, 20 nt, Pseudomonas aeruginosa PA01
caccagccaguccggcagca

SEQ ID NO: 3440530 - RNA, 11 nt, Pseudomonas aeruginosa PA01
caccagcccgc

SEQ ID NO: 3440531 - RNA, 14 nt, Pseudomonas aeruginosa PA01
caccagccggccgc

SEQ ID NO: 3440532 - RNA, 17 nt, Pseudomonas aeruginosa PA01
caccagccggccgcguc

SEQ ID NO: 3440533 - RNA, 19 nt, Pseudomonas aeruginosa PA01
caccagccuuccggcacca

SEQ ID NO: 3440534 - RNA, 19 nt, Pseudomonas aeruginosa PA01
caccagcgaaagcgucagc

SEQ ID NO: 3440535 - RNA, 21 nt, Pseudomonas aeruginosa PA01
caccagcgaagugcgcugcuu

SEQ ID NO: 3440536 - RNA, 22 nt, Pseudomonas aeruginosa PA01
caccagcgacgcgacauccucc

SEQ ID NO: 3440537 - RNA, 23 nt, Pseudomonas aeruginosa PA01
caccagcgagucgacccaggccc

SEQ ID NO: 3440538 - RNA, 18 nt, Pseudomonas aeruginosa PA01
caccagcgccaggccgcc

SEQ ID NO: 3440539 - RNA, 17 nt, Pseudomonas aeruginosa PA01
caccagcgcccguagca

SEQ ID NO: 3440540 - RNA, 14 nt, Pseudomonas aeruginosa PA01
caccagcgccgcca

SEQ ID NO: 3440541 - RNA, 20 nt, Pseudomonas aeruginosa PA01
caccagcgccgccaccgcca

SEQ ID NO: 3440542 - RNA, 15 nt, Pseudomonas aeruginosa PA01
caccagcgccgccag

SEQ ID NO: 3440543 - RNA, 16 nt, Pseudomonas aeruginosa PA01
caccagcgccgccagg

SEQ ID NO: 3440544 - RNA, 12 nt, Pseudomonas aeruginosa PA01
caccagcgccgg

SEQ ID NO: 3440545 - RNA, 14 nt, Pseudomonas aeruginosa PA01
caccagcgccggcg

SEQ ID NO: 3440546 - RNA, 17 nt, Pseudomonas aeruginosa PA01
caccagcgccggcggcg

SEQ ID NO: 3440547 - RNA, 18 nt, Pseudomonas aeruginosa PA01
caccagcgccggcggcgc

SEQ ID NO: 3440548 - RNA, 20 nt, Pseudomonas aeruginosa PA01
caccagcgccggcggcgcgu

SEQ ID NO: 3440549 - RNA, 13 nt, Pseudomonas aeruginosa PA01
caccagcgccggg

SEQ ID NO: 3440550 - RNA, 20 nt, Pseudomonas aeruginosa PA01
caccagcgccgucaccagca

SEQ ID NO: 3440551 - RNA, 19 nt, Pseudomonas aeruginosa PA01
caccagcggaccgucgggc

SEQ ID NO: 3440552 - RNA, 21 nt, Pseudomonas aeruginosa PA01
caccagcggaccgucgggcag

SEQ ID NO: 3440553 - RNA, 17 nt, Pseudomonas aeruginosa PA01
caccagcgggucgucga

SEQ ID NO: 3440554 - RNA, 23 nt, Pseudomonas aeruginosa PA01
caccagcggguucuugaagaagc

SEQ ID NO: 3440555 - RNA, 16 nt, Pseudomonas aeruginosa PA01
caccagcgucgccagg

SEQ ID NO: 3440556 - RNA, 19 nt, Pseudomonas aeruginosa PA01
caccagcgugggcaacagg

SEQ ID NO: 3440557 - RNA, 13 nt, Pseudomonas aeruginosa PA01
caccagcuccccg

SEQ ID NO: 3440558 - RNA, 15 nt, Pseudomonas aeruginosa PA01
caccagcuccccguc

SEQ ID NO: 3440559 - RNA, 12 nt, Pseudomonas aeruginosa PA01
caccagcucccg

SEQ ID NO: 3440560 - RNA, 13 nt, Pseudomonas aeruginosa PA01
caccaggacccag

SEQ ID NO: 3440561 - RNA, 20 nt, Pseudomonas aeruginosa PA01
caccaggacccagaugaucu

SEQ ID NO: 3440562 - RNA, 14 nt, Pseudomonas aeruginosa PA01
caccaggagcgcca

SEQ ID NO: 3440563 - RNA, 16 nt, Pseudomonas aeruginosa PA01
caccaggagcgccagc

SEQ ID NO: 3440564 - RNA, 21 nt, Pseudomonas aeruginosa PA01
caccaggagcgccagcaccag

SEQ ID NO: 3440565 - RNA, 12 nt, Pseudomonas aeruginosa PA01
caccaggccagg

SEQ ID NO: 3440566 - RNA, 14 nt, Pseudomonas aeruginosa PA01
caccaggccaggcu

SEQ ID NO: 3440567 - RNA, 19 nt, Pseudomonas aeruginosa PA01
caccaggccaggcugcgcu

SEQ ID NO: 3440568 - RNA, 13 nt, Pseudomonas aeruginosa PA01
caccaggcccgcc

SEQ ID NO: 3440569 - RNA, 16 nt, Pseudomonas aeruginosa PA01
caccaggcccgccggu

SEQ ID NO: 3440570 - RNA, 15 nt, Pseudomonas aeruginosa PA01
caccaggcccugcuc

SEQ ID NO: 3440571 - RNA, 17 nt, Pseudomonas aeruginosa PA01
caccaggcccugcuccu

SEQ ID NO: 3440572 - RNA, 12 nt, Pseudomonas aeruginosa PA01
caccaggccgau

SEQ ID NO: 3440573 - RNA, 19 nt, Pseudomonas aeruginosa PA01
caccaggccgaugaacgcc

SEQ ID NO: 3440574 - RNA, 23 nt, Pseudomonas aeruginosa PA01
caccaggccgaugaacgccgcga

SEQ ID NO: 3440575 - RNA, 13 nt, Pseudomonas aeruginosa PA01
caccaggccgcca

SEQ ID NO: 3440576 - RNA, 14 nt, Pseudomonas aeruginosa PA01
caccaggccgcugc

SEQ ID NO: 3440577 - RNA, 17 nt, Pseudomonas aeruginosa PA01
caccaggccucccagcc

SEQ ID NO: 3440578 - RNA, 15 nt, Pseudomonas aeruginosa PA01
caccaggcgaugcgc

SEQ ID NO: 3440579 - RNA, 19 nt, Pseudomonas aeruginosa PA01
caccaggcgaugcgccgga

SEQ ID NO: 3440580 - RNA, 14 nt, Pseudomonas aeruginosa PA01
caccaggcgccagg

SEQ ID NO: 3440581 - RNA, 15 nt, Pseudomonas aeruginosa PA01
caccaggcgccaggg

SEQ ID NO: 3440582 - RNA, 18 nt, Pseudomonas aeruginosa PA01
caccaggcgccagggacg

SEQ ID NO: 3440583 - RNA, 13 nt, Pseudomonas aeruginosa PA01
caccaggcgccgg

SEQ ID NO: 3440584 - RNA, 20 nt, Pseudomonas aeruginosa PA01
caccaggcgguacaccgcca

SEQ ID NO: 3440585 - RNA, 21 nt, Pseudomonas aeruginosa PA01
caccaggcgguacaccgccag

SEQ ID NO: 3440586 - RNA, 14 nt, Pseudomonas aeruginosa PA01
caccaggcucgccc

SEQ ID NO: 3440587 - RNA, 17 nt, Pseudomonas aeruginosa PA01
caccaggcucgccccgg

SEQ ID NO: 3440588 - RNA, 23 nt, Pseudomonas aeruginosa PA01
caccaggcucgccccggcggcga

SEQ ID NO: 3440589 - RNA, 14 nt, Pseudomonas aeruginosa PA01
caccaggcugccgc

SEQ ID NO: 3440590 - RNA, 15 nt, Pseudomonas aeruginosa PA01
caccaggcugccgcc

SEQ ID NO: 3440591 - RNA, 17 nt, Pseudomonas aeruginosa PA01
caccaggcugccgccgu

SEQ ID NO: 3440592 - RNA, 18 nt, Pseudomonas aeruginosa PA01
caccaggcuuacccgcga

SEQ ID NO: 3440593 - RNA, 20 nt, Pseudomonas aeruginosa PA01
caccaggcuuacccgcgacc

SEQ ID NO: 3440594 - RNA, 14 nt, Pseudomonas aeruginosa PA01
caccagggccagga

SEQ ID NO: 3440595 - RNA, 18 nt, Pseudomonas aeruginosa PA01
caccagggccucggggcc

SEQ ID NO: 3440596 - RNA, 21 nt, Pseudomonas aeruginosa PA01
caccagggccuugccgcgacc

SEQ ID NO: 3440597 - RNA, 11 nt, Pseudomonas aeruginosa PA01
caccagggcuu

SEQ ID NO: 3440598 - RNA, 19 nt, Pseudomonas aeruginosa PA01
caccagggcuucgcgcaga

SEQ ID NO: 3440599 - RNA, 17 nt, Pseudomonas aeruginosa PA01
caccaggguaucgcugu

SEQ ID NO: 3440600 - RNA, 22 nt, Pseudomonas aeruginosa PA01
caccaggguaucgcugucgccc

SEQ ID NO: 3440601 - RNA, 20 nt, Pseudomonas aeruginosa PA01
cacccgcgccgccgcggcca

SEQ ID NO: 3440602 - RNA, 14 nt, Pseudomonas aeruginosa PA01
cacccgcgccugca

SEQ ID NO: 3440603 - RNA, 16 nt, Pseudomonas aeruginosa PA01
cacccgcgccugcagg

SEQ ID NO: 3440604 - RNA, 13 nt, Pseudomonas aeruginosa PA01
cacccgcuccgcg

SEQ ID NO: 3440605 - RNA, 12 nt, Pseudomonas aeruginosa PA01
cacccgcuccgg

SEQ ID NO: 3440606 - RNA, 22 nt, Pseudomonas aeruginosa PA01
cacccgcuccggcucuccccgc

SEQ ID NO: 3440607 - RNA, 15 nt, Pseudomonas aeruginosa PA01
cacccgcucgaccuu

SEQ ID NO: 3440608 - RNA, 18 nt, Pseudomonas aeruginosa PA01
cacccgcucgaccuugcc

SEQ ID NO: 3440609 - RNA, 18 nt, Pseudomonas aeruginosa PA01
cacccggcccauggcgac

SEQ ID NO: 3440610 - RNA, 23 nt, Pseudomonas aeruginosa PA01
cacccggccgcgcucgacgguca

SEQ ID NO: 3440611 - RNA, 20 nt, Pseudomonas aeruginosa PA01
cacccggcgaagcuccucga

SEQ ID NO: 3440612 - RNA, 16 nt, Pseudomonas aeruginosa PA01
cacccggcgcacgccg

SEQ ID NO: 3440613 - RNA, 21 nt, Pseudomonas aeruginosa PA01
cacccggcgcacgccggccuc

SEQ ID NO: 3440614 - RNA, 12 nt, Pseudomonas aeruginosa PA01
cacccggcgccc

SEQ ID NO: 3440615 - RNA, 14 nt, Pseudomonas aeruginosa PA01
cacccggcgcccgg

SEQ ID NO: 3440616 - RNA, 15 nt, Pseudomonas aeruginosa PA01
cacccggcgcccggc

SEQ ID NO: 3440617 - RNA, 21 nt, Pseudomonas aeruginosa PA01
cacccggcgcccggcgcaugc

SEQ ID NO: 3440618 - RNA, 13 nt, Pseudomonas aeruginosa PA01
cacccggcggucc

SEQ ID NO: 3440619 - RNA, 18 nt, Pseudomonas aeruginosa PA01
cacccggcgguccgccgc

SEQ ID NO: 3440620 - RNA, 19 nt, Pseudomonas aeruginosa PA01
cacccggcgguccgccgcg

SEQ ID NO: 3440621 - RNA, 12 nt, Pseudomonas aeruginosa PA01
cacccggcugca

SEQ ID NO: 3440622 - RNA, 20 nt, Pseudomonas aeruginosa PA01
cacccggcuggguucggcga

SEQ ID NO: 3440623 - RNA, 11 nt, Pseudomonas aeruginosa PA01
cacccgggcga

SEQ ID NO: 3440624 - RNA, 14 nt, Pseudomonas aeruginosa PA01
cacccgggcgaccu

SEQ ID NO: 3440625 - RNA, 17 nt, Pseudomonas aeruginosa PA01
cacccgguugaccccgc

SEQ ID NO: 3440626 - RNA, 18 nt, Pseudomonas aeruginosa PA01
cacccgguugaccccgcg

SEQ ID NO: 3440627 - RNA, 19 nt, Pseudomonas aeruginosa PA01
cacccgguugaccccgcgg

SEQ ID NO: 3440628 - RNA, 18 nt, Pseudomonas aeruginosa PA01
cacccgucccgcgcgccg

SEQ ID NO: 3440629 - RNA, 20 nt, Pseudomonas aeruginosa PA01
cacccgucccgcgcgccgag

SEQ ID NO: 3440630 - RNA, 16 nt, Pseudomonas aeruginosa PA01
cacccguuccuugcgc

SEQ ID NO: 3440631 - RNA, 18 nt, Pseudomonas aeruginosa PA01
cacccguuccuugcgcgg

SEQ ID NO: 3440632 - RNA, 21 nt, Pseudomonas aeruginosa PA01
cacccguuccuugcgcggcag

SEQ ID NO: 3440633 - RNA, 23 nt, Pseudomonas aeruginosa PA01
cacccguuccuugcgcggcaggc

SEQ ID NO: 3440634 - RNA, 16 nt, Pseudomonas aeruginosa PA01
cacccguucgccggcc

SEQ ID NO: 3440635 - RNA, 14 nt, Pseudomonas aeruginosa PA01
cacccucggcuucg

SEQ ID NO: 3440636 - RNA, 14 nt, Pseudomonas aeruginosa PA01
cacccugccgcgcc

SEQ ID NO: 3440637 - RNA, 15 nt, Pseudomonas aeruginosa PA01
cacccugccgcgccg

SEQ ID NO: 3440638 - RNA, 17 nt, Pseudomonas aeruginosa PA01
cacccugccgcgccgga

SEQ ID NO: 3440639 - RNA, 11 nt, Pseudomonas aeruginosa PA01
cacccugcgcg

SEQ ID NO: 3440640 - RNA, 11 nt, Pseudomonas aeruginosa PA01
cacccugcugc

SEQ ID NO: 3440641 - RNA, 14 nt, Pseudomonas aeruginosa PA01
cacccugcugcugc

SEQ ID NO: 3440642 - RNA, 21 nt, Pseudomonas aeruginosa PA01
cacccugcugcugcucagcgc

SEQ ID NO: 3440643 - RNA, 16 nt, Pseudomonas aeruginosa PA01
cacccuggacccgggc

SEQ ID NO: 3440644 - RNA, 21 nt, Pseudomonas aeruginosa PA01
cacccuggcaccgauggcgug

SEQ ID NO: 3440645 - RNA, 22 nt, Pseudomonas aeruginosa PA01
cacccuggccacguccagcggc

SEQ ID NO: 3440646 - RNA, 16 nt, Pseudomonas aeruginosa PA01
cacccuugcgcccggc

SEQ ID NO: 3440647 - RNA, 18 nt, Pseudomonas aeruginosa PA01
cacccuugcguccugccu

SEQ ID NO: 3440648 - RNA, 19 nt, Pseudomonas aeruginosa PA01
cacccuugcguccugccuc

SEQ ID NO: 3440649 - RNA, 18 nt, Pseudomonas aeruginosa PA01
cacccuuggagccgcccu

SEQ ID NO: 3440650 - RNA, 19 nt, Pseudomonas aeruginosa PA01
cacccuuggagccgcccuc

SEQ ID NO: 3440651 - RNA, 14 nt, Pseudomonas aeruginosa PA01
cacccuuggcgcag

SEQ ID NO: 3440652 - RNA, 17 nt, Pseudomonas aeruginosa PA01
caccgaacuuccgccga

SEQ ID NO: 3440653 - RNA, 18 nt, Pseudomonas aeruginosa PA01
caccgaagcugaggccgg

SEQ ID NO: 3440654 - RNA, 18 nt, Pseudomonas aeruginosa PA01
caccgaagucgcccgccg

SEQ ID NO: 3440655 - RNA, 19 nt, Pseudomonas aeruginosa PA01
caccgaagucgcccgccgg

SEQ ID NO: 3440656 - RNA, 20 nt, Pseudomonas aeruginosa PA01
caccgaagucgcccgccggc

SEQ ID NO: 3440657 - RNA, 22 nt, Pseudomonas aeruginosa PA01
caccgaagucgcccgccggcgu

SEQ ID NO: 3440658 - RNA, 18 nt, Pseudomonas aeruginosa PA01
caccgacaaucgccgaga

SEQ ID NO: 3440659 - RNA, 17 nt, Pseudomonas aeruginosa PA01
caccgacagucccaggc

SEQ ID NO: 3440660 - RNA, 18 nt, Pseudomonas aeruginosa PA01
caccgacagucccaggcc

SEQ ID NO: 3440661 - RNA, 21 nt, Pseudomonas aeruginosa PA01
caccgacagucccaggccaac

SEQ ID NO: 3440662 - RNA, 14 nt, Pseudomonas aeruginosa PA01
caccgaccaccauc

SEQ ID NO: 3440663 - RNA, 15 nt, Pseudomonas aeruginosa PA01
caccgaccaccauca

SEQ ID NO: 3440664 - RNA, 15 nt, Pseudomonas aeruginosa PA01
caccgacccucggcg

SEQ ID NO: 3440665 - RNA, 14 nt, Pseudomonas aeruginosa PA01
caccgaccgcgagu

SEQ ID NO: 3440666 - RNA, 18 nt, Pseudomonas aeruginosa PA01
caccgacgaugggcacga

SEQ ID NO: 3440667 - RNA, 13 nt, Pseudomonas aeruginosa PA01
caccgacgccgcc

SEQ ID NO: 3440668 - RNA, 20 nt, Pseudomonas aeruginosa PA01
caccgacgggucgccauggu

SEQ ID NO: 3440669 - RNA, 22 nt, Pseudomonas aeruginosa PA01
caccgacgggucgccauggucg

SEQ ID NO: 3440670 - RNA, 13 nt, Pseudomonas aeruginosa PA01
caccgagaaccag

SEQ ID NO: 3440671 - RNA, 20 nt, Pseudomonas aeruginosa PA01
caccgagacgcccuggauga

SEQ ID NO: 3440672 - RNA, 16 nt, Pseudomonas aeruginosa PA01
caccgagagcggcgcc

SEQ ID NO: 3440673 - RNA, 16 nt, Pseudomonas aeruginosa PA01
caccgaggaucggcac

SEQ ID NO: 3440674 - RNA, 21 nt, Pseudomonas aeruginosa PA01
caccgaggcgcgccgacagca

SEQ ID NO: 3440675 - RNA, 22 nt, Pseudomonas aeruginosa PA01
caccgaggcgcgccgacagcac

SEQ ID NO: 3440676 - RNA, 12 nt, Pseudomonas aeruginosa PA01
caccgagggcag

SEQ ID NO: 3440677 - RNA, 20 nt, Pseudomonas aeruginosa PA01
caccgagguagucccagacc

SEQ ID NO: 3440678 - RNA, 20 nt, Pseudomonas aeruginosa PA01
caccgaguggcgcagcgccc

SEQ ID NO: 3440679 - RNA, 13 nt, Pseudomonas aeruginosa PA01
caccgaguugacc

SEQ ID NO: 3440680 - RNA, 14 nt, Pseudomonas aeruginosa PA01
caccgaguugacca

SEQ ID NO: 3440681 - RNA, 16 nt, Pseudomonas aeruginosa PA01
caccgauagcggcgcg

SEQ ID NO: 3440682 - RNA, 20 nt, Pseudomonas aeruginosa PA01
caccgauagcggcgcgaggc

SEQ ID NO: 3440683 - RNA, 14 nt, Pseudomonas aeruginosa PA01
caccgaucgcccgc

SEQ ID NO: 3440684 - RNA, 15 nt, Pseudomonas aeruginosa PA01
caccgaucgcccgcg

SEQ ID NO: 3440685 - RNA, 14 nt, Pseudomonas aeruginosa PA01
caccgaugccgaag

SEQ ID NO: 3440686 - RNA, 16 nt, Pseudomonas aeruginosa PA01
caccgaugccgaaggc

SEQ ID NO: 3440687 - RNA, 20 nt, Pseudomonas aeruginosa PA01
caccgaugccgaaggcgugg

SEQ ID NO: 3440688 - RNA, 13 nt, Pseudomonas aeruginosa PA01
caccgauggcgcg

SEQ ID NO: 3440689 - RNA, 15 nt, Pseudomonas aeruginosa PA01
caccgauggcgcgcu

SEQ ID NO: 3440690 - RNA, 15 nt, Pseudomonas aeruginosa PA01
caccgauucgccggc

SEQ ID NO: 3440691 - RNA, 16 nt, Pseudomonas aeruginosa PA01
caccgauucgccggcc

SEQ ID NO: 3440692 - RNA, 15 nt, Pseudomonas aeruginosa PA01
caccgauugcgcccu

SEQ ID NO: 3440693 - RNA, 17 nt, Pseudomonas aeruginosa PA01
caccgauuucagcggau

SEQ ID NO: 3440694 - RNA, 22 nt, Pseudomonas aeruginosa PA01
caccgauuuccccaaggcacgc

SEQ ID NO: 3440695 - RNA, 19 nt, Pseudomonas aeruginosa PA01
caccgcauaggucaugccc

SEQ ID NO: 3440696 - RNA, 18 nt, Pseudomonas aeruginosa PA01
caccgcauccucguucca

SEQ ID NO: 3440697 - RNA, 12 nt, Pseudomonas aeruginosa PA01
caccgcaucgaa

SEQ ID NO: 3440698 - RNA, 20 nt, Pseudomonas aeruginosa PA01
caccgcaucgaagcgcacca

SEQ ID NO: 3440699 - RNA, 15 nt, Pseudomonas aeruginosa PA01
caccgcaucgaaggc

SEQ ID NO: 3440700 - RNA, 22 nt, Pseudomonas aeruginosa PA01
caccgcaucgaaggcgccggca

SEQ ID NO: 3440701 - RNA, 13 nt, Pseudomonas aeruginosa PA01
caccgccaccagc

SEQ ID NO: 3440702 - RNA, 17 nt, Pseudomonas aeruginosa PA01
caccgccaccagcgagu

SEQ ID NO: 3440703 - RNA, 20 nt, Pseudomonas aeruginosa PA01
caccgccaccagcgagucga

SEQ ID NO: 3440704 - RNA, 21 nt, Pseudomonas aeruginosa PA01
caccggcagggcgauccgccc

SEQ ID NO: 3440705 - RNA, 22 nt, Pseudomonas aeruginosa PA01
caccggcagggcgauccgcccg

SEQ ID NO: 3440706 - RNA, 17 nt, Pseudomonas aeruginosa PA01
caccggcagugagaaga

SEQ ID NO: 3440707 - RNA, 19 nt, Pseudomonas aeruginosa PA01
caccggccacucgcagccg

SEQ ID NO: 3440708 - RNA, 16 nt, Pseudomonas aeruginosa PA01
caccggccaggcgcug

SEQ ID NO: 3440709 - RNA, 23 nt, Pseudomonas aeruginosa PA01
caccggccgcgccuucagcgcca

SEQ ID NO: 3440710 - RNA, 15 nt, Pseudomonas aeruginosa PA01
caccggccucaagca

SEQ ID NO: 3440711 - RNA, 13 nt, Pseudomonas aeruginosa PA01
caccggcgagcaa

SEQ ID NO: 3440712 - RNA, 21 nt, Pseudomonas aeruginosa PA01
caccggcgauggccggcacca

SEQ ID NO: 3440713 - RNA, 23 nt, Pseudomonas aeruginosa PA01
caccggcgauggccggcaccagc

SEQ ID NO: 3440714 - RNA, 13 nt, Pseudomonas aeruginosa PA01
caccggcgccgcc

SEQ ID NO: 3440715 - RNA, 17 nt, Pseudomonas aeruginosa PA01
caccggcgccgccuggc

SEQ ID NO: 3440716 - RNA, 23 nt, Pseudomonas aeruginosa PA01
caccggcggauuacuccgccggc

SEQ ID NO: 3440717 - RNA, 14 nt, Pseudomonas aeruginosa PA01
caccggcggcgcca

SEQ ID NO: 3440718 - RNA, 20 nt, Pseudomonas aeruginosa PA01
caccggcggcgccaggccgg

SEQ ID NO: 3440719 - RNA, 22 nt, Pseudomonas aeruginosa PA01
caccggcguccacuccggcagc

SEQ ID NO: 3440720 - RNA, 19 nt, Pseudomonas aeruginosa PA01
caccggcguuauccgccga

SEQ ID NO: 3440721 - RNA, 20 nt, Pseudomonas aeruginosa PA01
caccggcguuauccgccgau

SEQ ID NO: 3440722 - RNA, 16 nt, Pseudomonas aeruginosa PA01
caccggcucgcucucg

SEQ ID NO: 3440723 - RNA, 17 nt, Pseudomonas aeruginosa PA01
caccggcucgcucucga

SEQ ID NO: 3440724 - RNA, 18 nt, Pseudomonas aeruginosa PA01
caccggcucgcucucgaa

SEQ ID NO: 3440725 - RNA, 20 nt, Pseudomonas aeruginosa PA01
caccggcugcauguccgcca

SEQ ID NO: 3440726 - RNA, 21 nt, Pseudomonas aeruginosa PA01
caccggcugcauguccgccag

SEQ ID NO: 3440727 - RNA, 13 nt, Pseudomonas aeruginosa PA01
caccggcuggccg

SEQ ID NO: 3440728 - RNA, 17 nt, Pseudomonas aeruginosa PA01
caccggcuggcggcucg

SEQ ID NO: 3440729 - RNA, 20 nt, Pseudomonas aeruginosa PA01
caccgggaggcgccgcgcca

SEQ ID NO: 3440730 - RNA, 21 nt, Pseudomonas aeruginosa PA01
caccgggaggcgccgcgccag

SEQ ID NO: 3440731 - RNA, 23 nt, Pseudomonas aeruginosa PA01
caccgggaggcgccgcgccaggu

SEQ ID NO: 3440732 - RNA, 19 nt, Pseudomonas aeruginosa PA01
caccgggaucugccgguag

SEQ ID NO: 3440733 - RNA, 18 nt, Pseudomonas aeruginosa PA01
caccgggauggucgaggg

SEQ ID NO: 3440734 - RNA, 19 nt, Pseudomonas aeruginosa PA01
caccgggauggucgagggc

SEQ ID NO: 3440735 - RNA, 21 nt, Pseudomonas aeruginosa PA01
caccgggauggucgagggcgc

SEQ ID NO: 3440736 - RNA, 13 nt, Pseudomonas aeruginosa PA01
caccgggccaucg

SEQ ID NO: 3440737 - RNA, 13 nt, Pseudomonas aeruginosa PA01
caccgggccgacc

SEQ ID NO: 3440738 - RNA, 16 nt, Pseudomonas aeruginosa PA01
caccgggccgaccugc

SEQ ID NO: 3440739 - RNA, 17 nt, Pseudomonas aeruginosa PA01
caccgggccgaccugcc

SEQ ID NO: 3440740 - RNA, 20 nt, Pseudomonas aeruginosa PA01
caccgggccgaccugcccgc

SEQ ID NO: 3440741 - RNA, 21 nt, Pseudomonas aeruginosa PA01
caccgggccgaccugcccgcu

SEQ ID NO: 3440742 - RNA, 13 nt, Pseudomonas aeruginosa PA01
caccgggccgccg

SEQ ID NO: 3440743 - RNA, 15 nt, Pseudomonas aeruginosa PA01
caccgggccgccggc

SEQ ID NO: 3440744 - RNA, 16 nt, Pseudomonas aeruginosa PA01
caccgggccgccggcg

SEQ ID NO: 3440745 - RNA, 16 nt, Pseudomonas aeruginosa PA01
caccgggccgucgggc

SEQ ID NO: 3440746 - RNA, 19 nt, Pseudomonas aeruginosa PA01
caccggggccuucaggcgc

SEQ ID NO: 3440747 - RNA, 20 nt, Pseudomonas aeruginosa PA01
caccggggccuucaggcgcu

SEQ ID NO: 3440748 - RNA, 21 nt, Pseudomonas aeruginosa PA01
caccgggguguguuuccgaac

SEQ ID NO: 3440749 - RNA, 20 nt, Pseudomonas aeruginosa PA01
caccgggugcagguucaccg

SEQ ID NO: 3440750 - RNA, 16 nt, Pseudomonas aeruginosa PA01
caccgguacgcucacc

SEQ ID NO: 3440751 - RNA, 20 nt, Pseudomonas aeruginosa PA01
caccgguacgcucaccacca

SEQ ID NO: 3440752 - RNA, 23 nt, Pseudomonas aeruginosa PA01
caccgguacgcucaccaccaccg

SEQ ID NO: 3440753 - RNA, 19 nt, Pseudomonas aeruginosa PA01
caccgguagagggggagua

SEQ ID NO: 3440754 - RNA, 18 nt, Pseudomonas aeruginosa PA01
caccggucgagagggaua

SEQ ID NO: 3440755 - RNA, 19 nt, Pseudomonas aeruginosa PA01
caccggucuuggcgcgcga

SEQ ID NO: 3440756 - RNA, 18 nt, Pseudomonas aeruginosa PA01
caccgguggacugguuga

SEQ ID NO: 3440757 - RNA, 16 nt, Pseudomonas aeruginosa PA01
caccgguuucgccagu

SEQ ID NO: 3440758 - RNA, 13 nt, Pseudomonas aeruginosa PA01
caccgucaagggc

SEQ ID NO: 3440759 - RNA, 20 nt, Pseudomonas aeruginosa PA01
caccgucaagggccaggaaa

SEQ ID NO: 3440760 - RNA, 23 nt, Pseudomonas aeruginosa PA01
caccgucaccuguucggcgcuga

SEQ ID NO: 3440761 - RNA, 23 nt, Pseudomonas aeruginosa PA01
caccgucacggcgaaaccggcca

SEQ ID NO: 3440762 - RNA, 21 nt, Pseudomonas aeruginosa PA01
caccguccuucggccgcacca

SEQ ID NO: 3440763 - RNA, 22 nt, Pseudomonas aeruginosa PA01
caccguccuucggccgcaccag

SEQ ID NO: 3440764 - RNA, 14 nt, Pseudomonas aeruginosa PA01
caccgucgaaccag

SEQ ID NO: 3440765 - RNA, 15 nt, Pseudomonas aeruginosa PA01
caccgucgaaccagc

SEQ ID NO: 3440766 - RNA, 13 nt, Pseudomonas aeruginosa PA01
caccgucgcgguc

SEQ ID NO: 3440767 - RNA, 14 nt, Pseudomonas aeruginosa PA01
caccgucgcgguca

SEQ ID NO: 3440768 - RNA, 14 nt, Pseudomonas aeruginosa PA01
caccgucuggcgca

SEQ ID NO: 3440769 - RNA, 14 nt, Pseudomonas aeruginosa PA01
caccgugaccagca

SEQ ID NO: 3440770 - RNA, 20 nt, Pseudomonas aeruginosa PA01
caccgugcccgccggcgcgc

SEQ ID NO: 3440771 - RNA, 22 nt, Pseudomonas aeruginosa PA01
caccgugcccgccggcgcgccc

SEQ ID NO: 3440772 - RNA, 13 nt, Pseudomonas aeruginosa PA01
caccgugcgcacc

SEQ ID NO: 3440773 - RNA, 14 nt, Pseudomonas aeruginosa PA01
caccgugcgcgcgg

SEQ ID NO: 3440774 - RNA, 15 nt, Pseudomonas aeruginosa PA01
caccgugcgcgcggc

SEQ ID NO: 3440775 - RNA, 17 nt, Pseudomonas aeruginosa PA01
caccgugcgcgcggccu

SEQ ID NO: 3440776 - RNA, 21 nt, Pseudomonas aeruginosa PA01
caccguggagaggucgccgac

SEQ ID NO: 3440777 - RNA, 13 nt, Pseudomonas aeruginosa PA01
caccguggcgcca

SEQ ID NO: 3440778 - RNA, 14 nt, Pseudomonas aeruginosa PA01
caccguggcgccgg

SEQ ID NO: 3440779 - RNA, 15 nt, Pseudomonas aeruginosa PA01
caccguggcgccggc

SEQ ID NO: 3440780 - RNA, 16 nt, Pseudomonas aeruginosa PA01
caccguggcgccggcg

SEQ ID NO: 3440781 - RNA, 18 nt, Pseudomonas aeruginosa PA01
caccguggcgcuggccga

SEQ ID NO: 3440782 - RNA, 17 nt, Pseudomonas aeruginosa PA01
caccguggucagcacca

SEQ ID NO: 3440783 - RNA, 18 nt, Pseudomonas aeruginosa PA01
caccguggucagcaccag

SEQ ID NO: 3440784 - RNA, 23 nt, Pseudomonas aeruginosa PA01
caccguggucagcaccagggcca

SEQ ID NO: 3440785 - RNA, 17 nt, Pseudomonas aeruginosa PA01
caccguggucauggcgc

SEQ ID NO: 3440786 - RNA, 19 nt, Pseudomonas aeruginosa PA01
caccguggucauggcgcag

SEQ ID NO: 3440787 - RNA, 17 nt, Pseudomonas aeruginosa PA01
caccguguugaucgccg

SEQ ID NO: 3440788 - RNA, 18 nt, Pseudomonas aeruginosa PA01
caccguguugaucgccgc

SEQ ID NO: 3440789 - RNA, 14 nt, Pseudomonas aeruginosa PA01
caccguucccagca

SEQ ID NO: 3440790 - RNA, 17 nt, Pseudomonas aeruginosa PA01
caccguucccagcagcg

SEQ ID NO: 3440791 - RNA, 20 nt, Pseudomonas aeruginosa PA01
caccguucccagcagcgccu

SEQ ID NO: 3440792 - RNA, 21 nt, Pseudomonas aeruginosa PA01
caccguucuugaucaccgcgg

SEQ ID NO: 3440793 - RNA, 22 nt, Pseudomonas aeruginosa PA01
caccguucuugaucaccgcggu

SEQ ID NO: 3440794 - RNA, 23 nt, Pseudomonas aeruginosa PA01
caccguucuugaucaccgcggug

SEQ ID NO: 3440795 - RNA, 22 nt, Pseudomonas aeruginosa PA01
caccguuggcguuaugcgcccu

SEQ ID NO: 3440796 - RNA, 18 nt, Pseudomonas aeruginosa PA01
caccucaugcugcgcggg

SEQ ID NO: 3440797 - RNA, 20 nt, Pseudomonas aeruginosa PA01
caccucaugcugcgcgggac

SEQ ID NO: 3440798 - RNA, 18 nt, Pseudomonas aeruginosa PA01
caccucccccagcgggcg

SEQ ID NO: 3440799 - RNA, 16 nt, Pseudomonas aeruginosa PA01
caccuccucgggcgga

SEQ ID NO: 3440800 - RNA, 23 nt, Pseudomonas aeruginosa PA01
caccuccuguucgcgcgccucgc

SEQ ID NO: 3440801 - RNA, 19 nt, Pseudomonas aeruginosa PA01
caccuccuugggaucggcg

SEQ ID NO: 3440802 - RNA, 16 nt, Pseudomonas aeruginosa PA01
caccucgaaccccugg

SEQ ID NO: 3440803 - RNA, 22 nt, Pseudomonas aeruginosa PA01
caccucgaaccccuggcgcucg

SEQ ID NO: 3440804 - RNA, 23 nt, Pseudomonas aeruginosa PA01
caccucgaaggugugcagguugc

SEQ ID NO: 3440805 - RNA, 19 nt, Pseudomonas aeruginosa PA01
cacgaagaacgccagccca

SEQ ID NO: 3440806 - RNA, 12 nt, Pseudomonas aeruginosa PA01
cacgaagcgacc

SEQ ID NO: 3440807 - RNA, 14 nt, Pseudomonas aeruginosa PA01
cacgaagcgaccga

SEQ ID NO: 3440808 - RNA, 17 nt, Pseudomonas aeruginosa PA01
cacgaagcggucgccgg

SEQ ID NO: 3440809 - RNA, 21 nt, Pseudomonas aeruginosa PA01
cacgaagcggucgccggcgcg

SEQ ID NO: 3440810 - RNA, 12 nt, Pseudomonas aeruginosa PA01
cacgaaggcgau

SEQ ID NO: 3440811 - RNA, 15 nt, Pseudomonas aeruginosa PA01
cacgacccugcuggc

SEQ ID NO: 3440812 - RNA, 16 nt, Pseudomonas aeruginosa PA01
cacgacccugcuggcc

SEQ ID NO: 3440813 - RNA, 17 nt, Pseudomonas aeruginosa PA01
cacgacgaagcgccggc

SEQ ID NO: 3440814 - RNA, 15 nt, Pseudomonas aeruginosa PA01
cacgacgcacucaua

SEQ ID NO: 3440815 - RNA, 13 nt, Pseudomonas aeruginosa PA01
cacgacgucggcg

SEQ ID NO: 3440816 - RNA, 12 nt, Pseudomonas aeruginosa PA01
cacgacucaccc

SEQ ID NO: 3440817 - RNA, 18 nt, Pseudomonas aeruginosa PA01
cacgacucacccgcugcg

SEQ ID NO: 3440818 - RNA, 17 nt, Pseudomonas aeruginosa PA01
cacgagccgcugcggcu

SEQ ID NO: 3440819 - RNA, 21 nt, Pseudomonas aeruginosa PA01
cacgagccgcugcggcucgcc

SEQ ID NO: 3440820 - RNA, 22 nt, Pseudomonas aeruginosa PA01
cacgagccgcugcggcucgccg

SEQ ID NO: 3440821 - RNA, 23 nt, Pseudomonas aeruginosa PA01
cacgagccgcugcggcucgccga

SEQ ID NO: 3440822 - RNA, 17 nt, Pseudomonas aeruginosa PA01
cacgaggaugucggcga

SEQ ID NO: 3440823 - RNA, 23 nt, Pseudomonas aeruginosa PA01
cacgaggauuuccgcgcccggcu

SEQ ID NO: 3440824 - RNA, 17 nt, Pseudomonas aeruginosa PA01
cacgaggcgggcuggaa

SEQ ID NO: 3440825 - RNA, 16 nt, Pseudomonas aeruginosa PA01
cacgaucggcaccauc

SEQ ID NO: 3440826 - RNA, 20 nt, Pseudomonas aeruginosa PA01
cacgaucugcuugcgcgccg

SEQ ID NO: 3440827 - RNA, 22 nt, Pseudomonas aeruginosa PA01
cacgaucugcuugcgcgccgcc

SEQ ID NO: 3440828 - RNA, 23 nt, Pseudomonas aeruginosa PA01
cacgaucugcuugcgcgccgccg

SEQ ID NO: 3440829 - RNA, 12 nt, Pseudomonas aeruginosa PA01
cacgauggccgg

SEQ ID NO: 3440830 - RNA, 14 nt, Pseudomonas aeruginosa PA01
cacgauggccggca

SEQ ID NO: 3440831 - RNA, 17 nt, Pseudomonas aeruginosa PA01
cacgauggccggcagca

SEQ ID NO: 3440832 - RNA, 19 nt, Pseudomonas aeruginosa PA01
cacgauggccggcagcagc

SEQ ID NO: 3440833 - RNA, 20 nt, Pseudomonas aeruginosa PA01
cacgauggccggcagcagcg

SEQ ID NO: 3440834 - RNA, 21 nt, Pseudomonas aeruginosa PA01
cacgauggccggcagcagcgc

SEQ ID NO: 3440835 - RNA, 23 nt, Pseudomonas aeruginosa PA01
cacgauggccggcagcagcgcca

SEQ ID NO: 3440836 - RNA, 14 nt, Pseudomonas aeruginosa PA01
cacgauggcgagga

SEQ ID NO: 3440837 - RNA, 16 nt, Pseudomonas aeruginosa PA01
cacgaugucgaccugg

SEQ ID NO: 3440838 - RNA, 17 nt, Pseudomonas aeruginosa PA01
cacgaugucgaccuggg

SEQ ID NO: 3440839 - RNA, 19 nt, Pseudomonas aeruginosa PA01
cacgcaaccccgaaggauc

SEQ ID NO: 3440840 - RNA, 23 nt, Pseudomonas aeruginosa PA01
cacgcaauagugcagcuccaccg

SEQ ID NO: 3440841 - RNA, 19 nt, Pseudomonas aeruginosa PA01
cacgcaauggcgcagccgc

SEQ ID NO: 3440842 - RNA, 16 nt, Pseudomonas aeruginosa PA01
cacgcaccaccagguc

SEQ ID NO: 3440843 - RNA, 21 nt, Pseudomonas aeruginosa PA01
cacgcaccucgucgagcagcg

SEQ ID NO: 3440844 - RNA, 12 nt, Pseudomonas aeruginosa PA01
cacgcacucaua

SEQ ID NO: 3440845 - RNA, 13 nt, Pseudomonas aeruginosa PA01
cacgcagaaggcg

SEQ ID NO: 3440846 - RNA, 14 nt, Pseudomonas aeruginosa PA01
cacgcagaaggcgc

SEQ ID NO: 3440847 - RNA, 14 nt, Pseudomonas aeruginosa PA01
cacgcagacgucga

SEQ ID NO: 3440848 - RNA, 12 nt, Pseudomonas aeruginosa PA01
cacgcagcagcu

SEQ ID NO: 3440849 - RNA, 22 nt, Pseudomonas aeruginosa PA01
cacgcagcagcuucggcgcgac

SEQ ID NO: 3440850 - RNA, 16 nt, Pseudomonas aeruginosa PA01
cacgcagccacccgcg

SEQ ID NO: 3440851 - RNA, 14 nt, Pseudomonas aeruginosa PA01
cacgcagcgccgcg

SEQ ID NO: 3440852 - RNA, 18 nt, Pseudomonas aeruginosa PA01
cacgcaggaacagcuccu

SEQ ID NO: 3440853 - RNA, 14 nt, Pseudomonas aeruginosa PA01
cacgcaggccagcg

SEQ ID NO: 3440854 - RNA, 16 nt, Pseudomonas aeruginosa PA01
cacgcaggccagcgcc

SEQ ID NO: 3440855 - RNA, 17 nt, Pseudomonas aeruginosa PA01
cacgcaggccagcgcca

SEQ ID NO: 3440856 - RNA, 19 nt, Pseudomonas aeruginosa PA01
cacgcaggccagcgccagg

SEQ ID NO: 3440857 - RNA, 16 nt, Pseudomonas aeruginosa PA01
cacgcaggccgcugcc

SEQ ID NO: 3440858 - RNA, 19 nt, Pseudomonas aeruginosa PA01
cacgcaggcgccgauggcu

SEQ ID NO: 3440859 - RNA, 12 nt, Pseudomonas aeruginosa PA01
cacgcaggcgcg

SEQ ID NO: 3440860 - RNA, 17 nt, Pseudomonas aeruginosa PA01
cacgcaggcgcuggccg

SEQ ID NO: 3440861 - RNA, 15 nt, Pseudomonas aeruginosa PA01
cacgcaggcuuucca

SEQ ID NO: 3440862 - RNA, 20 nt, Pseudomonas aeruginosa PA01
cacgcaguacagcugcaccg

SEQ ID NO: 3440863 - RNA, 18 nt, Pseudomonas aeruginosa PA01
cacgcauugucgggcgua

SEQ ID NO: 3440864 - RNA, 20 nt, Pseudomonas aeruginosa PA01
cacgcauugucgggcguaga

SEQ ID NO: 3440865 - RNA, 17 nt, Pseudomonas aeruginosa PA01
cacgccauaggcggcgc

SEQ ID NO: 3440866 - RNA, 18 nt, Pseudomonas aeruginosa PA01
cacgccauccuccgaggc

SEQ ID NO: 3440867 - RNA, 20 nt, Pseudomonas aeruginosa PA01
cacgccauccuccgaggcca

SEQ ID NO: 3440868 - RNA, 13 nt, Pseudomonas aeruginosa PA01
cacgccauucgaa

SEQ ID NO: 3440869 - RNA, 21 nt, Pseudomonas aeruginosa PA01
cacgccauucgaauggcgccg

SEQ ID NO: 3440870 - RNA, 11 nt, Pseudomonas aeruginosa PA01
cacgcccaggc

SEQ ID NO: 3440871 - RNA, 13 nt, Pseudomonas aeruginosa PA01
cacgcccaggcgc

SEQ ID NO: 3440872 - RNA, 14 nt, Pseudomonas aeruginosa PA01
cacgcccaggcgcu

SEQ ID NO: 3440873 - RNA, 22 nt, Pseudomonas aeruginosa PA01
cacgcccaggcgcucggcgacc

SEQ ID NO: 3440874 - RNA, 21 nt, Pseudomonas aeruginosa PA01
cacgcccaguugcgccgccug

SEQ ID NO: 3440875 - RNA, 22 nt, Pseudomonas aeruginosa PA01
cacgcccaguugcgccgccugc

SEQ ID NO: 3440876 - RNA, 14 nt, Pseudomonas aeruginosa PA01
cacgcccaucgcca

SEQ ID NO: 3440877 - RNA, 20 nt, Pseudomonas aeruginosa PA01
cacgcccaucgccaccagca

SEQ ID NO: 3440878 - RNA, 19 nt, Pseudomonas aeruginosa PA01
cacgcccaucggcgucggc

SEQ ID NO: 3440879 - RNA, 23 nt, Pseudomonas aeruginosa PA01
cacgccccagaagccccagagcc

SEQ ID NO: 3440880 - RNA, 14 nt, Pseudomonas aeruginosa PA01
cacgccccagcgca

SEQ ID NO: 3440881 - RNA, 17 nt, Pseudomonas aeruginosa PA01
cacgccccagcgcaucg

SEQ ID NO: 3440882 - RNA, 20 nt, Pseudomonas aeruginosa PA01
cacgccccauccgggcggcg

SEQ ID NO: 3440883 - RNA, 22 nt, Pseudomonas aeruginosa PA01
cacgccccauccgggcggcggg

SEQ ID NO: 3440884 - RNA, 13 nt, Pseudomonas aeruginosa PA01
cacgcccgccgug

SEQ ID NO: 3440885 - RNA, 14 nt, Pseudomonas aeruginosa PA01
cacgcccggugucg

SEQ ID NO: 3440886 - RNA, 15 nt, Pseudomonas aeruginosa PA01
cacgcccggugucga

SEQ ID NO: 3440887 - RNA, 22 nt, Pseudomonas aeruginosa PA01
cacgcccugcaccuugggaucg

SEQ ID NO: 3440888 - RNA, 13 nt, Pseudomonas aeruginosa PA01
cacgcccugcgcc

SEQ ID NO: 3440889 - RNA, 14 nt, Pseudomonas aeruginosa PA01
cacgcccugcgcca

SEQ ID NO: 3440890 - RNA, 16 nt, Pseudomonas aeruginosa PA01
cacgcccugcgccagc

SEQ ID NO: 3440891 - RNA, 17 nt, Pseudomonas aeruginosa PA01
cacgcccugcgccagca

SEQ ID NO: 3440892 - RNA, 20 nt, Pseudomonas aeruginosa PA01
cacgcccugcgccagcaucg

SEQ ID NO: 3440893 - RNA, 22 nt, Pseudomonas aeruginosa PA01
cacgcccuguuucggguccagg

SEQ ID NO: 3440894 - RNA, 23 nt, Pseudomonas aeruginosa PA01
cacgcccuguuucggguccaggc

SEQ ID NO: 3440895 - RNA, 18 nt, Pseudomonas aeruginosa PA01
cacgcccuugcuguucgc

SEQ ID NO: 3440896 - RNA, 19 nt, Pseudomonas aeruginosa PA01
cacgccgaagucggcgagc

SEQ ID NO: 3440897 - RNA, 23 nt, Pseudomonas aeruginosa PA01
cacgccgaagucggcgagccggc

SEQ ID NO: 3440898 - RNA, 12 nt, Pseudomonas aeruginosa PA01
cacgccgagcaa

SEQ ID NO: 3440899 - RNA, 20 nt, Pseudomonas aeruginosa PA01
cacgccgagcaacggcagca

SEQ ID NO: 3440900 - RNA, 17 nt, Pseudomonas aeruginosa PA01
cacgccgaggcugcggg

SEQ ID NO: 3440901 - RNA, 14 nt, Pseudomonas aeruginosa PA01
cacgccgagggcgc

SEQ ID NO: 3440902 - RNA, 16 nt, Pseudomonas aeruginosa PA01
cacgccgagggcgcgg

SEQ ID NO: 3440903 - RNA, 19 nt, Pseudomonas aeruginosa PA01
cacgccgagggcgcggcgc

SEQ ID NO: 3440904 - RNA, 20 nt, Pseudomonas aeruginosa PA01
cacgccgagggcgcggcgcc

SEQ ID NO: 3440905 - RNA, 19 nt, Pseudomonas aeruginosa PA01
cacgccgaucccgaucggc

SEQ ID NO: 3440906 - RNA, 20 nt, Pseudomonas aeruginosa PA01
cacgccgaucccggcggcga

SEQ ID NO: 3440907 - RNA, 16 nt, Pseudomonas aeruginosa PA01
cacggaucgcgcuggg

SEQ ID NO: 3440908 - RNA, 19 nt, Pseudomonas aeruginosa PA01
cacggaucgcgcugggcgc

SEQ ID NO: 3440909 - RNA, 15 nt, Pseudomonas aeruginosa PA01
cacggaugcaguccc

SEQ ID NO: 3440910 - RNA, 18 nt, Pseudomonas aeruginosa PA01
cacggaugcagucccgcc

SEQ ID NO: 3440911 - RNA, 20 nt, Pseudomonas aeruginosa PA01
cacggaugcagucccgccag

SEQ ID NO: 3440912 - RNA, 17 nt, Pseudomonas aeruginosa PA01
cacggaugcccagccuc

SEQ ID NO: 3440913 - RNA, 15 nt, Pseudomonas aeruginosa PA01
cacggaugccgggcg

SEQ ID NO: 3440914 - RNA, 17 nt, Pseudomonas aeruginosa PA01
cacggcacacgucggca

SEQ ID NO: 3440915 - RNA, 16 nt, Pseudomonas aeruginosa PA01
cacggcauaaccgucg

SEQ ID NO: 3440916 - RNA, 20 nt, Pseudomonas aeruginosa PA01
cacggcauaaccgucgcugg

SEQ ID NO: 3440917 - RNA, 16 nt, Pseudomonas aeruginosa PA01
cacggcauccuggcgg

SEQ ID NO: 3440918 - RNA, 13 nt, Pseudomonas aeruginosa PA01
cacggccagcagg

SEQ ID NO: 3440919 - RNA, 18 nt, Pseudomonas aeruginosa PA01
cacggccaggccacggcc

SEQ ID NO: 3440920 - RNA, 13 nt, Pseudomonas aeruginosa PA01
cacggccaggccc

SEQ ID NO: 3440921 - RNA, 18 nt, Pseudomonas aeruginosa PA01
cacggccaggcccacgcc

SEQ ID NO: 3440922 - RNA, 23 nt, Pseudomonas aeruginosa PA01
cacggccgaacagacgcaggcag

SEQ ID NO: 3440923 - RNA, 12 nt, Pseudomonas aeruginosa PA01
cacggccucgcg

SEQ ID NO: 3440924 - RNA, 15 nt, Pseudomonas aeruginosa PA01
cacggccucgcgugc

SEQ ID NO: 3440925 - RNA, 20 nt, Pseudomonas aeruginosa PA01
cacggccucgcgugcgcugg

SEQ ID NO: 3440926 - RNA, 13 nt, Pseudomonas aeruginosa PA01
cacggccugcacc

SEQ ID NO: 3440927 - RNA, 14 nt, Pseudomonas aeruginosa PA01
cacggccuucggca

SEQ ID NO: 3440928 - RNA, 15 nt, Pseudomonas aeruginosa PA01
cacggccuucggcag

SEQ ID NO: 3440929 - RNA, 16 nt, Pseudomonas aeruginosa PA01
cacggccuucggcagg

SEQ ID NO: 3440930 - RNA, 17 nt, Pseudomonas aeruginosa PA01
cacggccuucggcagga

SEQ ID NO: 3440931 - RNA, 19 nt, Pseudomonas aeruginosa PA01
cacggcgaaaccggccagc

SEQ ID NO: 3440932 - RNA, 20 nt, Pseudomonas aeruginosa PA01
cacggcgaaaccggccagcg

SEQ ID NO: 3440933 - RNA, 22 nt, Pseudomonas aeruginosa PA01
cacggcgaaaccggccagcgcg

SEQ ID NO: 3440934 - RNA, 23 nt, Pseudomonas aeruginosa PA01
cacggcgaaaccggccagcgcgg

SEQ ID NO: 3440935 - RNA, 22 nt, Pseudomonas aeruginosa PA01
cacggcgaacaccgggccgccg

SEQ ID NO: 3440936 - RNA, 23 nt, Pseudomonas aeruginosa PA01
cacggcgaacaccgggccgccgg

SEQ ID NO: 3440937 - RNA, 17 nt, Pseudomonas aeruginosa PA01
cacggcgaagaacagcg

SEQ ID NO: 3440938 - RNA, 17 nt, Pseudomonas aeruginosa PA01
cacggcgaagccgcgcc

SEQ ID NO: 3440939 - RNA, 16 nt, Pseudomonas aeruginosa PA01
cacggcgaagcggccc

SEQ ID NO: 3440940 - RNA, 13 nt, Pseudomonas aeruginosa PA01
cacggcgacccgc

SEQ ID NO: 3440941 - RNA, 19 nt, Pseudomonas aeruginosa PA01
cacggcgacgaaggccugg

SEQ ID NO: 3440942 - RNA, 18 nt, Pseudomonas aeruginosa PA01
cacggcgagagcgccgac

SEQ ID NO: 3440943 - RNA, 19 nt, Pseudomonas aeruginosa PA01
cacggcgagagcgccgacc

SEQ ID NO: 3440944 - RNA, 22 nt, Pseudomonas aeruginosa PA01
cacggcgagagcgccgaccagc

SEQ ID NO: 3440945 - RNA, 19 nt, Pseudomonas aeruginosa PA01
cacggcgauacccaggccg

SEQ ID NO: 3440946 - RNA, 20 nt, Pseudomonas aeruginosa PA01
cacggcgauacccaggccgu

SEQ ID NO: 3440947 - RNA, 23 nt, Pseudomonas aeruginosa PA01
cacggcgauacccaggccgucga

SEQ ID NO: 3440948 - RNA, 20 nt, Pseudomonas aeruginosa PA01
cacggcgauggucaggacgc

SEQ ID NO: 3440949 - RNA, 17 nt, Pseudomonas aeruginosa PA01
cacggcgcagccgcaag

SEQ ID NO: 3440950 - RNA, 13 nt, Pseudomonas aeruginosa PA01
cacggcgccccgg

SEQ ID NO: 3440951 - RNA, 14 nt, Pseudomonas aeruginosa PA01
cacggcgccccggg

SEQ ID NO: 3440952 - RNA, 15 nt, Pseudomonas aeruginosa PA01
cacggcgccuuccca

SEQ ID NO: 3440953 - RNA, 16 nt, Pseudomonas aeruginosa PA01
cacggcgcgagaaaaa

SEQ ID NO: 3440954 - RNA, 14 nt, Pseudomonas aeruginosa PA01
cacggcgcgcuccg

SEQ ID NO: 3440955 - RNA, 19 nt, Pseudomonas aeruginosa PA01
cacggcgcgcuccggcgcg

SEQ ID NO: 3440956 - RNA, 22 nt, Pseudomonas aeruginosa PA01
cacggcgcgcuccggcgcgcca

SEQ ID NO: 3440957 - RNA, 12 nt, Pseudomonas aeruginosa PA01
cacggcgcggcc

SEQ ID NO: 3440958 - RNA, 15 nt, Pseudomonas aeruginosa PA01
cacggcgcuggucuc

SEQ ID NO: 3440959 - RNA, 14 nt, Pseudomonas aeruginosa PA01
cacggcggccucga

SEQ ID NO: 3440960 - RNA, 16 nt, Pseudomonas aeruginosa PA01
cacggcggccucgagg

SEQ ID NO: 3440961 - RNA, 14 nt, Pseudomonas aeruginosa PA01
cacggcgggacagg

SEQ ID NO: 3440962 - RNA, 15 nt, Pseudomonas aeruginosa PA01
cacggcgggacagga

SEQ ID NO: 3440963 - RNA, 13 nt, Pseudomonas aeruginosa PA01
cacggcgugccgc

SEQ ID NO: 3440964 - RNA, 16 nt, Pseudomonas aeruginosa PA01
cacggcgugccgcagg

SEQ ID NO: 3440965 - RNA, 18 nt, Pseudomonas aeruginosa PA01
cacggcgugccgcaggcc

SEQ ID NO: 3440966 - RNA, 19 nt, Pseudomonas aeruginosa PA01
cacggcgugccgcaggccg

SEQ ID NO: 3440967 - RNA, 22 nt, Pseudomonas aeruginosa PA01
cacggcgugccgcaggccgcgg

SEQ ID NO: 3440968 - RNA, 13 nt, Pseudomonas aeruginosa PA01
cacggcucggcga

SEQ ID NO: 3440969 - RNA, 15 nt, Pseudomonas aeruginosa PA01
cacggcucggcgagg

SEQ ID NO: 3440970 - RNA, 16 nt, Pseudomonas aeruginosa PA01
cacggcucggcgagga

SEQ ID NO: 3440971 - RNA, 22 nt, Pseudomonas aeruginosa PA01
cacggcucggcgaggaacagca

SEQ ID NO: 3440972 - RNA, 19 nt, Pseudomonas aeruginosa PA01
cacggcuucagcgccaggc

SEQ ID NO: 3440973 - RNA, 20 nt, Pseudomonas aeruginosa PA01
cacggcuucagcgccaggcc

SEQ ID NO: 3440974 - RNA, 21 nt, Pseudomonas aeruginosa PA01
cacggcuucagcgccaggccg

SEQ ID NO: 3440975 - RNA, 16 nt, Pseudomonas aeruginosa PA01
cacgggcagaccuucg

SEQ ID NO: 3440976 - RNA, 18 nt, Pseudomonas aeruginosa PA01
cacgggcgacccaggccg

SEQ ID NO: 3440977 - RNA, 19 nt, Pseudomonas aeruginosa PA01
cacgggcgacccaggccga

SEQ ID NO: 3440978 - RNA, 12 nt, Pseudomonas aeruginosa PA01
cacgggcggccg

SEQ ID NO: 3440979 - RNA, 22 nt, Pseudomonas aeruginosa PA01
cacggguaacgguagcggcagg

SEQ ID NO: 3440980 - RNA, 23 nt, Pseudomonas aeruginosa PA01
cacggguaacgguagcggcagga

SEQ ID NO: 3440981 - RNA, 15 nt, Pseudomonas aeruginosa PA01
cacgggucgcagccg

SEQ ID NO: 3440982 - RNA, 18 nt, Pseudomonas aeruginosa PA01
cacgggucgcagccgagc

SEQ ID NO: 3440983 - RNA, 16 nt, Pseudomonas aeruginosa PA01
cacgggucgucgcccu

SEQ ID NO: 3440984 - RNA, 22 nt, Pseudomonas aeruginosa PA01
cacgggucgucgcccuggccga

SEQ ID NO: 3440985 - RNA, 12 nt, Pseudomonas aeruginosa PA01
cacgguacacgc

SEQ ID NO: 3440986 - RNA, 19 nt, Pseudomonas aeruginosa PA01
cacgguagagacggcggcg

SEQ ID NO: 3440987 - RNA, 20 nt, Pseudomonas aeruginosa PA01
cacgguagagacggcggcga

SEQ ID NO: 3440988 - RNA, 13 nt, Pseudomonas aeruginosa PA01
cacgguagccgcc

SEQ ID NO: 3440989 - RNA, 16 nt, Pseudomonas aeruginosa PA01
cacggucagcucggca

SEQ ID NO: 3440990 - RNA, 20 nt, Pseudomonas aeruginosa PA01
cacggucauggccagcucga

SEQ ID NO: 3440991 - RNA, 23 nt, Pseudomonas aeruginosa PA01
cacggucauggccagcucgaccu

SEQ ID NO: 3440992 - RNA, 20 nt, Pseudomonas aeruginosa PA01
cacggucgagacccgcaaca

SEQ ID NO: 3440993 - RNA, 15 nt, Pseudomonas aeruginosa PA01
cacggucgcaggggc

SEQ ID NO: 3440994 - RNA, 19 nt, Pseudomonas aeruginosa PA01
cacggucuuggcggcgauc

SEQ ID NO: 3440995 - RNA, 17 nt, Pseudomonas aeruginosa PA01
cacggugaaccaggcgc

SEQ ID NO: 3440996 - RNA, 18 nt, Pseudomonas aeruginosa PA01
cacggugaaccaggcgcc

SEQ ID NO: 3440997 - RNA, 15 nt, Pseudomonas aeruginosa PA01
cacggugacacccug

SEQ ID NO: 3440998 - RNA, 17 nt, Pseudomonas aeruginosa PA01
cacggugacacccugcc

SEQ ID NO: 3440999 - RNA, 18 nt, Pseudomonas aeruginosa PA01
cacggugacacccugccg

SEQ ID NO: 3441000 - RNA, 22 nt, Pseudomonas aeruginosa PA01
cacggugacggugcagccaccc

SEQ ID NO: 3441001 - RNA, 13 nt, Pseudomonas aeruginosa PA01
cacggugaggacc

SEQ ID NO: 3441002 - RNA, 16 nt, Pseudomonas aeruginosa PA01
cacggugaggaccugg

SEQ ID NO: 3441003 - RNA, 19 nt, Pseudomonas aeruginosa PA01
cacggugaugguaucgccg

SEQ ID NO: 3441004 - RNA, 13 nt, Pseudomonas aeruginosa PA01
cacggugccaucc

SEQ ID NO: 3441005 - RNA, 17 nt, Pseudomonas aeruginosa PA01
cacgguguuguggcugg

SEQ ID NO: 3441006 - RNA, 15 nt, Pseudomonas aeruginosa PA01
cacguacguccaggg

SEQ ID NO: 3441007 - RNA, 15 nt, Pseudomonas aeruginosa PA01
cacguacuccagcaa

SEQ ID NO: 3441008 - RNA, 17 nt, Pseudomonas aeruginosa PA01
cacguagaugccggugc

SEQ ID NO: 3441009 - RNA, 14 nt, Pseudomonas aeruginosa PA01
cacguagcccccgc

SEQ ID NO: 3441010 - RNA, 17 nt, Pseudomonas aeruginosa PA01
cacugcuuggccaggcg

SEQ ID NO: 3441011 - RNA, 21 nt, Pseudomonas aeruginosa PA01
cacuggaaacgcccaucuuca

SEQ ID NO: 3441012 - RNA, 15 nt, Pseudomonas aeruginosa PA01
cacuggaacagcgcg

SEQ ID NO: 3441013 - RNA, 19 nt, Pseudomonas aeruginosa PA01
cacuggauggucacgccga

SEQ ID NO: 3441014 - RNA, 23 nt, Pseudomonas aeruginosa PA01
cacuggauggucacgccgaggcu

SEQ ID NO: 3441015 - RNA, 16 nt, Pseudomonas aeruginosa PA01
cacuggcgaggcugcg

SEQ ID NO: 3441016 - RNA, 14 nt, Pseudomonas aeruginosa PA01
cacuggcggaccgc

SEQ ID NO: 3441017 - RNA, 17 nt, Pseudomonas aeruginosa PA01
cacuggcggaccgccuc

SEQ ID NO: 3441018 - RNA, 19 nt, Pseudomonas aeruginosa PA01
cacuggcggaccgccucga

SEQ ID NO: 3441019 - RNA, 12 nt, Pseudomonas aeruginosa PA01
cacuggucggcc

SEQ ID NO: 3441020 - RNA, 22 nt, Pseudomonas aeruginosa PA01
cacugguggacggucucgccgc

SEQ ID NO: 3441021 - RNA, 23 nt, Pseudomonas aeruginosa PA01
cacugguggacggucucgccgcc

SEQ ID NO: 3441022 - RNA, 19 nt, Pseudomonas aeruginosa PA01
cacugguggcgaacagcac

SEQ ID NO: 3441023 - RNA, 15 nt, Pseudomonas aeruginosa PA01
cacuguccagggcga

SEQ ID NO: 3441024 - RNA, 19 nt, Pseudomonas aeruginosa PA01
cacuguccaugaaugccuu

SEQ ID NO: 3441025 - RNA, 21 nt, Pseudomonas aeruginosa PA01
cacuguuccucagccccucgc

SEQ ID NO: 3441026 - RNA, 19 nt, Pseudomonas aeruginosa PA01
cacuguuuuccauggcgag

SEQ ID NO: 3441027 - RNA, 22 nt, Pseudomonas aeruginosa PA01
cacuuaggcggauaacgccagg

SEQ ID NO: 3441028 - RNA, 20 nt, Pseudomonas aeruginosa PA01
cacuucacgacaggcggcgg

SEQ ID NO: 3441029 - RNA, 21 nt, Pseudomonas aeruginosa PA01
cacuucacgacaggcggcggg

SEQ ID NO: 3441030 - RNA, 16 nt, Pseudomonas aeruginosa PA01
cacuuccacuccaggc

SEQ ID NO: 3441031 - RNA, 14 nt, Pseudomonas aeruginosa PA01
cacuuccagguagc

SEQ ID NO: 3441032 - RNA, 18 nt, Pseudomonas aeruginosa PA01
cacuuccaguucguugcu

SEQ ID NO: 3441033 - RNA, 19 nt, Pseudomonas aeruginosa PA01
cacuucccaggugcccugg

SEQ ID NO: 3441034 - RNA, 14 nt, Pseudomonas aeruginosa PA01
cacuucccggcgca

SEQ ID NO: 3441035 - RNA, 22 nt, Pseudomonas aeruginosa PA01
cacuuccggacugcccagcgcc

SEQ ID NO: 3441036 - RNA, 19 nt, Pseudomonas aeruginosa PA01
cacuuccggcccggccagg

SEQ ID NO: 3441037 - RNA, 23 nt, Pseudomonas aeruginosa PA01
cacuuccggcccggccaggcgau

SEQ ID NO: 3441038 - RNA, 20 nt, Pseudomonas aeruginosa PA01
cacuuccgucacgcccugcc

SEQ ID NO: 3441039 - RNA, 12 nt, Pseudomonas aeruginosa PA01
cacuuccuugcg

SEQ ID NO: 3441040 - RNA, 12 nt, Pseudomonas aeruginosa PA01
cacuucgaagcc

SEQ ID NO: 3441041 - RNA, 16 nt, Pseudomonas aeruginosa PA01
cacuucgaccaguacg

SEQ ID NO: 3441042 - RNA, 22 nt, Pseudomonas aeruginosa PA01
cacuucgaccaguacgucgaga

SEQ ID NO: 3441043 - RNA, 15 nt, Pseudomonas aeruginosa PA01
cacuucgcgcggggu

SEQ ID NO: 3441044 - RNA, 20 nt, Pseudomonas aeruginosa PA01
cacuucggcgcgcggcagca

SEQ ID NO: 3441045 - RNA, 23 nt, Pseudomonas aeruginosa PA01
cacuucggcgguggggccgccga

SEQ ID NO: 3441046 - RNA, 21 nt, Pseudomonas aeruginosa PA01
cacuucgguggauucgaaggu

SEQ ID NO: 3441047 - RNA, 17 nt, Pseudomonas aeruginosa PA01
cacuucguccaggccgc

SEQ ID NO: 3441048 - RNA, 18 nt, Pseudomonas aeruginosa PA01
cacuucguccaggccgcc

SEQ ID NO: 3441049 - RNA, 17 nt, Pseudomonas aeruginosa PA01
cacuucguccggccgcc

SEQ ID NO: 3441050 - RNA, 19 nt, Pseudomonas aeruginosa PA01
cacuucguccggccgcccg

SEQ ID NO: 3441051 - RNA, 20 nt, Pseudomonas aeruginosa PA01
cacuucguccggccgcccga

SEQ ID NO: 3441052 - RNA, 20 nt, Pseudomonas aeruginosa PA01
cacuucucgaacagcuccuc

SEQ ID NO: 3441053 - RNA, 15 nt, Pseudomonas aeruginosa PA01
cacuugaggaagugc

SEQ ID NO: 3441054 - RNA, 13 nt, Pseudomonas aeruginosa PA01
cacuugccgccgc

SEQ ID NO: 3441055 - RNA, 22 nt, Pseudomonas aeruginosa PA01
cacuugccguccuucaggacga

SEQ ID NO: 3441056 - RNA, 14 nt, Pseudomonas aeruginosa PA01
cacuugcgccggcu

SEQ ID NO: 3441057 - RNA, 17 nt, Pseudomonas aeruginosa PA01
cacuugcgccggcugcc

SEQ ID NO: 3441058 - RNA, 18 nt, Pseudomonas aeruginosa PA01
cacuugcgccggcugccg

SEQ ID NO: 3441059 - RNA, 20 nt, Pseudomonas aeruginosa PA01
cacuugcgggugcgcaggcu

SEQ ID NO: 3441060 - RNA, 17 nt, Pseudomonas aeruginosa PA01
cagaaaccgaucagcac

SEQ ID NO: 3441061 - RNA, 15 nt, Pseudomonas aeruginosa PA01
cagaaacggcugccg

SEQ ID NO: 3441062 - RNA, 16 nt, Pseudomonas aeruginosa PA01
cagaaagccucaggcg

SEQ ID NO: 3441063 - RNA, 20 nt, Pseudomonas aeruginosa PA01
cagaaagccucaggcgcugc

SEQ ID NO: 3441064 - RNA, 13 nt, Pseudomonas aeruginosa PA01
cagaacacccggg

SEQ ID NO: 3441065 - RNA, 19 nt, Pseudomonas aeruginosa PA01
cagaacgaaaaaggcgcgc

SEQ ID NO: 3441066 - RNA, 22 nt, Pseudomonas aeruginosa PA01
cagaacgaaaaaggcgcgccgg

SEQ ID NO: 3441067 - RNA, 20 nt, Pseudomonas aeruginosa PA01
cagaacgcguaggggaccac

SEQ ID NO: 3441068 - RNA, 21 nt, Pseudomonas aeruginosa PA01
cagaacgcguaggggaccacc

SEQ ID NO: 3441069 - RNA, 21 nt, Pseudomonas aeruginosa PA01
cagaacgucggcggggugauc

SEQ ID NO: 3441070 - RNA, 16 nt, Pseudomonas aeruginosa PA01
cagaacugcucggcgu

SEQ ID NO: 3441071 - RNA, 19 nt, Pseudomonas aeruginosa PA01
cagaacugcucggcgucca

SEQ ID NO: 3441072 - RNA, 18 nt, Pseudomonas aeruginosa PA01
cagaacuugcgcaccgcg

SEQ ID NO: 3441073 - RNA, 23 nt, Pseudomonas aeruginosa PA01
cagaacuugcgcaccgcgccggg

SEQ ID NO: 3441074 - RNA, 19 nt, Pseudomonas aeruginosa PA01
cagaagacgcccagcaggg

SEQ ID NO: 3441075 - RNA, 21 nt, Pseudomonas aeruginosa PA01
cagaagacgcccagcagggcc

SEQ ID NO: 3441076 - RNA, 19 nt, Pseudomonas aeruginosa PA01
cagaagaucagcgcgguga

SEQ ID NO: 3441077 - RNA, 20 nt, Pseudomonas aeruginosa PA01
cagaagaucgccugcuggcc

SEQ ID NO: 3441078 - RNA, 19 nt, Pseudomonas aeruginosa PA01
cagaagccccagagcccgc

SEQ ID NO: 3441079 - RNA, 13 nt, Pseudomonas aeruginosa PA01
cagaagccgaccu

SEQ ID NO: 3441080 - RNA, 15 nt, Pseudomonas aeruginosa PA01
cagaagccgaccuug

SEQ ID NO: 3441081 - RNA, 15 nt, Pseudomonas aeruginosa PA01
cagaagccggccggg

SEQ ID NO: 3441082 - RNA, 16 nt, Pseudomonas aeruginosa PA01
cagaagccggccgggu

SEQ ID NO: 3441083 - RNA, 13 nt, Pseudomonas aeruginosa PA01
cagaaggccaggg

SEQ ID NO: 3441084 - RNA, 12 nt, Pseudomonas aeruginosa PA01
cagaaggccugc

SEQ ID NO: 3441085 - RNA, 23 nt, Pseudomonas aeruginosa PA01
cagaaggcuucuuccuggccggg

SEQ ID NO: 3441086 - RNA, 19 nt, Pseudomonas aeruginosa PA01
cagaagguaucggccaugg

SEQ ID NO: 3441087 - RNA, 19 nt, Pseudomonas aeruginosa PA01
cagaaguauuucaaccagg

SEQ ID NO: 3441088 - RNA, 17 nt, Pseudomonas aeruginosa PA01
cagaagucccagcgagu

SEQ ID NO: 3441089 - RNA, 21 nt, Pseudomonas aeruginosa PA01
cagaagucgcuggccuggggu

SEQ ID NO: 3441090 - RNA, 18 nt, Pseudomonas aeruginosa PA01
cagaaguugcuggcgauc

SEQ ID NO: 3441091 - RNA, 17 nt, Pseudomonas aeruginosa PA01
cagaaucucccgcaggc

SEQ ID NO: 3441092 - RNA, 22 nt, Pseudomonas aeruginosa PA01
cagaaugugccgguagcuggcc

SEQ ID NO: 3441093 - RNA, 16 nt, Pseudomonas aeruginosa PA01
cagaauuccagcaggu

SEQ ID NO: 3441094 - RNA, 13 nt, Pseudomonas aeruginosa PA01
cagacacaaaaaa

SEQ ID NO: 3441095 - RNA, 14 nt, Pseudomonas aeruginosa PA01
cagacacaaaaaac

SEQ ID NO: 3441096 - RNA, 13 nt, Pseudomonas aeruginosa PA01
cagacaccaccag

SEQ ID NO: 3441097 - RNA, 17 nt, Pseudomonas aeruginosa PA01
cagacacgccucaaggc

SEQ ID NO: 3441098 - RNA, 18 nt, Pseudomonas aeruginosa PA01
cagacacgccucaaggca

SEQ ID NO: 3441099 - RNA, 22 nt, Pseudomonas aeruginosa PA01
cagacacgccucaaggcaucgc

SEQ ID NO: 3441100 - RNA, 14 nt, Pseudomonas aeruginosa PA01
cagacagcccucca

SEQ ID NO: 3441101 - RNA, 19 nt, Pseudomonas aeruginosa PA01
cagacaggccagcucgccc

SEQ ID NO: 3441102 - RNA, 21 nt, Pseudomonas aeruginosa PA01
cagacaggccagcucgcccgc

SEQ ID NO: 3441103 - RNA, 17 nt, Pseudomonas aeruginosa PA01
cagacaggccuccagca

SEQ ID NO: 3441104 - RNA, 19 nt, Pseudomonas aeruginosa PA01
cagacaggccuccagcaac

SEQ ID NO: 3441105 - RNA, 21 nt, Pseudomonas aeruginosa PA01
cagacaucgccgagggcgaag

SEQ ID NO: 3441106 - RNA, 13 nt, Pseudomonas aeruginosa PA01
cagaccacccggc

SEQ ID NO: 3441107 - RNA, 14 nt, Pseudomonas aeruginosa PA01
cagaccacccggcu

SEQ ID NO: 3441108 - RNA, 20 nt, Pseudomonas aeruginosa PA01
cagaccacgaagcgaccgau

SEQ ID NO: 3441109 - RNA, 12 nt, Pseudomonas aeruginosa PA01
cagaccacgccc

SEQ ID NO: 3441110 - RNA, 15 nt, Pseudomonas aeruginosa PA01
cagaccacgcccugc

SEQ ID NO: 3441111 - RNA, 18 nt, Pseudomonas aeruginosa PA01
cagaccacgcccugcgcc

SEQ ID NO: 3441112 - RNA, 17 nt, Pseudomonas aeruginosa PA01
cagagcgcugccugcac

SEQ ID NO: 3441113 - RNA, 22 nt, Pseudomonas aeruginosa PA01
cagagcgcugccugcaccgggc

SEQ ID NO: 3441114 - RNA, 16 nt, Pseudomonas aeruginosa PA01
cagagcggcaggccgc

SEQ ID NO: 3441115 - RNA, 19 nt, Pseudomonas aeruginosa PA01
cagagcggcaggccgccga

SEQ ID NO: 3441116 - RNA, 16 nt, Pseudomonas aeruginosa PA01
cagagcggccaggucg

SEQ ID NO: 3441117 - RNA, 13 nt, Pseudomonas aeruginosa PA01
cagagcggccggc

SEQ ID NO: 3441118 - RNA, 14 nt, Pseudomonas aeruginosa PA01
cagagcggccggcg

SEQ ID NO: 3441119 - RNA, 16 nt, Pseudomonas aeruginosa PA01
cagagcggccggcgcg

SEQ ID NO: 3441120 - RNA, 17 nt, Pseudomonas aeruginosa PA01
cagagcggccggcgcgg

SEQ ID NO: 3441121 - RNA, 21 nt, Pseudomonas aeruginosa PA01
cagagcggccggcgcggcgcg

SEQ ID NO: 3441122 - RNA, 21 nt, Pseudomonas aeruginosa PA01
cagagcggugaaaccggcaag

SEQ ID NO: 3441123 - RNA, 19 nt, Pseudomonas aeruginosa PA01
cagagcguaucgaugcgcg

SEQ ID NO: 3441124 - RNA, 20 nt, Pseudomonas aeruginosa PA01
cagagcguaucgaugcgcgc

SEQ ID NO: 3441125 - RNA, 22 nt, Pseudomonas aeruginosa PA01
cagagcuggaagucguccagca

SEQ ID NO: 3441126 - RNA, 23 nt, Pseudomonas aeruginosa PA01
cagagcuggaagucguccagcag

SEQ ID NO: 3441127 - RNA, 13 nt, Pseudomonas aeruginosa PA01
cagaggaaggcgc

SEQ ID NO: 3441128 - RNA, 17 nt, Pseudomonas aeruginosa PA01
cagaggaaggcgccggc

SEQ ID NO: 3441129 - RNA, 13 nt, Pseudomonas aeruginosa PA01
cagaggcaacacc

SEQ ID NO: 3441130 - RNA, 20 nt, Pseudomonas aeruginosa PA01
cagaggcaacaccaucggcc

SEQ ID NO: 3441131 - RNA, 11 nt, Pseudomonas aeruginosa PA01
cagaggcgacc

SEQ ID NO: 3441132 - RNA, 15 nt, Pseudomonas aeruginosa PA01
cagaggcgaccagcc

SEQ ID NO: 3441133 - RNA, 17 nt, Pseudomonas aeruginosa PA01
cagaggcgaccagccgg

SEQ ID NO: 3441134 - RNA, 20 nt, Pseudomonas aeruginosa PA01
cagaggcgaccagccggggc

SEQ ID NO: 3441135 - RNA, 23 nt, Pseudomonas aeruginosa PA01
cagaggcgaccagccggggcgua

SEQ ID NO: 3441136 - RNA, 13 nt, Pseudomonas aeruginosa PA01
cagaggcgcucca

SEQ ID NO: 3441137 - RNA, 21 nt, Pseudomonas aeruginosa PA01
cagaggcgcuccaccagggcc

SEQ ID NO: 3441138 - RNA, 14 nt, Pseudomonas aeruginosa PA01
cagaggcugcgcuc

SEQ ID NO: 3441139 - RNA, 16 nt, Pseudomonas aeruginosa PA01
cagaggcugcgcucca

SEQ ID NO: 3441140 - RNA, 19 nt, Pseudomonas aeruginosa PA01
cagaggcugcgcuccaggc

SEQ ID NO: 3441141 - RNA, 12 nt, Pseudomonas aeruginosa PA01
cagagggcgaug

SEQ ID NO: 3441142 - RNA, 13 nt, Pseudomonas aeruginosa PA01
cagagggucgcca

SEQ ID NO: 3441143 - RNA, 14 nt, Pseudomonas aeruginosa PA01
cagagggucgccag

SEQ ID NO: 3441144 - RNA, 17 nt, Pseudomonas aeruginosa PA01
cagagggucgccagcga

SEQ ID NO: 3441145 - RNA, 18 nt, Pseudomonas aeruginosa PA01
cagagggucgccagcgag

SEQ ID NO: 3441146 - RNA, 16 nt, Pseudomonas aeruginosa PA01
cagagucgcaccggga

SEQ ID NO: 3441147 - RNA, 18 nt, Pseudomonas aeruginosa PA01
cagagucgcaccgggagg

SEQ ID NO: 3441148 - RNA, 14 nt, Pseudomonas aeruginosa PA01
cagagugcgcagca

SEQ ID NO: 3441149 - RNA, 15 nt, Pseudomonas aeruginosa PA01
cagagugcgcagcag

SEQ ID NO: 3441150 - RNA, 16 nt, Pseudomonas aeruginosa PA01
cagagugcgcagcagc

SEQ ID NO: 3441151 - RNA, 15 nt, Pseudomonas aeruginosa PA01
cagaguggcgcggcu

SEQ ID NO: 3441152 - RNA, 13 nt, Pseudomonas aeruginosa PA01
cagaguucgccca

SEQ ID NO: 3441153 - RNA, 20 nt, Pseudomonas aeruginosa PA01
cagaguugccuguccagcuc

SEQ ID NO: 3441154 - RNA, 22 nt, Pseudomonas aeruginosa PA01
cagaguugccuguccagcuccc

SEQ ID NO: 3441155 - RNA, 16 nt, Pseudomonas aeruginosa PA01
cagaguuuagccgcca

SEQ ID NO: 3441156 - RNA, 17 nt, Pseudomonas aeruginosa PA01
cagaguuuagccgccag

SEQ ID NO: 3441157 - RNA, 20 nt, Pseudomonas aeruginosa PA01
cagaguuucucggucgccgc

SEQ ID NO: 3441158 - RNA, 22 nt, Pseudomonas aeruginosa PA01
cagaguuucucggucgccgcca

SEQ ID NO: 3441159 - RNA, 23 nt, Pseudomonas aeruginosa PA01
cagaguuucucggucgccgccag

SEQ ID NO: 3441160 - RNA, 19 nt, Pseudomonas aeruginosa PA01
cagauaaagcuggaccacc

SEQ ID NO: 3441161 - RNA, 18 nt, Pseudomonas aeruginosa PA01
cagauaaccgauaucucc

SEQ ID NO: 3441162 - RNA, 19 nt, Pseudomonas aeruginosa PA01
cagauacuccagcagcgca

SEQ ID NO: 3441163 - RNA, 18 nt, Pseudomonas aeruginosa PA01
cagauagggcaucagccc

SEQ ID NO: 3441164 - RNA, 17 nt, Pseudomonas aeruginosa PA01
cagauagugcggccagg

SEQ ID NO: 3441165 - RNA, 18 nt, Pseudomonas aeruginosa PA01
cagauagugcggccaggc

SEQ ID NO: 3441166 - RNA, 18 nt, Pseudomonas aeruginosa PA01
cagauauccagggccagg

SEQ ID NO: 3441167 - RNA, 20 nt, Pseudomonas aeruginosa PA01
cagaucaccaccaccgucug

SEQ ID NO: 3441168 - RNA, 23 nt, Pseudomonas aeruginosa PA01
cagaucaccaccaccgucuggcg

SEQ ID NO: 3441169 - RNA, 20 nt, Pseudomonas aeruginosa PA01
cagaucauguagagcaggcu

SEQ ID NO: 3441170 - RNA, 13 nt, Pseudomonas aeruginosa PA01
cagauccagcggc

SEQ ID NO: 3441171 - RNA, 15 nt, Pseudomonas aeruginosa PA01
cagaucccaucgccc

SEQ ID NO: 3441172 - RNA, 20 nt, Pseudomonas aeruginosa PA01
cagaucgaggaccgacggca

SEQ ID NO: 3441173 - RNA, 21 nt, Pseudomonas aeruginosa PA01
cagaucgaggaccgacggcaa

SEQ ID NO: 3441174 - RNA, 22 nt, Pseudomonas aeruginosa PA01
cagaucgcauuguugcggucgc

SEQ ID NO: 3441175 - RNA, 13 nt, Pseudomonas aeruginosa PA01
cagaucgccaccc

SEQ ID NO: 3441176 - RNA, 14 nt, Pseudomonas aeruginosa PA01
cagaucgccagcgc

SEQ ID NO: 3441177 - RNA, 16 nt, Pseudomonas aeruginosa PA01
cagaucgccagcucgc

SEQ ID NO: 3441178 - RNA, 21 nt, Pseudomonas aeruginosa PA01
cagaucgccgcguagcgccag

SEQ ID NO: 3441179 - RNA, 22 nt, Pseudomonas aeruginosa PA01
cagaucgccgcguagcgccagg

SEQ ID NO: 3441180 - RNA, 17 nt, Pseudomonas aeruginosa PA01
cagaucgcggcgcaggc

SEQ ID NO: 3441181 - RNA, 19 nt, Pseudomonas aeruginosa PA01
cagaucgcguccagggugc

SEQ ID NO: 3441182 - RNA, 17 nt, Pseudomonas aeruginosa PA01
cagaucggcauggccga

SEQ ID NO: 3441183 - RNA, 20 nt, Pseudomonas aeruginosa PA01
cagaucggcauggccgaccg

SEQ ID NO: 3441184 - RNA, 12 nt, Pseudomonas aeruginosa PA01
cagaucggcgcg

SEQ ID NO: 3441185 - RNA, 14 nt, Pseudomonas aeruginosa PA01
cagaucggcgcgca

SEQ ID NO: 3441186 - RNA, 12 nt, Pseudomonas aeruginosa PA01
cagaucucccug

SEQ ID NO: 3441187 - RNA, 17 nt, Pseudomonas aeruginosa PA01
cagaugaaacugcccgg

SEQ ID NO: 3441188 - RNA, 18 nt, Pseudomonas aeruginosa PA01
cagaugacgauggccgcc

SEQ ID NO: 3441189 - RNA, 16 nt, Pseudomonas aeruginosa PA01
cagaugaucaggccga

SEQ ID NO: 3441190 - RNA, 17 nt, Pseudomonas aeruginosa PA01
cagaugcgcgucgccga

SEQ ID NO: 3441191 - RNA, 18 nt, Pseudomonas aeruginosa PA01
cagaugcgcgucgccgaa

SEQ ID NO: 3441192 - RNA, 14 nt, Pseudomonas aeruginosa PA01
cagaugcggggcga

SEQ ID NO: 3441193 - RNA, 14 nt, Pseudomonas aeruginosa PA01
cagaugcuccaggg

SEQ ID NO: 3441194 - RNA, 19 nt, Pseudomonas aeruginosa PA01
cagaugcuccagggagcgc

SEQ ID NO: 3441195 - RNA, 17 nt, Pseudomonas aeruginosa PA01
cagaugcuugcacaccu

SEQ ID NO: 3441196 - RNA, 15 nt, Pseudomonas aeruginosa PA01
cagauggcuggucag

SEQ ID NO: 3441197 - RNA, 13 nt, Pseudomonas aeruginosa PA01
cagauggucgccg

SEQ ID NO: 3441198 - RNA, 16 nt, Pseudomonas aeruginosa PA01
cagaugucggucaugc

SEQ ID NO: 3441199 - RNA, 18 nt, Pseudomonas aeruginosa PA01
cagcaaacccgggcccaa

SEQ ID NO: 3441200 - RNA, 19 nt, Pseudomonas aeruginosa PA01
cagcaaagcgcagguagcg

SEQ ID NO: 3441201 - RNA, 15 nt, Pseudomonas aeruginosa PA01
cagcaacaccgcgca

SEQ ID NO: 3441202 - RNA, 15 nt, Pseudomonas aeruginosa PA01
cagcaacagcgccgc

SEQ ID NO: 3441203 - RNA, 20 nt, Pseudomonas aeruginosa PA01
cagcaacagcgccgcgcgcu

SEQ ID NO: 3441204 - RNA, 15 nt, Pseudomonas aeruginosa PA01
cagcaacgccgcccc

SEQ ID NO: 3441205 - RNA, 17 nt, Pseudomonas aeruginosa PA01
cagcaacgccgccccca

SEQ ID NO: 3441206 - RNA, 23 nt, Pseudomonas aeruginosa PA01
cagcaacgccgcccccagcgcgc

SEQ ID NO: 3441207 - RNA, 17 nt, Pseudomonas aeruginosa PA01
cagcaacgugaagcccu

SEQ ID NO: 3441208 - RNA, 17 nt, Pseudomonas aeruginosa PA01
cagcaacucgccgccga

SEQ ID NO: 3441209 - RNA, 18 nt, Pseudomonas aeruginosa PA01
cagcaacucgccgccgac

SEQ ID NO: 3441210 - RNA, 23 nt, Pseudomonas aeruginosa PA01
cagcaacugaccuggccgucccu

SEQ ID NO: 3441211 - RNA, 17 nt, Pseudomonas aeruginosa PA01
cagcaacugccaaccgc

SEQ ID NO: 3441212 - RNA, 13 nt, Pseudomonas aeruginosa PA01
cagcaacuggucg

SEQ ID NO: 3441213 - RNA, 14 nt, Pseudomonas aeruginosa PA01
cagcaacuggucgc

SEQ ID NO: 3441214 - RNA, 16 nt, Pseudomonas aeruginosa PA01
cagcaacuggucgccg

SEQ ID NO: 3441215 - RNA, 17 nt, Pseudomonas aeruginosa PA01
cagcacggcgauaccca

SEQ ID NO: 3441216 - RNA, 20 nt, Pseudomonas aeruginosa PA01
cagcacggcgauacccaggc

SEQ ID NO: 3441217 - RNA, 15 nt, Pseudomonas aeruginosa PA01
cagcacggcgcaggg

SEQ ID NO: 3441218 - RNA, 16 nt, Pseudomonas aeruginosa PA01
cagcacggcgcagggc

SEQ ID NO: 3441219 - RNA, 12 nt, Pseudomonas aeruginosa PA01
cagcacggcggc

SEQ ID NO: 3441220 - RNA, 14 nt, Pseudomonas aeruginosa PA01
cagcacgguacacg

SEQ ID NO: 3441221 - RNA, 16 nt, Pseudomonas aeruginosa PA01
cagcacgguguugugg

SEQ ID NO: 3441222 - RNA, 17 nt, Pseudomonas aeruginosa PA01
cagcacgguguuguggc

SEQ ID NO: 3441223 - RNA, 20 nt, Pseudomonas aeruginosa PA01
cagcacgucgauauccagcg

SEQ ID NO: 3441224 - RNA, 22 nt, Pseudomonas aeruginosa PA01
cagcacgucgauauccagcggc

SEQ ID NO: 3441225 - RNA, 23 nt, Pseudomonas aeruginosa PA01
cagcacgucgauauccagcggca

SEQ ID NO: 3441226 - RNA, 18 nt, Pseudomonas aeruginosa PA01
cagcacgucguccagcgc

SEQ ID NO: 3441227 - RNA, 22 nt, Pseudomonas aeruginosa PA01
cagcacgucguccagcgccgag

SEQ ID NO: 3441228 - RNA, 23 nt, Pseudomonas aeruginosa PA01
cagcacgucguccagcgccgaga

SEQ ID NO: 3441229 - RNA, 15 nt, Pseudomonas aeruginosa PA01
cagcacgucuugcag

SEQ ID NO: 3441230 - RNA, 19 nt, Pseudomonas aeruginosa PA01
cagcacguugccauccagc

SEQ ID NO: 3441231 - RNA, 20 nt, Pseudomonas aeruginosa PA01
cagcacguugccauccagcg

SEQ ID NO: 3441232 - RNA, 17 nt, Pseudomonas aeruginosa PA01
cagcacuacgcccaugg

SEQ ID NO: 3441233 - RNA, 22 nt, Pseudomonas aeruginosa PA01
cagcacugguggacggucucgc

SEQ ID NO: 3441234 - RNA, 21 nt, Pseudomonas aeruginosa PA01
cagcacuuccugaaggcgcgg

SEQ ID NO: 3441235 - RNA, 22 nt, Pseudomonas aeruginosa PA01
cagcacuuccugaaggcgcggg

SEQ ID NO: 3441236 - RNA, 14 nt, Pseudomonas aeruginosa PA01
cagcacuucggcgc

SEQ ID NO: 3441237 - RNA, 16 nt, Pseudomonas aeruginosa PA01
cagcacuucggcgcgc

SEQ ID NO: 3441238 - RNA, 17 nt, Pseudomonas aeruginosa PA01
cagcacuucggcgcgcg

SEQ ID NO: 3441239 - RNA, 20 nt, Pseudomonas aeruginosa PA01
cagcacuucggcgcgcggca

SEQ ID NO: 3441240 - RNA, 15 nt, Pseudomonas aeruginosa PA01
cagcagacgcuccuu

SEQ ID NO: 3441241 - RNA, 15 nt, Pseudomonas aeruginosa PA01
cagcagacggcacga

SEQ ID NO: 3441242 - RNA, 17 nt, Pseudomonas aeruginosa PA01
cagcagacggcacgacg

SEQ ID NO: 3441243 - RNA, 13 nt, Pseudomonas aeruginosa PA01
cagcagagcgcca

SEQ ID NO: 3441244 - RNA, 16 nt, Pseudomonas aeruginosa PA01
cagcagcaacagcgcc

SEQ ID NO: 3441245 - RNA, 19 nt, Pseudomonas aeruginosa PA01
cagcagcaacagcgccgcg

SEQ ID NO: 3441246 - RNA, 20 nt, Pseudomonas aeruginosa PA01
cagcagcaacagcgccgcgc

SEQ ID NO: 3441247 - RNA, 21 nt, Pseudomonas aeruginosa PA01
cagcagcaacagcgccgcgcg

SEQ ID NO: 3441248 - RNA, 13 nt, Pseudomonas aeruginosa PA01
cagcagcaacucc

SEQ ID NO: 3441249 - RNA, 17 nt, Pseudomonas aeruginosa PA01
cagcagcaacuccagag

SEQ ID NO: 3441250 - RNA, 12 nt, Pseudomonas aeruginosa PA01
cagcagcaagcc

SEQ ID NO: 3441251 - RNA, 14 nt, Pseudomonas aeruginosa PA01
cagcagcaagccga

SEQ ID NO: 3441252 - RNA, 12 nt, Pseudomonas aeruginosa PA01
cagcagcaccau

SEQ ID NO: 3441253 - RNA, 13 nt, Pseudomonas aeruginosa PA01
cagcagcaccauc

SEQ ID NO: 3441254 - RNA, 14 nt, Pseudomonas aeruginosa PA01
cagcagcaccauca

SEQ ID NO: 3441255 - RNA, 18 nt, Pseudomonas aeruginosa PA01
cagcagcaccaucagcca

SEQ ID NO: 3441256 - RNA, 23 nt, Pseudomonas aeruginosa PA01
cagcagcaccaucagccagccca

SEQ ID NO: 3441257 - RNA, 15 nt, Pseudomonas aeruginosa PA01
cagcagcacccggac

SEQ ID NO: 3441258 - RNA, 16 nt, Pseudomonas aeruginosa PA01
cagcagcaccgcgagc

SEQ ID NO: 3441259 - RNA, 13 nt, Pseudomonas aeruginosa PA01
cagcagcacgccc

SEQ ID NO: 3441260 - RNA, 13 nt, Pseudomonas aeruginosa PA01
cagcagcagcgcc

SEQ ID NO: 3441261 - RNA, 15 nt, Pseudomonas aeruginosa PA01
cagcagcagcgccau

SEQ ID NO: 3441262 - RNA, 11 nt, Pseudomonas aeruginosa PA01
cagcagcaggc

SEQ ID NO: 3441263 - RNA, 14 nt, Pseudomonas aeruginosa PA01
cagcagcaggccgg

SEQ ID NO: 3441264 - RNA, 13 nt, Pseudomonas aeruginosa PA01
cagcagcaugccg

SEQ ID NO: 3441265 - RNA, 17 nt, Pseudomonas aeruginosa PA01
cagcagcaugccgcucu

SEQ ID NO: 3441266 - RNA, 23 nt, Pseudomonas aeruginosa PA01
cagcagcaugccgcucugccaga

SEQ ID NO: 3441267 - RNA, 20 nt, Pseudomonas aeruginosa PA01
cagcagcaugggauggcgcg

SEQ ID NO: 3441268 - RNA, 20 nt, Pseudomonas aeruginosa PA01
cagcagccaaggaugcgcca

SEQ ID NO: 3441269 - RNA, 14 nt, Pseudomonas aeruginosa PA01
cagcagccaggccu

SEQ ID NO: 3441270 - RNA, 13 nt, Pseudomonas aeruginosa PA01
cagcagccaggcg

SEQ ID NO: 3441271 - RNA, 12 nt, Pseudomonas aeruginosa PA01
cagcagccccga

SEQ ID NO: 3441272 - RNA, 15 nt, Pseudomonas aeruginosa PA01
cagcagccccgaggc

SEQ ID NO: 3441273 - RNA, 23 nt, Pseudomonas aeruginosa PA01
cagcagccccgaggccagcaggc

SEQ ID NO: 3441274 - RNA, 13 nt, Pseudomonas aeruginosa PA01
cagcagcccggcc

SEQ ID NO: 3441275 - RNA, 15 nt, Pseudomonas aeruginosa PA01
cagcagcccggccug

SEQ ID NO: 3441276 - RNA, 16 nt, Pseudomonas aeruginosa PA01
cagcagccggaccagc

SEQ ID NO: 3441277 - RNA, 23 nt, Pseudomonas aeruginosa PA01
cagcagccggaccagccguccgc

SEQ ID NO: 3441278 - RNA, 16 nt, Pseudomonas aeruginosa PA01
cagcagcgaacgccgc

SEQ ID NO: 3441279 - RNA, 15 nt, Pseudomonas aeruginosa PA01
cagcagcgaccugac

SEQ ID NO: 3441280 - RNA, 15 nt, Pseudomonas aeruginosa PA01
cagcagcgagcaggc

SEQ ID NO: 3441281 - RNA, 11 nt, Pseudomonas aeruginosa PA01
cagcagcgcca

SEQ ID NO: 3441282 - RNA, 15 nt, Pseudomonas aeruginosa PA01
cagcagcgccacgcu

SEQ ID NO: 3441283 - RNA, 14 nt, Pseudomonas aeruginosa PA01
cagcagcgccagca

SEQ ID NO: 3441284 - RNA, 17 nt, Pseudomonas aeruginosa PA01
cagcagcgccagcaggu

SEQ ID NO: 3441285 - RNA, 19 nt, Pseudomonas aeruginosa PA01
cagcagcgccagcaggucg

SEQ ID NO: 3441286 - RNA, 17 nt, Pseudomonas aeruginosa PA01
cagcagcgccgaacagg

SEQ ID NO: 3441287 - RNA, 12 nt, Pseudomonas aeruginosa PA01
cagcagcgccgc

SEQ ID NO: 3441288 - RNA, 13 nt, Pseudomonas aeruginosa PA01
cagcagcgccgcc

SEQ ID NO: 3441289 - RNA, 15 nt, Pseudomonas aeruginosa PA01
cagcagcgccgcccu

SEQ ID NO: 3441290 - RNA, 14 nt, Pseudomonas aeruginosa PA01
cagcagcgccgcga

SEQ ID NO: 3441291 - RNA, 16 nt, Pseudomonas aeruginosa PA01
cagcagcgccgcgaac

SEQ ID NO: 3441292 - RNA, 11 nt, Pseudomonas aeruginosa PA01
cagcagcgccu

SEQ ID NO: 3441293 - RNA, 20 nt, Pseudomonas aeruginosa PA01
cagcagcgccucggcaucga

SEQ ID NO: 3441294 - RNA, 12 nt, Pseudomonas aeruginosa PA01
cagcagcgccuu

SEQ ID NO: 3441295 - RNA, 21 nt, Pseudomonas aeruginosa PA01
cagcagcggauauucgacgcg

SEQ ID NO: 3441296 - RNA, 19 nt, Pseudomonas aeruginosa PA01
cagcagcggaucggcggug

SEQ ID NO: 3441297 - RNA, 21 nt, Pseudomonas aeruginosa PA01
cagcagcggcaaaggcccggc

SEQ ID NO: 3441298 - RNA, 20 nt, Pseudomonas aeruginosa PA01
cagcagcggcacccggcugg

SEQ ID NO: 3441299 - RNA, 13 nt, Pseudomonas aeruginosa PA01
cagcagcggcagc

SEQ ID NO: 3441300 - RNA, 15 nt, Pseudomonas aeruginosa PA01
cagcagcggcagcca

SEQ ID NO: 3441301 - RNA, 17 nt, Pseudomonas aeruginosa PA01
cagcagcggcagccacu

SEQ ID NO: 3441302 - RNA, 22 nt, Pseudomonas aeruginosa PA01
cagcagcggcgacaccgccagc

SEQ ID NO: 3441303 - RNA, 23 nt, Pseudomonas aeruginosa PA01
cagcagcggcgacaccgccagca

SEQ ID NO: 3441304 - RNA, 13 nt, Pseudomonas aeruginosa PA01
cagcagcggcggc

SEQ ID NO: 3441305 - RNA, 16 nt, Pseudomonas aeruginosa PA01
cagcagcggcggcgcc

SEQ ID NO: 3441306 - RNA, 18 nt, Pseudomonas aeruginosa PA01
cagcagcggcggcgccgg

SEQ ID NO: 3441307 - RNA, 22 nt, Pseudomonas aeruginosa PA01
cagcagcggcggcgccggcagg

SEQ ID NO: 3441308 - RNA, 18 nt, Pseudomonas aeruginosa PA01
cagcagcggcucacgccc

SEQ ID NO: 3441309 - RNA, 23 nt, Pseudomonas aeruginosa PA01
cagcagcggcucacgccccagcg

SEQ ID NO: 3441310 - RNA, 14 nt, Pseudomonas aeruginosa PA01
cagcagcgggcguc

SEQ ID NO: 3441311 - RNA, 16 nt, Pseudomonas aeruginosa PA01
cagcagcgggcguccg

SEQ ID NO: 3441312 - RNA, 22 nt, Pseudomonas aeruginosa PA01
cagcagcgggcguccggcgagc

SEQ ID NO: 3441313 - RNA, 22 nt, Pseudomonas aeruginosa PA01
cagcagcgguacggucgaggcg

SEQ ID NO: 3441314 - RNA, 21 nt, Pseudomonas aeruginosa PA01
cagcagcgucgcgucggccug

SEQ ID NO: 3441315 - RNA, 22 nt, Pseudomonas aeruginosa PA01
cagcagcuccauguccgaacgc

SEQ ID NO: 3441316 - RNA, 16 nt, Pseudomonas aeruginosa PA01
cagcagcuccgggcug

SEQ ID NO: 3441317 - RNA, 14 nt, Pseudomonas aeruginosa PA01
cagcagcucgacuu

SEQ ID NO: 3441318 - RNA, 13 nt, Pseudomonas aeruginosa PA01
cagcaggucgcgc

SEQ ID NO: 3441319 - RNA, 16 nt, Pseudomonas aeruginosa PA01
cagcaggucgcgcagu

SEQ ID NO: 3441320 - RNA, 20 nt, Pseudomonas aeruginosa PA01
cagcaggucgcgcaguucgu

SEQ ID NO: 3441321 - RNA, 21 nt, Pseudomonas aeruginosa PA01
cagcaggucgcggccccagca

SEQ ID NO: 3441322 - RNA, 16 nt, Pseudomonas aeruginosa PA01
cagcaggucgcggugc

SEQ ID NO: 3441323 - RNA, 18 nt, Pseudomonas aeruginosa PA01
cagcaggucggcagcguc

SEQ ID NO: 3441324 - RNA, 20 nt, Pseudomonas aeruginosa PA01
cagcaggucggcagcgucga

SEQ ID NO: 3441325 - RNA, 22 nt, Pseudomonas aeruginosa PA01
cagcaggucggcagcgucgagc

SEQ ID NO: 3441326 - RNA, 15 nt, Pseudomonas aeruginosa PA01
cagcaggucggccug

SEQ ID NO: 3441327 - RNA, 17 nt, Pseudomonas aeruginosa PA01
cagcaggucggccugcu

SEQ ID NO: 3441328 - RNA, 23 nt, Pseudomonas aeruginosa PA01
cagcaggucggccugcugcucga

SEQ ID NO: 3441329 - RNA, 15 nt, Pseudomonas aeruginosa PA01
cagcaggucggcgcg

SEQ ID NO: 3441330 - RNA, 16 nt, Pseudomonas aeruginosa PA01
cagcaggucggcgcga

SEQ ID NO: 3441331 - RNA, 17 nt, Pseudomonas aeruginosa PA01
cagcaggucgucggcga

SEQ ID NO: 3441332 - RNA, 19 nt, Pseudomonas aeruginosa PA01
cagcaggucgucggcgaaa

SEQ ID NO: 3441333 - RNA, 18 nt, Pseudomonas aeruginosa PA01
cagcaggucucaccgccc

SEQ ID NO: 3441334 - RNA, 23 nt, Pseudomonas aeruginosa PA01
cagcaggucuuccaccgcgucga

SEQ ID NO: 3441335 - RNA, 22 nt, Pseudomonas aeruginosa PA01
cagcagguggcaagccucgcgu

SEQ ID NO: 3441336 - RNA, 23 nt, Pseudomonas aeruginosa PA01
cagcagguggcuggucaguucgg

SEQ ID NO: 3441337 - RNA, 23 nt, Pseudomonas aeruginosa PA01
cagcagguggucgaugggcgagc

SEQ ID NO: 3441338 - RNA, 14 nt, Pseudomonas aeruginosa PA01
cagcagguuccucc

SEQ ID NO: 3441339 - RNA, 17 nt, Pseudomonas aeruginosa PA01
cagcagguuccuccugg

SEQ ID NO: 3441340 - RNA, 20 nt, Pseudomonas aeruginosa PA01
cagcagguuccuccugggcc

SEQ ID NO: 3441341 - RNA, 22 nt, Pseudomonas aeruginosa PA01
cagcagguuccuccugggccga

SEQ ID NO: 3441342 - RNA, 23 nt, Pseudomonas aeruginosa PA01
cagcagguucgaaugcugcccgg

SEQ ID NO: 3441343 - RNA, 13 nt, Pseudomonas aeruginosa PA01
cagcagguugacc

SEQ ID NO: 3441344 - RNA, 14 nt, Pseudomonas aeruginosa PA01
cagcagguugaccc

SEQ ID NO: 3441345 - RNA, 17 nt, Pseudomonas aeruginosa PA01
cagcagguugaccccgc

SEQ ID NO: 3441346 - RNA, 20 nt, Pseudomonas aeruginosa PA01
cagcagguugaccccgcggc

SEQ ID NO: 3441347 - RNA, 15 nt, Pseudomonas aeruginosa PA01
cagcagguugcuggc

SEQ ID NO: 3441348 - RNA, 17 nt, Pseudomonas aeruginosa PA01
cagcagguuggucugcu

SEQ ID NO: 3441349 - RNA, 17 nt, Pseudomonas aeruginosa PA01
cagcaguccgccauacc

SEQ ID NO: 3441350 - RNA, 20 nt, Pseudomonas aeruginosa PA01
cagcagucgcacagccaggg

SEQ ID NO: 3441351 - RNA, 17 nt, Pseudomonas aeruginosa PA01
cagcagucgcagcucgg

SEQ ID NO: 3441352 - RNA, 16 nt, Pseudomonas aeruginosa PA01
cagcagucgcggcccu

SEQ ID NO: 3441353 - RNA, 22 nt, Pseudomonas aeruginosa PA01
cagcagucguugacggugcugu

SEQ ID NO: 3441354 - RNA, 16 nt, Pseudomonas aeruginosa PA01
cagcagugcggggcgc

SEQ ID NO: 3441355 - RNA, 16 nt, Pseudomonas aeruginosa PA01
cagcaguuccaggcgu

SEQ ID NO: 3441356 - RNA, 18 nt, Pseudomonas aeruginosa PA01
cagcaguucgucgccacg

SEQ ID NO: 3441357 - RNA, 21 nt, Pseudomonas aeruginosa PA01
cagcaguucgucgccacgccc

SEQ ID NO: 3441358 - RNA, 23 nt, Pseudomonas aeruginosa PA01
cagcaguucgucgccacgcccgc

SEQ ID NO: 3441359 - RNA, 16 nt, Pseudomonas aeruginosa PA01
cagcaguugcaacagc

SEQ ID NO: 3441360 - RNA, 18 nt, Pseudomonas aeruginosa PA01
cagcaguugcaacagcgc

SEQ ID NO: 3441361 - RNA, 20 nt, Pseudomonas aeruginosa PA01
cagcauaaccccuuugccga

SEQ ID NO: 3441362 - RNA, 11 nt, Pseudomonas aeruginosa PA01
cagcaucacca

SEQ ID NO: 3441363 - RNA, 22 nt, Pseudomonas aeruginosa PA01
cagcaucaccuugcggaacccg

SEQ ID NO: 3441364 - RNA, 19 nt, Pseudomonas aeruginosa PA01
cagcaucagaggcaacacc

SEQ ID NO: 3441365 - RNA, 20 nt, Pseudomonas aeruginosa PA01
cagcaucagcaggaagcuga

SEQ ID NO: 3441366 - RNA, 14 nt, Pseudomonas aeruginosa PA01
cagcaucagccgcg

SEQ ID NO: 3441367 - RNA, 17 nt, Pseudomonas aeruginosa PA01
cagcaucaggcgcuccg

SEQ ID NO: 3441368 - RNA, 13 nt, Pseudomonas aeruginosa PA01
cagcaucaggucg

SEQ ID NO: 3441369 - RNA, 13 nt, Pseudomonas aeruginosa PA01
cagcauccagcga

SEQ ID NO: 3441370 - RNA, 14 nt, Pseudomonas aeruginosa PA01
cagcaucgcaucgg

SEQ ID NO: 3441371 - RNA, 19 nt, Pseudomonas aeruginosa PA01
cagcaucgccggcagcgcc

SEQ ID NO: 3441372 - RNA, 22 nt, Pseudomonas aeruginosa PA01
cagcaucguagggagcgacacc

SEQ ID NO: 3441373 - RNA, 17 nt, Pseudomonas aeruginosa PA01
cagcaucucggugcgcc

SEQ ID NO: 3441374 - RNA, 18 nt, Pseudomonas aeruginosa PA01
cagcaucucggugcgccc

SEQ ID NO: 3441375 - RNA, 23 nt, Pseudomonas aeruginosa PA01
cagcaucucggugcgccccaggu

SEQ ID NO: 3441376 - RNA, 21 nt, Pseudomonas aeruginosa PA01
cagcaucugcugguccuggcg

SEQ ID NO: 3441377 - RNA, 22 nt, Pseudomonas aeruginosa PA01
cagcaucugcugguccuggcgc

SEQ ID NO: 3441378 - RNA, 16 nt, Pseudomonas aeruginosa PA01
cagcaucuucucggcg

SEQ ID NO: 3441379 - RNA, 14 nt, Pseudomonas aeruginosa PA01
cagcaugcccagcg

SEQ ID NO: 3441380 - RNA, 19 nt, Pseudomonas aeruginosa PA01
cagcaugcucgggcugccg

SEQ ID NO: 3441381 - RNA, 21 nt, Pseudomonas aeruginosa PA01
cagcaugcucgggcugccgca

SEQ ID NO: 3441382 - RNA, 23 nt, Pseudomonas aeruginosa PA01
cagcaugggauggcgcgguccgc

SEQ ID NO: 3441383 - RNA, 13 nt, Pseudomonas aeruginosa PA01
cagcauggggcgg

SEQ ID NO: 3441384 - RNA, 22 nt, Pseudomonas aeruginosa PA01
cagcauguuguuauggccgacc

SEQ ID NO: 3441385 - RNA, 23 nt, Pseudomonas aeruginosa PA01
cagcauguuguuauggccgaccc

SEQ ID NO: 3441386 - RNA, 22 nt, Pseudomonas aeruginosa PA01
cagcauuaccccgaccaggucg

SEQ ID NO: 3441387 - RNA, 18 nt, Pseudomonas aeruginosa PA01
cagccacccagcagcaac

SEQ ID NO: 3441388 - RNA, 18 nt, Pseudomonas aeruginosa PA01
cagccaccugcucgcuga

SEQ ID NO: 3441389 - RNA, 14 nt, Pseudomonas aeruginosa PA01
cagccacgaagccu

SEQ ID NO: 3441390 - RNA, 15 nt, Pseudomonas aeruginosa PA01
cagccacggacgcgc

SEQ ID NO: 3441391 - RNA, 23 nt, Pseudomonas aeruginosa PA01
cagccacggacgcgcagggucag

SEQ ID NO: 3441392 - RNA, 18 nt, Pseudomonas aeruginosa PA01
cagccacggcacacgucg

SEQ ID NO: 3441393 - RNA, 20 nt, Pseudomonas aeruginosa PA01
cagccacggcacacgucggc

SEQ ID NO: 3441394 - RNA, 17 nt, Pseudomonas aeruginosa PA01
cagccacgggcgccagc

SEQ ID NO: 3441395 - RNA, 18 nt, Pseudomonas aeruginosa PA01
cagccacgggcgccagcg

SEQ ID NO: 3441396 - RNA, 19 nt, Pseudomonas aeruginosa PA01
cagccacgggcgccagcgg

SEQ ID NO: 3441397 - RNA, 20 nt, Pseudomonas aeruginosa PA01
cagccacgggcgccagcggu

SEQ ID NO: 3441398 - RNA, 20 nt, Pseudomonas aeruginosa PA01
cagccacucccggcccuuga

SEQ ID NO: 3441399 - RNA, 16 nt, Pseudomonas aeruginosa PA01
cagccacucggccagg

SEQ ID NO: 3441400 - RNA, 13 nt, Pseudomonas aeruginosa PA01
cagccacugccgc

SEQ ID NO: 3441401 - RNA, 15 nt, Pseudomonas aeruginosa PA01
cagccacugcuuggc

SEQ ID NO: 3441402 - RNA, 20 nt, Pseudomonas aeruginosa PA01
cagccacugcuuggcgaacu

SEQ ID NO: 3441403 - RNA, 12 nt, Pseudomonas aeruginosa PA01
cagccacuggcg

SEQ ID NO: 3441404 - RNA, 14 nt, Pseudomonas aeruginosa PA01
cagccacuggcgga

SEQ ID NO: 3441405 - RNA, 22 nt, Pseudomonas aeruginosa PA01
cagccacuggcggaccgccucg

SEQ ID NO: 3441406 - RNA, 23 nt, Pseudomonas aeruginosa PA01
cagccacuguccaugaaugccuu

SEQ ID NO: 3441407 - RNA, 13 nt, Pseudomonas aeruginosa PA01
cagccagaccggc

SEQ ID NO: 3441408 - RNA, 15 nt, Pseudomonas aeruginosa PA01
cagccagaccggcag

SEQ ID NO: 3441409 - RNA, 17 nt, Pseudomonas aeruginosa PA01
cagccagaccggcagcg

SEQ ID NO: 3441410 - RNA, 23 nt, Pseudomonas aeruginosa PA01
cagccagaccggcagcgccgcca

SEQ ID NO: 3441411 - RNA, 16 nt, Pseudomonas aeruginosa PA01
cagccagacguccggc

SEQ ID NO: 3441412 - RNA, 17 nt, Pseudomonas aeruginosa PA01
cagccagacguccggca

SEQ ID NO: 3441413 - RNA, 16 nt, Pseudomonas aeruginosa PA01
cagccagagcagcguc

SEQ ID NO: 3441414 - RNA, 11 nt, Pseudomonas aeruginosa PA01
cagccagagcc

SEQ ID NO: 3441415 - RNA, 17 nt, Pseudomonas aeruginosa PA01
cagccagagccagucga

SEQ ID NO: 3441416 - RNA, 16 nt, Pseudomonas aeruginosa PA01
cagccagagcccgucg

SEQ ID NO: 3441417 - RNA, 17 nt, Pseudomonas aeruginosa PA01
cagccagagcccgucga

SEQ ID NO: 3441418 - RNA, 21 nt, Pseudomonas aeruginosa PA01
cagccagagcguaucgaugcg

SEQ ID NO: 3441419 - RNA, 14 nt, Pseudomonas aeruginosa PA01
cagccagagcucca

SEQ ID NO: 3441420 - RNA, 14 nt, Pseudomonas aeruginosa PA01
cagccccucggcca

SEQ ID NO: 3441421 - RNA, 15 nt, Pseudomonas aeruginosa PA01
cagccccugcggacc

SEQ ID NO: 3441422 - RNA, 17 nt, Pseudomonas aeruginosa PA01
cagccccuugagcgcgu

SEQ ID NO: 3441423 - RNA, 19 nt, Pseudomonas aeruginosa PA01
cagccccuugcgcucuggc

SEQ ID NO: 3441424 - RNA, 20 nt, Pseudomonas aeruginosa PA01
cagcccgccaacguccucga

SEQ ID NO: 3441425 - RNA, 13 nt, Pseudomonas aeruginosa PA01
cagcccgccggcg

SEQ ID NO: 3441426 - RNA, 14 nt, Pseudomonas aeruginosa PA01
cagcccgccgugcg

SEQ ID NO: 3441427 - RNA, 15 nt, Pseudomonas aeruginosa PA01
cagcccgccgugcgc

SEQ ID NO: 3441428 - RNA, 16 nt, Pseudomonas aeruginosa PA01
cagcccgccgugcgcu

SEQ ID NO: 3441429 - RNA, 18 nt, Pseudomonas aeruginosa PA01
cagcccgccgugcgcucc

SEQ ID NO: 3441430 - RNA, 20 nt, Pseudomonas aeruginosa PA01
cagcccgccgugcgcuccgc

SEQ ID NO: 3441431 - RNA, 13 nt, Pseudomonas aeruginosa PA01
cagcccgcgccgc

SEQ ID NO: 3441432 - RNA, 17 nt, Pseudomonas aeruginosa PA01
cagcccgcgccgcgagg

SEQ ID NO: 3441433 - RNA, 23 nt, Pseudomonas aeruginosa PA01
cagcccgcgcgacagcucugggg

SEQ ID NO: 3441434 - RNA, 24 nt, Pseudomonas aeruginosa PA01
cagcccgcgcucggccgccuggcg

SEQ ID NO: 3441435 - RNA, 20 nt, Pseudomonas aeruginosa PA01
cagcccgcugaccgggcgga

SEQ ID NO: 3441436 - RNA, 19 nt, Pseudomonas aeruginosa PA01
cagcccggcaccaggccga

SEQ ID NO: 3441437 - RNA, 16 nt, Pseudomonas aeruginosa PA01
cagcccggccucgccg

SEQ ID NO: 3441438 - RNA, 15 nt, Pseudomonas aeruginosa PA01
cagcccggccuggau

SEQ ID NO: 3441439 - RNA, 13 nt, Pseudomonas aeruginosa PA01
cagcccggcggcg

SEQ ID NO: 3441440 - RNA, 15 nt, Pseudomonas aeruginosa PA01
cagcccggcggcggc

SEQ ID NO: 3441441 - RNA, 16 nt, Pseudomonas aeruginosa PA01
cagcccggcggcggca

SEQ ID NO: 3441442 - RNA, 20 nt, Pseudomonas aeruginosa PA01
cagcccggcggcggcaccga

SEQ ID NO: 3441443 - RNA, 19 nt, Pseudomonas aeruginosa PA01
cagcccggcggugaugccg

SEQ ID NO: 3441444 - RNA, 14 nt, Pseudomonas aeruginosa PA01
cagcccggcucggc

SEQ ID NO: 3441445 - RNA, 18 nt, Pseudomonas aeruginosa PA01
cagcccggucacgccggg

SEQ ID NO: 3441446 - RNA, 19 nt, Pseudomonas aeruginosa PA01
cagcccggucacgccggga

SEQ ID NO: 3441447 - RNA, 19 nt, Pseudomonas aeruginosa PA01
cagcccgguccguccagcg

SEQ ID NO: 3441448 - RNA, 19 nt, Pseudomonas aeruginosa PA01
cagcccguagucguucagc

SEQ ID NO: 3441449 - RNA, 16 nt, Pseudomonas aeruginosa PA01
cagcccgucgcgcgcc

SEQ ID NO: 3441450 - RNA, 19 nt, Pseudomonas aeruginosa PA01
cagcccgucgcgcgccgga

SEQ ID NO: 3441451 - RNA, 20 nt, Pseudomonas aeruginosa PA01
cagcccgucgcgcgccggag

SEQ ID NO: 3441452 - RNA, 20 nt, Pseudomonas aeruginosa PA01
cagcccgucggccucgccga

SEQ ID NO: 3441453 - RNA, 19 nt, Pseudomonas aeruginosa PA01
cagcccguguucggccagc

SEQ ID NO: 3441454 - RNA, 20 nt, Pseudomonas aeruginosa PA01
cagcccguguucggccagcc

SEQ ID NO: 3441455 - RNA, 22 nt, Pseudomonas aeruginosa PA01
cagcccguguucggccagccgg

SEQ ID NO: 3441456 - RNA, 23 nt, Pseudomonas aeruginosa PA01
cagcccguguucggccagccggc

SEQ ID NO: 3441457 - RNA, 16 nt, Pseudomonas aeruginosa PA01
cagcccguugcgguag

SEQ ID NO: 3441458 - RNA, 16 nt, Pseudomonas aeruginosa PA01
cagcccuaggcgaccc

SEQ ID NO: 3441459 - RNA, 13 nt, Pseudomonas aeruginosa PA01
cagcccucgccca

SEQ ID NO: 3441460 - RNA, 22 nt, Pseudomonas aeruginosa PA01
cagcccucgcccaggugcgccg

SEQ ID NO: 3441461 - RNA, 15 nt, Pseudomonas aeruginosa PA01
cagcccucggcccgg

SEQ ID NO: 3441462 - RNA, 19 nt, Pseudomonas aeruginosa PA01
cagcccucggggaagguca

SEQ ID NO: 3441463 - RNA, 22 nt, Pseudomonas aeruginosa PA01
cagcccucggggaaggucaccg

SEQ ID NO: 3441464 - RNA, 12 nt, Pseudomonas aeruginosa PA01
cagcccuggcgc

SEQ ID NO: 3441465 - RNA, 16 nt, Pseudomonas aeruginosa PA01
cagcccuggcgcggca

SEQ ID NO: 3441466 - RNA, 18 nt, Pseudomonas aeruginosa PA01
cagcccuggcgcggcaaa

SEQ ID NO: 3441467 - RNA, 21 nt, Pseudomonas aeruginosa PA01
cagcccuggcguggccggcga

SEQ ID NO: 3441468 - RNA, 15 nt, Pseudomonas aeruginosa PA01
cagcccuucgcgcuc

SEQ ID NO: 3441469 - RNA, 17 nt, Pseudomonas aeruginosa PA01
cagcccuugcaaccgcc

SEQ ID NO: 3441470 - RNA, 19 nt, Pseudomonas aeruginosa PA01
cagcccuugcaaccgccgc

SEQ ID NO: 3441471 - RNA, 22 nt, Pseudomonas aeruginosa PA01
cagcccuugcaaccgccgccgc

SEQ ID NO: 3441472 - RNA, 19 nt, Pseudomonas aeruginosa PA01
cagcccuuucagcggcugc

SEQ ID NO: 3441473 - RNA, 19 nt, Pseudomonas aeruginosa PA01
cagccgaccaccuucaggc

SEQ ID NO: 3441474 - RNA, 22 nt, Pseudomonas aeruginosa PA01
cagccgaccaccuucaggcugc

SEQ ID NO: 3441475 - RNA, 23 nt, Pseudomonas aeruginosa PA01
cagccgaccaccuucaggcugcu

SEQ ID NO: 3441476 - RNA, 15 nt, Pseudomonas aeruginosa PA01
cagccgaccguccgc

SEQ ID NO: 3441477 - RNA, 19 nt, Pseudomonas aeruginosa PA01
cagccgaccguccgccugc

SEQ ID NO: 3441478 - RNA, 15 nt, Pseudomonas aeruginosa PA01
cagccgacgcgcagc

SEQ ID NO: 3441479 - RNA, 16 nt, Pseudomonas aeruginosa PA01
cagccgacuggcggua

SEQ ID NO: 3441480 - RNA, 17 nt, Pseudomonas aeruginosa PA01
cagccgacuggcgguac

SEQ ID NO: 3441481 - RNA, 20 nt, Pseudomonas aeruginosa PA01
cagccgagcaacucggcggc

SEQ ID NO: 3441482 - RNA, 13 nt, Pseudomonas aeruginosa PA01
cagccgagccccc

SEQ ID NO: 3441483 - RNA, 14 nt, Pseudomonas aeruginosa PA01
cagccgaggcagcc

SEQ ID NO: 3441484 - RNA, 16 nt, Pseudomonas aeruginosa PA01
cagccgaggucgccgc

SEQ ID NO: 3441485 - RNA, 20 nt, Pseudomonas aeruginosa PA01
cagccgaggucgccgccagc

SEQ ID NO: 3441486 - RNA, 22 nt, Pseudomonas aeruginosa PA01
cagccgaggucgccgccagcua

SEQ ID NO: 3441487 - RNA, 22 nt, Pseudomonas aeruginosa PA01
cagccgagguucuugcccagca

SEQ ID NO: 3441488 - RNA, 16 nt, Pseudomonas aeruginosa PA01
cagccgaucgaagaag

SEQ ID NO: 3441489 - RNA, 19 nt, Pseudomonas aeruginosa PA01
cagccgaucgaagaaggcu

SEQ ID NO: 3441490 - RNA, 13 nt, Pseudomonas aeruginosa PA01
cagccgaugcucg

SEQ ID NO: 3441491 - RNA, 18 nt, Pseudomonas aeruginosa PA01
cagccgaugcucgcgcca

SEQ ID NO: 3441492 - RNA, 20 nt, Pseudomonas aeruginosa PA01
cagccgaugcucgcgccagc

SEQ ID NO: 3441493 - RNA, 21 nt, Pseudomonas aeruginosa PA01
cagccgaugcucgcgccagcc

SEQ ID NO: 3441494 - RNA, 16 nt, Pseudomonas aeruginosa PA01
cagccgcaaggccagg

SEQ ID NO: 3441495 - RNA, 15 nt, Pseudomonas aeruginosa PA01
cagccgcacgccccu

SEQ ID NO: 3441496 - RNA, 14 nt, Pseudomonas aeruginosa PA01
cagccgcagcccgg

SEQ ID NO: 3441497 - RNA, 15 nt, Pseudomonas aeruginosa PA01
cagccgcagcccggu

SEQ ID NO: 3441498 - RNA, 13 nt, Pseudomonas aeruginosa PA01
cagccgcagcggc

SEQ ID NO: 3441499 - RNA, 16 nt, Pseudomonas aeruginosa PA01
cagccgcagcggcaug

SEQ ID NO: 3441500 - RNA, 17 nt, Pseudomonas aeruginosa PA01
cagccgcagcggcaugc

SEQ ID NO: 3441501 - RNA, 18 nt, Pseudomonas aeruginosa PA01
cagccgcagcggcaugcc

SEQ ID NO: 3441502 - RNA, 22 nt, Pseudomonas aeruginosa PA01
cagccgcagcggcaugcccugc

SEQ ID NO: 3441503 - RNA, 14 nt, Pseudomonas aeruginosa PA01
cagccgcaggaugc

SEQ ID NO: 3441504 - RNA, 15 nt, Pseudomonas aeruginosa PA01
cagccgcaggaugcc

SEQ ID NO: 3441505 - RNA, 19 nt, Pseudomonas aeruginosa PA01
cagccgcaggaugccgccu

SEQ ID NO: 3441506 - RNA, 20 nt, Pseudomonas aeruginosa PA01
cagccgcaggaugccgccug

SEQ ID NO: 3441507 - RNA, 21 nt, Pseudomonas aeruginosa PA01
cagccgcaggaugccgccugc

SEQ ID NO: 3441508 - RNA, 22 nt, Pseudomonas aeruginosa PA01
cagccgcaggaugccgccugcg

SEQ ID NO: 3441509 - RNA, 12 nt, Pseudomonas aeruginosa PA01
cagccgcaggca

SEQ ID NO: 3441510 - RNA, 17 nt, Pseudomonas aeruginosa PA01
cagccgcaggcagaacg

SEQ ID NO: 3441511 - RNA, 17 nt, Pseudomonas aeruginosa PA01
cagccgcaggcugccgu

SEQ ID NO: 3441512 - RNA, 18 nt, Pseudomonas aeruginosa PA01
cagccgccaucaccagcg

SEQ ID NO: 3441513 - RNA, 13 nt, Pseudomonas aeruginosa PA01
cagccgccccacc

SEQ ID NO: 3441514 - RNA, 18 nt, Pseudomonas aeruginosa PA01
cagccgccccaccaccau

SEQ ID NO: 3441515 - RNA, 20 nt, Pseudomonas aeruginosa PA01
cagccgccccaccaccaucg

SEQ ID NO: 3441516 - RNA, 21 nt, Pseudomonas aeruginosa PA01
cagccgccccaccaccaucgc

SEQ ID NO: 3441517 - RNA, 16 nt, Pseudomonas aeruginosa PA01
cagccgccgcggcacc

SEQ ID NO: 3441518 - RNA, 14 nt, Pseudomonas aeruginosa PA01
cagccgccgcugca

SEQ ID NO: 3441519 - RNA, 22 nt, Pseudomonas aeruginosa PA01
cagccgcgacgacugcggcagc

SEQ ID NO: 3441520 - RNA, 16 nt, Pseudomonas aeruginosa PA01
cagccgcgacucggcu

SEQ ID NO: 3441521 - RNA, 19 nt, Pseudomonas aeruginosa PA01
cagccgcgaguccuucggc

SEQ ID NO: 3441522 - RNA, 20 nt, Pseudomonas aeruginosa PA01
cagccuuggccacggcaucg

SEQ ID NO: 3441523 - RNA, 21 nt, Pseudomonas aeruginosa PA01
cagccuuuuuugugcccgccc

SEQ ID NO: 3441524 - RNA, 23 nt, Pseudomonas aeruginosa PA01
cagccuuuuuugugcccgccccu

SEQ ID NO: 3441525 - RNA, 22 nt, Pseudomonas aeruginosa PA01
cagcgaaacucgugcuccaccu

SEQ ID NO: 3441526 - RNA, 23 nt, Pseudomonas aeruginosa PA01
cagcgaaacucgugcuccaccuc

SEQ ID NO: 3441527 - RNA, 20 nt, Pseudomonas aeruginosa PA01
cagcgaaauggucaccauga

SEQ ID NO: 3441528 - RNA, 15 nt, Pseudomonas aeruginosa PA01
cagcgaacccaggcc

SEQ ID NO: 3441529 - RNA, 17 nt, Pseudomonas aeruginosa PA01
cagcgaacccaggccgc

SEQ ID NO: 3441530 - RNA, 15 nt, Pseudomonas aeruginosa PA01
cagcgaaccgccggc

SEQ ID NO: 3441531 - RNA, 18 nt, Pseudomonas aeruginosa PA01
cagcgaaccgccggccuc

SEQ ID NO: 3441532 - RNA, 13 nt, Pseudomonas aeruginosa PA01
cagcgaacgccgc

SEQ ID NO: 3441533 - RNA, 15 nt, Pseudomonas aeruginosa PA01
cagcgaacgccgcag

SEQ ID NO: 3441534 - RNA, 15 nt, Pseudomonas aeruginosa PA01
cagcgaagcuggcgc

SEQ ID NO: 3441535 - RNA, 16 nt, Pseudomonas aeruginosa PA01
cagcgaagcuggcgca

SEQ ID NO: 3441536 - RNA, 23 nt, Pseudomonas aeruginosa PA01
cagcgaagcuggcgcaacugcgc

SEQ ID NO: 3441537 - RNA, 16 nt, Pseudomonas aeruginosa PA01
cagcgaauggacaggc

SEQ ID NO: 3441538 - RNA, 20 nt, Pseudomonas aeruginosa PA01
cagcgaauggacaggcgccc

SEQ ID NO: 3441539 - RNA, 23 nt, Pseudomonas aeruginosa PA01
cagcgaauggacaggcgccccug

SEQ ID NO: 3441540 - RNA, 18 nt, Pseudomonas aeruginosa PA01
cagcgacacaacgcugca

SEQ ID NO: 3441541 - RNA, 19 nt, Pseudomonas aeruginosa PA01
cagcgacacaacgcugcaa

SEQ ID NO: 3441542 - RNA, 16 nt, Pseudomonas aeruginosa PA01
cagcgacagcauggcc

SEQ ID NO: 3441543 - RNA, 22 nt, Pseudomonas aeruginosa PA01
cagcgacagcauggccuugccg

SEQ ID NO: 3441544 - RNA, 16 nt, Pseudomonas aeruginosa PA01
cagcgaccaccaccag

SEQ ID NO: 3441545 - RNA, 17 nt, Pseudomonas aeruginosa PA01
cagcgaccaccaccagg

SEQ ID NO: 3441546 - RNA, 20 nt, Pseudomonas aeruginosa PA01
cagcgaccaccaccaggucg

SEQ ID NO: 3441547 - RNA, 21 nt, Pseudomonas aeruginosa PA01
cagcgaccaccaccaggucgg

SEQ ID NO: 3441548 - RNA, 17 nt, Pseudomonas aeruginosa PA01
cagcgaccugacccgcu

SEQ ID NO: 3441549 - RNA, 14 nt, Pseudomonas aeruginosa PA01
cagcgacuccagcc

SEQ ID NO: 3441550 - RNA, 19 nt, Pseudomonas aeruginosa PA01
cagcgacuccagccaggcg

SEQ ID NO: 3441551 - RNA, 20 nt, Pseudomonas aeruginosa PA01
cagcgacucgaugaacgccc

SEQ ID NO: 3441552 - RNA, 21 nt, Pseudomonas aeruginosa PA01
cagcgacucgaugcgcagcuu

SEQ ID NO: 3441553 - RNA, 24 nt, Pseudomonas aeruginosa PA01
cagcgacucgaugcgcagcuugcu

SEQ ID NO: 3441554 - RNA, 17 nt, Pseudomonas aeruginosa PA01
cagcgacucgcugccgg

SEQ ID NO: 3441555 - RNA, 22 nt, Pseudomonas aeruginosa PA01
cagcgacucgcugccggcgcgc

SEQ ID NO: 3441556 - RNA, 23 nt, Pseudomonas aeruginosa PA01
cagcgacucgcugccggcgcgca

SEQ ID NO: 3441557 - RNA, 17 nt, Pseudomonas aeruginosa PA01
cagcgacucgcugggcg

SEQ ID NO: 3441558 - RNA, 18 nt, Pseudomonas aeruginosa PA01
cagcgacucgcugggcgc

SEQ ID NO: 3441559 - RNA, 22 nt, Pseudomonas aeruginosa PA01
cagcgacucgcugggcgccggc

SEQ ID NO: 3441560 - RNA, 23 nt, Pseudomonas aeruginosa PA01
cagcgacucgcugggcgccggca

SEQ ID NO: 3441561 - RNA, 16 nt, Pseudomonas aeruginosa PA01
cagcgacucguagucg

SEQ ID NO: 3441562 - RNA, 21 nt, Pseudomonas aeruginosa PA01
cagcgacucguagucgaucag

SEQ ID NO: 3441563 - RNA, 20 nt, Pseudomonas aeruginosa PA01
cagcgacuggaaacgcaucc

SEQ ID NO: 3441564 - RNA, 15 nt, Pseudomonas aeruginosa PA01
cagcgacuggugguc

SEQ ID NO: 3441565 - RNA, 15 nt, Pseudomonas aeruginosa PA01
cagcgagaacagcuc

SEQ ID NO: 3441566 - RNA, 16 nt, Pseudomonas aeruginosa PA01
cagcgagaacagcucc

SEQ ID NO: 3441567 - RNA, 18 nt, Pseudomonas aeruginosa PA01
cagcgagaacuugccggc

SEQ ID NO: 3441568 - RNA, 19 nt, Pseudomonas aeruginosa PA01
cagcgagaacuugccggcg

SEQ ID NO: 3441569 - RNA, 22 nt, Pseudomonas aeruginosa PA01
cagcgagaacuugccggcgcca

SEQ ID NO: 3441570 - RNA, 22 nt, Pseudomonas aeruginosa PA01
cagcgagacccgguacuccucc

SEQ ID NO: 3441571 - RNA, 23 nt, Pseudomonas aeruginosa PA01
cagcgagacccgguacuccucca

SEQ ID NO: 3441572 - RNA, 17 nt, Pseudomonas aeruginosa PA01
cagcgagaccucgccca

SEQ ID NO: 3441573 - RNA, 18 nt, Pseudomonas aeruginosa PA01
cagcgagaggggcgcucg

SEQ ID NO: 3441574 - RNA, 12 nt, Pseudomonas aeruginosa PA01
cagcgagcaggc

SEQ ID NO: 3441575 - RNA, 14 nt, Pseudomonas aeruginosa PA01
cagcgagcaggcga

SEQ ID NO: 3441576 - RNA, 18 nt, Pseudomonas aeruginosa PA01
cagcgagccgaucaccag

SEQ ID NO: 3441577 - RNA, 19 nt, Pseudomonas aeruginosa PA01
cagcgagccgaucaccagc

SEQ ID NO: 3441578 - RNA, 20 nt, Pseudomonas aeruginosa PA01
cagcgagccgaucaccagca

SEQ ID NO: 3441579 - RNA, 21 nt, Pseudomonas aeruginosa PA01
cagcgagccgaucaccagcaa

SEQ ID NO: 3441580 - RNA, 19 nt, Pseudomonas aeruginosa PA01
cagcgagcgggcgagggcg

SEQ ID NO: 3441581 - RNA, 20 nt, Pseudomonas aeruginosa PA01
cagcgagcgggcgagggcgg

SEQ ID NO: 3441582 - RNA, 22 nt, Pseudomonas aeruginosa PA01
cagcgagcgggcgagggcggcg

SEQ ID NO: 3441583 - RNA, 17 nt, Pseudomonas aeruginosa PA01
cagcgagcggucggcca

SEQ ID NO: 3441584 - RNA, 19 nt, Pseudomonas aeruginosa PA01
cagcgagcggucggccaug

SEQ ID NO: 3441585 - RNA, 21 nt, Pseudomonas aeruginosa PA01
cagcgagcggucggccauggc

SEQ ID NO: 3441586 - RNA, 21 nt, Pseudomonas aeruginosa PA01
cagcgagcuucgccgcgcaag

SEQ ID NO: 3441587 - RNA, 15 nt, Pseudomonas aeruginosa PA01
cagcgaggcccgcgc

SEQ ID NO: 3441588 - RNA, 19 nt, Pseudomonas aeruginosa PA01
cagcgaggcccgcgccgcc

SEQ ID NO: 3441589 - RNA, 14 nt, Pseudomonas aeruginosa PA01
cagcgaggcgggcg

SEQ ID NO: 3441590 - RNA, 15 nt, Pseudomonas aeruginosa PA01
cagcgaggcgggcgc

SEQ ID NO: 3441591 - RNA, 24 nt, Pseudomonas aeruginosa PA01
cagcgaggcgggcgcggaucggcg

SEQ ID NO: 3441592 - RNA, 22 nt, Pseudomonas aeruginosa PA01
cagcgaggggaagaucuccggg

SEQ ID NO: 3441593 - RNA, 20 nt, Pseudomonas aeruginosa PA01
cagcgaguagucgcggggcg

SEQ ID NO: 3441594 - RNA, 17 nt, Pseudomonas aeruginosa PA01
cagcgagucgacccagg

SEQ ID NO: 3441595 - RNA, 18 nt, Pseudomonas aeruginosa PA01
cagcgagucgacccaggc

SEQ ID NO: 3441596 - RNA, 20 nt, Pseudomonas aeruginosa PA01
cagcgagucgacccaggccc

SEQ ID NO: 3441597 - RNA, 21 nt, Pseudomonas aeruginosa PA01
cagcgagugcugaacaucagg

SEQ ID NO: 3441598 - RNA, 16 nt, Pseudomonas aeruginosa PA01
cagcgaguugaccuug

SEQ ID NO: 3441599 - RNA, 16 nt, Pseudomonas aeruginosa PA01
cagcgauacaccugca

SEQ ID NO: 3441600 - RNA, 13 nt, Pseudomonas aeruginosa PA01
cagcgaucgccgc

SEQ ID NO: 3441601 - RNA, 23 nt, Pseudomonas aeruginosa PA01
cagcgaucgccgccauugacgaa

SEQ ID NO: 3441602 - RNA, 23 nt, Pseudomonas aeruginosa PA01
cagcgauucccgaggguggcgcu

SEQ ID NO: 3441603 - RNA, 24 nt, Pseudomonas aeruginosa PA01
cagcgauucccgaggguggcgcug

SEQ ID NO: 3441604 - RNA, 12 nt, Pseudomonas aeruginosa PA01
cagcgcaccagg

SEQ ID NO: 3441605 - RNA, 12 nt, Pseudomonas aeruginosa PA01
cagcgcaccauc

SEQ ID NO: 3441606 - RNA, 16 nt, Pseudomonas aeruginosa PA01
cagcgcaccauccucg

SEQ ID NO: 3441607 - RNA, 17 nt, Pseudomonas aeruginosa PA01
cagcgcaccgccaagga

SEQ ID NO: 3441608 - RNA, 13 nt, Pseudomonas aeruginosa PA01
cagcgcaccgccc

SEQ ID NO: 3441609 - RNA, 14 nt, Pseudomonas aeruginosa PA01
cagcgcaccgcccu

SEQ ID NO: 3441610 - RNA, 16 nt, Pseudomonas aeruginosa PA01
cagcgcaccgcccugc

SEQ ID NO: 3441611 - RNA, 13 nt, Pseudomonas aeruginosa PA01
cagcgcagccugc

SEQ ID NO: 3441612 - RNA, 16 nt, Pseudomonas aeruginosa PA01
cagcgcagccugcugg

SEQ ID NO: 3441613 - RNA, 17 nt, Pseudomonas aeruginosa PA01
cagcgcagccugcuggc

SEQ ID NO: 3441614 - RNA, 20 nt, Pseudomonas aeruginosa PA01
cagcgcagccugcuggccug

SEQ ID NO: 3441615 - RNA, 12 nt, Pseudomonas aeruginosa PA01
cagcgcagcgaa

SEQ ID NO: 3441616 - RNA, 14 nt, Pseudomonas aeruginosa PA01
cagcgcagcgaaga

SEQ ID NO: 3441617 - RNA, 16 nt, Pseudomonas aeruginosa PA01
cagcgcagcgaagauc

SEQ ID NO: 3441618 - RNA, 14 nt, Pseudomonas aeruginosa PA01
cagcgcaggccgau

SEQ ID NO: 3441619 - RNA, 18 nt, Pseudomonas aeruginosa PA01
cagcgcauaggccugggc

SEQ ID NO: 3441620 - RNA, 16 nt, Pseudomonas aeruginosa PA01
cagcgcaucgaggccg

SEQ ID NO: 3441621 - RNA, 18 nt, Pseudomonas aeruginosa PA01
cagcgcaucgaggccggc

SEQ ID NO: 3441622 - RNA, 13 nt, Pseudomonas aeruginosa PA01
cagcgcaucggcg

SEQ ID NO: 3441623 - RNA, 15 nt, Pseudomonas aeruginosa PA01
cagcgcaucggcgcc

SEQ ID NO: 3441624 - RNA, 16 nt, Pseudomonas aeruginosa PA01
cagcgccgcgaacaca

SEQ ID NO: 3441625 - RNA, 14 nt, Pseudomonas aeruginosa PA01
cagcgccgcgcgcu

SEQ ID NO: 3441626 - RNA, 15 nt, Pseudomonas aeruginosa PA01
cagcgccgcgcggca

SEQ ID NO: 3441627 - RNA, 16 nt, Pseudomonas aeruginosa PA01
cagcgccgcgcggcaa

SEQ ID NO: 3441628 - RNA, 16 nt, Pseudomonas aeruginosa PA01
cagcgccgcgcugcgu

SEQ ID NO: 3441629 - RNA, 14 nt, Pseudomonas aeruginosa PA01
cagcgccgcggcga

SEQ ID NO: 3441630 - RNA, 16 nt, Pseudomonas aeruginosa PA01
cagcgccgcggcgacc

SEQ ID NO: 3441631 - RNA, 17 nt, Pseudomonas aeruginosa PA01
cagcgccgcggcgacca

SEQ ID NO: 3441632 - RNA, 16 nt, Pseudomonas aeruginosa PA01
cagcgccgcggcuggc

SEQ ID NO: 3441633 - RNA, 17 nt, Pseudomonas aeruginosa PA01
cagcgccgcggcuggcc

SEQ ID NO: 3441634 - RNA, 14 nt, Pseudomonas aeruginosa PA01
cagcgccgcggugu

SEQ ID NO: 3441635 - RNA, 17 nt, Pseudomonas aeruginosa PA01
cagcgccgcuccuccuc

SEQ ID NO: 3441636 - RNA, 22 nt, Pseudomonas aeruginosa PA01
cagcgccgcucggcgagccgcc

SEQ ID NO: 3441637 - RNA, 21 nt, Pseudomonas aeruginosa PA01
cagcgccgcuucuucccgccc

SEQ ID NO: 3441638 - RNA, 22 nt, Pseudomonas aeruginosa PA01
cagcgccgcuucuucccgccca

SEQ ID NO: 3441639 - RNA, 16 nt, Pseudomonas aeruginosa PA01
cagcgccggccagggg

SEQ ID NO: 3441640 - RNA, 14 nt, Pseudomonas aeruginosa PA01
cagcgccggcggcg

SEQ ID NO: 3441641 - RNA, 15 nt, Pseudomonas aeruginosa PA01
cagcgccggcggcgc

SEQ ID NO: 3441642 - RNA, 12 nt, Pseudomonas aeruginosa PA01
cagcgccgggca

SEQ ID NO: 3441643 - RNA, 16 nt, Pseudomonas aeruginosa PA01
cagcgccgggcauucg

SEQ ID NO: 3441644 - RNA, 14 nt, Pseudomonas aeruginosa PA01
cagcgccgggucga

SEQ ID NO: 3441645 - RNA, 17 nt, Pseudomonas aeruginosa PA01
cagcgccgggucgaccu

SEQ ID NO: 3441646 - RNA, 22 nt, Pseudomonas aeruginosa PA01
cagcgccgggucgaccuugccg

SEQ ID NO: 3441647 - RNA, 20 nt, Pseudomonas aeruginosa PA01
cagcgccgggugaccgugcg

SEQ ID NO: 3441648 - RNA, 18 nt, Pseudomonas aeruginosa PA01
cagcgccgguagcggcgc

SEQ ID NO: 3441649 - RNA, 19 nt, Pseudomonas aeruginosa PA01
cagcgccgguagcggcgca

SEQ ID NO: 3441650 - RNA, 24 nt, Pseudomonas aeruginosa PA01
cagcgccgguucguugaccgucca

SEQ ID NO: 3441651 - RNA, 19 nt, Pseudomonas aeruginosa PA01
cagcgccgucaccagcagc

SEQ ID NO: 3441652 - RNA, 17 nt, Pseudomonas aeruginosa PA01
cagcgccguucacgccu

SEQ ID NO: 3441653 - RNA, 18 nt, Pseudomonas aeruginosa PA01
cagcgccguucacgccug

SEQ ID NO: 3441654 - RNA, 20 nt, Pseudomonas aeruginosa PA01
cagcgccguucacgccuggc

SEQ ID NO: 3441655 - RNA, 21 nt, Pseudomonas aeruginosa PA01
cagcgccguucacgccuggcg

SEQ ID NO: 3441656 - RNA, 22 nt, Pseudomonas aeruginosa PA01
cagcgccguucacgccuggcgg

SEQ ID NO: 3441657 - RNA, 19 nt, Pseudomonas aeruginosa PA01
cagcgccguugccgaugcc

SEQ ID NO: 3441658 - RNA, 15 nt, Pseudomonas aeruginosa PA01
cagcgccguugcggc

SEQ ID NO: 3441659 - RNA, 18 nt, Pseudomonas aeruginosa PA01
cagcgccguugcggcagc

SEQ ID NO: 3441660 - RNA, 22 nt, Pseudomonas aeruginosa PA01
cagcgccguugcggcagcaucc

SEQ ID NO: 3441661 - RNA, 13 nt, Pseudomonas aeruginosa PA01
cagcgccuccagc

SEQ ID NO: 3441662 - RNA, 14 nt, Pseudomonas aeruginosa PA01
cagcgccuccagca

SEQ ID NO: 3441663 - RNA, 16 nt, Pseudomonas aeruginosa PA01
cagcgccuccagcacc

SEQ ID NO: 3441664 - RNA, 17 nt, Pseudomonas aeruginosa PA01
cagcgccuccagcaccg

SEQ ID NO: 3441665 - RNA, 19 nt, Pseudomonas aeruginosa PA01
cagcgccuccagcaccggg

SEQ ID NO: 3441666 - RNA, 16 nt, Pseudomonas aeruginosa PA01
cagcgccuccagcguc

SEQ ID NO: 3441667 - RNA, 15 nt, Pseudomonas aeruginosa PA01
cagcgccucccgggc

SEQ ID NO: 3441668 - RNA, 17 nt, Pseudomonas aeruginosa PA01
cagcgccucccgggccu

SEQ ID NO: 3441669 - RNA, 14 nt, Pseudomonas aeruginosa PA01
cagcgccuccucua

SEQ ID NO: 3441670 - RNA, 20 nt, Pseudomonas aeruginosa PA01
cagcgccuccucuaccaggc

SEQ ID NO: 3441671 - RNA, 13 nt, Pseudomonas aeruginosa PA01
cagcgccucgacc

SEQ ID NO: 3441672 - RNA, 14 nt, Pseudomonas aeruginosa PA01
cagcgccucgaccu

SEQ ID NO: 3441673 - RNA, 16 nt, Pseudomonas aeruginosa PA01
cagcgccucgccgagc

SEQ ID NO: 3441674 - RNA, 14 nt, Pseudomonas aeruginosa PA01
cagcgccucggcgc

SEQ ID NO: 3441675 - RNA, 19 nt, Pseudomonas aeruginosa PA01
cagcgccucgggccggagc

SEQ ID NO: 3441676 - RNA, 19 nt, Pseudomonas aeruginosa PA01
cagcgccucguggaacagc

SEQ ID NO: 3441677 - RNA, 22 nt, Pseudomonas aeruginosa PA01
cagcgccucguggaacagcgcg

SEQ ID NO: 3441678 - RNA, 23 nt, Pseudomonas aeruginosa PA01
cagcgccugcaaagaggcgcuca

SEQ ID NO: 3441679 - RNA, 14 nt, Pseudomonas aeruginosa PA01
cagcgccugcugcg

SEQ ID NO: 3441680 - RNA, 16 nt, Pseudomonas aeruginosa PA01
cagcgccuggaugauc

SEQ ID NO: 3441681 - RNA, 14 nt, Pseudomonas aeruginosa PA01
cagcgccugggccg

SEQ ID NO: 3441682 - RNA, 18 nt, Pseudomonas aeruginosa PA01
cagcgccugggccgcgcu

SEQ ID NO: 3441683 - RNA, 15 nt, Pseudomonas aeruginosa PA01
cagcgccuggucggc

SEQ ID NO: 3441684 - RNA, 16 nt, Pseudomonas aeruginosa PA01
cagcgccuggucggcg

SEQ ID NO: 3441685 - RNA, 17 nt, Pseudomonas aeruginosa PA01
cagcgccuggucggcgg

SEQ ID NO: 3441686 - RNA, 18 nt, Pseudomonas aeruginosa PA01
cagcgccuguuccagggc

SEQ ID NO: 3441687 - RNA, 17 nt, Pseudomonas aeruginosa PA01
cagcgccuugaccucga

SEQ ID NO: 3441688 - RNA, 19 nt, Pseudomonas aeruginosa PA01
cagcgccuuuuccgcaucu

SEQ ID NO: 3441689 - RNA, 22 nt, Pseudomonas aeruginosa PA01
cagcgccuuuuccgcaucuccc

SEQ ID NO: 3441690 - RNA, 16 nt, Pseudomonas aeruginosa PA01
cagcgcgacaucggcg

SEQ ID NO: 3441691 - RNA, 12 nt, Pseudomonas aeruginosa PA01
cagcgcgagcgu

SEQ ID NO: 3441692 - RNA, 22 nt, Pseudomonas aeruginosa PA01
cagcgcgagggggccucggcca

SEQ ID NO: 3441693 - RNA, 17 nt, Pseudomonas aeruginosa PA01
cagcgcgauacccuggc

SEQ ID NO: 3441694 - RNA, 18 nt, Pseudomonas aeruginosa PA01
cagcgcgauacccuggcc

SEQ ID NO: 3441695 - RNA, 20 nt, Pseudomonas aeruginosa PA01
cagcgcgauacccuggccgg

SEQ ID NO: 3441696 - RNA, 23 nt, Pseudomonas aeruginosa PA01
cagcgcgauacccuggccggccu

SEQ ID NO: 3441697 - RNA, 20 nt, Pseudomonas aeruginosa PA01
cagcgcgauaucgcaggcca

SEQ ID NO: 3441698 - RNA, 23 nt, Pseudomonas aeruginosa PA01
cagcgcgauaucgcaggccaggc

SEQ ID NO: 3441699 - RNA, 19 nt, Pseudomonas aeruginosa PA01
cagcgcgauuuugggcuca

SEQ ID NO: 3441700 - RNA, 20 nt, Pseudomonas aeruginosa PA01
cagcgcgauuuugggcucag

SEQ ID NO: 3441701 - RNA, 12 nt, Pseudomonas aeruginosa PA01
cagcgcgccagc

SEQ ID NO: 3441702 - RNA, 13 nt, Pseudomonas aeruginosa PA01
cagcgcgccagca

SEQ ID NO: 3441703 - RNA, 17 nt, Pseudomonas aeruginosa PA01
cagcgcgccagcacggc

SEQ ID NO: 3441704 - RNA, 16 nt, Pseudomonas aeruginosa PA01
cagcgcgccaucggcg

SEQ ID NO: 3441705 - RNA, 13 nt, Pseudomonas aeruginosa PA01
cagcgcgccccgg

SEQ ID NO: 3441706 - RNA, 17 nt, Pseudomonas aeruginosa PA01
cagcgcgccccggcgag

SEQ ID NO: 3441707 - RNA, 22 nt, Pseudomonas aeruginosa PA01
cagcgcgcccggcgccaccccg

SEQ ID NO: 3441708 - RNA, 13 nt, Pseudomonas aeruginosa PA01
cagcgcgccgagc

SEQ ID NO: 3441709 - RNA, 15 nt, Pseudomonas aeruginosa PA01
cagcgcgccgagcca

SEQ ID NO: 3441710 - RNA, 20 nt, Pseudomonas aeruginosa PA01
cagcgcgccgaguucgccgc

SEQ ID NO: 3441711 - RNA, 14 nt, Pseudomonas aeruginosa PA01
cagcgcgccgccga

SEQ ID NO: 3441712 - RNA, 15 nt, Pseudomonas aeruginosa PA01
cagcgcgccgccgag

SEQ ID NO: 3441713 - RNA, 16 nt, Pseudomonas aeruginosa PA01
cagcgcgccgccgagg

SEQ ID NO: 3441714 - RNA, 17 nt, Pseudomonas aeruginosa PA01
cagcgcgccgccgaggu

SEQ ID NO: 3441715 - RNA, 20 nt, Pseudomonas aeruginosa PA01
cagcgcgcgauaccgacaag

SEQ ID NO: 3441716 - RNA, 13 nt, Pseudomonas aeruginosa PA01
cagcgcgcgccga

SEQ ID NO: 3441717 - RNA, 14 nt, Pseudomonas aeruginosa PA01
cagcgcgcgccgac

SEQ ID NO: 3441718 - RNA, 21 nt, Pseudomonas aeruginosa PA01
cagcgcgcgccgagcaaccgc

SEQ ID NO: 3441719 - RNA, 23 nt, Pseudomonas aeruginosa PA01
cagcgcgcgccgagcaaccgcga

SEQ ID NO: 3441720 - RNA, 15 nt, Pseudomonas aeruginosa PA01
cagcgcgcgcuggcg

SEQ ID NO: 3441721 - RNA, 17 nt, Pseudomonas aeruginosa PA01
cagcgcgcgcuggcgca

SEQ ID NO: 3441722 - RNA, 17 nt, Pseudomonas aeruginosa PA01
cagcgcgcgcuggucgu

SEQ ID NO: 3441723 - RNA, 19 nt, Pseudomonas aeruginosa PA01
cagcgcgcggaccgaaggc

SEQ ID NO: 3441724 - RNA, 13 nt, Pseudomonas aeruginosa PA01
cagcgcgcggcca

SEQ ID NO: 3441725 - RNA, 14 nt, Pseudomonas aeruginosa PA01
cagcgcgcggccag

SEQ ID NO: 3441726 - RNA, 12 nt, Pseudomonas aeruginosa PA01
cagcgcgcggcu

SEQ ID NO: 3441727 - RNA, 18 nt, Pseudomonas aeruginosa PA01
cagcggcagggcggcgau

SEQ ID NO: 3441728 - RNA, 23 nt, Pseudomonas aeruginosa PA01
cagcggcaggucguugacgaucu

SEQ ID NO: 3441729 - RNA, 15 nt, Pseudomonas aeruginosa PA01
cagcggcaugcccug

SEQ ID NO: 3441730 - RNA, 21 nt, Pseudomonas aeruginosa PA01
cagcggcaugcccugccggcg

SEQ ID NO: 3441731 - RNA, 22 nt, Pseudomonas aeruginosa PA01
cagcggcaugcccugccggcgc

SEQ ID NO: 3441732 - RNA, 15 nt, Pseudomonas aeruginosa PA01
cagcggcauggucag

SEQ ID NO: 3441733 - RNA, 17 nt, Pseudomonas aeruginosa PA01
cagcggccacggcggau

SEQ ID NO: 3441734 - RNA, 14 nt, Pseudomonas aeruginosa PA01
cagcggccagggcg

SEQ ID NO: 3441735 - RNA, 13 nt, Pseudomonas aeruginosa PA01
cagcggcccagcg

SEQ ID NO: 3441736 - RNA, 14 nt, Pseudomonas aeruginosa PA01
cagcggcccagcgc

SEQ ID NO: 3441737 - RNA, 20 nt, Pseudomonas aeruginosa PA01
cagcggcccagcgccccgcc

SEQ ID NO: 3441738 - RNA, 13 nt, Pseudomonas aeruginosa PA01
cagcggcccgagc

SEQ ID NO: 3441739 - RNA, 14 nt, Pseudomonas aeruginosa PA01
cagcggcccgagca

SEQ ID NO: 3441740 - RNA, 15 nt, Pseudomonas aeruginosa PA01
cagcggcccgagcag

SEQ ID NO: 3441741 - RNA, 17 nt, Pseudomonas aeruginosa PA01
cagcggcccgagcaggc

SEQ ID NO: 3441742 - RNA, 23 nt, Pseudomonas aeruginosa PA01
cagcggcccgagcaggcugccga

SEQ ID NO: 3441743 - RNA, 16 nt, Pseudomonas aeruginosa PA01
cagcggcccggcaggc

SEQ ID NO: 3441744 - RNA, 15 nt, Pseudomonas aeruginosa PA01
cagcggccgagcagg

SEQ ID NO: 3441745 - RNA, 19 nt, Pseudomonas aeruginosa PA01
cagcggccgagcaggcgcg

SEQ ID NO: 3441746 - RNA, 22 nt, Pseudomonas aeruginosa PA01
cagcggccgagcaggcgcgcca

SEQ ID NO: 3441747 - RNA, 14 nt, Pseudomonas aeruginosa PA01
cagcggccgcgagc

SEQ ID NO: 3441748 - RNA, 20 nt, Pseudomonas aeruginosa PA01
cagcggccgcgagcgcggcc

SEQ ID NO: 3441749 - RNA, 22 nt, Pseudomonas aeruginosa PA01
cagcggccgcgagcgcggccgg

SEQ ID NO: 3441750 - RNA, 14 nt, Pseudomonas aeruginosa PA01
cagcggccgcgccu

SEQ ID NO: 3441751 - RNA, 20 nt, Pseudomonas aeruginosa PA01
cagcggcgacaccgccagca

SEQ ID NO: 3441752 - RNA, 13 nt, Pseudomonas aeruginosa PA01
cagcggcgagcag

SEQ ID NO: 3441753 - RNA, 14 nt, Pseudomonas aeruginosa PA01
cagcggcgcagccu

SEQ ID NO: 3441754 - RNA, 21 nt, Pseudomonas aeruginosa PA01
cagcggcgccaacucggccug

SEQ ID NO: 3441755 - RNA, 23 nt, Pseudomonas aeruginosa PA01
cagcggcgccagcuccagcgccc

SEQ ID NO: 3441756 - RNA, 14 nt, Pseudomonas aeruginosa PA01
cagcggcgccucga

SEQ ID NO: 3441757 - RNA, 17 nt, Pseudomonas aeruginosa PA01
cagcggcgcgucgcuca

SEQ ID NO: 3441758 - RNA, 17 nt, Pseudomonas aeruginosa PA01
cagcggcgcuugcgggc

SEQ ID NO: 3441759 - RNA, 18 nt, Pseudomonas aeruginosa PA01
cagcggcgcuugcgggcg

SEQ ID NO: 3441760 - RNA, 23 nt, Pseudomonas aeruginosa PA01
cagcggcgcuugcgggcgcgccu

SEQ ID NO: 3441761 - RNA, 16 nt, Pseudomonas aeruginosa PA01
cagcggcgcuuuccac

SEQ ID NO: 3441762 - RNA, 21 nt, Pseudomonas aeruginosa PA01
cagcggcggauacaggcgcag

SEQ ID NO: 3441763 - RNA, 23 nt, Pseudomonas aeruginosa PA01
cagcggcggauacaggcgcagca

SEQ ID NO: 3441764 - RNA, 16 nt, Pseudomonas aeruginosa PA01
cagcggcggcgccggc

SEQ ID NO: 3441765 - RNA, 21 nt, Pseudomonas aeruginosa PA01
cagcggcgggaaacgcagcga

SEQ ID NO: 3441766 - RNA, 14 nt, Pseudomonas aeruginosa PA01
cagcggcggggcca

SEQ ID NO: 3441767 - RNA, 21 nt, Pseudomonas aeruginosa PA01
cagcggcgguagcuccaggcc

SEQ ID NO: 3441768 - RNA, 23 nt, Pseudomonas aeruginosa PA01
cagcggcgguagcuccaggccga

SEQ ID NO: 3441769 - RNA, 18 nt, Pseudomonas aeruginosa PA01
cagcggcggugcgccggc

SEQ ID NO: 3441770 - RNA, 19 nt, Pseudomonas aeruginosa PA01
cagcggcggugcgccggcg

SEQ ID NO: 3441771 - RNA, 23 nt, Pseudomonas aeruginosa PA01
cagcggcguaugcgccuccaggu

SEQ ID NO: 3441772 - RNA, 19 nt, Pseudomonas aeruginosa PA01
cagcggcgugaagccgccg

SEQ ID NO: 3441773 - RNA, 20 nt, Pseudomonas aeruginosa PA01
cagcggcgugaagccgccgc

SEQ ID NO: 3441774 - RNA, 22 nt, Pseudomonas aeruginosa PA01
cagcggcgugaagccgccgccc

SEQ ID NO: 3441775 - RNA, 23 nt, Pseudomonas aeruginosa PA01
cagcggcgugaagccgccgccca

SEQ ID NO: 3441776 - RNA, 17 nt, Pseudomonas aeruginosa PA01
cagcggcucacgcccca

SEQ ID NO: 3441777 - RNA, 19 nt, Pseudomonas aeruginosa PA01
cagcggcucacgccccagc

SEQ ID NO: 3441778 - RNA, 23 nt, Pseudomonas aeruginosa PA01
cagcggcucacgccccagcgcau

SEQ ID NO: 3441779 - RNA, 13 nt, Pseudomonas aeruginosa PA01
cagcggcuccggg

SEQ ID NO: 3441780 - RNA, 24 nt, Pseudomonas aeruginosa PA01
cagcggcuccucggccugggcgca

SEQ ID NO: 3441781 - RNA, 23 nt, Pseudomonas aeruginosa PA01
cagcggcuccuggaugcuccgcg

SEQ ID NO: 3441782 - RNA, 20 nt, Pseudomonas aeruginosa PA01
cagcggcucgucaucgucca

SEQ ID NO: 3441783 - RNA, 13 nt, Pseudomonas aeruginosa PA01
cagcggcugcccg

SEQ ID NO: 3441784 - RNA, 14 nt, Pseudomonas aeruginosa PA01
cagcggcugcccgg

SEQ ID NO: 3441785 - RNA, 22 nt, Pseudomonas aeruginosa PA01
cagcggcugcccgggguuggcg

SEQ ID NO: 3441786 - RNA, 13 nt, Pseudomonas aeruginosa PA01
cagcggcugcggg

SEQ ID NO: 3441787 - RNA, 13 nt, Pseudomonas aeruginosa PA01
cagcggcuggccc

SEQ ID NO: 3441788 - RNA, 16 nt, Pseudomonas aeruginosa PA01
cagcggcuggccgucg

SEQ ID NO: 3441789 - RNA, 19 nt, Pseudomonas aeruginosa PA01
cagcggcuggccgucgacc

SEQ ID NO: 3441790 - RNA, 13 nt, Pseudomonas aeruginosa PA01
cagcggcuggcga

SEQ ID NO: 3441791 - RNA, 22 nt, Pseudomonas aeruginosa PA01
cagcggcuggcgaugcugaccc

SEQ ID NO: 3441792 - RNA, 23 nt, Pseudomonas aeruginosa PA01
cagcggcuggcgcuugccgcgcc

SEQ ID NO: 3441793 - RNA, 13 nt, Pseudomonas aeruginosa PA01
cagcggcuggcgg

SEQ ID NO: 3441794 - RNA, 17 nt, Pseudomonas aeruginosa PA01
cagcggcuggcgggcga

SEQ ID NO: 3441795 - RNA, 22 nt, Pseudomonas aeruginosa PA01
cagcggcuggcgggcgaccgga

SEQ ID NO: 3441796 - RNA, 19 nt, Pseudomonas aeruginosa PA01
cagcggcuuguccuggcgc

SEQ ID NO: 3441797 - RNA, 20 nt, Pseudomonas aeruginosa PA01
cagcgggaaggucggcagca

SEQ ID NO: 3441798 - RNA, 23 nt, Pseudomonas aeruginosa PA01
cagcgggaaggucggcagcagcu

SEQ ID NO: 3441799 - RNA, 20 nt, Pseudomonas aeruginosa PA01
cagcgggacgaugccgaucu

SEQ ID NO: 3441800 - RNA, 19 nt, Pseudomonas aeruginosa PA01
cagcgggaugugcaccagc

SEQ ID NO: 3441801 - RNA, 21 nt, Pseudomonas aeruginosa PA01
cagcgggaugugcaccagcaa

SEQ ID NO: 3441802 - RNA, 23 nt, Pseudomonas aeruginosa PA01
cagcgggaugugcaccagcaacu

SEQ ID NO: 3441803 - RNA, 12 nt, Pseudomonas aeruginosa PA01
cagcgggccagg

SEQ ID NO: 3441804 - RNA, 12 nt, Pseudomonas aeruginosa PA01
cagcgggccggg

SEQ ID NO: 3441805 - RNA, 16 nt, Pseudomonas aeruginosa PA01
cagcgggccuucgcca

SEQ ID NO: 3441806 - RNA, 21 nt, Pseudomonas aeruginosa PA01
cagcgggccuucgccagcggc

SEQ ID NO: 3441807 - RNA, 12 nt, Pseudomonas aeruginosa PA01
cagcgggcggau

SEQ ID NO: 3441808 - RNA, 14 nt, Pseudomonas aeruginosa PA01
cagcgggcggucgc

SEQ ID NO: 3441809 - RNA, 23 nt, Pseudomonas aeruginosa PA01
cagcgggcugaagugggucgccg

SEQ ID NO: 3441810 - RNA, 21 nt, Pseudomonas aeruginosa PA01
cagcggggaugaccguccggu

SEQ ID NO: 3441811 - RNA, 18 nt, Pseudomonas aeruginosa PA01
cagcggguagaugccacu

SEQ ID NO: 3441812 - RNA, 17 nt, Pseudomonas aeruginosa PA01
cagcggguagcugcugg

SEQ ID NO: 3441813 - RNA, 23 nt, Pseudomonas aeruginosa PA01
cagcggguaguagaucagcuucu

SEQ ID NO: 3441814 - RNA, 16 nt, Pseudomonas aeruginosa PA01
cagcgggucgcggcug

SEQ ID NO: 3441815 - RNA, 23 nt, Pseudomonas aeruginosa PA01
cagcgggucgcggcuggccgccu

SEQ ID NO: 3441816 - RNA, 14 nt, Pseudomonas aeruginosa PA01
cagcgggucggcga

SEQ ID NO: 3441817 - RNA, 23 nt, Pseudomonas aeruginosa PA01
cagcgggucgucgaagcgcagca

SEQ ID NO: 3441818 - RNA, 20 nt, Pseudomonas aeruginosa PA01
cagcggguuggcuuccagcc

SEQ ID NO: 3441819 - RNA, 16 nt, Pseudomonas aeruginosa PA01
cagcgguacaggcgga

SEQ ID NO: 3441820 - RNA, 16 nt, Pseudomonas aeruginosa PA01
cagcgguaccagcagc

SEQ ID NO: 3441821 - RNA, 17 nt, Pseudomonas aeruginosa PA01
cagcgguaccagcagcg

SEQ ID NO: 3441822 - RNA, 21 nt, Pseudomonas aeruginosa PA01
cagcgguaccagcagcgccga

SEQ ID NO: 3441823 - RNA, 19 nt, Pseudomonas aeruginosa PA01
cagcgguacccgccggcca

SEQ ID NO: 3441824 - RNA, 16 nt, Pseudomonas aeruginosa PA01
cagcgguacggucgag

SEQ ID NO: 3441825 - RNA, 18 nt, Pseudomonas aeruginosa PA01
cagcgguacggucgaggc

SEQ ID NO: 3441826 - RNA, 18 nt, Pseudomonas aeruginosa PA01
cagcgguaguucagucgg

SEQ ID NO: 3441827 - RNA, 15 nt, Pseudomonas aeruginosa PA01
cagcgguaugccgca

SEQ ID NO: 3441828 - RNA, 19 nt, Pseudomonas aeruginosa PA01
cagcucgacccgcccgccg

SEQ ID NO: 3441829 - RNA, 23 nt, Pseudomonas aeruginosa PA01
cagcucgacccgcccgccguccu

SEQ ID NO: 3441830 - RNA, 13 nt, Pseudomonas aeruginosa PA01
cagcucgaccuug

SEQ ID NO: 3441831 - RNA, 20 nt, Pseudomonas aeruginosa PA01
cagcucgaccuugcccuuga

SEQ ID NO: 3441832 - RNA, 16 nt, Pseudomonas aeruginosa PA01
cagcucgaggccagga

SEQ ID NO: 3441833 - RNA, 15 nt, Pseudomonas aeruginosa PA01
cagcucgaucagccc

SEQ ID NO: 3441834 - RNA, 20 nt, Pseudomonas aeruginosa PA01
cagcucgaucagcccgccaa

SEQ ID NO: 3441835 - RNA, 21 nt, Pseudomonas aeruginosa PA01
cagcucgaucagcccgccaac

SEQ ID NO: 3441836 - RNA, 17 nt, Pseudomonas aeruginosa PA01
cagcucgaucucauggu

SEQ ID NO: 3441837 - RNA, 14 nt, Pseudomonas aeruginosa PA01
cagcucgcccgccu

SEQ ID NO: 3441838 - RNA, 13 nt, Pseudomonas aeruginosa PA01
cagcucgccgaag

SEQ ID NO: 3441839 - RNA, 14 nt, Pseudomonas aeruginosa PA01
cagcucgccgaaga

SEQ ID NO: 3441840 - RNA, 14 nt, Pseudomonas aeruginosa PA01
cagcucgccgcgcu

SEQ ID NO: 3441841 - RNA, 17 nt, Pseudomonas aeruginosa PA01
cagcucgccgcgcucca

SEQ ID NO: 3441842 - RNA, 18 nt, Pseudomonas aeruginosa PA01
cagcucgccgcuacccag

SEQ ID NO: 3441843 - RNA, 13 nt, Pseudomonas aeruginosa PA01
cagcucgccgcuc

SEQ ID NO: 3441844 - RNA, 17 nt, Pseudomonas aeruginosa PA01
cagcucgccgcuccaca

SEQ ID NO: 3441845 - RNA, 13 nt, Pseudomonas aeruginosa PA01
cagcucgccggcg

SEQ ID NO: 3441846 - RNA, 21 nt, Pseudomonas aeruginosa PA01
cagcucgcgcaaccagccgga

SEQ ID NO: 3441847 - RNA, 13 nt, Pseudomonas aeruginosa PA01
cagcucgcgggac

SEQ ID NO: 3441848 - RNA, 20 nt, Pseudomonas aeruginosa PA01
cagcucgcgguaggccagcu

SEQ ID NO: 3441849 - RNA, 19 nt, Pseudomonas aeruginosa PA01
cagcucgcuaugcagcagg

SEQ ID NO: 3441850 - RNA, 21 nt, Pseudomonas aeruginosa PA01
cagcucgcuaugcagcaggua

SEQ ID NO: 3441851 - RNA, 14 nt, Pseudomonas aeruginosa PA01
cagcucgcugucca

SEQ ID NO: 3441852 - RNA, 19 nt, Pseudomonas aeruginosa PA01
cagcucgcugucgccgagc

SEQ ID NO: 3441853 - RNA, 23 nt, Pseudomonas aeruginosa PA01
cagcucggacaagggccagagca

SEQ ID NO: 3441854 - RNA, 16 nt, Pseudomonas aeruginosa PA01
cagcucggccaucagc

SEQ ID NO: 3441855 - RNA, 17 nt, Pseudomonas aeruginosa PA01
cagcucggccaucagcg

SEQ ID NO: 3441856 - RNA, 18 nt, Pseudomonas aeruginosa PA01
cagcucggccaucagcgc

SEQ ID NO: 3441857 - RNA, 20 nt, Pseudomonas aeruginosa PA01
cagcucggccaucagcgcca

SEQ ID NO: 3441858 - RNA, 22 nt, Pseudomonas aeruginosa PA01
cagcucggccaucagcgccagg

SEQ ID NO: 3441859 - RNA, 14 nt, Pseudomonas aeruginosa PA01
cagcucggccgagg

SEQ ID NO: 3441860 - RNA, 20 nt, Pseudomonas aeruginosa PA01
cagcucggccgagggcagcc

SEQ ID NO: 3441861 - RNA, 13 nt, Pseudomonas aeruginosa PA01
cagcucggccggc

SEQ ID NO: 3441862 - RNA, 15 nt, Pseudomonas aeruginosa PA01
cagcucggccggcag

SEQ ID NO: 3441863 - RNA, 20 nt, Pseudomonas aeruginosa PA01
cagcucggccggcaggcugu

SEQ ID NO: 3441864 - RNA, 15 nt, Pseudomonas aeruginosa PA01
cagcucggccugguc

SEQ ID NO: 3441865 - RNA, 16 nt, Pseudomonas aeruginosa PA01
cagcucggccuggucc

SEQ ID NO: 3441866 - RNA, 21 nt, Pseudomonas aeruginosa PA01
cagcucggcgacauagccggc

SEQ ID NO: 3441867 - RNA, 22 nt, Pseudomonas aeruginosa PA01
cagcucggcgacauagccggcg

SEQ ID NO: 3441868 - RNA, 14 nt, Pseudomonas aeruginosa PA01
cagcucggcgagga

SEQ ID NO: 3441869 - RNA, 16 nt, Pseudomonas aeruginosa PA01
cagcucggcgaugccg

SEQ ID NO: 3441870 - RNA, 24 nt, Pseudomonas aeruginosa PA01
cagcucggcgaugccgccgggcau

SEQ ID NO: 3441871 - RNA, 14 nt, Pseudomonas aeruginosa PA01
cagcucggcgcccu

SEQ ID NO: 3441872 - RNA, 16 nt, Pseudomonas aeruginosa PA01
cagcucggcgcccugg

SEQ ID NO: 3441873 - RNA, 20 nt, Pseudomonas aeruginosa PA01
cagcucggcgcccuggccgc

SEQ ID NO: 3441874 - RNA, 22 nt, Pseudomonas aeruginosa PA01
cagcucggcgcccuggccgcca

SEQ ID NO: 3441875 - RNA, 13 nt, Pseudomonas aeruginosa PA01
cagcucggcggga

SEQ ID NO: 3441876 - RNA, 20 nt, Pseudomonas aeruginosa PA01
cagcucggcguagcgcuggg

SEQ ID NO: 3441877 - RNA, 15 nt, Pseudomonas aeruginosa PA01
cagcucggucucgau

SEQ ID NO: 3441878 - RNA, 23 nt, Pseudomonas aeruginosa PA01
cagcucggucucgaucggcccgg

SEQ ID NO: 3441879 - RNA, 20 nt, Pseudomonas aeruginosa PA01
cagcucggugagcaggcgcc

SEQ ID NO: 3441880 - RNA, 14 nt, Pseudomonas aeruginosa PA01
cagcucguccaggc

SEQ ID NO: 3441881 - RNA, 17 nt, Pseudomonas aeruginosa PA01
cagcucguccaggcaag

SEQ ID NO: 3441882 - RNA, 18 nt, Pseudomonas aeruginosa PA01
cagcucguccaggcaagc

SEQ ID NO: 3441883 - RNA, 22 nt, Pseudomonas aeruginosa PA01
cagcucguccaggcaagcgcau

SEQ ID NO: 3441884 - RNA, 15 nt, Pseudomonas aeruginosa PA01
cagcucguccuuggu

SEQ ID NO: 3441885 - RNA, 15 nt, Pseudomonas aeruginosa PA01
cagcucgucgagcug

SEQ ID NO: 3441886 - RNA, 20 nt, Pseudomonas aeruginosa PA01
cagcucgucgagcugcucgg

SEQ ID NO: 3441887 - RNA, 14 nt, Pseudomonas aeruginosa PA01
cagcucgucgcccu

SEQ ID NO: 3441888 - RNA, 16 nt, Pseudomonas aeruginosa PA01
cagcucgucgcccuuc

SEQ ID NO: 3441889 - RNA, 17 nt, Pseudomonas aeruginosa PA01
cagcucgucgcccuuca

SEQ ID NO: 3441890 - RNA, 22 nt, Pseudomonas aeruginosa PA01
cagcucgucgcccuucaggucg

SEQ ID NO: 3441891 - RNA, 14 nt, Pseudomonas aeruginosa PA01
cagcucgucgugga

SEQ ID NO: 3441892 - RNA, 15 nt, Pseudomonas aeruginosa PA01
cagcucgucguggaa

SEQ ID NO: 3441893 - RNA, 16 nt, Pseudomonas aeruginosa PA01
cagcucgucguggaag

SEQ ID NO: 3441894 - RNA, 14 nt, Pseudomonas aeruginosa PA01
cagcucguggcugg

SEQ ID NO: 3441895 - RNA, 17 nt, Pseudomonas aeruginosa PA01
cagcucguggcuggcgc

SEQ ID NO: 3441896 - RNA, 21 nt, Pseudomonas aeruginosa PA01
cagcucguggcuggcgccgcg

SEQ ID NO: 3441897 - RNA, 23 nt, Pseudomonas aeruginosa PA01
cagcucguggcuggcgccgcggg

SEQ ID NO: 3441898 - RNA, 15 nt, Pseudomonas aeruginosa PA01
cagcucguugcacag

SEQ ID NO: 3441899 - RNA, 22 nt, Pseudomonas aeruginosa PA01
cagcucguugcacagcgcccag

SEQ ID NO: 3441900 - RNA, 17 nt, Pseudomonas aeruginosa PA01
cagcucguugcccggcu

SEQ ID NO: 3441901 - RNA, 19 nt, Pseudomonas aeruginosa PA01
cagcucguuggccaccugc

SEQ ID NO: 3441902 - RNA, 16 nt, Pseudomonas aeruginosa PA01
cagcucucccgaggcg

SEQ ID NO: 3441903 - RNA, 23 nt, Pseudomonas aeruginosa PA01
cagcucuggggucaguucguuga

SEQ ID NO: 3441904 - RNA, 21 nt, Pseudomonas aeruginosa PA01
cagcucugucuccugugccuu

SEQ ID NO: 3441905 - RNA, 19 nt, Pseudomonas aeruginosa PA01
cagcugcaccgcgcggauc

SEQ ID NO: 3441906 - RNA, 15 nt, Pseudomonas aeruginosa PA01
cagcugccagccccg

SEQ ID NO: 3441907 - RNA, 20 nt, Pseudomonas aeruginosa PA01
cagcugcgagaacaggcgga

SEQ ID NO: 3441908 - RNA, 21 nt, Pseudomonas aeruginosa PA01
cagcugcgagaacaggcggau

SEQ ID NO: 3441909 - RNA, 12 nt, Pseudomonas aeruginosa PA01
cagcugcggcgg

SEQ ID NO: 3441910 - RNA, 17 nt, Pseudomonas aeruginosa PA01
cagcugcggcggcacca

SEQ ID NO: 3441911 - RNA, 19 nt, Pseudomonas aeruginosa PA01
cagcugcggcggcaccacg

SEQ ID NO: 3441912 - RNA, 20 nt, Pseudomonas aeruginosa PA01
cagcugcggcggcaccacgu

SEQ ID NO: 3441913 - RNA, 23 nt, Pseudomonas aeruginosa PA01
cagcuggauagaguacucggcua

SEQ ID NO: 3441914 - RNA, 22 nt, Pseudomonas aeruginosa PA01
cagcuggauccgugccaggcgc

SEQ ID NO: 3441915 - RNA, 23 nt, Pseudomonas aeruginosa PA01
cagcuggauccgugccaggcgcu

SEQ ID NO: 3441916 - RNA, 13 nt, Pseudomonas aeruginosa PA01
cagcuggcgacgg

SEQ ID NO: 3441917 - RNA, 16 nt, Pseudomonas aeruginosa PA01
cagcuggcgcagccgu

SEQ ID NO: 3441918 - RNA, 16 nt, Pseudomonas aeruginosa PA01
cagcuggcgcgucgcu

SEQ ID NO: 3441919 - RNA, 18 nt, Pseudomonas aeruginosa PA01
cagcuggcgcgucgcugc

SEQ ID NO: 3441920 - RNA, 19 nt, Pseudomonas aeruginosa PA01
cagcuggcgcguugugccg

SEQ ID NO: 3441921 - RNA, 22 nt, Pseudomonas aeruginosa PA01
cagcuggcgcguugugccgcca

SEQ ID NO: 3441922 - RNA, 16 nt, Pseudomonas aeruginosa PA01
cagcuguccgcgccgc

SEQ ID NO: 3441923 - RNA, 17 nt, Pseudomonas aeruginosa PA01
cagcuguccgcgccgcg

SEQ ID NO: 3441924 - RNA, 14 nt, Pseudomonas aeruginosa PA01
cagcuucaggcgca

SEQ ID NO: 3441925 - RNA, 13 nt, Pseudomonas aeruginosa PA01
cagcuucagggug

SEQ ID NO: 3441926 - RNA, 14 nt, Pseudomonas aeruginosa PA01
cagcuuccaggcgc

SEQ ID NO: 3441927 - RNA, 19 nt, Pseudomonas aeruginosa PA01
cagcuuccaggcgcgcugg

SEQ ID NO: 3441928 - RNA, 15 nt, Pseudomonas aeruginosa PA01
cagcuucgccgcccu

SEQ ID NO: 3441929 - RNA, 16 nt, Pseudomonas aeruginosa PA01
cagcuucgccgcccug

SEQ ID NO: 3441930 - RNA, 17 nt, Pseudomonas aeruginosa PA01
caggaccggcaggucgg

SEQ ID NO: 3441931 - RNA, 13 nt, Pseudomonas aeruginosa PA01
caggaccuccugc

SEQ ID NO: 3441932 - RNA, 14 nt, Pseudomonas aeruginosa PA01
caggaccuccugca

SEQ ID NO: 3441933 - RNA, 17 nt, Pseudomonas aeruginosa PA01
caggaccucgaagcugg

SEQ ID NO: 3441934 - RNA, 19 nt, Pseudomonas aeruginosa PA01
caggaccucgaagcuggcc

SEQ ID NO: 3441935 - RNA, 20 nt, Pseudomonas aeruginosa PA01
caggaccucgaagcuggcca

SEQ ID NO: 3441936 - RNA, 16 nt, Pseudomonas aeruginosa PA01
caggaccuggcugagg

SEQ ID NO: 3441937 - RNA, 17 nt, Pseudomonas aeruginosa PA01
caggaccuuccgccagc

SEQ ID NO: 3441938 - RNA, 18 nt, Pseudomonas aeruginosa PA01
caggaccuuccgccagca

SEQ ID NO: 3441939 - RNA, 20 nt, Pseudomonas aeruginosa PA01
caggaccuuccgccagcagg

SEQ ID NO: 3441940 - RNA, 21 nt, Pseudomonas aeruginosa PA01
caggaccuuccgccagcaggc

SEQ ID NO: 3441941 - RNA, 23 nt, Pseudomonas aeruginosa PA01
caggaccuuccgccagcaggcgc

SEQ ID NO: 3441942 - RNA, 22 nt, Pseudomonas aeruginosa PA01
caggaccuugucgcgcaccaca

SEQ ID NO: 3441943 - RNA, 21 nt, Pseudomonas aeruginosa PA01
caggacgaagucgccggcauc

SEQ ID NO: 3441944 - RNA, 14 nt, Pseudomonas aeruginosa PA01
caggacgagacgcc

SEQ ID NO: 3441945 - RNA, 19 nt, Pseudomonas aeruginosa PA01
caggacgagacgccgagga

SEQ ID NO: 3441946 - RNA, 22 nt, Pseudomonas aeruginosa PA01
caggacgagaguguccgagccg

SEQ ID NO: 3441947 - RNA, 21 nt, Pseudomonas aeruginosa PA01
caggacgagcguccgccgccg

SEQ ID NO: 3441948 - RNA, 15 nt, Pseudomonas aeruginosa PA01
caggacgaggaaggc

SEQ ID NO: 3441949 - RNA, 19 nt, Pseudomonas aeruginosa PA01
caggacgaugaucaccagg

SEQ ID NO: 3441950 - RNA, 16 nt, Pseudomonas aeruginosa PA01
caggacgccaccaggc

SEQ ID NO: 3441951 - RNA, 18 nt, Pseudomonas aeruginosa PA01
caggacgccaccaggccg

SEQ ID NO: 3441952 - RNA, 17 nt, Pseudomonas aeruginosa PA01
caggacgcuccugcgcc

SEQ ID NO: 3441953 - RNA, 19 nt, Pseudomonas aeruginosa PA01
caggacgcuccugcgccgg

SEQ ID NO: 3441954 - RNA, 21 nt, Pseudomonas aeruginosa PA01
caggacgcuccugcgccggcu

SEQ ID NO: 3441955 - RNA, 23 nt, Pseudomonas aeruginosa PA01
caggacgcuccugcgccggcucg

SEQ ID NO: 3441956 - RNA, 14 nt, Pseudomonas aeruginosa PA01
caggacgcuggcga

SEQ ID NO: 3441957 - RNA, 22 nt, Pseudomonas aeruginosa PA01
caggacggauaacggcagccgc

SEQ ID NO: 3441958 - RNA, 16 nt, Pseudomonas aeruginosa PA01
caggacguccuggccg

SEQ ID NO: 3441959 - RNA, 17 nt, Pseudomonas aeruginosa PA01
caggacguccuggccga

SEQ ID NO: 3441960 - RNA, 19 nt, Pseudomonas aeruginosa PA01
caggacguuauccguccua

SEQ ID NO: 3441961 - RNA, 21 nt, Pseudomonas aeruginosa PA01
caggacucgccaucggccugg

SEQ ID NO: 3441962 - RNA, 14 nt, Pseudomonas aeruginosa PA01
caggacugcccgcg

SEQ ID NO: 3441963 - RNA, 17 nt, Pseudomonas aeruginosa PA01
caggagaagcgccucgc

SEQ ID NO: 3441964 - RNA, 20 nt, Pseudomonas aeruginosa PA01
caggagauacgcuccggugc

SEQ ID NO: 3441965 - RNA, 16 nt, Pseudomonas aeruginosa PA01
caggagcacgccgugc

SEQ ID NO: 3441966 - RNA, 17 nt, Pseudomonas aeruginosa PA01
caggagcacgccgugca

SEQ ID NO: 3441967 - RNA, 20 nt, Pseudomonas aeruginosa PA01
caggagcagcuugcgcgagu

SEQ ID NO: 3441968 - RNA, 18 nt, Pseudomonas aeruginosa PA01
caggagcagggcgccgau

SEQ ID NO: 3441969 - RNA, 15 nt, Pseudomonas aeruginosa PA01
caggagcaucggcgc

SEQ ID NO: 3441970 - RNA, 18 nt, Pseudomonas aeruginosa PA01
caggagcaugaaggucga

SEQ ID NO: 3441971 - RNA, 19 nt, Pseudomonas aeruginosa PA01
caggagccaucgcuccagc

SEQ ID NO: 3441972 - RNA, 16 nt, Pseudomonas aeruginosa PA01
caggagcgccaucagc

SEQ ID NO: 3441973 - RNA, 18 nt, Pseudomonas aeruginosa PA01
caggagcgccgcgcagcg

SEQ ID NO: 3441974 - RNA, 20 nt, Pseudomonas aeruginosa PA01
caggagcgccgcgcagcgcg

SEQ ID NO: 3441975 - RNA, 23 nt, Pseudomonas aeruginosa PA01
caggagcgccgcgcagcgcggcg

SEQ ID NO: 3441976 - RNA, 20 nt, Pseudomonas aeruginosa PA01
caggagcguugcgggcaggu

SEQ ID NO: 3441977 - RNA, 22 nt, Pseudomonas aeruginosa PA01
caggagcguugcgggcaggucg

SEQ ID NO: 3441978 - RNA, 19 nt, Pseudomonas aeruginosa PA01
caggaggauacggcgcagc

SEQ ID NO: 3441979 - RNA, 22 nt, Pseudomonas aeruginosa PA01
caggaggauacggcgcagcagg

SEQ ID NO: 3441980 - RNA, 17 nt, Pseudomonas aeruginosa PA01
caggaggaucgccagga

SEQ ID NO: 3441981 - RNA, 18 nt, Pseudomonas aeruginosa PA01
caggaggauucgccagcc

SEQ ID NO: 3441982 - RNA, 19 nt, Pseudomonas aeruginosa PA01
caggaggauucgccagccu

SEQ ID NO: 3441983 - RNA, 22 nt, Pseudomonas aeruginosa PA01
caggaggcccacgggcggccga

SEQ ID NO: 3441984 - RNA, 16 nt, Pseudomonas aeruginosa PA01
caggagggcugcuguc

SEQ ID NO: 3441985 - RNA, 16 nt, Pseudomonas aeruginosa PA01
caggaguaggcaucga

SEQ ID NO: 3441986 - RNA, 21 nt, Pseudomonas aeruginosa PA01
caggaguuucaucucggcgca

SEQ ID NO: 3441987 - RNA, 16 nt, Pseudomonas aeruginosa PA01
caggauagccggcgcg

SEQ ID NO: 3441988 - RNA, 14 nt, Pseudomonas aeruginosa PA01
caggauaucgccca

SEQ ID NO: 3441989 - RNA, 19 nt, Pseudomonas aeruginosa PA01
caggaucacaucgcccggc

SEQ ID NO: 3441990 - RNA, 14 nt, Pseudomonas aeruginosa PA01
caggauccaggugc

SEQ ID NO: 3441991 - RNA, 18 nt, Pseudomonas aeruginosa PA01
caggauccaggugcgcgg

SEQ ID NO: 3441992 - RNA, 22 nt, Pseudomonas aeruginosa PA01
caggauccaggugcgcggcagg

SEQ ID NO: 3441993 - RNA, 22 nt, Pseudomonas aeruginosa PA01
caggaucgaacuggccagcacc

SEQ ID NO: 3441994 - RNA, 23 nt, Pseudomonas aeruginosa PA01
caggaucgaacuggccagcacca

SEQ ID NO: 3441995 - RNA, 14 nt, Pseudomonas aeruginosa PA01
caggaucgacagca

SEQ ID NO: 3441996 - RNA, 16 nt, Pseudomonas aeruginosa PA01
caggaucgacagcagc

SEQ ID NO: 3441997 - RNA, 20 nt, Pseudomonas aeruginosa PA01
caggaucgacagcagcgcca

SEQ ID NO: 3441998 - RNA, 20 nt, Pseudomonas aeruginosa PA01
caggaucgaccccgccgggg

SEQ ID NO: 3441999 - RNA, 21 nt, Pseudomonas aeruginosa PA01
caggaucgagcccuggucgac

SEQ ID NO: 3442000 - RNA, 15 nt, Pseudomonas aeruginosa PA01
caggaucgccgggcu

SEQ ID NO: 3442001 - RNA, 18 nt, Pseudomonas aeruginosa PA01
caggaucgccuccaccag

SEQ ID NO: 3442002 - RNA, 22 nt, Pseudomonas aeruginosa PA01
caggaucgccuccaccagcgcc

SEQ ID NO: 3442003 - RNA, 14 nt, Pseudomonas aeruginosa PA01
caggaucggcaugg

SEQ ID NO: 3442004 - RNA, 15 nt, Pseudomonas aeruginosa PA01
caggaucggcgccca

SEQ ID NO: 3442005 - RNA, 18 nt, Pseudomonas aeruginosa PA01
caggaucggcgcccagca

SEQ ID NO: 3442006 - RNA, 21 nt, Pseudomonas aeruginosa PA01
caggaucggcgcccagcacca

SEQ ID NO: 3442007 - RNA, 14 nt, Pseudomonas aeruginosa PA01
caggaucgucggcc

SEQ ID NO: 3442008 - RNA, 15 nt, Pseudomonas aeruginosa PA01
caggaucgucggccc

SEQ ID NO: 3442009 - RNA, 17 nt, Pseudomonas aeruginosa PA01
caggaucgucggcccgc

SEQ ID NO: 3442010 - RNA, 18 nt, Pseudomonas aeruginosa PA01
caggaucgucggcccgca

SEQ ID NO: 3442011 - RNA, 17 nt, Pseudomonas aeruginosa PA01
caggaucuccucggcca

SEQ ID NO: 3442012 - RNA, 21 nt, Pseudomonas aeruginosa PA01
caggaucugcugcaacauggc

SEQ ID NO: 3442013 - RNA, 22 nt, Pseudomonas aeruginosa PA01
caggaucugcugcaacauggcg

SEQ ID NO: 3442014 - RNA, 13 nt, Pseudomonas aeruginosa PA01
caggaugaccagg

SEQ ID NO: 3442015 - RNA, 16 nt, Pseudomonas aeruginosa PA01
caggaugaccaggcug

SEQ ID NO: 3442016 - RNA, 17 nt, Pseudomonas aeruginosa PA01
caggaugaccaggcuga

SEQ ID NO: 3442017 - RNA, 20 nt, Pseudomonas aeruginosa PA01
caggaugcaaccgcccuggu

SEQ ID NO: 3442018 - RNA, 23 nt, Pseudomonas aeruginosa PA01
caggaugcccugcucuuccagcg

SEQ ID NO: 3442019 - RNA, 22 nt, Pseudomonas aeruginosa PA01
caggaugggcgaagccggcggc

SEQ ID NO: 3442020 - RNA, 23 nt, Pseudomonas aeruginosa PA01
caggaugggcgaagccggcggcg

SEQ ID NO: 3442021 - RNA, 17 nt, Pseudomonas aeruginosa PA01
caggauguccuuguucg

SEQ ID NO: 3442022 - RNA, 22 nt, Pseudomonas aeruginosa PA01
caggauguccuuguucggcugg

SEQ ID NO: 3442023 - RNA, 16 nt, Pseudomonas aeruginosa PA01
caggauguggccgucg

SEQ ID NO: 3442024 - RNA, 19 nt, Pseudomonas aeruginosa PA01
caggauguggccgucgcgc

SEQ ID NO: 3442025 - RNA, 23 nt, Pseudomonas aeruginosa PA01
caggauguggccgucgcgccgcg

SEQ ID NO: 3442026 - RNA, 17 nt, Pseudomonas aeruginosa PA01
caggauguucgccgagg

SEQ ID NO: 3442027 - RNA, 21 nt, Pseudomonas aeruginosa PA01
caggauguucgccgaggggcg

SEQ ID NO: 3442028 - RNA, 21 nt, Pseudomonas aeruginosa PA01
caggauguugaacaggcucga

SEQ ID NO: 3442029 - RNA, 18 nt, Pseudomonas aeruginosa PA01
caggauguugacgauggc

SEQ ID NO: 3442030 - RNA, 19 nt, Pseudomonas aeruginosa PA01
caggauguugacgauggcc

SEQ ID NO: 3442031 - RNA, 15 nt, Pseudomonas aeruginosa PA01
caggcccagcgcggc

SEQ ID NO: 3442032 - RNA, 18 nt, Pseudomonas aeruginosa PA01
caggcccagcgcggcgcc

SEQ ID NO: 3442033 - RNA, 13 nt, Pseudomonas aeruginosa PA01
caggcccagcuuc

SEQ ID NO: 3442034 - RNA, 23 nt, Pseudomonas aeruginosa PA01
caggcccaguucgcugccgccgc

SEQ ID NO: 3442035 - RNA, 20 nt, Pseudomonas aeruginosa PA01
caggcccauccuggcgauca

SEQ ID NO: 3442036 - RNA, 20 nt, Pseudomonas aeruginosa PA01
caggcccaugauggucggca

SEQ ID NO: 3442037 - RNA, 15 nt, Pseudomonas aeruginosa PA01
caggccccaggccgc

SEQ ID NO: 3442038 - RNA, 18 nt, Pseudomonas aeruginosa PA01
caggccccaggccgccgc

SEQ ID NO: 3442039 - RNA, 14 nt, Pseudomonas aeruginosa PA01
caggccccagggcc

SEQ ID NO: 3442040 - RNA, 21 nt, Pseudomonas aeruginosa PA01
caggccccagggccggcgccc

SEQ ID NO: 3442041 - RNA, 14 nt, Pseudomonas aeruginosa PA01
caggcccgagccgg

SEQ ID NO: 3442042 - RNA, 17 nt, Pseudomonas aeruginosa PA01
caggcccgccgcggcga

SEQ ID NO: 3442043 - RNA, 15 nt, Pseudomonas aeruginosa PA01
caggcccggccgccu

SEQ ID NO: 3442044 - RNA, 18 nt, Pseudomonas aeruginosa PA01
caggcccggccgccugcc

SEQ ID NO: 3442045 - RNA, 15 nt, Pseudomonas aeruginosa PA01
caggcccggcgcugc

SEQ ID NO: 3442046 - RNA, 16 nt, Pseudomonas aeruginosa PA01
caggcccggcgcugcu

SEQ ID NO: 3442047 - RNA, 14 nt, Pseudomonas aeruginosa PA01
caggcccucagcgg

SEQ ID NO: 3442048 - RNA, 13 nt, Pseudomonas aeruginosa PA01
caggcccugcagc

SEQ ID NO: 3442049 - RNA, 16 nt, Pseudomonas aeruginosa PA01
caggcccugcagcgcc

SEQ ID NO: 3442050 - RNA, 13 nt, Pseudomonas aeruginosa PA01
caggcccugcucc

SEQ ID NO: 3442051 - RNA, 20 nt, Pseudomonas aeruginosa PA01
caggcccugcuccuccaggc

SEQ ID NO: 3442052 - RNA, 23 nt, Pseudomonas aeruginosa PA01
caggcccugcuucuguaguugau

SEQ ID NO: 3442053 - RNA, 19 nt, Pseudomonas aeruginosa PA01
caggcccuggaucaccgcg

SEQ ID NO: 3442054 - RNA, 20 nt, Pseudomonas aeruginosa PA01
caggcccuggaucaccgcgg

SEQ ID NO: 3442055 - RNA, 21 nt, Pseudomonas aeruginosa PA01
caggcccuggaucaccgcggc

SEQ ID NO: 3442056 - RNA, 22 nt, Pseudomonas aeruginosa PA01
caggcccuggaucaccgcggcg

SEQ ID NO: 3442057 - RNA, 17 nt, Pseudomonas aeruginosa PA01
caggcccugggcggcgg

SEQ ID NO: 3442058 - RNA, 20 nt, Pseudomonas aeruginosa PA01
caggcccugggcggcgggcc

SEQ ID NO: 3442059 - RNA, 17 nt, Pseudomonas aeruginosa PA01
caggcccuugaacaggc

SEQ ID NO: 3442060 - RNA, 15 nt, Pseudomonas aeruginosa PA01
caggcccuugaggaa

SEQ ID NO: 3442061 - RNA, 16 nt, Pseudomonas aeruginosa PA01
caggcccuugaggaag

SEQ ID NO: 3442062 - RNA, 17 nt, Pseudomonas aeruginosa PA01
caggcccuugaggaagu

SEQ ID NO: 3442063 - RNA, 23 nt, Pseudomonas aeruginosa PA01
caggcccuugagggccucggcga

SEQ ID NO: 3442064 - RNA, 20 nt, Pseudomonas aeruginosa PA01
caggcccuuggucaggccga

SEQ ID NO: 3442065 - RNA, 20 nt, Pseudomonas aeruginosa PA01
caggcccuuuuccaccggcc

SEQ ID NO: 3442066 - RNA, 21 nt, Pseudomonas aeruginosa PA01
caggcccuuuuccaccggccg

SEQ ID NO: 3442067 - RNA, 23 nt, Pseudomonas aeruginosa PA01
caggccgaacucacggaugccgg

SEQ ID NO: 3442068 - RNA, 16 nt, Pseudomonas aeruginosa PA01
caggccgaagccgccg

SEQ ID NO: 3442069 - RNA, 17 nt, Pseudomonas aeruginosa PA01
caggccgaagccgccgg

SEQ ID NO: 3442070 - RNA, 18 nt, Pseudomonas aeruginosa PA01
caggccgaagccgccggg

SEQ ID NO: 3442071 - RNA, 19 nt, Pseudomonas aeruginosa PA01
caggccgaagccgccggga

SEQ ID NO: 3442072 - RNA, 15 nt, Pseudomonas aeruginosa PA01
caggccgaaggccag

SEQ ID NO: 3442073 - RNA, 16 nt, Pseudomonas aeruginosa PA01
caggccgaaggccagg

SEQ ID NO: 3442074 - RNA, 19 nt, Pseudomonas aeruginosa PA01
caggccgaaggccaggacc

SEQ ID NO: 3442075 - RNA, 16 nt, Pseudomonas aeruginosa PA01
caggccgaaggccugg

SEQ ID NO: 3442076 - RNA, 19 nt, Pseudomonas aeruginosa PA01
caggccgaaggccuggccg

SEQ ID NO: 3442077 - RNA, 20 nt, Pseudomonas aeruginosa PA01
caggccgaaggccuggccgu

SEQ ID NO: 3442078 - RNA, 17 nt, Pseudomonas aeruginosa PA01
caggccgaauccgccgg

SEQ ID NO: 3442079 - RNA, 19 nt, Pseudomonas aeruginosa PA01
caggccgaauccgccggcg

SEQ ID NO: 3442080 - RNA, 20 nt, Pseudomonas aeruginosa PA01
caggccgaauccgccggcga

SEQ ID NO: 3442081 - RNA, 17 nt, Pseudomonas aeruginosa PA01
caggccgacagcggcug

SEQ ID NO: 3442082 - RNA, 18 nt, Pseudomonas aeruginosa PA01
caggccgacagcggcugg

SEQ ID NO: 3442083 - RNA, 20 nt, Pseudomonas aeruginosa PA01
caggccgaccagcagggcca

SEQ ID NO: 3442084 - RNA, 17 nt, Pseudomonas aeruginosa PA01
caggccgaccagcgccg

SEQ ID NO: 3442085 - RNA, 20 nt, Pseudomonas aeruginosa PA01
caggccgaccagcgccgacu

SEQ ID NO: 3442086 - RNA, 20 nt, Pseudomonas aeruginosa PA01
caggccgacccgcaggccgg

SEQ ID NO: 3442087 - RNA, 16 nt, Pseudomonas aeruginosa PA01
caggccgacgaagacc

SEQ ID NO: 3442088 - RNA, 14 nt, Pseudomonas aeruginosa PA01
caggccgacggcgc

SEQ ID NO: 3442089 - RNA, 15 nt, Pseudomonas aeruginosa PA01
caggccgacggcgcg

SEQ ID NO: 3442090 - RNA, 17 nt, Pseudomonas aeruginosa PA01
caggccgacggcgcgcu

SEQ ID NO: 3442091 - RNA, 19 nt, Pseudomonas aeruginosa PA01
caggccgagaaaccgccau

SEQ ID NO: 3442092 - RNA, 22 nt, Pseudomonas aeruginosa PA01
caggccgagaaaccgccaucga

SEQ ID NO: 3442093 - RNA, 18 nt, Pseudomonas aeruginosa PA01
caggccgagaccgcagcc

SEQ ID NO: 3442094 - RNA, 23 nt, Pseudomonas aeruginosa PA01
caggccgagcaauccggcgcugc

SEQ ID NO: 3442095 - RNA, 12 nt, Pseudomonas aeruginosa PA01
caggccgagcac

SEQ ID NO: 3442096 - RNA, 15 nt, Pseudomonas aeruginosa PA01
caggccgagcagcgc

SEQ ID NO: 3442097 - RNA, 16 nt, Pseudomonas aeruginosa PA01
caggccgagcagcgcc

SEQ ID NO: 3442098 - RNA, 17 nt, Pseudomonas aeruginosa PA01
caggccgagcagcgcca

SEQ ID NO: 3442099 - RNA, 19 nt, Pseudomonas aeruginosa PA01
caggccgagcccgagugcg

SEQ ID NO: 3442100 - RNA, 15 nt, Pseudomonas aeruginosa PA01
caggccgagcgccag

SEQ ID NO: 3442101 - RNA, 23 nt, Pseudomonas aeruginosa PA01
caggccgagcgccagggccaggg

SEQ ID NO: 3442102 - RNA, 17 nt, Pseudomonas aeruginosa PA01
caggccgagcgcgccgc

SEQ ID NO: 3442103 - RNA, 18 nt, Pseudomonas aeruginosa PA01
caggccgagcgcgccgcc

SEQ ID NO: 3442104 - RNA, 19 nt, Pseudomonas aeruginosa PA01
caggccgagcgcgccgccg

SEQ ID NO: 3442105 - RNA, 20 nt, Pseudomonas aeruginosa PA01
caggccgagcgcgccgccga

SEQ ID NO: 3442106 - RNA, 14 nt, Pseudomonas aeruginosa PA01
caggccgaggagga

SEQ ID NO: 3442107 - RNA, 17 nt, Pseudomonas aeruginosa PA01
caggccgaggaugcucg

SEQ ID NO: 3442108 - RNA, 12 nt, Pseudomonas aeruginosa PA01
caggccgaggcg

SEQ ID NO: 3442109 - RNA, 23 nt, Pseudomonas aeruginosa PA01
caggccgaggcgcuucugcucgg

SEQ ID NO: 3442110 - RNA, 17 nt, Pseudomonas aeruginosa PA01
caggccgagggcugccg

SEQ ID NO: 3442111 - RNA, 20 nt, Pseudomonas aeruginosa PA01
caggccgagggcugccgccc

SEQ ID NO: 3442112 - RNA, 22 nt, Pseudomonas aeruginosa PA01
caggccgagggcugccgcccgg

SEQ ID NO: 3442113 - RNA, 17 nt, Pseudomonas aeruginosa PA01
caggccgaggucggcgg

SEQ ID NO: 3442114 - RNA, 21 nt, Pseudomonas aeruginosa PA01
caggccgaggucggcggcggg

SEQ ID NO: 3442115 - RNA, 18 nt, Pseudomonas aeruginosa PA01
caggccgagguugacgaa

SEQ ID NO: 3442116 - RNA, 24 nt, Pseudomonas aeruginosa PA01
caggccgagguuuccaguugcagg

SEQ ID NO: 3442117 - RNA, 16 nt, Pseudomonas aeruginosa PA01
caggccgaguccgcgc

SEQ ID NO: 3442118 - RNA, 18 nt, Pseudomonas aeruginosa PA01
caggccgaguccgcgcgc

SEQ ID NO: 3442119 - RNA, 14 nt, Pseudomonas aeruginosa PA01
caggccgaucacca

SEQ ID NO: 3442120 - RNA, 19 nt, Pseudomonas aeruginosa PA01
caggccgaucaccaccagc

SEQ ID NO: 3442121 - RNA, 20 nt, Pseudomonas aeruginosa PA01
caggccgaucaccaccagcg

SEQ ID NO: 3442122 - RNA, 21 nt, Pseudomonas aeruginosa PA01
caggccgaucaccaccagcgc

SEQ ID NO: 3442123 - RNA, 23 nt, Pseudomonas aeruginosa PA01
caggccgaucaccaccagcgccg

SEQ ID NO: 3442124 - RNA, 17 nt, Pseudomonas aeruginosa PA01
caggccgaucaccagcg

SEQ ID NO: 3442125 - RNA, 20 nt, Pseudomonas aeruginosa PA01
caggccgaucaccagcgcca

SEQ ID NO: 3442126 - RNA, 21 nt, Pseudomonas aeruginosa PA01
caggccgaucaccagcgccag

SEQ ID NO: 3442127 - RNA, 23 nt, Pseudomonas aeruginosa PA01
caggccgaucaccagcgccaggc

SEQ ID NO: 3442128 - RNA, 24 nt, Pseudomonas aeruginosa PA01
caggccgaucaccagcgccaggcc

SEQ ID NO: 3442129 - RNA, 15 nt, Pseudomonas aeruginosa PA01
caggccgaucagcgg

SEQ ID NO: 3442130 - RNA, 18 nt, Pseudomonas aeruginosa PA01
caggccgaucagcggcgg

SEQ ID NO: 3442131 - RNA, 14 nt, Pseudomonas aeruginosa PA01
caggccgaucagga

SEQ ID NO: 3442132 - RNA, 16 nt, Pseudomonas aeruginosa PA01
caggccgaucaggaaa

SEQ ID NO: 3442133 - RNA, 19 nt, Pseudomonas aeruginosa PA01
caggccugggucaccagca

SEQ ID NO: 3442134 - RNA, 20 nt, Pseudomonas aeruginosa PA01
caggccugggucaccagcac

SEQ ID NO: 3442135 - RNA, 21 nt, Pseudomonas aeruginosa PA01
caggccugggucaccagcacc

SEQ ID NO: 3442136 - RNA, 22 nt, Pseudomonas aeruginosa PA01
caggccugggucaccagcacca

SEQ ID NO: 3442137 - RNA, 13 nt, Pseudomonas aeruginosa PA01
caggccuguggau

SEQ ID NO: 3442138 - RNA, 19 nt, Pseudomonas aeruginosa PA01
caggccuguggauagaaaa

SEQ ID NO: 3442139 - RNA, 15 nt, Pseudomonas aeruginosa PA01
caggccuuccacgcc

SEQ ID NO: 3442140 - RNA, 19 nt, Pseudomonas aeruginosa PA01
caggccuuccagaacgccg

SEQ ID NO: 3442141 - RNA, 21 nt, Pseudomonas aeruginosa PA01
caggccuuccagaacgccgcg

SEQ ID NO: 3442142 - RNA, 16 nt, Pseudomonas aeruginosa PA01
caggccuucccacucc

SEQ ID NO: 3442143 - RNA, 23 nt, Pseudomonas aeruginosa PA01
caggccuucgacuucgacgaacu

SEQ ID NO: 3442144 - RNA, 15 nt, Pseudomonas aeruginosa PA01
caggccuucggcgcc

SEQ ID NO: 3442145 - RNA, 18 nt, Pseudomonas aeruginosa PA01
caggccuucggcgccgga

SEQ ID NO: 3442146 - RNA, 14 nt, Pseudomonas aeruginosa PA01
caggccuugcaggg

SEQ ID NO: 3442147 - RNA, 16 nt, Pseudomonas aeruginosa PA01
caggccuugcagggcc

SEQ ID NO: 3442148 - RNA, 23 nt, Pseudomonas aeruginosa PA01
caggccuugcagggccgccagcc

SEQ ID NO: 3442149 - RNA, 16 nt, Pseudomonas aeruginosa PA01
caggccuugcgcggcg

SEQ ID NO: 3442150 - RNA, 21 nt, Pseudomonas aeruginosa PA01
caggccuugcgcggcgccggu

SEQ ID NO: 3442151 - RNA, 23 nt, Pseudomonas aeruginosa PA01
caggccuuggcccgguuggccag

SEQ ID NO: 3442152 - RNA, 18 nt, Pseudomonas aeruginosa PA01
caggccuugugcgccagc

SEQ ID NO: 3442153 - RNA, 17 nt, Pseudomonas aeruginosa PA01
caggcgaaaaaaagccc

SEQ ID NO: 3442154 - RNA, 20 nt, Pseudomonas aeruginosa PA01
caggcgaaaaaaagccccgc

SEQ ID NO: 3442155 - RNA, 21 nt, Pseudomonas aeruginosa PA01
caggcgaaaaaaagccccgcc

SEQ ID NO: 3442156 - RNA, 17 nt, Pseudomonas aeruginosa PA01
caggcgaaagucggcgc

SEQ ID NO: 3442157 - RNA, 18 nt, Pseudomonas aeruginosa PA01
caggcgaaagucggcgcg

SEQ ID NO: 3442158 - RNA, 20 nt, Pseudomonas aeruginosa PA01
caggcgaaagucggcgcgac

SEQ ID NO: 3442159 - RNA, 22 nt, Pseudomonas aeruginosa PA01
caggcgaaagucggcgcgacug

SEQ ID NO: 3442160 - RNA, 14 nt, Pseudomonas aeruginosa PA01
caggcgaacagggc

SEQ ID NO: 3442161 - RNA, 22 nt, Pseudomonas aeruginosa PA01
caggcgaaccuggagaaauccg

SEQ ID NO: 3442162 - RNA, 23 nt, Pseudomonas aeruginosa PA01
caggcgaacugccgacggcggcg

SEQ ID NO: 3442163 - RNA, 18 nt, Pseudomonas aeruginosa PA01
caggcgaagaaagccccu

SEQ ID NO: 3442164 - RNA, 23 nt, Pseudomonas aeruginosa PA01
caggcgaagcggcuggccgcggu

SEQ ID NO: 3442165 - RNA, 22 nt, Pseudomonas aeruginosa PA01
caggcgaaggcgaucccguaga

SEQ ID NO: 3442166 - RNA, 21 nt, Pseudomonas aeruginosa PA01
caggcgaaggucgaaggcgcg

SEQ ID NO: 3442167 - RNA, 16 nt, Pseudomonas aeruginosa PA01
caggcgacgccgcgcu

SEQ ID NO: 3442168 - RNA, 17 nt, Pseudomonas aeruginosa PA01
caggcgacgccgcgcug

SEQ ID NO: 3442169 - RNA, 18 nt, Pseudomonas aeruginosa PA01
caggcgacgccgcgcugc

SEQ ID NO: 3442170 - RNA, 16 nt, Pseudomonas aeruginosa PA01
caggcgacggucaggc

SEQ ID NO: 3442171 - RNA, 18 nt, Pseudomonas aeruginosa PA01
caggcgacggucaggccg

SEQ ID NO: 3442172 - RNA, 19 nt, Pseudomonas aeruginosa PA01
caggcgaggaacagcgaga

SEQ ID NO: 3442173 - RNA, 20 nt, Pseudomonas aeruginosa PA01
caggcgauagccgaccaggc

SEQ ID NO: 3442174 - RNA, 22 nt, Pseudomonas aeruginosa PA01
caggcgauagccgaccaggccg

SEQ ID NO: 3442175 - RNA, 18 nt, Pseudomonas aeruginosa PA01
caggcgauaucccgccgc

SEQ ID NO: 3442176 - RNA, 19 nt, Pseudomonas aeruginosa PA01
caggcgauaucccgccgcc

SEQ ID NO: 3442177 - RNA, 20 nt, Pseudomonas aeruginosa PA01
caggcgauaucccgccgccg

SEQ ID NO: 3442178 - RNA, 21 nt, Pseudomonas aeruginosa PA01
caggcgauaucccgccgccgc

SEQ ID NO: 3442179 - RNA, 16 nt, Pseudomonas aeruginosa PA01
caggcgauccacagca

SEQ ID NO: 3442180 - RNA, 22 nt, Pseudomonas aeruginosa PA01
caggcgaucgacgccucggcgc

SEQ ID NO: 3442181 - RNA, 13 nt, Pseudomonas aeruginosa PA01
caggcgaucgccg

SEQ ID NO: 3442182 - RNA, 19 nt, Pseudomonas aeruginosa PA01
caggcgaugaacggcguca

SEQ ID NO: 3442183 - RNA, 21 nt, Pseudomonas aeruginosa PA01
caggcgaugaccgccccggca

SEQ ID NO: 3442184 - RNA, 13 nt, Pseudomonas aeruginosa PA01
caggcgaugauca

SEQ ID NO: 3442185 - RNA, 18 nt, Pseudomonas aeruginosa PA01
caggcgaugaucagcccu

SEQ ID NO: 3442186 - RNA, 20 nt, Pseudomonas aeruginosa PA01
caggcgaugaucagcccuuc

SEQ ID NO: 3442187 - RNA, 15 nt, Pseudomonas aeruginosa PA01
caggcgaugcgccgg

SEQ ID NO: 3442188 - RNA, 16 nt, Pseudomonas aeruginosa PA01
caggcgaugcgccgga

SEQ ID NO: 3442189 - RNA, 21 nt, Pseudomonas aeruginosa PA01
caggcgaugcgccggaucggc

SEQ ID NO: 3442190 - RNA, 18 nt, Pseudomonas aeruginosa PA01
caggcgauggugcgcucg

SEQ ID NO: 3442191 - RNA, 21 nt, Pseudomonas aeruginosa PA01
caggcgauggugcgcucgcgg

SEQ ID NO: 3442192 - RNA, 14 nt, Pseudomonas aeruginosa PA01
caggcgcaaccaga

SEQ ID NO: 3442193 - RNA, 19 nt, Pseudomonas aeruginosa PA01
caggcgcaaccagaccagc

SEQ ID NO: 3442194 - RNA, 14 nt, Pseudomonas aeruginosa PA01
caggcgcaccagca

SEQ ID NO: 3442195 - RNA, 15 nt, Pseudomonas aeruginosa PA01
caggcgcaccuccuc

SEQ ID NO: 3442196 - RNA, 22 nt, Pseudomonas aeruginosa PA01
caggcgcaccuccucgggcgga

SEQ ID NO: 3442197 - RNA, 14 nt, Pseudomonas aeruginosa PA01
caggcgcaccuggc

SEQ ID NO: 3442198 - RNA, 14 nt, Pseudomonas aeruginosa PA01
caggcgcagcagca

SEQ ID NO: 3442199 - RNA, 14 nt, Pseudomonas aeruginosa PA01
caggcgcagcagcg

SEQ ID NO: 3442200 - RNA, 22 nt, Pseudomonas aeruginosa PA01
caggcgcagcagcgacucgcug

SEQ ID NO: 3442201 - RNA, 20 nt, Pseudomonas aeruginosa PA01
caggcgcagccagcacaugc

SEQ ID NO: 3442202 - RNA, 19 nt, Pseudomonas aeruginosa PA01
caggcgcagcguccugccc

SEQ ID NO: 3442203 - RNA, 22 nt, Pseudomonas aeruginosa PA01
caggcgcagcguccugcccucc

SEQ ID NO: 3442204 - RNA, 13 nt, Pseudomonas aeruginosa PA01
caggcgcaggcga

SEQ ID NO: 3442205 - RNA, 21 nt, Pseudomonas aeruginosa PA01
caggcgcaggcgaacugccga

SEQ ID NO: 3442206 - RNA, 12 nt, Pseudomonas aeruginosa PA01
caggcgcagggg

SEQ ID NO: 3442207 - RNA, 17 nt, Pseudomonas aeruginosa PA01
caggcgcaggggcgaga

SEQ ID NO: 3442208 - RNA, 22 nt, Pseudomonas aeruginosa PA01
caggcgcaggucggccucggcg

SEQ ID NO: 3442209 - RNA, 19 nt, Pseudomonas aeruginosa PA01
caggcgcaguaggccuggu

SEQ ID NO: 3442210 - RNA, 16 nt, Pseudomonas aeruginosa PA01
caggcgcaucaggcca

SEQ ID NO: 3442211 - RNA, 19 nt, Pseudomonas aeruginosa PA01
caggcgcaucaggccaaag

SEQ ID NO: 3442212 - RNA, 23 nt, Pseudomonas aeruginosa PA01
caggcgcaugcccagggccagca

SEQ ID NO: 3442213 - RNA, 14 nt, Pseudomonas aeruginosa PA01
caggcgcaugucca

SEQ ID NO: 3442214 - RNA, 18 nt, Pseudomonas aeruginosa PA01
caggcgcauguccagcca

SEQ ID NO: 3442215 - RNA, 17 nt, Pseudomonas aeruginosa PA01
caggcgccaaccgggca

SEQ ID NO: 3442216 - RNA, 15 nt, Pseudomonas aeruginosa PA01
caggcgccaauccgg

SEQ ID NO: 3442217 - RNA, 18 nt, Pseudomonas aeruginosa PA01
caggcgccaauccgggcg

SEQ ID NO: 3442218 - RNA, 19 nt, Pseudomonas aeruginosa PA01
caggcgccaauccgggcgu

SEQ ID NO: 3442219 - RNA, 18 nt, Pseudomonas aeruginosa PA01
caggcgccagagcgcgcu

SEQ ID NO: 3442220 - RNA, 13 nt, Pseudomonas aeruginosa PA01
caggcgccaggac

SEQ ID NO: 3442221 - RNA, 12 nt, Pseudomonas aeruginosa PA01
caggcgccaggc

SEQ ID NO: 3442222 - RNA, 16 nt, Pseudomonas aeruginosa PA01
caggcgccaggccuca

SEQ ID NO: 3442223 - RNA, 16 nt, Pseudomonas aeruginosa PA01
caggcgccagggccgg

SEQ ID NO: 3442224 - RNA, 23 nt, Pseudomonas aeruginosa PA01
caggcgccagucauugcgcuccg

SEQ ID NO: 3442225 - RNA, 13 nt, Pseudomonas aeruginosa PA01
caggcgcccaggc

SEQ ID NO: 3442226 - RNA, 15 nt, Pseudomonas aeruginosa PA01
caggcgcccaggcag

SEQ ID NO: 3442227 - RNA, 16 nt, Pseudomonas aeruginosa PA01
caggcgccccuggucc

SEQ ID NO: 3442228 - RNA, 17 nt, Pseudomonas aeruginosa PA01
caggcgcccggucaggu

SEQ ID NO: 3442229 - RNA, 15 nt, Pseudomonas aeruginosa PA01
caggcgcccggugga

SEQ ID NO: 3442230 - RNA, 18 nt, Pseudomonas aeruginosa PA01
caggcgcccgguggaggu

SEQ ID NO: 3442231 - RNA, 16 nt, Pseudomonas aeruginosa PA01
caggcgcccuggccgu

SEQ ID NO: 3442232 - RNA, 19 nt, Pseudomonas aeruginosa PA01
caggcgccgaugcccaggc

SEQ ID NO: 3442233 - RNA, 22 nt, Pseudomonas aeruginosa PA01
caggcgccgcgcauccucggca

SEQ ID NO: 3442234 - RNA, 19 nt, Pseudomonas aeruginosa PA01
caggcgccgcucgaugccc

SEQ ID NO: 3442235 - RNA, 14 nt, Pseudomonas aeruginosa PA01
caggcggcgggccg

SEQ ID NO: 3442236 - RNA, 21 nt, Pseudomonas aeruginosa PA01
caggcggcgggccggcgucca

SEQ ID NO: 3442237 - RNA, 22 nt, Pseudomonas aeruginosa PA01
caggcggcgggccggcguccag

SEQ ID NO: 3442238 - RNA, 15 nt, Pseudomonas aeruginosa PA01
caggcggcgguagcc

SEQ ID NO: 3442239 - RNA, 22 nt, Pseudomonas aeruginosa PA01
caggcggcgguagccgaggcgg

SEQ ID NO: 3442240 - RNA, 15 nt, Pseudomonas aeruginosa PA01
caggcggcuggcgcg

SEQ ID NO: 3442241 - RNA, 23 nt, Pseudomonas aeruginosa PA01
caggcgggaguccaggcgggcca

SEQ ID NO: 3442242 - RNA, 19 nt, Pseudomonas aeruginosa PA01
caggcgggccagcuggcga

SEQ ID NO: 3442243 - RNA, 17 nt, Pseudomonas aeruginosa PA01
caggcgggcuccgccgc

SEQ ID NO: 3442244 - RNA, 20 nt, Pseudomonas aeruginosa PA01
caggcgguagcgccgcgcca

SEQ ID NO: 3442245 - RNA, 16 nt, Pseudomonas aeruginosa PA01
caggcgguccagccag

SEQ ID NO: 3442246 - RNA, 17 nt, Pseudomonas aeruginosa PA01
caggcggucgccgaaca

SEQ ID NO: 3442247 - RNA, 19 nt, Pseudomonas aeruginosa PA01
caggcggucggaaagcagg

SEQ ID NO: 3442248 - RNA, 22 nt, Pseudomonas aeruginosa PA01
caggcggucggaaagcagggcg

SEQ ID NO: 3442249 - RNA, 17 nt, Pseudomonas aeruginosa PA01
caggcgguucucgucga

SEQ ID NO: 3442250 - RNA, 21 nt, Pseudomonas aeruginosa PA01
caggcgguuggcccgcgccgu

SEQ ID NO: 3442251 - RNA, 22 nt, Pseudomonas aeruginosa PA01
caggcgguuggcccgcgccgug

SEQ ID NO: 3442252 - RNA, 23 nt, Pseudomonas aeruginosa PA01
caggcgguuggcccgcgccgugu

SEQ ID NO: 3442253 - RNA, 17 nt, Pseudomonas aeruginosa PA01
caggcgguuguucagcg

SEQ ID NO: 3442254 - RNA, 16 nt, Pseudomonas aeruginosa PA01
caggcguaggccgucg

SEQ ID NO: 3442255 - RNA, 24 nt, Pseudomonas aeruginosa PA01
caggcguaggccgucgcugccgag

SEQ ID NO: 3442256 - RNA, 16 nt, Pseudomonas aeruginosa PA01
caggcguauucggcga

SEQ ID NO: 3442257 - RNA, 17 nt, Pseudomonas aeruginosa PA01
caggcguauucggcgac

SEQ ID NO: 3442258 - RNA, 19 nt, Pseudomonas aeruginosa PA01
caggcgucccauggcgcca

SEQ ID NO: 3442259 - RNA, 19 nt, Pseudomonas aeruginosa PA01
caggcgucccgcuccagcc

SEQ ID NO: 3442260 - RNA, 21 nt, Pseudomonas aeruginosa PA01
caggcgucccgcuccagccgg

SEQ ID NO: 3442261 - RNA, 22 nt, Pseudomonas aeruginosa PA01
caggcgucccgcuccagccggc

SEQ ID NO: 3442262 - RNA, 23 nt, Pseudomonas aeruginosa PA01
caggcgucccgcuccagccggca

SEQ ID NO: 3442263 - RNA, 23 nt, Pseudomonas aeruginosa PA01
caggcgucccguuccgcucacca

SEQ ID NO: 3442264 - RNA, 17 nt, Pseudomonas aeruginosa PA01
caggcgucccuggagca

SEQ ID NO: 3442265 - RNA, 18 nt, Pseudomonas aeruginosa PA01
caggcgucccuggagcag

SEQ ID NO: 3442266 - RNA, 22 nt, Pseudomonas aeruginosa PA01
caggcgucccuggagcagggcg

SEQ ID NO: 3442267 - RNA, 19 nt, Pseudomonas aeruginosa PA01
caggcguccgcuggccugc

SEQ ID NO: 3442268 - RNA, 23 nt, Pseudomonas aeruginosa PA01
caggcguccgcuggccugcagca

SEQ ID NO: 3442269 - RNA, 14 nt, Pseudomonas aeruginosa PA01
caggcgucgcaccu

SEQ ID NO: 3442270 - RNA, 16 nt, Pseudomonas aeruginosa PA01
caggcgucgccgacuu

SEQ ID NO: 3442271 - RNA, 14 nt, Pseudomonas aeruginosa PA01
caggcgucgcgcca

SEQ ID NO: 3442272 - RNA, 16 nt, Pseudomonas aeruginosa PA01
caggcgucgcgccagc

SEQ ID NO: 3442273 - RNA, 18 nt, Pseudomonas aeruginosa PA01
caggcgucgcgccagcac

SEQ ID NO: 3442274 - RNA, 20 nt, Pseudomonas aeruginosa PA01
caggcgucgcgccagcaccg

SEQ ID NO: 3442275 - RNA, 13 nt, Pseudomonas aeruginosa PA01
caggcgucggcgc

SEQ ID NO: 3442276 - RNA, 15 nt, Pseudomonas aeruginosa PA01
caggcgucgguccag

SEQ ID NO: 3442277 - RNA, 22 nt, Pseudomonas aeruginosa PA01
caggcgucguuguugcgggcga

SEQ ID NO: 3442278 - RNA, 12 nt, Pseudomonas aeruginosa PA01
caggcgugccug

SEQ ID NO: 3442279 - RNA, 17 nt, Pseudomonas aeruginosa PA01
caggcgugccuguuccu

SEQ ID NO: 3442280 - RNA, 18 nt, Pseudomonas aeruginosa PA01
caggcgugggccagccca

SEQ ID NO: 3442281 - RNA, 14 nt, Pseudomonas aeruginosa PA01
caggcguggggcga

SEQ ID NO: 3442282 - RNA, 16 nt, Pseudomonas aeruginosa PA01
caggcguggggcgaau

SEQ ID NO: 3442283 - RNA, 16 nt, Pseudomonas aeruginosa PA01
caggcguuauccgccg

SEQ ID NO: 3442284 - RNA, 18 nt, Pseudomonas aeruginosa PA01
caggcguuauccgccgau

SEQ ID NO: 3442285 - RNA, 20 nt, Pseudomonas aeruginosa PA01
caggcguuauccgccgccga

SEQ ID NO: 3442286 - RNA, 21 nt, Pseudomonas aeruginosa PA01
caggcguuauccgccgccgac

SEQ ID NO: 3442287 - RNA, 15 nt, Pseudomonas aeruginosa PA01
caggcguuccaccag

SEQ ID NO: 3442288 - RNA, 23 nt, Pseudomonas aeruginosa PA01
caggcguuccaccaggcgucgca

SEQ ID NO: 3442289 - RNA, 20 nt, Pseudomonas aeruginosa PA01
caggcguuccagcucggcga

SEQ ID NO: 3442290 - RNA, 22 nt, Pseudomonas aeruginosa PA01
caggcguucgucguggccauag

SEQ ID NO: 3442291 - RNA, 20 nt, Pseudomonas aeruginosa PA01
caggcguugcagugcgccgc

SEQ ID NO: 3442292 - RNA, 21 nt, Pseudomonas aeruginosa PA01
caggcguugcagugcgccgca

SEQ ID NO: 3442293 - RNA, 17 nt, Pseudomonas aeruginosa PA01
caggcguugccggacuu

SEQ ID NO: 3442294 - RNA, 20 nt, Pseudomonas aeruginosa PA01
caggcucacgcguucggcga

SEQ ID NO: 3442295 - RNA, 12 nt, Pseudomonas aeruginosa PA01
caggcucagcgc

SEQ ID NO: 3442296 - RNA, 21 nt, Pseudomonas aeruginosa PA01
caggcucagcucucccgaggc

SEQ ID NO: 3442297 - RNA, 14 nt, Pseudomonas aeruginosa PA01
caggcucaggccgg

SEQ ID NO: 3442298 - RNA, 17 nt, Pseudomonas aeruginosa PA01
caggcucaggccgggca

SEQ ID NO: 3442299 - RNA, 18 nt, Pseudomonas aeruginosa PA01
caggcucaggccgggcac

SEQ ID NO: 3442300 - RNA, 22 nt, Pseudomonas aeruginosa PA01
caggcucaggccgggcaccccg

SEQ ID NO: 3442301 - RNA, 23 nt, Pseudomonas aeruginosa PA01
caggcucagggucucgcgggcgu

SEQ ID NO: 3442302 - RNA, 16 nt, Pseudomonas aeruginosa PA01
caggcucaguucggcc

SEQ ID NO: 3442303 - RNA, 17 nt, Pseudomonas aeruginosa PA01
caggcucaguucggcca

SEQ ID NO: 3442304 - RNA, 21 nt, Pseudomonas aeruginosa PA01
caggcucaguucggccagcgg

SEQ ID NO: 3442305 - RNA, 22 nt, Pseudomonas aeruginosa PA01
caggcucaguucggccagcggc

SEQ ID NO: 3442306 - RNA, 22 nt, Pseudomonas aeruginosa PA01
caggcuccgacuggugggcacg

SEQ ID NO: 3442307 - RNA, 20 nt, Pseudomonas aeruginosa PA01
caggcucgacaggucggcga

SEQ ID NO: 3442308 - RNA, 21 nt, Pseudomonas aeruginosa PA01
caggcucgagccgaacuccgg

SEQ ID NO: 3442309 - RNA, 14 nt, Pseudomonas aeruginosa PA01
caggcucgaggccg

SEQ ID NO: 3442310 - RNA, 18 nt, Pseudomonas aeruginosa PA01
caggcucgaggccgagcc

SEQ ID NO: 3442311 - RNA, 21 nt, Pseudomonas aeruginosa PA01
caggcucgaggccgagccggc

SEQ ID NO: 3442312 - RNA, 13 nt, Pseudomonas aeruginosa PA01
caggcucgccccg

SEQ ID NO: 3442313 - RNA, 20 nt, Pseudomonas aeruginosa PA01
caggcucgccccggcggcga

SEQ ID NO: 3442314 - RNA, 21 nt, Pseudomonas aeruginosa PA01
caggcucgccccggcggcgau

SEQ ID NO: 3442315 - RNA, 13 nt, Pseudomonas aeruginosa PA01
caggcucgccgcc

SEQ ID NO: 3442316 - RNA, 14 nt, Pseudomonas aeruginosa PA01
caggcucgccgcca

SEQ ID NO: 3442317 - RNA, 15 nt, Pseudomonas aeruginosa PA01
caggcucgccgccag

SEQ ID NO: 3442318 - RNA, 16 nt, Pseudomonas aeruginosa PA01
caggcucgccgccagc

SEQ ID NO: 3442319 - RNA, 15 nt, Pseudomonas aeruginosa PA01
caggcucgcgaugcu

SEQ ID NO: 3442320 - RNA, 16 nt, Pseudomonas aeruginosa PA01
caggcucgguucugcg

SEQ ID NO: 3442321 - RNA, 14 nt, Pseudomonas aeruginosa PA01
caggcucucgcgca

SEQ ID NO: 3442322 - RNA, 16 nt, Pseudomonas aeruginosa PA01
caggcucucgcgcagc

SEQ ID NO: 3442323 - RNA, 17 nt, Pseudomonas aeruginosa PA01
caggcucucgcgcagca

SEQ ID NO: 3442324 - RNA, 19 nt, Pseudomonas aeruginosa PA01
caggcucucgcgcagcagg

SEQ ID NO: 3442325 - RNA, 15 nt, Pseudomonas aeruginosa PA01
caggcucuucagcac

SEQ ID NO: 3442326 - RNA, 12 nt, Pseudomonas aeruginosa PA01
caggcugacccg

SEQ ID NO: 3442327 - RNA, 18 nt, Pseudomonas aeruginosa PA01
caggcugaccgcgugggc

SEQ ID NO: 3442328 - RNA, 14 nt, Pseudomonas aeruginosa PA01
caggcugacgucga

SEQ ID NO: 3442329 - RNA, 22 nt, Pseudomonas aeruginosa PA01
caggcugacgucgacgcagcgc

SEQ ID NO: 3442330 - RNA, 18 nt, Pseudomonas aeruginosa PA01
caggcugaggucgcgggc

SEQ ID NO: 3442331 - RNA, 19 nt, Pseudomonas aeruginosa PA01
caggcugaguucgucgagc

SEQ ID NO: 3442332 - RNA, 13 nt, Pseudomonas aeruginosa PA01
caggcugaucagc

SEQ ID NO: 3442333 - RNA, 14 nt, Pseudomonas aeruginosa PA01
caggcugaucagcc

SEQ ID NO: 3442334 - RNA, 22 nt, Pseudomonas aeruginosa PA01
caggcugauccgcgacaguucg

SEQ ID NO: 3442335 - RNA, 17 nt, Pseudomonas aeruginosa PA01
caggcugaucggcgcgc

SEQ ID NO: 3442336 - RNA, 20 nt, Pseudomonas aeruginosa PA01
caggcugaucggcgcgccgg

SEQ ID NO: 3442337 - RNA, 19 nt, Pseudomonas aeruginosa PA01
cagggacgcgccggcggau

SEQ ID NO: 3442338 - RNA, 14 nt, Pseudomonas aeruginosa PA01
cagggacgcggcgu

SEQ ID NO: 3442339 - RNA, 18 nt, Pseudomonas aeruginosa PA01
cagggagaacagcagggu

SEQ ID NO: 3442340 - RNA, 17 nt, Pseudomonas aeruginosa PA01
cagggagaaccaggcgg

SEQ ID NO: 3442341 - RNA, 22 nt, Pseudomonas aeruginosa PA01
cagggagaacgcuucgaagcuc

SEQ ID NO: 3442342 - RNA, 21 nt, Pseudomonas aeruginosa PA01
cagggaggagggcgaggucac

SEQ ID NO: 3442343 - RNA, 13 nt, Pseudomonas aeruginosa PA01
cagggaggcgcac

SEQ ID NO: 3442344 - RNA, 20 nt, Pseudomonas aeruginosa PA01
cagggaggcgcacaucaccc

SEQ ID NO: 3442345 - RNA, 21 nt, Pseudomonas aeruginosa PA01
cagggaggcgcuggccagcgc

SEQ ID NO: 3442346 - RNA, 19 nt, Pseudomonas aeruginosa PA01
cagggaguccgccagccgg

SEQ ID NO: 3442347 - RNA, 15 nt, Pseudomonas aeruginosa PA01
cagggauuccggguc

SEQ ID NO: 3442348 - RNA, 21 nt, Pseudomonas aeruginosa PA01
cagggauuccuuggucagguc

SEQ ID NO: 3442349 - RNA, 14 nt, Pseudomonas aeruginosa PA01
cagggcaacgccag

SEQ ID NO: 3442350 - RNA, 15 nt, Pseudomonas aeruginosa PA01
cagggcaacgccagg

SEQ ID NO: 3442351 - RNA, 16 nt, Pseudomonas aeruginosa PA01
cagggcaacgccaggc

SEQ ID NO: 3442352 - RNA, 18 nt, Pseudomonas aeruginosa PA01
cagggcaacgccaggcug

SEQ ID NO: 3442353 - RNA, 14 nt, Pseudomonas aeruginosa PA01
cagggcaccacgga

SEQ ID NO: 3442354 - RNA, 13 nt, Pseudomonas aeruginosa PA01
cagggcaccgccg

SEQ ID NO: 3442355 - RNA, 15 nt, Pseudomonas aeruginosa PA01
cagggcagccgccgc

SEQ ID NO: 3442356 - RNA, 20 nt, Pseudomonas aeruginosa PA01
cagggcagcggcccuugccc

SEQ ID NO: 3442357 - RNA, 19 nt, Pseudomonas aeruginosa PA01
cagggcauagaugccgccc

SEQ ID NO: 3442358 - RNA, 21 nt, Pseudomonas aeruginosa PA01
cagggcauagaugccgcccug

SEQ ID NO: 3442359 - RNA, 14 nt, Pseudomonas aeruginosa PA01
cagggcaucgauga

SEQ ID NO: 3442360 - RNA, 16 nt, Pseudomonas aeruginosa PA01
cagggcauguuccucc

SEQ ID NO: 3442361 - RNA, 23 nt, Pseudomonas aeruginosa PA01
cagggcauguuccuccagagugc

SEQ ID NO: 3442362 - RNA, 20 nt, Pseudomonas aeruginosa PA01
cagggcauuggccaucagcg

SEQ ID NO: 3442363 - RNA, 22 nt, Pseudomonas aeruginosa PA01
cagggcauuggccaucagcgcc

SEQ ID NO: 3442364 - RNA, 23 nt, Pseudomonas aeruginosa PA01
cagggcauuggccaucagcgccg

SEQ ID NO: 3442365 - RNA, 14 nt, Pseudomonas aeruginosa PA01
cagggccagcaaca

SEQ ID NO: 3442366 - RNA, 13 nt, Pseudomonas aeruginosa PA01
cagggccagcagc

SEQ ID NO: 3442367 - RNA, 14 nt, Pseudomonas aeruginosa PA01
cagggccagcagcg

SEQ ID NO: 3442368 - RNA, 15 nt, Pseudomonas aeruginosa PA01
cagggccagcagcgc

SEQ ID NO: 3442369 - RNA, 22 nt, Pseudomonas aeruginosa PA01
cagggccagcagcggcggcgcc

SEQ ID NO: 3442370 - RNA, 14 nt, Pseudomonas aeruginosa PA01
cagggccagccaga

SEQ ID NO: 3442371 - RNA, 14 nt, Pseudomonas aeruginosa PA01
cagggccagcgccu

SEQ ID NO: 3442372 - RNA, 16 nt, Pseudomonas aeruginosa PA01
cagggccagcgccugg

SEQ ID NO: 3442373 - RNA, 17 nt, Pseudomonas aeruginosa PA01
cagggccagcgccuggc

SEQ ID NO: 3442374 - RNA, 20 nt, Pseudomonas aeruginosa PA01
cagggccagcgccuggcgca

SEQ ID NO: 3442375 - RNA, 15 nt, Pseudomonas aeruginosa PA01
cagggccagcggaac

SEQ ID NO: 3442376 - RNA, 13 nt, Pseudomonas aeruginosa PA01
cagggccagcggg

SEQ ID NO: 3442377 - RNA, 20 nt, Pseudomonas aeruginosa PA01
cagggccagcuuggucggga

SEQ ID NO: 3442378 - RNA, 14 nt, Pseudomonas aeruginosa PA01
cagggccaggagca

SEQ ID NO: 3442379 - RNA, 20 nt, Pseudomonas aeruginosa PA01
cagggccaggagcaucggcg

SEQ ID NO: 3442380 - RNA, 14 nt, Pseudomonas aeruginosa PA01
cagggccaggauga

SEQ ID NO: 3442381 - RNA, 11 nt, Pseudomonas aeruginosa PA01
cagggccaggc

SEQ ID NO: 3442382 - RNA, 13 nt, Pseudomonas aeruginosa PA01
cagggccaggccg

SEQ ID NO: 3442383 - RNA, 23 nt, Pseudomonas aeruginosa PA01
cagggccaggccgagcaauccgg

SEQ ID NO: 3442384 - RNA, 17 nt, Pseudomonas aeruginosa PA01
cagggccaggccgagcg

SEQ ID NO: 3442385 - RNA, 18 nt, Pseudomonas aeruginosa PA01
cagggccagggaaaucag

SEQ ID NO: 3442386 - RNA, 23 nt, Pseudomonas aeruginosa PA01
cagggccagggaaaucaggaagg

SEQ ID NO: 3442387 - RNA, 22 nt, Pseudomonas aeruginosa PA01
cagggccagggaggcgcuggcc

SEQ ID NO: 3442388 - RNA, 14 nt, Pseudomonas aeruginosa PA01
cagggccagggcga

SEQ ID NO: 3442389 - RNA, 14 nt, Pseudomonas aeruginosa PA01
cagggccagggcgg

SEQ ID NO: 3442390 - RNA, 18 nt, Pseudomonas aeruginosa PA01
cagggccagggcggcggc

SEQ ID NO: 3442391 - RNA, 18 nt, Pseudomonas aeruginosa PA01
cagggcccacagugccag

SEQ ID NO: 3442392 - RNA, 17 nt, Pseudomonas aeruginosa PA01
cagggcccagagcagca

SEQ ID NO: 3442393 - RNA, 19 nt, Pseudomonas aeruginosa PA01
cagggcccagagcagcacc

SEQ ID NO: 3442394 - RNA, 20 nt, Pseudomonas aeruginosa PA01
cagggcccagagcagcacca

SEQ ID NO: 3442395 - RNA, 12 nt, Pseudomonas aeruginosa PA01
cagggccgagca

SEQ ID NO: 3442396 - RNA, 17 nt, Pseudomonas aeruginosa PA01
cagggccgagcacaggg

SEQ ID NO: 3442397 - RNA, 20 nt, Pseudomonas aeruginosa PA01
cagggccgagcgcagcgcca

SEQ ID NO: 3442398 - RNA, 22 nt, Pseudomonas aeruginosa PA01
cagggccgagcgcagcgccacc

SEQ ID NO: 3442399 - RNA, 13 nt, Pseudomonas aeruginosa PA01
cagggccgccagc

SEQ ID NO: 3442400 - RNA, 14 nt, Pseudomonas aeruginosa PA01
cagggccgccagcc

SEQ ID NO: 3442401 - RNA, 17 nt, Pseudomonas aeruginosa PA01
cagggccgccagccgcc

SEQ ID NO: 3442402 - RNA, 18 nt, Pseudomonas aeruginosa PA01
cagggccgccagccgcca

SEQ ID NO: 3442403 - RNA, 21 nt, Pseudomonas aeruginosa PA01
cagggccgccagccgccagga

SEQ ID NO: 3442404 - RNA, 23 nt, Pseudomonas aeruginosa PA01
cagggccgccagccgccaggacg

SEQ ID NO: 3442405 - RNA, 13 nt, Pseudomonas aeruginosa PA01
cagggccgcgaga

SEQ ID NO: 3442406 - RNA, 17 nt, Pseudomonas aeruginosa PA01
cagggccgcgccgagcc

SEQ ID NO: 3442407 - RNA, 14 nt, Pseudomonas aeruginosa PA01
cagggccgcggcgu

SEQ ID NO: 3442408 - RNA, 19 nt, Pseudomonas aeruginosa PA01
cagggccggaugccaccgc

SEQ ID NO: 3442409 - RNA, 21 nt, Pseudomonas aeruginosa PA01
cagggccggaugccaccgcuc

SEQ ID NO: 3442410 - RNA, 11 nt, Pseudomonas aeruginosa PA01
cagggccggcg

SEQ ID NO: 3442411 - RNA, 22 nt, Pseudomonas aeruginosa PA01
cagggccgggucaucaccggca

SEQ ID NO: 3442412 - RNA, 13 nt, Pseudomonas aeruginosa PA01
cagggccucgggc

SEQ ID NO: 3442413 - RNA, 17 nt, Pseudomonas aeruginosa PA01
cagggccucgggcggga

SEQ ID NO: 3442414 - RNA, 18 nt, Pseudomonas aeruginosa PA01
cagggccucgggcgggau

SEQ ID NO: 3442415 - RNA, 14 nt, Pseudomonas aeruginosa PA01
cagggccucggggc

SEQ ID NO: 3442416 - RNA, 20 nt, Pseudomonas aeruginosa PA01
cagggccucggggccguccg

SEQ ID NO: 3442417 - RNA, 17 nt, Pseudomonas aeruginosa PA01
cagggccugcuccagcg

SEQ ID NO: 3442418 - RNA, 19 nt, Pseudomonas aeruginosa PA01
cagggccugcuccagcgga

SEQ ID NO: 3442419 - RNA, 20 nt, Pseudomonas aeruginosa PA01
cagggccugcuccagcggag

SEQ ID NO: 3442420 - RNA, 14 nt, Pseudomonas aeruginosa PA01
cagggccuggcccu

SEQ ID NO: 3442421 - RNA, 14 nt, Pseudomonas aeruginosa PA01
cagggccuggcgca

SEQ ID NO: 3442422 - RNA, 14 nt, Pseudomonas aeruginosa PA01
cagggccugguaga

SEQ ID NO: 3442423 - RNA, 13 nt, Pseudomonas aeruginosa PA01
cagggccuugcug

SEQ ID NO: 3442424 - RNA, 14 nt, Pseudomonas aeruginosa PA01
cagggccuugcuga

SEQ ID NO: 3442425 - RNA, 17 nt, Pseudomonas aeruginosa PA01
cagggcgaacagcgccg

SEQ ID NO: 3442426 - RNA, 18 nt, Pseudomonas aeruginosa PA01
cagggcgaacagcgccgc

SEQ ID NO: 3442427 - RNA, 19 nt, Pseudomonas aeruginosa PA01
cagggcgaaccacucggcg

SEQ ID NO: 3442428 - RNA, 20 nt, Pseudomonas aeruginosa PA01
cagggcgaaccacucggcgc

SEQ ID NO: 3442429 - RNA, 14 nt, Pseudomonas aeruginosa PA01
cagggcgaaggcca

SEQ ID NO: 3442430 - RNA, 15 nt, Pseudomonas aeruginosa PA01
cagggcgaaggccac

SEQ ID NO: 3442431 - RNA, 18 nt, Pseudomonas aeruginosa PA01
cagggcgaaggccaccau

SEQ ID NO: 3442432 - RNA, 20 nt, Pseudomonas aeruginosa PA01
cagggcgaaggccaccaucg

SEQ ID NO: 3442433 - RNA, 18 nt, Pseudomonas aeruginosa PA01
cagggcgaaggucugccc

SEQ ID NO: 3442434 - RNA, 17 nt, Pseudomonas aeruginosa PA01
cagggcgaagucggcgc

SEQ ID NO: 3442435 - RNA, 19 nt, Pseudomonas aeruginosa PA01
cagggcgaagucggcgcgc

SEQ ID NO: 3442436 - RNA, 20 nt, Pseudomonas aeruginosa PA01
cagggcgaagucggcgcgcc

SEQ ID NO: 3442437 - RNA, 24 nt, Pseudomonas aeruginosa PA01
cagggcgaagucggcgcgccagaa

SEQ ID NO: 3442438 - RNA, 24 nt, Pseudomonas aeruginosa PA01
cagggcgaauaccagugccgcggu

SEQ ID NO: 3442439 - RNA, 15 nt, Pseudomonas aeruginosa PA01
cagggcgaccagaag

SEQ ID NO: 3442440 - RNA, 13 nt, Pseudomonas aeruginosa PA01
cagggucagccga

SEQ ID NO: 3442441 - RNA, 17 nt, Pseudomonas aeruginosa PA01
cagggucagcuggcgcg

SEQ ID NO: 3442442 - RNA, 19 nt, Pseudomonas aeruginosa PA01
cagggucagcuggcgcgcc

SEQ ID NO: 3442443 - RNA, 16 nt, Pseudomonas aeruginosa PA01
cagggucaggcccuug

SEQ ID NO: 3442444 - RNA, 17 nt, Pseudomonas aeruginosa PA01
cagggucagucgagcag

SEQ ID NO: 3442445 - RNA, 16 nt, Pseudomonas aeruginosa PA01
cagggucaugaugccu

SEQ ID NO: 3442446 - RNA, 21 nt, Pseudomonas aeruginosa PA01
caggguccgcuucagcgcgcc

SEQ ID NO: 3442447 - RNA, 22 nt, Pseudomonas aeruginosa PA01
caggguccgcuucagcgcgccg

SEQ ID NO: 3442448 - RNA, 14 nt, Pseudomonas aeruginosa PA01
cagggucgccagca

SEQ ID NO: 3442449 - RNA, 16 nt, Pseudomonas aeruginosa PA01
cagggucgccagcagg

SEQ ID NO: 3442450 - RNA, 17 nt, Pseudomonas aeruginosa PA01
cagggucgccgggucga

SEQ ID NO: 3442451 - RNA, 13 nt, Pseudomonas aeruginosa PA01
cagggucgcgagc

SEQ ID NO: 3442452 - RNA, 20 nt, Pseudomonas aeruginosa PA01
cagggucgcgagcagggcga

SEQ ID NO: 3442453 - RNA, 22 nt, Pseudomonas aeruginosa PA01
cagggucgcgccguccaucagg

SEQ ID NO: 3442454 - RNA, 16 nt, Pseudomonas aeruginosa PA01
cagggucgcguuggcg

SEQ ID NO: 3442455 - RNA, 19 nt, Pseudomonas aeruginosa PA01
cagggucgcuuccucggca

SEQ ID NO: 3442456 - RNA, 16 nt, Pseudomonas aeruginosa PA01
cagggucggcaggacc

SEQ ID NO: 3442457 - RNA, 14 nt, Pseudomonas aeruginosa PA01
cagggucgggccgc

SEQ ID NO: 3442458 - RNA, 20 nt, Pseudomonas aeruginosa PA01
cagggucgguucgcggcgca

SEQ ID NO: 3442459 - RNA, 21 nt, Pseudomonas aeruginosa PA01
cagggucuccaggaccaguuc

SEQ ID NO: 3442460 - RNA, 13 nt, Pseudomonas aeruginosa PA01
cagggucucgcgg

SEQ ID NO: 3442461 - RNA, 13 nt, Pseudomonas aeruginosa PA01
cagggucuucagg

SEQ ID NO: 3442462 - RNA, 17 nt, Pseudomonas aeruginosa PA01
cagggucuucaggccga

SEQ ID NO: 3442463 - RNA, 17 nt, Pseudomonas aeruginosa PA01
cagggucuucaggcgcc

SEQ ID NO: 3442464 - RNA, 22 nt, Pseudomonas aeruginosa PA01
cagggucuucaggcgugggcca

SEQ ID NO: 3442465 - RNA, 17 nt, Pseudomonas aeruginosa PA01
cagggucuugccgaccu

SEQ ID NO: 3442466 - RNA, 20 nt, Pseudomonas aeruginosa PA01
cagggucuugccgaccuuca

SEQ ID NO: 3442467 - RNA, 15 nt, Pseudomonas aeruginosa PA01
cagggugaagcugcg

SEQ ID NO: 3442468 - RNA, 15 nt, Pseudomonas aeruginosa PA01
cagggugccgaccaa

SEQ ID NO: 3442469 - RNA, 19 nt, Pseudomonas aeruginosa PA01
cagggugcgauggaugcgc

SEQ ID NO: 3442470 - RNA, 21 nt, Pseudomonas aeruginosa PA01
cagggugcgauggaugcgcgg

SEQ ID NO: 3442471 - RNA, 14 nt, Pseudomonas aeruginosa PA01
cagggugcgccggg

SEQ ID NO: 3442472 - RNA, 21 nt, Pseudomonas aeruginosa PA01
cagggugcgccggggaucagg

SEQ ID NO: 3442473 - RNA, 23 nt, Pseudomonas aeruginosa PA01
cagggugcggauggcgaucgagc

SEQ ID NO: 3442474 - RNA, 13 nt, Pseudomonas aeruginosa PA01
cagggugcggcug

SEQ ID NO: 3442475 - RNA, 23 nt, Pseudomonas aeruginosa PA01
cagggugcguacggucaugccga

SEQ ID NO: 3442476 - RNA, 18 nt, Pseudomonas aeruginosa PA01
cagggugcugaccuucac

SEQ ID NO: 3442477 - RNA, 14 nt, Pseudomonas aeruginosa PA01
cagggugcugccca

SEQ ID NO: 3442478 - RNA, 14 nt, Pseudomonas aeruginosa PA01
caggguggccaggg

SEQ ID NO: 3442479 - RNA, 16 nt, Pseudomonas aeruginosa PA01
caggguggcgcgcacc

SEQ ID NO: 3442480 - RNA, 20 nt, Pseudomonas aeruginosa PA01
caggguggcgcgcaccaccu

SEQ ID NO: 3442481 - RNA, 23 nt, Pseudomonas aeruginosa PA01
caggguggcgcgcaccaccuggc

SEQ ID NO: 3442482 - RNA, 24 nt, Pseudomonas aeruginosa PA01
caggguggcgcgcaccaccuggca

SEQ ID NO: 3442483 - RNA, 13 nt, Pseudomonas aeruginosa PA01
caggguggcggcg

SEQ ID NO: 3442484 - RNA, 16 nt, Pseudomonas aeruginosa PA01
caggguggcggcggcg

SEQ ID NO: 3442485 - RNA, 19 nt, Pseudomonas aeruginosa PA01
caggguggcggcggcgagu

SEQ ID NO: 3442486 - RNA, 22 nt, Pseudomonas aeruginosa PA01
caggguggcguuuucccaggug

SEQ ID NO: 3442487 - RNA, 18 nt, Pseudomonas aeruginosa PA01
caggguggggaugcgcga

SEQ ID NO: 3442488 - RNA, 19 nt, Pseudomonas aeruginosa PA01
caggguggggaugcgcgag

SEQ ID NO: 3442489 - RNA, 21 nt, Pseudomonas aeruginosa PA01
caggguggugaacaggcggau

SEQ ID NO: 3442490 - RNA, 21 nt, Pseudomonas aeruginosa PA01
caggguguagguauccgccgg

SEQ ID NO: 3442491 - RNA, 19 nt, Pseudomonas aeruginosa PA01
caggguguuguucgccagc

SEQ ID NO: 3442492 - RNA, 20 nt, Pseudomonas aeruginosa PA01
caggguguuguucgccagca

SEQ ID NO: 3442493 - RNA, 22 nt, Pseudomonas aeruginosa PA01
caggguguuguucgccagcagg

SEQ ID NO: 3442494 - RNA, 23 nt, Pseudomonas aeruginosa PA01
caggguguuguucgccagcaggc

SEQ ID NO: 3442495 - RNA, 13 nt, Pseudomonas aeruginosa PA01
caggguuggaaga

SEQ ID NO: 3442496 - RNA, 16 nt, Pseudomonas aeruginosa PA01
caggguuggcggcauc

SEQ ID NO: 3442497 - RNA, 13 nt, Pseudomonas aeruginosa PA01
caggguugggcga

SEQ ID NO: 3442498 - RNA, 16 nt, Pseudomonas aeruginosa PA01
caggguuuccagcagc

SEQ ID NO: 3442499 - RNA, 19 nt, Pseudomonas aeruginosa PA01
caggguuuccagcagcacc

SEQ ID NO: 3442500 - RNA, 16 nt, Pseudomonas aeruginosa PA01
cagguaaaggccacca

SEQ ID NO: 3442501 - RNA, 16 nt, Pseudomonas aeruginosa PA01
cagguaacccgcggcg

SEQ ID NO: 3442502 - RNA, 18 nt, Pseudomonas aeruginosa PA01
cagguacagccgcagaug

SEQ ID NO: 3442503 - RNA, 20 nt, Pseudomonas aeruginosa PA01
cagguacagccgcagaugcu

SEQ ID NO: 3442504 - RNA, 16 nt, Pseudomonas aeruginosa PA01
cagguaccggccaggc

SEQ ID NO: 3442505 - RNA, 18 nt, Pseudomonas aeruginosa PA01
cagguaccggccaggcgg

SEQ ID NO: 3442506 - RNA, 22 nt, Pseudomonas aeruginosa PA01
cagguacggaagcggccgagca

SEQ ID NO: 3442507 - RNA, 13 nt, Pseudomonas aeruginosa PA01
cagguacggcccg

SEQ ID NO: 3442508 - RNA, 15 nt, Pseudomonas aeruginosa PA01
cagguacggcgccgc

SEQ ID NO: 3442509 - RNA, 16 nt, Pseudomonas aeruginosa PA01
cagguacggcgccgcu

SEQ ID NO: 3442510 - RNA, 14 nt, Pseudomonas aeruginosa PA01
cagguacucgccgg

SEQ ID NO: 3442511 - RNA, 15 nt, Pseudomonas aeruginosa PA01
cagguacucgccggc

SEQ ID NO: 3442512 - RNA, 16 nt, Pseudomonas aeruginosa PA01
cagguacucgccggcg

SEQ ID NO: 3442513 - RNA, 18 nt, Pseudomonas aeruginosa PA01
cagguacucgccggcgau

SEQ ID NO: 3442514 - RNA, 14 nt, Pseudomonas aeruginosa PA01
cagguacugggcga

SEQ ID NO: 3442515 - RNA, 15 nt, Pseudomonas aeruginosa PA01
cagguacugggcgau

SEQ ID NO: 3442516 - RNA, 20 nt, Pseudomonas aeruginosa PA01
cagguagaagaacaucggcg

SEQ ID NO: 3442517 - RNA, 21 nt, Pseudomonas aeruginosa PA01
cagguagaagaacaucggcgc

SEQ ID NO: 3442518 - RNA, 22 nt, Pseudomonas aeruginosa PA01
cagguagaagaacaucggcgcu

SEQ ID NO: 3442519 - RNA, 20 nt, Pseudomonas aeruginosa PA01
cagguagaaggugcccagcg

SEQ ID NO: 3442520 - RNA, 19 nt, Pseudomonas aeruginosa PA01
cagguagaccacgcaggcc

SEQ ID NO: 3442521 - RNA, 23 nt, Pseudomonas aeruginosa PA01
cagguagaccacgcaggccagcg

SEQ ID NO: 3442522 - RNA, 16 nt, Pseudomonas aeruginosa PA01
cagguagagcagcccg

SEQ ID NO: 3442523 - RNA, 21 nt, Pseudomonas aeruginosa PA01
cagguagagcagcccgggcaa

SEQ ID NO: 3442524 - RNA, 20 nt, Pseudomonas aeruginosa PA01
cagguagcagccguccagcu

SEQ ID NO: 3442525 - RNA, 13 nt, Pseudomonas aeruginosa PA01
cagguagccaggg

SEQ ID NO: 3442526 - RNA, 23 nt, Pseudomonas aeruginosa PA01
cagguagccaggggucaggccga

SEQ ID NO: 3442527 - RNA, 14 nt, Pseudomonas aeruginosa PA01
cagguagcccaccu

SEQ ID NO: 3442528 - RNA, 12 nt, Pseudomonas aeruginosa PA01
cagguagccccg

SEQ ID NO: 3442529 - RNA, 16 nt, Pseudomonas aeruginosa PA01
cagguagccccggccc

SEQ ID NO: 3442530 - RNA, 17 nt, Pseudomonas aeruginosa PA01
cagguagccccggcccg

SEQ ID NO: 3442531 - RNA, 23 nt, Pseudomonas aeruginosa PA01
cagguagccgccuuguuccaggc

SEQ ID NO: 3442532 - RNA, 14 nt, Pseudomonas aeruginosa PA01
cagguagccgcgcc

SEQ ID NO: 3442533 - RNA, 17 nt, Pseudomonas aeruginosa PA01
cagguagccgcgccggc

SEQ ID NO: 3442534 - RNA, 17 nt, Pseudomonas aeruginosa PA01
cagguagccugcggcca

SEQ ID NO: 3442535 - RNA, 19 nt, Pseudomonas aeruginosa PA01
cagguagccugcggccagc

SEQ ID NO: 3442536 - RNA, 20 nt, Pseudomonas aeruginosa PA01
cagguagccugcggccagcg

SEQ ID NO: 3442537 - RNA, 16 nt, Pseudomonas aeruginosa PA01
cagguagcgcugcgcc

SEQ ID NO: 3442538 - RNA, 17 nt, Pseudomonas aeruginosa PA01
cagguagcgcugcgcca

SEQ ID NO: 3442539 - RNA, 19 nt, Pseudomonas aeruginosa PA01
cagguagcgcugcgcccgc

SEQ ID NO: 3442540 - RNA, 20 nt, Pseudomonas aeruginosa PA01
cagguagcugagcaggccga

SEQ ID NO: 3442541 - RNA, 20 nt, Pseudomonas aeruginosa PA01
cagguagcugcuccagcccg

SEQ ID NO: 3442542 - RNA, 20 nt, Pseudomonas aeruginosa PA01
caggucgcugucgcguuccc

SEQ ID NO: 3442543 - RNA, 14 nt, Pseudomonas aeruginosa PA01
caggucggacaggc

SEQ ID NO: 3442544 - RNA, 17 nt, Pseudomonas aeruginosa PA01
caggucggacaggcauu

SEQ ID NO: 3442545 - RNA, 22 nt, Pseudomonas aeruginosa PA01
caggucggcagcgucgagcugg

SEQ ID NO: 3442546 - RNA, 12 nt, Pseudomonas aeruginosa PA01
caggucggccgc

SEQ ID NO: 3442547 - RNA, 13 nt, Pseudomonas aeruginosa PA01
caggucggccgcc

SEQ ID NO: 3442548 - RNA, 14 nt, Pseudomonas aeruginosa PA01
caggucggccgccu

SEQ ID NO: 3442549 - RNA, 15 nt, Pseudomonas aeruginosa PA01
caggucggccgccuc

SEQ ID NO: 3442550 - RNA, 17 nt, Pseudomonas aeruginosa PA01
caggucggccgccucgg

SEQ ID NO: 3442551 - RNA, 20 nt, Pseudomonas aeruginosa PA01
caggucggccggcagcuccg

SEQ ID NO: 3442552 - RNA, 12 nt, Pseudomonas aeruginosa PA01
caggucggccuc

SEQ ID NO: 3442553 - RNA, 16 nt, Pseudomonas aeruginosa PA01
caggucggccucggcg

SEQ ID NO: 3442554 - RNA, 13 nt, Pseudomonas aeruginosa PA01
caggucggcgccg

SEQ ID NO: 3442555 - RNA, 14 nt, Pseudomonas aeruginosa PA01
caggucggcgccgg

SEQ ID NO: 3442556 - RNA, 15 nt, Pseudomonas aeruginosa PA01
caggucggcgcgacg

SEQ ID NO: 3442557 - RNA, 18 nt, Pseudomonas aeruginosa PA01
caggucggcgcgacggcc

SEQ ID NO: 3442558 - RNA, 17 nt, Pseudomonas aeruginosa PA01
caggucggcgcgcaccu

SEQ ID NO: 3442559 - RNA, 17 nt, Pseudomonas aeruginosa PA01
caggucggcgcgcgaca

SEQ ID NO: 3442560 - RNA, 13 nt, Pseudomonas aeruginosa PA01
caggucggcggca

SEQ ID NO: 3442561 - RNA, 16 nt, Pseudomonas aeruginosa PA01
caggucggcggcacgc

SEQ ID NO: 3442562 - RNA, 15 nt, Pseudomonas aeruginosa PA01
caggucggucggcgg

SEQ ID NO: 3442563 - RNA, 17 nt, Pseudomonas aeruginosa PA01
caggucggucggcggcg

SEQ ID NO: 3442564 - RNA, 18 nt, Pseudomonas aeruginosa PA01
caggucggucggcggcgg

SEQ ID NO: 3442565 - RNA, 16 nt, Pseudomonas aeruginosa PA01
caggucggucuggcgg

SEQ ID NO: 3442566 - RNA, 17 nt, Pseudomonas aeruginosa PA01
caggucggucuggcggc

SEQ ID NO: 3442567 - RNA, 14 nt, Pseudomonas aeruginosa PA01
caggucgucgagga

SEQ ID NO: 3442568 - RNA, 21 nt, Pseudomonas aeruginosa PA01
caggucgucgaggaucuucuc

SEQ ID NO: 3442569 - RNA, 16 nt, Pseudomonas aeruginosa PA01
caggucgucgggcaga

SEQ ID NO: 3442570 - RNA, 14 nt, Pseudomonas aeruginosa PA01
caggucgugcagcc

SEQ ID NO: 3442571 - RNA, 15 nt, Pseudomonas aeruginosa PA01
caggucguggaaggc

SEQ ID NO: 3442572 - RNA, 16 nt, Pseudomonas aeruginosa PA01
caggucguggaaggcu

SEQ ID NO: 3442573 - RNA, 23 nt, Pseudomonas aeruginosa PA01
caggucguugacgaucugcgagc

SEQ ID NO: 3442574 - RNA, 17 nt, Pseudomonas aeruginosa PA01
caggucguugcgccggc

SEQ ID NO: 3442575 - RNA, 21 nt, Pseudomonas aeruginosa PA01
caggucucaccgcccugcgcg

SEQ ID NO: 3442576 - RNA, 16 nt, Pseudomonas aeruginosa PA01
caggucuuccaccgcg

SEQ ID NO: 3442577 - RNA, 14 nt, Pseudomonas aeruginosa PA01
caggugaaaagcgc

SEQ ID NO: 3442578 - RNA, 21 nt, Pseudomonas aeruginosa PA01
caggugaaaagcgcugacgaa

SEQ ID NO: 3442579 - RNA, 18 nt, Pseudomonas aeruginosa PA01
caggugagggcgacccag

SEQ ID NO: 3442580 - RNA, 16 nt, Pseudomonas aeruginosa PA01
caggugcaccgcgcug

SEQ ID NO: 3442581 - RNA, 17 nt, Pseudomonas aeruginosa PA01
caggugcaccgcgcugg

SEQ ID NO: 3442582 - RNA, 18 nt, Pseudomonas aeruginosa PA01
caggugcaccgcgcugga

SEQ ID NO: 3442583 - RNA, 16 nt, Pseudomonas aeruginosa PA01
caggugcacggccagg

SEQ ID NO: 3442584 - RNA, 17 nt, Pseudomonas aeruginosa PA01
caggugcacggccaggc

SEQ ID NO: 3442585 - RNA, 19 nt, Pseudomonas aeruginosa PA01
caggugcacggccaggcca

SEQ ID NO: 3442586 - RNA, 13 nt, Pseudomonas aeruginosa PA01
caggugcagcgag

SEQ ID NO: 3442587 - RNA, 12 nt, Pseudomonas aeruginosa PA01
caggugcaggaa

SEQ ID NO: 3442588 - RNA, 14 nt, Pseudomonas aeruginosa PA01
caggugcaggaaca

SEQ ID NO: 3442589 - RNA, 16 nt, Pseudomonas aeruginosa PA01
caggugcaggaacagc

SEQ ID NO: 3442590 - RNA, 17 nt, Pseudomonas aeruginosa PA01
caggugcaggaacagcc

SEQ ID NO: 3442591 - RNA, 19 nt, Pseudomonas aeruginosa PA01
caggugcaggaagcgccgg

SEQ ID NO: 3442592 - RNA, 20 nt, Pseudomonas aeruginosa PA01
caggugcaggaagcgccggg

SEQ ID NO: 3442593 - RNA, 23 nt, Pseudomonas aeruginosa PA01
caggugcauguagcgcuccucgc

SEQ ID NO: 3442594 - RNA, 15 nt, Pseudomonas aeruginosa PA01
caggugccaauccgg

SEQ ID NO: 3442595 - RNA, 20 nt, Pseudomonas aeruginosa PA01
caggugcccuggaagccggc

SEQ ID NO: 3442596 - RNA, 21 nt, Pseudomonas aeruginosa PA01
caggugcccuggaagccggca

SEQ ID NO: 3442597 - RNA, 19 nt, Pseudomonas aeruginosa PA01
caggugccgcucguccagu

SEQ ID NO: 3442598 - RNA, 22 nt, Pseudomonas aeruginosa PA01
caggugccgcucguccaguucc

SEQ ID NO: 3442599 - RNA, 14 nt, Pseudomonas aeruginosa PA01
caggugcgcaggcg

SEQ ID NO: 3442600 - RNA, 16 nt, Pseudomonas aeruginosa PA01
caggugcgcggcagga

SEQ ID NO: 3442601 - RNA, 20 nt, Pseudomonas aeruginosa PA01
caggugcggcugggugucga

SEQ ID NO: 3442602 - RNA, 23 nt, Pseudomonas aeruginosa PA01
caggugcguacuuggcccggcgu

SEQ ID NO: 3442603 - RNA, 20 nt, Pseudomonas aeruginosa PA01
caggugcuggacucgcgcca

SEQ ID NO: 3442604 - RNA, 19 nt, Pseudomonas aeruginosa PA01
caggugcugguggcccugg

SEQ ID NO: 3442605 - RNA, 20 nt, Pseudomonas aeruginosa PA01
caggugcugguggcccuggg

SEQ ID NO: 3442606 - RNA, 17 nt, Pseudomonas aeruginosa PA01
caggugcuuggcaccgc

SEQ ID NO: 3442607 - RNA, 19 nt, Pseudomonas aeruginosa PA01
caggugcuuggcaccgcgc

SEQ ID NO: 3442608 - RNA, 20 nt, Pseudomonas aeruginosa PA01
caggugcuuggcaccgcgca

SEQ ID NO: 3442609 - RNA, 17 nt, Pseudomonas aeruginosa PA01
caggugcuuggcuucga

SEQ ID NO: 3442610 - RNA, 22 nt, Pseudomonas aeruginosa PA01
cagguggaagcgcgcgucggcg

SEQ ID NO: 3442611 - RNA, 13 nt, Pseudomonas aeruginosa PA01
cagguggacggca

SEQ ID NO: 3442612 - RNA, 16 nt, Pseudomonas aeruginosa PA01
cagguggaucgcggcg

SEQ ID NO: 3442613 - RNA, 13 nt, Pseudomonas aeruginosa PA01
cagguggcaggcc

SEQ ID NO: 3442614 - RNA, 14 nt, Pseudomonas aeruginosa PA01
cagguggcaggccu

SEQ ID NO: 3442615 - RNA, 23 nt, Pseudomonas aeruginosa PA01
cagguggcgcacugccaggagca

SEQ ID NO: 3442616 - RNA, 15 nt, Pseudomonas aeruginosa PA01
cagguggcgcagccg

SEQ ID NO: 3442617 - RNA, 19 nt, Pseudomonas aeruginosa PA01
cagguggcgggucggcgga

SEQ ID NO: 3442618 - RNA, 13 nt, Pseudomonas aeruginosa PA01
cagguggcuggcc

SEQ ID NO: 3442619 - RNA, 14 nt, Pseudomonas aeruginosa PA01
cagguggcuggcca

SEQ ID NO: 3442620 - RNA, 15 nt, Pseudomonas aeruginosa PA01
cagguggcuuuccag

SEQ ID NO: 3442621 - RNA, 15 nt, Pseudomonas aeruginosa PA01
caggugggccacuuc

SEQ ID NO: 3442622 - RNA, 17 nt, Pseudomonas aeruginosa PA01
caggugggucacgucgg

SEQ ID NO: 3442623 - RNA, 20 nt, Pseudomonas aeruginosa PA01
caggugggucacgucggcgu

SEQ ID NO: 3442624 - RNA, 19 nt, Pseudomonas aeruginosa PA01
caggugguaagcgagcaga

SEQ ID NO: 3442625 - RNA, 15 nt, Pseudomonas aeruginosa PA01
caggugguacggcug

SEQ ID NO: 3442626 - RNA, 16 nt, Pseudomonas aeruginosa PA01
cagguggucgaccagg

SEQ ID NO: 3442627 - RNA, 17 nt, Pseudomonas aeruginosa PA01
cagguggucgaccaggc

SEQ ID NO: 3442628 - RNA, 14 nt, Pseudomonas aeruginosa PA01
cagguggucgaugg

SEQ ID NO: 3442629 - RNA, 20 nt, Pseudomonas aeruginosa PA01
cagguggucguugcgcgcca

SEQ ID NO: 3442630 - RNA, 15 nt, Pseudomonas aeruginosa PA01
caggugguggcggau

SEQ ID NO: 3442631 - RNA, 23 nt, Pseudomonas aeruginosa PA01
caggugguggcggaucugcucga

SEQ ID NO: 3442632 - RNA, 16 nt, Pseudomonas aeruginosa PA01
cagguguucggccccg

SEQ ID NO: 3442633 - RNA, 20 nt, Pseudomonas aeruginosa PA01
cagguguucggcggcgugca

SEQ ID NO: 3442634 - RNA, 22 nt, Pseudomonas aeruginosa PA01
cagguucacccaguuguaacga

SEQ ID NO: 3442635 - RNA, 14 nt, Pseudomonas aeruginosa PA01
cagguucaccgccu

SEQ ID NO: 3442636 - RNA, 20 nt, Pseudomonas aeruginosa PA01
cagguucaccgccucggaga

SEQ ID NO: 3442637 - RNA, 13 nt, Pseudomonas aeruginosa PA01
cagguucagggug

SEQ ID NO: 3442638 - RNA, 17 nt, Pseudomonas aeruginosa PA01
cagguucaggguggcga

SEQ ID NO: 3442639 - RNA, 20 nt, Pseudomonas aeruginosa PA01
cagguucaucgccgccaggc

SEQ ID NO: 3442640 - RNA, 23 nt, Pseudomonas aeruginosa PA01
cagguucaucgccgccaggcaga

SEQ ID NO: 3442641 - RNA, 17 nt, Pseudomonas aeruginosa PA01
cagguuccuccugggcc

SEQ ID NO: 3442642 - RNA, 19 nt, Pseudomonas aeruginosa PA01
cagguucgcguggcccggc

SEQ ID NO: 3442643 - RNA, 22 nt, Pseudomonas aeruginosa PA01
cagguucgcguggcccggcgcg

SEQ ID NO: 3442644 - RNA, 23 nt, Pseudomonas aeruginosa PA01
cagguucgcguggcccggcgcgg

SEQ ID NO: 3442645 - RNA, 17 nt, Pseudomonas aeruginosa PA01
cagucgcccccaccgcc

SEQ ID NO: 3442646 - RNA, 18 nt, Pseudomonas aeruginosa PA01
cagucgcccccaccgccc

SEQ ID NO: 3442647 - RNA, 21 nt, Pseudomonas aeruginosa PA01
cagucgcccccaccgcccccg

SEQ ID NO: 3442648 - RNA, 12 nt, Pseudomonas aeruginosa PA01
cagucgcccgcu

SEQ ID NO: 3442649 - RNA, 23 nt, Pseudomonas aeruginosa PA01
cagucgccgcaccggcgauggcc

SEQ ID NO: 3442650 - RNA, 14 nt, Pseudomonas aeruginosa PA01
cagucgccgccagu

SEQ ID NO: 3442651 - RNA, 13 nt, Pseudomonas aeruginosa PA01
cagucgccuggcc

SEQ ID NO: 3442652 - RNA, 15 nt, Pseudomonas aeruginosa PA01
cagucgccuggcccu

SEQ ID NO: 3442653 - RNA, 17 nt, Pseudomonas aeruginosa PA01
cagucgcugcucggccu

SEQ ID NO: 3442654 - RNA, 15 nt, Pseudomonas aeruginosa PA01
cagucgcuuccgcgc

SEQ ID NO: 3442655 - RNA, 17 nt, Pseudomonas aeruginosa PA01
cagucgcuuccgcgcgg

SEQ ID NO: 3442656 - RNA, 20 nt, Pseudomonas aeruginosa PA01
cagucggcaccgaucgcccg

SEQ ID NO: 3442657 - RNA, 17 nt, Pseudomonas aeruginosa PA01
cagucggccaggcgcca

SEQ ID NO: 3442658 - RNA, 20 nt, Pseudomonas aeruginosa PA01
cagucggccaggcgccaggu

SEQ ID NO: 3442659 - RNA, 15 nt, Pseudomonas aeruginosa PA01
cagucggccguugcg

SEQ ID NO: 3442660 - RNA, 18 nt, Pseudomonas aeruginosa PA01
cagucggccguugcgggc

SEQ ID NO: 3442661 - RNA, 20 nt, Pseudomonas aeruginosa PA01
cagucggccguugcgggcga

SEQ ID NO: 3442662 - RNA, 13 nt, Pseudomonas aeruginosa PA01
cagucggcgcugg

SEQ ID NO: 3442663 - RNA, 15 nt, Pseudomonas aeruginosa PA01
cagucggcgcuggag

SEQ ID NO: 3442664 - RNA, 17 nt, Pseudomonas aeruginosa PA01
cagucggcguccgccuc

SEQ ID NO: 3442665 - RNA, 15 nt, Pseudomonas aeruginosa PA01
cagucgggcucagaa

SEQ ID NO: 3442666 - RNA, 13 nt, Pseudomonas aeruginosa PA01
cagucggggcagg

SEQ ID NO: 3442667 - RNA, 18 nt, Pseudomonas aeruginosa PA01
cagucgguagaaauccuc

SEQ ID NO: 3442668 - RNA, 22 nt, Pseudomonas aeruginosa PA01
cagucgguuagaauaccggccu

SEQ ID NO: 3442669 - RNA, 23 nt, Pseudomonas aeruginosa PA01
cagucgguuagaauaccggccug

SEQ ID NO: 3442670 - RNA, 18 nt, Pseudomonas aeruginosa PA01
cagucguaggucugcccg

SEQ ID NO: 3442671 - RNA, 22 nt, Pseudomonas aeruginosa PA01
cagucguaggucugcccgacga

SEQ ID NO: 3442672 - RNA, 22 nt, Pseudomonas aeruginosa PA01
cagucgucgcgcagcuccucgg

SEQ ID NO: 3442673 - RNA, 21 nt, Pseudomonas aeruginosa PA01
cagucuggaagguaaagguaa

SEQ ID NO: 3442674 - RNA, 13 nt, Pseudomonas aeruginosa PA01
cagucuucgccgg

SEQ ID NO: 3442675 - RNA, 23 nt, Pseudomonas aeruginosa PA01
cagucuucgccggccugcgcgca

SEQ ID NO: 3442676 - RNA, 16 nt, Pseudomonas aeruginosa PA01
cagucuucgcuggcga

SEQ ID NO: 3442677 - RNA, 22 nt, Pseudomonas aeruginosa PA01
cagugacauccucccugcccgc

SEQ ID NO: 3442678 - RNA, 23 nt, Pseudomonas aeruginosa PA01
cagugacauccucccugcccgcu

SEQ ID NO: 3442679 - RNA, 17 nt, Pseudomonas aeruginosa PA01
cagugacugaccgucgg

SEQ ID NO: 3442680 - RNA, 16 nt, Pseudomonas aeruginosa PA01
cagugagccccggcgu

SEQ ID NO: 3442681 - RNA, 22 nt, Pseudomonas aeruginosa PA01
cagugagccccggcgucggcgc

SEQ ID NO: 3442682 - RNA, 21 nt, Pseudomonas aeruginosa PA01
cagugcaccgccggguacagc

SEQ ID NO: 3442683 - RNA, 18 nt, Pseudomonas aeruginosa PA01
cagugcacguuccagcuc

SEQ ID NO: 3442684 - RNA, 18 nt, Pseudomonas aeruginosa PA01
cagugcagccguugcccc

SEQ ID NO: 3442685 - RNA, 14 nt, Pseudomonas aeruginosa PA01
cagugcaucggccg

SEQ ID NO: 3442686 - RNA, 15 nt, Pseudomonas aeruginosa PA01
cagugcaucggccgc

SEQ ID NO: 3442687 - RNA, 22 nt, Pseudomonas aeruginosa PA01
cagugcaucggccgccaggcug

SEQ ID NO: 3442688 - RNA, 13 nt, Pseudomonas aeruginosa PA01
cagugccagcaga

SEQ ID NO: 3442689 - RNA, 14 nt, Pseudomonas aeruginosa PA01
cagugccagcagac

SEQ ID NO: 3442690 - RNA, 17 nt, Pseudomonas aeruginosa PA01
cagugccaggcucgccg

SEQ ID NO: 3442691 - RNA, 22 nt, Pseudomonas aeruginosa PA01
cagugccaggcucgccgccagc

SEQ ID NO: 3442692 - RNA, 17 nt, Pseudomonas aeruginosa PA01
cagugcccggcagaucu

SEQ ID NO: 3442693 - RNA, 18 nt, Pseudomonas aeruginosa PA01
cagugcccggcagaucuc

SEQ ID NO: 3442694 - RNA, 19 nt, Pseudomonas aeruginosa PA01
cagugccgcggugcgggcc

SEQ ID NO: 3442695 - RNA, 12 nt, Pseudomonas aeruginosa PA01
cagugccgggcg

SEQ ID NO: 3442696 - RNA, 23 nt, Pseudomonas aeruginosa PA01
cagugccucgcgcguggccgcca

SEQ ID NO: 3442697 - RNA, 16 nt, Pseudomonas aeruginosa PA01
cagugccugcaccacg

SEQ ID NO: 3442698 - RNA, 17 nt, Pseudomonas aeruginosa PA01
cagugccugcaccacgc

SEQ ID NO: 3442699 - RNA, 19 nt, Pseudomonas aeruginosa PA01
cagugccugcaccacgcag

SEQ ID NO: 3442700 - RNA, 13 nt, Pseudomonas aeruginosa PA01
cagugccugcuuc

SEQ ID NO: 3442701 - RNA, 14 nt, Pseudomonas aeruginosa PA01
cagugccugcuuca

SEQ ID NO: 3442702 - RNA, 22 nt, Pseudomonas aeruginosa PA01
cagugcgcccucgaacggcgug

SEQ ID NO: 3442703 - RNA, 17 nt, Pseudomonas aeruginosa PA01
cagugcgccgcagcgca

SEQ ID NO: 3442704 - RNA, 13 nt, Pseudomonas aeruginosa PA01
cagugcgggcagu

SEQ ID NO: 3442705 - RNA, 16 nt, Pseudomonas aeruginosa PA01
cagugcggggcgcucg

SEQ ID NO: 3442706 - RNA, 19 nt, Pseudomonas aeruginosa PA01
cagugcggggcgcucgccc

SEQ ID NO: 3442707 - RNA, 17 nt, Pseudomonas aeruginosa PA01
cagugcucaucauugaa

SEQ ID NO: 3442708 - RNA, 13 nt, Pseudomonas aeruginosa PA01
cagugcucccgca

SEQ ID NO: 3442709 - RNA, 15 nt, Pseudomonas aeruginosa PA01
cagugcuugagcgga

SEQ ID NO: 3442710 - RNA, 22 nt, Pseudomonas aeruginosa PA01
caguggaauucgaugaaauagc

SEQ ID NO: 3442711 - RNA, 15 nt, Pseudomonas aeruginosa PA01
caguggcgccagcca

SEQ ID NO: 3442712 - RNA, 17 nt, Pseudomonas aeruginosa PA01
caguggcgccagccagc

SEQ ID NO: 3442713 - RNA, 14 nt, Pseudomonas aeruginosa PA01
caguggcuccgcgc

SEQ ID NO: 3442714 - RNA, 13 nt, Pseudomonas aeruginosa PA01
caguucagccacu

SEQ ID NO: 3442715 - RNA, 19 nt, Pseudomonas aeruginosa PA01
caguucaggcugggccgaa

SEQ ID NO: 3442716 - RNA, 22 nt, Pseudomonas aeruginosa PA01
caguucagggcgagcagggcac

SEQ ID NO: 3442717 - RNA, 21 nt, Pseudomonas aeruginosa PA01
caguucaucgagguucuccac

SEQ ID NO: 3442718 - RNA, 13 nt, Pseudomonas aeruginosa PA01
caguuccaggcgu

SEQ ID NO: 3442719 - RNA, 18 nt, Pseudomonas aeruginosa PA01
caguuccaggcguccgcu

SEQ ID NO: 3442720 - RNA, 22 nt, Pseudomonas aeruginosa PA01
caguuccaggcgugcugcacgg

SEQ ID NO: 3442721 - RNA, 15 nt, Pseudomonas aeruginosa PA01
caguuccagggucag

SEQ ID NO: 3442722 - RNA, 18 nt, Pseudomonas aeruginosa PA01
caguuccaggucggcggc

SEQ ID NO: 3442723 - RNA, 21 nt, Pseudomonas aeruginosa PA01
caguuccaggucggcggcacg

SEQ ID NO: 3442724 - RNA, 18 nt, Pseudomonas aeruginosa PA01
caguuccaugucgcuggc

SEQ ID NO: 3442725 - RNA, 20 nt, Pseudomonas aeruginosa PA01
caguuccgacugcgagccga

SEQ ID NO: 3442726 - RNA, 16 nt, Pseudomonas aeruginosa PA01
caguuccgccagaugc

SEQ ID NO: 3442727 - RNA, 17 nt, Pseudomonas aeruginosa PA01
caguuccgccagaugcg

SEQ ID NO: 3442728 - RNA, 19 nt, Pseudomonas aeruginosa PA01
caguuccggggucagcgcc

SEQ ID NO: 3442729 - RNA, 20 nt, Pseudomonas aeruginosa PA01
caguuccggggucagcgccu

SEQ ID NO: 3442730 - RNA, 13 nt, Pseudomonas aeruginosa PA01
caguuccucgccg

SEQ ID NO: 3442731 - RNA, 15 nt, Pseudomonas aeruginosa PA01
caguuccucgccgcu

SEQ ID NO: 3442732 - RNA, 16 nt, Pseudomonas aeruginosa PA01
caguuccucgccgcug

SEQ ID NO: 3442733 - RNA, 22 nt, Pseudomonas aeruginosa PA01
caguuccucgcggaagcguugc

SEQ ID NO: 3442734 - RNA, 15 nt, Pseudomonas aeruginosa PA01
caguuccugcaccac

SEQ ID NO: 3442735 - RNA, 17 nt, Pseudomonas aeruginosa PA01
caguuccugcuccuccg

SEQ ID NO: 3442736 - RNA, 19 nt, Pseudomonas aeruginosa PA01
caguuccuguaccagggga

SEQ ID NO: 3442737 - RNA, 20 nt, Pseudomonas aeruginosa PA01
caguuccuguaccaggggau

SEQ ID NO: 3442738 - RNA, 19 nt, Pseudomonas aeruginosa PA01
caguuccuucaccggacgg

SEQ ID NO: 3442739 - RNA, 17 nt, Pseudomonas aeruginosa PA01
caguuccuucgccgaaa

SEQ ID NO: 3442740 - RNA, 14 nt, Pseudomonas aeruginosa PA01
caguuccuugaggu

SEQ ID NO: 3442741 - RNA, 17 nt, Pseudomonas aeruginosa PA01
caguuccuugggcaucg

SEQ ID NO: 3442742 - RNA, 16 nt, Pseudomonas aeruginosa PA01
caguucgaccuccagg

SEQ ID NO: 3442743 - RNA, 17 nt, Pseudomonas aeruginosa PA01
caguucgaccuccaggc

SEQ ID NO: 3442744 - RNA, 16 nt, Pseudomonas aeruginosa PA01
caguucgaugggccgg

SEQ ID NO: 3442745 - RNA, 18 nt, Pseudomonas aeruginosa PA01
caguucgaugggccggua

SEQ ID NO: 3442746 - RNA, 15 nt, Pseudomonas aeruginosa PA01
caguucgccccgccg

SEQ ID NO: 3442747 - RNA, 20 nt, Pseudomonas aeruginosa PA01
cauaguagagaugcaccggc

SEQ ID NO: 3442748 - RNA, 21 nt, Pseudomonas aeruginosa PA01
cauaguggaugugcugguugg

SEQ ID NO: 3442749 - RNA, 16 nt, Pseudomonas aeruginosa PA01
cauauggaaguucaca

SEQ ID NO: 3442750 - RNA, 19 nt, Pseudomonas aeruginosa PA01
caucaacgagccgagcagg

SEQ ID NO: 3442751 - RNA, 22 nt, Pseudomonas aeruginosa PA01
caucaacgagccgagcaggcca

SEQ ID NO: 3442752 - RNA, 16 nt, Pseudomonas aeruginosa PA01
caucaccacgaucagc

SEQ ID NO: 3442753 - RNA, 17 nt, Pseudomonas aeruginosa PA01
caucaccagcgccguca

SEQ ID NO: 3442754 - RNA, 20 nt, Pseudomonas aeruginosa PA01
caucaccagcggcgagcagg

SEQ ID NO: 3442755 - RNA, 14 nt, Pseudomonas aeruginosa PA01
caucaccaggcugc

SEQ ID NO: 3442756 - RNA, 20 nt, Pseudomonas aeruginosa PA01
caucaccaggcugccgccgu

SEQ ID NO: 3442757 - RNA, 22 nt, Pseudomonas aeruginosa PA01
caucaccaggcugccgccguag

SEQ ID NO: 3442758 - RNA, 14 nt, Pseudomonas aeruginosa PA01
caucaccccgcaac

SEQ ID NO: 3442759 - RNA, 15 nt, Pseudomonas aeruginosa PA01
caucaccccgcaacc

SEQ ID NO: 3442760 - RNA, 17 nt, Pseudomonas aeruginosa PA01
caucaccccgcaaccgc

SEQ ID NO: 3442761 - RNA, 19 nt, Pseudomonas aeruginosa PA01
caucaccccgcaaccgcag

SEQ ID NO: 3442762 - RNA, 22 nt, Pseudomonas aeruginosa PA01
caucaccgacagucccaggcca

SEQ ID NO: 3442763 - RNA, 14 nt, Pseudomonas aeruginosa PA01
caucaccgccauca

SEQ ID NO: 3442764 - RNA, 18 nt, Pseudomonas aeruginosa PA01
caucaccgccaucagcac

SEQ ID NO: 3442765 - RNA, 19 nt, Pseudomonas aeruginosa PA01
caucaccgccaucagcacg

SEQ ID NO: 3442766 - RNA, 19 nt, Pseudomonas aeruginosa PA01
caucaccgcgguuggcgcc

SEQ ID NO: 3442767 - RNA, 11 nt, Pseudomonas aeruginosa PA01
caucaccggca

SEQ ID NO: 3442768 - RNA, 16 nt, Pseudomonas aeruginosa PA01
caucaccggcagcagc

SEQ ID NO: 3442769 - RNA, 17 nt, Pseudomonas aeruginosa PA01
caucaccggcagcagcg

SEQ ID NO: 3442770 - RNA, 23 nt, Pseudomonas aeruginosa PA01
caucaccuucgccagcaggcuca

SEQ ID NO: 3442771 - RNA, 16 nt, Pseudomonas aeruginosa PA01
caucaccuucgcccuc

SEQ ID NO: 3442772 - RNA, 16 nt, Pseudomonas aeruginosa PA01
caucacgcuuuccggc

SEQ ID NO: 3442773 - RNA, 20 nt, Pseudomonas aeruginosa PA01
caucacgcuuuccggcuuga

SEQ ID NO: 3442774 - RNA, 18 nt, Pseudomonas aeruginosa PA01
caucacggccccgagaaa

SEQ ID NO: 3442775 - RNA, 16 nt, Pseudomonas aeruginosa PA01
caucacguacggcgcc

SEQ ID NO: 3442776 - RNA, 13 nt, Pseudomonas aeruginosa PA01
caucacgucgcgc

SEQ ID NO: 3442777 - RNA, 17 nt, Pseudomonas aeruginosa PA01
caucacgucgcgcaccu

SEQ ID NO: 3442778 - RNA, 21 nt, Pseudomonas aeruginosa PA01
caucacgucgcgcaccuggcg

SEQ ID NO: 3442779 - RNA, 23 nt, Pseudomonas aeruginosa PA01
caucagaggcaacaccaucggcc

SEQ ID NO: 3442780 - RNA, 18 nt, Pseudomonas aeruginosa PA01
caucagcaauuccgcagc

SEQ ID NO: 3442781 - RNA, 19 nt, Pseudomonas aeruginosa PA01
caucagcaauuccgcagcc

SEQ ID NO: 3442782 - RNA, 23 nt, Pseudomonas aeruginosa PA01
caucagcaauuccgcagccuugg

SEQ ID NO: 3442783 - RNA, 14 nt, Pseudomonas aeruginosa PA01
caucagcaccagga

SEQ ID NO: 3442784 - RNA, 18 nt, Pseudomonas aeruginosa PA01
caucagcaccaggaagcc

SEQ ID NO: 3442785 - RNA, 23 nt, Pseudomonas aeruginosa PA01
caucagcacgaaagccaugccca

SEQ ID NO: 3442786 - RNA, 15 nt, Pseudomonas aeruginosa PA01
caucagcagcgccag

SEQ ID NO: 3442787 - RNA, 14 nt, Pseudomonas aeruginosa PA01
caucagccccucgg

SEQ ID NO: 3442788 - RNA, 12 nt, Pseudomonas aeruginosa PA01
caucagccgcgc

SEQ ID NO: 3442789 - RNA, 16 nt, Pseudomonas aeruginosa PA01
caucagccuggccagc

SEQ ID NO: 3442790 - RNA, 19 nt, Pseudomonas aeruginosa PA01
caucagcgacagcauggcc

SEQ ID NO: 3442791 - RNA, 13 nt, Pseudomonas aeruginosa PA01
caucagcgccgcc

SEQ ID NO: 3442792 - RNA, 14 nt, Pseudomonas aeruginosa PA01
caucagcgccgccu

SEQ ID NO: 3442793 - RNA, 19 nt, Pseudomonas aeruginosa PA01
caucagcgucugcagcuug

SEQ ID NO: 3442794 - RNA, 18 nt, Pseudomonas aeruginosa PA01
caucagcuccacgucggc

SEQ ID NO: 3442795 - RNA, 20 nt, Pseudomonas aeruginosa PA01
caucagcuccacgucggccc

SEQ ID NO: 3442796 - RNA, 22 nt, Pseudomonas aeruginosa PA01
caucaggaucagguugaagagc

SEQ ID NO: 3442797 - RNA, 21 nt, Pseudomonas aeruginosa PA01
caucaggccgcggcccugcgc

SEQ ID NO: 3442798 - RNA, 21 nt, Pseudomonas aeruginosa PA01
caucaggcggcacucggcgac

SEQ ID NO: 3442799 - RNA, 15 nt, Pseudomonas aeruginosa PA01
caucaggcucaggcc

SEQ ID NO: 3442800 - RNA, 16 nt, Pseudomonas aeruginosa PA01
caucaggcugccgagc

SEQ ID NO: 3442801 - RNA, 20 nt, Pseudomonas aeruginosa PA01
caucaggcugccgagcaggg

SEQ ID NO: 3442802 - RNA, 22 nt, Pseudomonas aeruginosa PA01
caucaggcugccgagcaggguc

SEQ ID NO: 3442803 - RNA, 13 nt, Pseudomonas aeruginosa PA01
caucaggcugcug

SEQ ID NO: 3442804 - RNA, 15 nt, Pseudomonas aeruginosa PA01
caucagggcgaaagc

SEQ ID NO: 3442805 - RNA, 14 nt, Pseudomonas aeruginosa PA01
caucagggucggcc

SEQ ID NO: 3442806 - RNA, 15 nt, Pseudomonas aeruginosa PA01
caucagggucggccc

SEQ ID NO: 3442807 - RNA, 17 nt, Pseudomonas aeruginosa PA01
caucagggucggcccgg

SEQ ID NO: 3442808 - RNA, 16 nt, Pseudomonas aeruginosa PA01
caucagguccaccagc

SEQ ID NO: 3442809 - RNA, 14 nt, Pseudomonas aeruginosa PA01
caucaggucggcgc

SEQ ID NO: 3442810 - RNA, 17 nt, Pseudomonas aeruginosa PA01
caucaggucggcgcgca

SEQ ID NO: 3442811 - RNA, 18 nt, Pseudomonas aeruginosa PA01
caucaggucggcgcgcac

SEQ ID NO: 3442812 - RNA, 13 nt, Pseudomonas aeruginosa PA01
caucaggucgguc

SEQ ID NO: 3442813 - RNA, 21 nt, Pseudomonas aeruginosa PA01
caucaguagcgggcauccagc

SEQ ID NO: 3442814 - RNA, 16 nt, Pseudomonas aeruginosa PA01
caucagugccugcacg

SEQ ID NO: 3442815 - RNA, 13 nt, Pseudomonas aeruginosa PA01
caucaguuccucg

SEQ ID NO: 3442816 - RNA, 18 nt, Pseudomonas aeruginosa PA01
caucaguugcgcgcgggu

SEQ ID NO: 3442817 - RNA, 15 nt, Pseudomonas aeruginosa PA01
caucauccgcguggc

SEQ ID NO: 3442818 - RNA, 14 nt, Pseudomonas aeruginosa PA01
caucaucggacgcc

SEQ ID NO: 3442819 - RNA, 19 nt, Pseudomonas aeruginosa PA01
caucauguagacgaugccg

SEQ ID NO: 3442820 - RNA, 14 nt, Pseudomonas aeruginosa PA01
cauccagcaccgcu

SEQ ID NO: 3442821 - RNA, 15 nt, Pseudomonas aeruginosa PA01
cauccagcaccgcuu

SEQ ID NO: 3442822 - RNA, 23 nt, Pseudomonas aeruginosa PA01
cauccagcaccgcuuucaccagg

SEQ ID NO: 3442823 - RNA, 17 nt, Pseudomonas aeruginosa PA01
cauccagcauccgugcg

SEQ ID NO: 3442824 - RNA, 13 nt, Pseudomonas aeruginosa PA01
cauccagccccca

SEQ ID NO: 3442825 - RNA, 15 nt, Pseudomonas aeruginosa PA01
cauccagccugcgcu

SEQ ID NO: 3442826 - RNA, 17 nt, Pseudomonas aeruginosa PA01
cauccagccugcgcugu

SEQ ID NO: 3442827 - RNA, 14 nt, Pseudomonas aeruginosa PA01
cauccagcgccugg

SEQ ID NO: 3442828 - RNA, 17 nt, Pseudomonas aeruginosa PA01
cauccagcggacgcuug

SEQ ID NO: 3442829 - RNA, 19 nt, Pseudomonas aeruginosa PA01
cauccagucuucgccggcc

SEQ ID NO: 3442830 - RNA, 20 nt, Pseudomonas aeruginosa PA01
cauccagucuucgccggccu

SEQ ID NO: 3442831 - RNA, 15 nt, Pseudomonas aeruginosa PA01
cauccaguguggcgg

SEQ ID NO: 3442832 - RNA, 17 nt, Pseudomonas aeruginosa PA01
cauccaguuccugcacc

SEQ ID NO: 3442833 - RNA, 20 nt, Pseudomonas aeruginosa PA01
cauccaguuccugcaccacg

SEQ ID NO: 3442834 - RNA, 19 nt, Pseudomonas aeruginosa PA01
cauccccgaggcgacgccc

SEQ ID NO: 3442835 - RNA, 21 nt, Pseudomonas aeruginosa PA01
cauccccgccucgaccagcgc

SEQ ID NO: 3442836 - RNA, 22 nt, Pseudomonas aeruginosa PA01
cauccccgccucgaccagcgcc

SEQ ID NO: 3442837 - RNA, 22 nt, Pseudomonas aeruginosa PA01
cauccccuuuuuuugcgcgcca

SEQ ID NO: 3442838 - RNA, 20 nt, Pseudomonas aeruginosa PA01
caucccgcccggucucagcc

SEQ ID NO: 3442839 - RNA, 22 nt, Pseudomonas aeruginosa PA01
caucccgggguugcccagcagg

SEQ ID NO: 3442840 - RNA, 18 nt, Pseudomonas aeruginosa PA01
caucccgguuuccgcagc

SEQ ID NO: 3442841 - RNA, 14 nt, Pseudomonas aeruginosa PA01
caucccuucuuuua

SEQ ID NO: 3442842 - RNA, 18 nt, Pseudomonas aeruginosa PA01
cauccgcaccauccgccg

SEQ ID NO: 3442843 - RNA, 19 nt, Pseudomonas aeruginosa PA01
cauccgcaccauccgccgc

SEQ ID NO: 3442844 - RNA, 12 nt, Pseudomonas aeruginosa PA01
cauccgcccugc

SEQ ID NO: 3442845 - RNA, 14 nt, Pseudomonas aeruginosa PA01
cauccgcccugcgg

SEQ ID NO: 3442846 - RNA, 20 nt, Pseudomonas aeruginosa PA01
cauccgccgcagaccagcga

SEQ ID NO: 3442847 - RNA, 22 nt, Pseudomonas aeruginosa PA01
cauccgccgcagaccagcgaac

SEQ ID NO: 3442848 - RNA, 12 nt, Pseudomonas aeruginosa PA01
cauccgccgcug

SEQ ID NO: 3442849 - RNA, 23 nt, Pseudomonas aeruginosa PA01
caucgccgcggcgaagcgcucga

SEQ ID NO: 3442850 - RNA, 17 nt, Pseudomonas aeruginosa PA01
caucgccggcagcgccg

SEQ ID NO: 3442851 - RNA, 18 nt, Pseudomonas aeruginosa PA01
caucgccggcagcgccgc

SEQ ID NO: 3442852 - RNA, 14 nt, Pseudomonas aeruginosa PA01
caucgccggcgagc

SEQ ID NO: 3442853 - RNA, 18 nt, Pseudomonas aeruginosa PA01
caucgccggcgagccgcu

SEQ ID NO: 3442854 - RNA, 19 nt, Pseudomonas aeruginosa PA01
caucgccggcgagccgcug

SEQ ID NO: 3442855 - RNA, 22 nt, Pseudomonas aeruginosa PA01
caucgccggcgagccgcuggca

SEQ ID NO: 3442856 - RNA, 15 nt, Pseudomonas aeruginosa PA01
caucgccggcgccga

SEQ ID NO: 3442857 - RNA, 18 nt, Pseudomonas aeruginosa PA01
caucgccgucucguagac

SEQ ID NO: 3442858 - RNA, 14 nt, Pseudomonas aeruginosa PA01
caucgccucgcgga

SEQ ID NO: 3442859 - RNA, 14 nt, Pseudomonas aeruginosa PA01
caucgccugcuggu

SEQ ID NO: 3442860 - RNA, 22 nt, Pseudomonas aeruginosa PA01
caucgccugcuuggcggcggug

SEQ ID NO: 3442861 - RNA, 14 nt, Pseudomonas aeruginosa PA01
caucgccugggccg

SEQ ID NO: 3442862 - RNA, 15 nt, Pseudomonas aeruginosa PA01
caucgccugggccgg

SEQ ID NO: 3442863 - RNA, 19 nt, Pseudomonas aeruginosa PA01
caucgcgaaaacucccggc

SEQ ID NO: 3442864 - RNA, 22 nt, Pseudomonas aeruginosa PA01
caucgcgaaaacucccggccug

SEQ ID NO: 3442865 - RNA, 19 nt, Pseudomonas aeruginosa PA01
caucgcgcacaugccgagc

SEQ ID NO: 3442866 - RNA, 14 nt, Pseudomonas aeruginosa PA01
caucgcgccgccga

SEQ ID NO: 3442867 - RNA, 21 nt, Pseudomonas aeruginosa PA01
caucgcggaaacccuuccagc

SEQ ID NO: 3442868 - RNA, 15 nt, Pseudomonas aeruginosa PA01
caucgcggacaccgc

SEQ ID NO: 3442869 - RNA, 16 nt, Pseudomonas aeruginosa PA01
caucgcggacaccgcg

SEQ ID NO: 3442870 - RNA, 17 nt, Pseudomonas aeruginosa PA01
caucgcggacaccgcgg

SEQ ID NO: 3442871 - RNA, 13 nt, Pseudomonas aeruginosa PA01
caucgcggcgaug

SEQ ID NO: 3442872 - RNA, 23 nt, Pseudomonas aeruginosa PA01
caucgcggcgauggccgccagca

SEQ ID NO: 3442873 - RNA, 18 nt, Pseudomonas aeruginosa PA01
caucgcgggcgugcucca

SEQ ID NO: 3442874 - RNA, 17 nt, Pseudomonas aeruginosa PA01
caucgcgguuauccgcc

SEQ ID NO: 3442875 - RNA, 18 nt, Pseudomonas aeruginosa PA01
caucgcgguuauccgccg

SEQ ID NO: 3442876 - RNA, 19 nt, Pseudomonas aeruginosa PA01
caucgcgguuauccgccga

SEQ ID NO: 3442877 - RNA, 20 nt, Pseudomonas aeruginosa PA01
caucgcgguuauccgccggc

SEQ ID NO: 3442878 - RNA, 21 nt, Pseudomonas aeruginosa PA01
caucgcgguuauccgccggcu

SEQ ID NO: 3442879 - RNA, 23 nt, Pseudomonas aeruginosa PA01
caucgcguaggacgcauaaccgc

SEQ ID NO: 3442880 - RNA, 23 nt, Pseudomonas aeruginosa PA01
caucgcguagggcgacggcgcuu

SEQ ID NO: 3442881 - RNA, 13 nt, Pseudomonas aeruginosa PA01
caucgcgucgccg

SEQ ID NO: 3442882 - RNA, 15 nt, Pseudomonas aeruginosa PA01
caucgcugaccucga

SEQ ID NO: 3442883 - RNA, 14 nt, Pseudomonas aeruginosa PA01
caucgcugaccugg

SEQ ID NO: 3442884 - RNA, 18 nt, Pseudomonas aeruginosa PA01
caucgcuuucaggcgcuc

SEQ ID NO: 3442885 - RNA, 23 nt, Pseudomonas aeruginosa PA01
caucgcuuucaggcgcucgucga

SEQ ID NO: 3442886 - RNA, 21 nt, Pseudomonas aeruginosa PA01
caucgcuuuccuggccgaccc

SEQ ID NO: 3442887 - RNA, 22 nt, Pseudomonas aeruginosa PA01
caucgcuuuccuggccgacccg

SEQ ID NO: 3442888 - RNA, 19 nt, Pseudomonas aeruginosa PA01
caucggccaccuucgcccg

SEQ ID NO: 3442889 - RNA, 20 nt, Pseudomonas aeruginosa PA01
caucggccaccuucgcccgc

SEQ ID NO: 3442890 - RNA, 22 nt, Pseudomonas aeruginosa PA01
caucggccaccuucgcccgcug

SEQ ID NO: 3442891 - RNA, 23 nt, Pseudomonas aeruginosa PA01
caucggccaguccggucagcagc

SEQ ID NO: 3442892 - RNA, 18 nt, Pseudomonas aeruginosa PA01
caucggccauucggccug

SEQ ID NO: 3442893 - RNA, 22 nt, Pseudomonas aeruginosa PA01
caucggccauucggccuggcag

SEQ ID NO: 3442894 - RNA, 13 nt, Pseudomonas aeruginosa PA01
caucggcccuggg

SEQ ID NO: 3442895 - RNA, 15 nt, Pseudomonas aeruginosa PA01
caucggcccugggcg

SEQ ID NO: 3442896 - RNA, 20 nt, Pseudomonas aeruginosa PA01
caucggcccugggcguggca

SEQ ID NO: 3442897 - RNA, 13 nt, Pseudomonas aeruginosa PA01
caucggccgccag

SEQ ID NO: 3442898 - RNA, 14 nt, Pseudomonas aeruginosa PA01
caucggccgccagg

SEQ ID NO: 3442899 - RNA, 21 nt, Pseudomonas aeruginosa PA01
caucggccgggauacagcagc

SEQ ID NO: 3442900 - RNA, 22 nt, Pseudomonas aeruginosa PA01
caucggccgggauacagcagcc

SEQ ID NO: 3442901 - RNA, 23 nt, Pseudomonas aeruginosa PA01
caucggccgggauacagcagcca

SEQ ID NO: 3442902 - RNA, 23 nt, Pseudomonas aeruginosa PA01
caucggcgaagcggaagcgcagc

SEQ ID NO: 3442903 - RNA, 15 nt, Pseudomonas aeruginosa PA01
caucggcgccgcgca

SEQ ID NO: 3442904 - RNA, 19 nt, Pseudomonas aeruginosa PA01
caucggcgcuccgccgaac

SEQ ID NO: 3442905 - RNA, 16 nt, Pseudomonas aeruginosa PA01
caucggcggcaggccg

SEQ ID NO: 3442906 - RNA, 17 nt, Pseudomonas aeruginosa PA01
caucggcggcaggccga

SEQ ID NO: 3442907 - RNA, 15 nt, Pseudomonas aeruginosa PA01
caucggcggcggccc

SEQ ID NO: 3442908 - RNA, 15 nt, Pseudomonas aeruginosa PA01
caucggcgguacgcc

SEQ ID NO: 3442909 - RNA, 22 nt, Pseudomonas aeruginosa PA01
caucggcgguacgcccuccagc

SEQ ID NO: 3442910 - RNA, 13 nt, Pseudomonas aeruginosa PA01
caucggcuggccg

SEQ ID NO: 3442911 - RNA, 14 nt, Pseudomonas aeruginosa PA01
caucggcuggucgu

SEQ ID NO: 3442912 - RNA, 17 nt, Pseudomonas aeruginosa PA01
caucgggauaccggcca

SEQ ID NO: 3442913 - RNA, 20 nt, Pseudomonas aeruginosa PA01
caucggucgcgcccccaucu

SEQ ID NO: 3442914 - RNA, 15 nt, Pseudomonas aeruginosa PA01
caucggugccggcag

SEQ ID NO: 3442915 - RNA, 17 nt, Pseudomonas aeruginosa PA01
caucguccagcucggcc

SEQ ID NO: 3442916 - RNA, 18 nt, Pseudomonas aeruginosa PA01
caucgucgaaacgcuggc

SEQ ID NO: 3442917 - RNA, 21 nt, Pseudomonas aeruginosa PA01
caucgucgaugcguccgcgca

SEQ ID NO: 3442918 - RNA, 20 nt, Pseudomonas aeruginosa PA01
caucgucgcuuccggcgcca

SEQ ID NO: 3442919 - RNA, 13 nt, Pseudomonas aeruginosa PA01
caucgucggcagc

SEQ ID NO: 3442920 - RNA, 14 nt, Pseudomonas aeruginosa PA01
caucgucggcagcc

SEQ ID NO: 3442921 - RNA, 15 nt, Pseudomonas aeruginosa PA01
caucgucugcgcggc

SEQ ID NO: 3442922 - RNA, 14 nt, Pseudomonas aeruginosa PA01
caucguggccaugg

SEQ ID NO: 3442923 - RNA, 12 nt, Pseudomonas aeruginosa PA01
caucguggggcg

SEQ ID NO: 3442924 - RNA, 15 nt, Pseudomonas aeruginosa PA01
caucguucaguugcc

SEQ ID NO: 3442925 - RNA, 17 nt, Pseudomonas aeruginosa PA01
caucuccaggccgcuca

SEQ ID NO: 3442926 - RNA, 20 nt, Pseudomonas aeruginosa PA01
caucuccaggccgcucaccg

SEQ ID NO: 3442927 - RNA, 15 nt, Pseudomonas aeruginosa PA01
caucuccccaccaac

SEQ ID NO: 3442928 - RNA, 14 nt, Pseudomonas aeruginosa PA01
caucuccgcggaga

SEQ ID NO: 3442929 - RNA, 14 nt, Pseudomonas aeruginosa PA01
caucuccugcugga

SEQ ID NO: 3442930 - RNA, 14 nt, Pseudomonas aeruginosa PA01
caucuccuguggau

SEQ ID NO: 3442931 - RNA, 14 nt, Pseudomonas aeruginosa PA01
caucucgaagcaga

SEQ ID NO: 3442932 - RNA, 22 nt, Pseudomonas aeruginosa PA01
caucucgauggugaacgccagg

SEQ ID NO: 3442933 - RNA, 18 nt, Pseudomonas aeruginosa PA01
caucucgccgcgcacguc

SEQ ID NO: 3442934 - RNA, 12 nt, Pseudomonas aeruginosa PA01
caucucgccggc

SEQ ID NO: 3442935 - RNA, 13 nt, Pseudomonas aeruginosa PA01
caucucgccggca

SEQ ID NO: 3442936 - RNA, 14 nt, Pseudomonas aeruginosa PA01
caucucgccggcac

SEQ ID NO: 3442937 - RNA, 14 nt, Pseudomonas aeruginosa PA01
caucucggccaccu

SEQ ID NO: 3442938 - RNA, 20 nt, Pseudomonas aeruginosa PA01
caucucggccaggcccuuga

SEQ ID NO: 3442939 - RNA, 12 nt, Pseudomonas aeruginosa PA01
caucucggcgca

SEQ ID NO: 3442940 - RNA, 18 nt, Pseudomonas aeruginosa PA01
caucucggugcgccccag

SEQ ID NO: 3442941 - RNA, 20 nt, Pseudomonas aeruginosa PA01
caucucgugguugaggcgcu

SEQ ID NO: 3442942 - RNA, 17 nt, Pseudomonas aeruginosa PA01
caucucguugaggguca

SEQ ID NO: 3442943 - RNA, 14 nt, Pseudomonas aeruginosa PA01
caucugcaacgcgg

SEQ ID NO: 3442944 - RNA, 19 nt, Pseudomonas aeruginosa PA01
caucugcaacgcggcguca

SEQ ID NO: 3442945 - RNA, 18 nt, Pseudomonas aeruginosa PA01
caucugcaccacguucgg

SEQ ID NO: 3442946 - RNA, 22 nt, Pseudomonas aeruginosa PA01
caucugcacgucguagcccuuc

SEQ ID NO: 3442947 - RNA, 14 nt, Pseudomonas aeruginosa PA01
caucugccgggcgu

SEQ ID NO: 3442948 - RNA, 21 nt, Pseudomonas aeruginosa PA01
caucugccuuacaagcagagg

SEQ ID NO: 3442949 - RNA, 13 nt, Pseudomonas aeruginosa PA01
caucugcucgagg

SEQ ID NO: 3442950 - RNA, 17 nt, Pseudomonas aeruginosa PA01
caucugcugcagcauca

SEQ ID NO: 3442951 - RNA, 21 nt, Pseudomonas aeruginosa PA01
caucugcugguccuggcgcga

SEQ ID NO: 3442952 - RNA, 16 nt, Pseudomonas aeruginosa PA01
caucuggaucaggaag

SEQ ID NO: 3442953 - RNA, 12 nt, Pseudomonas aeruginosa PA01
caucuggcugcg

SEQ ID NO: 3442954 - RNA, 14 nt, Pseudomonas aeruginosa PA01
caucuggcugcgcg

SEQ ID NO: 3442955 - RNA, 16 nt, Pseudomonas aeruginosa PA01
caucuggcugcgcgcc

SEQ ID NO: 3442956 - RNA, 17 nt, Pseudomonas aeruginosa PA01
caucuggcugcgcgcca

SEQ ID NO: 3442957 - RNA, 15 nt, Pseudomonas aeruginosa PA01
caucugggccaucgc

SEQ ID NO: 3442958 - RNA, 21 nt, Pseudomonas aeruginosa PA01
caucugggccaucgccggccc

SEQ ID NO: 3442959 - RNA, 12 nt, Pseudomonas aeruginosa PA01
caucuggguccu

SEQ ID NO: 3442960 - RNA, 18 nt, Pseudomonas aeruginosa PA01
caucuggguccuggugau

SEQ ID NO: 3442961 - RNA, 14 nt, Pseudomonas aeruginosa PA01
caucugggucuuca

SEQ ID NO: 3442962 - RNA, 20 nt, Pseudomonas aeruginosa PA01
caucugggucuucagcuugg

SEQ ID NO: 3442963 - RNA, 17 nt, Pseudomonas aeruginosa PA01
caucuguaccaccgcca

SEQ ID NO: 3442964 - RNA, 17 nt, Pseudomonas aeruginosa PA01
caucuucaaucgcgcgu

SEQ ID NO: 3442965 - RNA, 22 nt, Pseudomonas aeruginosa PA01
caucuucagcaucaggucggcg

SEQ ID NO: 3442966 - RNA, 12 nt, Pseudomonas aeruginosa PA01
caucuucuccca

SEQ ID NO: 3442967 - RNA, 19 nt, Pseudomonas aeruginosa PA01
caucuucucgaagcgcgcc

SEQ ID NO: 3442968 - RNA, 22 nt, Pseudomonas aeruginosa PA01
caucuucucgaagcgcgccugc

SEQ ID NO: 3442969 - RNA, 23 nt, Pseudomonas aeruginosa PA01
caucuucugcgcguugcagcgcc

SEQ ID NO: 3442970 - RNA, 19 nt, Pseudomonas aeruginosa PA01
caucuucuucaaccgcugg

SEQ ID NO: 3442971 - RNA, 13 nt, Pseudomonas aeruginosa PA01
caucuugaugccg

SEQ ID NO: 3442972 - RNA, 20 nt, Pseudomonas aeruginosa PA01
caucuuggcaaucaucgcgu

SEQ ID NO: 3442973 - RNA, 19 nt, Pseudomonas aeruginosa PA01
caucuuuuccugcuggcga

SEQ ID NO: 3442974 - RNA, 16 nt, Pseudomonas aeruginosa PA01
caugaaaaagcccggc

SEQ ID NO: 3442975 - RNA, 20 nt, Pseudomonas aeruginosa PA01
caugaaaaagcccggccugg

SEQ ID NO: 3442976 - RNA, 22 nt, Pseudomonas aeruginosa PA01
caugaaaaagcccggccuggug

SEQ ID NO: 3442977 - RNA, 20 nt, Pseudomonas aeruginosa PA01
caugaaaaaggccggucgca

SEQ ID NO: 3442978 - RNA, 16 nt, Pseudomonas aeruginosa PA01
caugaaacaguuggac

SEQ ID NO: 3442979 - RNA, 20 nt, Pseudomonas aeruginosa PA01
caugaacacauagaccagca

SEQ ID NO: 3442980 - RNA, 14 nt, Pseudomonas aeruginosa PA01
caugaacaccgugu

SEQ ID NO: 3442981 - RNA, 13 nt, Pseudomonas aeruginosa PA01
caugaaccaaccg

SEQ ID NO: 3442982 - RNA, 17 nt, Pseudomonas aeruginosa PA01
caugaagccgcgcgccg

SEQ ID NO: 3442983 - RNA, 19 nt, Pseudomonas aeruginosa PA01
caugaagccgcgcgccgag

SEQ ID NO: 3442984 - RNA, 16 nt, Pseudomonas aeruginosa PA01
caugaaugccuugagg

SEQ ID NO: 3442985 - RNA, 20 nt, Pseudomonas aeruginosa PA01
caugaaugccuugaggccuu

SEQ ID NO: 3442986 - RNA, 18 nt, Pseudomonas aeruginosa PA01
caugaauguggugucgca

SEQ ID NO: 3442987 - RNA, 17 nt, Pseudomonas aeruginosa PA01
caugaccagagccgccg

SEQ ID NO: 3442988 - RNA, 20 nt, Pseudomonas aeruginosa PA01
caugaccagagccgccgaac

SEQ ID NO: 3442989 - RNA, 14 nt, Pseudomonas aeruginosa PA01
caugacccgcggca

SEQ ID NO: 3442990 - RNA, 21 nt, Pseudomonas aeruginosa PA01
caugaccgagcaugcgcggca

SEQ ID NO: 3442991 - RNA, 22 nt, Pseudomonas aeruginosa PA01
caugaccgauggcgccgcgaug

SEQ ID NO: 3442992 - RNA, 19 nt, Pseudomonas aeruginosa PA01
caugaccgccgcucaucug

SEQ ID NO: 3442993 - RNA, 24 nt, Pseudomonas aeruginosa PA01
caugaccgccgcucaucugcacca

SEQ ID NO: 3442994 - RNA, 17 nt, Pseudomonas aeruginosa PA01
caugaccuccagggcca

SEQ ID NO: 3442995 - RNA, 16 nt, Pseudomonas aeruginosa PA01
caugaccucggccagc

SEQ ID NO: 3442996 - RNA, 17 nt, Pseudomonas aeruginosa PA01
caugaccucggccagcc

SEQ ID NO: 3442997 - RNA, 21 nt, Pseudomonas aeruginosa PA01
caugaccuucagcaccugcgc

SEQ ID NO: 3442998 - RNA, 22 nt, Pseudomonas aeruginosa PA01
caugaccuucagcaccugcgcc

SEQ ID NO: 3442999 - RNA, 14 nt, Pseudomonas aeruginosa PA01
caugacgaagcgca

SEQ ID NO: 3443000 - RNA, 17 nt, Pseudomonas aeruginosa PA01
caugacgaagcgcaccg

SEQ ID NO: 3443001 - RNA, 21 nt, Pseudomonas aeruginosa PA01
caugacgauaucggcgccggc

SEQ ID NO: 3443002 - RNA, 23 nt, Pseudomonas aeruginosa PA01
caugacgauaucggcgccggccu

SEQ ID NO: 3443003 - RNA, 14 nt, Pseudomonas aeruginosa PA01
caugagcgcccggc

SEQ ID NO: 3443004 - RNA, 15 nt, Pseudomonas aeruginosa PA01
caugaggggaaucgc

SEQ ID NO: 3443005 - RNA, 14 nt, Pseudomonas aeruginosa PA01
caugauaaggcaaa

SEQ ID NO: 3443006 - RNA, 19 nt, Pseudomonas aeruginosa PA01
caugaucccuagggguucu

SEQ ID NO: 3443007 - RNA, 13 nt, Pseudomonas aeruginosa PA01
caugauccggugc

SEQ ID NO: 3443008 - RNA, 18 nt, Pseudomonas aeruginosa PA01
caugaucgccucggcgcg

SEQ ID NO: 3443009 - RNA, 14 nt, Pseudomonas aeruginosa PA01
caugaucuggcugu

SEQ ID NO: 3443010 - RNA, 23 nt, Pseudomonas aeruginosa PA01
caugaucuggcugucgccgaucu

SEQ ID NO: 3443011 - RNA, 15 nt, Pseudomonas aeruginosa PA01
caugaugcgcccgga

SEQ ID NO: 3443012 - RNA, 14 nt, Pseudomonas aeruginosa PA01
caugauggucggca

SEQ ID NO: 3443013 - RNA, 12 nt, Pseudomonas aeruginosa PA01
caugauggugcc

SEQ ID NO: 3443014 - RNA, 20 nt, Pseudomonas aeruginosa PA01
caugauuucguuggcccaga

SEQ ID NO: 3443015 - RNA, 12 nt, Pseudomonas aeruginosa PA01
caugcaccaccu

SEQ ID NO: 3443016 - RNA, 13 nt, Pseudomonas aeruginosa PA01
caugcaccaccug

SEQ ID NO: 3443017 - RNA, 11 nt, Pseudomonas aeruginosa PA01
caugcacgccc

SEQ ID NO: 3443018 - RNA, 16 nt, Pseudomonas aeruginosa PA01
caugcacuucgaccag

SEQ ID NO: 3443019 - RNA, 18 nt, Pseudomonas aeruginosa PA01
caugcagcggcaugguca

SEQ ID NO: 3443020 - RNA, 22 nt, Pseudomonas aeruginosa PA01
caugcagcggcauggucagccc

SEQ ID NO: 3443021 - RNA, 14 nt, Pseudomonas aeruginosa PA01
caugcaggccaggg

SEQ ID NO: 3443022 - RNA, 12 nt, Pseudomonas aeruginosa PA01
caugcaggccga

SEQ ID NO: 3443023 - RNA, 13 nt, Pseudomonas aeruginosa PA01
caugcaggccggc

SEQ ID NO: 3443024 - RNA, 19 nt, Pseudomonas aeruginosa PA01
caugcaggccggccuccag

SEQ ID NO: 3443025 - RNA, 20 nt, Pseudomonas aeruginosa PA01
caugcaggccggccuccagc

SEQ ID NO: 3443026 - RNA, 19 nt, Pseudomonas aeruginosa PA01
caugcaggcucgacagguc

SEQ ID NO: 3443027 - RNA, 13 nt, Pseudomonas aeruginosa PA01
caugcaggcucuc

SEQ ID NO: 3443028 - RNA, 20 nt, Pseudomonas aeruginosa PA01
caugcaggucgugcagcccg

SEQ ID NO: 3443029 - RNA, 15 nt, Pseudomonas aeruginosa PA01
caugcagguggcgcu

SEQ ID NO: 3443030 - RNA, 23 nt, Pseudomonas aeruginosa PA01
caugccagggccuugcugaaguu

SEQ ID NO: 3443031 - RNA, 18 nt, Pseudomonas aeruginosa PA01
caugcccagacgccgcuc

SEQ ID NO: 3443032 - RNA, 22 nt, Pseudomonas aeruginosa PA01
caugcccagcguggccagcgaa

SEQ ID NO: 3443033 - RNA, 12 nt, Pseudomonas aeruginosa PA01
caugcccagcuu

SEQ ID NO: 3443034 - RNA, 15 nt, Pseudomonas aeruginosa PA01
caugcccagcuuggc

SEQ ID NO: 3443035 - RNA, 10 nt, Pseudomonas aeruginosa PA01
caugcccagg

SEQ ID NO: 3443036 - RNA, 13 nt, Pseudomonas aeruginosa PA01
caugcccagggcc

SEQ ID NO: 3443037 - RNA, 19 nt, Pseudomonas aeruginosa PA01
caugcccagggccagcagc

SEQ ID NO: 3443038 - RNA, 20 nt, Pseudomonas aeruginosa PA01
caugcccagggccagcagcg

SEQ ID NO: 3443039 - RNA, 21 nt, Pseudomonas aeruginosa PA01
caugcccagggccagcagcgg

SEQ ID NO: 3443040 - RNA, 22 nt, Pseudomonas aeruginosa PA01
caugcccagggccagcagcggc

SEQ ID NO: 3443041 - RNA, 17 nt, Pseudomonas aeruginosa PA01
caugccccgccgacugg

SEQ ID NO: 3443042 - RNA, 14 nt, Pseudomonas aeruginosa PA01
caugcccgccccgc

SEQ ID NO: 3443043 - RNA, 20 nt, Pseudomonas aeruginosa PA01
caugcccgcgucgcgcgcgg

SEQ ID NO: 3443044 - RNA, 22 nt, Pseudomonas aeruginosa PA01
caugcccgcgucgcgcgcggca

SEQ ID NO: 3443045 - RNA, 14 nt, Pseudomonas aeruginosa PA01
caugcccggcuggc

SEQ ID NO: 3443046 - RNA, 16 nt, Pseudomonas aeruginosa PA01
caugcccggcuggcgu

SEQ ID NO: 3443047 - RNA, 22 nt, Pseudomonas aeruginosa PA01
caugcccgucgaccaucaccag

SEQ ID NO: 3443048 - RNA, 15 nt, Pseudomonas aeruginosa PA01
caugcccugccggcg

SEQ ID NO: 3443049 - RNA, 13 nt, Pseudomonas aeruginosa PA01
caugcccuggccg

SEQ ID NO: 3443050 - RNA, 22 nt, Pseudomonas aeruginosa PA01
caugcccuggccgacgcugagg

SEQ ID NO: 3443051 - RNA, 18 nt, Pseudomonas aeruginosa PA01
caugcccuuguccggccc

SEQ ID NO: 3443052 - RNA, 19 nt, Pseudomonas aeruginosa PA01
caugcccuuguccggcccg

SEQ ID NO: 3443053 - RNA, 21 nt, Pseudomonas aeruginosa PA01
caugcccuugucgcccuucuu

SEQ ID NO: 3443054 - RNA, 20 nt, Pseudomonas aeruginosa PA01
cauggccuggcgcucagcgc

SEQ ID NO: 3443055 - RNA, 22 nt, Pseudomonas aeruginosa PA01
cauggccuggcgcucagcgccg

SEQ ID NO: 3443056 - RNA, 14 nt, Pseudomonas aeruginosa PA01
cauggccuugccgg

SEQ ID NO: 3443057 - RNA, 16 nt, Pseudomonas aeruginosa PA01
cauggccuugccggca

SEQ ID NO: 3443058 - RNA, 14 nt, Pseudomonas aeruginosa PA01
cauggcgaguucca

SEQ ID NO: 3443059 - RNA, 13 nt, Pseudomonas aeruginosa PA01
cauggcgcacgcc

SEQ ID NO: 3443060 - RNA, 18 nt, Pseudomonas aeruginosa PA01
cauggcgccacucggcgu

SEQ ID NO: 3443061 - RNA, 23 nt, Pseudomonas aeruginosa PA01
cauggcgccacucggcgugccgg

SEQ ID NO: 3443062 - RNA, 19 nt, Pseudomonas aeruginosa PA01
cauggcgcgaaucuucggc

SEQ ID NO: 3443063 - RNA, 21 nt, Pseudomonas aeruginosa PA01
cauggcgcgaugcucccgagc

SEQ ID NO: 3443064 - RNA, 12 nt, Pseudomonas aeruginosa PA01
cauggcgcucga

SEQ ID NO: 3443065 - RNA, 13 nt, Pseudomonas aeruginosa PA01
cauggcgguccag

SEQ ID NO: 3443066 - RNA, 16 nt, Pseudomonas aeruginosa PA01
cauggcgguuccucca

SEQ ID NO: 3443067 - RNA, 13 nt, Pseudomonas aeruginosa PA01
cauggcguccggu

SEQ ID NO: 3443068 - RNA, 13 nt, Pseudomonas aeruginosa PA01
cauggcgucggcg

SEQ ID NO: 3443069 - RNA, 19 nt, Pseudomonas aeruginosa PA01
cauggcuguagcucugcug

SEQ ID NO: 3443070 - RNA, 21 nt, Pseudomonas aeruginosa PA01
cauggcuguagcucugcuggc

SEQ ID NO: 3443071 - RNA, 21 nt, Pseudomonas aeruginosa PA01
cauggcuuuccaggcgccgcu

SEQ ID NO: 3443072 - RNA, 20 nt, Pseudomonas aeruginosa PA01
caugggaaccucggcaggcu

SEQ ID NO: 3443073 - RNA, 24 nt, Pseudomonas aeruginosa PA01
caugggacaaacgauugcggcaga

SEQ ID NO: 3443074 - RNA, 15 nt, Pseudomonas aeruginosa PA01
caugggauggcgcgg

SEQ ID NO: 3443075 - RNA, 13 nt, Pseudomonas aeruginosa PA01
caugggcacgccg

SEQ ID NO: 3443076 - RNA, 23 nt, Pseudomonas aeruginosa PA01
caugggcacgccgguggccaggc

SEQ ID NO: 3443077 - RNA, 16 nt, Pseudomonas aeruginosa PA01
caugggcauccugccg

SEQ ID NO: 3443078 - RNA, 21 nt, Pseudomonas aeruginosa PA01
caugggcauccugccgccugu

SEQ ID NO: 3443079 - RNA, 15 nt, Pseudomonas aeruginosa PA01
caugggccggccgac

SEQ ID NO: 3443080 - RNA, 14 nt, Pseudomonas aeruginosa PA01
caugggggccagca

SEQ ID NO: 3443081 - RNA, 21 nt, Pseudomonas aeruginosa PA01
caugggggccagcagggccgc

SEQ ID NO: 3443082 - RNA, 23 nt, Pseudomonas aeruginosa PA01
caugggggccagcagggccgccg

SEQ ID NO: 3443083 - RNA, 15 nt, Pseudomonas aeruginosa PA01
caugggucagcgcca

SEQ ID NO: 3443084 - RNA, 15 nt, Pseudomonas aeruginosa PA01
caugggugucggcga

SEQ ID NO: 3443085 - RNA, 17 nt, Pseudomonas aeruginosa PA01
caugggugucggcgauc

SEQ ID NO: 3443086 - RNA, 20 nt, Pseudomonas aeruginosa PA01
caugggugucggcgaucagg

SEQ ID NO: 3443087 - RNA, 13 nt, Pseudomonas aeruginosa PA01
caugguccgucgc

SEQ ID NO: 3443088 - RNA, 20 nt, Pseudomonas aeruginosa PA01
cauggucgagaaggcugccg

SEQ ID NO: 3443089 - RNA, 23 nt, Pseudomonas aeruginosa PA01
cauggucgagaaggcugccgggc

SEQ ID NO: 3443090 - RNA, 23 nt, Pseudomonas aeruginosa PA01
cauggucgcgcuguugccgcgcu

SEQ ID NO: 3443091 - RNA, 14 nt, Pseudomonas aeruginosa PA01
cauggucggccagg

SEQ ID NO: 3443092 - RNA, 18 nt, Pseudomonas aeruginosa PA01
cauggucggccaggucgc

SEQ ID NO: 3443093 - RNA, 21 nt, Pseudomonas aeruginosa PA01
cauggucucgcugacccaggc

SEQ ID NO: 3443094 - RNA, 13 nt, Pseudomonas aeruginosa PA01
cauggucuuccca

SEQ ID NO: 3443095 - RNA, 20 nt, Pseudomonas aeruginosa PA01
cauggucuucccagaccccg

SEQ ID NO: 3443096 - RNA, 18 nt, Pseudomonas aeruginosa PA01
cauggucuuuccuuucac

SEQ ID NO: 3443097 - RNA, 20 nt, Pseudomonas aeruginosa PA01
cauggugaagcccaccacca

SEQ ID NO: 3443098 - RNA, 16 nt, Pseudomonas aeruginosa PA01
caugguggaucgacug

SEQ ID NO: 3443099 - RNA, 16 nt, Pseudomonas aeruginosa PA01
caugguguuggcggcc

SEQ ID NO: 3443100 - RNA, 14 nt, Pseudomonas aeruginosa PA01
caugguguugggca

SEQ ID NO: 3443101 - RNA, 23 nt, Pseudomonas aeruginosa PA01
caugguuuccgccggacccugcc

SEQ ID NO: 3443102 - RNA, 14 nt, Pseudomonas aeruginosa PA01
cauguaccucuggc

SEQ ID NO: 3443103 - RNA, 17 nt, Pseudomonas aeruginosa PA01
cauguaccucuggcuga

SEQ ID NO: 3443104 - RNA, 16 nt, Pseudomonas aeruginosa PA01
cauguacguaucccag

SEQ ID NO: 3443105 - RNA, 23 nt, Pseudomonas aeruginosa PA01
cauguagaacggguugaucaggu

SEQ ID NO: 3443106 - RNA, 18 nt, Pseudomonas aeruginosa PA01
cauguagagcaggcugcu

SEQ ID NO: 3443107 - RNA, 17 nt, Pseudomonas aeruginosa PA01
cauguagcgcuccucgc

SEQ ID NO: 3443108 - RNA, 18 nt, Pseudomonas aeruginosa PA01
cauguaggcgcaccaggc

SEQ ID NO: 3443109 - RNA, 20 nt, Pseudomonas aeruginosa PA01
cauguaggcgcaccaggcca

SEQ ID NO: 3443110 - RNA, 21 nt, Pseudomonas aeruginosa PA01
cauguaggcgcaccaggccag

SEQ ID NO: 3443111 - RNA, 15 nt, Pseudomonas aeruginosa PA01
caugucagcggugaa

SEQ ID NO: 3443112 - RNA, 16 nt, Pseudomonas aeruginosa PA01
cauguccaccgccgcc

SEQ ID NO: 3443113 - RNA, 18 nt, Pseudomonas aeruginosa PA01
cauguccagccaguggcu

SEQ ID NO: 3443114 - RNA, 19 nt, Pseudomonas aeruginosa PA01
cauguccgaacgcgagguc

SEQ ID NO: 3443115 - RNA, 20 nt, Pseudomonas aeruginosa PA01
cauguccgcaggcaggucgc

SEQ ID NO: 3443116 - RNA, 14 nt, Pseudomonas aeruginosa PA01
cauguccggggcga

SEQ ID NO: 3443117 - RNA, 13 nt, Pseudomonas aeruginosa PA01
cauguccucggcg

SEQ ID NO: 3443118 - RNA, 22 nt, Pseudomonas aeruginosa PA01
caugucgcacuggucggccagu

SEQ ID NO: 3443119 - RNA, 20 nt, Pseudomonas aeruginosa PA01
caugucgcugaaacgcgcgu

SEQ ID NO: 3443120 - RNA, 23 nt, Pseudomonas aeruginosa PA01
caugucgcugagcggcugguggc

SEQ ID NO: 3443121 - RNA, 13 nt, Pseudomonas aeruginosa PA01
caugucgcuggcc

SEQ ID NO: 3443122 - RNA, 22 nt, Pseudomonas aeruginosa PA01
caugucguggacauacaggcgc

SEQ ID NO: 3443123 - RNA, 12 nt, Pseudomonas aeruginosa PA01
caugucuucuca

SEQ ID NO: 3443124 - RNA, 14 nt, Pseudomonas aeruginosa PA01
caugugcuggcgga

SEQ ID NO: 3443125 - RNA, 18 nt, Pseudomonas aeruginosa PA01
caugugcuugaccgccgc

SEQ ID NO: 3443126 - RNA, 19 nt, Pseudomonas aeruginosa PA01
caugugcuugaccgccgcc

SEQ ID NO: 3443127 - RNA, 21 nt, Pseudomonas aeruginosa PA01
caugugcuugaccgccgccug

SEQ ID NO: 3443128 - RNA, 11 nt, Pseudomonas aeruginosa PA01
cauguucacca

SEQ ID NO: 3443129 - RNA, 16 nt, Pseudomonas aeruginosa PA01
cauguucaccagcgcu

SEQ ID NO: 3443130 - RNA, 16 nt, Pseudomonas aeruginosa PA01
cauguucaugcgcugg

SEQ ID NO: 3443131 - RNA, 22 nt, Pseudomonas aeruginosa PA01
cauguuguuauggccgacccgu

SEQ ID NO: 3443132 - RNA, 21 nt, Pseudomonas aeruginosa PA01
cauguuguucgcgcaccuugg

SEQ ID NO: 3443133 - RNA, 14 nt, Pseudomonas aeruginosa PA01
cauuaccggcgacc

SEQ ID NO: 3443134 - RNA, 21 nt, Pseudomonas aeruginosa PA01
cauuagaggaacccaaucaca

SEQ ID NO: 3443135 - RNA, 17 nt, Pseudomonas aeruginosa PA01
cauuagcgucgcgcggc

SEQ ID NO: 3443136 - RNA, 18 nt, Pseudomonas aeruginosa PA01
cauuagcgucgcgcggcc

SEQ ID NO: 3443137 - RNA, 22 nt, Pseudomonas aeruginosa PA01
cauuagcgucgcgcggccagcg

SEQ ID NO: 3443138 - RNA, 22 nt, Pseudomonas aeruginosa PA01
cauucauggcgccacucggcgu

SEQ ID NO: 3443139 - RNA, 15 nt, Pseudomonas aeruginosa PA01
cauuccaccuuggca

SEQ ID NO: 3443140 - RNA, 16 nt, Pseudomonas aeruginosa PA01
cauucccacgacccgc

SEQ ID NO: 3443141 - RNA, 20 nt, Pseudomonas aeruginosa PA01
cauuccgacaaggagcgcga

SEQ ID NO: 3443142 - RNA, 20 nt, Pseudomonas aeruginosa PA01
cauuccgcggcacuccggca

SEQ ID NO: 3443143 - RNA, 13 nt, Pseudomonas aeruginosa PA01
cauuccucagcgc

SEQ ID NO: 3443144 - RNA, 15 nt, Pseudomonas aeruginosa PA01
cauuccucagcgccg

SEQ ID NO: 3443145 - RNA, 16 nt, Pseudomonas aeruginosa PA01
cauuccucagcgccgg

SEQ ID NO: 3443146 - RNA, 21 nt, Pseudomonas aeruginosa PA01
cauuccugggccccggccagg

SEQ ID NO: 3443147 - RNA, 15 nt, Pseudomonas aeruginosa PA01
cauuccuuccagggu

SEQ ID NO: 3443148 - RNA, 20 nt, Pseudomonas aeruginosa PA01
cauuccuugauuugcccggc

SEQ ID NO: 3443149 - RNA, 16 nt, Pseudomonas aeruginosa PA01
cauucgaauggcgccg

SEQ ID NO: 3443150 - RNA, 15 nt, Pseudomonas aeruginosa PA01
cauucgacagcaggu

SEQ ID NO: 3443151 - RNA, 16 nt, Pseudomonas aeruginosa PA01
cauucgcagcggcccc

SEQ ID NO: 3443152 - RNA, 13 nt, Pseudomonas aeruginosa PA01
cauucgccgcgac

SEQ ID NO: 3443153 - RNA, 21 nt, Pseudomonas aeruginosa PA01
cauucgcugucgucggcgcgg

SEQ ID NO: 3443154 - RNA, 15 nt, Pseudomonas aeruginosa PA01
cauucgcuucggcca

SEQ ID NO: 3443155 - RNA, 22 nt, Pseudomonas aeruginosa PA01
cauucggugcgcuccuguugcu

SEQ ID NO: 3443156 - RNA, 18 nt, Pseudomonas aeruginosa PA01
ccacccccggcccggcca

SEQ ID NO: 3443157 - RNA, 13 nt, Pseudomonas aeruginosa PA01
ccaccccgccgcg

SEQ ID NO: 3443158 - RNA, 14 nt, Pseudomonas aeruginosa PA01
ccaccccgccggcg

SEQ ID NO: 3443159 - RNA, 13 nt, Pseudomonas aeruginosa PA01
ccaccccgcuccg

SEQ ID NO: 3443160 - RNA, 15 nt, Pseudomonas aeruginosa PA01
ccaccccgcuccgcu

SEQ ID NO: 3443161 - RNA, 13 nt, Pseudomonas aeruginosa PA01
ccaccccggucau

SEQ ID NO: 3443162 - RNA, 20 nt, Pseudomonas aeruginosa PA01
ccacccgaaagccgaagcgc

SEQ ID NO: 3443163 - RNA, 13 nt, Pseudomonas aeruginosa PA01
ccacccgcagccg

SEQ ID NO: 3443164 - RNA, 15 nt, Pseudomonas aeruginosa PA01
ccacccgcagccgcg

SEQ ID NO: 3443165 - RNA, 22 nt, Pseudomonas aeruginosa PA01
ccacccgcaucgaggccgccca

SEQ ID NO: 3443166 - RNA, 23 nt, Pseudomonas aeruginosa PA01
ccacccgcaucgaggccgcccag

SEQ ID NO: 3443167 - RNA, 18 nt, Pseudomonas aeruginosa PA01
ccacccgccucgucgcca

SEQ ID NO: 3443168 - RNA, 23 nt, Pseudomonas aeruginosa PA01
ccacccgcuccgcggccggcuuc

SEQ ID NO: 3443169 - RNA, 12 nt, Pseudomonas aeruginosa PA01
ccacccgcucga

SEQ ID NO: 3443170 - RNA, 20 nt, Pseudomonas aeruginosa PA01
ccacccgcucgaccuugccg

SEQ ID NO: 3443171 - RNA, 13 nt, Pseudomonas aeruginosa PA01
ccacccgcugcaa

SEQ ID NO: 3443172 - RNA, 23 nt, Pseudomonas aeruginosa PA01
ccacccggagaauucgcguccac

SEQ ID NO: 3443173 - RNA, 21 nt, Pseudomonas aeruginosa PA01
ccacccggcgcacgccggccu

SEQ ID NO: 3443174 - RNA, 12 nt, Pseudomonas aeruginosa PA01
ccacccggcgcc

SEQ ID NO: 3443175 - RNA, 13 nt, Pseudomonas aeruginosa PA01
ccacccggcgccc

SEQ ID NO: 3443176 - RNA, 18 nt, Pseudomonas aeruginosa PA01
ccacccggcgcccggcgc

SEQ ID NO: 3443177 - RNA, 19 nt, Pseudomonas aeruginosa PA01
ccacccggcgguccgccgc

SEQ ID NO: 3443178 - RNA, 20 nt, Pseudomonas aeruginosa PA01
ccacccggcgguccgccgcg

SEQ ID NO: 3443179 - RNA, 21 nt, Pseudomonas aeruginosa PA01
ccacccggcgguccgccgcgg

SEQ ID NO: 3443180 - RNA, 14 nt, Pseudomonas aeruginosa PA01
ccacccgucccgcg

SEQ ID NO: 3443181 - RNA, 15 nt, Pseudomonas aeruginosa PA01
ccacccgucccgcgc

SEQ ID NO: 3443182 - RNA, 19 nt, Pseudomonas aeruginosa PA01
ccacccgucccgcgcgccg

SEQ ID NO: 3443183 - RNA, 12 nt, Pseudomonas aeruginosa PA01
ccacccucggcu

SEQ ID NO: 3443184 - RNA, 13 nt, Pseudomonas aeruginosa PA01
ccacccugcgcga

SEQ ID NO: 3443185 - RNA, 21 nt, Pseudomonas aeruginosa PA01
ccacccuugcgcccggcuucg

SEQ ID NO: 3443186 - RNA, 17 nt, Pseudomonas aeruginosa PA01
ccacccuugcguccugc

SEQ ID NO: 3443187 - RNA, 19 nt, Pseudomonas aeruginosa PA01
ccacccuugcguccugccu

SEQ ID NO: 3443188 - RNA, 17 nt, Pseudomonas aeruginosa PA01
ccacccuuggagccgcc

SEQ ID NO: 3443189 - RNA, 18 nt, Pseudomonas aeruginosa PA01
ccaccgaauaccagggcu

SEQ ID NO: 3443190 - RNA, 22 nt, Pseudomonas aeruginosa PA01
ccaccgaauccuugaucaccuu

SEQ ID NO: 3443191 - RNA, 19 nt, Pseudomonas aeruginosa PA01
ccaccgacaggccgaccag

SEQ ID NO: 3443192 - RNA, 14 nt, Pseudomonas aeruginosa PA01
ccaccgacccucgg

SEQ ID NO: 3443193 - RNA, 16 nt, Pseudomonas aeruginosa PA01
ccaccgacccucggcg

SEQ ID NO: 3443194 - RNA, 18 nt, Pseudomonas aeruginosa PA01
ccaccgacccucggcgag

SEQ ID NO: 3443195 - RNA, 17 nt, Pseudomonas aeruginosa PA01
ccaccgacgccggacgc

SEQ ID NO: 3443196 - RNA, 13 nt, Pseudomonas aeruginosa PA01
ccaccgacggcuc

SEQ ID NO: 3443197 - RNA, 17 nt, Pseudomonas aeruginosa PA01
ccaccgacggcuccgga

SEQ ID NO: 3443198 - RNA, 17 nt, Pseudomonas aeruginosa PA01
ccaccgacgggucgcca

SEQ ID NO: 3443199 - RNA, 18 nt, Pseudomonas aeruginosa PA01
ccaccgacgggucgccau

SEQ ID NO: 3443200 - RNA, 21 nt, Pseudomonas aeruginosa PA01
ccaccgagggcaggaaccaga

SEQ ID NO: 3443201 - RNA, 17 nt, Pseudomonas aeruginosa PA01
ccaccgaguggcgcagc

SEQ ID NO: 3443202 - RNA, 14 nt, Pseudomonas aeruginosa PA01
ccaccgauagcggc

SEQ ID NO: 3443203 - RNA, 18 nt, Pseudomonas aeruginosa PA01
ccaccgauagcggcgcga

SEQ ID NO: 3443204 - RNA, 14 nt, Pseudomonas aeruginosa PA01
ccaccgauggcgcg

SEQ ID NO: 3443205 - RNA, 15 nt, Pseudomonas aeruginosa PA01
ccaccgauggcgcgc

SEQ ID NO: 3443206 - RNA, 16 nt, Pseudomonas aeruginosa PA01
ccaccgauucgccggc

SEQ ID NO: 3443207 - RNA, 22 nt, Pseudomonas aeruginosa PA01
ccaccgauucgccggccaccag

SEQ ID NO: 3443208 - RNA, 23 nt, Pseudomonas aeruginosa PA01
ccaccgcacugguggcgaacagc

SEQ ID NO: 3443209 - RNA, 16 nt, Pseudomonas aeruginosa PA01
ccaccgccaccgccgg

SEQ ID NO: 3443210 - RNA, 13 nt, Pseudomonas aeruginosa PA01
ccaccgccaccug

SEQ ID NO: 3443211 - RNA, 11 nt, Pseudomonas aeruginosa PA01
ccaccgccagg

SEQ ID NO: 3443212 - RNA, 18 nt, Pseudomonas aeruginosa PA01
ccaccgccaggaccucga

SEQ ID NO: 3443213 - RNA, 12 nt, Pseudomonas aeruginosa PA01
ccaccgcccccg

SEQ ID NO: 3443214 - RNA, 16 nt, Pseudomonas aeruginosa PA01
ccaccgcccccggcgc

SEQ ID NO: 3443215 - RNA, 17 nt, Pseudomonas aeruginosa PA01
ccaccgccgacaucgga

SEQ ID NO: 3443216 - RNA, 19 nt, Pseudomonas aeruginosa PA01
ccaccgccgccagcaacag

SEQ ID NO: 3443217 - RNA, 14 nt, Pseudomonas aeruginosa PA01
ccaccgccugcccc

SEQ ID NO: 3443218 - RNA, 12 nt, Pseudomonas aeruginosa PA01
ccaccgccugga

SEQ ID NO: 3443219 - RNA, 14 nt, Pseudomonas aeruginosa PA01
ccaccgccuggacc

SEQ ID NO: 3443220 - RNA, 20 nt, Pseudomonas aeruginosa PA01
ccaccgcgaauccgcggccc

SEQ ID NO: 3443221 - RNA, 21 nt, Pseudomonas aeruginosa PA01
ccaccgcgacgcgcuggacca

SEQ ID NO: 3443222 - RNA, 16 nt, Pseudomonas aeruginosa PA01
ccaccgcgcgcccucg

SEQ ID NO: 3443223 - RNA, 14 nt, Pseudomonas aeruginosa PA01
ccaccgcgcggcac

SEQ ID NO: 3443224 - RNA, 14 nt, Pseudomonas aeruginosa PA01
ccaccgcggccucg

SEQ ID NO: 3443225 - RNA, 24 nt, Pseudomonas aeruginosa PA01
ccaccgcgucgaguaccgcugcgg

SEQ ID NO: 3443226 - RNA, 15 nt, Pseudomonas aeruginosa PA01
ccaccgcuccggcgc

SEQ ID NO: 3443227 - RNA, 11 nt, Pseudomonas aeruginosa PA01
ccaccgcucga

SEQ ID NO: 3443228 - RNA, 19 nt, Pseudomonas aeruginosa PA01
ccaccgcuuucagcgccgc

SEQ ID NO: 3443229 - RNA, 16 nt, Pseudomonas aeruginosa PA01
ccaccggaccgggcgc

SEQ ID NO: 3443230 - RNA, 20 nt, Pseudomonas aeruginosa PA01
ccaccggaccgggcgccucg

SEQ ID NO: 3443231 - RNA, 13 nt, Pseudomonas aeruginosa PA01
ccaccggccgcgc

SEQ ID NO: 3443232 - RNA, 16 nt, Pseudomonas aeruginosa PA01
ccaccggcguccacuc

SEQ ID NO: 3443233 - RNA, 19 nt, Pseudomonas aeruginosa PA01
ccaccggcguuauccgccg

SEQ ID NO: 3443234 - RNA, 20 nt, Pseudomonas aeruginosa PA01
ccaccggcguuauccgccga

SEQ ID NO: 3443235 - RNA, 21 nt, Pseudomonas aeruginosa PA01
ccaccggcguuauccgccgau

SEQ ID NO: 3443236 - RNA, 15 nt, Pseudomonas aeruginosa PA01
ccaccggcucgcucu

SEQ ID NO: 3443237 - RNA, 23 nt, Pseudomonas aeruginosa PA01
ccaccggcugcauguccgccagu

SEQ ID NO: 3443238 - RNA, 17 nt, Pseudomonas aeruginosa PA01
ccaccggcuggccgcga

SEQ ID NO: 3443239 - RNA, 15 nt, Pseudomonas aeruginosa PA01
ccaccggcuggcggc

SEQ ID NO: 3443240 - RNA, 19 nt, Pseudomonas aeruginosa PA01
ccaccggcuggcggcucgg

SEQ ID NO: 3443241 - RNA, 21 nt, Pseudomonas aeruginosa PA01
ccaccggcuggcggcucggcu

SEQ ID NO: 3443242 - RNA, 13 nt, Pseudomonas aeruginosa PA01
ccaccgggaagga

SEQ ID NO: 3443243 - RNA, 15 nt, Pseudomonas aeruginosa PA01
ccaccgggaucagcg

SEQ ID NO: 3443244 - RNA, 12 nt, Pseudomonas aeruginosa PA01
ccaccgggaucg

SEQ ID NO: 3443245 - RNA, 18 nt, Pseudomonas aeruginosa PA01
ccaccgggaucugccggu

SEQ ID NO: 3443246 - RNA, 21 nt, Pseudomonas aeruginosa PA01
ccaccgggaucuggcccugca

SEQ ID NO: 3443247 - RNA, 23 nt, Pseudomonas aeruginosa PA01
ccaccgggccgucgggcauggcg

SEQ ID NO: 3443248 - RNA, 18 nt, Pseudomonas aeruginosa PA01
ccaccgguacgcucacca

SEQ ID NO: 3443249 - RNA, 21 nt, Pseudomonas aeruginosa PA01
ccaccggucaaaccauggcgu

SEQ ID NO: 3443250 - RNA, 16 nt, Pseudomonas aeruginosa PA01
ccaccggucaaaucgu

SEQ ID NO: 3443251 - RNA, 18 nt, Pseudomonas aeruginosa PA01
ccaccggucuuggcgcgc

SEQ ID NO: 3443252 - RNA, 15 nt, Pseudomonas aeruginosa PA01
ccaccgguggacugg

SEQ ID NO: 3443253 - RNA, 21 nt, Pseudomonas aeruginosa PA01
ccaccgguggcgacgcgcagg

SEQ ID NO: 3443254 - RNA, 20 nt, Pseudomonas aeruginosa PA01
ccaccgguuugcugaccgga

SEQ ID NO: 3443255 - RNA, 18 nt, Pseudomonas aeruginosa PA01
ccaccgucgcggucaucg

SEQ ID NO: 3443256 - RNA, 12 nt, Pseudomonas aeruginosa PA01
ccaccgucggau

SEQ ID NO: 3443257 - RNA, 16 nt, Pseudomonas aeruginosa PA01
ccaccgucggauggcc

SEQ ID NO: 3443258 - RNA, 14 nt, Pseudomonas aeruginosa PA01
ccaccgucuggcgc

SEQ ID NO: 3443259 - RNA, 17 nt, Pseudomonas aeruginosa PA01
ccacgcgaccagcgcca

SEQ ID NO: 3443260 - RNA, 18 nt, Pseudomonas aeruginosa PA01
ccacgcgaccagcgccag

SEQ ID NO: 3443261 - RNA, 19 nt, Pseudomonas aeruginosa PA01
ccacgcgaccagcgccagg

SEQ ID NO: 3443262 - RNA, 19 nt, Pseudomonas aeruginosa PA01
ccacgcgacccaucgccga

SEQ ID NO: 3443263 - RNA, 17 nt, Pseudomonas aeruginosa PA01
ccacgcgagaagccgcc

SEQ ID NO: 3443264 - RNA, 19 nt, Pseudomonas aeruginosa PA01
ccacgcgagaagccgccca

SEQ ID NO: 3443265 - RNA, 13 nt, Pseudomonas aeruginosa PA01
ccacgcgcaagcc

SEQ ID NO: 3443266 - RNA, 16 nt, Pseudomonas aeruginosa PA01
ccacgcgcaucgugca

SEQ ID NO: 3443267 - RNA, 21 nt, Pseudomonas aeruginosa PA01
ccacgcgcaucgugcagccag

SEQ ID NO: 3443268 - RNA, 16 nt, Pseudomonas aeruginosa PA01
ccacgcgccgauccag

SEQ ID NO: 3443269 - RNA, 15 nt, Pseudomonas aeruginosa PA01
ccacgcgccuggccg

SEQ ID NO: 3443270 - RNA, 16 nt, Pseudomonas aeruginosa PA01
ccacgcgccuggccgu

SEQ ID NO: 3443271 - RNA, 23 nt, Pseudomonas aeruginosa PA01
ccacgcggugccauucggugcgc

SEQ ID NO: 3443272 - RNA, 20 nt, Pseudomonas aeruginosa PA01
ccacgcgguuccacucccau

SEQ ID NO: 3443273 - RNA, 13 nt, Pseudomonas aeruginosa PA01
ccacgcucaccgg

SEQ ID NO: 3443274 - RNA, 14 nt, Pseudomonas aeruginosa PA01
ccacgcucaccggu

SEQ ID NO: 3443275 - RNA, 15 nt, Pseudomonas aeruginosa PA01
ccacgcucaggucgg

SEQ ID NO: 3443276 - RNA, 13 nt, Pseudomonas aeruginosa PA01
ccacgcucagugc

SEQ ID NO: 3443277 - RNA, 18 nt, Pseudomonas aeruginosa PA01
ccacgcucagugcgccgg

SEQ ID NO: 3443278 - RNA, 19 nt, Pseudomonas aeruginosa PA01
ccacgcucagugcgccggg

SEQ ID NO: 3443279 - RNA, 20 nt, Pseudomonas aeruginosa PA01
ccacgcuccuuuggcgucga

SEQ ID NO: 3443280 - RNA, 14 nt, Pseudomonas aeruginosa PA01
ccacgcucuugauc

SEQ ID NO: 3443281 - RNA, 17 nt, Pseudomonas aeruginosa PA01
ccacgcucuugaucguc

SEQ ID NO: 3443282 - RNA, 20 nt, Pseudomonas aeruginosa PA01
ccacgcucuugaucgucucg

SEQ ID NO: 3443283 - RNA, 15 nt, Pseudomonas aeruginosa PA01
ccacgcugaggcuca

SEQ ID NO: 3443284 - RNA, 21 nt, Pseudomonas aeruginosa PA01
ccacgcugaggcucagcgcgc

SEQ ID NO: 3443285 - RNA, 24 nt, Pseudomonas aeruginosa PA01
ccacgcugaggcucagcgcgccga

SEQ ID NO: 3443286 - RNA, 13 nt, Pseudomonas aeruginosa PA01
ccacgcuggucac

SEQ ID NO: 3443287 - RNA, 15 nt, Pseudomonas aeruginosa PA01
ccacgcugugcggca

SEQ ID NO: 3443288 - RNA, 20 nt, Pseudomonas aeruginosa PA01
ccacgcugugcggcagcagg

SEQ ID NO: 3443289 - RNA, 22 nt, Pseudomonas aeruginosa PA01
ccacgcugugcggcagcaggcu

SEQ ID NO: 3443290 - RNA, 17 nt, Pseudomonas aeruginosa PA01
ccacggaaggccacgcc

SEQ ID NO: 3443291 - RNA, 19 nt, Pseudomonas aeruginosa PA01
ccacggaaggccacgccgc

SEQ ID NO: 3443292 - RNA, 14 nt, Pseudomonas aeruginosa PA01
ccacggacgcgcag

SEQ ID NO: 3443293 - RNA, 21 nt, Pseudomonas aeruginosa PA01
ccacggacgcgcagggucagg

SEQ ID NO: 3443294 - RNA, 19 nt, Pseudomonas aeruginosa PA01
ccacggaggccuucgccga

SEQ ID NO: 3443295 - RNA, 20 nt, Pseudomonas aeruginosa PA01
ccacggaggccuucgccgac

SEQ ID NO: 3443296 - RNA, 22 nt, Pseudomonas aeruginosa PA01
ccacggauaugcgccgccacgu

SEQ ID NO: 3443297 - RNA, 21 nt, Pseudomonas aeruginosa PA01
ccacggaugcagucccgccag

SEQ ID NO: 3443298 - RNA, 21 nt, Pseudomonas aeruginosa PA01
ccacggcacacgucggcaucg

SEQ ID NO: 3443299 - RNA, 14 nt, Pseudomonas aeruginosa PA01
ccacggccagcagg

SEQ ID NO: 3443300 - RNA, 15 nt, Pseudomonas aeruginosa PA01
ccacggccaggccca

SEQ ID NO: 3443301 - RNA, 16 nt, Pseudomonas aeruginosa PA01
ccacggccgcugcgca

SEQ ID NO: 3443302 - RNA, 20 nt, Pseudomonas aeruginosa PA01
ccacggccgcugcgcaggcc

SEQ ID NO: 3443303 - RNA, 21 nt, Pseudomonas aeruginosa PA01
ccacggccggcgaggcguucc

SEQ ID NO: 3443304 - RNA, 18 nt, Pseudomonas aeruginosa PA01
ccacggcgagagcgccga

SEQ ID NO: 3443305 - RNA, 16 nt, Pseudomonas aeruginosa PA01
ccacggcgaucgccgg

SEQ ID NO: 3443306 - RNA, 20 nt, Pseudomonas aeruginosa PA01
ccacggcgauggucaggacg

SEQ ID NO: 3443307 - RNA, 21 nt, Pseudomonas aeruginosa PA01
ccacggcgccuucccagauac

SEQ ID NO: 3443308 - RNA, 17 nt, Pseudomonas aeruginosa PA01
ccacggcgcgcuccggc

SEQ ID NO: 3443309 - RNA, 15 nt, Pseudomonas aeruginosa PA01
ccacggcgcggccgu

SEQ ID NO: 3443310 - RNA, 13 nt, Pseudomonas aeruginosa PA01
ccacggcgcgucg

SEQ ID NO: 3443311 - RNA, 15 nt, Pseudomonas aeruginosa PA01
ccacggcggccucga

SEQ ID NO: 3443312 - RNA, 15 nt, Pseudomonas aeruginosa PA01
ccacgggcaguucca

SEQ ID NO: 3443313 - RNA, 19 nt, Pseudomonas aeruginosa PA01
ccacgggcaguuccaggcc

SEQ ID NO: 3443314 - RNA, 18 nt, Pseudomonas aeruginosa PA01
ccacgggcgacccaggcc

SEQ ID NO: 3443315 - RNA, 14 nt, Pseudomonas aeruginosa PA01
ccacgggcggccga

SEQ ID NO: 3443316 - RNA, 22 nt, Pseudomonas aeruginosa PA01
ccacgggcggccgacgugcacc

SEQ ID NO: 3443317 - RNA, 17 nt, Pseudomonas aeruginosa PA01
ccacggguaacgguagc

SEQ ID NO: 3443318 - RNA, 23 nt, Pseudomonas aeruginosa PA01
ccacggguaacgguagcggcagg

SEQ ID NO: 3443319 - RNA, 14 nt, Pseudomonas aeruginosa PA01
ccacgggucgcagc

SEQ ID NO: 3443320 - RNA, 19 nt, Pseudomonas aeruginosa PA01
ccacgguagagacggcggc

SEQ ID NO: 3443321 - RNA, 14 nt, Pseudomonas aeruginosa PA01
ccacgguguugccg

SEQ ID NO: 3443322 - RNA, 22 nt, Pseudomonas aeruginosa PA01
ccacgguguugccguggucgcg

SEQ ID NO: 3443323 - RNA, 13 nt, Pseudomonas aeruginosa PA01
ccacguacagcgc

SEQ ID NO: 3443324 - RNA, 14 nt, Pseudomonas aeruginosa PA01
ccacguacagcgcg

SEQ ID NO: 3443325 - RNA, 14 nt, Pseudomonas aeruginosa PA01
ccacguacuccagc

SEQ ID NO: 3443326 - RNA, 16 nt, Pseudomonas aeruginosa PA01
ccacguacuccagcaa

SEQ ID NO: 3443327 - RNA, 22 nt, Pseudomonas aeruginosa PA01
ccacguagccggcguccgccgg

SEQ ID NO: 3443328 - RNA, 17 nt, Pseudomonas aeruginosa PA01
ccacguaguaggcgcgg

SEQ ID NO: 3443329 - RNA, 14 nt, Pseudomonas aeruginosa PA01
ccacguccagcggc

SEQ ID NO: 3443330 - RNA, 21 nt, Pseudomonas aeruginosa PA01
ccacgucgccccagggaaucg

SEQ ID NO: 3443331 - RNA, 14 nt, Pseudomonas aeruginosa PA01
ccacgucgccgacc

SEQ ID NO: 3443332 - RNA, 22 nt, Pseudomonas aeruginosa PA01
ccacgucgcgaccgguaacugg

SEQ ID NO: 3443333 - RNA, 14 nt, Pseudomonas aeruginosa PA01
ccacgucggcccgg

SEQ ID NO: 3443334 - RNA, 16 nt, Pseudomonas aeruginosa PA01
ccacgucguccggcgc

SEQ ID NO: 3443335 - RNA, 19 nt, Pseudomonas aeruginosa PA01
ccacgucugugccgaggcc

SEQ ID NO: 3443336 - RNA, 12 nt, Pseudomonas aeruginosa PA01
ccacgugcagca

SEQ ID NO: 3443337 - RNA, 13 nt, Pseudomonas aeruginosa PA01
ccacgugcagcag

SEQ ID NO: 3443338 - RNA, 15 nt, Pseudomonas aeruginosa PA01
ccacgugcggggugc

SEQ ID NO: 3443339 - RNA, 13 nt, Pseudomonas aeruginosa PA01
ccacgugcucgcg

SEQ ID NO: 3443340 - RNA, 22 nt, Pseudomonas aeruginosa PA01
ccacgugcucgcggaccagcuc

SEQ ID NO: 3443341 - RNA, 16 nt, Pseudomonas aeruginosa PA01
ccacguggccggcgcg

SEQ ID NO: 3443342 - RNA, 17 nt, Pseudomonas aeruginosa PA01
ccacguugagcaucacc

SEQ ID NO: 3443343 - RNA, 16 nt, Pseudomonas aeruginosa PA01
ccacguugcaguccag

SEQ ID NO: 3443344 - RNA, 19 nt, Pseudomonas aeruginosa PA01
ccacguugcaguccaggcc

SEQ ID NO: 3443345 - RNA, 13 nt, Pseudomonas aeruginosa PA01
ccacguugcgccg

SEQ ID NO: 3443346 - RNA, 16 nt, Pseudomonas aeruginosa PA01
ccacguugcgccgcag

SEQ ID NO: 3443347 - RNA, 13 nt, Pseudomonas aeruginosa PA01
ccacuaccgccga

SEQ ID NO: 3443348 - RNA, 14 nt, Pseudomonas aeruginosa PA01
ccacuaccgccgag

SEQ ID NO: 3443349 - RNA, 22 nt, Pseudomonas aeruginosa PA01
ccacuaucgccaacgccaccgc

SEQ ID NO: 3443350 - RNA, 23 nt, Pseudomonas aeruginosa PA01
ccacuaucuucgauugcuacagc

SEQ ID NO: 3443351 - RNA, 11 nt, Pseudomonas aeruginosa PA01
ccacuccagcc

SEQ ID NO: 3443352 - RNA, 14 nt, Pseudomonas aeruginosa PA01
ccacuccagccccg

SEQ ID NO: 3443353 - RNA, 14 nt, Pseudomonas aeruginosa PA01
ccacuccagcgggg

SEQ ID NO: 3443354 - RNA, 14 nt, Pseudomonas aeruginosa PA01
ccacuccaggcggc

SEQ ID NO: 3443355 - RNA, 16 nt, Pseudomonas aeruginosa PA01
ccacuccccagcaggc

SEQ ID NO: 3443356 - RNA, 21 nt, Pseudomonas aeruginosa PA01
ccacucccggcccuugagcau

SEQ ID NO: 3443357 - RNA, 20 nt, Pseudomonas aeruginosa PA01
ccacuccgccacccgcuccg

SEQ ID NO: 3443358 - RNA, 15 nt, Pseudomonas aeruginosa PA01
ccacuccggcagcac

SEQ ID NO: 3443359 - RNA, 16 nt, Pseudomonas aeruginosa PA01
ccacuccggcaggcgc

SEQ ID NO: 3443360 - RNA, 14 nt, Pseudomonas aeruginosa PA01
ccacuccguccagu

SEQ ID NO: 3443361 - RNA, 14 nt, Pseudomonas aeruginosa PA01
ccacuccuccgccu

SEQ ID NO: 3443362 - RNA, 18 nt, Pseudomonas aeruginosa PA01
ccagagccagccgcgagu

SEQ ID NO: 3443363 - RNA, 19 nt, Pseudomonas aeruginosa PA01
ccagagccagucgagagcg

SEQ ID NO: 3443364 - RNA, 14 nt, Pseudomonas aeruginosa PA01
ccagagcccgccga

SEQ ID NO: 3443365 - RNA, 19 nt, Pseudomonas aeruginosa PA01
ccagagcccgucgaagcca

SEQ ID NO: 3443366 - RNA, 12 nt, Pseudomonas aeruginosa PA01
ccagagccgccg

SEQ ID NO: 3443367 - RNA, 15 nt, Pseudomonas aeruginosa PA01
ccagagccgcucggc

SEQ ID NO: 3443368 - RNA, 21 nt, Pseudomonas aeruginosa PA01
ccagagcgcgcccugcaggcc

SEQ ID NO: 3443369 - RNA, 23 nt, Pseudomonas aeruginosa PA01
ccagagcgcgcccugcaggccga

SEQ ID NO: 3443370 - RNA, 14 nt, Pseudomonas aeruginosa PA01
ccagagcgcugccu

SEQ ID NO: 3443371 - RNA, 13 nt, Pseudomonas aeruginosa PA01
ccagagcuccagg

SEQ ID NO: 3443372 - RNA, 17 nt, Pseudomonas aeruginosa PA01
ccagagcuccagggcug

SEQ ID NO: 3443373 - RNA, 14 nt, Pseudomonas aeruginosa PA01
ccagaggaucggcc

SEQ ID NO: 3443374 - RNA, 15 nt, Pseudomonas aeruginosa PA01
ccagaggaucggcca

SEQ ID NO: 3443375 - RNA, 18 nt, Pseudomonas aeruginosa PA01
ccagaggcugcgcuccag

SEQ ID NO: 3443376 - RNA, 19 nt, Pseudomonas aeruginosa PA01
ccagaggcugcgcuccagg

SEQ ID NO: 3443377 - RNA, 18 nt, Pseudomonas aeruginosa PA01
ccagagugcgcagcagcg

SEQ ID NO: 3443378 - RNA, 20 nt, Pseudomonas aeruginosa PA01
ccagagugcgcagcagcguc

SEQ ID NO: 3443379 - RNA, 21 nt, Pseudomonas aeruginosa PA01
ccagagugcgcagcagcgucg

SEQ ID NO: 3443380 - RNA, 17 nt, Pseudomonas aeruginosa PA01
ccagaguucgcccagcu

SEQ ID NO: 3443381 - RNA, 20 nt, Pseudomonas aeruginosa PA01
ccagaguucgcccagcucgc

SEQ ID NO: 3443382 - RNA, 18 nt, Pseudomonas aeruginosa PA01
ccagaguugccuguccag

SEQ ID NO: 3443383 - RNA, 19 nt, Pseudomonas aeruginosa PA01
ccagauagugcggccaggc

SEQ ID NO: 3443384 - RNA, 19 nt, Pseudomonas aeruginosa PA01
ccagaucauguagagcagg

SEQ ID NO: 3443385 - RNA, 20 nt, Pseudomonas aeruginosa PA01
ccagaucauguagagcaggc

SEQ ID NO: 3443386 - RNA, 21 nt, Pseudomonas aeruginosa PA01
ccagauccccugcaggacccg

SEQ ID NO: 3443387 - RNA, 19 nt, Pseudomonas aeruginosa PA01
ccagauccgggaaggccug

SEQ ID NO: 3443388 - RNA, 13 nt, Pseudomonas aeruginosa PA01
ccagaucgccacc

SEQ ID NO: 3443389 - RNA, 14 nt, Pseudomonas aeruginosa PA01
ccagaucgccaccc

SEQ ID NO: 3443390 - RNA, 13 nt, Pseudomonas aeruginosa PA01
ccagaucgccagc

SEQ ID NO: 3443391 - RNA, 14 nt, Pseudomonas aeruginosa PA01
ccagaucgccagcg

SEQ ID NO: 3443392 - RNA, 15 nt, Pseudomonas aeruginosa PA01
ccagaucgccagcgc

SEQ ID NO: 3443393 - RNA, 15 nt, Pseudomonas aeruginosa PA01
ccagaucggcgcgca

SEQ ID NO: 3443394 - RNA, 19 nt, Pseudomonas aeruginosa PA01
ccagaugaaacugcccggc

SEQ ID NO: 3443395 - RNA, 20 nt, Pseudomonas aeruginosa PA01
ccagaugaaacugcccggcu

SEQ ID NO: 3443396 - RNA, 19 nt, Pseudomonas aeruginosa PA01
ccagaugacgauggccgcc

SEQ ID NO: 3443397 - RNA, 23 nt, Pseudomonas aeruginosa PA01
ccagaugacgauggccgccgccg

SEQ ID NO: 3443398 - RNA, 16 nt, Pseudomonas aeruginosa PA01
ccagaugaucaggccg

SEQ ID NO: 3443399 - RNA, 17 nt, Pseudomonas aeruginosa PA01
ccagaugaucaggccga

SEQ ID NO: 3443400 - RNA, 20 nt, Pseudomonas aeruginosa PA01
ccagaugaucaggccgagca

SEQ ID NO: 3443401 - RNA, 14 nt, Pseudomonas aeruginosa PA01
ccagaugcgcgucg

SEQ ID NO: 3443402 - RNA, 17 nt, Pseudomonas aeruginosa PA01
ccagaugcgcgucgccg

SEQ ID NO: 3443403 - RNA, 23 nt, Pseudomonas aeruginosa PA01
ccagaugcgcgucgccgaacggc

SEQ ID NO: 3443404 - RNA, 18 nt, Pseudomonas aeruginosa PA01
ccagcaacaaaccucgag

SEQ ID NO: 3443405 - RNA, 14 nt, Pseudomonas aeruginosa PA01
ccagcaacaggcaa

SEQ ID NO: 3443406 - RNA, 16 nt, Pseudomonas aeruginosa PA01
ccagcaacaguugccg

SEQ ID NO: 3443407 - RNA, 16 nt, Pseudomonas aeruginosa PA01
ccagcaacccaugccg

SEQ ID NO: 3443408 - RNA, 21 nt, Pseudomonas aeruginosa PA01
ccagcaacccaugccgcaagc

SEQ ID NO: 3443409 - RNA, 23 nt, Pseudomonas aeruginosa PA01
ccagcaacccgcccuugcucgcg

SEQ ID NO: 3443410 - RNA, 13 nt, Pseudomonas aeruginosa PA01
ccagcaacgccgc

SEQ ID NO: 3443411 - RNA, 17 nt, Pseudomonas aeruginosa PA01
ccagcaacgccgccccc

SEQ ID NO: 3443412 - RNA, 14 nt, Pseudomonas aeruginosa PA01
ccagcaacgccucg

SEQ ID NO: 3443413 - RNA, 18 nt, Pseudomonas aeruginosa PA01
ccagcaacugaccuggcc

SEQ ID NO: 3443414 - RNA, 21 nt, Pseudomonas aeruginosa PA01
ccagcaacugaccuggccguc

SEQ ID NO: 3443415 - RNA, 19 nt, Pseudomonas aeruginosa PA01
ccagcaagacgguccccag

SEQ ID NO: 3443416 - RNA, 19 nt, Pseudomonas aeruginosa PA01
ccagcaaggugcgggcgac

SEQ ID NO: 3443417 - RNA, 16 nt, Pseudomonas aeruginosa PA01
ccagcaauagccucag

SEQ ID NO: 3443418 - RNA, 14 nt, Pseudomonas aeruginosa PA01
ccagcaaugccagc

SEQ ID NO: 3443419 - RNA, 18 nt, Pseudomonas aeruginosa PA01
ccagcaaugccagcgcca

SEQ ID NO: 3443420 - RNA, 21 nt, Pseudomonas aeruginosa PA01
ccagcaaugccagcgccacgc

SEQ ID NO: 3443421 - RNA, 18 nt, Pseudomonas aeruginosa PA01
ccagcaaugcccagcgca

SEQ ID NO: 3443422 - RNA, 22 nt, Pseudomonas aeruginosa PA01
ccagcaauuccacgcgacagcg

SEQ ID NO: 3443423 - RNA, 16 nt, Pseudomonas aeruginosa PA01
ccagcaauugccggcg

SEQ ID NO: 3443424 - RNA, 17 nt, Pseudomonas aeruginosa PA01
ccagcaauugccggcgu

SEQ ID NO: 3443425 - RNA, 17 nt, Pseudomonas aeruginosa PA01
ccagcaccacccggccg

SEQ ID NO: 3443426 - RNA, 18 nt, Pseudomonas aeruginosa PA01
ccagcaccacccggccgc

SEQ ID NO: 3443427 - RNA, 19 nt, Pseudomonas aeruginosa PA01
ccagcaccacccggccgcg

SEQ ID NO: 3443428 - RNA, 16 nt, Pseudomonas aeruginosa PA01
ccagcaccacccggcg

SEQ ID NO: 3443429 - RNA, 17 nt, Pseudomonas aeruginosa PA01
ccagcaccacccggcgc

SEQ ID NO: 3443430 - RNA, 16 nt, Pseudomonas aeruginosa PA01
ccagcaccagcacgcc

SEQ ID NO: 3443431 - RNA, 14 nt, Pseudomonas aeruginosa PA01
ccagcaccagcagg

SEQ ID NO: 3443432 - RNA, 15 nt, Pseudomonas aeruginosa PA01
ccagcaccagcagga

SEQ ID NO: 3443433 - RNA, 16 nt, Pseudomonas aeruginosa PA01
ccagcaccagcaggag

SEQ ID NO: 3443434 - RNA, 17 nt, Pseudomonas aeruginosa PA01
ccagcaccagcaggagc

SEQ ID NO: 3443435 - RNA, 23 nt, Pseudomonas aeruginosa PA01
ccagcaccagucccuggccggcg

SEQ ID NO: 3443436 - RNA, 12 nt, Pseudomonas aeruginosa PA01
ccagcacccagg

SEQ ID NO: 3443437 - RNA, 15 nt, Pseudomonas aeruginosa PA01
ccagcacccagguag

SEQ ID NO: 3443438 - RNA, 16 nt, Pseudomonas aeruginosa PA01
ccagcaccgagcugau

SEQ ID NO: 3443439 - RNA, 20 nt, Pseudomonas aeruginosa PA01
ccagcaccgagcugaucgcg

SEQ ID NO: 3443440 - RNA, 21 nt, Pseudomonas aeruginosa PA01
ccagcaccgagcugaucgcgc

SEQ ID NO: 3443441 - RNA, 14 nt, Pseudomonas aeruginosa PA01
ccagcaccgcaagg

SEQ ID NO: 3443442 - RNA, 14 nt, Pseudomonas aeruginosa PA01
ccagcaccgccugc

SEQ ID NO: 3443443 - RNA, 21 nt, Pseudomonas aeruginosa PA01
ccagcaccgccugcaacucgu

SEQ ID NO: 3443444 - RNA, 18 nt, Pseudomonas aeruginosa PA01
ccagcaccgccuggcgca

SEQ ID NO: 3443445 - RNA, 15 nt, Pseudomonas aeruginosa PA01
ccagcaccggcggcg

SEQ ID NO: 3443446 - RNA, 16 nt, Pseudomonas aeruginosa PA01
ccagcaccggcggcgc

SEQ ID NO: 3443447 - RNA, 13 nt, Pseudomonas aeruginosa PA01
ccagcaccguggu

SEQ ID NO: 3443448 - RNA, 17 nt, Pseudomonas aeruginosa PA01
ccagcaccguggucagc

SEQ ID NO: 3443449 - RNA, 20 nt, Pseudomonas aeruginosa PA01
ccagcaccucccccagcggg

SEQ ID NO: 3443450 - RNA, 21 nt, Pseudomonas aeruginosa PA01
ccagcaccucccccagcgggc

SEQ ID NO: 3443451 - RNA, 22 nt, Pseudomonas aeruginosa PA01
ccagcaccucccccagcgggcg

SEQ ID NO: 3443452 - RNA, 14 nt, Pseudomonas aeruginosa PA01
ccagcaccucgacg

SEQ ID NO: 3443453 - RNA, 13 nt, Pseudomonas aeruginosa PA01
ccagcaccucgcc

SEQ ID NO: 3443454 - RNA, 17 nt, Pseudomonas aeruginosa PA01
ccagcaccucgccgucg

SEQ ID NO: 3443455 - RNA, 14 nt, Pseudomonas aeruginosa PA01
ccagcaccucgcgg

SEQ ID NO: 3443456 - RNA, 20 nt, Pseudomonas aeruginosa PA01
ccagcaccucguaggccgac

SEQ ID NO: 3443457 - RNA, 22 nt, Pseudomonas aeruginosa PA01
ccagcaccugcgggcugcgugc

SEQ ID NO: 3443458 - RNA, 12 nt, Pseudomonas aeruginosa PA01
ccagcaccugga

SEQ ID NO: 3443459 - RNA, 21 nt, Pseudomonas aeruginosa PA01
ccagcaccuggacgaaugccc

SEQ ID NO: 3443460 - RNA, 14 nt, Pseudomonas aeruginosa PA01
ccagcaccuucacc

SEQ ID NO: 3443461 - RNA, 16 nt, Pseudomonas aeruginosa PA01
ccagcaccuucaccgu

SEQ ID NO: 3443462 - RNA, 13 nt, Pseudomonas aeruginosa PA01
ccagcacgcccuu

SEQ ID NO: 3443463 - RNA, 14 nt, Pseudomonas aeruginosa PA01
ccagcacgccgagc

SEQ ID NO: 3443464 - RNA, 23 nt, Pseudomonas aeruginosa PA01
ccagcacgccgagcaacggcagc

SEQ ID NO: 3443465 - RNA, 23 nt, Pseudomonas aeruginosa PA01
ccagcagguagccugcggccagc

SEQ ID NO: 3443466 - RNA, 18 nt, Pseudomonas aeruginosa PA01
ccagcaggucgagggcgu

SEQ ID NO: 3443467 - RNA, 20 nt, Pseudomonas aeruginosa PA01
ccagcaggucgagggcgucc

SEQ ID NO: 3443468 - RNA, 14 nt, Pseudomonas aeruginosa PA01
ccagcaggucgcgc

SEQ ID NO: 3443469 - RNA, 17 nt, Pseudomonas aeruginosa PA01
ccagcaggucgcgcugg

SEQ ID NO: 3443470 - RNA, 17 nt, Pseudomonas aeruginosa PA01
ccagcaggucggcagcg

SEQ ID NO: 3443471 - RNA, 20 nt, Pseudomonas aeruginosa PA01
ccagcaggucggccugcugc

SEQ ID NO: 3443472 - RNA, 15 nt, Pseudomonas aeruginosa PA01
ccagcaggucggcgc

SEQ ID NO: 3443473 - RNA, 16 nt, Pseudomonas aeruginosa PA01
ccagcaggucggcgcg

SEQ ID NO: 3443474 - RNA, 19 nt, Pseudomonas aeruginosa PA01
ccagcaggucggcgcgacg

SEQ ID NO: 3443475 - RNA, 13 nt, Pseudomonas aeruginosa PA01
ccagcagguggcg

SEQ ID NO: 3443476 - RNA, 16 nt, Pseudomonas aeruginosa PA01
ccagcagguggcgcac

SEQ ID NO: 3443477 - RNA, 23 nt, Pseudomonas aeruginosa PA01
ccagcagguggcgcacugccagg

SEQ ID NO: 3443478 - RNA, 16 nt, Pseudomonas aeruginosa PA01
ccagcaguagugcgac

SEQ ID NO: 3443479 - RNA, 20 nt, Pseudomonas aeruginosa PA01
ccagcagucgcacagccagg

SEQ ID NO: 3443480 - RNA, 22 nt, Pseudomonas aeruginosa PA01
ccagcagucgcacagccagggg

SEQ ID NO: 3443481 - RNA, 15 nt, Pseudomonas aeruginosa PA01
ccagcagucgcggcc

SEQ ID NO: 3443482 - RNA, 19 nt, Pseudomonas aeruginosa PA01
ccagcagucgcggcccugg

SEQ ID NO: 3443483 - RNA, 20 nt, Pseudomonas aeruginosa PA01
ccagcagucgcggcccuggu

SEQ ID NO: 3443484 - RNA, 20 nt, Pseudomonas aeruginosa PA01
ccagcaguggcuccgcgcgu

SEQ ID NO: 3443485 - RNA, 23 nt, Pseudomonas aeruginosa PA01
ccagcaguucgucgccacgcccg

SEQ ID NO: 3443486 - RNA, 17 nt, Pseudomonas aeruginosa PA01
ccagcauaaccccuuug

SEQ ID NO: 3443487 - RNA, 21 nt, Pseudomonas aeruginosa PA01
ccagcauaaccccuuugccga

SEQ ID NO: 3443488 - RNA, 18 nt, Pseudomonas aeruginosa PA01
ccagcaucaccuugcgga

SEQ ID NO: 3443489 - RNA, 15 nt, Pseudomonas aeruginosa PA01
ccagcaucagcagga

SEQ ID NO: 3443490 - RNA, 19 nt, Pseudomonas aeruginosa PA01
ccagcaucagcaggaagcu

SEQ ID NO: 3443491 - RNA, 20 nt, Pseudomonas aeruginosa PA01
ccagcaucagcaggaagcug

SEQ ID NO: 3443492 - RNA, 13 nt, Pseudomonas aeruginosa PA01
ccagcaucgcauc

SEQ ID NO: 3443493 - RNA, 18 nt, Pseudomonas aeruginosa PA01
ccagcaucgcaucggcga

SEQ ID NO: 3443494 - RNA, 14 nt, Pseudomonas aeruginosa PA01
ccagcaucgccggc

SEQ ID NO: 3443495 - RNA, 16 nt, Pseudomonas aeruginosa PA01
ccagcaucgccggcag

SEQ ID NO: 3443496 - RNA, 17 nt, Pseudomonas aeruginosa PA01
ccagcaucgccggcagc

SEQ ID NO: 3443497 - RNA, 18 nt, Pseudomonas aeruginosa PA01
ccagcaucgccggcagcg

SEQ ID NO: 3443498 - RNA, 21 nt, Pseudomonas aeruginosa PA01
ccagcaucgccggcagcgccg

SEQ ID NO: 3443499 - RNA, 13 nt, Pseudomonas aeruginosa PA01
ccagcaugcccag

SEQ ID NO: 3443500 - RNA, 14 nt, Pseudomonas aeruginosa PA01
ccagcaugcccagc

SEQ ID NO: 3443501 - RNA, 22 nt, Pseudomonas aeruginosa PA01
ccagcaugcccagcguggccag

SEQ ID NO: 3443502 - RNA, 16 nt, Pseudomonas aeruginosa PA01
ccagcauggcgggcca

SEQ ID NO: 3443503 - RNA, 23 nt, Pseudomonas aeruginosa PA01
ccagcauguuguuauggccgacc

SEQ ID NO: 3443504 - RNA, 19 nt, Pseudomonas aeruginosa PA01
ccagcauuaccccgaccag

SEQ ID NO: 3443505 - RNA, 22 nt, Pseudomonas aeruginosa PA01
ccagcauuaccccgaccagguc

SEQ ID NO: 3443506 - RNA, 18 nt, Pseudomonas aeruginosa PA01
ccagccaacugcuucagg

SEQ ID NO: 3443507 - RNA, 23 nt, Pseudomonas aeruginosa PA01
ccagccacagaggucgcugacca

SEQ ID NO: 3443508 - RNA, 13 nt, Pseudomonas aeruginosa PA01
ccagccacucccg

SEQ ID NO: 3443509 - RNA, 20 nt, Pseudomonas aeruginosa PA01
ccagccagacguccggcagg

SEQ ID NO: 3443510 - RNA, 15 nt, Pseudomonas aeruginosa PA01
ccagccagagcagcg

SEQ ID NO: 3443511 - RNA, 12 nt, Pseudomonas aeruginosa PA01
ccagccagagcg

SEQ ID NO: 3443512 - RNA, 13 nt, Pseudomonas aeruginosa PA01
ccagccagcagcc

SEQ ID NO: 3443513 - RNA, 20 nt, Pseudomonas aeruginosa PA01
ccagccagcagcccggccug

SEQ ID NO: 3443514 - RNA, 15 nt, Pseudomonas aeruginosa PA01
ccagccagcccggcg

SEQ ID NO: 3443515 - RNA, 11 nt, Pseudomonas aeruginosa PA01
ccagccagccg

SEQ ID NO: 3443516 - RNA, 13 nt, Pseudomonas aeruginosa PA01
ccagccagccgcc

SEQ ID NO: 3443517 - RNA, 14 nt, Pseudomonas aeruginosa PA01
ccagccagccgccu

SEQ ID NO: 3443518 - RNA, 12 nt, Pseudomonas aeruginosa PA01
ccagccagcgcg

SEQ ID NO: 3443519 - RNA, 16 nt, Pseudomonas aeruginosa PA01
ccagccagcgcggcuc

SEQ ID NO: 3443520 - RNA, 17 nt, Pseudomonas aeruginosa PA01
ccagccagcgcggcucg

SEQ ID NO: 3443521 - RNA, 12 nt, Pseudomonas aeruginosa PA01
ccagccagcucg

SEQ ID NO: 3443522 - RNA, 23 nt, Pseudomonas aeruginosa PA01
ccagccaggacaauggacaagcg

SEQ ID NO: 3443523 - RNA, 12 nt, Pseudomonas aeruginosa PA01
ccagccaggcga

SEQ ID NO: 3443524 - RNA, 21 nt, Pseudomonas aeruginosa PA01
ccagccaggcgcucucgccgc

SEQ ID NO: 3443525 - RNA, 22 nt, Pseudomonas aeruginosa PA01
ccagccaggcgcucucgccgcc

SEQ ID NO: 3443526 - RNA, 15 nt, Pseudomonas aeruginosa PA01
ccagccaggcggcca

SEQ ID NO: 3443527 - RNA, 16 nt, Pseudomonas aeruginosa PA01
ccagccagggcagcag

SEQ ID NO: 3443528 - RNA, 12 nt, Pseudomonas aeruginosa PA01
ccagccagggcc

SEQ ID NO: 3443529 - RNA, 11 nt, Pseudomonas aeruginosa PA01
ccagccagguc

SEQ ID NO: 3443530 - RNA, 13 nt, Pseudomonas aeruginosa PA01
ccagccaggucgg

SEQ ID NO: 3443531 - RNA, 21 nt, Pseudomonas aeruginosa PA01
ccagccagguguucggccccg

SEQ ID NO: 3443532 - RNA, 21 nt, Pseudomonas aeruginosa PA01
ccagccagucgagacgccagc

SEQ ID NO: 3443533 - RNA, 22 nt, Pseudomonas aeruginosa PA01
ccagccagucgagacgccagcc

SEQ ID NO: 3443534 - RNA, 15 nt, Pseudomonas aeruginosa PA01
ccagccagucggcgg

SEQ ID NO: 3443535 - RNA, 15 nt, Pseudomonas aeruginosa PA01
ccagccaguggcugg

SEQ ID NO: 3443536 - RNA, 23 nt, Pseudomonas aeruginosa PA01
ccagccaugcaggcugccggacg

SEQ ID NO: 3443537 - RNA, 16 nt, Pseudomonas aeruginosa PA01
ccagccauugagcgcg

SEQ ID NO: 3443538 - RNA, 20 nt, Pseudomonas aeruginosa PA01
ccagccauugagcgcgccca

SEQ ID NO: 3443539 - RNA, 20 nt, Pseudomonas aeruginosa PA01
ccagccauugcgccaggacc

SEQ ID NO: 3443540 - RNA, 13 nt, Pseudomonas aeruginosa PA01
ccagcccagaaca

SEQ ID NO: 3443541 - RNA, 16 nt, Pseudomonas aeruginosa PA01
ccagcccagaacagca

SEQ ID NO: 3443542 - RNA, 14 nt, Pseudomonas aeruginosa PA01
ccagcccagcggcg

SEQ ID NO: 3443543 - RNA, 12 nt, Pseudomonas aeruginosa PA01
ccagcccagggc

SEQ ID NO: 3443544 - RNA, 14 nt, Pseudomonas aeruginosa PA01
ccagcccagggcga

SEQ ID NO: 3443545 - RNA, 17 nt, Pseudomonas aeruginosa PA01
ccagcccagggcgaucg

SEQ ID NO: 3443546 - RNA, 14 nt, Pseudomonas aeruginosa PA01
ccagcccagugcug

SEQ ID NO: 3443547 - RNA, 15 nt, Pseudomonas aeruginosa PA01
ccagcccaguucguu

SEQ ID NO: 3443548 - RNA, 18 nt, Pseudomonas aeruginosa PA01
ccagccccaccgccaggu

SEQ ID NO: 3443549 - RNA, 15 nt, Pseudomonas aeruginosa PA01
ccagccccagauggg

SEQ ID NO: 3443550 - RNA, 15 nt, Pseudomonas aeruginosa PA01
ccagccccaggcgcg

SEQ ID NO: 3443551 - RNA, 21 nt, Pseudomonas aeruginosa PA01
ccagccccaggcgcggcgucg

SEQ ID NO: 3443552 - RNA, 22 nt, Pseudomonas aeruginosa PA01
ccagccccagucccuucagcgc

SEQ ID NO: 3443553 - RNA, 18 nt, Pseudomonas aeruginosa PA01
ccagcccccucgcccucg

SEQ ID NO: 3443554 - RNA, 21 nt, Pseudomonas aeruginosa PA01
ccagccccgcgauugcagcuc

SEQ ID NO: 3443555 - RNA, 12 nt, Pseudomonas aeruginosa PA01
ccagccccugcg

SEQ ID NO: 3443556 - RNA, 21 nt, Pseudomonas aeruginosa PA01
ccagccccugcggaccgcaga

SEQ ID NO: 3443557 - RNA, 19 nt, Pseudomonas aeruginosa PA01
ccagcccgccuuccagcuu

SEQ ID NO: 3443558 - RNA, 12 nt, Pseudomonas aeruginosa PA01
ccagcccgcgcg

SEQ ID NO: 3443559 - RNA, 13 nt, Pseudomonas aeruginosa PA01
ccagcccggcagg

SEQ ID NO: 3443560 - RNA, 13 nt, Pseudomonas aeruginosa PA01
ccagcccggccau

SEQ ID NO: 3443561 - RNA, 15 nt, Pseudomonas aeruginosa PA01
ccagcccggccaucc

SEQ ID NO: 3443562 - RNA, 17 nt, Pseudomonas aeruginosa PA01
ccagcccggccauccug

SEQ ID NO: 3443563 - RNA, 14 nt, Pseudomonas aeruginosa PA01
ccagcccggccucg

SEQ ID NO: 3443564 - RNA, 21 nt, Pseudomonas aeruginosa PA01
ccagcccggccucgccggucg

SEQ ID NO: 3443565 - RNA, 22 nt, Pseudomonas aeruginosa PA01
ccagcccggccucgccggucgc

SEQ ID NO: 3443566 - RNA, 14 nt, Pseudomonas aeruginosa PA01
ccagcccggcggcg

SEQ ID NO: 3443567 - RNA, 14 nt, Pseudomonas aeruginosa PA01
ccagcccggcggug

SEQ ID NO: 3443568 - RNA, 16 nt, Pseudomonas aeruginosa PA01
ccagcgcaccgccaag

SEQ ID NO: 3443569 - RNA, 17 nt, Pseudomonas aeruginosa PA01
ccagcgcacgccgugga

SEQ ID NO: 3443570 - RNA, 20 nt, Pseudomonas aeruginosa PA01
ccagcgcagccugcuggccu

SEQ ID NO: 3443571 - RNA, 22 nt, Pseudomonas aeruginosa PA01
ccagcgcagccugcuggccugg

SEQ ID NO: 3443572 - RNA, 14 nt, Pseudomonas aeruginosa PA01
ccagcgcaggccga

SEQ ID NO: 3443573 - RNA, 19 nt, Pseudomonas aeruginosa PA01
ccagcgcaggccgaucucg

SEQ ID NO: 3443574 - RNA, 22 nt, Pseudomonas aeruginosa PA01
ccagcgcaucgaggccggcaug

SEQ ID NO: 3443575 - RNA, 14 nt, Pseudomonas aeruginosa PA01
ccagcgccaccagc

SEQ ID NO: 3443576 - RNA, 17 nt, Pseudomonas aeruginosa PA01
ccagcgccaccagcagg

SEQ ID NO: 3443577 - RNA, 13 nt, Pseudomonas aeruginosa PA01
ccagcgccacgcc

SEQ ID NO: 3443578 - RNA, 15 nt, Pseudomonas aeruginosa PA01
ccagcgccacgccgc

SEQ ID NO: 3443579 - RNA, 16 nt, Pseudomonas aeruginosa PA01
ccagcgccacgccgcu

SEQ ID NO: 3443580 - RNA, 18 nt, Pseudomonas aeruginosa PA01
ccagcgccacgccgcugu

SEQ ID NO: 3443581 - RNA, 19 nt, Pseudomonas aeruginosa PA01
ccagcgccacggcgcggaa

SEQ ID NO: 3443582 - RNA, 15 nt, Pseudomonas aeruginosa PA01
ccagcgccacuucca

SEQ ID NO: 3443583 - RNA, 15 nt, Pseudomonas aeruginosa PA01
ccagcgccaggagca

SEQ ID NO: 3443584 - RNA, 17 nt, Pseudomonas aeruginosa PA01
ccagcgccaggagcagg

SEQ ID NO: 3443585 - RNA, 15 nt, Pseudomonas aeruginosa PA01
ccagcgccaggccgc

SEQ ID NO: 3443586 - RNA, 18 nt, Pseudomonas aeruginosa PA01
ccagcgccaggccgccga

SEQ ID NO: 3443587 - RNA, 14 nt, Pseudomonas aeruginosa PA01
ccagcgccaggcgc

SEQ ID NO: 3443588 - RNA, 22 nt, Pseudomonas aeruginosa PA01
ccagcgccagggguaggaggaa

SEQ ID NO: 3443589 - RNA, 21 nt, Pseudomonas aeruginosa PA01
ccagcgcccaggccgggucgc

SEQ ID NO: 3443590 - RNA, 13 nt, Pseudomonas aeruginosa PA01
ccagcgcccaggu

SEQ ID NO: 3443591 - RNA, 14 nt, Pseudomonas aeruginosa PA01
ccagcgcccaggug

SEQ ID NO: 3443592 - RNA, 20 nt, Pseudomonas aeruginosa PA01
ccagcgccccaccaggcucg

SEQ ID NO: 3443593 - RNA, 19 nt, Pseudomonas aeruginosa PA01
ccagcgccccgccuaccgg

SEQ ID NO: 3443594 - RNA, 11 nt, Pseudomonas aeruginosa PA01
ccagcgccgcc

SEQ ID NO: 3443595 - RNA, 12 nt, Pseudomonas aeruginosa PA01
ccagcgccgcca

SEQ ID NO: 3443596 - RNA, 20 nt, Pseudomonas aeruginosa PA01
ccagcgccgccaaccacucc

SEQ ID NO: 3443597 - RNA, 13 nt, Pseudomonas aeruginosa PA01
ccagcgccgccag

SEQ ID NO: 3443598 - RNA, 14 nt, Pseudomonas aeruginosa PA01
ccagcgccgccagc

SEQ ID NO: 3443599 - RNA, 17 nt, Pseudomonas aeruginosa PA01
ccagcgccgccagcagg

SEQ ID NO: 3443600 - RNA, 18 nt, Pseudomonas aeruginosa PA01
ccagcgccgccaggcaga

SEQ ID NO: 3443601 - RNA, 18 nt, Pseudomonas aeruginosa PA01
ccagcgccgccaggcgcg

SEQ ID NO: 3443602 - RNA, 12 nt, Pseudomonas aeruginosa PA01
ccagcgccgccg

SEQ ID NO: 3443603 - RNA, 20 nt, Pseudomonas aeruginosa PA01
ccagcgccgccucgaaggcc

SEQ ID NO: 3443604 - RNA, 19 nt, Pseudomonas aeruginosa PA01
ccagcgccgccugcuggcu

SEQ ID NO: 3443605 - RNA, 13 nt, Pseudomonas aeruginosa PA01
ccagcgccgcggc

SEQ ID NO: 3443606 - RNA, 14 nt, Pseudomonas aeruginosa PA01
ccagcgccgcggcg

SEQ ID NO: 3443607 - RNA, 15 nt, Pseudomonas aeruginosa PA01
ccagcgccgcggcga

SEQ ID NO: 3443608 - RNA, 21 nt, Pseudomonas aeruginosa PA01
ccagcgccgcuccuccucgcu

SEQ ID NO: 3443609 - RNA, 13 nt, Pseudomonas aeruginosa PA01
ccagcgccggcca

SEQ ID NO: 3443610 - RNA, 15 nt, Pseudomonas aeruginosa PA01
ccagcgccggcggcg

SEQ ID NO: 3443611 - RNA, 16 nt, Pseudomonas aeruginosa PA01
ccagcgccggcggcgc

SEQ ID NO: 3443612 - RNA, 19 nt, Pseudomonas aeruginosa PA01
ccagcgccguacgcaccgc

SEQ ID NO: 3443613 - RNA, 21 nt, Pseudomonas aeruginosa PA01
ccagcgccguacgcaccgcgu

SEQ ID NO: 3443614 - RNA, 21 nt, Pseudomonas aeruginosa PA01
ccagcgccgucaccagcagcc

SEQ ID NO: 3443615 - RNA, 15 nt, Pseudomonas aeruginosa PA01
ccagcgccguucacg

SEQ ID NO: 3443616 - RNA, 20 nt, Pseudomonas aeruginosa PA01
ccagcgccguucacgccugg

SEQ ID NO: 3443617 - RNA, 15 nt, Pseudomonas aeruginosa PA01
ccagcgccucgacca

SEQ ID NO: 3443618 - RNA, 16 nt, Pseudomonas aeruginosa PA01
ccagcgccucgaccag

SEQ ID NO: 3443619 - RNA, 15 nt, Pseudomonas aeruginosa PA01
ccagcgccucgccga

SEQ ID NO: 3443620 - RNA, 16 nt, Pseudomonas aeruginosa PA01
ccagcgccucgccgag

SEQ ID NO: 3443621 - RNA, 17 nt, Pseudomonas aeruginosa PA01
ccagcgccucgccgagc

SEQ ID NO: 3443622 - RNA, 18 nt, Pseudomonas aeruginosa PA01
ccagcgccucgggccgga

SEQ ID NO: 3443623 - RNA, 21 nt, Pseudomonas aeruginosa PA01
ccagcgccugcaaagaggcgc

SEQ ID NO: 3443624 - RNA, 14 nt, Pseudomonas aeruginosa PA01
ccagcgccugcugc

SEQ ID NO: 3443625 - RNA, 15 nt, Pseudomonas aeruginosa PA01
ccagcgccuggcgca

SEQ ID NO: 3443626 - RNA, 18 nt, Pseudomonas aeruginosa PA01
ccagcgccugggccgcgc

SEQ ID NO: 3443627 - RNA, 19 nt, Pseudomonas aeruginosa PA01
ccagcgcgagcguuccaug

SEQ ID NO: 3443628 - RNA, 23 nt, Pseudomonas aeruginosa PA01
ccagcgcgauacccuggccggcc

SEQ ID NO: 3443629 - RNA, 13 nt, Pseudomonas aeruginosa PA01
ccagcgcgcagcg

SEQ ID NO: 3443630 - RNA, 14 nt, Pseudomonas aeruginosa PA01
ccagcgcgcccggc

SEQ ID NO: 3443631 - RNA, 17 nt, Pseudomonas aeruginosa PA01
ccagcgcgcccggcgcc

SEQ ID NO: 3443632 - RNA, 11 nt, Pseudomonas aeruginosa PA01
ccagcgcgccg

SEQ ID NO: 3443633 - RNA, 16 nt, Pseudomonas aeruginosa PA01
ccagcgcgccgccgag

SEQ ID NO: 3443634 - RNA, 17 nt, Pseudomonas aeruginosa PA01
ccagcgcgccgccgagg

SEQ ID NO: 3443635 - RNA, 13 nt, Pseudomonas aeruginosa PA01
ccagcgcgccgcg

SEQ ID NO: 3443636 - RNA, 13 nt, Pseudomonas aeruginosa PA01
ccagcgcgcgccg

SEQ ID NO: 3443637 - RNA, 15 nt, Pseudomonas aeruginosa PA01
ccagcgcgcgccgac

SEQ ID NO: 3443638 - RNA, 16 nt, Pseudomonas aeruginosa PA01
ccagcgcgcgcuggcg

SEQ ID NO: 3443639 - RNA, 17 nt, Pseudomonas aeruginosa PA01
ccagcgcgcgcuggcgc

SEQ ID NO: 3443640 - RNA, 19 nt, Pseudomonas aeruginosa PA01
ccagcgcgcucuucgccgc

SEQ ID NO: 3443641 - RNA, 20 nt, Pseudomonas aeruginosa PA01
ccagcgcgcucuucgccgcg

SEQ ID NO: 3443642 - RNA, 23 nt, Pseudomonas aeruginosa PA01
ccagcgcgcucuucgccgcggcg

SEQ ID NO: 3443643 - RNA, 15 nt, Pseudomonas aeruginosa PA01
ccagcgcggccgccg

SEQ ID NO: 3443644 - RNA, 23 nt, Pseudomonas aeruginosa PA01
ccagcgcggccgccgccgacagg

SEQ ID NO: 3443645 - RNA, 18 nt, Pseudomonas aeruginosa PA01
ccagcgcggcgccccagg

SEQ ID NO: 3443646 - RNA, 21 nt, Pseudomonas aeruginosa PA01
ccagcgcggcgccccaggcgc

SEQ ID NO: 3443647 - RNA, 13 nt, Pseudomonas aeruginosa PA01
ccagcgcggcgcg

SEQ ID NO: 3443648 - RNA, 15 nt, Pseudomonas aeruginosa PA01
ccagcgcggcgcgga

SEQ ID NO: 3443649 - RNA, 22 nt, Pseudomonas aeruginosa PA01
ccagcgcggcggacaggcagcc

SEQ ID NO: 3443650 - RNA, 23 nt, Pseudomonas aeruginosa PA01
ccagcgcggcggacaggcagccg

SEQ ID NO: 3443651 - RNA, 23 nt, Pseudomonas aeruginosa PA01
ccagcgcgggcaccgagucggca

SEQ ID NO: 3443652 - RNA, 14 nt, Pseudomonas aeruginosa PA01
ccagcgcggugcgc

SEQ ID NO: 3443653 - RNA, 16 nt, Pseudomonas aeruginosa PA01
ccagcgcggugcgcgc

SEQ ID NO: 3443654 - RNA, 18 nt, Pseudomonas aeruginosa PA01
ccagcgcggugcgcgcca

SEQ ID NO: 3443655 - RNA, 23 nt, Pseudomonas aeruginosa PA01
ccagcgcguagcuuuccgcggcg

SEQ ID NO: 3443656 - RNA, 16 nt, Pseudomonas aeruginosa PA01
ccagcgcgucgaccac

SEQ ID NO: 3443657 - RNA, 18 nt, Pseudomonas aeruginosa PA01
ccagcgcgucggcacgcc

SEQ ID NO: 3443658 - RNA, 20 nt, Pseudomonas aeruginosa PA01
ccagcgcuccuugcgccagg

SEQ ID NO: 3443659 - RNA, 19 nt, Pseudomonas aeruginosa PA01
ccagcgcucgaacgccgcc

SEQ ID NO: 3443660 - RNA, 20 nt, Pseudomonas aeruginosa PA01
ccagcgcucgaacgccgccc

SEQ ID NO: 3443661 - RNA, 14 nt, Pseudomonas aeruginosa PA01
ccagcgcucguagc

SEQ ID NO: 3443662 - RNA, 19 nt, Pseudomonas aeruginosa PA01
ccagcgcucguagccggcg

SEQ ID NO: 3443663 - RNA, 20 nt, Pseudomonas aeruginosa PA01
ccagcgcucguagccggcgc

SEQ ID NO: 3443664 - RNA, 12 nt, Pseudomonas aeruginosa PA01
ccagcgcuggca

SEQ ID NO: 3443665 - RNA, 15 nt, Pseudomonas aeruginosa PA01
ccagcgcuggcaggu

SEQ ID NO: 3443666 - RNA, 19 nt, Pseudomonas aeruginosa PA01
ccagcgcuuccaccgccug

SEQ ID NO: 3443667 - RNA, 20 nt, Pseudomonas aeruginosa PA01
ccagcgcuuccaccgccugc

SEQ ID NO: 3443668 - RNA, 15 nt, Pseudomonas aeruginosa PA01
ccagcgcuuccucgg

SEQ ID NO: 3443669 - RNA, 16 nt, Pseudomonas aeruginosa PA01
ccagcgcuuccucggg

SEQ ID NO: 3443670 - RNA, 22 nt, Pseudomonas aeruginosa PA01
ccagcgcuuccucgggcagcuc

SEQ ID NO: 3443671 - RNA, 18 nt, Pseudomonas aeruginosa PA01
ccagcucgccgaacagga

SEQ ID NO: 3443672 - RNA, 14 nt, Pseudomonas aeruginosa PA01
ccagcucgccgcgc

SEQ ID NO: 3443673 - RNA, 15 nt, Pseudomonas aeruginosa PA01
ccagcucgccgcgcu

SEQ ID NO: 3443674 - RNA, 17 nt, Pseudomonas aeruginosa PA01
ccagcucgccgcgcucc

SEQ ID NO: 3443675 - RNA, 15 nt, Pseudomonas aeruginosa PA01
ccagcucgcugucca

SEQ ID NO: 3443676 - RNA, 12 nt, Pseudomonas aeruginosa PA01
ccagcucggaca

SEQ ID NO: 3443677 - RNA, 17 nt, Pseudomonas aeruginosa PA01
ccagcucggacaagggc

SEQ ID NO: 3443678 - RNA, 22 nt, Pseudomonas aeruginosa PA01
ccagcucggacaagggccagag

SEQ ID NO: 3443679 - RNA, 18 nt, Pseudomonas aeruginosa PA01
ccagcucggccaucagcg

SEQ ID NO: 3443680 - RNA, 15 nt, Pseudomonas aeruginosa PA01
ccagcucggccggca

SEQ ID NO: 3443681 - RNA, 16 nt, Pseudomonas aeruginosa PA01
ccagcucggccggcag

SEQ ID NO: 3443682 - RNA, 17 nt, Pseudomonas aeruginosa PA01
ccagcucggccggcagg

SEQ ID NO: 3443683 - RNA, 13 nt, Pseudomonas aeruginosa PA01
ccagcucggccug

SEQ ID NO: 3443684 - RNA, 15 nt, Pseudomonas aeruginosa PA01
ccagcucggcgagga

SEQ ID NO: 3443685 - RNA, 13 nt, Pseudomonas aeruginosa PA01
ccagcucggcggg

SEQ ID NO: 3443686 - RNA, 19 nt, Pseudomonas aeruginosa PA01
ccagcucggcgggacggcg

SEQ ID NO: 3443687 - RNA, 15 nt, Pseudomonas aeruginosa PA01
ccagcucggucagcg

SEQ ID NO: 3443688 - RNA, 17 nt, Pseudomonas aeruginosa PA01
ccagcucggucagcggc

SEQ ID NO: 3443689 - RNA, 22 nt, Pseudomonas aeruginosa PA01
ccagcucggucagcggcgcagc

SEQ ID NO: 3443690 - RNA, 23 nt, Pseudomonas aeruginosa PA01
ccagcucggucagcggcgcagcc

SEQ ID NO: 3443691 - RNA, 14 nt, Pseudomonas aeruginosa PA01
ccagcucggugccg

SEQ ID NO: 3443692 - RNA, 14 nt, Pseudomonas aeruginosa PA01
ccagcucgucgagc

SEQ ID NO: 3443693 - RNA, 21 nt, Pseudomonas aeruginosa PA01
ccagcucgucgagcugcucgg

SEQ ID NO: 3443694 - RNA, 14 nt, Pseudomonas aeruginosa PA01
ccagcucgucgaug

SEQ ID NO: 3443695 - RNA, 17 nt, Pseudomonas aeruginosa PA01
ccagcugccagugcucg

SEQ ID NO: 3443696 - RNA, 18 nt, Pseudomonas aeruginosa PA01
ccagcugcgccugcagcu

SEQ ID NO: 3443697 - RNA, 14 nt, Pseudomonas aeruginosa PA01
ccagcuggcgcagc

SEQ ID NO: 3443698 - RNA, 16 nt, Pseudomonas aeruginosa PA01
ccagcuggcgcagccg

SEQ ID NO: 3443699 - RNA, 22 nt, Pseudomonas aeruginosa PA01
ccagcuggcgcguugugccgcc

SEQ ID NO: 3443700 - RNA, 14 nt, Pseudomonas aeruginosa PA01
ccagcuucaccggu

SEQ ID NO: 3443701 - RNA, 20 nt, Pseudomonas aeruginosa PA01
ccagcuucaccggugccggg

SEQ ID NO: 3443702 - RNA, 15 nt, Pseudomonas aeruginosa PA01
ccagcuuccaggcgc

SEQ ID NO: 3443703 - RNA, 17 nt, Pseudomonas aeruginosa PA01
ccagcuuccaggcgcgc

SEQ ID NO: 3443704 - RNA, 18 nt, Pseudomonas aeruginosa PA01
ccagcuuccaggcgcgcu

SEQ ID NO: 3443705 - RNA, 19 nt, Pseudomonas aeruginosa PA01
ccagcuucuucugcagcuc

SEQ ID NO: 3443706 - RNA, 22 nt, Pseudomonas aeruginosa PA01
ccagcuucuucugcagcucggc

SEQ ID NO: 3443707 - RNA, 12 nt, Pseudomonas aeruginosa PA01
ccagcuucuugc

SEQ ID NO: 3443708 - RNA, 12 nt, Pseudomonas aeruginosa PA01
ccagcuugcgcc

SEQ ID NO: 3443709 - RNA, 20 nt, Pseudomonas aeruginosa PA01
ccagcuugcgccagagcagg

SEQ ID NO: 3443710 - RNA, 23 nt, Pseudomonas aeruginosa PA01
ccagcuugcgucccuuggcgucg

SEQ ID NO: 3443711 - RNA, 20 nt, Pseudomonas aeruginosa PA01
ccagcuuggcacggccggcg

SEQ ID NO: 3443712 - RNA, 19 nt, Pseudomonas aeruginosa PA01
ccagcuuggccacguccuu

SEQ ID NO: 3443713 - RNA, 12 nt, Pseudomonas aeruginosa PA01
ccagcuugggca

SEQ ID NO: 3443714 - RNA, 14 nt, Pseudomonas aeruginosa PA01
ccagcuugggcacg

SEQ ID NO: 3443715 - RNA, 16 nt, Pseudomonas aeruginosa PA01
ccagcuuggucgggau

SEQ ID NO: 3443716 - RNA, 19 nt, Pseudomonas aeruginosa PA01
ccagcuuguaguagcgccc

SEQ ID NO: 3443717 - RNA, 17 nt, Pseudomonas aeruginosa PA01
ccagcuuguccacgcca

SEQ ID NO: 3443718 - RNA, 15 nt, Pseudomonas aeruginosa PA01
ccagcuugucgccuu

SEQ ID NO: 3443719 - RNA, 20 nt, Pseudomonas aeruginosa PA01
ccagcuugucgccuuccucg

SEQ ID NO: 3443720 - RNA, 17 nt, Pseudomonas aeruginosa PA01
ccagcuugucgucggcc

SEQ ID NO: 3443721 - RNA, 18 nt, Pseudomonas aeruginosa PA01
ccagcuugucgucggccu

SEQ ID NO: 3443722 - RNA, 15 nt, Pseudomonas aeruginosa PA01
ccaggaaaucgccgu

SEQ ID NO: 3443723 - RNA, 19 nt, Pseudomonas aeruginosa PA01
ccaggaacgccucugcgcu

SEQ ID NO: 3443724 - RNA, 12 nt, Pseudomonas aeruginosa PA01
ccaggaagcccc

SEQ ID NO: 3443725 - RNA, 15 nt, Pseudomonas aeruginosa PA01
ccaggaagccccaga

SEQ ID NO: 3443726 - RNA, 13 nt, Pseudomonas aeruginosa PA01
ccaggaagccgcg

SEQ ID NO: 3443727 - RNA, 14 nt, Pseudomonas aeruginosa PA01
ccaggaagcggcgg

SEQ ID NO: 3443728 - RNA, 23 nt, Pseudomonas aeruginosa PA01
ccaggaagcggcgguacauggcc

SEQ ID NO: 3443729 - RNA, 17 nt, Pseudomonas aeruginosa PA01
ccaggaagcgggccucg

SEQ ID NO: 3443730 - RNA, 23 nt, Pseudomonas aeruginosa PA01
ccaggaagcgucgugcgccggcc

SEQ ID NO: 3443731 - RNA, 15 nt, Pseudomonas aeruginosa PA01
ccaggaagcucggca

SEQ ID NO: 3443732 - RNA, 16 nt, Pseudomonas aeruginosa PA01
ccaggaagcucggcag

SEQ ID NO: 3443733 - RNA, 17 nt, Pseudomonas aeruginosa PA01
ccaggaagcucggcagc

SEQ ID NO: 3443734 - RNA, 17 nt, Pseudomonas aeruginosa PA01
ccaggaaggaaugcugc

SEQ ID NO: 3443735 - RNA, 23 nt, Pseudomonas aeruginosa PA01
ccaggaaggccgcuucgccgccc

SEQ ID NO: 3443736 - RNA, 15 nt, Pseudomonas aeruginosa PA01
ccaggaaggccgggc

SEQ ID NO: 3443737 - RNA, 16 nt, Pseudomonas aeruginosa PA01
ccaggaaggccgggcc

SEQ ID NO: 3443738 - RNA, 20 nt, Pseudomonas aeruginosa PA01
ccaggaaggccgggcccugg

SEQ ID NO: 3443739 - RNA, 13 nt, Pseudomonas aeruginosa PA01
ccaggaaggcguc

SEQ ID NO: 3443740 - RNA, 19 nt, Pseudomonas aeruginosa PA01
ccaggaauccuccgccagc

SEQ ID NO: 3443741 - RNA, 21 nt, Pseudomonas aeruginosa PA01
ccaggaauccuccgccagcgu

SEQ ID NO: 3443742 - RNA, 19 nt, Pseudomonas aeruginosa PA01
ccaggaauuccuggccggu

SEQ ID NO: 3443743 - RNA, 16 nt, Pseudomonas aeruginosa PA01
ccaggacaacgacagc

SEQ ID NO: 3443744 - RNA, 15 nt, Pseudomonas aeruginosa PA01
ccaggacacuuccag

SEQ ID NO: 3443745 - RNA, 12 nt, Pseudomonas aeruginosa PA01
ccaggacagcac

SEQ ID NO: 3443746 - RNA, 18 nt, Pseudomonas aeruginosa PA01
ccaggacagcacgcucag

SEQ ID NO: 3443747 - RNA, 21 nt, Pseudomonas aeruginosa PA01
ccaggacagcacgcucaggca

SEQ ID NO: 3443748 - RNA, 13 nt, Pseudomonas aeruginosa PA01
ccaggaccagccc

SEQ ID NO: 3443749 - RNA, 12 nt, Pseudomonas aeruginosa PA01
ccaggaccagcg

SEQ ID NO: 3443750 - RNA, 19 nt, Pseudomonas aeruginosa PA01
ccaggaccaguucgccgcc

SEQ ID NO: 3443751 - RNA, 20 nt, Pseudomonas aeruginosa PA01
ccaggaccaguucgccgccg

SEQ ID NO: 3443752 - RNA, 15 nt, Pseudomonas aeruginosa PA01
ccaggaccaucggca

SEQ ID NO: 3443753 - RNA, 19 nt, Pseudomonas aeruginosa PA01
ccaggaccauuugcgccuc

SEQ ID NO: 3443754 - RNA, 12 nt, Pseudomonas aeruginosa PA01
ccaggaccgcga

SEQ ID NO: 3443755 - RNA, 13 nt, Pseudomonas aeruginosa PA01
ccaggaccggcag

SEQ ID NO: 3443756 - RNA, 14 nt, Pseudomonas aeruginosa PA01
ccaggaccuccugc

SEQ ID NO: 3443757 - RNA, 13 nt, Pseudomonas aeruginosa PA01
ccaggacggcagg

SEQ ID NO: 3443758 - RNA, 14 nt, Pseudomonas aeruginosa PA01
ccaggacggcaggg

SEQ ID NO: 3443759 - RNA, 23 nt, Pseudomonas aeruginosa PA01
ccaggacggcagggucagccgau

SEQ ID NO: 3443760 - RNA, 14 nt, Pseudomonas aeruginosa PA01
ccaggagcagggcg

SEQ ID NO: 3443761 - RNA, 18 nt, Pseudomonas aeruginosa PA01
ccaggagcagggcgccga

SEQ ID NO: 3443762 - RNA, 22 nt, Pseudomonas aeruginosa PA01
ccaggagcagggcgccgaucag

SEQ ID NO: 3443763 - RNA, 15 nt, Pseudomonas aeruginosa PA01
ccaggagcaucggcg

SEQ ID NO: 3443764 - RNA, 17 nt, Pseudomonas aeruginosa PA01
ccaggagcaucggcgcg

SEQ ID NO: 3443765 - RNA, 18 nt, Pseudomonas aeruginosa PA01
ccaggagcaucggcgcgg

SEQ ID NO: 3443766 - RNA, 21 nt, Pseudomonas aeruginosa PA01
ccaggagcgccagcaccagca

SEQ ID NO: 3443767 - RNA, 21 nt, Pseudomonas aeruginosa PA01
ccaggaggauucgccagccuc

SEQ ID NO: 3443768 - RNA, 16 nt, Pseudomonas aeruginosa PA01
ccaggagggcugcugu

SEQ ID NO: 3443769 - RNA, 23 nt, Pseudomonas aeruginosa PA01
ccaggagggcugcuguccagcgc

SEQ ID NO: 3443770 - RNA, 19 nt, Pseudomonas aeruginosa PA01
ccaggaucgaacuggccag

SEQ ID NO: 3443771 - RNA, 18 nt, Pseudomonas aeruginosa PA01
ccaggaucgaccccgccg

SEQ ID NO: 3443772 - RNA, 13 nt, Pseudomonas aeruginosa PA01
ccaggaucgccgg

SEQ ID NO: 3443773 - RNA, 14 nt, Pseudomonas aeruginosa PA01
ccaggaucgccggg

SEQ ID NO: 3443774 - RNA, 16 nt, Pseudomonas aeruginosa PA01
ccaggccggcggccga

SEQ ID NO: 3443775 - RNA, 14 nt, Pseudomonas aeruginosa PA01
ccaggccgggucgc

SEQ ID NO: 3443776 - RNA, 18 nt, Pseudomonas aeruginosa PA01
ccaggccgggucgcagcc

SEQ ID NO: 3443777 - RNA, 19 nt, Pseudomonas aeruginosa PA01
ccaggccgggucgcagccg

SEQ ID NO: 3443778 - RNA, 23 nt, Pseudomonas aeruginosa PA01
ccaggccguagaccaccagcagc

SEQ ID NO: 3443779 - RNA, 18 nt, Pseudomonas aeruginosa PA01
ccaggccguagcugcgcg

SEQ ID NO: 3443780 - RNA, 15 nt, Pseudomonas aeruginosa PA01
ccaggccucagaacu

SEQ ID NO: 3443781 - RNA, 17 nt, Pseudomonas aeruginosa PA01
ccaggccucccagccgu

SEQ ID NO: 3443782 - RNA, 17 nt, Pseudomonas aeruginosa PA01
ccaggccugggucacca

SEQ ID NO: 3443783 - RNA, 18 nt, Pseudomonas aeruginosa PA01
ccaggccuugcagcaacu

SEQ ID NO: 3443784 - RNA, 20 nt, Pseudomonas aeruginosa PA01
ccaggccuugugcgccagcu

SEQ ID NO: 3443785 - RNA, 21 nt, Pseudomonas aeruginosa PA01
ccaggcgaagaaagccccugc

SEQ ID NO: 3443786 - RNA, 14 nt, Pseudomonas aeruginosa PA01
ccaggcgaagcggc

SEQ ID NO: 3443787 - RNA, 20 nt, Pseudomonas aeruginosa PA01
ccaggcgaagcggcuggccg

SEQ ID NO: 3443788 - RNA, 12 nt, Pseudomonas aeruginosa PA01
ccaggcgaaggu

SEQ ID NO: 3443789 - RNA, 19 nt, Pseudomonas aeruginosa PA01
ccaggcgacgaaacggcuc

SEQ ID NO: 3443790 - RNA, 22 nt, Pseudomonas aeruginosa PA01
ccaggcgacgaaacggcucugc

SEQ ID NO: 3443791 - RNA, 23 nt, Pseudomonas aeruginosa PA01
ccaggcgacgcugaugccggcga

SEQ ID NO: 3443792 - RNA, 19 nt, Pseudomonas aeruginosa PA01
ccaggcgaggaacagcgag

SEQ ID NO: 3443793 - RNA, 16 nt, Pseudomonas aeruginosa PA01
ccaggcgauacgcggc

SEQ ID NO: 3443794 - RNA, 18 nt, Pseudomonas aeruginosa PA01
ccaggcgauaucccgccg

SEQ ID NO: 3443795 - RNA, 21 nt, Pseudomonas aeruginosa PA01
ccaggcgauaucccgccgccg

SEQ ID NO: 3443796 - RNA, 22 nt, Pseudomonas aeruginosa PA01
ccaggcgauaucccgccgccgc

SEQ ID NO: 3443797 - RNA, 17 nt, Pseudomonas aeruginosa PA01
ccaggcgauccacagca

SEQ ID NO: 3443798 - RNA, 13 nt, Pseudomonas aeruginosa PA01
ccaggcgauccag

SEQ ID NO: 3443799 - RNA, 17 nt, Pseudomonas aeruginosa PA01
ccaggcgauccagcggg

SEQ ID NO: 3443800 - RNA, 14 nt, Pseudomonas aeruginosa PA01
ccaggcgaugcgcc

SEQ ID NO: 3443801 - RNA, 11 nt, Pseudomonas aeruginosa PA01
ccaggcgaugg

SEQ ID NO: 3443802 - RNA, 18 nt, Pseudomonas aeruginosa PA01
ccaggcgauggugcgcuc

SEQ ID NO: 3443803 - RNA, 15 nt, Pseudomonas aeruginosa PA01
ccaggcgaugguugc

SEQ ID NO: 3443804 - RNA, 17 nt, Pseudomonas aeruginosa PA01
ccaggcgcaccagcagg

SEQ ID NO: 3443805 - RNA, 19 nt, Pseudomonas aeruginosa PA01
ccaggcgcaccagcaggcg

SEQ ID NO: 3443806 - RNA, 14 nt, Pseudomonas aeruginosa PA01
ccaggcgcaccucc

SEQ ID NO: 3443807 - RNA, 24 nt, Pseudomonas aeruginosa PA01
ccaggcgcaccuccucgggcggau

SEQ ID NO: 3443808 - RNA, 13 nt, Pseudomonas aeruginosa PA01
ccaggcgcagcca

SEQ ID NO: 3443809 - RNA, 17 nt, Pseudomonas aeruginosa PA01
ccaggcgcaggcgagga

SEQ ID NO: 3443810 - RNA, 20 nt, Pseudomonas aeruginosa PA01
ccaggcgccaauccgggcgu

SEQ ID NO: 3443811 - RNA, 17 nt, Pseudomonas aeruginosa PA01
ccaggcgccagagcgcg

SEQ ID NO: 3443812 - RNA, 18 nt, Pseudomonas aeruginosa PA01
ccaggcgccagagcgcgc

SEQ ID NO: 3443813 - RNA, 16 nt, Pseudomonas aeruginosa PA01
ccaggcgccagggacg

SEQ ID NO: 3443814 - RNA, 23 nt, Pseudomonas aeruginosa PA01
ccaggcgccagggacgcgcagcg

SEQ ID NO: 3443815 - RNA, 14 nt, Pseudomonas aeruginosa PA01
ccaggcgccagggc

SEQ ID NO: 3443816 - RNA, 16 nt, Pseudomonas aeruginosa PA01
ccaggcgccagggccg

SEQ ID NO: 3443817 - RNA, 22 nt, Pseudomonas aeruginosa PA01
ccaggcgccagguagugccgcc

SEQ ID NO: 3443818 - RNA, 14 nt, Pseudomonas aeruginosa PA01
ccaggcgcccaggc

SEQ ID NO: 3443819 - RNA, 19 nt, Pseudomonas aeruginosa PA01
ccaggcgcccaggcagcag

SEQ ID NO: 3443820 - RNA, 20 nt, Pseudomonas aeruginosa PA01
ccaggcgcccaggcagcaga

SEQ ID NO: 3443821 - RNA, 16 nt, Pseudomonas aeruginosa PA01
ccaggcgccgaugccc

SEQ ID NO: 3443822 - RNA, 18 nt, Pseudomonas aeruginosa PA01
ccaggcgccgaugcccag

SEQ ID NO: 3443823 - RNA, 22 nt, Pseudomonas aeruginosa PA01
ccaggcgccgaugcccaggccg

SEQ ID NO: 3443824 - RNA, 17 nt, Pseudomonas aeruginosa PA01
ccaggcgccgcucgaug

SEQ ID NO: 3443825 - RNA, 21 nt, Pseudomonas aeruginosa PA01
ccaggcgccgggucgaugggc

SEQ ID NO: 3443826 - RNA, 12 nt, Pseudomonas aeruginosa PA01
ccaggcgcgccg

SEQ ID NO: 3443827 - RNA, 13 nt, Pseudomonas aeruginosa PA01
ccaggcgcgccgu

SEQ ID NO: 3443828 - RNA, 15 nt, Pseudomonas aeruginosa PA01
ccaggcgcgccgugc

SEQ ID NO: 3443829 - RNA, 16 nt, Pseudomonas aeruginosa PA01
ccaggcgcgccgugcg

SEQ ID NO: 3443830 - RNA, 13 nt, Pseudomonas aeruginosa PA01
ccaggcgcgcugg

SEQ ID NO: 3443831 - RNA, 17 nt, Pseudomonas aeruginosa PA01
ccaggcgcgcuggaugc

SEQ ID NO: 3443832 - RNA, 24 nt, Pseudomonas aeruginosa PA01
ccaggcgcggcgccuucagcgccg

SEQ ID NO: 3443833 - RNA, 22 nt, Pseudomonas aeruginosa PA01
ccaggcgcgguugccgcugcgg

SEQ ID NO: 3443834 - RNA, 18 nt, Pseudomonas aeruginosa PA01
ccaggcgcgucgcggccu

SEQ ID NO: 3443835 - RNA, 17 nt, Pseudomonas aeruginosa PA01
ccaggcgcgucuccagc

SEQ ID NO: 3443836 - RNA, 18 nt, Pseudomonas aeruginosa PA01
ccaggcgcuccagggcau

SEQ ID NO: 3443837 - RNA, 13 nt, Pseudomonas aeruginosa PA01
ccaggcgcuccuc

SEQ ID NO: 3443838 - RNA, 14 nt, Pseudomonas aeruginosa PA01
ccaggcgcuccucc

SEQ ID NO: 3443839 - RNA, 22 nt, Pseudomonas aeruginosa PA01
ccaggcgcuccuccagcgccgc

SEQ ID NO: 3443840 - RNA, 17 nt, Pseudomonas aeruginosa PA01
ccaggcgcucgcgcugc

SEQ ID NO: 3443841 - RNA, 16 nt, Pseudomonas aeruginosa PA01
ccaggcgcucggcggc

SEQ ID NO: 3443842 - RNA, 17 nt, Pseudomonas aeruginosa PA01
ccaggcgcucggcggcg

SEQ ID NO: 3443843 - RNA, 18 nt, Pseudomonas aeruginosa PA01
ccaggcgcucggcggcgc

SEQ ID NO: 3443844 - RNA, 19 nt, Pseudomonas aeruginosa PA01
ccaggcgcucucgccgccu

SEQ ID NO: 3443845 - RNA, 23 nt, Pseudomonas aeruginosa PA01
ccaggcgcugcucgauggccuug

SEQ ID NO: 3443846 - RNA, 11 nt, Pseudomonas aeruginosa PA01
ccaggcgcugg

SEQ ID NO: 3443847 - RNA, 14 nt, Pseudomonas aeruginosa PA01
ccaggcgcuggcgc

SEQ ID NO: 3443848 - RNA, 15 nt, Pseudomonas aeruginosa PA01
ccaggcgcuggcgcc

SEQ ID NO: 3443849 - RNA, 21 nt, Pseudomonas aeruginosa PA01
ccaggcgcugguccagcacgc

SEQ ID NO: 3443850 - RNA, 16 nt, Pseudomonas aeruginosa PA01
ccaggcgcuuguccga

SEQ ID NO: 3443851 - RNA, 15 nt, Pseudomonas aeruginosa PA01
ccaggcggaacggcu

SEQ ID NO: 3443852 - RNA, 23 nt, Pseudomonas aeruginosa PA01
ccaggcggaacggcucgcgaccg

SEQ ID NO: 3443853 - RNA, 14 nt, Pseudomonas aeruginosa PA01
ccaggcggagcaug

SEQ ID NO: 3443854 - RNA, 16 nt, Pseudomonas aeruginosa PA01
ccaggcggagcauggu

SEQ ID NO: 3443855 - RNA, 22 nt, Pseudomonas aeruginosa PA01
ccaggcggcaagggcgucuggg

SEQ ID NO: 3443856 - RNA, 11 nt, Pseudomonas aeruginosa PA01
ccaggcggccg

SEQ ID NO: 3443857 - RNA, 17 nt, Pseudomonas aeruginosa PA01
ccaggcggccgacgaug

SEQ ID NO: 3443858 - RNA, 15 nt, Pseudomonas aeruginosa PA01
ccaggcggccgcugg

SEQ ID NO: 3443859 - RNA, 18 nt, Pseudomonas aeruginosa PA01
ccaggcggccgcuggcga

SEQ ID NO: 3443860 - RNA, 15 nt, Pseudomonas aeruginosa PA01
ccaggcggccggugc

SEQ ID NO: 3443861 - RNA, 15 nt, Pseudomonas aeruginosa PA01
ccaggcggccgucgg

SEQ ID NO: 3443862 - RNA, 19 nt, Pseudomonas aeruginosa PA01
ccaggcggccgucggccug

SEQ ID NO: 3443863 - RNA, 20 nt, Pseudomonas aeruginosa PA01
ccaggcggccgucggccugg

SEQ ID NO: 3443864 - RNA, 17 nt, Pseudomonas aeruginosa PA01
ccaggcgggccagcugg

SEQ ID NO: 3443865 - RNA, 20 nt, Pseudomonas aeruginosa PA01
ccaggcgggccagcuggcga

SEQ ID NO: 3443866 - RNA, 20 nt, Pseudomonas aeruginosa PA01
ccaggcggggauggcgggcu

SEQ ID NO: 3443867 - RNA, 20 nt, Pseudomonas aeruginosa PA01
ccaggcggggucagagggug

SEQ ID NO: 3443868 - RNA, 15 nt, Pseudomonas aeruginosa PA01
ccaggcgguccagcc

SEQ ID NO: 3443869 - RNA, 23 nt, Pseudomonas aeruginosa PA01
ccaggcggugucgcgguugcgcu

SEQ ID NO: 3443870 - RNA, 19 nt, Pseudomonas aeruginosa PA01
ccaggcgguuggcccgcgc

SEQ ID NO: 3443871 - RNA, 21 nt, Pseudomonas aeruginosa PA01
ccaggcgguuggcccgcgccg

SEQ ID NO: 3443872 - RNA, 19 nt, Pseudomonas aeruginosa PA01
ccaggcgguuguucagcgg

SEQ ID NO: 3443873 - RNA, 17 nt, Pseudomonas aeruginosa PA01
ccaggcguauucggcga

SEQ ID NO: 3443874 - RNA, 15 nt, Pseudomonas aeruginosa PA01
ccaggcguccgcugg

SEQ ID NO: 3443875 - RNA, 20 nt, Pseudomonas aeruginosa PA01
ccaggcguccgcuggccugc

SEQ ID NO: 3443876 - RNA, 13 nt, Pseudomonas aeruginosa PA01
ccagggccuggcg

SEQ ID NO: 3443877 - RNA, 14 nt, Pseudomonas aeruginosa PA01
ccagggccuggcgc

SEQ ID NO: 3443878 - RNA, 20 nt, Pseudomonas aeruginosa PA01
ccagggccuggcgcacggcc

SEQ ID NO: 3443879 - RNA, 20 nt, Pseudomonas aeruginosa PA01
ccagggcgaacagcgccgcg

SEQ ID NO: 3443880 - RNA, 18 nt, Pseudomonas aeruginosa PA01
ccagggcgaauaccagug

SEQ ID NO: 3443881 - RNA, 20 nt, Pseudomonas aeruginosa PA01
ccagggcgaauaccagugcc

SEQ ID NO: 3443882 - RNA, 16 nt, Pseudomonas aeruginosa PA01
ccagggcgaggaucac

SEQ ID NO: 3443883 - RNA, 21 nt, Pseudomonas aeruginosa PA01
ccagggcgaggaucacgcagc

SEQ ID NO: 3443884 - RNA, 23 nt, Pseudomonas aeruginosa PA01
ccagggcgaggaucacgcagcag

SEQ ID NO: 3443885 - RNA, 13 nt, Pseudomonas aeruginosa PA01
ccagggcgaggcc

SEQ ID NO: 3443886 - RNA, 12 nt, Pseudomonas aeruginosa PA01
ccagggcgaucg

SEQ ID NO: 3443887 - RNA, 15 nt, Pseudomonas aeruginosa PA01
ccagggcgcugccga

SEQ ID NO: 3443888 - RNA, 21 nt, Pseudomonas aeruginosa PA01
ccagggcgcugccgaucagcc

SEQ ID NO: 3443889 - RNA, 14 nt, Pseudomonas aeruginosa PA01
ccagggcggcgccg

SEQ ID NO: 3443890 - RNA, 15 nt, Pseudomonas aeruginosa PA01
ccagggcggcgccga

SEQ ID NO: 3443891 - RNA, 15 nt, Pseudomonas aeruginosa PA01
ccagggcggcggcga

SEQ ID NO: 3443892 - RNA, 18 nt, Pseudomonas aeruginosa PA01
ccagggcgggccgcucgc

SEQ ID NO: 3443893 - RNA, 19 nt, Pseudomonas aeruginosa PA01
ccagggcgggccgcucgcg

SEQ ID NO: 3443894 - RNA, 20 nt, Pseudomonas aeruginosa PA01
ccagggcgggccgcucgcgc

SEQ ID NO: 3443895 - RNA, 20 nt, Pseudomonas aeruginosa PA01
ccagggcgguuaccaggucu

SEQ ID NO: 3443896 - RNA, 23 nt, Pseudomonas aeruginosa PA01
ccagggcgguuaccaggucugug

SEQ ID NO: 3443897 - RNA, 15 nt, Pseudomonas aeruginosa PA01
ccagggcgucggaga

SEQ ID NO: 3443898 - RNA, 15 nt, Pseudomonas aeruginosa PA01
ccagggcguggucgg

SEQ ID NO: 3443899 - RNA, 20 nt, Pseudomonas aeruginosa PA01
ccagggcugccaccgagggc

SEQ ID NO: 3443900 - RNA, 17 nt, Pseudomonas aeruginosa PA01
ccagggcuucccaggcc

SEQ ID NO: 3443901 - RNA, 19 nt, Pseudomonas aeruginosa PA01
ccagggcuucccaggccag

SEQ ID NO: 3443902 - RNA, 20 nt, Pseudomonas aeruginosa PA01
ccagggcuucccaggccagc

SEQ ID NO: 3443903 - RNA, 16 nt, Pseudomonas aeruginosa PA01
ccagggcuucgacaua

SEQ ID NO: 3443904 - RNA, 17 nt, Pseudomonas aeruginosa PA01
ccagggcuucgcgcaga

SEQ ID NO: 3443905 - RNA, 17 nt, Pseudomonas aeruginosa PA01
ccaggggagcgccggcg

SEQ ID NO: 3443906 - RNA, 18 nt, Pseudomonas aeruginosa PA01
ccaggggagcgccggcgc

SEQ ID NO: 3443907 - RNA, 19 nt, Pseudomonas aeruginosa PA01
ccaggggagcgccggcgcg

SEQ ID NO: 3443908 - RNA, 18 nt, Pseudomonas aeruginosa PA01
ccaggggauggucgguga

SEQ ID NO: 3443909 - RNA, 13 nt, Pseudomonas aeruginosa PA01
ccaggggcacgcu

SEQ ID NO: 3443910 - RNA, 17 nt, Pseudomonas aeruginosa PA01
ccaggggcacgcuggcg

SEQ ID NO: 3443911 - RNA, 22 nt, Pseudomonas aeruginosa PA01
ccaggggcuagucgcgcagcgc

SEQ ID NO: 3443912 - RNA, 16 nt, Pseudomonas aeruginosa PA01
ccagggggccgggccg

SEQ ID NO: 3443913 - RNA, 13 nt, Pseudomonas aeruginosa PA01
ccagggggccugg

SEQ ID NO: 3443914 - RNA, 19 nt, Pseudomonas aeruginosa PA01
ccagggggcgacauagcgg

SEQ ID NO: 3443915 - RNA, 16 nt, Pseudomonas aeruginosa PA01
ccagggguaggaggaa

SEQ ID NO: 3443916 - RNA, 18 nt, Pseudomonas aeruginosa PA01
ccaggggucgacgcaggg

SEQ ID NO: 3443917 - RNA, 19 nt, Pseudomonas aeruginosa PA01
ccaggggucgacgcagggc

SEQ ID NO: 3443918 - RNA, 19 nt, Pseudomonas aeruginosa PA01
ccaggggucggcaucgcgu

SEQ ID NO: 3443919 - RNA, 21 nt, Pseudomonas aeruginosa PA01
ccaggguacuucgugccacag

SEQ ID NO: 3443920 - RNA, 16 nt, Pseudomonas aeruginosa PA01
ccaggguagcgccgcg

SEQ ID NO: 3443921 - RNA, 17 nt, Pseudomonas aeruginosa PA01
ccaggguagcgccgcgg

SEQ ID NO: 3443922 - RNA, 14 nt, Pseudomonas aeruginosa PA01
ccaggguaucgcug

SEQ ID NO: 3443923 - RNA, 20 nt, Pseudomonas aeruginosa PA01
ccaggguaucgcugucgccc

SEQ ID NO: 3443924 - RNA, 21 nt, Pseudomonas aeruginosa PA01
ccaggguaucgcugucgcccg

SEQ ID NO: 3443925 - RNA, 15 nt, Pseudomonas aeruginosa PA01
ccagggucacgccag

SEQ ID NO: 3443926 - RNA, 17 nt, Pseudomonas aeruginosa PA01
ccagggucacgccgcgg

SEQ ID NO: 3443927 - RNA, 18 nt, Pseudomonas aeruginosa PA01
ccagggucacgccgcggc

SEQ ID NO: 3443928 - RNA, 20 nt, Pseudomonas aeruginosa PA01
ccagggucacgccgcggcug

SEQ ID NO: 3443929 - RNA, 14 nt, Pseudomonas aeruginosa PA01
ccagggucagcugg

SEQ ID NO: 3443930 - RNA, 16 nt, Pseudomonas aeruginosa PA01
ccagggucagcuggcg

SEQ ID NO: 3443931 - RNA, 19 nt, Pseudomonas aeruginosa PA01
ccagggucagcuggcgcgc

SEQ ID NO: 3443932 - RNA, 20 nt, Pseudomonas aeruginosa PA01
ccaggguccgcuucagcgcg

SEQ ID NO: 3443933 - RNA, 13 nt, Pseudomonas aeruginosa PA01
ccagggucgaggg

SEQ ID NO: 3443934 - RNA, 12 nt, Pseudomonas aeruginosa PA01
ccagggucgcca

SEQ ID NO: 3443935 - RNA, 12 nt, Pseudomonas aeruginosa PA01
ccagggucgccc

SEQ ID NO: 3443936 - RNA, 18 nt, Pseudomonas aeruginosa PA01
ccagggucggcaccugca

SEQ ID NO: 3443937 - RNA, 20 nt, Pseudomonas aeruginosa PA01
ccagggucggcaccugcaga

SEQ ID NO: 3443938 - RNA, 19 nt, Pseudomonas aeruginosa PA01
ccagggucgggccgcgcuc

SEQ ID NO: 3443939 - RNA, 20 nt, Pseudomonas aeruginosa PA01
ccagggucgggccgcgcucg

SEQ ID NO: 3443940 - RNA, 17 nt, Pseudomonas aeruginosa PA01
ccagggucuccaggacc

SEQ ID NO: 3443941 - RNA, 17 nt, Pseudomonas aeruginosa PA01
ccagggucuucagugca

SEQ ID NO: 3443942 - RNA, 18 nt, Pseudomonas aeruginosa PA01
ccagggucuucagugcac

SEQ ID NO: 3443943 - RNA, 15 nt, Pseudomonas aeruginosa PA01
ccagggucuugccga

SEQ ID NO: 3443944 - RNA, 12 nt, Pseudomonas aeruginosa PA01
ccagggugcgcu

SEQ ID NO: 3443945 - RNA, 13 nt, Pseudomonas aeruginosa PA01
ccagggugcgcuc

SEQ ID NO: 3443946 - RNA, 15 nt, Pseudomonas aeruginosa PA01
ccaggguggcgcgca

SEQ ID NO: 3443947 - RNA, 18 nt, Pseudomonas aeruginosa PA01
ccaggguggcggcggcga

SEQ ID NO: 3443948 - RNA, 19 nt, Pseudomonas aeruginosa PA01
ccaggguggcggcggcgag

SEQ ID NO: 3443949 - RNA, 14 nt, Pseudomonas aeruginosa PA01
ccaggguggcguuc

SEQ ID NO: 3443950 - RNA, 16 nt, Pseudomonas aeruginosa PA01
ccaggguggggaugcg

SEQ ID NO: 3443951 - RNA, 20 nt, Pseudomonas aeruginosa PA01
ccaggguggggaugcgcgag

SEQ ID NO: 3443952 - RNA, 18 nt, Pseudomonas aeruginosa PA01
ccaggguuggcggcaucg

SEQ ID NO: 3443953 - RNA, 19 nt, Pseudomonas aeruginosa PA01
ccaggguuuccagcagcac

SEQ ID NO: 3443954 - RNA, 22 nt, Pseudomonas aeruginosa PA01
ccagguaaaggccaccagagcc

SEQ ID NO: 3443955 - RNA, 14 nt, Pseudomonas aeruginosa PA01
ccagguacagccgc

SEQ ID NO: 3443956 - RNA, 16 nt, Pseudomonas aeruginosa PA01
ccagguacagccgcag

SEQ ID NO: 3443957 - RNA, 12 nt, Pseudomonas aeruginosa PA01
ccagguaccggc

SEQ ID NO: 3443958 - RNA, 20 nt, Pseudomonas aeruginosa PA01
ccagguacggaucggucccc

SEQ ID NO: 3443959 - RNA, 14 nt, Pseudomonas aeruginosa PA01
ccagguacggcccg

SEQ ID NO: 3443960 - RNA, 17 nt, Pseudomonas aeruginosa PA01
ccagguacggcccgcgg

SEQ ID NO: 3443961 - RNA, 16 nt, Pseudomonas aeruginosa PA01
ccagguacugggcgau

SEQ ID NO: 3443962 - RNA, 18 nt, Pseudomonas aeruginosa PA01
ccagguacuuggccacgc

SEQ ID NO: 3443963 - RNA, 18 nt, Pseudomonas aeruginosa PA01
ccagguagaccuugccgu

SEQ ID NO: 3443964 - RNA, 16 nt, Pseudomonas aeruginosa PA01
ccagguagagaagcgu

SEQ ID NO: 3443965 - RNA, 23 nt, Pseudomonas aeruginosa PA01
ccagguagagaagcguucgccga

SEQ ID NO: 3443966 - RNA, 15 nt, Pseudomonas aeruginosa PA01
ccagguagagcagcc

SEQ ID NO: 3443967 - RNA, 15 nt, Pseudomonas aeruginosa PA01
ccagguagcccaccu

SEQ ID NO: 3443968 - RNA, 14 nt, Pseudomonas aeruginosa PA01
ccagguagccggcg

SEQ ID NO: 3443969 - RNA, 15 nt, Pseudomonas aeruginosa PA01
ccagguagccggcga

SEQ ID NO: 3443970 - RNA, 13 nt, Pseudomonas aeruginosa PA01
ccagguagccugg

SEQ ID NO: 3443971 - RNA, 18 nt, Pseudomonas aeruginosa PA01
ccagguagccuggauacg

SEQ ID NO: 3443972 - RNA, 17 nt, Pseudomonas aeruginosa PA01
ccagguagcgcugcgcc

SEQ ID NO: 3443973 - RNA, 21 nt, Pseudomonas aeruginosa PA01
ccagguagcgcugcgccaggc

SEQ ID NO: 3443974 - RNA, 22 nt, Pseudomonas aeruginosa PA01
ccagguagcgcugcgccaggcu

SEQ ID NO: 3443975 - RNA, 19 nt, Pseudomonas aeruginosa PA01
ccagguagcggaccccggc

SEQ ID NO: 3443976 - RNA, 21 nt, Pseudomonas aeruginosa PA01
ccagguagcggaccccggccu

SEQ ID NO: 3443977 - RNA, 13 nt, Pseudomonas aeruginosa PA01
ccagguaggcgac

SEQ ID NO: 3443978 - RNA, 15 nt, Pseudomonas aeruginosa PA01
ccagguaggcgacga

SEQ ID NO: 3443979 - RNA, 15 nt, Pseudomonas aeruginosa PA01
ccaguagcgccuggu

SEQ ID NO: 3443980 - RNA, 20 nt, Pseudomonas aeruginosa PA01
ccaguagcggaagcacggcu

SEQ ID NO: 3443981 - RNA, 15 nt, Pseudomonas aeruginosa PA01
ccaguagggcccgug

SEQ ID NO: 3443982 - RNA, 15 nt, Pseudomonas aeruginosa PA01
ccaguagggggugaa

SEQ ID NO: 3443983 - RNA, 17 nt, Pseudomonas aeruginosa PA01
ccaguagggggugaagc

SEQ ID NO: 3443984 - RNA, 18 nt, Pseudomonas aeruginosa PA01
ccagucaccaggucgcgg

SEQ ID NO: 3443985 - RNA, 23 nt, Pseudomonas aeruginosa PA01
ccagucccgcaaagcccgcuccg

SEQ ID NO: 3443986 - RNA, 14 nt, Pseudomonas aeruginosa PA01
ccagucccuggccg

SEQ ID NO: 3443987 - RNA, 19 nt, Pseudomonas aeruginosa PA01
ccagucccuggccggcgau

SEQ ID NO: 3443988 - RNA, 22 nt, Pseudomonas aeruginosa PA01
ccagucccuucagcgcaccgcc

SEQ ID NO: 3443989 - RNA, 14 nt, Pseudomonas aeruginosa PA01
ccaguccggcagca

SEQ ID NO: 3443990 - RNA, 20 nt, Pseudomonas aeruginosa PA01
ccaguccggcagcacggcga

SEQ ID NO: 3443991 - RNA, 14 nt, Pseudomonas aeruginosa PA01
ccaguccugggugu

SEQ ID NO: 3443992 - RNA, 16 nt, Pseudomonas aeruginosa PA01
ccagucgagacgccag

SEQ ID NO: 3443993 - RNA, 19 nt, Pseudomonas aeruginosa PA01
ccagucgagacgccagccg

SEQ ID NO: 3443994 - RNA, 15 nt, Pseudomonas aeruginosa PA01
ccagucgagagcggg

SEQ ID NO: 3443995 - RNA, 14 nt, Pseudomonas aeruginosa PA01
ccagucgcccgcuu

SEQ ID NO: 3443996 - RNA, 13 nt, Pseudomonas aeruginosa PA01
ccagucggccugg

SEQ ID NO: 3443997 - RNA, 11 nt, Pseudomonas aeruginosa PA01
ccagucggcgc

SEQ ID NO: 3443998 - RNA, 14 nt, Pseudomonas aeruginosa PA01
ccagucggcgcugg

SEQ ID NO: 3443999 - RNA, 15 nt, Pseudomonas aeruginosa PA01
ccagucggcgcugga

SEQ ID NO: 3444000 - RNA, 19 nt, Pseudomonas aeruginosa PA01
ccagucggcguccgccucg

SEQ ID NO: 3444001 - RNA, 14 nt, Pseudomonas aeruginosa PA01
ccagucggggcagg

SEQ ID NO: 3444002 - RNA, 18 nt, Pseudomonas aeruginosa PA01
ccagucggggcaggcgca

SEQ ID NO: 3444003 - RNA, 22 nt, Pseudomonas aeruginosa PA01
ccagucggggcaggcgcaggcg

SEQ ID NO: 3444004 - RNA, 16 nt, Pseudomonas aeruginosa PA01
ccagucuucgccggcc

SEQ ID NO: 3444005 - RNA, 14 nt, Pseudomonas aeruginosa PA01
ccagugcaccgccg

SEQ ID NO: 3444006 - RNA, 15 nt, Pseudomonas aeruginosa PA01
ccagugcaccgccgg

SEQ ID NO: 3444007 - RNA, 20 nt, Pseudomonas aeruginosa PA01
ccagugcaugcguucgccga

SEQ ID NO: 3444008 - RNA, 14 nt, Pseudomonas aeruginosa PA01
ccagugcccggcag

SEQ ID NO: 3444009 - RNA, 15 nt, Pseudomonas aeruginosa PA01
ccagugccucccggc

SEQ ID NO: 3444010 - RNA, 15 nt, Pseudomonas aeruginosa PA01
ccagugccucgcgcg

SEQ ID NO: 3444011 - RNA, 18 nt, Pseudomonas aeruginosa PA01
ccagugcgcgguccgcgu

SEQ ID NO: 3444012 - RNA, 15 nt, Pseudomonas aeruginosa PA01
ccaguggcgccgcca

SEQ ID NO: 3444013 - RNA, 23 nt, Pseudomonas aeruginosa PA01
ccagugguuccaggagggcugcu

SEQ ID NO: 3444014 - RNA, 15 nt, Pseudomonas aeruginosa PA01
ccaguguggcggcgu

SEQ ID NO: 3444015 - RNA, 23 nt, Pseudomonas aeruginosa PA01
ccaguguggcggcguggcucgau

SEQ ID NO: 3444016 - RNA, 17 nt, Pseudomonas aeruginosa PA01
ccaguucagggcgagca

SEQ ID NO: 3444017 - RNA, 15 nt, Pseudomonas aeruginosa PA01
ccaguucaucgagca

SEQ ID NO: 3444018 - RNA, 18 nt, Pseudomonas aeruginosa PA01
ccaguuccaugucgcugg

SEQ ID NO: 3444019 - RNA, 16 nt, Pseudomonas aeruginosa PA01
ccaguuccggggucag

SEQ ID NO: 3444020 - RNA, 12 nt, Pseudomonas aeruginosa PA01
ccaguuccucgc

SEQ ID NO: 3444021 - RNA, 13 nt, Pseudomonas aeruginosa PA01
ccaguuccucgcg

SEQ ID NO: 3444022 - RNA, 18 nt, Pseudomonas aeruginosa PA01
ccaguuccugcaccacgu

SEQ ID NO: 3444023 - RNA, 16 nt, Pseudomonas aeruginosa PA01
ccaguuccugcuccuc

SEQ ID NO: 3444024 - RNA, 20 nt, Pseudomonas aeruginosa PA01
ccaguuccuucacggcaucc

SEQ ID NO: 3444025 - RNA, 20 nt, Pseudomonas aeruginosa PA01
ccaguuccuucgccgaaagc

SEQ ID NO: 3444026 - RNA, 23 nt, Pseudomonas aeruginosa PA01
ccaguuccuucuugacccgcugc

SEQ ID NO: 3444027 - RNA, 21 nt, Pseudomonas aeruginosa PA01
ccaguucgagcagucgcuuca

SEQ ID NO: 3444028 - RNA, 15 nt, Pseudomonas aeruginosa PA01
ccaguucgccgccgc

SEQ ID NO: 3444029 - RNA, 16 nt, Pseudomonas aeruginosa PA01
ccaguucgccggccag

SEQ ID NO: 3444030 - RNA, 17 nt, Pseudomonas aeruginosa PA01
ccaguucgccggccagc

SEQ ID NO: 3444031 - RNA, 20 nt, Pseudomonas aeruginosa PA01
ccaguucgccggccagcacc

SEQ ID NO: 3444032 - RNA, 13 nt, Pseudomonas aeruginosa PA01
ccaguucgcgcag

SEQ ID NO: 3444033 - RNA, 20 nt, Pseudomonas aeruginosa PA01
ccaguucgcgcaggaccugg

SEQ ID NO: 3444034 - RNA, 21 nt, Pseudomonas aeruginosa PA01
ccaguucgcgcaggaccuggc

SEQ ID NO: 3444035 - RNA, 14 nt, Pseudomonas aeruginosa PA01
ccaguucgcgcgga

SEQ ID NO: 3444036 - RNA, 15 nt, Pseudomonas aeruginosa PA01
ccaguucgcggcgca

SEQ ID NO: 3444037 - RNA, 17 nt, Pseudomonas aeruginosa PA01
ccaguucgcggcgcagu

SEQ ID NO: 3444038 - RNA, 21 nt, Pseudomonas aeruginosa PA01
ccaguucgcugacccagcgca

SEQ ID NO: 3444039 - RNA, 14 nt, Pseudomonas aeruginosa PA01
ccaguucggccgcg

SEQ ID NO: 3444040 - RNA, 19 nt, Pseudomonas aeruginosa PA01
ccaguucggggucggccug

SEQ ID NO: 3444041 - RNA, 15 nt, Pseudomonas aeruginosa PA01
ccaguucguugacca

SEQ ID NO: 3444042 - RNA, 16 nt, Pseudomonas aeruginosa PA01
ccaguucguugaccac

SEQ ID NO: 3444043 - RNA, 16 nt, Pseudomonas aeruginosa PA01
ccaguucuucgccgcc

SEQ ID NO: 3444044 - RNA, 17 nt, Pseudomonas aeruginosa PA01
ccaguucuucgccgccc

SEQ ID NO: 3444045 - RNA, 14 nt, Pseudomonas aeruginosa PA01
ccaguugcaccgca

SEQ ID NO: 3444046 - RNA, 21 nt, Pseudomonas aeruginosa PA01
ccaguugcccgagugccggcg

SEQ ID NO: 3444047 - RNA, 22 nt, Pseudomonas aeruginosa PA01
ccaguugcccgagugccggcgc

SEQ ID NO: 3444048 - RNA, 16 nt, Pseudomonas aeruginosa PA01
ccaguugcccggccug

SEQ ID NO: 3444049 - RNA, 15 nt, Pseudomonas aeruginosa PA01
ccaguugccgagcuu

SEQ ID NO: 3444050 - RNA, 14 nt, Pseudomonas aeruginosa PA01
ccaguugcgcuccg

SEQ ID NO: 3444051 - RNA, 15 nt, Pseudomonas aeruginosa PA01
ccaguugcugggcga

SEQ ID NO: 3444052 - RNA, 17 nt, Pseudomonas aeruginosa PA01
ccauaauggccgcuacg

SEQ ID NO: 3444053 - RNA, 13 nt, Pseudomonas aeruginosa PA01
ccauaccgccucg

SEQ ID NO: 3444054 - RNA, 17 nt, Pseudomonas aeruginosa PA01
ccauaccuccagccagc

SEQ ID NO: 3444055 - RNA, 22 nt, Pseudomonas aeruginosa PA01
ccauagaguugcuuggcgcgcu

SEQ ID NO: 3444056 - RNA, 14 nt, Pseudomonas aeruginosa PA01
ccauagcgagccgc

SEQ ID NO: 3444057 - RNA, 13 nt, Pseudomonas aeruginosa PA01
ccauagcgcgccg

SEQ ID NO: 3444058 - RNA, 14 nt, Pseudomonas aeruginosa PA01
ccauagcgcgccgg

SEQ ID NO: 3444059 - RNA, 20 nt, Pseudomonas aeruginosa PA01
ccauaggcuggaucgaucuc

SEQ ID NO: 3444060 - RNA, 18 nt, Pseudomonas aeruginosa PA01
ccauagggcggcgcggcg

SEQ ID NO: 3444061 - RNA, 23 nt, Pseudomonas aeruginosa PA01
ccauaguagagaugcaccggcca

SEQ ID NO: 3444062 - RNA, 20 nt, Pseudomonas aeruginosa PA01
ccaucaacggauauccccgu

SEQ ID NO: 3444063 - RNA, 13 nt, Pseudomonas aeruginosa PA01
ccaucaccagcgc

SEQ ID NO: 3444064 - RNA, 15 nt, Pseudomonas aeruginosa PA01
ccaucaccagcgccg

SEQ ID NO: 3444065 - RNA, 17 nt, Pseudomonas aeruginosa PA01
ccaucaccgacaguccc

SEQ ID NO: 3444066 - RNA, 23 nt, Pseudomonas aeruginosa PA01
ccaucaccgacagucccaggcca

SEQ ID NO: 3444067 - RNA, 21 nt, Pseudomonas aeruginosa PA01
ccaucaccgccaucagcacga

SEQ ID NO: 3444068 - RNA, 12 nt, Pseudomonas aeruginosa PA01
ccaucaccgcgu

SEQ ID NO: 3444069 - RNA, 19 nt, Pseudomonas aeruginosa PA01
ccaucacggccccgagaaa

SEQ ID NO: 3444070 - RNA, 16 nt, Pseudomonas aeruginosa PA01
ccaucacgucgcgcac

SEQ ID NO: 3444071 - RNA, 13 nt, Pseudomonas aeruginosa PA01
ccaucagcaccag

SEQ ID NO: 3444072 - RNA, 22 nt, Pseudomonas aeruginosa PA01
ccaucagcaccaggaagcccca

SEQ ID NO: 3444073 - RNA, 22 nt, Pseudomonas aeruginosa PA01
ccaucagcacgucguccagcgc

SEQ ID NO: 3444074 - RNA, 23 nt, Pseudomonas aeruginosa PA01
ccaucagcacgucguccagcgcc

SEQ ID NO: 3444075 - RNA, 14 nt, Pseudomonas aeruginosa PA01
ccaucagcaguccg

SEQ ID NO: 3444076 - RNA, 15 nt, Pseudomonas aeruginosa PA01
ccaucagcaguccgc

SEQ ID NO: 3444077 - RNA, 16 nt, Pseudomonas aeruginosa PA01
ccaucagccagcccag

SEQ ID NO: 3444078 - RNA, 15 nt, Pseudomonas aeruginosa PA01
ccaucagccgcgcgc

SEQ ID NO: 3444079 - RNA, 12 nt, Pseudomonas aeruginosa PA01
ccaucagcgccg

SEQ ID NO: 3444080 - RNA, 14 nt, Pseudomonas aeruginosa PA01
ccaucagcgccgcc

SEQ ID NO: 3444081 - RNA, 15 nt, Pseudomonas aeruginosa PA01
ccaucagcgccgccu

SEQ ID NO: 3444082 - RNA, 21 nt, Pseudomonas aeruginosa PA01
ccaugcccgcugggcaggugg

SEQ ID NO: 3444083 - RNA, 21 nt, Pseudomonas aeruginosa PA01
ccaugcccuuguccggcccgg

SEQ ID NO: 3444084 - RNA, 22 nt, Pseudomonas aeruginosa PA01
ccaugcccuuguccggcccgga

SEQ ID NO: 3444085 - RNA, 23 nt, Pseudomonas aeruginosa PA01
ccaugccgcaagcuccccgccgc

SEQ ID NO: 3444086 - RNA, 13 nt, Pseudomonas aeruginosa PA01
ccaugccgcccgg

SEQ ID NO: 3444087 - RNA, 15 nt, Pseudomonas aeruginosa PA01
ccaugccgcccggcc

SEQ ID NO: 3444088 - RNA, 18 nt, Pseudomonas aeruginosa PA01
ccaugccgcccggccgcu

SEQ ID NO: 3444089 - RNA, 19 nt, Pseudomonas aeruginosa PA01
ccaugccgcuagcccugcu

SEQ ID NO: 3444090 - RNA, 20 nt, Pseudomonas aeruginosa PA01
ccaugccgcuagcccugcug

SEQ ID NO: 3444091 - RNA, 16 nt, Pseudomonas aeruginosa PA01
ccaugccggcgccgau

SEQ ID NO: 3444092 - RNA, 22 nt, Pseudomonas aeruginosa PA01
ccaugccguacaggucggcgcc

SEQ ID NO: 3444093 - RNA, 20 nt, Pseudomonas aeruginosa PA01
ccaugccguucaggccggcg

SEQ ID NO: 3444094 - RNA, 13 nt, Pseudomonas aeruginosa PA01
ccaugccuccgac

SEQ ID NO: 3444095 - RNA, 12 nt, Pseudomonas aeruginosa PA01
ccaugccuugca

SEQ ID NO: 3444096 - RNA, 17 nt, Pseudomonas aeruginosa PA01
ccaugccuugcagcgcc

SEQ ID NO: 3444097 - RNA, 22 nt, Pseudomonas aeruginosa PA01
ccaugcgaaaacggcgacccug

SEQ ID NO: 3444098 - RNA, 24 nt, Pseudomonas aeruginosa PA01
ccaugcgaaaacggcgacccuggg

SEQ ID NO: 3444099 - RNA, 23 nt, Pseudomonas aeruginosa PA01
ccaugcgcggcaggaaauccgcc

SEQ ID NO: 3444100 - RNA, 18 nt, Pseudomonas aeruginosa PA01
ccaugcggaucgccuccg

SEQ ID NO: 3444101 - RNA, 14 nt, Pseudomonas aeruginosa PA01
ccaugcggcaggcc

SEQ ID NO: 3444102 - RNA, 20 nt, Pseudomonas aeruginosa PA01
ccaugcggcuacucgcccga

SEQ ID NO: 3444103 - RNA, 16 nt, Pseudomonas aeruginosa PA01
ccaugcgguucggcgu

SEQ ID NO: 3444104 - RNA, 18 nt, Pseudomonas aeruginosa PA01
ccaugcguugcggcauga

SEQ ID NO: 3444105 - RNA, 19 nt, Pseudomonas aeruginosa PA01
ccaugcucaggucgaacug

SEQ ID NO: 3444106 - RNA, 16 nt, Pseudomonas aeruginosa PA01
ccaugcuccgccuggc

SEQ ID NO: 3444107 - RNA, 18 nt, Pseudomonas aeruginosa PA01
ccaugcuccgccuggcgg

SEQ ID NO: 3444108 - RNA, 20 nt, Pseudomonas aeruginosa PA01
ccaugcuccgccuggcggau

SEQ ID NO: 3444109 - RNA, 13 nt, Pseudomonas aeruginosa PA01
ccaugcucgccac

SEQ ID NO: 3444110 - RNA, 17 nt, Pseudomonas aeruginosa PA01
ccaugcucggccagcuc

SEQ ID NO: 3444111 - RNA, 20 nt, Pseudomonas aeruginosa PA01
ccaugcucggccagcucgcc

SEQ ID NO: 3444112 - RNA, 21 nt, Pseudomonas aeruginosa PA01
ccaugcucggccagcucgccg

SEQ ID NO: 3444113 - RNA, 14 nt, Pseudomonas aeruginosa PA01
ccaugcucuucagg

SEQ ID NO: 3444114 - RNA, 22 nt, Pseudomonas aeruginosa PA01
ccaugcuguugccguggcggcg

SEQ ID NO: 3444115 - RNA, 13 nt, Pseudomonas aeruginosa PA01
ccauggcagagcu

SEQ ID NO: 3444116 - RNA, 14 nt, Pseudomonas aeruginosa PA01
ccauggcauccccu

SEQ ID NO: 3444117 - RNA, 20 nt, Pseudomonas aeruginosa PA01
ccauggcaugaggggaaucg

SEQ ID NO: 3444118 - RNA, 15 nt, Pseudomonas aeruginosa PA01
ccauggccgagccca

SEQ ID NO: 3444119 - RNA, 16 nt, Pseudomonas aeruginosa PA01
ccauggccgagcccag

SEQ ID NO: 3444120 - RNA, 15 nt, Pseudomonas aeruginosa PA01
ccauggccgcugaaa

SEQ ID NO: 3444121 - RNA, 18 nt, Pseudomonas aeruginosa PA01
ccauggcgacgcauggau

SEQ ID NO: 3444122 - RNA, 13 nt, Pseudomonas aeruginosa PA01
ccauggcgcgaug

SEQ ID NO: 3444123 - RNA, 20 nt, Pseudomonas aeruginosa PA01
ccauggcgcuucaucuccug

SEQ ID NO: 3444124 - RNA, 22 nt, Pseudomonas aeruginosa PA01
ccauggcgcuucaucuccugcu

SEQ ID NO: 3444125 - RNA, 15 nt, Pseudomonas aeruginosa PA01
ccauggcggaucugg

SEQ ID NO: 3444126 - RNA, 17 nt, Pseudomonas aeruginosa PA01
ccauggcguagggcgaa

SEQ ID NO: 3444127 - RNA, 16 nt, Pseudomonas aeruginosa PA01
ccaugggccggccgac

SEQ ID NO: 3444128 - RNA, 19 nt, Pseudomonas aeruginosa PA01
ccaugggcgcguucucccu

SEQ ID NO: 3444129 - RNA, 13 nt, Pseudomonas aeruginosa PA01
ccauggggaucac

SEQ ID NO: 3444130 - RNA, 16 nt, Pseudomonas aeruginosa PA01
ccauggggaucaccgg

SEQ ID NO: 3444131 - RNA, 22 nt, Pseudomonas aeruginosa PA01
ccauggguaucguugaucggcu

SEQ ID NO: 3444132 - RNA, 11 nt, Pseudomonas aeruginosa PA01
ccaugggugga

SEQ ID NO: 3444133 - RNA, 20 nt, Pseudomonas aeruginosa PA01
ccaugggugucggcgaucag

SEQ ID NO: 3444134 - RNA, 18 nt, Pseudomonas aeruginosa PA01
ccauggucguucagcggc

SEQ ID NO: 3444135 - RNA, 16 nt, Pseudomonas aeruginosa PA01
ccauggucuuuccuuu

SEQ ID NO: 3444136 - RNA, 18 nt, Pseudomonas aeruginosa PA01
ccauggugaugcgcaugc

SEQ ID NO: 3444137 - RNA, 21 nt, Pseudomonas aeruginosa PA01
ccauggugaugcgcaugcugg

SEQ ID NO: 3444138 - RNA, 19 nt, Pseudomonas aeruginosa PA01
ccaugguuuaccaggacca

SEQ ID NO: 3444139 - RNA, 22 nt, Pseudomonas aeruginosa PA01
ccaugguuuaccaggaccagcg

SEQ ID NO: 3444140 - RNA, 16 nt, Pseudomonas aeruginosa PA01
ccauguaccucuggcu

SEQ ID NO: 3444141 - RNA, 17 nt, Pseudomonas aeruginosa PA01
ccauguaccucuggcug

SEQ ID NO: 3444142 - RNA, 16 nt, Pseudomonas aeruginosa PA01
ccauguagaccaccag

SEQ ID NO: 3444143 - RNA, 16 nt, Pseudomonas aeruginosa PA01
ccauguccaccacgcg

SEQ ID NO: 3444144 - RNA, 12 nt, Pseudomonas aeruginosa PA01
ccaugucgcugg

SEQ ID NO: 3444145 - RNA, 18 nt, Pseudomonas aeruginosa PA01
ccaugucgcuggccugca

SEQ ID NO: 3444146 - RNA, 20 nt, Pseudomonas aeruginosa PA01
ccauguggcgcagcaucauc

SEQ ID NO: 3444147 - RNA, 17 nt, Pseudomonas aeruginosa PA01
ccauuagcgucgcgcgg

SEQ ID NO: 3444148 - RNA, 16 nt, Pseudomonas aeruginosa PA01
ccauucaggcggauca

SEQ ID NO: 3444149 - RNA, 20 nt, Pseudomonas aeruginosa PA01
ccauucaugggcgcacuccg

SEQ ID NO: 3444150 - RNA, 22 nt, Pseudomonas aeruginosa PA01
ccauuccggaacucuguucguc

SEQ ID NO: 3444151 - RNA, 22 nt, Pseudomonas aeruginosa PA01
ccauuccugggccccggccagg

SEQ ID NO: 3444152 - RNA, 15 nt, Pseudomonas aeruginosa PA01
ccauuccuuccaggg

SEQ ID NO: 3444153 - RNA, 16 nt, Pseudomonas aeruginosa PA01
ccauuccuuccagggu

SEQ ID NO: 3444154 - RNA, 19 nt, Pseudomonas aeruginosa PA01
ccauucgaauggcgccggc

SEQ ID NO: 3444155 - RNA, 17 nt, Pseudomonas aeruginosa PA01
ccauucgaugccgcgcg

SEQ ID NO: 3444156 - RNA, 16 nt, Pseudomonas aeruginosa PA01
ccauucgcugucgagc

SEQ ID NO: 3444157 - RNA, 14 nt, Pseudomonas aeruginosa PA01
ccauucggcuuccu

SEQ ID NO: 3444158 - RNA, 16 nt, Pseudomonas aeruginosa PA01
ccauucggcuuccugg

SEQ ID NO: 3444159 - RNA, 17 nt, Pseudomonas aeruginosa PA01
ccauugacgaaauacuc

SEQ ID NO: 3444160 - RNA, 14 nt, Pseudomonas aeruginosa PA01
ccauugagcgcgcc

SEQ ID NO: 3444161 - RNA, 15 nt, Pseudomonas aeruginosa PA01
ccauugagcgcgccc

SEQ ID NO: 3444162 - RNA, 17 nt, Pseudomonas aeruginosa PA01
ccauugagcgcgcccag

SEQ ID NO: 3444163 - RNA, 21 nt, Pseudomonas aeruginosa PA01
ccauugcagguaguccagcca

SEQ ID NO: 3444164 - RNA, 14 nt, Pseudomonas aeruginosa PA01
ccauugcccggcca

SEQ ID NO: 3444165 - RNA, 14 nt, Pseudomonas aeruginosa PA01
ccauugcggcccgc

SEQ ID NO: 3444166 - RNA, 16 nt, Pseudomonas aeruginosa PA01
ccauugcggcccgcca

SEQ ID NO: 3444167 - RNA, 12 nt, Pseudomonas aeruginosa PA01
ccauuggccgac

SEQ ID NO: 3444168 - RNA, 19 nt, Pseudomonas aeruginosa PA01
ccauuggccgacgccgcug

SEQ ID NO: 3444169 - RNA, 17 nt, Pseudomonas aeruginosa PA01
ccauuguuggcgcucgg

SEQ ID NO: 3444170 - RNA, 15 nt, Pseudomonas aeruginosa PA01
ccauuucccgcgagc

SEQ ID NO: 3444171 - RNA, 16 nt, Pseudomonas aeruginosa PA01
ccauuucguagcccag

SEQ ID NO: 3444172 - RNA, 14 nt, Pseudomonas aeruginosa PA01
cccaaaauccgcau

SEQ ID NO: 3444173 - RNA, 14 nt, Pseudomonas aeruginosa PA01
cccaacagcggugu

SEQ ID NO: 3444174 - RNA, 19 nt, Pseudomonas aeruginosa PA01
cccaacagcggugugcuca

SEQ ID NO: 3444175 - RNA, 14 nt, Pseudomonas aeruginosa PA01
cccaacccggccag

SEQ ID NO: 3444176 - RNA, 13 nt, Pseudomonas aeruginosa PA01
cccaaccuucucc

SEQ ID NO: 3444177 - RNA, 16 nt, Pseudomonas aeruginosa PA01
cccaaccuucucccuu

SEQ ID NO: 3444178 - RNA, 22 nt, Pseudomonas aeruginosa PA01
cccaacggggccuucgggcccc

SEQ ID NO: 3444179 - RNA, 23 nt, Pseudomonas aeruginosa PA01
cccaacgucuucaggcgcuccug

SEQ ID NO: 3444180 - RNA, 20 nt, Pseudomonas aeruginosa PA01
cccaacuggcggaugcguug

SEQ ID NO: 3444181 - RNA, 22 nt, Pseudomonas aeruginosa PA01
cccaacuggcggaugcguugcu

SEQ ID NO: 3444182 - RNA, 12 nt, Pseudomonas aeruginosa PA01
cccaacuggucu

SEQ ID NO: 3444183 - RNA, 15 nt, Pseudomonas aeruginosa PA01
cccaagccgagcggc

SEQ ID NO: 3444184 - RNA, 13 nt, Pseudomonas aeruginosa PA01
cccaaggcacgcc

SEQ ID NO: 3444185 - RNA, 14 nt, Pseudomonas aeruginosa PA01
cccagcaucgccgg

SEQ ID NO: 3444186 - RNA, 22 nt, Pseudomonas aeruginosa PA01
cccagcaucgccggcagcgccg

SEQ ID NO: 3444187 - RNA, 17 nt, Pseudomonas aeruginosa PA01
cccagccagggccgcga

SEQ ID NO: 3444188 - RNA, 23 nt, Pseudomonas aeruginosa PA01
cccagcccagggcgaucgucgag

SEQ ID NO: 3444189 - RNA, 14 nt, Pseudomonas aeruginosa PA01
cccagccccaccgc

SEQ ID NO: 3444190 - RNA, 16 nt, Pseudomonas aeruginosa PA01
cccagccccaccgcca

SEQ ID NO: 3444191 - RNA, 13 nt, Pseudomonas aeruginosa PA01
cccagcccgccuu

SEQ ID NO: 3444192 - RNA, 21 nt, Pseudomonas aeruginosa PA01
cccagcccgccuuccagcuug

SEQ ID NO: 3444193 - RNA, 13 nt, Pseudomonas aeruginosa PA01
cccagcccggcca

SEQ ID NO: 3444194 - RNA, 14 nt, Pseudomonas aeruginosa PA01
cccagcccggccau

SEQ ID NO: 3444195 - RNA, 17 nt, Pseudomonas aeruginosa PA01
cccagccgacgcgcagc

SEQ ID NO: 3444196 - RNA, 13 nt, Pseudomonas aeruginosa PA01
cccagccgaggca

SEQ ID NO: 3444197 - RNA, 17 nt, Pseudomonas aeruginosa PA01
cccagccgcacgccccu

SEQ ID NO: 3444198 - RNA, 15 nt, Pseudomonas aeruginosa PA01
cccagccgcggccgu

SEQ ID NO: 3444199 - RNA, 14 nt, Pseudomonas aeruginosa PA01
cccagccgcggcgc

SEQ ID NO: 3444200 - RNA, 22 nt, Pseudomonas aeruginosa PA01
cccagccggugaaacggaucac

SEQ ID NO: 3444201 - RNA, 23 nt, Pseudomonas aeruginosa PA01
cccagccgugggcguagagccug

SEQ ID NO: 3444202 - RNA, 13 nt, Pseudomonas aeruginosa PA01
cccagccucggca

SEQ ID NO: 3444203 - RNA, 14 nt, Pseudomonas aeruginosa PA01
cccagccucggcag

SEQ ID NO: 3444204 - RNA, 20 nt, Pseudomonas aeruginosa PA01
cccagccucggcagggcgcc

SEQ ID NO: 3444205 - RNA, 13 nt, Pseudomonas aeruginosa PA01
cccagccuugcug

SEQ ID NO: 3444206 - RNA, 22 nt, Pseudomonas aeruginosa PA01
cccagccuugcuggacuucccg

SEQ ID NO: 3444207 - RNA, 17 nt, Pseudomonas aeruginosa PA01
cccagcgaagcuucuuc

SEQ ID NO: 3444208 - RNA, 14 nt, Pseudomonas aeruginosa PA01
cccagcgacuccgc

SEQ ID NO: 3444209 - RNA, 18 nt, Pseudomonas aeruginosa PA01
cccagcgacuccgccagu

SEQ ID NO: 3444210 - RNA, 20 nt, Pseudomonas aeruginosa PA01
cccagcgagccgagcauguc

SEQ ID NO: 3444211 - RNA, 21 nt, Pseudomonas aeruginosa PA01
cccagcgagccgaucaccagc

SEQ ID NO: 3444212 - RNA, 22 nt, Pseudomonas aeruginosa PA01
cccagcgagccgaucaccagca

SEQ ID NO: 3444213 - RNA, 18 nt, Pseudomonas aeruginosa PA01
cccagcgaguagucgcgg

SEQ ID NO: 3444214 - RNA, 22 nt, Pseudomonas aeruginosa PA01
cccagcgaguagucgcggggcg

SEQ ID NO: 3444215 - RNA, 13 nt, Pseudomonas aeruginosa PA01
cccagcgcacgcc

SEQ ID NO: 3444216 - RNA, 15 nt, Pseudomonas aeruginosa PA01
cccagcgcagccugc

SEQ ID NO: 3444217 - RNA, 19 nt, Pseudomonas aeruginosa PA01
cccagcgcagccugcuggc

SEQ ID NO: 3444218 - RNA, 12 nt, Pseudomonas aeruginosa PA01
cccagcgcaucg

SEQ ID NO: 3444219 - RNA, 16 nt, Pseudomonas aeruginosa PA01
cccagcgcaucgcgca

SEQ ID NO: 3444220 - RNA, 17 nt, Pseudomonas aeruginosa PA01
cccagcgcaucgcgcac

SEQ ID NO: 3444221 - RNA, 12 nt, Pseudomonas aeruginosa PA01
cccagcgccccg

SEQ ID NO: 3444222 - RNA, 14 nt, Pseudomonas aeruginosa PA01
cccagcgccccgcc

SEQ ID NO: 3444223 - RNA, 17 nt, Pseudomonas aeruginosa PA01
cccagcgccccgccuac

SEQ ID NO: 3444224 - RNA, 12 nt, Pseudomonas aeruginosa PA01
cccagcgccgcc

SEQ ID NO: 3444225 - RNA, 14 nt, Pseudomonas aeruginosa PA01
cccagcgccgccag

SEQ ID NO: 3444226 - RNA, 15 nt, Pseudomonas aeruginosa PA01
cccagcgccgccagc

SEQ ID NO: 3444227 - RNA, 16 nt, Pseudomonas aeruginosa PA01
cccagcgccgccagca

SEQ ID NO: 3444228 - RNA, 13 nt, Pseudomonas aeruginosa PA01
cccagcgccgccu

SEQ ID NO: 3444229 - RNA, 16 nt, Pseudomonas aeruginosa PA01
cccagcgccgccugcu

SEQ ID NO: 3444230 - RNA, 18 nt, Pseudomonas aeruginosa PA01
cccagcgccgccugcugg

SEQ ID NO: 3444231 - RNA, 17 nt, Pseudomonas aeruginosa PA01
cccagcgccugggccgc

SEQ ID NO: 3444232 - RNA, 13 nt, Pseudomonas aeruginosa PA01
cccagcgcgccgc

SEQ ID NO: 3444233 - RNA, 20 nt, Pseudomonas aeruginosa PA01
cccagcgcgccgccgaggug

SEQ ID NO: 3444234 - RNA, 14 nt, Pseudomonas aeruginosa PA01
cccagcgcggcgcc

SEQ ID NO: 3444235 - RNA, 21 nt, Pseudomonas aeruginosa PA01
cccagcgcggcgccccaggcg

SEQ ID NO: 3444236 - RNA, 12 nt, Pseudomonas aeruginosa PA01
cccagcgcgugc

SEQ ID NO: 3444237 - RNA, 17 nt, Pseudomonas aeruginosa PA01
cccagcgcuuccucggg

SEQ ID NO: 3444238 - RNA, 20 nt, Pseudomonas aeruginosa PA01
cccagcgcuuccucgggcag

SEQ ID NO: 3444239 - RNA, 21 nt, Pseudomonas aeruginosa PA01
cccagcgcuuccucgggcagc

SEQ ID NO: 3444240 - RNA, 14 nt, Pseudomonas aeruginosa PA01
cccagcggaugcgc

SEQ ID NO: 3444241 - RNA, 16 nt, Pseudomonas aeruginosa PA01
cccagcggaugcgcga

SEQ ID NO: 3444242 - RNA, 23 nt, Pseudomonas aeruginosa PA01
cccagcggcaggcacgcugccag

SEQ ID NO: 3444243 - RNA, 19 nt, Pseudomonas aeruginosa PA01
cccagcggcagggcggcga

SEQ ID NO: 3444244 - RNA, 17 nt, Pseudomonas aeruginosa PA01
cccagcggcaggucguu

SEQ ID NO: 3444245 - RNA, 12 nt, Pseudomonas aeruginosa PA01
cccagcggcgcc

SEQ ID NO: 3444246 - RNA, 17 nt, Pseudomonas aeruginosa PA01
cccagcggcgccagcuc

SEQ ID NO: 3444247 - RNA, 13 nt, Pseudomonas aeruginosa PA01
cccagcggcgccu

SEQ ID NO: 3444248 - RNA, 15 nt, Pseudomonas aeruginosa PA01
cccagcggcgcggcg

SEQ ID NO: 3444249 - RNA, 21 nt, Pseudomonas aeruginosa PA01
cccagcggcgcggcguaccag

SEQ ID NO: 3444250 - RNA, 14 nt, Pseudomonas aeruginosa PA01
cccagcggcuggcg

SEQ ID NO: 3444251 - RNA, 14 nt, Pseudomonas aeruginosa PA01
cccagcgggcaacc

SEQ ID NO: 3444252 - RNA, 19 nt, Pseudomonas aeruginosa PA01
cccagcgggcggucgcgga

SEQ ID NO: 3444253 - RNA, 13 nt, Pseudomonas aeruginosa PA01
cccagcguggcca

SEQ ID NO: 3444254 - RNA, 17 nt, Pseudomonas aeruginosa PA01
cccagcguggccagcga

SEQ ID NO: 3444255 - RNA, 18 nt, Pseudomonas aeruginosa PA01
cccagcguucggcgcugg

SEQ ID NO: 3444256 - RNA, 23 nt, Pseudomonas aeruginosa PA01
cccagcguucggcgcuggcgcgg

SEQ ID NO: 3444257 - RNA, 17 nt, Pseudomonas aeruginosa PA01
cccagcguuguccucgg

SEQ ID NO: 3444258 - RNA, 22 nt, Pseudomonas aeruginosa PA01
cccagcguuguccucggcggcu

SEQ ID NO: 3444259 - RNA, 14 nt, Pseudomonas aeruginosa PA01
cccagcucagcagg

SEQ ID NO: 3444260 - RNA, 16 nt, Pseudomonas aeruginosa PA01
cccagcucagcagguc

SEQ ID NO: 3444261 - RNA, 18 nt, Pseudomonas aeruginosa PA01
cccagcucguccaggcaa

SEQ ID NO: 3444262 - RNA, 15 nt, Pseudomonas aeruginosa PA01
cccagcuugcuggcg

SEQ ID NO: 3444263 - RNA, 16 nt, Pseudomonas aeruginosa PA01
cccagcuugcuggcgu

SEQ ID NO: 3444264 - RNA, 19 nt, Pseudomonas aeruginosa PA01
cccaggacaacgacagccc

SEQ ID NO: 3444265 - RNA, 18 nt, Pseudomonas aeruginosa PA01
cccaggcaacggagcugg

SEQ ID NO: 3444266 - RNA, 20 nt, Pseudomonas aeruginosa PA01
cccaggcaccguaggccagg

SEQ ID NO: 3444267 - RNA, 21 nt, Pseudomonas aeruginosa PA01
cccaggcaccguaggccaggc

SEQ ID NO: 3444268 - RNA, 13 nt, Pseudomonas aeruginosa PA01
cccaggcagaucg

SEQ ID NO: 3444269 - RNA, 21 nt, Pseudomonas aeruginosa PA01
cccaggcagcagagcgccacg

SEQ ID NO: 3444270 - RNA, 12 nt, Pseudomonas aeruginosa PA01
cccaggccaacc

SEQ ID NO: 3444271 - RNA, 15 nt, Pseudomonas aeruginosa PA01
cccaggccacgccca

SEQ ID NO: 3444272 - RNA, 14 nt, Pseudomonas aeruginosa PA01
cccaggcccagccg

SEQ ID NO: 3444273 - RNA, 18 nt, Pseudomonas aeruginosa PA01
cccaggcccagccgguga

SEQ ID NO: 3444274 - RNA, 15 nt, Pseudomonas aeruginosa PA01
cccaggccgaaggcc

SEQ ID NO: 3444275 - RNA, 21 nt, Pseudomonas aeruginosa PA01
cccaggccgcccuugacccca

SEQ ID NO: 3444276 - RNA, 12 nt, Pseudomonas aeruginosa PA01
cccaggccgccg

SEQ ID NO: 3444277 - RNA, 14 nt, Pseudomonas aeruginosa PA01
cccaggccgccgau

SEQ ID NO: 3444278 - RNA, 13 nt, Pseudomonas aeruginosa PA01
cccaggccgccgc

SEQ ID NO: 3444279 - RNA, 13 nt, Pseudomonas aeruginosa PA01
cccaggccgcgca

SEQ ID NO: 3444280 - RNA, 19 nt, Pseudomonas aeruginosa PA01
cccaggccgcgcagcaacg

SEQ ID NO: 3444281 - RNA, 17 nt, Pseudomonas aeruginosa PA01
cccaggccgcuggcggc

SEQ ID NO: 3444282 - RNA, 19 nt, Pseudomonas aeruginosa PA01
cccaggccgcuggcggcga

SEQ ID NO: 3444283 - RNA, 17 nt, Pseudomonas aeruginosa PA01
cccaggccgggucgcag

SEQ ID NO: 3444284 - RNA, 14 nt, Pseudomonas aeruginosa PA01
cccaggccugggug

SEQ ID NO: 3444285 - RNA, 14 nt, Pseudomonas aeruginosa PA01
cccaggcgacgcug

SEQ ID NO: 3444286 - RNA, 12 nt, Pseudomonas aeruginosa PA01
cccaggcgaucc

SEQ ID NO: 3444287 - RNA, 20 nt, Pseudomonas aeruginosa PA01
cccaggcgauccacagcagg

SEQ ID NO: 3444288 - RNA, 14 nt, Pseudomonas aeruginosa PA01
cccaggcgcaccuc

SEQ ID NO: 3444289 - RNA, 18 nt, Pseudomonas aeruginosa PA01
ccccacaggcccugcagc

SEQ ID NO: 3444290 - RNA, 22 nt, Pseudomonas aeruginosa PA01
ccccacaggcccugcagcgcca

SEQ ID NO: 3444291 - RNA, 13 nt, Pseudomonas aeruginosa PA01
ccccacccguccc

SEQ ID NO: 3444292 - RNA, 15 nt, Pseudomonas aeruginosa PA01
ccccacccgucccgc

SEQ ID NO: 3444293 - RNA, 22 nt, Pseudomonas aeruginosa PA01
ccccaccggucuuggcgcgcga

SEQ ID NO: 3444294 - RNA, 14 nt, Pseudomonas aeruginosa PA01
ccccacggcgcggc

SEQ ID NO: 3444295 - RNA, 15 nt, Pseudomonas aeruginosa PA01
ccccacggcgcggcc

SEQ ID NO: 3444296 - RNA, 13 nt, Pseudomonas aeruginosa PA01
ccccacgggcgac

SEQ ID NO: 3444297 - RNA, 21 nt, Pseudomonas aeruginosa PA01
ccccacgguagagacggcggc

SEQ ID NO: 3444298 - RNA, 23 nt, Pseudomonas aeruginosa PA01
ccccacgucguuucucggcgaug

SEQ ID NO: 3444299 - RNA, 14 nt, Pseudomonas aeruginosa PA01
ccccacucggccag

SEQ ID NO: 3444300 - RNA, 22 nt, Pseudomonas aeruginosa PA01
ccccacuuccggcccggccagg

SEQ ID NO: 3444301 - RNA, 17 nt, Pseudomonas aeruginosa PA01
ccccacuucgagaguga

SEQ ID NO: 3444302 - RNA, 16 nt, Pseudomonas aeruginosa PA01
ccccagagcccgccga

SEQ ID NO: 3444303 - RNA, 18 nt, Pseudomonas aeruginosa PA01
ccccagaucgccagcgcc

SEQ ID NO: 3444304 - RNA, 14 nt, Pseudomonas aeruginosa PA01
ccccagcaccugga

SEQ ID NO: 3444305 - RNA, 20 nt, Pseudomonas aeruginosa PA01
ccccagcaucgccggcagcg

SEQ ID NO: 3444306 - RNA, 20 nt, Pseudomonas aeruginosa PA01
ccccagcccggccauccugg

SEQ ID NO: 3444307 - RNA, 15 nt, Pseudomonas aeruginosa PA01
ccccagccucggcag

SEQ ID NO: 3444308 - RNA, 13 nt, Pseudomonas aeruginosa PA01
ccccagcgccugg

SEQ ID NO: 3444309 - RNA, 13 nt, Pseudomonas aeruginosa PA01
ccccagcggcagg

SEQ ID NO: 3444310 - RNA, 14 nt, Pseudomonas aeruginosa PA01
ccccagcggcaggc

SEQ ID NO: 3444311 - RNA, 23 nt, Pseudomonas aeruginosa PA01
ccccagcggcaggcacgcugcca

SEQ ID NO: 3444312 - RNA, 21 nt, Pseudomonas aeruginosa PA01
ccccaggcaccguaggccagg

SEQ ID NO: 3444313 - RNA, 18 nt, Pseudomonas aeruginosa PA01
ccccaggccgcccuugac

SEQ ID NO: 3444314 - RNA, 23 nt, Pseudomonas aeruginosa PA01
ccccaggccgcccuugaccccac

SEQ ID NO: 3444315 - RNA, 18 nt, Pseudomonas aeruginosa PA01
ccccaggcgauccacagc

SEQ ID NO: 3444316 - RNA, 14 nt, Pseudomonas aeruginosa PA01
ccccaggcgcccag

SEQ ID NO: 3444317 - RNA, 15 nt, Pseudomonas aeruginosa PA01
ccccaggcgcccagg

SEQ ID NO: 3444318 - RNA, 17 nt, Pseudomonas aeruginosa PA01
ccccaggcgcccaggca

SEQ ID NO: 3444319 - RNA, 18 nt, Pseudomonas aeruginosa PA01
ccccaggcgcccaggcag

SEQ ID NO: 3444320 - RNA, 13 nt, Pseudomonas aeruginosa PA01
ccccaggcgcggc

SEQ ID NO: 3444321 - RNA, 13 nt, Pseudomonas aeruginosa PA01
ccccaggcugccc

SEQ ID NO: 3444322 - RNA, 15 nt, Pseudomonas aeruginosa PA01
ccccagggccggcgc

SEQ ID NO: 3444323 - RNA, 16 nt, Pseudomonas aeruginosa PA01
ccccagggccggcgcc

SEQ ID NO: 3444324 - RNA, 17 nt, Pseudomonas aeruginosa PA01
ccccagggccggcgccc

SEQ ID NO: 3444325 - RNA, 21 nt, Pseudomonas aeruginosa PA01
ccccagggccggcgcccuucg

SEQ ID NO: 3444326 - RNA, 20 nt, Pseudomonas aeruginosa PA01
ccccagguaggcgaaggcga

SEQ ID NO: 3444327 - RNA, 21 nt, Pseudomonas aeruginosa PA01
ccccagguaggcgaaggcgau

SEQ ID NO: 3444328 - RNA, 18 nt, Pseudomonas aeruginosa PA01
ccccaggugcagcgaggg

SEQ ID NO: 3444329 - RNA, 16 nt, Pseudomonas aeruginosa PA01
ccccaguagcgcuucg

SEQ ID NO: 3444330 - RNA, 22 nt, Pseudomonas aeruginosa PA01
ccccaguagcgcuucgcgcagc

SEQ ID NO: 3444331 - RNA, 22 nt, Pseudomonas aeruginosa PA01
ccccaguccucguacaugcgcg

SEQ ID NO: 3444332 - RNA, 23 nt, Pseudomonas aeruginosa PA01
ccccaguccucguacaugcgcga

SEQ ID NO: 3444333 - RNA, 16 nt, Pseudomonas aeruginosa PA01
ccccauccgcaguacg

SEQ ID NO: 3444334 - RNA, 19 nt, Pseudomonas aeruginosa PA01
ccccaugaaaaaggccggu

SEQ ID NO: 3444335 - RNA, 16 nt, Pseudomonas aeruginosa PA01
ccccauguaccucugg

SEQ ID NO: 3444336 - RNA, 19 nt, Pseudomonas aeruginosa PA01
ccccauguaccucuggcug

SEQ ID NO: 3444337 - RNA, 14 nt, Pseudomonas aeruginosa PA01
cccccaccgccccc

SEQ ID NO: 3444338 - RNA, 14 nt, Pseudomonas aeruginosa PA01
cccccaccgggcca

SEQ ID NO: 3444339 - RNA, 18 nt, Pseudomonas aeruginosa PA01
cccccagcaccuggacga

SEQ ID NO: 3444340 - RNA, 12 nt, Pseudomonas aeruginosa PA01
cccccagcgccc

SEQ ID NO: 3444341 - RNA, 20 nt, Pseudomonas aeruginosa PA01
cccccaggcaccguaggcca

SEQ ID NO: 3444342 - RNA, 14 nt, Pseudomonas aeruginosa PA01
cccccaucgcccgc

SEQ ID NO: 3444343 - RNA, 13 nt, Pseudomonas aeruginosa PA01
cccccgccccuca

SEQ ID NO: 3444344 - RNA, 18 nt, Pseudomonas aeruginosa PA01
cccccgccccucacuccg

SEQ ID NO: 3444345 - RNA, 12 nt, Pseudomonas aeruginosa PA01
cccccgccggcc

SEQ ID NO: 3444346 - RNA, 14 nt, Pseudomonas aeruginosa PA01
cccccgccggccgg

SEQ ID NO: 3444347 - RNA, 20 nt, Pseudomonas aeruginosa PA01
cccccggcaacacccucccu

SEQ ID NO: 3444348 - RNA, 14 nt, Pseudomonas aeruginosa PA01
cccccggcgccacc

SEQ ID NO: 3444349 - RNA, 15 nt, Pseudomonas aeruginosa PA01
cccccggcgcccaga

SEQ ID NO: 3444350 - RNA, 20 nt, Pseudomonas aeruginosa PA01
cccccgggaugcccggccgc

SEQ ID NO: 3444351 - RNA, 13 nt, Pseudomonas aeruginosa PA01
cccccugccgccc

SEQ ID NO: 3444352 - RNA, 12 nt, Pseudomonas aeruginosa PA01
cccccugcgcgg

SEQ ID NO: 3444353 - RNA, 12 nt, Pseudomonas aeruginosa PA01
cccccuguuucg

SEQ ID NO: 3444354 - RNA, 23 nt, Pseudomonas aeruginosa PA01
cccccuuuuucggcgcggaccgc

SEQ ID NO: 3444355 - RNA, 15 nt, Pseudomonas aeruginosa PA01
ccccgaaaccggcga

SEQ ID NO: 3444356 - RNA, 17 nt, Pseudomonas aeruginosa PA01
ccccgaaaccggcgaug

SEQ ID NO: 3444357 - RNA, 13 nt, Pseudomonas aeruginosa PA01
ccccgaacuuccc

SEQ ID NO: 3444358 - RNA, 15 nt, Pseudomonas aeruginosa PA01
ccccgaccacccugu

SEQ ID NO: 3444359 - RNA, 12 nt, Pseudomonas aeruginosa PA01
ccccgaccagcg

SEQ ID NO: 3444360 - RNA, 12 nt, Pseudomonas aeruginosa PA01
ccccgaccaggu

SEQ ID NO: 3444361 - RNA, 22 nt, Pseudomonas aeruginosa PA01
ccccgaccaggucgcuggcacc

SEQ ID NO: 3444362 - RNA, 16 nt, Pseudomonas aeruginosa PA01
ccccgagaaaacccug

SEQ ID NO: 3444363 - RNA, 16 nt, Pseudomonas aeruginosa PA01
ccccgagcccggccgg

SEQ ID NO: 3444364 - RNA, 18 nt, Pseudomonas aeruginosa PA01
ccccgagcggcgcgaagu

SEQ ID NO: 3444365 - RNA, 15 nt, Pseudomonas aeruginosa PA01
ccccgaggucggcga

SEQ ID NO: 3444366 - RNA, 11 nt, Pseudomonas aeruginosa PA01
ccccgaucacc

SEQ ID NO: 3444367 - RNA, 19 nt, Pseudomonas aeruginosa PA01
ccccgcaaccgcugccgcc

SEQ ID NO: 3444368 - RNA, 14 nt, Pseudomonas aeruginosa PA01
ccccgcaccugccg

SEQ ID NO: 3444369 - RNA, 12 nt, Pseudomonas aeruginosa PA01
ccccgcagccgc

SEQ ID NO: 3444370 - RNA, 16 nt, Pseudomonas aeruginosa PA01
ccccgcauccuccacc

SEQ ID NO: 3444371 - RNA, 18 nt, Pseudomonas aeruginosa PA01
ccccgccacuuccagcac

SEQ ID NO: 3444372 - RNA, 17 nt, Pseudomonas aeruginosa PA01
ccccgccccucacuccg

SEQ ID NO: 3444373 - RNA, 11 nt, Pseudomonas aeruginosa PA01
ccccgccgacu

SEQ ID NO: 3444374 - RNA, 12 nt, Pseudomonas aeruginosa PA01
ccccgccgccag

SEQ ID NO: 3444375 - RNA, 12 nt, Pseudomonas aeruginosa PA01
ccccgccgcuga

SEQ ID NO: 3444376 - RNA, 13 nt, Pseudomonas aeruginosa PA01
ccccgccggccgg

SEQ ID NO: 3444377 - RNA, 12 nt, Pseudomonas aeruginosa PA01
ccccgccggcgu

SEQ ID NO: 3444378 - RNA, 15 nt, Pseudomonas aeruginosa PA01
ccccgccggcguucg

SEQ ID NO: 3444379 - RNA, 17 nt, Pseudomonas aeruginosa PA01
ccccgccgggagcggcc

SEQ ID NO: 3444380 - RNA, 19 nt, Pseudomonas aeruginosa PA01
ccccgccgggagcggccgu

SEQ ID NO: 3444381 - RNA, 22 nt, Pseudomonas aeruginosa PA01
ccccgccggggcgugcaggccg

SEQ ID NO: 3444382 - RNA, 13 nt, Pseudomonas aeruginosa PA01
ccccgcgccgccg

SEQ ID NO: 3444383 - RNA, 15 nt, Pseudomonas aeruginosa PA01
ccccgcgccgccgga

SEQ ID NO: 3444384 - RNA, 12 nt, Pseudomonas aeruginosa PA01
ccccgcggccga

SEQ ID NO: 3444385 - RNA, 20 nt, Pseudomonas aeruginosa PA01
ccccgcgguacccggcaggg

SEQ ID NO: 3444386 - RNA, 17 nt, Pseudomonas aeruginosa PA01
ccccgcuacccugcccc

SEQ ID NO: 3444387 - RNA, 23 nt, Pseudomonas aeruginosa PA01
ccccgcucccgcggcccaagggc

SEQ ID NO: 3444388 - RNA, 15 nt, Pseudomonas aeruginosa PA01
ccccgcuucggcggg

SEQ ID NO: 3444389 - RNA, 13 nt, Pseudomonas aeruginosa PA01
ccccggaccggcu

SEQ ID NO: 3444390 - RNA, 16 nt, Pseudomonas aeruginosa PA01
ccccggaccggcucuc

SEQ ID NO: 3444391 - RNA, 15 nt, Pseudomonas aeruginosa PA01
ccccggacugcccga

SEQ ID NO: 3444392 - RNA, 16 nt, Pseudomonas aeruginosa PA01
ccccggcaagggccug

SEQ ID NO: 3444393 - RNA, 22 nt, Pseudomonas aeruginosa PA01
cccgacgcccuccagcaccgcc

SEQ ID NO: 3444394 - RNA, 13 nt, Pseudomonas aeruginosa PA01
cccgacgccgccc

SEQ ID NO: 3444395 - RNA, 13 nt, Pseudomonas aeruginosa PA01
cccgacugcagcg

SEQ ID NO: 3444396 - RNA, 15 nt, Pseudomonas aeruginosa PA01
cccgacugucgugcc

SEQ ID NO: 3444397 - RNA, 21 nt, Pseudomonas aeruginosa PA01
cccgacugucgugccuccagc

SEQ ID NO: 3444398 - RNA, 18 nt, Pseudomonas aeruginosa PA01
cccgagaaaacccuggga

SEQ ID NO: 3444399 - RNA, 22 nt, Pseudomonas aeruginosa PA01
cccgagacuugaucgcacggcg

SEQ ID NO: 3444400 - RNA, 12 nt, Pseudomonas aeruginosa PA01
cccgagcaccgg

SEQ ID NO: 3444401 - RNA, 21 nt, Pseudomonas aeruginosa PA01
cccgagcaccggccucaagca

SEQ ID NO: 3444402 - RNA, 13 nt, Pseudomonas aeruginosa PA01
cccgagcaggcug

SEQ ID NO: 3444403 - RNA, 13 nt, Pseudomonas aeruginosa PA01
cccgagcggcgcg

SEQ ID NO: 3444404 - RNA, 16 nt, Pseudomonas aeruginosa PA01
cccgagcgggccgagg

SEQ ID NO: 3444405 - RNA, 19 nt, Pseudomonas aeruginosa PA01
cccgagcuuugcgcagcca

SEQ ID NO: 3444406 - RNA, 19 nt, Pseudomonas aeruginosa PA01
cccgaggccagcaggccgu

SEQ ID NO: 3444407 - RNA, 15 nt, Pseudomonas aeruginosa PA01
cccgaggcgacgccc

SEQ ID NO: 3444408 - RNA, 22 nt, Pseudomonas aeruginosa PA01
cccgaggcgacgcccuguucgg

SEQ ID NO: 3444409 - RNA, 14 nt, Pseudomonas aeruginosa PA01
cccgaggcgaucgc

SEQ ID NO: 3444410 - RNA, 21 nt, Pseudomonas aeruginosa PA01
cccgaggcgaucgccgcggcg

SEQ ID NO: 3444411 - RNA, 23 nt, Pseudomonas aeruginosa PA01
cccgaggcgaucgccgcggcgaa

SEQ ID NO: 3444412 - RNA, 21 nt, Pseudomonas aeruginosa PA01
cccgaggcguuauccgccgau

SEQ ID NO: 3444413 - RNA, 23 nt, Pseudomonas aeruginosa PA01
cccgagggucgccuugaccagcg

SEQ ID NO: 3444414 - RNA, 20 nt, Pseudomonas aeruginosa PA01
cccgagucccuugcggcaga

SEQ ID NO: 3444415 - RNA, 21 nt, Pseudomonas aeruginosa PA01
cccgagucccuugcggcagac

SEQ ID NO: 3444416 - RNA, 16 nt, Pseudomonas aeruginosa PA01
cccgagugcgcccagc

SEQ ID NO: 3444417 - RNA, 17 nt, Pseudomonas aeruginosa PA01
cccgagugcgcccagca

SEQ ID NO: 3444418 - RNA, 18 nt, Pseudomonas aeruginosa PA01
cccgagugcgcccagcag

SEQ ID NO: 3444419 - RNA, 19 nt, Pseudomonas aeruginosa PA01
cccgagugcgcccagcagc

SEQ ID NO: 3444420 - RNA, 20 nt, Pseudomonas aeruginosa PA01
cccgaguucaccaccccgaa

SEQ ID NO: 3444421 - RNA, 12 nt, Pseudomonas aeruginosa PA01
cccgaucgccuc

SEQ ID NO: 3444422 - RNA, 15 nt, Pseudomonas aeruginosa PA01
cccgaucgccucggc

SEQ ID NO: 3444423 - RNA, 17 nt, Pseudomonas aeruginosa PA01
cccgaugaucgagcgca

SEQ ID NO: 3444424 - RNA, 15 nt, Pseudomonas aeruginosa PA01
cccgaugccgcgccg

SEQ ID NO: 3444425 - RNA, 16 nt, Pseudomonas aeruginosa PA01
cccgaugccgcgccgg

SEQ ID NO: 3444426 - RNA, 15 nt, Pseudomonas aeruginosa PA01
cccgauuccgcgcac

SEQ ID NO: 3444427 - RNA, 19 nt, Pseudomonas aeruginosa PA01
cccgauugggcgcguuuuu

SEQ ID NO: 3444428 - RNA, 12 nt, Pseudomonas aeruginosa PA01
cccgcaaccgca

SEQ ID NO: 3444429 - RNA, 24 nt, Pseudomonas aeruginosa PA01
cccgcaaccgcagacuccggcgca

SEQ ID NO: 3444430 - RNA, 16 nt, Pseudomonas aeruginosa PA01
cccgcaaccgcugccg

SEQ ID NO: 3444431 - RNA, 19 nt, Pseudomonas aeruginosa PA01
cccgcaaccgcugccgccg

SEQ ID NO: 3444432 - RNA, 18 nt, Pseudomonas aeruginosa PA01
cccgcaaggugcgggccg

SEQ ID NO: 3444433 - RNA, 13 nt, Pseudomonas aeruginosa PA01
cccgcaccagcca

SEQ ID NO: 3444434 - RNA, 15 nt, Pseudomonas aeruginosa PA01
cccgcaccagccagc

SEQ ID NO: 3444435 - RNA, 13 nt, Pseudomonas aeruginosa PA01
cccgcaccagccg

SEQ ID NO: 3444436 - RNA, 15 nt, Pseudomonas aeruginosa PA01
cccgcaccggcgcgc

SEQ ID NO: 3444437 - RNA, 13 nt, Pseudomonas aeruginosa PA01
cccgcaccugccg

SEQ ID NO: 3444438 - RNA, 17 nt, Pseudomonas aeruginosa PA01
cccgcaccugccgucac

SEQ ID NO: 3444439 - RNA, 14 nt, Pseudomonas aeruginosa PA01
cccgcaccuugccc

SEQ ID NO: 3444440 - RNA, 22 nt, Pseudomonas aeruginosa PA01
cccgcaccuugcccugcaucac

SEQ ID NO: 3444441 - RNA, 21 nt, Pseudomonas aeruginosa PA01
cccgcacuuuaccccgauugc

SEQ ID NO: 3444442 - RNA, 21 nt, Pseudomonas aeruginosa PA01
cccgcagccacaggcgccagu

SEQ ID NO: 3444443 - RNA, 17 nt, Pseudomonas aeruginosa PA01
cccgcagccccgccgga

SEQ ID NO: 3444444 - RNA, 14 nt, Pseudomonas aeruginosa PA01
cccgcagcggcagc

SEQ ID NO: 3444445 - RNA, 15 nt, Pseudomonas aeruginosa PA01
cccgcagcggcagcg

SEQ ID NO: 3444446 - RNA, 13 nt, Pseudomonas aeruginosa PA01
cccgcagcggcgc

SEQ ID NO: 3444447 - RNA, 14 nt, Pseudomonas aeruginosa PA01
cccgcagcggcgcu

SEQ ID NO: 3444448 - RNA, 13 nt, Pseudomonas aeruginosa PA01
cccgcaggccggc

SEQ ID NO: 3444449 - RNA, 14 nt, Pseudomonas aeruginosa PA01
cccgcaggccggcc

SEQ ID NO: 3444450 - RNA, 16 nt, Pseudomonas aeruginosa PA01
cccgcaggccggccag

SEQ ID NO: 3444451 - RNA, 17 nt, Pseudomonas aeruginosa PA01
cccgcaggccggccagg

SEQ ID NO: 3444452 - RNA, 17 nt, Pseudomonas aeruginosa PA01
cccgcagggcucgugcc

SEQ ID NO: 3444453 - RNA, 23 nt, Pseudomonas aeruginosa PA01
cccgcaggguccauggaccgaga

SEQ ID NO: 3444454 - RNA, 16 nt, Pseudomonas aeruginosa PA01
cccgcaguacuucgag

SEQ ID NO: 3444455 - RNA, 19 nt, Pseudomonas aeruginosa PA01
cccgcaguagcucgccgag

SEQ ID NO: 3444456 - RNA, 16 nt, Pseudomonas aeruginosa PA01
cccgcaguuccucgcc

SEQ ID NO: 3444457 - RNA, 13 nt, Pseudomonas aeruginosa PA01
cccgcaguuccuu

SEQ ID NO: 3444458 - RNA, 23 nt, Pseudomonas aeruginosa PA01
cccgcaguuccuugggcaucgag

SEQ ID NO: 3444459 - RNA, 13 nt, Pseudomonas aeruginosa PA01
cccgcaucgaggc

SEQ ID NO: 3444460 - RNA, 15 nt, Pseudomonas aeruginosa PA01
cccgcaucgaggccg

SEQ ID NO: 3444461 - RNA, 16 nt, Pseudomonas aeruginosa PA01
cccgcaucgaggccgc

SEQ ID NO: 3444462 - RNA, 18 nt, Pseudomonas aeruginosa PA01
cccgcaucgaggccgccc

SEQ ID NO: 3444463 - RNA, 20 nt, Pseudomonas aeruginosa PA01
cccgcaucgaggccgcccag

SEQ ID NO: 3444464 - RNA, 12 nt, Pseudomonas aeruginosa PA01
cccgcaucgcgg

SEQ ID NO: 3444465 - RNA, 23 nt, Pseudomonas aeruginosa PA01
cccgcaugaacgccucgccaacc

SEQ ID NO: 3444466 - RNA, 17 nt, Pseudomonas aeruginosa PA01
cccgcauugcggggcgu

SEQ ID NO: 3444467 - RNA, 17 nt, Pseudomonas aeruginosa PA01
cccgccaacguccucga

SEQ ID NO: 3444468 - RNA, 19 nt, Pseudomonas aeruginosa PA01
cccgccacagaucgccagc

SEQ ID NO: 3444469 - RNA, 21 nt, Pseudomonas aeruginosa PA01
cccgccaccgacccucggcga

SEQ ID NO: 3444470 - RNA, 13 nt, Pseudomonas aeruginosa PA01
cccgccaccuggc

SEQ ID NO: 3444471 - RNA, 16 nt, Pseudomonas aeruginosa PA01
cccgccacuuccagca

SEQ ID NO: 3444472 - RNA, 22 nt, Pseudomonas aeruginosa PA01
cccgccacuuccagcacgccga

SEQ ID NO: 3444473 - RNA, 12 nt, Pseudomonas aeruginosa PA01
cccgccagcaag

SEQ ID NO: 3444474 - RNA, 14 nt, Pseudomonas aeruginosa PA01
cccgccagcaggcg

SEQ ID NO: 3444475 - RNA, 19 nt, Pseudomonas aeruginosa PA01
cccgccagcaggcgccggc

SEQ ID NO: 3444476 - RNA, 13 nt, Pseudomonas aeruginosa PA01
cccgccagcggca

SEQ ID NO: 3444477 - RNA, 14 nt, Pseudomonas aeruginosa PA01
cccgccaggcgccg

SEQ ID NO: 3444478 - RNA, 21 nt, Pseudomonas aeruginosa PA01
cccgccccgaaaaaaaaggcc

SEQ ID NO: 3444479 - RNA, 12 nt, Pseudomonas aeruginosa PA01
cccgcccgccgu

SEQ ID NO: 3444480 - RNA, 20 nt, Pseudomonas aeruginosa PA01
cccgcccgccguccuccagc

SEQ ID NO: 3444481 - RNA, 16 nt, Pseudomonas aeruginosa PA01
cccgcccggcaccacc

SEQ ID NO: 3444482 - RNA, 22 nt, Pseudomonas aeruginosa PA01
cccgcccggcucaacugcuuac

SEQ ID NO: 3444483 - RNA, 23 nt, Pseudomonas aeruginosa PA01
cccgcccggucucagccggcgcu

SEQ ID NO: 3444484 - RNA, 18 nt, Pseudomonas aeruginosa PA01
cccgcccuuggcggcgcc

SEQ ID NO: 3444485 - RNA, 18 nt, Pseudomonas aeruginosa PA01
cccgccgaccagcacggc

SEQ ID NO: 3444486 - RNA, 19 nt, Pseudomonas aeruginosa PA01
cccgccgaccagcacggcg

SEQ ID NO: 3444487 - RNA, 21 nt, Pseudomonas aeruginosa PA01
cccgccgaggaagccgaccgg

SEQ ID NO: 3444488 - RNA, 22 nt, Pseudomonas aeruginosa PA01
cccgccgaggaagccgaccggc

SEQ ID NO: 3444489 - RNA, 23 nt, Pseudomonas aeruginosa PA01
cccgccgaggaagccgaccggcg

SEQ ID NO: 3444490 - RNA, 12 nt, Pseudomonas aeruginosa PA01
cccgccgccagg

SEQ ID NO: 3444491 - RNA, 21 nt, Pseudomonas aeruginosa PA01
cccgccgccaggcgcuggcga

SEQ ID NO: 3444492 - RNA, 13 nt, Pseudomonas aeruginosa PA01
cccgccgccgcgc

SEQ ID NO: 3444493 - RNA, 14 nt, Pseudomonas aeruginosa PA01
cccgccgccgcgcc

SEQ ID NO: 3444494 - RNA, 16 nt, Pseudomonas aeruginosa PA01
cccgccgcgagcgccg

SEQ ID NO: 3444495 - RNA, 12 nt, Pseudomonas aeruginosa PA01
cccgccgcgcau

SEQ ID NO: 3444496 - RNA, 13 nt, Pseudomonas aeruginosa PA01
cccgcugcgcugc

SEQ ID NO: 3444497 - RNA, 15 nt, Pseudomonas aeruginosa PA01
cccgcugcgcugcca

SEQ ID NO: 3444498 - RNA, 21 nt, Pseudomonas aeruginosa PA01
cccgcuggcccaacagcggug

SEQ ID NO: 3444499 - RNA, 16 nt, Pseudomonas aeruginosa PA01
cccgcuguccgccggc

SEQ ID NO: 3444500 - RNA, 12 nt, Pseudomonas aeruginosa PA01
cccgcuucggcc

SEQ ID NO: 3444501 - RNA, 20 nt, Pseudomonas aeruginosa PA01
cccgcuugccgucgaccugc

SEQ ID NO: 3444502 - RNA, 17 nt, Pseudomonas aeruginosa PA01
cccgcuugcgccgccuc

SEQ ID NO: 3444503 - RNA, 18 nt, Pseudomonas aeruginosa PA01
cccgcuuuccccggcggc

SEQ ID NO: 3444504 - RNA, 20 nt, Pseudomonas aeruginosa PA01
cccggaaagguucacgcagu

SEQ ID NO: 3444505 - RNA, 13 nt, Pseudomonas aeruginosa PA01
cccggaaccaccg

SEQ ID NO: 3444506 - RNA, 16 nt, Pseudomonas aeruginosa PA01
cccggaccagggcgcc

SEQ ID NO: 3444507 - RNA, 16 nt, Pseudomonas aeruginosa PA01
cccggaccuuguccag

SEQ ID NO: 3444508 - RNA, 17 nt, Pseudomonas aeruginosa PA01
cccggaccuuguccagg

SEQ ID NO: 3444509 - RNA, 19 nt, Pseudomonas aeruginosa PA01
cccggacgacgaaagaagc

SEQ ID NO: 3444510 - RNA, 15 nt, Pseudomonas aeruginosa PA01
cccggacgggugcgc

SEQ ID NO: 3444511 - RNA, 19 nt, Pseudomonas aeruginosa PA01
cccggacgggugcgcgcca

SEQ ID NO: 3444512 - RNA, 20 nt, Pseudomonas aeruginosa PA01
cccggacgggugcgcgccac

SEQ ID NO: 3444513 - RNA, 16 nt, Pseudomonas aeruginosa PA01
cccggagaccgugccg

SEQ ID NO: 3444514 - RNA, 21 nt, Pseudomonas aeruginosa PA01
cccggagaccgugccgccggg

SEQ ID NO: 3444515 - RNA, 20 nt, Pseudomonas aeruginosa PA01
cccggagaucgccgcgccgu

SEQ ID NO: 3444516 - RNA, 19 nt, Pseudomonas aeruginosa PA01
cccggagcgcgaaagcgcc

SEQ ID NO: 3444517 - RNA, 19 nt, Pseudomonas aeruginosa PA01
cccggagcgcgaggcgagu

SEQ ID NO: 3444518 - RNA, 20 nt, Pseudomonas aeruginosa PA01
cccggaggaacgaacaugag

SEQ ID NO: 3444519 - RNA, 17 nt, Pseudomonas aeruginosa PA01
cccggaguuccagcggg

SEQ ID NO: 3444520 - RNA, 20 nt, Pseudomonas aeruginosa PA01
cccggaguuccagcggggau

SEQ ID NO: 3444521 - RNA, 15 nt, Pseudomonas aeruginosa PA01
cccggaucagcucgc

SEQ ID NO: 3444522 - RNA, 16 nt, Pseudomonas aeruginosa PA01
cccggaucagcucgcg

SEQ ID NO: 3444523 - RNA, 16 nt, Pseudomonas aeruginosa PA01
cccggauucgccgagg

SEQ ID NO: 3444524 - RNA, 17 nt, Pseudomonas aeruginosa PA01
cccggauucgccgagga

SEQ ID NO: 3444525 - RNA, 20 nt, Pseudomonas aeruginosa PA01
cccggauuuugggcagcgug

SEQ ID NO: 3444526 - RNA, 16 nt, Pseudomonas aeruginosa PA01
cccggcaaaugccggg

SEQ ID NO: 3444527 - RNA, 15 nt, Pseudomonas aeruginosa PA01
cccggcaagggccug

SEQ ID NO: 3444528 - RNA, 20 nt, Pseudomonas aeruginosa PA01
cccggcaagggccugcucag

SEQ ID NO: 3444529 - RNA, 13 nt, Pseudomonas aeruginosa PA01
cccggcaccaccg

SEQ ID NO: 3444530 - RNA, 15 nt, Pseudomonas aeruginosa PA01
cccggcaccaggccg

SEQ ID NO: 3444531 - RNA, 14 nt, Pseudomonas aeruginosa PA01
cccggcacgcucca

SEQ ID NO: 3444532 - RNA, 20 nt, Pseudomonas aeruginosa PA01
cccggcacgcuccagggcgg

SEQ ID NO: 3444533 - RNA, 14 nt, Pseudomonas aeruginosa PA01
cccggcacucgccg

SEQ ID NO: 3444534 - RNA, 18 nt, Pseudomonas aeruginosa PA01
cccggcagcaggccgccg

SEQ ID NO: 3444535 - RNA, 19 nt, Pseudomonas aeruginosa PA01
cccggcagcaggccgccgc

SEQ ID NO: 3444536 - RNA, 15 nt, Pseudomonas aeruginosa PA01
cccggcagccaccag

SEQ ID NO: 3444537 - RNA, 13 nt, Pseudomonas aeruginosa PA01
cccggcagcgccg

SEQ ID NO: 3444538 - RNA, 16 nt, Pseudomonas aeruginosa PA01
cccggcagcgccgggc

SEQ ID NO: 3444539 - RNA, 13 nt, Pseudomonas aeruginosa PA01
cccggcagcggcu

SEQ ID NO: 3444540 - RNA, 14 nt, Pseudomonas aeruginosa PA01
cccggcagcggcug

SEQ ID NO: 3444541 - RNA, 19 nt, Pseudomonas aeruginosa PA01
cccggcagcggcuggccgu

SEQ ID NO: 3444542 - RNA, 22 nt, Pseudomonas aeruginosa PA01
cccggcagcggcuggccgucga

SEQ ID NO: 3444543 - RNA, 16 nt, Pseudomonas aeruginosa PA01
cccggcagcucccuug

SEQ ID NO: 3444544 - RNA, 22 nt, Pseudomonas aeruginosa PA01
cccggcagcucccuugccgccg

SEQ ID NO: 3444545 - RNA, 23 nt, Pseudomonas aeruginosa PA01
cccggcagcucccuugccgccgg

SEQ ID NO: 3444546 - RNA, 12 nt, Pseudomonas aeruginosa PA01
cccggcaggcgc

SEQ ID NO: 3444547 - RNA, 12 nt, Pseudomonas aeruginosa PA01
cccggcagggcc

SEQ ID NO: 3444548 - RNA, 17 nt, Pseudomonas aeruginosa PA01
cccggcagggccagcgg

SEQ ID NO: 3444549 - RNA, 16 nt, Pseudomonas aeruginosa PA01
cccggcaggucgagga

SEQ ID NO: 3444550 - RNA, 17 nt, Pseudomonas aeruginosa PA01
cccggcauaggcgccag

SEQ ID NO: 3444551 - RNA, 18 nt, Pseudomonas aeruginosa PA01
cccggcauaggcgccagc

SEQ ID NO: 3444552 - RNA, 14 nt, Pseudomonas aeruginosa PA01
cccggcaucgccgg

SEQ ID NO: 3444553 - RNA, 15 nt, Pseudomonas aeruginosa PA01
cccggcauucgccgg

SEQ ID NO: 3444554 - RNA, 17 nt, Pseudomonas aeruginosa PA01
cccggcauucgccgggc

SEQ ID NO: 3444555 - RNA, 14 nt, Pseudomonas aeruginosa PA01
cccggccagcagcg

SEQ ID NO: 3444556 - RNA, 15 nt, Pseudomonas aeruginosa PA01
cccggccagcagcgc

SEQ ID NO: 3444557 - RNA, 16 nt, Pseudomonas aeruginosa PA01
cccggccagcagcgcc

SEQ ID NO: 3444558 - RNA, 12 nt, Pseudomonas aeruginosa PA01
cccggccagccc

SEQ ID NO: 3444559 - RNA, 17 nt, Pseudomonas aeruginosa PA01
cccggccaggccacggc

SEQ ID NO: 3444560 - RNA, 18 nt, Pseudomonas aeruginosa PA01
cccggccaggccacggcg

SEQ ID NO: 3444561 - RNA, 22 nt, Pseudomonas aeruginosa PA01
cccggccaggcccucagcggcg

SEQ ID NO: 3444562 - RNA, 16 nt, Pseudomonas aeruginosa PA01
cccggccaggccgccc

SEQ ID NO: 3444563 - RNA, 17 nt, Pseudomonas aeruginosa PA01
cccggccaggccgccca

SEQ ID NO: 3444564 - RNA, 15 nt, Pseudomonas aeruginosa PA01
cccggccaggcgaua

SEQ ID NO: 3444565 - RNA, 13 nt, Pseudomonas aeruginosa PA01
cccggccaggcgc

SEQ ID NO: 3444566 - RNA, 15 nt, Pseudomonas aeruginosa PA01
cccggccaggcgcgg

SEQ ID NO: 3444567 - RNA, 12 nt, Pseudomonas aeruginosa PA01
cccggccaggua

SEQ ID NO: 3444568 - RNA, 20 nt, Pseudomonas aeruginosa PA01
cccggccagguaccggccag

SEQ ID NO: 3444569 - RNA, 20 nt, Pseudomonas aeruginosa PA01
cccggccagguaggcgacga

SEQ ID NO: 3444570 - RNA, 19 nt, Pseudomonas aeruginosa PA01
cccggccauccuggccggu

SEQ ID NO: 3444571 - RNA, 11 nt, Pseudomonas aeruginosa PA01
cccggccauga

SEQ ID NO: 3444572 - RNA, 17 nt, Pseudomonas aeruginosa PA01
cccggccaugccgccga

SEQ ID NO: 3444573 - RNA, 19 nt, Pseudomonas aeruginosa PA01
cccggccaugccgccgacg

SEQ ID NO: 3444574 - RNA, 22 nt, Pseudomonas aeruginosa PA01
cccggccauggcgggucacgcc

SEQ ID NO: 3444575 - RNA, 20 nt, Pseudomonas aeruginosa PA01
cccggccauuccuuccaggg

SEQ ID NO: 3444576 - RNA, 15 nt, Pseudomonas aeruginosa PA01
cccggcccagccgcg

SEQ ID NO: 3444577 - RNA, 19 nt, Pseudomonas aeruginosa PA01
cccggcccagccgcggcgc

SEQ ID NO: 3444578 - RNA, 12 nt, Pseudomonas aeruginosa PA01
cccggcccaggc

SEQ ID NO: 3444579 - RNA, 15 nt, Pseudomonas aeruginosa PA01
cccggcccauggcga

SEQ ID NO: 3444580 - RNA, 16 nt, Pseudomonas aeruginosa PA01
cccggcccauggcgac

SEQ ID NO: 3444581 - RNA, 15 nt, Pseudomonas aeruginosa PA01
cccggcccgcgccgc

SEQ ID NO: 3444582 - RNA, 16 nt, Pseudomonas aeruginosa PA01
cccggcccgcgccgcc

SEQ ID NO: 3444583 - RNA, 22 nt, Pseudomonas aeruginosa PA01
cccggcccgcgccgccucgaug

SEQ ID NO: 3444584 - RNA, 15 nt, Pseudomonas aeruginosa PA01
cccggcccggccauc

SEQ ID NO: 3444585 - RNA, 19 nt, Pseudomonas aeruginosa PA01
cccggcccgggcguuggcu

SEQ ID NO: 3444586 - RNA, 20 nt, Pseudomonas aeruginosa PA01
cccggcccuugagcauggcg

SEQ ID NO: 3444587 - RNA, 22 nt, Pseudomonas aeruginosa PA01
cccggccgauggaaaucggcca

SEQ ID NO: 3444588 - RNA, 19 nt, Pseudomonas aeruginosa PA01
cccggccgcaggcagcaca

SEQ ID NO: 3444589 - RNA, 14 nt, Pseudomonas aeruginosa PA01
cccggccgccugcc

SEQ ID NO: 3444590 - RNA, 13 nt, Pseudomonas aeruginosa PA01
cccggccgccuuc

SEQ ID NO: 3444591 - RNA, 20 nt, Pseudomonas aeruginosa PA01
cccggccgccuuccucggcc

SEQ ID NO: 3444592 - RNA, 14 nt, Pseudomonas aeruginosa PA01
cccggccgcgccag

SEQ ID NO: 3444593 - RNA, 15 nt, Pseudomonas aeruginosa PA01
cccggccgcgccagc

SEQ ID NO: 3444594 - RNA, 16 nt, Pseudomonas aeruginosa PA01
cccggccgcgccagcc

SEQ ID NO: 3444595 - RNA, 14 nt, Pseudomonas aeruginosa PA01
cccggccgcugccg

SEQ ID NO: 3444596 - RNA, 17 nt, Pseudomonas aeruginosa PA01
cccggccgcugccgggc

SEQ ID NO: 3444597 - RNA, 23 nt, Pseudomonas aeruginosa PA01
cccggccgcuggaugccgaccac

SEQ ID NO: 3444598 - RNA, 11 nt, Pseudomonas aeruginosa PA01
cccggccggca

SEQ ID NO: 3444599 - RNA, 14 nt, Pseudomonas aeruginosa PA01
cccgggcuccgggu

SEQ ID NO: 3444600 - RNA, 16 nt, Pseudomonas aeruginosa PA01
cccggggcucugccgg

SEQ ID NO: 3444601 - RNA, 22 nt, Pseudomonas aeruginosa PA01
cccggguauagaaaucgaucga

SEQ ID NO: 3444602 - RNA, 16 nt, Pseudomonas aeruginosa PA01
cccgggucgcgcagcg

SEQ ID NO: 3444603 - RNA, 18 nt, Pseudomonas aeruginosa PA01
cccgggucgcgcagcggc

SEQ ID NO: 3444604 - RNA, 13 nt, Pseudomonas aeruginosa PA01
cccgggucggcac

SEQ ID NO: 3444605 - RNA, 21 nt, Pseudomonas aeruginosa PA01
cccgggucgucggucggccag

SEQ ID NO: 3444606 - RNA, 23 nt, Pseudomonas aeruginosa PA01
cccgggucgucggucggccagga

SEQ ID NO: 3444607 - RNA, 20 nt, Pseudomonas aeruginosa PA01
cccgggugccuuccgcgccc

SEQ ID NO: 3444608 - RNA, 14 nt, Pseudomonas aeruginosa PA01
cccggguucugcuc

SEQ ID NO: 3444609 - RNA, 14 nt, Pseudomonas aeruginosa PA01
cccggguugcccuc

SEQ ID NO: 3444610 - RNA, 21 nt, Pseudomonas aeruginosa PA01
cccggguugcccucgcagccg

SEQ ID NO: 3444611 - RNA, 24 nt, Pseudomonas aeruginosa PA01
cccggguugcccucgcagccggcg

SEQ ID NO: 3444612 - RNA, 15 nt, Pseudomonas aeruginosa PA01
cccggguugccguag

SEQ ID NO: 3444613 - RNA, 23 nt, Pseudomonas aeruginosa PA01
cccggguuuccgugugcagcagg

SEQ ID NO: 3444614 - RNA, 15 nt, Pseudomonas aeruginosa PA01
cccggguuuccugcc

SEQ ID NO: 3444615 - RNA, 24 nt, Pseudomonas aeruginosa PA01
cccgguacagccaacccucggaug

SEQ ID NO: 3444616 - RNA, 13 nt, Pseudomonas aeruginosa PA01
cccgguacagcgc

SEQ ID NO: 3444617 - RNA, 21 nt, Pseudomonas aeruginosa PA01
cccgguacuccuccagcaucc

SEQ ID NO: 3444618 - RNA, 15 nt, Pseudomonas aeruginosa PA01
cccgguauucagcca

SEQ ID NO: 3444619 - RNA, 21 nt, Pseudomonas aeruginosa PA01
cccggucaccacccagccgcg

SEQ ID NO: 3444620 - RNA, 14 nt, Pseudomonas aeruginosa PA01
cccggucacgccgg

SEQ ID NO: 3444621 - RNA, 16 nt, Pseudomonas aeruginosa PA01
cccggucacgccggga

SEQ ID NO: 3444622 - RNA, 20 nt, Pseudomonas aeruginosa PA01
cccggucagcuucgccgccc

SEQ ID NO: 3444623 - RNA, 15 nt, Pseudomonas aeruginosa PA01
cccggucaggccgau

SEQ ID NO: 3444624 - RNA, 23 nt, Pseudomonas aeruginosa PA01
cccggucaggccgaucaccacca

SEQ ID NO: 3444625 - RNA, 21 nt, Pseudomonas aeruginosa PA01
cccggucagguuggacagguc

SEQ ID NO: 3444626 - RNA, 17 nt, Pseudomonas aeruginosa PA01
cccggucauggugccga

SEQ ID NO: 3444627 - RNA, 13 nt, Pseudomonas aeruginosa PA01
cccgguccgguga

SEQ ID NO: 3444628 - RNA, 17 nt, Pseudomonas aeruginosa PA01
cccgguccugcaacugg

SEQ ID NO: 3444629 - RNA, 18 nt, Pseudomonas aeruginosa PA01
cccgguccugcaacugga

SEQ ID NO: 3444630 - RNA, 23 nt, Pseudomonas aeruginosa PA01
cccgguccugcaacuggaaggcc

SEQ ID NO: 3444631 - RNA, 22 nt, Pseudomonas aeruginosa PA01
cccggucgcgcuggaccuggcc

SEQ ID NO: 3444632 - RNA, 20 nt, Pseudomonas aeruginosa PA01
cccggucggccuguucgccc

SEQ ID NO: 3444633 - RNA, 14 nt, Pseudomonas aeruginosa PA01
cccggucucgcgca

SEQ ID NO: 3444634 - RNA, 15 nt, Pseudomonas aeruginosa PA01
cccggucucgcgcag

SEQ ID NO: 3444635 - RNA, 16 nt, Pseudomonas aeruginosa PA01
cccggucucgcgcagc

SEQ ID NO: 3444636 - RNA, 17 nt, Pseudomonas aeruginosa PA01
cccggucucgcgcagcg

SEQ ID NO: 3444637 - RNA, 19 nt, Pseudomonas aeruginosa PA01
cccggucucgcgcagcggc

SEQ ID NO: 3444638 - RNA, 20 nt, Pseudomonas aeruginosa PA01
cccggucucgcgcagcggcg

SEQ ID NO: 3444639 - RNA, 15 nt, Pseudomonas aeruginosa PA01
cccggugcaggaaca

SEQ ID NO: 3444640 - RNA, 21 nt, Pseudomonas aeruginosa PA01
cccgguggaauaccgcugcgc

SEQ ID NO: 3444641 - RNA, 17 nt, Pseudomonas aeruginosa PA01
cccgguggccuccugca

SEQ ID NO: 3444642 - RNA, 13 nt, Pseudomonas aeruginosa PA01
cccggugucgacg

SEQ ID NO: 3444643 - RNA, 15 nt, Pseudomonas aeruginosa PA01
cccggugugcgcugc

SEQ ID NO: 3444644 - RNA, 22 nt, Pseudomonas aeruginosa PA01
cccggugugcgcugcaucggcg

SEQ ID NO: 3444645 - RNA, 18 nt, Pseudomonas aeruginosa PA01
cccgguuaccggcgacca

SEQ ID NO: 3444646 - RNA, 16 nt, Pseudomonas aeruginosa PA01
cccgguuacucgccgg

SEQ ID NO: 3444647 - RNA, 18 nt, Pseudomonas aeruginosa PA01
cccgguuacucgccggca

SEQ ID NO: 3444648 - RNA, 20 nt, Pseudomonas aeruginosa PA01
cccgguuacucgccggcauu

SEQ ID NO: 3444649 - RNA, 13 nt, Pseudomonas aeruginosa PA01
cccgguucagcgg

SEQ ID NO: 3444650 - RNA, 14 nt, Pseudomonas aeruginosa PA01
cccgguucagcggg

SEQ ID NO: 3444651 - RNA, 16 nt, Pseudomonas aeruginosa PA01
cccgguucagcgggac

SEQ ID NO: 3444652 - RNA, 19 nt, Pseudomonas aeruginosa PA01
cccgguucguagaguucgc

SEQ ID NO: 3444653 - RNA, 14 nt, Pseudomonas aeruginosa PA01
cccgguucucgccc

SEQ ID NO: 3444654 - RNA, 18 nt, Pseudomonas aeruginosa PA01
cccgguugaccccgcggg

SEQ ID NO: 3444655 - RNA, 17 nt, Pseudomonas aeruginosa PA01
cccgguugccuucgucg

SEQ ID NO: 3444656 - RNA, 21 nt, Pseudomonas aeruginosa PA01
cccgguugccuucgucgcugg

SEQ ID NO: 3444657 - RNA, 18 nt, Pseudomonas aeruginosa PA01
cccgguuggccaggacca

SEQ ID NO: 3444658 - RNA, 15 nt, Pseudomonas aeruginosa PA01
cccgguuggcgcccc

SEQ ID NO: 3444659 - RNA, 14 nt, Pseudomonas aeruginosa PA01
cccgguuuccgcag

SEQ ID NO: 3444660 - RNA, 16 nt, Pseudomonas aeruginosa PA01
cccgguuuccgcagcg

SEQ ID NO: 3444661 - RNA, 15 nt, Pseudomonas aeruginosa PA01
cccguaaggccaggc

SEQ ID NO: 3444662 - RNA, 14 nt, Pseudomonas aeruginosa PA01
cccguaccagcgcg

SEQ ID NO: 3444663 - RNA, 16 nt, Pseudomonas aeruginosa PA01
cccguaccagcgcgau

SEQ ID NO: 3444664 - RNA, 18 nt, Pseudomonas aeruginosa PA01
cccguagccaugcccggc

SEQ ID NO: 3444665 - RNA, 23 nt, Pseudomonas aeruginosa PA01
cccguagucguucagcgccucgc

SEQ ID NO: 3444666 - RNA, 24 nt, Pseudomonas aeruginosa PA01
cccgucacuucacgacaggcggcg

SEQ ID NO: 3444667 - RNA, 21 nt, Pseudomonas aeruginosa PA01
cccgucaggccuugcgcggcg

SEQ ID NO: 3444668 - RNA, 23 nt, Pseudomonas aeruginosa PA01
cccgucaggccuugcgcggcgcc

SEQ ID NO: 3444669 - RNA, 14 nt, Pseudomonas aeruginosa PA01
cccgucaucaccca

SEQ ID NO: 3444670 - RNA, 23 nt, Pseudomonas aeruginosa PA01
cccgucaugaccagagccgccga

SEQ ID NO: 3444671 - RNA, 22 nt, Pseudomonas aeruginosa PA01
cccgucauugaaaacggcgccc

SEQ ID NO: 3444672 - RNA, 16 nt, Pseudomonas aeruginosa PA01
cccgucccgcgcgccg

SEQ ID NO: 3444673 - RNA, 13 nt, Pseudomonas aeruginosa PA01
cccguccgcugcg

SEQ ID NO: 3444674 - RNA, 16 nt, Pseudomonas aeruginosa PA01
cccguccgcugcgcca

SEQ ID NO: 3444675 - RNA, 17 nt, Pseudomonas aeruginosa PA01
cccgucgaccaucacca

SEQ ID NO: 3444676 - RNA, 23 nt, Pseudomonas aeruginosa PA01
cccgucgaccaucaccagcgccg

SEQ ID NO: 3444677 - RNA, 19 nt, Pseudomonas aeruginosa PA01
cccgucgccauucggcgac

SEQ ID NO: 3444678 - RNA, 15 nt, Pseudomonas aeruginosa PA01
cccgucgcgccggcc

SEQ ID NO: 3444679 - RNA, 13 nt, Pseudomonas aeruginosa PA01
cccgucgcgcgcc

SEQ ID NO: 3444680 - RNA, 17 nt, Pseudomonas aeruginosa PA01
cccgucggccucgccga

SEQ ID NO: 3444681 - RNA, 15 nt, Pseudomonas aeruginosa PA01
cccgucgggcaaggg

SEQ ID NO: 3444682 - RNA, 13 nt, Pseudomonas aeruginosa PA01
cccgugcgccgcg

SEQ ID NO: 3444683 - RNA, 22 nt, Pseudomonas aeruginosa PA01
cccgugcgccgcgggucaccag

SEQ ID NO: 3444684 - RNA, 15 nt, Pseudomonas aeruginosa PA01
cccgugcggcacgcu

SEQ ID NO: 3444685 - RNA, 14 nt, Pseudomonas aeruginosa PA01
cccguggcgacgca

SEQ ID NO: 3444686 - RNA, 22 nt, Pseudomonas aeruginosa PA01
cccguggcgacgcagcacggcg

SEQ ID NO: 3444687 - RNA, 18 nt, Pseudomonas aeruginosa PA01
cccguggcgccgcagggc

SEQ ID NO: 3444688 - RNA, 13 nt, Pseudomonas aeruginosa PA01
cccguggcgcgga

SEQ ID NO: 3444689 - RNA, 12 nt, Pseudomonas aeruginosa PA01
cccguggcgggc

SEQ ID NO: 3444690 - RNA, 15 nt, Pseudomonas aeruginosa PA01
cccguggcgggccag

SEQ ID NO: 3444691 - RNA, 21 nt, Pseudomonas aeruginosa PA01
cccguggcuggggccggccug

SEQ ID NO: 3444692 - RNA, 23 nt, Pseudomonas aeruginosa PA01
cccgugggaucgccacgccggcg

SEQ ID NO: 3444693 - RNA, 16 nt, Pseudomonas aeruginosa PA01
cccgugguagucgagc

SEQ ID NO: 3444694 - RNA, 21 nt, Pseudomonas aeruginosa PA01
cccgugguagucgagccggau

SEQ ID NO: 3444695 - RNA, 15 nt, Pseudomonas aeruginosa PA01
cccgugguccgccag

SEQ ID NO: 3444696 - RNA, 21 nt, Pseudomonas aeruginosa PA01
cccgugguccgccagcaggcg

SEQ ID NO: 3444697 - RNA, 13 nt, Pseudomonas aeruginosa PA01
cccgugucgccuu

SEQ ID NO: 3444698 - RNA, 14 nt, Pseudomonas aeruginosa PA01
cccguguugcggag

SEQ ID NO: 3444699 - RNA, 16 nt, Pseudomonas aeruginosa PA01
cccguuccaccgccug

SEQ ID NO: 3444700 - RNA, 21 nt, Pseudomonas aeruginosa PA01
cccguuccaccgccuggacca

SEQ ID NO: 3444701 - RNA, 18 nt, Pseudomonas aeruginosa PA01
cccucucucgccucggcg

SEQ ID NO: 3444702 - RNA, 14 nt, Pseudomonas aeruginosa PA01
cccugaagggagag

SEQ ID NO: 3444703 - RNA, 14 nt, Pseudomonas aeruginosa PA01
cccugaccagcagg

SEQ ID NO: 3444704 - RNA, 13 nt, Pseudomonas aeruginosa PA01
cccugacccgcac

SEQ ID NO: 3444705 - RNA, 17 nt, Pseudomonas aeruginosa PA01
cccugacccgcaccggc

SEQ ID NO: 3444706 - RNA, 14 nt, Pseudomonas aeruginosa PA01
cccugaccgcgagc

SEQ ID NO: 3444707 - RNA, 15 nt, Pseudomonas aeruginosa PA01
cccugaccgcgagcg

SEQ ID NO: 3444708 - RNA, 20 nt, Pseudomonas aeruginosa PA01
cccugaccgcgagcgccgcc

SEQ ID NO: 3444709 - RNA, 21 nt, Pseudomonas aeruginosa PA01
cccugaccgcgagcgccgccu

SEQ ID NO: 3444710 - RNA, 20 nt, Pseudomonas aeruginosa PA01
cccugacgaugcagggcugc

SEQ ID NO: 3444711 - RNA, 20 nt, Pseudomonas aeruginosa PA01
cccugaggcuuuccugcgcc

SEQ ID NO: 3444712 - RNA, 23 nt, Pseudomonas aeruginosa PA01
cccugaggcuuuccugcgccucg

SEQ ID NO: 3444713 - RNA, 22 nt, Pseudomonas aeruginosa PA01
cccugcaaagcggcgacgccac

SEQ ID NO: 3444714 - RNA, 20 nt, Pseudomonas aeruginosa PA01
cccugcaacacguagcgcag

SEQ ID NO: 3444715 - RNA, 12 nt, Pseudomonas aeruginosa PA01
cccugcaacagg

SEQ ID NO: 3444716 - RNA, 17 nt, Pseudomonas aeruginosa PA01
cccugcaacaggaccca

SEQ ID NO: 3444717 - RNA, 22 nt, Pseudomonas aeruginosa PA01
cccugcaacaggacccagccau

SEQ ID NO: 3444718 - RNA, 22 nt, Pseudomonas aeruginosa PA01
cccugcaauggggcggccggcg

SEQ ID NO: 3444719 - RNA, 15 nt, Pseudomonas aeruginosa PA01
cccugcacagggacg

SEQ ID NO: 3444720 - RNA, 17 nt, Pseudomonas aeruginosa PA01
cccugcacagggacgcg

SEQ ID NO: 3444721 - RNA, 23 nt, Pseudomonas aeruginosa PA01
cccugcacaucaccuucgcccuc

SEQ ID NO: 3444722 - RNA, 19 nt, Pseudomonas aeruginosa PA01
cccugcacccuuggcgcag

SEQ ID NO: 3444723 - RNA, 12 nt, Pseudomonas aeruginosa PA01
cccugcaccuug

SEQ ID NO: 3444724 - RNA, 20 nt, Pseudomonas aeruginosa PA01
cccugcaccuugggaucguc

SEQ ID NO: 3444725 - RNA, 15 nt, Pseudomonas aeruginosa PA01
cccugcagcgccaug

SEQ ID NO: 3444726 - RNA, 15 nt, Pseudomonas aeruginosa PA01
cccugcagcgcgcgc

SEQ ID NO: 3444727 - RNA, 14 nt, Pseudomonas aeruginosa PA01
cccugcaggacccg

SEQ ID NO: 3444728 - RNA, 22 nt, Pseudomonas aeruginosa PA01
cccugcaggccgaauccgccgg

SEQ ID NO: 3444729 - RNA, 23 nt, Pseudomonas aeruginosa PA01
cccugcaggccgaauccgccggc

SEQ ID NO: 3444730 - RNA, 16 nt, Pseudomonas aeruginosa PA01
cccugcaucgcgacag

SEQ ID NO: 3444731 - RNA, 14 nt, Pseudomonas aeruginosa PA01
cccugcaugccggc

SEQ ID NO: 3444732 - RNA, 16 nt, Pseudomonas aeruginosa PA01
cccugccagcgggcgc

SEQ ID NO: 3444733 - RNA, 20 nt, Pseudomonas aeruginosa PA01
cccugccagcgggcgccgcc

SEQ ID NO: 3444734 - RNA, 12 nt, Pseudomonas aeruginosa PA01
cccugccagggg

SEQ ID NO: 3444735 - RNA, 22 nt, Pseudomonas aeruginosa PA01
cccugcccagugggccaccggc

SEQ ID NO: 3444736 - RNA, 13 nt, Pseudomonas aeruginosa PA01
cccugccccagca

SEQ ID NO: 3444737 - RNA, 16 nt, Pseudomonas aeruginosa PA01
cccugccccagcaucg

SEQ ID NO: 3444738 - RNA, 14 nt, Pseudomonas aeruginosa PA01
cccugcccgcgccu

SEQ ID NO: 3444739 - RNA, 15 nt, Pseudomonas aeruginosa PA01
cccugcccgcgccuc

SEQ ID NO: 3444740 - RNA, 21 nt, Pseudomonas aeruginosa PA01
cccugccggcgguggacgucg

SEQ ID NO: 3444741 - RNA, 19 nt, Pseudomonas aeruginosa PA01
cccugccguauccgcggca

SEQ ID NO: 3444742 - RNA, 12 nt, Pseudomonas aeruginosa PA01
cccugcgcaagg

SEQ ID NO: 3444743 - RNA, 13 nt, Pseudomonas aeruginosa PA01
cccugcgccagca

SEQ ID NO: 3444744 - RNA, 15 nt, Pseudomonas aeruginosa PA01
cccugcgccagcauc

SEQ ID NO: 3444745 - RNA, 17 nt, Pseudomonas aeruginosa PA01
cccugcgccgcagcggc

SEQ ID NO: 3444746 - RNA, 18 nt, Pseudomonas aeruginosa PA01
cccugcgccgcagcggcc

SEQ ID NO: 3444747 - RNA, 12 nt, Pseudomonas aeruginosa PA01
cccugcgccuca

SEQ ID NO: 3444748 - RNA, 12 nt, Pseudomonas aeruginosa PA01
cccugcgccucg

SEQ ID NO: 3444749 - RNA, 14 nt, Pseudomonas aeruginosa PA01
cccugcgccucgac

SEQ ID NO: 3444750 - RNA, 17 nt, Pseudomonas aeruginosa PA01
cccugcgccucgaccug

SEQ ID NO: 3444751 - RNA, 18 nt, Pseudomonas aeruginosa PA01
cccugcgccucgaccugg

SEQ ID NO: 3444752 - RNA, 18 nt, Pseudomonas aeruginosa PA01
cccugcgcgaucccccgc

SEQ ID NO: 3444753 - RNA, 19 nt, Pseudomonas aeruginosa PA01
cccugcgcgaucccccgcc

SEQ ID NO: 3444754 - RNA, 12 nt, Pseudomonas aeruginosa PA01
cccugcgcgcgc

SEQ ID NO: 3444755 - RNA, 23 nt, Pseudomonas aeruginosa PA01
cccugcgcggacguaacggcuug

SEQ ID NO: 3444756 - RNA, 17 nt, Pseudomonas aeruginosa PA01
cccugcggaccgcagaa

SEQ ID NO: 3444757 - RNA, 19 nt, Pseudomonas aeruginosa PA01
cccugcggaccgcagaacc

SEQ ID NO: 3444758 - RNA, 21 nt, Pseudomonas aeruginosa PA01
cccugcggauggcgcggggcc

SEQ ID NO: 3444759 - RNA, 15 nt, Pseudomonas aeruginosa PA01
cccugcggcaggcgc

SEQ ID NO: 3444760 - RNA, 17 nt, Pseudomonas aeruginosa PA01
cccugcggcaggcgcca

SEQ ID NO: 3444761 - RNA, 17 nt, Pseudomonas aeruginosa PA01
cccugcggcccgagggc

SEQ ID NO: 3444762 - RNA, 13 nt, Pseudomonas aeruginosa PA01
cccugcggcgccg

SEQ ID NO: 3444763 - RNA, 18 nt, Pseudomonas aeruginosa PA01
cccugcucgccggcgcgg

SEQ ID NO: 3444764 - RNA, 10 nt, Pseudomonas aeruginosa PA01
cccugcucgu

SEQ ID NO: 3444765 - RNA, 17 nt, Pseudomonas aeruginosa PA01
cccugcucuuccagcgg

SEQ ID NO: 3444766 - RNA, 15 nt, Pseudomonas aeruginosa PA01
cccugcugcagggcc

SEQ ID NO: 3444767 - RNA, 14 nt, Pseudomonas aeruginosa PA01
cccugcugcucgcc

SEQ ID NO: 3444768 - RNA, 17 nt, Pseudomonas aeruginosa PA01
cccugcugcugcucagc

SEQ ID NO: 3444769 - RNA, 16 nt, Pseudomonas aeruginosa PA01
cccugcuggccggugc

SEQ ID NO: 3444770 - RNA, 21 nt, Pseudomonas aeruginosa PA01
cccugcuggccggugccgccc

SEQ ID NO: 3444771 - RNA, 22 nt, Pseudomonas aeruginosa PA01
cccugcuggccggugccgcccu

SEQ ID NO: 3444772 - RNA, 19 nt, Pseudomonas aeruginosa PA01
cccugcuggcgcagccagg

SEQ ID NO: 3444773 - RNA, 13 nt, Pseudomonas aeruginosa PA01
cccugcugggcgg

SEQ ID NO: 3444774 - RNA, 18 nt, Pseudomonas aeruginosa PA01
cccugcuucgaacgugcg

SEQ ID NO: 3444775 - RNA, 18 nt, Pseudomonas aeruginosa PA01
cccugcuuggccagcgcg

SEQ ID NO: 3444776 - RNA, 19 nt, Pseudomonas aeruginosa PA01
cccugcuuggccagcgcgg

SEQ ID NO: 3444777 - RNA, 19 nt, Pseudomonas aeruginosa PA01
cccuggaaaggccucggcg

SEQ ID NO: 3444778 - RNA, 21 nt, Pseudomonas aeruginosa PA01
cccuggaaaggccucggcgau

SEQ ID NO: 3444779 - RNA, 22 nt, Pseudomonas aeruginosa PA01
cccuggaaaggccucggcgaug

SEQ ID NO: 3444780 - RNA, 21 nt, Pseudomonas aeruginosa PA01
cccuggacccgggccuccugg

SEQ ID NO: 3444781 - RNA, 16 nt, Pseudomonas aeruginosa PA01
cccuggagcagggcga

SEQ ID NO: 3444782 - RNA, 15 nt, Pseudomonas aeruginosa PA01
cccuggaucuccugg

SEQ ID NO: 3444783 - RNA, 21 nt, Pseudomonas aeruginosa PA01
cccuggaucugcgggaacuug

SEQ ID NO: 3444784 - RNA, 20 nt, Pseudomonas aeruginosa PA01
cccuggcaccgauggcgugu

SEQ ID NO: 3444785 - RNA, 19 nt, Pseudomonas aeruginosa PA01
cccuggcagacgcugcucg

SEQ ID NO: 3444786 - RNA, 12 nt, Pseudomonas aeruginosa PA01
cccuggccgcca

SEQ ID NO: 3444787 - RNA, 13 nt, Pseudomonas aeruginosa PA01
cccuggccgccaa

SEQ ID NO: 3444788 - RNA, 14 nt, Pseudomonas aeruginosa PA01
cccuggccgcccag

SEQ ID NO: 3444789 - RNA, 15 nt, Pseudomonas aeruginosa PA01
cccuggccgcugccg

SEQ ID NO: 3444790 - RNA, 16 nt, Pseudomonas aeruginosa PA01
cccuggccggccucgg

SEQ ID NO: 3444791 - RNA, 12 nt, Pseudomonas aeruginosa PA01
cccuggccggcg

SEQ ID NO: 3444792 - RNA, 15 nt, Pseudomonas aeruginosa PA01
cccuggccgucggcc

SEQ ID NO: 3444793 - RNA, 17 nt, Pseudomonas aeruginosa PA01
cccuggccgucggccug

SEQ ID NO: 3444794 - RNA, 19 nt, Pseudomonas aeruginosa PA01
cccuggccgucggccugcu

SEQ ID NO: 3444795 - RNA, 22 nt, Pseudomonas aeruginosa PA01
cccuggccguugaccagcgcgu

SEQ ID NO: 3444796 - RNA, 18 nt, Pseudomonas aeruginosa PA01
cccuggccucggcguccu

SEQ ID NO: 3444797 - RNA, 13 nt, Pseudomonas aeruginosa PA01
cccuggccuuggc

SEQ ID NO: 3444798 - RNA, 15 nt, Pseudomonas aeruginosa PA01
cccuggccuuggcca

SEQ ID NO: 3444799 - RNA, 14 nt, Pseudomonas aeruginosa PA01
cccuggcgcaggcg

SEQ ID NO: 3444800 - RNA, 16 nt, Pseudomonas aeruginosa PA01
cccuggcgccagcguu

SEQ ID NO: 3444801 - RNA, 14 nt, Pseudomonas aeruginosa PA01
cccuggcgcugucg

SEQ ID NO: 3444802 - RNA, 23 nt, Pseudomonas aeruginosa PA01
cccuggcgcugucgcccgggcgc

SEQ ID NO: 3444803 - RNA, 17 nt, Pseudomonas aeruginosa PA01
cccuggcggauaucgcg

SEQ ID NO: 3444804 - RNA, 18 nt, Pseudomonas aeruginosa PA01
ccgaacaugccgaagagc

SEQ ID NO: 3444805 - RNA, 22 nt, Pseudomonas aeruginosa PA01
ccgaacccgccucaaggugaag

SEQ ID NO: 3444806 - RNA, 12 nt, Pseudomonas aeruginosa PA01
ccgaacgccgac

SEQ ID NO: 3444807 - RNA, 13 nt, Pseudomonas aeruginosa PA01
ccgaacgccgacc

SEQ ID NO: 3444808 - RNA, 13 nt, Pseudomonas aeruginosa PA01
ccgaacgcgaggu

SEQ ID NO: 3444809 - RNA, 13 nt, Pseudomonas aeruginosa PA01
ccgaacgcgcuga

SEQ ID NO: 3444810 - RNA, 17 nt, Pseudomonas aeruginosa PA01
ccgaacggaucgcgucg

SEQ ID NO: 3444811 - RNA, 18 nt, Pseudomonas aeruginosa PA01
ccgaacggaucgcgucgc

SEQ ID NO: 3444812 - RNA, 19 nt, Pseudomonas aeruginosa PA01
ccgaacggcagcuggaucc

SEQ ID NO: 3444813 - RNA, 16 nt, Pseudomonas aeruginosa PA01
ccgaacuccgagcagg

SEQ ID NO: 3444814 - RNA, 15 nt, Pseudomonas aeruginosa PA01
ccgaacuccgccagc

SEQ ID NO: 3444815 - RNA, 18 nt, Pseudomonas aeruginosa PA01
ccgaacuccgccagcacc

SEQ ID NO: 3444816 - RNA, 16 nt, Pseudomonas aeruginosa PA01
ccgaacucgaacgcgu

SEQ ID NO: 3444817 - RNA, 15 nt, Pseudomonas aeruginosa PA01
ccgaacugcagggcg

SEQ ID NO: 3444818 - RNA, 15 nt, Pseudomonas aeruginosa PA01
ccgaacuuccgccga

SEQ ID NO: 3444819 - RNA, 22 nt, Pseudomonas aeruginosa PA01
ccgaagaacgguaucggcuugc

SEQ ID NO: 3444820 - RNA, 16 nt, Pseudomonas aeruginosa PA01
ccgaagacaggccuuu

SEQ ID NO: 3444821 - RNA, 16 nt, Pseudomonas aeruginosa PA01
ccgaagaccaccaugg

SEQ ID NO: 3444822 - RNA, 20 nt, Pseudomonas aeruginosa PA01
ccgaagacgccugucggcac

SEQ ID NO: 3444823 - RNA, 14 nt, Pseudomonas aeruginosa PA01
ccgaagaggcccuc

SEQ ID NO: 3444824 - RNA, 16 nt, Pseudomonas aeruginosa PA01
ccgaagauccgcucca

SEQ ID NO: 3444825 - RNA, 18 nt, Pseudomonas aeruginosa PA01
ccgaagauccgcuccagg

SEQ ID NO: 3444826 - RNA, 12 nt, Pseudomonas aeruginosa PA01
ccgaagccccgg

SEQ ID NO: 3444827 - RNA, 17 nt, Pseudomonas aeruginosa PA01
ccgaagccgacgccgag

SEQ ID NO: 3444828 - RNA, 18 nt, Pseudomonas aeruginosa PA01
ccgaagccgacgccgagc

SEQ ID NO: 3444829 - RNA, 19 nt, Pseudomonas aeruginosa PA01
ccgaagccgacgccgagca

SEQ ID NO: 3444830 - RNA, 12 nt, Pseudomonas aeruginosa PA01
ccgaagccgccg

SEQ ID NO: 3444831 - RNA, 13 nt, Pseudomonas aeruginosa PA01
ccgaagccgccgg

SEQ ID NO: 3444832 - RNA, 20 nt, Pseudomonas aeruginosa PA01
ccgaagccgccgggaaucug

SEQ ID NO: 3444833 - RNA, 16 nt, Pseudomonas aeruginosa PA01
ccgaagccgcgcagca

SEQ ID NO: 3444834 - RNA, 18 nt, Pseudomonas aeruginosa PA01
ccgaagccgcuggcauuc

SEQ ID NO: 3444835 - RNA, 18 nt, Pseudomonas aeruginosa PA01
ccgaagcgugggcggccg

SEQ ID NO: 3444836 - RNA, 20 nt, Pseudomonas aeruginosa PA01
ccgaagcugucgagcacggc

SEQ ID NO: 3444837 - RNA, 13 nt, Pseudomonas aeruginosa PA01
ccgaaggccagga

SEQ ID NO: 3444838 - RNA, 19 nt, Pseudomonas aeruginosa PA01
ccgaaggccaggccggcgc

SEQ ID NO: 3444839 - RNA, 21 nt, Pseudomonas aeruginosa PA01
ccgaaggccaggccggcgccu

SEQ ID NO: 3444840 - RNA, 16 nt, Pseudomonas aeruginosa PA01
ccgaaggccuggccgu

SEQ ID NO: 3444841 - RNA, 19 nt, Pseudomonas aeruginosa PA01
ccgaaggcgauauggccga

SEQ ID NO: 3444842 - RNA, 17 nt, Pseudomonas aeruginosa PA01
ccgaaggcgucauccgc

SEQ ID NO: 3444843 - RNA, 15 nt, Pseudomonas aeruginosa PA01
ccgaaggcgucgggc

SEQ ID NO: 3444844 - RNA, 16 nt, Pseudomonas aeruginosa PA01
ccgaaggcgucgggca

SEQ ID NO: 3444845 - RNA, 16 nt, Pseudomonas aeruginosa PA01
ccgaaggcgugggcgc

SEQ ID NO: 3444846 - RNA, 18 nt, Pseudomonas aeruginosa PA01
ccgaaggcgugggcgccg

SEQ ID NO: 3444847 - RNA, 20 nt, Pseudomonas aeruginosa PA01
ccgaaggcgugggcgccggc

SEQ ID NO: 3444848 - RNA, 19 nt, Pseudomonas aeruginosa PA01
ccgaagggaaacaccaggc

SEQ ID NO: 3444849 - RNA, 21 nt, Pseudomonas aeruginosa PA01
ccgaagggaaacaccaggccg

SEQ ID NO: 3444850 - RNA, 23 nt, Pseudomonas aeruginosa PA01
ccgaagggaacccgcggcgcgcc

SEQ ID NO: 3444851 - RNA, 22 nt, Pseudomonas aeruginosa PA01
ccgaagggaaucuuuccuccag

SEQ ID NO: 3444852 - RNA, 17 nt, Pseudomonas aeruginosa PA01
ccgaagguacugccgcu

SEQ ID NO: 3444853 - RNA, 19 nt, Pseudomonas aeruginosa PA01
ccgaagguacugccgcuau

SEQ ID NO: 3444854 - RNA, 23 nt, Pseudomonas aeruginosa PA01
ccgaagguacugccgcuaucgcu

SEQ ID NO: 3444855 - RNA, 19 nt, Pseudomonas aeruginosa PA01
ccgaaggucaaugccacgu

SEQ ID NO: 3444856 - RNA, 18 nt, Pseudomonas aeruginosa PA01
ccgaaggucgccguccug

SEQ ID NO: 3444857 - RNA, 17 nt, Pseudomonas aeruginosa PA01
ccgaaggugcaggccgc

SEQ ID NO: 3444858 - RNA, 17 nt, Pseudomonas aeruginosa PA01
ccgaaguagucgccccg

SEQ ID NO: 3444859 - RNA, 14 nt, Pseudomonas aeruginosa PA01
ccgaagucgcccgc

SEQ ID NO: 3444860 - RNA, 16 nt, Pseudomonas aeruginosa PA01
ccgaagucgcccgccg

SEQ ID NO: 3444861 - RNA, 22 nt, Pseudomonas aeruginosa PA01
ccgaagucgcccgccggcgugc

SEQ ID NO: 3444862 - RNA, 13 nt, Pseudomonas aeruginosa PA01
ccgaagucggcga

SEQ ID NO: 3444863 - RNA, 16 nt, Pseudomonas aeruginosa PA01
ccgaagucggcgagcc

SEQ ID NO: 3444864 - RNA, 17 nt, Pseudomonas aeruginosa PA01
ccgaaguucuucagcag

SEQ ID NO: 3444865 - RNA, 18 nt, Pseudomonas aeruginosa PA01
ccgaauacugcacgccca

SEQ ID NO: 3444866 - RNA, 19 nt, Pseudomonas aeruginosa PA01
ccgaauagaucugcaccag

SEQ ID NO: 3444867 - RNA, 15 nt, Pseudomonas aeruginosa PA01
ccgaauccaggccga

SEQ ID NO: 3444868 - RNA, 16 nt, Pseudomonas aeruginosa PA01
ccgaauccaggccgac

SEQ ID NO: 3444869 - RNA, 14 nt, Pseudomonas aeruginosa PA01
ccgaauccgccggc

SEQ ID NO: 3444870 - RNA, 17 nt, Pseudomonas aeruginosa PA01
ccgaauccgccggcgau

SEQ ID NO: 3444871 - RNA, 17 nt, Pseudomonas aeruginosa PA01
ccgaauccuccagccgg

SEQ ID NO: 3444872 - RNA, 18 nt, Pseudomonas aeruginosa PA01
ccgaauccuccagccggc

SEQ ID NO: 3444873 - RNA, 21 nt, Pseudomonas aeruginosa PA01
ccgaauccuccagccggcgac

SEQ ID NO: 3444874 - RNA, 15 nt, Pseudomonas aeruginosa PA01
ccgaaucgaacaggg

SEQ ID NO: 3444875 - RNA, 21 nt, Pseudomonas aeruginosa PA01
ccgaaucgaacagggcgaagg

SEQ ID NO: 3444876 - RNA, 23 nt, Pseudomonas aeruginosa PA01
ccgacaacgaaaagagccgcgcc

SEQ ID NO: 3444877 - RNA, 22 nt, Pseudomonas aeruginosa PA01
ccgacaagcauucagcgcgccc

SEQ ID NO: 3444878 - RNA, 18 nt, Pseudomonas aeruginosa PA01
ccgacaagccuccagcgc

SEQ ID NO: 3444879 - RNA, 21 nt, Pseudomonas aeruginosa PA01
ccgacaagccuccagcgccgc

SEQ ID NO: 3444880 - RNA, 15 nt, Pseudomonas aeruginosa PA01
ccgacaaggagcgcg

SEQ ID NO: 3444881 - RNA, 15 nt, Pseudomonas aeruginosa PA01
ccgacaaucgccgag

SEQ ID NO: 3444882 - RNA, 17 nt, Pseudomonas aeruginosa PA01
ccgacaaucgccgagaa

SEQ ID NO: 3444883 - RNA, 16 nt, Pseudomonas aeruginosa PA01
ccgacacccgcgccgc

SEQ ID NO: 3444884 - RNA, 18 nt, Pseudomonas aeruginosa PA01
ccgacaccucgaucagcg

SEQ ID NO: 3444885 - RNA, 23 nt, Pseudomonas aeruginosa PA01
ccgacacgcacucauagcucagc

SEQ ID NO: 3444886 - RNA, 11 nt, Pseudomonas aeruginosa PA01
ccgacacgugu

SEQ ID NO: 3444887 - RNA, 17 nt, Pseudomonas aeruginosa PA01
ccgacacguucaggcgu

SEQ ID NO: 3444888 - RNA, 20 nt, Pseudomonas aeruginosa PA01
ccgacacguucaggcguacg

SEQ ID NO: 3444889 - RNA, 16 nt, Pseudomonas aeruginosa PA01
ccgacagagcggccgg

SEQ ID NO: 3444890 - RNA, 19 nt, Pseudomonas aeruginosa PA01
ccgacagagcggccggcgc

SEQ ID NO: 3444891 - RNA, 21 nt, Pseudomonas aeruginosa PA01
ccgacagagcggccggcgcgg

SEQ ID NO: 3444892 - RNA, 15 nt, Pseudomonas aeruginosa PA01
ccgacagcaggucgu

SEQ ID NO: 3444893 - RNA, 13 nt, Pseudomonas aeruginosa PA01
ccgacagcggcug

SEQ ID NO: 3444894 - RNA, 16 nt, Pseudomonas aeruginosa PA01
ccgacagcggcuggcg

SEQ ID NO: 3444895 - RNA, 17 nt, Pseudomonas aeruginosa PA01
ccgacaggcagcgccgc

SEQ ID NO: 3444896 - RNA, 18 nt, Pseudomonas aeruginosa PA01
ccgacaggcagcgccgcc

SEQ ID NO: 3444897 - RNA, 22 nt, Pseudomonas aeruginosa PA01
ccgacaggcagcgccgcccaca

SEQ ID NO: 3444898 - RNA, 18 nt, Pseudomonas aeruginosa PA01
ccgacaggccgaccagca

SEQ ID NO: 3444899 - RNA, 14 nt, Pseudomonas aeruginosa PA01
ccgacaggccggug

SEQ ID NO: 3444900 - RNA, 15 nt, Pseudomonas aeruginosa PA01
ccgacaggccggugc

SEQ ID NO: 3444901 - RNA, 21 nt, Pseudomonas aeruginosa PA01
ccgacaggccggugccgccgg

SEQ ID NO: 3444902 - RNA, 21 nt, Pseudomonas aeruginosa PA01
ccgacaggucgcuuucgcgca

SEQ ID NO: 3444903 - RNA, 23 nt, Pseudomonas aeruginosa PA01
ccgacaggucgcuuucgcgcaga

SEQ ID NO: 3444904 - RNA, 15 nt, Pseudomonas aeruginosa PA01
ccgacagucccaggc

SEQ ID NO: 3444905 - RNA, 16 nt, Pseudomonas aeruginosa PA01
ccgacagucccaggcc

SEQ ID NO: 3444906 - RNA, 17 nt, Pseudomonas aeruginosa PA01
ccgacagucccaggcca

SEQ ID NO: 3444907 - RNA, 12 nt, Pseudomonas aeruginosa PA01
ccgacggcccuc

SEQ ID NO: 3444908 - RNA, 13 nt, Pseudomonas aeruginosa PA01
ccgacggcccucc

SEQ ID NO: 3444909 - RNA, 19 nt, Pseudomonas aeruginosa PA01
ccgacggcccuccggcgcg

SEQ ID NO: 3444910 - RNA, 13 nt, Pseudomonas aeruginosa PA01
ccgacggcgcgcu

SEQ ID NO: 3444911 - RNA, 15 nt, Pseudomonas aeruginosa PA01
ccgacggcgcgcugc

SEQ ID NO: 3444912 - RNA, 16 nt, Pseudomonas aeruginosa PA01
ccgacggcgcgcugcg

SEQ ID NO: 3444913 - RNA, 15 nt, Pseudomonas aeruginosa PA01
ccgacggcgugccgu

SEQ ID NO: 3444914 - RNA, 23 nt, Pseudomonas aeruginosa PA01
ccgacggcuucgaccacgacccg

SEQ ID NO: 3444915 - RNA, 19 nt, Pseudomonas aeruginosa PA01
ccgacggcuugaucacgcc

SEQ ID NO: 3444916 - RNA, 20 nt, Pseudomonas aeruginosa PA01
ccgacggcuugaucacgccg

SEQ ID NO: 3444917 - RNA, 21 nt, Pseudomonas aeruginosa PA01
ccgacgggucgccauggucgu

SEQ ID NO: 3444918 - RNA, 17 nt, Pseudomonas aeruginosa PA01
ccgacggguucuucucg

SEQ ID NO: 3444919 - RNA, 21 nt, Pseudomonas aeruginosa PA01
ccgacgguaguaccucgaagc

SEQ ID NO: 3444920 - RNA, 15 nt, Pseudomonas aeruginosa PA01
ccgacggugcggccg

SEQ ID NO: 3444921 - RNA, 21 nt, Pseudomonas aeruginosa PA01
ccgacguagggcaucgccgac

SEQ ID NO: 3444922 - RNA, 22 nt, Pseudomonas aeruginosa PA01
ccgacgucacggauaggcggcg

SEQ ID NO: 3444923 - RNA, 23 nt, Pseudomonas aeruginosa PA01
ccgacgucacggauaggcggcgg

SEQ ID NO: 3444924 - RNA, 16 nt, Pseudomonas aeruginosa PA01
ccgacguccuccagga

SEQ ID NO: 3444925 - RNA, 21 nt, Pseudomonas aeruginosa PA01
ccgacgucgaugacgauggcg

SEQ ID NO: 3444926 - RNA, 22 nt, Pseudomonas aeruginosa PA01
ccgacgucgaugacgauggcgc

SEQ ID NO: 3444927 - RNA, 23 nt, Pseudomonas aeruginosa PA01
ccgacgucgaugacgauggcgcc

SEQ ID NO: 3444928 - RNA, 23 nt, Pseudomonas aeruginosa PA01
ccgacgugcacccgcuguuucuc

SEQ ID NO: 3444929 - RNA, 16 nt, Pseudomonas aeruginosa PA01
ccgacguugagaaggc

SEQ ID NO: 3444930 - RNA, 23 nt, Pseudomonas aeruginosa PA01
ccgacugagcuaauccggcggcg

SEQ ID NO: 3444931 - RNA, 17 nt, Pseudomonas aeruginosa PA01
ccgacugcaacuggccg

SEQ ID NO: 3444932 - RNA, 19 nt, Pseudomonas aeruginosa PA01
ccgacuuccaggcgcaggc

SEQ ID NO: 3444933 - RNA, 23 nt, Pseudomonas aeruginosa PA01
ccgagaaaacccugggaauggcg

SEQ ID NO: 3444934 - RNA, 16 nt, Pseudomonas aeruginosa PA01
ccgagaaaccgccauc

SEQ ID NO: 3444935 - RNA, 12 nt, Pseudomonas aeruginosa PA01
ccgagaaccagu

SEQ ID NO: 3444936 - RNA, 15 nt, Pseudomonas aeruginosa PA01
ccgagaagccggggc

SEQ ID NO: 3444937 - RNA, 16 nt, Pseudomonas aeruginosa PA01
ccgagaaucugcccgg

SEQ ID NO: 3444938 - RNA, 22 nt, Pseudomonas aeruginosa PA01
ccgagaaucugcccggccaugc

SEQ ID NO: 3444939 - RNA, 17 nt, Pseudomonas aeruginosa PA01
ccgagacgaucagcagg

SEQ ID NO: 3444940 - RNA, 21 nt, Pseudomonas aeruginosa PA01
ccgagacgaucagcaggaugc

SEQ ID NO: 3444941 - RNA, 15 nt, Pseudomonas aeruginosa PA01
ccgagacgcccugga

SEQ ID NO: 3444942 - RNA, 19 nt, Pseudomonas aeruginosa PA01
ccgagacgugaagccccug

SEQ ID NO: 3444943 - RNA, 15 nt, Pseudomonas aeruginosa PA01
ccgagacuugaucgc

SEQ ID NO: 3444944 - RNA, 13 nt, Pseudomonas aeruginosa PA01
ccgagagcggcgc

SEQ ID NO: 3444945 - RNA, 20 nt, Pseudomonas aeruginosa PA01
ccgagagcggcgccaggcgu

SEQ ID NO: 3444946 - RNA, 22 nt, Pseudomonas aeruginosa PA01
ccgagagcggcgccaggcguuc

SEQ ID NO: 3444947 - RNA, 22 nt, Pseudomonas aeruginosa PA01
ccgagagugguauuggucgcga

SEQ ID NO: 3444948 - RNA, 14 nt, Pseudomonas aeruginosa PA01
ccgagaucggucac

SEQ ID NO: 3444949 - RNA, 20 nt, Pseudomonas aeruginosa PA01
ccgagaugcagagaaaaggc

SEQ ID NO: 3444950 - RNA, 13 nt, Pseudomonas aeruginosa PA01
ccgagaugcugcc

SEQ ID NO: 3444951 - RNA, 20 nt, Pseudomonas aeruginosa PA01
ccgagauucugcaggcgcuc

SEQ ID NO: 3444952 - RNA, 16 nt, Pseudomonas aeruginosa PA01
ccgagauuggccgccu

SEQ ID NO: 3444953 - RNA, 17 nt, Pseudomonas aeruginosa PA01
ccgagauuggccgccug

SEQ ID NO: 3444954 - RNA, 22 nt, Pseudomonas aeruginosa PA01
ccgagcaaccgcgauggcguga

SEQ ID NO: 3444955 - RNA, 15 nt, Pseudomonas aeruginosa PA01
ccgagcaacggcagc

SEQ ID NO: 3444956 - RNA, 17 nt, Pseudomonas aeruginosa PA01
ccgagcaacucggcggc

SEQ ID NO: 3444957 - RNA, 20 nt, Pseudomonas aeruginosa PA01
ccgagcaacucggcggcgag

SEQ ID NO: 3444958 - RNA, 21 nt, Pseudomonas aeruginosa PA01
ccgagcaacucggcggcgagc

SEQ ID NO: 3444959 - RNA, 16 nt, Pseudomonas aeruginosa PA01
ccgagcaacugcaugu

SEQ ID NO: 3444960 - RNA, 19 nt, Pseudomonas aeruginosa PA01
ccgagcaagccuuccaggu

SEQ ID NO: 3444961 - RNA, 19 nt, Pseudomonas aeruginosa PA01
ccgagcaauccggcgcugc

SEQ ID NO: 3444962 - RNA, 22 nt, Pseudomonas aeruginosa PA01
ccgagcaauccggcgcugccga

SEQ ID NO: 3444963 - RNA, 14 nt, Pseudomonas aeruginosa PA01
ccgagcacagggug

SEQ ID NO: 3444964 - RNA, 15 nt, Pseudomonas aeruginosa PA01
ccgagcacaggguga

SEQ ID NO: 3444965 - RNA, 13 nt, Pseudomonas aeruginosa PA01
ccgagcaccacgc

SEQ ID NO: 3444966 - RNA, 17 nt, Pseudomonas aeruginosa PA01
ccgagcaccacgcgcaa

SEQ ID NO: 3444967 - RNA, 14 nt, Pseudomonas aeruginosa PA01
ccgagcaccccgac

SEQ ID NO: 3444968 - RNA, 16 nt, Pseudomonas aeruginosa PA01
ccgagcaccggcagga

SEQ ID NO: 3444969 - RNA, 19 nt, Pseudomonas aeruginosa PA01
ccgagcaccggcaggacga

SEQ ID NO: 3444970 - RNA, 11 nt, Pseudomonas aeruginosa PA01
ccgagcagcac

SEQ ID NO: 3444971 - RNA, 18 nt, Pseudomonas aeruginosa PA01
ccgagcagcaccaggcug

SEQ ID NO: 3444972 - RNA, 14 nt, Pseudomonas aeruginosa PA01
ccgagcagcggacg

SEQ ID NO: 3444973 - RNA, 13 nt, Pseudomonas aeruginosa PA01
ccgagcagcggcg

SEQ ID NO: 3444974 - RNA, 19 nt, Pseudomonas aeruginosa PA01
ccgagcaggaagaagccga

SEQ ID NO: 3444975 - RNA, 17 nt, Pseudomonas aeruginosa PA01
ccgagcaggacagcagg

SEQ ID NO: 3444976 - RNA, 18 nt, Pseudomonas aeruginosa PA01
ccgagcaggcacccgcgg

SEQ ID NO: 3444977 - RNA, 22 nt, Pseudomonas aeruginosa PA01
ccgagcaggccuugcagggccg

SEQ ID NO: 3444978 - RNA, 23 nt, Pseudomonas aeruginosa PA01
ccgagcaggccuugcagggccgc

SEQ ID NO: 3444979 - RNA, 18 nt, Pseudomonas aeruginosa PA01
ccgagcaggcgcgccagg

SEQ ID NO: 3444980 - RNA, 15 nt, Pseudomonas aeruginosa PA01
ccgagcaucagcgac

SEQ ID NO: 3444981 - RNA, 16 nt, Pseudomonas aeruginosa PA01
ccgagcaucagcgacu

SEQ ID NO: 3444982 - RNA, 20 nt, Pseudomonas aeruginosa PA01
ccgagcaugaugcaggcagu

SEQ ID NO: 3444983 - RNA, 16 nt, Pseudomonas aeruginosa PA01
ccgagcaugcgcggca

SEQ ID NO: 3444984 - RNA, 20 nt, Pseudomonas aeruginosa PA01
ccgagcauguaggcgcacca

SEQ ID NO: 3444985 - RNA, 17 nt, Pseudomonas aeruginosa PA01
ccgagcauuccgacaag

SEQ ID NO: 3444986 - RNA, 13 nt, Pseudomonas aeruginosa PA01
ccgagccagccgc

SEQ ID NO: 3444987 - RNA, 12 nt, Pseudomonas aeruginosa PA01
ccgagccaggua

SEQ ID NO: 3444988 - RNA, 15 nt, Pseudomonas aeruginosa PA01
ccgagcccaccggga

SEQ ID NO: 3444989 - RNA, 15 nt, Pseudomonas aeruginosa PA01
ccgagcccagcggca

SEQ ID NO: 3444990 - RNA, 16 nt, Pseudomonas aeruginosa PA01
ccgagcccagcggcag

SEQ ID NO: 3444991 - RNA, 16 nt, Pseudomonas aeruginosa PA01
ccgagcccccggcgcc

SEQ ID NO: 3444992 - RNA, 18 nt, Pseudomonas aeruginosa PA01
ccgagcccccggcgccca

SEQ ID NO: 3444993 - RNA, 22 nt, Pseudomonas aeruginosa PA01
ccgagccccgguuacucgccgg

SEQ ID NO: 3444994 - RNA, 18 nt, Pseudomonas aeruginosa PA01
ccgagcccgagugcgccc

SEQ ID NO: 3444995 - RNA, 19 nt, Pseudomonas aeruginosa PA01
ccgagcccgagugcgccca

SEQ ID NO: 3444996 - RNA, 14 nt, Pseudomonas aeruginosa PA01
ccgagcccggccgg

SEQ ID NO: 3444997 - RNA, 15 nt, Pseudomonas aeruginosa PA01
ccgagccgacauccu

SEQ ID NO: 3444998 - RNA, 13 nt, Pseudomonas aeruginosa PA01
ccgagccgcugca

SEQ ID NO: 3444999 - RNA, 14 nt, Pseudomonas aeruginosa PA01
ccgagccggacgag

SEQ ID NO: 3445000 - RNA, 16 nt, Pseudomonas aeruginosa PA01
ccgagccggcugccga

SEQ ID NO: 3445001 - RNA, 22 nt, Pseudomonas aeruginosa PA01
ccgagcgacuggaugaacagcg

SEQ ID NO: 3445002 - RNA, 14 nt, Pseudomonas aeruginosa PA01
ccgagcgcagcgcc

SEQ ID NO: 3445003 - RNA, 16 nt, Pseudomonas aeruginosa PA01
ccgagcgcagcgccac

SEQ ID NO: 3445004 - RNA, 19 nt, Pseudomonas aeruginosa PA01
ccgagcgcaguucgucgcc

SEQ ID NO: 3445005 - RNA, 21 nt, Pseudomonas aeruginosa PA01
ccgagcgcaguucgucgccca

SEQ ID NO: 3445006 - RNA, 22 nt, Pseudomonas aeruginosa PA01
ccgagcgcaguucgucgcccau

SEQ ID NO: 3445007 - RNA, 13 nt, Pseudomonas aeruginosa PA01
ccgagcgccgcca

SEQ ID NO: 3445008 - RNA, 21 nt, Pseudomonas aeruginosa PA01
ccgagcgccgccaggcaggcc

SEQ ID NO: 3445009 - RNA, 17 nt, Pseudomonas aeruginosa PA01
ccgaggucgccgccagc

SEQ ID NO: 3445010 - RNA, 16 nt, Pseudomonas aeruginosa PA01
ccgaggucgcgggcca

SEQ ID NO: 3445011 - RNA, 20 nt, Pseudomonas aeruginosa PA01
ccgaggucgcgggccaggcc

SEQ ID NO: 3445012 - RNA, 13 nt, Pseudomonas aeruginosa PA01
ccgaggucggcgg

SEQ ID NO: 3445013 - RNA, 18 nt, Pseudomonas aeruginosa PA01
ccgaggucgucgcugagc

SEQ ID NO: 3445014 - RNA, 21 nt, Pseudomonas aeruginosa PA01
ccgaggucgucgcugagcagu

SEQ ID NO: 3445015 - RNA, 16 nt, Pseudomonas aeruginosa PA01
ccgaggucuuggccag

SEQ ID NO: 3445016 - RNA, 17 nt, Pseudomonas aeruginosa PA01
ccgaggucuuggccagc

SEQ ID NO: 3445017 - RNA, 20 nt, Pseudomonas aeruginosa PA01
ccgaggucuuggccagccgc

SEQ ID NO: 3445018 - RNA, 21 nt, Pseudomonas aeruginosa PA01
ccgaggucuuggccagccgcg

SEQ ID NO: 3445019 - RNA, 14 nt, Pseudomonas aeruginosa PA01
ccgaggugucgccg

SEQ ID NO: 3445020 - RNA, 17 nt, Pseudomonas aeruginosa PA01
ccgaggugucgccgcgg

SEQ ID NO: 3445021 - RNA, 12 nt, Pseudomonas aeruginosa PA01
ccgagguucuuc

SEQ ID NO: 3445022 - RNA, 22 nt, Pseudomonas aeruginosa PA01
ccgagguucuugcccagcaacg

SEQ ID NO: 3445023 - RNA, 18 nt, Pseudomonas aeruginosa PA01
ccgagguugacgaacggc

SEQ ID NO: 3445024 - RNA, 14 nt, Pseudomonas aeruginosa PA01
ccgagguuuccagu

SEQ ID NO: 3445025 - RNA, 14 nt, Pseudomonas aeruginosa PA01
ccgaguaggcgcug

SEQ ID NO: 3445026 - RNA, 14 nt, Pseudomonas aeruginosa PA01
ccgagucccuugcg

SEQ ID NO: 3445027 - RNA, 13 nt, Pseudomonas aeruginosa PA01
ccgaguccgcgcg

SEQ ID NO: 3445028 - RNA, 14 nt, Pseudomonas aeruginosa PA01
ccgaguccgcgcgc

SEQ ID NO: 3445029 - RNA, 16 nt, Pseudomonas aeruginosa PA01
ccgaguccgcgcgcgc

SEQ ID NO: 3445030 - RNA, 19 nt, Pseudomonas aeruginosa PA01
ccgaguccgcgcgcgcgcu

SEQ ID NO: 3445031 - RNA, 14 nt, Pseudomonas aeruginosa PA01
ccgaguccugcugc

SEQ ID NO: 3445032 - RNA, 15 nt, Pseudomonas aeruginosa PA01
ccgaguccugcugcg

SEQ ID NO: 3445033 - RNA, 18 nt, Pseudomonas aeruginosa PA01
ccgagugccggcgcgucg

SEQ ID NO: 3445034 - RNA, 23 nt, Pseudomonas aeruginosa PA01
ccgagugccggcgcgucgcugcg

SEQ ID NO: 3445035 - RNA, 15 nt, Pseudomonas aeruginosa PA01
ccgagugcgcccagc

SEQ ID NO: 3445036 - RNA, 21 nt, Pseudomonas aeruginosa PA01
ccgagugcgcccagcagcagg

SEQ ID NO: 3445037 - RNA, 18 nt, Pseudomonas aeruginosa PA01
ccgaguggccgaaggcgc

SEQ ID NO: 3445038 - RNA, 19 nt, Pseudomonas aeruginosa PA01
ccgaguggccgaaggcgcu

SEQ ID NO: 3445039 - RNA, 16 nt, Pseudomonas aeruginosa PA01
ccgaguggccgcugag

SEQ ID NO: 3445040 - RNA, 19 nt, Pseudomonas aeruginosa PA01
ccgaguggcgcagcgcccg

SEQ ID NO: 3445041 - RNA, 13 nt, Pseudomonas aeruginosa PA01
ccgaguucaccac

SEQ ID NO: 3445042 - RNA, 13 nt, Pseudomonas aeruginosa PA01
ccgaguucgccgc

SEQ ID NO: 3445043 - RNA, 19 nt, Pseudomonas aeruginosa PA01
ccgaguucgccgcgagcac

SEQ ID NO: 3445044 - RNA, 18 nt, Pseudomonas aeruginosa PA01
ccgaguucgcgcaggcgc

SEQ ID NO: 3445045 - RNA, 13 nt, Pseudomonas aeruginosa PA01
ccgaguugaccag

SEQ ID NO: 3445046 - RNA, 23 nt, Pseudomonas aeruginosa PA01
ccgaguuggaaccaguugccgag

SEQ ID NO: 3445047 - RNA, 21 nt, Pseudomonas aeruginosa PA01
ccgaguuggcccaauccgcgc

SEQ ID NO: 3445048 - RNA, 18 nt, Pseudomonas aeruginosa PA01
ccgaguuucccggcgcgg

SEQ ID NO: 3445049 - RNA, 22 nt, Pseudomonas aeruginosa PA01
ccgauacccugggagccgccgg

SEQ ID NO: 3445050 - RNA, 23 nt, Pseudomonas aeruginosa PA01
ccgauacgagaucgagcgcgccc

SEQ ID NO: 3445051 - RNA, 15 nt, Pseudomonas aeruginosa PA01
ccgauaggcgccggc

SEQ ID NO: 3445052 - RNA, 22 nt, Pseudomonas aeruginosa PA01
ccgauauaggggaugccuucgg

SEQ ID NO: 3445053 - RNA, 21 nt, Pseudomonas aeruginosa PA01
ccgaucaacgcggccagcagc

SEQ ID NO: 3445054 - RNA, 14 nt, Pseudomonas aeruginosa PA01
ccgaucaccaccag

SEQ ID NO: 3445055 - RNA, 15 nt, Pseudomonas aeruginosa PA01
ccgaucaccaccagc

SEQ ID NO: 3445056 - RNA, 13 nt, Pseudomonas aeruginosa PA01
ccgaucaccagca

SEQ ID NO: 3445057 - RNA, 14 nt, Pseudomonas aeruginosa PA01
ccgaucaccagcgc

SEQ ID NO: 3445058 - RNA, 18 nt, Pseudomonas aeruginosa PA01
ccgaucaccagcgccagg

SEQ ID NO: 3445059 - RNA, 21 nt, Pseudomonas aeruginosa PA01
ccgaucaccagcgccaggccg

SEQ ID NO: 3445060 - RNA, 23 nt, Pseudomonas aeruginosa PA01
ccgaucaccaggaucgccgggcu

SEQ ID NO: 3445061 - RNA, 15 nt, Pseudomonas aeruginosa PA01
ccgaucaccccgccc

SEQ ID NO: 3445062 - RNA, 15 nt, Pseudomonas aeruginosa PA01
ccgaucaccuggcca

SEQ ID NO: 3445063 - RNA, 19 nt, Pseudomonas aeruginosa PA01
ccgaucagcaccgccacca

SEQ ID NO: 3445064 - RNA, 16 nt, Pseudomonas aeruginosa PA01
ccgaucagcccgucgg

SEQ ID NO: 3445065 - RNA, 18 nt, Pseudomonas aeruginosa PA01
ccgaucagcccgucggcc

SEQ ID NO: 3445066 - RNA, 19 nt, Pseudomonas aeruginosa PA01
ccgaucagcccgucggccu

SEQ ID NO: 3445067 - RNA, 16 nt, Pseudomonas aeruginosa PA01
ccgaucagcgccucgg

SEQ ID NO: 3445068 - RNA, 13 nt, Pseudomonas aeruginosa PA01
ccgaucagcgcgc

SEQ ID NO: 3445069 - RNA, 15 nt, Pseudomonas aeruginosa PA01
ccgaucagcgcgccu

SEQ ID NO: 3445070 - RNA, 23 nt, Pseudomonas aeruginosa PA01
ccgaucagcgcgccuucgacgcg

SEQ ID NO: 3445071 - RNA, 22 nt, Pseudomonas aeruginosa PA01
ccgaucaggcugaagcggccgc

SEQ ID NO: 3445072 - RNA, 15 nt, Pseudomonas aeruginosa PA01
ccgaucaggucgcgc

SEQ ID NO: 3445073 - RNA, 21 nt, Pseudomonas aeruginosa PA01
ccgaucaguggucgcagcucc

SEQ ID NO: 3445074 - RNA, 14 nt, Pseudomonas aeruginosa PA01
ccgaucaucggcug

SEQ ID NO: 3445075 - RNA, 15 nt, Pseudomonas aeruginosa PA01
ccgaucaucggcugg

SEQ ID NO: 3445076 - RNA, 16 nt, Pseudomonas aeruginosa PA01
ccgaucaucggcuggu

SEQ ID NO: 3445077 - RNA, 15 nt, Pseudomonas aeruginosa PA01
ccgaucaugcucggc

SEQ ID NO: 3445078 - RNA, 21 nt, Pseudomonas aeruginosa PA01
ccgaucaugggggccagcagg

SEQ ID NO: 3445079 - RNA, 19 nt, Pseudomonas aeruginosa PA01
ccgaucccgacgcccucca

SEQ ID NO: 3445080 - RNA, 21 nt, Pseudomonas aeruginosa PA01
ccgaucccgacgcccuccagc

SEQ ID NO: 3445081 - RNA, 23 nt, Pseudomonas aeruginosa PA01
ccgaucccgacgcccuccagcac

SEQ ID NO: 3445082 - RNA, 14 nt, Pseudomonas aeruginosa PA01
ccgaucccgaucgg

SEQ ID NO: 3445083 - RNA, 15 nt, Pseudomonas aeruginosa PA01
ccgaucccggcggcg

SEQ ID NO: 3445084 - RNA, 21 nt, Pseudomonas aeruginosa PA01
ccgaucccggcggcgacccag

SEQ ID NO: 3445085 - RNA, 13 nt, Pseudomonas aeruginosa PA01
ccgauccgcgaau

SEQ ID NO: 3445086 - RNA, 15 nt, Pseudomonas aeruginosa PA01
ccgauccuccugggg

SEQ ID NO: 3445087 - RNA, 16 nt, Pseudomonas aeruginosa PA01
ccgaucgaagaaggcu

SEQ ID NO: 3445088 - RNA, 21 nt, Pseudomonas aeruginosa PA01
ccgaucgaagaaggcucaccg

SEQ ID NO: 3445089 - RNA, 17 nt, Pseudomonas aeruginosa PA01
ccgaucgagcggcccgc

SEQ ID NO: 3445090 - RNA, 15 nt, Pseudomonas aeruginosa PA01
ccgaucgcccgcgcc

SEQ ID NO: 3445091 - RNA, 17 nt, Pseudomonas aeruginosa PA01
ccgaucgccgcgcgguc

SEQ ID NO: 3445092 - RNA, 18 nt, Pseudomonas aeruginosa PA01
ccgaucgccgcgcggucg

SEQ ID NO: 3445093 - RNA, 19 nt, Pseudomonas aeruginosa PA01
ccgaucgccgcgcggucga

SEQ ID NO: 3445094 - RNA, 23 nt, Pseudomonas aeruginosa PA01
ccgaucgccgcgcggucgagcuc

SEQ ID NO: 3445095 - RNA, 13 nt, Pseudomonas aeruginosa PA01
ccgaucgccucgg

SEQ ID NO: 3445096 - RNA, 20 nt, Pseudomonas aeruginosa PA01
ccgaucgccucggccaucga

SEQ ID NO: 3445097 - RNA, 22 nt, Pseudomonas aeruginosa PA01
ccgaucgccucggccaucgagc

SEQ ID NO: 3445098 - RNA, 20 nt, Pseudomonas aeruginosa PA01
ccgaucgccucgucgagcgc

SEQ ID NO: 3445099 - RNA, 21 nt, Pseudomonas aeruginosa PA01
ccgaucgccucgucgagcgca

SEQ ID NO: 3445100 - RNA, 13 nt, Pseudomonas aeruginosa PA01
ccgaucggcaagc

SEQ ID NO: 3445101 - RNA, 13 nt, Pseudomonas aeruginosa PA01
ccgaucggcaugu

SEQ ID NO: 3445102 - RNA, 15 nt, Pseudomonas aeruginosa PA01
ccgaucggcugccca

SEQ ID NO: 3445103 - RNA, 16 nt, Pseudomonas aeruginosa PA01
ccgaucguuggcgaag

SEQ ID NO: 3445104 - RNA, 17 nt, Pseudomonas aeruginosa PA01
ccgaucguuggcgaagu

SEQ ID NO: 3445105 - RNA, 14 nt, Pseudomonas aeruginosa PA01
ccgaucuccuccgc

SEQ ID NO: 3445106 - RNA, 15 nt, Pseudomonas aeruginosa PA01
ccgaucuccuccgcc

SEQ ID NO: 3445107 - RNA, 18 nt, Pseudomonas aeruginosa PA01
ccgaucuccuccgccccg

SEQ ID NO: 3445108 - RNA, 16 nt, Pseudomonas aeruginosa PA01
ccgaucuccugguaga

SEQ ID NO: 3445109 - RNA, 21 nt, Pseudomonas aeruginosa PA01
ccgaucucguggacccgugcg

SEQ ID NO: 3445110 - RNA, 14 nt, Pseudomonas aeruginosa PA01
ccgaucuucagcag

SEQ ID NO: 3445111 - RNA, 16 nt, Pseudomonas aeruginosa PA01
ccgaucuucagcagca

SEQ ID NO: 3445112 - RNA, 23 nt, Pseudomonas aeruginosa PA01
ccgcagaaccagacgcucggcca

SEQ ID NO: 3445113 - RNA, 14 nt, Pseudomonas aeruginosa PA01
ccgcagacaucgcc

SEQ ID NO: 3445114 - RNA, 15 nt, Pseudomonas aeruginosa PA01
ccgcagacaucgccg

SEQ ID NO: 3445115 - RNA, 23 nt, Pseudomonas aeruginosa PA01
ccgcagacaucgccgagggcgaa

SEQ ID NO: 3445116 - RNA, 16 nt, Pseudomonas aeruginosa PA01
ccgcagaccagcgaac

SEQ ID NO: 3445117 - RNA, 20 nt, Pseudomonas aeruginosa PA01
ccgcagaccagcgaaccgcc

SEQ ID NO: 3445118 - RNA, 22 nt, Pseudomonas aeruginosa PA01
ccgcagaccagcgaaccgccgg

SEQ ID NO: 3445119 - RNA, 23 nt, Pseudomonas aeruginosa PA01
ccgcagaccagcgaaccgccggc

SEQ ID NO: 3445120 - RNA, 22 nt, Pseudomonas aeruginosa PA01
ccgcagacguggcauucgucgc

SEQ ID NO: 3445121 - RNA, 15 nt, Pseudomonas aeruginosa PA01
ccgcagacuccggcg

SEQ ID NO: 3445122 - RNA, 16 nt, Pseudomonas aeruginosa PA01
ccgcagacuccggcgc

SEQ ID NO: 3445123 - RNA, 20 nt, Pseudomonas aeruginosa PA01
ccgcagagcaucacccgcga

SEQ ID NO: 3445124 - RNA, 23 nt, Pseudomonas aeruginosa PA01
ccgcagauagggcaucagccccu

SEQ ID NO: 3445125 - RNA, 20 nt, Pseudomonas aeruginosa PA01
ccgcagaugcuccagggagc

SEQ ID NO: 3445126 - RNA, 23 nt, Pseudomonas aeruginosa PA01
ccgcagcaagucgaacaggcccu

SEQ ID NO: 3445127 - RNA, 13 nt, Pseudomonas aeruginosa PA01
ccgcagcacagcc

SEQ ID NO: 3445128 - RNA, 23 nt, Pseudomonas aeruginosa PA01
ccgcagcacagccccagccucgg

SEQ ID NO: 3445129 - RNA, 19 nt, Pseudomonas aeruginosa PA01
ccgcagcagguucgaaugc

SEQ ID NO: 3445130 - RNA, 22 nt, Pseudomonas aeruginosa PA01
ccgcagcagguucgaaugcugc

SEQ ID NO: 3445131 - RNA, 23 nt, Pseudomonas aeruginosa PA01
ccgcagcagguucgaaugcugcc

SEQ ID NO: 3445132 - RNA, 19 nt, Pseudomonas aeruginosa PA01
ccgcagccacaggcgccag

SEQ ID NO: 3445133 - RNA, 20 nt, Pseudomonas aeruginosa PA01
ccgcagccacaggcgccagu

SEQ ID NO: 3445134 - RNA, 22 nt, Pseudomonas aeruginosa PA01
ccgcagccacggcacacgucgg

SEQ ID NO: 3445135 - RNA, 12 nt, Pseudomonas aeruginosa PA01
ccgcagcccagu

SEQ ID NO: 3445136 - RNA, 15 nt, Pseudomonas aeruginosa PA01
ccgcagccccgccgg

SEQ ID NO: 3445137 - RNA, 20 nt, Pseudomonas aeruginosa PA01
ccgcagcccgguccguccag

SEQ ID NO: 3445138 - RNA, 21 nt, Pseudomonas aeruginosa PA01
ccgcagcccuaggcgacccgg

SEQ ID NO: 3445139 - RNA, 12 nt, Pseudomonas aeruginosa PA01
ccgcagccggcg

SEQ ID NO: 3445140 - RNA, 15 nt, Pseudomonas aeruginosa PA01
ccgcagccguggcgc

SEQ ID NO: 3445141 - RNA, 19 nt, Pseudomonas aeruginosa PA01
ccgcagcgaucagcaccag

SEQ ID NO: 3445142 - RNA, 22 nt, Pseudomonas aeruginosa PA01
ccgcagcgaucagcaccagcgg

SEQ ID NO: 3445143 - RNA, 13 nt, Pseudomonas aeruginosa PA01
ccgcagcgcaacg

SEQ ID NO: 3445144 - RNA, 18 nt, Pseudomonas aeruginosa PA01
ccgcagcgcaagucggcc

SEQ ID NO: 3445145 - RNA, 21 nt, Pseudomonas aeruginosa PA01
ccgcagcgcaagucggccugc

SEQ ID NO: 3445146 - RNA, 15 nt, Pseudomonas aeruginosa PA01
ccgcagcgcagccga

SEQ ID NO: 3445147 - RNA, 19 nt, Pseudomonas aeruginosa PA01
ccgcagcgccacuuccagc

SEQ ID NO: 3445148 - RNA, 15 nt, Pseudomonas aeruginosa PA01
ccgcagcgccccucc

SEQ ID NO: 3445149 - RNA, 20 nt, Pseudomonas aeruginosa PA01
ccgcagcgcuuuucaggaug

SEQ ID NO: 3445150 - RNA, 13 nt, Pseudomonas aeruginosa PA01
ccgcagcggcagc

SEQ ID NO: 3445151 - RNA, 16 nt, Pseudomonas aeruginosa PA01
ccgcagcggcagcggc

SEQ ID NO: 3445152 - RNA, 19 nt, Pseudomonas aeruginosa PA01
ccgcagcggcagcggcucg

SEQ ID NO: 3445153 - RNA, 14 nt, Pseudomonas aeruginosa PA01
ccgcagcggcaugc

SEQ ID NO: 3445154 - RNA, 21 nt, Pseudomonas aeruginosa PA01
ccgcagcggcaugcccugccg

SEQ ID NO: 3445155 - RNA, 13 nt, Pseudomonas aeruginosa PA01
ccgcagcggcgcu

SEQ ID NO: 3445156 - RNA, 13 nt, Pseudomonas aeruginosa PA01
ccgcagcggcguc

SEQ ID NO: 3445157 - RNA, 17 nt, Pseudomonas aeruginosa PA01
ccgcagcggcuguugcc

SEQ ID NO: 3445158 - RNA, 13 nt, Pseudomonas aeruginosa PA01
ccgcagcucggcc

SEQ ID NO: 3445159 - RNA, 18 nt, Pseudomonas aeruginosa PA01
ccgcaggaaccgacgcgc

SEQ ID NO: 3445160 - RNA, 16 nt, Pseudomonas aeruginosa PA01
ccgcaggaaggcgaag

SEQ ID NO: 3445161 - RNA, 17 nt, Pseudomonas aeruginosa PA01
ccgcaggaaggcgaagc

SEQ ID NO: 3445162 - RNA, 15 nt, Pseudomonas aeruginosa PA01
ccgcaggaugccgcc

SEQ ID NO: 3445163 - RNA, 17 nt, Pseudomonas aeruginosa PA01
ccgcaggcaggucgcug

SEQ ID NO: 3445164 - RNA, 20 nt, Pseudomonas aeruginosa PA01
ccgcaggcaguggcgccagc

SEQ ID NO: 3445165 - RNA, 21 nt, Pseudomonas aeruginosa PA01
ccgcaggcaguggcgccagcc

SEQ ID NO: 3445166 - RNA, 24 nt, Pseudomonas aeruginosa PA01
ccgcaggcaguggcgccagccagc

SEQ ID NO: 3445167 - RNA, 17 nt, Pseudomonas aeruginosa PA01
ccgcaggccgcggccga

SEQ ID NO: 3445168 - RNA, 13 nt, Pseudomonas aeruginosa PA01
ccgcaggccggcc

SEQ ID NO: 3445169 - RNA, 21 nt, Pseudomonas aeruginosa PA01
ccgcaggccggccagggagcg

SEQ ID NO: 3445170 - RNA, 20 nt, Pseudomonas aeruginosa PA01
ccgcaggcgcuucagcgccu

SEQ ID NO: 3445171 - RNA, 18 nt, Pseudomonas aeruginosa PA01
ccgcaggcguuauccgcc

SEQ ID NO: 3445172 - RNA, 20 nt, Pseudomonas aeruginosa PA01
ccgcaggcugccguccaggc

SEQ ID NO: 3445173 - RNA, 22 nt, Pseudomonas aeruginosa PA01
ccgcaggcugccguccaggcgc

SEQ ID NO: 3445174 - RNA, 17 nt, Pseudomonas aeruginosa PA01
ccgcagggcucgugcca

SEQ ID NO: 3445175 - RNA, 21 nt, Pseudomonas aeruginosa PA01
ccgcagggcucgugccaucag

SEQ ID NO: 3445176 - RNA, 14 nt, Pseudomonas aeruginosa PA01
ccgcaggggcugcc

SEQ ID NO: 3445177 - RNA, 18 nt, Pseudomonas aeruginosa PA01
ccgcagggugcggcugcu

SEQ ID NO: 3445178 - RNA, 19 nt, Pseudomonas aeruginosa PA01
ccgcagguagcugagcagg

SEQ ID NO: 3445179 - RNA, 16 nt, Pseudomonas aeruginosa PA01
ccgcaggucggcgucu

SEQ ID NO: 3445180 - RNA, 13 nt, Pseudomonas aeruginosa PA01
ccgcaggucuugu

SEQ ID NO: 3445181 - RNA, 13 nt, Pseudomonas aeruginosa PA01
ccgcaggugaagc

SEQ ID NO: 3445182 - RNA, 18 nt, Pseudomonas aeruginosa PA01
ccgcagguugcacuugaa

SEQ ID NO: 3445183 - RNA, 21 nt, Pseudomonas aeruginosa PA01
ccgcagguuggccccgccgag

SEQ ID NO: 3445184 - RNA, 17 nt, Pseudomonas aeruginosa PA01
ccgcaguagaugccgcg

SEQ ID NO: 3445185 - RNA, 20 nt, Pseudomonas aeruginosa PA01
ccgcaguagcucgccgaggu

SEQ ID NO: 3445186 - RNA, 16 nt, Pseudomonas aeruginosa PA01
ccgcaguccagggcga

SEQ ID NO: 3445187 - RNA, 19 nt, Pseudomonas aeruginosa PA01
ccgcaguuccucgccgcug

SEQ ID NO: 3445188 - RNA, 21 nt, Pseudomonas aeruginosa PA01
ccgcaguuccucgccgcugcu

SEQ ID NO: 3445189 - RNA, 13 nt, Pseudomonas aeruginosa PA01
ccgcaguucgccc

SEQ ID NO: 3445190 - RNA, 16 nt, Pseudomonas aeruginosa PA01
ccgcaguucgccccgc

SEQ ID NO: 3445191 - RNA, 19 nt, Pseudomonas aeruginosa PA01
ccgcaguucgccccgccgc

SEQ ID NO: 3445192 - RNA, 21 nt, Pseudomonas aeruginosa PA01
ccgcaguucgccccgccgcca

SEQ ID NO: 3445193 - RNA, 22 nt, Pseudomonas aeruginosa PA01
ccgcaguucgccccgccgccag

SEQ ID NO: 3445194 - RNA, 18 nt, Pseudomonas aeruginosa PA01
ccgcaguuguuccucgcg

SEQ ID NO: 3445195 - RNA, 20 nt, Pseudomonas aeruginosa PA01
ccgcauaggucaugcccagg

SEQ ID NO: 3445196 - RNA, 21 nt, Pseudomonas aeruginosa PA01
ccgcauaggucaugcccaggc

SEQ ID NO: 3445197 - RNA, 21 nt, Pseudomonas aeruginosa PA01
ccgcauccucguuccacgggu

SEQ ID NO: 3445198 - RNA, 19 nt, Pseudomonas aeruginosa PA01
ccgcaucgaagcgcaccag

SEQ ID NO: 3445199 - RNA, 20 nt, Pseudomonas aeruginosa PA01
ccgcaucgaagcgcaccagg

SEQ ID NO: 3445200 - RNA, 16 nt, Pseudomonas aeruginosa PA01
ccgcaucgaaggcgcc

SEQ ID NO: 3445201 - RNA, 18 nt, Pseudomonas aeruginosa PA01
ccgcaucgaaggcgccgg

SEQ ID NO: 3445202 - RNA, 22 nt, Pseudomonas aeruginosa PA01
ccgcaucgaccuugcccucggc

SEQ ID NO: 3445203 - RNA, 16 nt, Pseudomonas aeruginosa PA01
ccgcaucgaggccgcc

SEQ ID NO: 3445204 - RNA, 20 nt, Pseudomonas aeruginosa PA01
ccgcaucgaggccgcccagc

SEQ ID NO: 3445205 - RNA, 14 nt, Pseudomonas aeruginosa PA01
ccgcaucgccaccg

SEQ ID NO: 3445206 - RNA, 11 nt, Pseudomonas aeruginosa PA01
ccgcaucgcgg

SEQ ID NO: 3445207 - RNA, 15 nt, Pseudomonas aeruginosa PA01
ccgcaucgcgggcgu

SEQ ID NO: 3445208 - RNA, 18 nt, Pseudomonas aeruginosa PA01
ccgcaucgcgggcgugcu

SEQ ID NO: 3445209 - RNA, 19 nt, Pseudomonas aeruginosa PA01
ccgcaucgcgggcgugcuc

SEQ ID NO: 3445210 - RNA, 22 nt, Pseudomonas aeruginosa PA01
ccgcaucgcgguuauccgccga

SEQ ID NO: 3445211 - RNA, 23 nt, Pseudomonas aeruginosa PA01
ccgcaucgcgguuauccgccggc

SEQ ID NO: 3445212 - RNA, 20 nt, Pseudomonas aeruginosa PA01
ccgcaucgcugaccucgagc

SEQ ID NO: 3445213 - RNA, 23 nt, Pseudomonas aeruginosa PA01
ccgccaggcgcgucgcggccucu

SEQ ID NO: 3445214 - RNA, 20 nt, Pseudomonas aeruginosa PA01
ccgccaggcgcgucuccagc

SEQ ID NO: 3445215 - RNA, 14 nt, Pseudomonas aeruginosa PA01
ccgccaggcgcucc

SEQ ID NO: 3445216 - RNA, 14 nt, Pseudomonas aeruginosa PA01
ccgccaggcggcaa

SEQ ID NO: 3445217 - RNA, 17 nt, Pseudomonas aeruginosa PA01
ccgccaggcggccgcug

SEQ ID NO: 3445218 - RNA, 20 nt, Pseudomonas aeruginosa PA01
ccgccaggcuggguuggcgc

SEQ ID NO: 3445219 - RNA, 21 nt, Pseudomonas aeruginosa PA01
ccgccaggcuggguuggcgcg

SEQ ID NO: 3445220 - RNA, 21 nt, Pseudomonas aeruginosa PA01
ccgccagggagcaggacgccg

SEQ ID NO: 3445221 - RNA, 19 nt, Pseudomonas aeruginosa PA01
ccgccagggcgcucaccga

SEQ ID NO: 3445222 - RNA, 14 nt, Pseudomonas aeruginosa PA01
ccgccagggcgucg

SEQ ID NO: 3445223 - RNA, 20 nt, Pseudomonas aeruginosa PA01
ccgccagggucagcucgaca

SEQ ID NO: 3445224 - RNA, 22 nt, Pseudomonas aeruginosa PA01
ccgccagggucagcucgacagc

SEQ ID NO: 3445225 - RNA, 20 nt, Pseudomonas aeruginosa PA01
ccgccaggguguuguucgcc

SEQ ID NO: 3445226 - RNA, 21 nt, Pseudomonas aeruginosa PA01
ccgccaggguguuguucgcca

SEQ ID NO: 3445227 - RNA, 15 nt, Pseudomonas aeruginosa PA01
ccgccagguccaggc

SEQ ID NO: 3445228 - RNA, 20 nt, Pseudomonas aeruginosa PA01
ccgccagguccaggcucagc

SEQ ID NO: 3445229 - RNA, 17 nt, Pseudomonas aeruginosa PA01
ccgccagguggcgggca

SEQ ID NO: 3445230 - RNA, 22 nt, Pseudomonas aeruginosa PA01
ccgccagguugcgcaaccagcg

SEQ ID NO: 3445231 - RNA, 15 nt, Pseudomonas aeruginosa PA01
ccgccagucggccug

SEQ ID NO: 3445232 - RNA, 16 nt, Pseudomonas aeruginosa PA01
ccgccagugcagccgu

SEQ ID NO: 3445233 - RNA, 17 nt, Pseudomonas aeruginosa PA01
ccgccaguuccggcaac

SEQ ID NO: 3445234 - RNA, 17 nt, Pseudomonas aeruginosa PA01
ccgccaguuccgggguc

SEQ ID NO: 3445235 - RNA, 15 nt, Pseudomonas aeruginosa PA01
ccgccaguucgcgca

SEQ ID NO: 3445236 - RNA, 17 nt, Pseudomonas aeruginosa PA01
ccgccaguucgcgcagg

SEQ ID NO: 3445237 - RNA, 12 nt, Pseudomonas aeruginosa PA01
ccgccaguucgg

SEQ ID NO: 3445238 - RNA, 15 nt, Pseudomonas aeruginosa PA01
ccgccaguucggcca

SEQ ID NO: 3445239 - RNA, 20 nt, Pseudomonas aeruginosa PA01
ccgccaguucggccaucagc

SEQ ID NO: 3445240 - RNA, 15 nt, Pseudomonas aeruginosa PA01
ccgccaucaccagcg

SEQ ID NO: 3445241 - RNA, 18 nt, Pseudomonas aeruginosa PA01
ccgccaucccucuaucac

SEQ ID NO: 3445242 - RNA, 15 nt, Pseudomonas aeruginosa PA01
ccgccaucgaccagg

SEQ ID NO: 3445243 - RNA, 21 nt, Pseudomonas aeruginosa PA01
ccgccaucgauggucaggcug

SEQ ID NO: 3445244 - RNA, 14 nt, Pseudomonas aeruginosa PA01
ccgccaucgcccgg

SEQ ID NO: 3445245 - RNA, 14 nt, Pseudomonas aeruginosa PA01
ccgccaucgccucg

SEQ ID NO: 3445246 - RNA, 17 nt, Pseudomonas aeruginosa PA01
ccgccaucgccucgccg

SEQ ID NO: 3445247 - RNA, 15 nt, Pseudomonas aeruginosa PA01
ccgccaugcucggcc

SEQ ID NO: 3445248 - RNA, 18 nt, Pseudomonas aeruginosa PA01
ccgccaugcucggccagc

SEQ ID NO: 3445249 - RNA, 20 nt, Pseudomonas aeruginosa PA01
ccgccaugcucggccagcuc

SEQ ID NO: 3445250 - RNA, 16 nt, Pseudomonas aeruginosa PA01
ccgccaugcuguugca

SEQ ID NO: 3445251 - RNA, 24 nt, Pseudomonas aeruginosa PA01
ccgccaugguuuaccaggaccagc

SEQ ID NO: 3445252 - RNA, 12 nt, Pseudomonas aeruginosa PA01
ccgcccacccug

SEQ ID NO: 3445253 - RNA, 14 nt, Pseudomonas aeruginosa PA01
ccgcccacccugcg

SEQ ID NO: 3445254 - RNA, 18 nt, Pseudomonas aeruginosa PA01
ccgcccacccugcgcgag

SEQ ID NO: 3445255 - RNA, 12 nt, Pseudomonas aeruginosa PA01
ccgcccagcagc

SEQ ID NO: 3445256 - RNA, 14 nt, Pseudomonas aeruginosa PA01
ccgcccagcagcac

SEQ ID NO: 3445257 - RNA, 19 nt, Pseudomonas aeruginosa PA01
ccgcccagcagcaccauca

SEQ ID NO: 3445258 - RNA, 15 nt, Pseudomonas aeruginosa PA01
ccgcccagcgcagcc

SEQ ID NO: 3445259 - RNA, 12 nt, Pseudomonas aeruginosa PA01
ccgcccagcgga

SEQ ID NO: 3445260 - RNA, 15 nt, Pseudomonas aeruginosa PA01
ccgcccaggacaacg

SEQ ID NO: 3445261 - RNA, 19 nt, Pseudomonas aeruginosa PA01
ccgcccaggcugccgccgc

SEQ ID NO: 3445262 - RNA, 21 nt, Pseudomonas aeruginosa PA01
ccgcccagggggccgggccga

SEQ ID NO: 3445263 - RNA, 13 nt, Pseudomonas aeruginosa PA01
ccgcccaguucgc

SEQ ID NO: 3445264 - RNA, 18 nt, Pseudomonas aeruginosa PA01
ccgcccaguucgccggcc

SEQ ID NO: 3445265 - RNA, 21 nt, Pseudomonas aeruginosa PA01
ccgcccaguucgccggccagc

SEQ ID NO: 3445266 - RNA, 18 nt, Pseudomonas aeruginosa PA01
ccgcccaguucgcgcgga

SEQ ID NO: 3445267 - RNA, 18 nt, Pseudomonas aeruginosa PA01
ccgcccaguucuucgccg

SEQ ID NO: 3445268 - RNA, 19 nt, Pseudomonas aeruginosa PA01
ccgcccaguucuucgccgc

SEQ ID NO: 3445269 - RNA, 22 nt, Pseudomonas aeruginosa PA01
ccgcccaguucuucgccgcccg

SEQ ID NO: 3445270 - RNA, 23 nt, Pseudomonas aeruginosa PA01
ccgcccaguucuucgccgcccgc

SEQ ID NO: 3445271 - RNA, 14 nt, Pseudomonas aeruginosa PA01
ccgcccaucaacga

SEQ ID NO: 3445272 - RNA, 16 nt, Pseudomonas aeruginosa PA01
ccgcccaucaacgagc

SEQ ID NO: 3445273 - RNA, 20 nt, Pseudomonas aeruginosa PA01
ccgcccauugcccggccagg

SEQ ID NO: 3445274 - RNA, 13 nt, Pseudomonas aeruginosa PA01
ccgccccaccacc

SEQ ID NO: 3445275 - RNA, 14 nt, Pseudomonas aeruginosa PA01
ccgccccaccacca

SEQ ID NO: 3445276 - RNA, 17 nt, Pseudomonas aeruginosa PA01
ccgccccaccccagggu

SEQ ID NO: 3445277 - RNA, 14 nt, Pseudomonas aeruginosa PA01
ccgcccccagcgcg

SEQ ID NO: 3445278 - RNA, 18 nt, Pseudomonas aeruginosa PA01
ccgcccccagcgcgccgc

SEQ ID NO: 3445279 - RNA, 14 nt, Pseudomonas aeruginosa PA01
ccgccccgaggggc

SEQ ID NO: 3445280 - RNA, 17 nt, Pseudomonas aeruginosa PA01
ccgccccgaggggcggc

SEQ ID NO: 3445281 - RNA, 21 nt, Pseudomonas aeruginosa PA01
ccgccccgcaccagccagccc

SEQ ID NO: 3445282 - RNA, 20 nt, Pseudomonas aeruginosa PA01
ccgccccggcaagcgccggc

SEQ ID NO: 3445283 - RNA, 13 nt, Pseudomonas aeruginosa PA01
ccgccccggcagc

SEQ ID NO: 3445284 - RNA, 14 nt, Pseudomonas aeruginosa PA01
ccgccccggcagcc

SEQ ID NO: 3445285 - RNA, 16 nt, Pseudomonas aeruginosa PA01
ccgccccggcagccac

SEQ ID NO: 3445286 - RNA, 17 nt, Pseudomonas aeruginosa PA01
ccgccccggcagccacc

SEQ ID NO: 3445287 - RNA, 20 nt, Pseudomonas aeruginosa PA01
ccgcccgagcuuugcgcagc

SEQ ID NO: 3445288 - RNA, 22 nt, Pseudomonas aeruginosa PA01
ccgcccgaucgccucgucgagc

SEQ ID NO: 3445289 - RNA, 24 nt, Pseudomonas aeruginosa PA01
ccgcccgaucgccucgucgagcgc

SEQ ID NO: 3445290 - RNA, 14 nt, Pseudomonas aeruginosa PA01
ccgcccgcaugcca

SEQ ID NO: 3445291 - RNA, 21 nt, Pseudomonas aeruginosa PA01
ccgcccgccguccuccagcaa

SEQ ID NO: 3445292 - RNA, 13 nt, Pseudomonas aeruginosa PA01
ccgcccgccgucg

SEQ ID NO: 3445293 - RNA, 14 nt, Pseudomonas aeruginosa PA01
ccgcccgccgucgc

SEQ ID NO: 3445294 - RNA, 14 nt, Pseudomonas aeruginosa PA01
ccgcccgcgccucc

SEQ ID NO: 3445295 - RNA, 17 nt, Pseudomonas aeruginosa PA01
ccgcccgcgccuccagg

SEQ ID NO: 3445296 - RNA, 22 nt, Pseudomonas aeruginosa PA01
ccgcccgcggaccgggcggcgc

SEQ ID NO: 3445297 - RNA, 20 nt, Pseudomonas aeruginosa PA01
ccgcccgcucaagggcuggc

SEQ ID NO: 3445298 - RNA, 16 nt, Pseudomonas aeruginosa PA01
ccgcccggaaccaccg

SEQ ID NO: 3445299 - RNA, 10 nt, Pseudomonas aeruginosa PA01
ccgcccggca

SEQ ID NO: 3445300 - RNA, 18 nt, Pseudomonas aeruginosa PA01
ccgcccggcaccaccggu

SEQ ID NO: 3445301 - RNA, 19 nt, Pseudomonas aeruginosa PA01
ccgcccggcaccgggguga

SEQ ID NO: 3445302 - RNA, 20 nt, Pseudomonas aeruginosa PA01
ccgcccggcagcggcuggcc

SEQ ID NO: 3445303 - RNA, 15 nt, Pseudomonas aeruginosa PA01
ccgcccggccaggcc

SEQ ID NO: 3445304 - RNA, 18 nt, Pseudomonas aeruginosa PA01
ccgcccggccaggccacg

SEQ ID NO: 3445305 - RNA, 12 nt, Pseudomonas aeruginosa PA01
ccgcccggccgc

SEQ ID NO: 3445306 - RNA, 13 nt, Pseudomonas aeruginosa PA01
ccgcccggcgcca

SEQ ID NO: 3445307 - RNA, 13 nt, Pseudomonas aeruginosa PA01
ccgcccggcucgc

SEQ ID NO: 3445308 - RNA, 15 nt, Pseudomonas aeruginosa PA01
ccgcccggcucgccg

SEQ ID NO: 3445309 - RNA, 16 nt, Pseudomonas aeruginosa PA01
ccgcccggcucgccgc

SEQ ID NO: 3445310 - RNA, 22 nt, Pseudomonas aeruginosa PA01
ccgcccggucuagcgccccggc

SEQ ID NO: 3445311 - RNA, 23 nt, Pseudomonas aeruginosa PA01
ccgcccggucuagcgccccggcc

SEQ ID NO: 3445312 - RNA, 21 nt, Pseudomonas aeruginosa PA01
ccgcccggucucagccggcgc

SEQ ID NO: 3445313 - RNA, 22 nt, Pseudomonas aeruginosa PA01
ccgcccggucucagccggcgcu

SEQ ID NO: 3445314 - RNA, 18 nt, Pseudomonas aeruginosa PA01
ccgcccgucaugaccaga

SEQ ID NO: 3445315 - RNA, 21 nt, Pseudomonas aeruginosa PA01
ccgcccgucaugaccagagcc

SEQ ID NO: 3445316 - RNA, 11 nt, Pseudomonas aeruginosa PA01
ccgccgccagg

SEQ ID NO: 3445317 - RNA, 12 nt, Pseudomonas aeruginosa PA01
ccgccgccaggc

SEQ ID NO: 3445318 - RNA, 11 nt, Pseudomonas aeruginosa PA01
ccgccgccgac

SEQ ID NO: 3445319 - RNA, 13 nt, Pseudomonas aeruginosa PA01
ccgccgccgacgu

SEQ ID NO: 3445320 - RNA, 13 nt, Pseudomonas aeruginosa PA01
ccgccgccgccgu

SEQ ID NO: 3445321 - RNA, 13 nt, Pseudomonas aeruginosa PA01
ccgccgccgcgcc

SEQ ID NO: 3445322 - RNA, 16 nt, Pseudomonas aeruginosa PA01
ccgccgccgcgccggc

SEQ ID NO: 3445323 - RNA, 14 nt, Pseudomonas aeruginosa PA01
ccgccgccgcgccu

SEQ ID NO: 3445324 - RNA, 15 nt, Pseudomonas aeruginosa PA01
ccgccgccgcggucu

SEQ ID NO: 3445325 - RNA, 10 nt, Pseudomonas aeruginosa PA01
ccgccgccgg

SEQ ID NO: 3445326 - RNA, 12 nt, Pseudomonas aeruginosa PA01
ccgccgccggcc

SEQ ID NO: 3445327 - RNA, 14 nt, Pseudomonas aeruginosa PA01
ccgccgccggccug

SEQ ID NO: 3445328 - RNA, 11 nt, Pseudomonas aeruginosa PA01
ccgccgccggg

SEQ ID NO: 3445329 - RNA, 12 nt, Pseudomonas aeruginosa PA01
ccgccgccgggc

SEQ ID NO: 3445330 - RNA, 13 nt, Pseudomonas aeruginosa PA01
ccgccgccgggcu

SEQ ID NO: 3445331 - RNA, 16 nt, Pseudomonas aeruginosa PA01
ccgccgccgggcuucg

SEQ ID NO: 3445332 - RNA, 13 nt, Pseudomonas aeruginosa PA01
ccgccgccggggc

SEQ ID NO: 3445333 - RNA, 14 nt, Pseudomonas aeruginosa PA01
ccgccgccggggcg

SEQ ID NO: 3445334 - RNA, 16 nt, Pseudomonas aeruginosa PA01
ccgccgccgugaucuc

SEQ ID NO: 3445335 - RNA, 17 nt, Pseudomonas aeruginosa PA01
ccgccgccugcucgccg

SEQ ID NO: 3445336 - RNA, 18 nt, Pseudomonas aeruginosa PA01
ccgccgccugcucgccgc

SEQ ID NO: 3445337 - RNA, 18 nt, Pseudomonas aeruginosa PA01
ccgccgccuggguggcga

SEQ ID NO: 3445338 - RNA, 20 nt, Pseudomonas aeruginosa PA01
ccgccgccuggguggcgacg

SEQ ID NO: 3445339 - RNA, 18 nt, Pseudomonas aeruginosa PA01
ccgccgcgagcgccgccg

SEQ ID NO: 3445340 - RNA, 19 nt, Pseudomonas aeruginosa PA01
ccgccgcgagcgccgccgg

SEQ ID NO: 3445341 - RNA, 12 nt, Pseudomonas aeruginosa PA01
ccgccgcgcagc

SEQ ID NO: 3445342 - RNA, 14 nt, Pseudomonas aeruginosa PA01
ccgccgcgcaggcg

SEQ ID NO: 3445343 - RNA, 18 nt, Pseudomonas aeruginosa PA01
ccgccgcgcaucaccccg

SEQ ID NO: 3445344 - RNA, 17 nt, Pseudomonas aeruginosa PA01
ccgccgcgcccggcgcc

SEQ ID NO: 3445345 - RNA, 16 nt, Pseudomonas aeruginosa PA01
ccgccgcgccgcucag

SEQ ID NO: 3445346 - RNA, 12 nt, Pseudomonas aeruginosa PA01
ccgccgcgccgg

SEQ ID NO: 3445347 - RNA, 18 nt, Pseudomonas aeruginosa PA01
ccgccgcgccggcgaucg

SEQ ID NO: 3445348 - RNA, 19 nt, Pseudomonas aeruginosa PA01
ccgccgcgccucgucgcgc

SEQ ID NO: 3445349 - RNA, 23 nt, Pseudomonas aeruginosa PA01
ccgccgcgccucgucgcgccagg

SEQ ID NO: 3445350 - RNA, 13 nt, Pseudomonas aeruginosa PA01
ccgccgcgcgcgc

SEQ ID NO: 3445351 - RNA, 14 nt, Pseudomonas aeruginosa PA01
ccgccgcgcgcgcg

SEQ ID NO: 3445352 - RNA, 15 nt, Pseudomonas aeruginosa PA01
ccgccgcgcgcgcgg

SEQ ID NO: 3445353 - RNA, 16 nt, Pseudomonas aeruginosa PA01
ccgccgcgcgcgcggu

SEQ ID NO: 3445354 - RNA, 17 nt, Pseudomonas aeruginosa PA01
ccgccgcgcgcgcgguc

SEQ ID NO: 3445355 - RNA, 13 nt, Pseudomonas aeruginosa PA01
ccgccgcgcugca

SEQ ID NO: 3445356 - RNA, 16 nt, Pseudomonas aeruginosa PA01
ccgccgcgcugcaggc

SEQ ID NO: 3445357 - RNA, 20 nt, Pseudomonas aeruginosa PA01
ccgccgcggcaaugcggcga

SEQ ID NO: 3445358 - RNA, 22 nt, Pseudomonas aeruginosa PA01
ccgccgcggcaaugcggcgaug

SEQ ID NO: 3445359 - RNA, 16 nt, Pseudomonas aeruginosa PA01
ccgccgcggcaccggc

SEQ ID NO: 3445360 - RNA, 13 nt, Pseudomonas aeruginosa PA01
ccgccgcggccag

SEQ ID NO: 3445361 - RNA, 14 nt, Pseudomonas aeruginosa PA01
ccgccgcggccagc

SEQ ID NO: 3445362 - RNA, 16 nt, Pseudomonas aeruginosa PA01
ccgccgcggccagccc

SEQ ID NO: 3445363 - RNA, 18 nt, Pseudomonas aeruginosa PA01
ccgccgcggccagccccc

SEQ ID NO: 3445364 - RNA, 22 nt, Pseudomonas aeruginosa PA01
ccgccgcggccagcccccucgc

SEQ ID NO: 3445365 - RNA, 14 nt, Pseudomonas aeruginosa PA01
ccgccgcggcguua

SEQ ID NO: 3445366 - RNA, 20 nt, Pseudomonas aeruginosa PA01
ccgccgcggcguuagccgcc

SEQ ID NO: 3445367 - RNA, 16 nt, Pseudomonas aeruginosa PA01
ccgccgcgggacgccg

SEQ ID NO: 3445368 - RNA, 19 nt, Pseudomonas aeruginosa PA01
ccgccgcgggacgccgcag

SEQ ID NO: 3445369 - RNA, 12 nt, Pseudomonas aeruginosa PA01
ccgccgcgggca

SEQ ID NO: 3445370 - RNA, 17 nt, Pseudomonas aeruginosa PA01
ccgccgcgggcaaccgc

SEQ ID NO: 3445371 - RNA, 14 nt, Pseudomonas aeruginosa PA01
ccgccgcgggcgaa

SEQ ID NO: 3445372 - RNA, 19 nt, Pseudomonas aeruginosa PA01
ccgccgcgucgaagcuguc

SEQ ID NO: 3445373 - RNA, 14 nt, Pseudomonas aeruginosa PA01
ccgccgcgugccgc

SEQ ID NO: 3445374 - RNA, 18 nt, Pseudomonas aeruginosa PA01
ccgccgcgugccgccgga

SEQ ID NO: 3445375 - RNA, 16 nt, Pseudomonas aeruginosa PA01
ccgccgcgugcgcgcc

SEQ ID NO: 3445376 - RNA, 20 nt, Pseudomonas aeruginosa PA01
ccgccgcgugcgcgcccucg

SEQ ID NO: 3445377 - RNA, 20 nt, Pseudomonas aeruginosa PA01
ccgccgcgugggcuucgccg

SEQ ID NO: 3445378 - RNA, 23 nt, Pseudomonas aeruginosa PA01
ccgccgcgugggcuucgccgccg

SEQ ID NO: 3445379 - RNA, 18 nt, Pseudomonas aeruginosa PA01
ccgccgcuaucgccgccg

SEQ ID NO: 3445380 - RNA, 19 nt, Pseudomonas aeruginosa PA01
ccgccgcuaucgccgccgc

SEQ ID NO: 3445381 - RNA, 22 nt, Pseudomonas aeruginosa PA01
ccgccgcuaucgccgccgcagc

SEQ ID NO: 3445382 - RNA, 17 nt, Pseudomonas aeruginosa PA01
ccgccgcucacccuguc

SEQ ID NO: 3445383 - RNA, 21 nt, Pseudomonas aeruginosa PA01
ccgccgcucacccugucccau

SEQ ID NO: 3445384 - RNA, 13 nt, Pseudomonas aeruginosa PA01
ccgccgcuccggc

SEQ ID NO: 3445385 - RNA, 17 nt, Pseudomonas aeruginosa PA01
ccgccgcucugcuggcc

SEQ ID NO: 3445386 - RNA, 19 nt, Pseudomonas aeruginosa PA01
ccgccgcucugcuggccgc

SEQ ID NO: 3445387 - RNA, 21 nt, Pseudomonas aeruginosa PA01
ccgccgcucugcuggccgccc

SEQ ID NO: 3445388 - RNA, 20 nt, Pseudomonas aeruginosa PA01
ccgccgcugaggcucgccgg

SEQ ID NO: 3445389 - RNA, 19 nt, Pseudomonas aeruginosa PA01
ccgccgcugaucaguaccg

SEQ ID NO: 3445390 - RNA, 18 nt, Pseudomonas aeruginosa PA01
ccgccgcugcaccgaacg

SEQ ID NO: 3445391 - RNA, 14 nt, Pseudomonas aeruginosa PA01
ccgccgcugcgucg

SEQ ID NO: 3445392 - RNA, 12 nt, Pseudomonas aeruginosa PA01
ccgccgcuggca

SEQ ID NO: 3445393 - RNA, 13 nt, Pseudomonas aeruginosa PA01
ccgccgcuggccu

SEQ ID NO: 3445394 - RNA, 13 nt, Pseudomonas aeruginosa PA01
ccgccgcuggcga

SEQ ID NO: 3445395 - RNA, 17 nt, Pseudomonas aeruginosa PA01
ccgccgcuggggaccgc

SEQ ID NO: 3445396 - RNA, 14 nt, Pseudomonas aeruginosa PA01
ccgccgcugugcag

SEQ ID NO: 3445397 - RNA, 14 nt, Pseudomonas aeruginosa PA01
ccgccgcuuccgcc

SEQ ID NO: 3445398 - RNA, 20 nt, Pseudomonas aeruginosa PA01
ccgccgcuuccgccaggcgc

SEQ ID NO: 3445399 - RNA, 23 nt, Pseudomonas aeruginosa PA01
ccgccgcuuccgccaggcgcagc

SEQ ID NO: 3445400 - RNA, 17 nt, Pseudomonas aeruginosa PA01
ccgccgcuuccgccggc

SEQ ID NO: 3445401 - RNA, 19 nt, Pseudomonas aeruginosa PA01
ccgccgcuuccgccggcgc

SEQ ID NO: 3445402 - RNA, 20 nt, Pseudomonas aeruginosa PA01
ccgccgcuuccgccggcgcc

SEQ ID NO: 3445403 - RNA, 15 nt, Pseudomonas aeruginosa PA01
ccgccggaaccugca

SEQ ID NO: 3445404 - RNA, 17 nt, Pseudomonas aeruginosa PA01
ccgccggaaccugcaug

SEQ ID NO: 3445405 - RNA, 22 nt, Pseudomonas aeruginosa PA01
ccgccggaaccugcaugucacc

SEQ ID NO: 3445406 - RNA, 18 nt, Pseudomonas aeruginosa PA01
ccgccggaaccuguccga

SEQ ID NO: 3445407 - RNA, 22 nt, Pseudomonas aeruginosa PA01
ccgccggaagacggaaacgcgc

SEQ ID NO: 3445408 - RNA, 16 nt, Pseudomonas aeruginosa PA01
ccgccggacccugccg

SEQ ID NO: 3445409 - RNA, 14 nt, Pseudomonas aeruginosa PA01
ccgccggaccgucg

SEQ ID NO: 3445410 - RNA, 18 nt, Pseudomonas aeruginosa PA01
ccgccggaccgucgcgau

SEQ ID NO: 3445411 - RNA, 15 nt, Pseudomonas aeruginosa PA01
ccgccggacuuggag

SEQ ID NO: 3445412 - RNA, 13 nt, Pseudomonas aeruginosa PA01
ccgccggagggaa

SEQ ID NO: 3445413 - RNA, 15 nt, Pseudomonas aeruginosa PA01
ccgccggccaccagc

SEQ ID NO: 3445414 - RNA, 12 nt, Pseudomonas aeruginosa PA01
ccgccggccagc

SEQ ID NO: 3445415 - RNA, 15 nt, Pseudomonas aeruginosa PA01
ccgccggccagccgc

SEQ ID NO: 3445416 - RNA, 17 nt, Pseudomonas aeruginosa PA01
ccgccggccagccgcgc

SEQ ID NO: 3445417 - RNA, 18 nt, Pseudomonas aeruginosa PA01
ccgccggccagccgcgcc

SEQ ID NO: 3445418 - RNA, 20 nt, Pseudomonas aeruginosa PA01
ccgccggccagccgcgccag

SEQ ID NO: 3445419 - RNA, 14 nt, Pseudomonas aeruginosa PA01
ccgccggccaugcc

SEQ ID NO: 3445420 - RNA, 19 nt, Pseudomonas aeruginosa PA01
ccgccucgaucuucuuccc

SEQ ID NO: 3445421 - RNA, 16 nt, Pseudomonas aeruginosa PA01
ccgccucgauggcggc

SEQ ID NO: 3445422 - RNA, 14 nt, Pseudomonas aeruginosa PA01
ccgccucgcgcaac

SEQ ID NO: 3445423 - RNA, 12 nt, Pseudomonas aeruginosa PA01
ccgccucgcgcc

SEQ ID NO: 3445424 - RNA, 14 nt, Pseudomonas aeruginosa PA01
ccgccucgcgccgc

SEQ ID NO: 3445425 - RNA, 15 nt, Pseudomonas aeruginosa PA01
ccgccucgcgccgcg

SEQ ID NO: 3445426 - RNA, 16 nt, Pseudomonas aeruginosa PA01
ccgccucgcgccgcgc

SEQ ID NO: 3445427 - RNA, 23 nt, Pseudomonas aeruginosa PA01
ccgccucgcgccgcgccagcagg

SEQ ID NO: 3445428 - RNA, 14 nt, Pseudomonas aeruginosa PA01
ccgccucgcgccgu

SEQ ID NO: 3445429 - RNA, 19 nt, Pseudomonas aeruginosa PA01
ccgccucgcugagcaccgg

SEQ ID NO: 3445430 - RNA, 14 nt, Pseudomonas aeruginosa PA01
ccgccucgcugggc

SEQ ID NO: 3445431 - RNA, 15 nt, Pseudomonas aeruginosa PA01
ccgccucgcugggcg

SEQ ID NO: 3445432 - RNA, 18 nt, Pseudomonas aeruginosa PA01
ccgccucgcugggcgggc

SEQ ID NO: 3445433 - RNA, 22 nt, Pseudomonas aeruginosa PA01
ccgccucgcugggcgggcgucc

SEQ ID NO: 3445434 - RNA, 13 nt, Pseudomonas aeruginosa PA01
ccgccucggagaa

SEQ ID NO: 3445435 - RNA, 20 nt, Pseudomonas aeruginosa PA01
ccgccucggagaacagcagc

SEQ ID NO: 3445436 - RNA, 13 nt, Pseudomonas aeruginosa PA01
ccgccucggcggc

SEQ ID NO: 3445437 - RNA, 15 nt, Pseudomonas aeruginosa PA01
ccgccucgggcagcc

SEQ ID NO: 3445438 - RNA, 14 nt, Pseudomonas aeruginosa PA01
ccgccucgugcagc

SEQ ID NO: 3445439 - RNA, 18 nt, Pseudomonas aeruginosa PA01
ccgccucgugcagcaagc

SEQ ID NO: 3445440 - RNA, 20 nt, Pseudomonas aeruginosa PA01
ccgccucuaugaaccggggc

SEQ ID NO: 3445441 - RNA, 15 nt, Pseudomonas aeruginosa PA01
ccgccugcagcacca

SEQ ID NO: 3445442 - RNA, 15 nt, Pseudomonas aeruginosa PA01
ccgccugcagggcgu

SEQ ID NO: 3445443 - RNA, 15 nt, Pseudomonas aeruginosa PA01
ccgccugcgccucgg

SEQ ID NO: 3445444 - RNA, 18 nt, Pseudomonas aeruginosa PA01
ccgccugcgccucggccc

SEQ ID NO: 3445445 - RNA, 18 nt, Pseudomonas aeruginosa PA01
ccgccugcggauagccaa

SEQ ID NO: 3445446 - RNA, 23 nt, Pseudomonas aeruginosa PA01
ccgccugcggauagccaaccaga

SEQ ID NO: 3445447 - RNA, 16 nt, Pseudomonas aeruginosa PA01
ccgccugcgucagcga

SEQ ID NO: 3445448 - RNA, 13 nt, Pseudomonas aeruginosa PA01
ccgccugcucgcc

SEQ ID NO: 3445449 - RNA, 14 nt, Pseudomonas aeruginosa PA01
ccgccugcucggcc

SEQ ID NO: 3445450 - RNA, 16 nt, Pseudomonas aeruginosa PA01
ccgccugcucggccug

SEQ ID NO: 3445451 - RNA, 16 nt, Pseudomonas aeruginosa PA01
ccgccuggaaggcgcu

SEQ ID NO: 3445452 - RNA, 23 nt, Pseudomonas aeruginosa PA01
ccgccuggaaggcgcugggcggc

SEQ ID NO: 3445453 - RNA, 12 nt, Pseudomonas aeruginosa PA01
ccgccuggccgg

SEQ ID NO: 3445454 - RNA, 14 nt, Pseudomonas aeruginosa PA01
ccgccuggccggcc

SEQ ID NO: 3445455 - RNA, 15 nt, Pseudomonas aeruginosa PA01
ccgccuggccggcca

SEQ ID NO: 3445456 - RNA, 16 nt, Pseudomonas aeruginosa PA01
ccgccuggccggccag

SEQ ID NO: 3445457 - RNA, 22 nt, Pseudomonas aeruginosa PA01
ccgccuggccggccagccaggc

SEQ ID NO: 3445458 - RNA, 12 nt, Pseudomonas aeruginosa PA01
ccgccuggcgca

SEQ ID NO: 3445459 - RNA, 21 nt, Pseudomonas aeruginosa PA01
ccgccuggcgcauggcgcucu

SEQ ID NO: 3445460 - RNA, 19 nt, Pseudomonas aeruginosa PA01
ccgccuggcggauaucgcg

SEQ ID NO: 3445461 - RNA, 21 nt, Pseudomonas aeruginosa PA01
ccgccuggcgugccgccaggc

SEQ ID NO: 3445462 - RNA, 18 nt, Pseudomonas aeruginosa PA01
ccgccugggccgccucgc

SEQ ID NO: 3445463 - RNA, 19 nt, Pseudomonas aeruginosa PA01
ccgccugggcggucggcuc

SEQ ID NO: 3445464 - RNA, 20 nt, Pseudomonas aeruginosa PA01
ccgccugggcggucggcuca

SEQ ID NO: 3445465 - RNA, 15 nt, Pseudomonas aeruginosa PA01
ccgccuggguggcga

SEQ ID NO: 3445466 - RNA, 17 nt, Pseudomonas aeruginosa PA01
ccgccuggguggcgacg

SEQ ID NO: 3445467 - RNA, 15 nt, Pseudomonas aeruginosa PA01
ccgccuggucgaucu

SEQ ID NO: 3445468 - RNA, 22 nt, Pseudomonas aeruginosa PA01
ccgccuggucgaucucgucgaa

SEQ ID NO: 3445469 - RNA, 14 nt, Pseudomonas aeruginosa PA01
ccgccuggucgccg

SEQ ID NO: 3445470 - RNA, 15 nt, Pseudomonas aeruginosa PA01
ccgccuggucggggc

SEQ ID NO: 3445471 - RNA, 16 nt, Pseudomonas aeruginosa PA01
ccgccuggucggggcc

SEQ ID NO: 3445472 - RNA, 18 nt, Pseudomonas aeruginosa PA01
ccgccuggucggggccgg

SEQ ID NO: 3445473 - RNA, 24 nt, Pseudomonas aeruginosa PA01
ccgccuggucggggccggcgaugc

SEQ ID NO: 3445474 - RNA, 12 nt, Pseudomonas aeruginosa PA01
ccgccuguccac

SEQ ID NO: 3445475 - RNA, 20 nt, Pseudomonas aeruginosa PA01
ccgccuguccaccgguggcg

SEQ ID NO: 3445476 - RNA, 14 nt, Pseudomonas aeruginosa PA01
ccgccuuccagcuu

SEQ ID NO: 3445477 - RNA, 23 nt, Pseudomonas aeruginosa PA01
ccgccuuccagcuugcgccagag

SEQ ID NO: 3445478 - RNA, 16 nt, Pseudomonas aeruginosa PA01
ccgccuuccucggccg

SEQ ID NO: 3445479 - RNA, 17 nt, Pseudomonas aeruginosa PA01
ccgccuuccucggccgc

SEQ ID NO: 3445480 - RNA, 19 nt, Pseudomonas aeruginosa PA01
ccgccuuccucggccgcca

SEQ ID NO: 3445481 - RNA, 20 nt, Pseudomonas aeruginosa PA01
ccgccuuccucggccgccag

SEQ ID NO: 3445482 - RNA, 14 nt, Pseudomonas aeruginosa PA01
ccgccuucgcgggc

SEQ ID NO: 3445483 - RNA, 17 nt, Pseudomonas aeruginosa PA01
ccgccuucgcgggccag

SEQ ID NO: 3445484 - RNA, 18 nt, Pseudomonas aeruginosa PA01
ccgccuucgcgggccagg

SEQ ID NO: 3445485 - RNA, 19 nt, Pseudomonas aeruginosa PA01
ccgccuucgcgggccaggc

SEQ ID NO: 3445486 - RNA, 21 nt, Pseudomonas aeruginosa PA01
ccgccuucgcgggccaggccg

SEQ ID NO: 3445487 - RNA, 19 nt, Pseudomonas aeruginosa PA01
ccgccuucggcaggaccuc

SEQ ID NO: 3445488 - RNA, 23 nt, Pseudomonas aeruginosa PA01
ccgccuucuuuucuuccgccucg

SEQ ID NO: 3445489 - RNA, 19 nt, Pseudomonas aeruginosa PA01
ccgccuugaccugcugggc

SEQ ID NO: 3445490 - RNA, 23 nt, Pseudomonas aeruginosa PA01
ccgccuugaccugcugggccagc

SEQ ID NO: 3445491 - RNA, 20 nt, Pseudomonas aeruginosa PA01
ccgccuugagcggcgcccug

SEQ ID NO: 3445492 - RNA, 22 nt, Pseudomonas aeruginosa PA01
ccgccuugagcggcgcccuggc

SEQ ID NO: 3445493 - RNA, 17 nt, Pseudomonas aeruginosa PA01
ccgccuugauggcgggc

SEQ ID NO: 3445494 - RNA, 22 nt, Pseudomonas aeruginosa PA01
ccgccuugcguaccagcgcgca

SEQ ID NO: 3445495 - RNA, 24 nt, Pseudomonas aeruginosa PA01
ccgccuugcguaccagcgcgcagc

SEQ ID NO: 3445496 - RNA, 15 nt, Pseudomonas aeruginosa PA01
ccgccuugcucgacc

SEQ ID NO: 3445497 - RNA, 19 nt, Pseudomonas aeruginosa PA01
ccgccuuggcaucgccgcc

SEQ ID NO: 3445498 - RNA, 20 nt, Pseudomonas aeruginosa PA01
ccgccuuggcaucgccgccc

SEQ ID NO: 3445499 - RNA, 18 nt, Pseudomonas aeruginosa PA01
ccgccuuguccugcaacu

SEQ ID NO: 3445500 - RNA, 14 nt, Pseudomonas aeruginosa PA01
ccgccuuguucgcc

SEQ ID NO: 3445501 - RNA, 15 nt, Pseudomonas aeruginosa PA01
ccgccuuguucgcca

SEQ ID NO: 3445502 - RNA, 19 nt, Pseudomonas aeruginosa PA01
ccgccuuguucgccagcac

SEQ ID NO: 3445503 - RNA, 20 nt, Pseudomonas aeruginosa PA01
ccgccuuguucgccagcacc

SEQ ID NO: 3445504 - RNA, 21 nt, Pseudomonas aeruginosa PA01
ccgccuuguucgccagcaccu

SEQ ID NO: 3445505 - RNA, 17 nt, Pseudomonas aeruginosa PA01
ccgccuuuuuugugccc

SEQ ID NO: 3445506 - RNA, 18 nt, Pseudomonas aeruginosa PA01
ccgcgaaccgggucguca

SEQ ID NO: 3445507 - RNA, 22 nt, Pseudomonas aeruginosa PA01
ccgcgaaccucgguagccggcc

SEQ ID NO: 3445508 - RNA, 13 nt, Pseudomonas aeruginosa PA01
ccgcgaagcccag

SEQ ID NO: 3445509 - RNA, 16 nt, Pseudomonas aeruginosa PA01
ccgcgaagcccagcgc

SEQ ID NO: 3445510 - RNA, 18 nt, Pseudomonas aeruginosa PA01
ccgcgaagcccagcgccg

SEQ ID NO: 3445511 - RNA, 17 nt, Pseudomonas aeruginosa PA01
ccgcgaagcgacggcgc

SEQ ID NO: 3445512 - RNA, 19 nt, Pseudomonas aeruginosa PA01
ccgcgaagcgguuagccgg

SEQ ID NO: 3445513 - RNA, 15 nt, Pseudomonas aeruginosa PA01
ccgcgaauagggcgg

SEQ ID NO: 3445514 - RNA, 17 nt, Pseudomonas aeruginosa PA01
ccgcgaauccgcggccc

SEQ ID NO: 3445515 - RNA, 17 nt, Pseudomonas aeruginosa PA01
ccgcgaauggcagcagg

SEQ ID NO: 3445516 - RNA, 23 nt, Pseudomonas aeruginosa PA01
ccgcgaauggcagcaggcacagg

SEQ ID NO: 3445517 - RNA, 19 nt, Pseudomonas aeruginosa PA01
ccgcgacaacccugucccc

SEQ ID NO: 3445518 - RNA, 22 nt, Pseudomonas aeruginosa PA01
ccgcgacaacccuguccccuca

SEQ ID NO: 3445519 - RNA, 14 nt, Pseudomonas aeruginosa PA01
ccgcgacaguucgc

SEQ ID NO: 3445520 - RNA, 15 nt, Pseudomonas aeruginosa PA01
ccgcgacaguucgcc

SEQ ID NO: 3445521 - RNA, 18 nt, Pseudomonas aeruginosa PA01
ccgcgaccacaggcggcg

SEQ ID NO: 3445522 - RNA, 23 nt, Pseudomonas aeruginosa PA01
ccgcgcccaggcugccggccagg

SEQ ID NO: 3445523 - RNA, 17 nt, Pseudomonas aeruginosa PA01
ccgcgccccacggcgcg

SEQ ID NO: 3445524 - RNA, 15 nt, Pseudomonas aeruginosa PA01
ccgcgccccagcggc

SEQ ID NO: 3445525 - RNA, 16 nt, Pseudomonas aeruginosa PA01
ccgcgccccagcggca

SEQ ID NO: 3445526 - RNA, 18 nt, Pseudomonas aeruginosa PA01
ccgcgccccagcggcagg

SEQ ID NO: 3445527 - RNA, 11 nt, Pseudomonas aeruginosa PA01
ccgcgcccggc

SEQ ID NO: 3445528 - RNA, 12 nt, Pseudomonas aeruginosa PA01
ccgcgcccggcc

SEQ ID NO: 3445529 - RNA, 14 nt, Pseudomonas aeruginosa PA01
ccgcgcccggccag

SEQ ID NO: 3445530 - RNA, 20 nt, Pseudomonas aeruginosa PA01
ccgcgcccggcgccaggcug

SEQ ID NO: 3445531 - RNA, 14 nt, Pseudomonas aeruginosa PA01
ccgcgcccggcugg

SEQ ID NO: 3445532 - RNA, 16 nt, Pseudomonas aeruginosa PA01
ccgcgcccggcuggcc

SEQ ID NO: 3445533 - RNA, 18 nt, Pseudomonas aeruginosa PA01
ccgcgcccggcuggccau

SEQ ID NO: 3445534 - RNA, 13 nt, Pseudomonas aeruginosa PA01
ccgcgccgaaggc

SEQ ID NO: 3445535 - RNA, 13 nt, Pseudomonas aeruginosa PA01
ccgcgccgaccag

SEQ ID NO: 3445536 - RNA, 14 nt, Pseudomonas aeruginosa PA01
ccgcgccgaccagc

SEQ ID NO: 3445537 - RNA, 18 nt, Pseudomonas aeruginosa PA01
ccgcgccgacccagagcg

SEQ ID NO: 3445538 - RNA, 15 nt, Pseudomonas aeruginosa PA01
ccgcgccgagccggc

SEQ ID NO: 3445539 - RNA, 22 nt, Pseudomonas aeruginosa PA01
ccgcgccgagccggcugccgaa

SEQ ID NO: 3445540 - RNA, 14 nt, Pseudomonas aeruginosa PA01
ccgcgccgaugccg

SEQ ID NO: 3445541 - RNA, 16 nt, Pseudomonas aeruginosa PA01
ccgcgccgccgagggc

SEQ ID NO: 3445542 - RNA, 21 nt, Pseudomonas aeruginosa PA01
ccgcgccgccgagggcaccga

SEQ ID NO: 3445543 - RNA, 17 nt, Pseudomonas aeruginosa PA01
ccgcgccgccgcggcca

SEQ ID NO: 3445544 - RNA, 19 nt, Pseudomonas aeruginosa PA01
ccgcgccgccgcggccagc

SEQ ID NO: 3445545 - RNA, 12 nt, Pseudomonas aeruginosa PA01
ccgcgccgccgg

SEQ ID NO: 3445546 - RNA, 13 nt, Pseudomonas aeruginosa PA01
ccgcgccgccgga

SEQ ID NO: 3445547 - RNA, 14 nt, Pseudomonas aeruginosa PA01
ccgcgccgccucga

SEQ ID NO: 3445548 - RNA, 15 nt, Pseudomonas aeruginosa PA01
ccgcgccgccucgau

SEQ ID NO: 3445549 - RNA, 17 nt, Pseudomonas aeruginosa PA01
ccgcgccgcgucgccgc

SEQ ID NO: 3445550 - RNA, 20 nt, Pseudomonas aeruginosa PA01
ccgcgccgcgucgccgccag

SEQ ID NO: 3445551 - RNA, 19 nt, Pseudomonas aeruginosa PA01
ccgcgccggaaguggcagc

SEQ ID NO: 3445552 - RNA, 19 nt, Pseudomonas aeruginosa PA01
ccgcgccggcagcucggcc

SEQ ID NO: 3445553 - RNA, 17 nt, Pseudomonas aeruginosa PA01
ccgcgccggccguccca

SEQ ID NO: 3445554 - RNA, 12 nt, Pseudomonas aeruginosa PA01
ccgcgccggcga

SEQ ID NO: 3445555 - RNA, 20 nt, Pseudomonas aeruginosa PA01
ccgcgccggcgaucgccagg

SEQ ID NO: 3445556 - RNA, 20 nt, Pseudomonas aeruginosa PA01
ccgcgccgggcuggccgucg

SEQ ID NO: 3445557 - RNA, 18 nt, Pseudomonas aeruginosa PA01
ccgcgccggggcagcagg

SEQ ID NO: 3445558 - RNA, 24 nt, Pseudomonas aeruginosa PA01
ccgcgccggggcagcagggcguag

SEQ ID NO: 3445559 - RNA, 14 nt, Pseudomonas aeruginosa PA01
ccgcgccuccaggc

SEQ ID NO: 3445560 - RNA, 17 nt, Pseudomonas aeruginosa PA01
ccgcgccuccaggcgcg

SEQ ID NO: 3445561 - RNA, 18 nt, Pseudomonas aeruginosa PA01
ccgcgccuccaggcgcgc

SEQ ID NO: 3445562 - RNA, 23 nt, Pseudomonas aeruginosa PA01
ccgcgccuccaggcgcgccugga

SEQ ID NO: 3445563 - RNA, 15 nt, Pseudomonas aeruginosa PA01
ccgcgccucgcgcaa

SEQ ID NO: 3445564 - RNA, 16 nt, Pseudomonas aeruginosa PA01
ccgcgccucgucgcgc

SEQ ID NO: 3445565 - RNA, 16 nt, Pseudomonas aeruginosa PA01
ccgcgccugcuugaaa

SEQ ID NO: 3445566 - RNA, 18 nt, Pseudomonas aeruginosa PA01
ccgcgccugggccgcgag

SEQ ID NO: 3445567 - RNA, 19 nt, Pseudomonas aeruginosa PA01
ccgcgccugggccgcgagg

SEQ ID NO: 3445568 - RNA, 19 nt, Pseudomonas aeruginosa PA01
ccgcgccuucagcgccagc

SEQ ID NO: 3445569 - RNA, 22 nt, Pseudomonas aeruginosa PA01
ccgcgccuucagcgccagcagg

SEQ ID NO: 3445570 - RNA, 17 nt, Pseudomonas aeruginosa PA01
ccgcgccuuccagcccu

SEQ ID NO: 3445571 - RNA, 16 nt, Pseudomonas aeruginosa PA01
ccgcgccuucgagcgc

SEQ ID NO: 3445572 - RNA, 12 nt, Pseudomonas aeruginosa PA01
ccgcgcgacagc

SEQ ID NO: 3445573 - RNA, 17 nt, Pseudomonas aeruginosa PA01
ccgcgcgaccgcggcgc

SEQ ID NO: 3445574 - RNA, 18 nt, Pseudomonas aeruginosa PA01
ccgcgcgaccgcggcgcu

SEQ ID NO: 3445575 - RNA, 21 nt, Pseudomonas aeruginosa PA01
ccgcgcgaccgcggcgcucgg

SEQ ID NO: 3445576 - RNA, 22 nt, Pseudomonas aeruginosa PA01
ccgcgcgacggaacaagccgcc

SEQ ID NO: 3445577 - RNA, 20 nt, Pseudomonas aeruginosa PA01
ccgcgcgauaaaaagccccg

SEQ ID NO: 3445578 - RNA, 16 nt, Pseudomonas aeruginosa PA01
ccgcgcgauggccggc

SEQ ID NO: 3445579 - RNA, 18 nt, Pseudomonas aeruginosa PA01
ccgcgcgauggccggcgg

SEQ ID NO: 3445580 - RNA, 20 nt, Pseudomonas aeruginosa PA01
ccgcgcgcauggucgcgcug

SEQ ID NO: 3445581 - RNA, 19 nt, Pseudomonas aeruginosa PA01
ccgcgcgccagcaacgccu

SEQ ID NO: 3445582 - RNA, 16 nt, Pseudomonas aeruginosa PA01
ccgcgcgccauggccu

SEQ ID NO: 3445583 - RNA, 17 nt, Pseudomonas aeruginosa PA01
ccgcgcgccauggccug

SEQ ID NO: 3445584 - RNA, 20 nt, Pseudomonas aeruginosa PA01
ccgcgcgccugcaacgccag

SEQ ID NO: 3445585 - RNA, 21 nt, Pseudomonas aeruginosa PA01
ccgcgcgccugcaacgccagc

SEQ ID NO: 3445586 - RNA, 14 nt, Pseudomonas aeruginosa PA01
ccgcgcgccuggcu

SEQ ID NO: 3445587 - RNA, 15 nt, Pseudomonas aeruginosa PA01
ccgcgcgccuggcug

SEQ ID NO: 3445588 - RNA, 14 nt, Pseudomonas aeruginosa PA01
ccgcgcgcgcaagg

SEQ ID NO: 3445589 - RNA, 12 nt, Pseudomonas aeruginosa PA01
ccgcgcgcgccu

SEQ ID NO: 3445590 - RNA, 17 nt, Pseudomonas aeruginosa PA01
ccgcgcgcgcgcuccuc

SEQ ID NO: 3445591 - RNA, 22 nt, Pseudomonas aeruginosa PA01
ccgcgcgcuggauuucgccgag

SEQ ID NO: 3445592 - RNA, 22 nt, Pseudomonas aeruginosa PA01
ccgcgcggauccccucccgcgc

SEQ ID NO: 3445593 - RNA, 13 nt, Pseudomonas aeruginosa PA01
ccgcgcggcaacg

SEQ ID NO: 3445594 - RNA, 21 nt, Pseudomonas aeruginosa PA01
ccgcgcggcacagcguggcca

SEQ ID NO: 3445595 - RNA, 18 nt, Pseudomonas aeruginosa PA01
ccgcgcggcacaggcggc

SEQ ID NO: 3445596 - RNA, 20 nt, Pseudomonas aeruginosa PA01
ccgcgcggcacaggcggcug

SEQ ID NO: 3445597 - RNA, 18 nt, Pseudomonas aeruginosa PA01
ccgcgcggcauagcgcag

SEQ ID NO: 3445598 - RNA, 22 nt, Pseudomonas aeruginosa PA01
ccgcgcggcauagcgcagccgc

SEQ ID NO: 3445599 - RNA, 18 nt, Pseudomonas aeruginosa PA01
ccgcgcggcuugccggcg

SEQ ID NO: 3445600 - RNA, 19 nt, Pseudomonas aeruginosa PA01
ccgcgcggcuugccggcgc

SEQ ID NO: 3445601 - RNA, 20 nt, Pseudomonas aeruginosa PA01
ccgcgcgggccgaggucgcg

SEQ ID NO: 3445602 - RNA, 13 nt, Pseudomonas aeruginosa PA01
ccgcgcgggccgg

SEQ ID NO: 3445603 - RNA, 14 nt, Pseudomonas aeruginosa PA01
ccgcgcgggccggc

SEQ ID NO: 3445604 - RNA, 15 nt, Pseudomonas aeruginosa PA01
ccgcgcgggccggcg

SEQ ID NO: 3445605 - RNA, 17 nt, Pseudomonas aeruginosa PA01
ccgcgcgggccggcgau

SEQ ID NO: 3445606 - RNA, 16 nt, Pseudomonas aeruginosa PA01
ccgcgcggucgagcuc

SEQ ID NO: 3445607 - RNA, 12 nt, Pseudomonas aeruginosa PA01
ccgcgcguggcu

SEQ ID NO: 3445608 - RNA, 23 nt, Pseudomonas aeruginosa PA01
ccgcgcguggcuucguccagcga

SEQ ID NO: 3445609 - RNA, 17 nt, Pseudomonas aeruginosa PA01
ccgcgcguucagccacg

SEQ ID NO: 3445610 - RNA, 22 nt, Pseudomonas aeruginosa PA01
ccgcgcguucgcgcgaggcgcu

SEQ ID NO: 3445611 - RNA, 16 nt, Pseudomonas aeruginosa PA01
ccgcgcuccaacaggc

SEQ ID NO: 3445612 - RNA, 13 nt, Pseudomonas aeruginosa PA01
ccgcgcuccgcug

SEQ ID NO: 3445613 - RNA, 15 nt, Pseudomonas aeruginosa PA01
ccgcgcucgacgguc

SEQ ID NO: 3445614 - RNA, 13 nt, Pseudomonas aeruginosa PA01
ccgcgcucgcgca

SEQ ID NO: 3445615 - RNA, 13 nt, Pseudomonas aeruginosa PA01
ccgcgcucggcca

SEQ ID NO: 3445616 - RNA, 15 nt, Pseudomonas aeruginosa PA01
ccgcgcucggccagu

SEQ ID NO: 3445617 - RNA, 15 nt, Pseudomonas aeruginosa PA01
ccgcgcucggccgcc

SEQ ID NO: 3445618 - RNA, 16 nt, Pseudomonas aeruginosa PA01
ccgcgcucggccgccu

SEQ ID NO: 3445619 - RNA, 19 nt, Pseudomonas aeruginosa PA01
ccgcgcucggccgccuggc

SEQ ID NO: 3445620 - RNA, 12 nt, Pseudomonas aeruginosa PA01
ccgcgcucggcg

SEQ ID NO: 3445621 - RNA, 21 nt, Pseudomonas aeruginosa PA01
ccgcgcucggcggucaggcca

SEQ ID NO: 3445622 - RNA, 21 nt, Pseudomonas aeruginosa PA01
ccgcgcucgguccagaucgcc

SEQ ID NO: 3445623 - RNA, 22 nt, Pseudomonas aeruginosa PA01
ccgcgcucgguccagaucgcca

SEQ ID NO: 3445624 - RNA, 18 nt, Pseudomonas aeruginosa PA01
ccgcgcugcaagggcacu

SEQ ID NO: 3445625 - RNA, 22 nt, Pseudomonas aeruginosa PA01
ccgcgggucucgaucagcgccg

SEQ ID NO: 3445626 - RNA, 14 nt, Pseudomonas aeruginosa PA01
ccgcgggucugcuc

SEQ ID NO: 3445627 - RNA, 21 nt, Pseudomonas aeruginosa PA01
ccgcgggucuugcgcagggcg

SEQ ID NO: 3445628 - RNA, 22 nt, Pseudomonas aeruginosa PA01
ccgcgggucuugcgcagggcgg

SEQ ID NO: 3445629 - RNA, 21 nt, Pseudomonas aeruginosa PA01
ccgcggguggcaaccgacgag

SEQ ID NO: 3445630 - RNA, 23 nt, Pseudomonas aeruginosa PA01
ccgcggguuccucacggcgcagc

SEQ ID NO: 3445631 - RNA, 16 nt, Pseudomonas aeruginosa PA01
ccgcgguacccggcag

SEQ ID NO: 3445632 - RNA, 22 nt, Pseudomonas aeruginosa PA01
ccgcgguacccggcagggccag

SEQ ID NO: 3445633 - RNA, 21 nt, Pseudomonas aeruginosa PA01
ccgcgguauucuccagcaggc

SEQ ID NO: 3445634 - RNA, 18 nt, Pseudomonas aeruginosa PA01
ccgcggucacucggccuc

SEQ ID NO: 3445635 - RNA, 17 nt, Pseudomonas aeruginosa PA01
ccgcggucgaugucgcg

SEQ ID NO: 3445636 - RNA, 15 nt, Pseudomonas aeruginosa PA01
ccgcggucgggcaga

SEQ ID NO: 3445637 - RNA, 15 nt, Pseudomonas aeruginosa PA01
ccgcggucuucccgu

SEQ ID NO: 3445638 - RNA, 24 nt, Pseudomonas aeruginosa PA01
ccgcggucuucgcguuggcggugc

SEQ ID NO: 3445639 - RNA, 12 nt, Pseudomonas aeruginosa PA01
ccgcggugggcu

SEQ ID NO: 3445640 - RNA, 15 nt, Pseudomonas aeruginosa PA01
ccgcggugucggcga

SEQ ID NO: 3445641 - RNA, 18 nt, Pseudomonas aeruginosa PA01
ccgcggugucggugcccu

SEQ ID NO: 3445642 - RNA, 23 nt, Pseudomonas aeruginosa PA01
ccgcggugucggugcccucgcgg

SEQ ID NO: 3445643 - RNA, 14 nt, Pseudomonas aeruginosa PA01
ccgcguaagcggcc

SEQ ID NO: 3445644 - RNA, 16 nt, Pseudomonas aeruginosa PA01
ccgcguaauaggcgaa

SEQ ID NO: 3445645 - RNA, 17 nt, Pseudomonas aeruginosa PA01
ccgcguaauaggcgaag

SEQ ID NO: 3445646 - RNA, 22 nt, Pseudomonas aeruginosa PA01
ccgcguaauaggcgaagcggcu

SEQ ID NO: 3445647 - RNA, 14 nt, Pseudomonas aeruginosa PA01
ccgcguagcgccag

SEQ ID NO: 3445648 - RNA, 15 nt, Pseudomonas aeruginosa PA01
ccgcguagcgccagg

SEQ ID NO: 3445649 - RNA, 11 nt, Pseudomonas aeruginosa PA01
ccgcguagggc

SEQ ID NO: 3445650 - RNA, 16 nt, Pseudomonas aeruginosa PA01
ccgcguaguagccgga

SEQ ID NO: 3445651 - RNA, 23 nt, Pseudomonas aeruginosa PA01
ccgcgucacggacccgcucggcc

SEQ ID NO: 3445652 - RNA, 14 nt, Pseudomonas aeruginosa PA01
ccgcguccaucccc

SEQ ID NO: 3445653 - RNA, 18 nt, Pseudomonas aeruginosa PA01
ccgcguccauccccgccu

SEQ ID NO: 3445654 - RNA, 20 nt, Pseudomonas aeruginosa PA01
ccgcguccauccccgccucg

SEQ ID NO: 3445655 - RNA, 17 nt, Pseudomonas aeruginosa PA01
ccgcgucccuugcgggu

SEQ ID NO: 3445656 - RNA, 22 nt, Pseudomonas aeruginosa PA01
ccgcgucgaagucgaucaccgc

SEQ ID NO: 3445657 - RNA, 23 nt, Pseudomonas aeruginosa PA01
ccgcgucgaguaccgcugcggcc

SEQ ID NO: 3445658 - RNA, 15 nt, Pseudomonas aeruginosa PA01
ccgcgucgcccaggc

SEQ ID NO: 3445659 - RNA, 16 nt, Pseudomonas aeruginosa PA01
ccgcgucgcccaggcc

SEQ ID NO: 3445660 - RNA, 13 nt, Pseudomonas aeruginosa PA01
ccgcgucgccgcc

SEQ ID NO: 3445661 - RNA, 16 nt, Pseudomonas aeruginosa PA01
ccgcgucgccgccagc

SEQ ID NO: 3445662 - RNA, 12 nt, Pseudomonas aeruginosa PA01
ccgcgucgccuu

SEQ ID NO: 3445663 - RNA, 15 nt, Pseudomonas aeruginosa PA01
ccgcgucgcgcgcgg

SEQ ID NO: 3445664 - RNA, 16 nt, Pseudomonas aeruginosa PA01
ccgcgucgcgcgcggc

SEQ ID NO: 3445665 - RNA, 23 nt, Pseudomonas aeruginosa PA01
ccgcgucggcucgguuccagcuc

SEQ ID NO: 3445666 - RNA, 21 nt, Pseudomonas aeruginosa PA01
ccgcgucgggaaaggccgcca

SEQ ID NO: 3445667 - RNA, 23 nt, Pseudomonas aeruginosa PA01
ccgcgucgggaaaggccgccacg

SEQ ID NO: 3445668 - RNA, 14 nt, Pseudomonas aeruginosa PA01
ccgcgucgucggcg

SEQ ID NO: 3445669 - RNA, 15 nt, Pseudomonas aeruginosa PA01
ccgcgucgucggcga

SEQ ID NO: 3445670 - RNA, 18 nt, Pseudomonas aeruginosa PA01
ccgcgugcgcgcccucgg

SEQ ID NO: 3445671 - RNA, 15 nt, Pseudomonas aeruginosa PA01
ccgcgugcgcgccgc

SEQ ID NO: 3445672 - RNA, 17 nt, Pseudomonas aeruginosa PA01
ccgcgugcgcgccgccg

SEQ ID NO: 3445673 - RNA, 20 nt, Pseudomonas aeruginosa PA01
ccgcgugcgcgccgccgggc

SEQ ID NO: 3445674 - RNA, 14 nt, Pseudomonas aeruginosa PA01
ccgcguggcgugcu

SEQ ID NO: 3445675 - RNA, 19 nt, Pseudomonas aeruginosa PA01
ccgcguggcgugcucggcg

SEQ ID NO: 3445676 - RNA, 12 nt, Pseudomonas aeruginosa PA01
ccgcgugggccg

SEQ ID NO: 3445677 - RNA, 14 nt, Pseudomonas aeruginosa PA01
ccgcgugggccggc

SEQ ID NO: 3445678 - RNA, 16 nt, Pseudomonas aeruginosa PA01
ccgcgugggccggcau

SEQ ID NO: 3445679 - RNA, 17 nt, Pseudomonas aeruginosa PA01
ccgcgugggccggcaug

SEQ ID NO: 3445680 - RNA, 21 nt, Pseudomonas aeruginosa PA01
ccgcgugggcuucgccgccgc

SEQ ID NO: 3445681 - RNA, 18 nt, Pseudomonas aeruginosa PA01
ccgcguguucgaccgggu

SEQ ID NO: 3445682 - RNA, 15 nt, Pseudomonas aeruginosa PA01
ccgcguguucgcggc

SEQ ID NO: 3445683 - RNA, 20 nt, Pseudomonas aeruginosa PA01
ccgcguguucgcggcucugg

SEQ ID NO: 3445684 - RNA, 18 nt, Pseudomonas aeruginosa PA01
ccgcguuaccguccgcgc

SEQ ID NO: 3445685 - RNA, 22 nt, Pseudomonas aeruginosa PA01
ccgcguuaccguccgcgccgcg

SEQ ID NO: 3445686 - RNA, 15 nt, Pseudomonas aeruginosa PA01
ccgcguucagucccg

SEQ ID NO: 3445687 - RNA, 14 nt, Pseudomonas aeruginosa PA01
ccgcguucgccgag

SEQ ID NO: 3445688 - RNA, 15 nt, Pseudomonas aeruginosa PA01
ccgcguucgccgagg

SEQ ID NO: 3445689 - RNA, 15 nt, Pseudomonas aeruginosa PA01
ccgcguucugcggac

SEQ ID NO: 3445690 - RNA, 15 nt, Pseudomonas aeruginosa PA01
ccgcguugacgcgga

SEQ ID NO: 3445691 - RNA, 21 nt, Pseudomonas aeruginosa PA01
ccgcguugcauguccucggcg

SEQ ID NO: 3445692 - RNA, 23 nt, Pseudomonas aeruginosa PA01
ccgcguugcauguccucggcgcc

SEQ ID NO: 3445693 - RNA, 19 nt, Pseudomonas aeruginosa PA01
ccgcuacccugccccagca

SEQ ID NO: 3445694 - RNA, 13 nt, Pseudomonas aeruginosa PA01
ccgcuacgcggcg

SEQ ID NO: 3445695 - RNA, 15 nt, Pseudomonas aeruginosa PA01
ccgcuagcccugcug

SEQ ID NO: 3445696 - RNA, 17 nt, Pseudomonas aeruginosa PA01
ccgcuagcccugcugcu

SEQ ID NO: 3445697 - RNA, 17 nt, Pseudomonas aeruginosa PA01
ccgcuagggcgcccucg

SEQ ID NO: 3445698 - RNA, 14 nt, Pseudomonas aeruginosa PA01
ccgcuaucgccgcc

SEQ ID NO: 3445699 - RNA, 15 nt, Pseudomonas aeruginosa PA01
ccgcuaucgccgccg

SEQ ID NO: 3445700 - RNA, 15 nt, Pseudomonas aeruginosa PA01
ccgcuaucgcuggcg

SEQ ID NO: 3445701 - RNA, 15 nt, Pseudomonas aeruginosa PA01
ccgcuauggcggggc

SEQ ID NO: 3445702 - RNA, 16 nt, Pseudomonas aeruginosa PA01
ccgcuauggcggggcu

SEQ ID NO: 3445703 - RNA, 18 nt, Pseudomonas aeruginosa PA01
ccgcuaugggcaccgcgc

SEQ ID NO: 3445704 - RNA, 21 nt, Pseudomonas aeruginosa PA01
ccgcuaugggcaccgcgccgg

SEQ ID NO: 3445705 - RNA, 22 nt, Pseudomonas aeruginosa PA01
ccgcuaugggcaccgcgccggc

SEQ ID NO: 3445706 - RNA, 21 nt, Pseudomonas aeruginosa PA01
ccgcucaaccgaacaggcgac

SEQ ID NO: 3445707 - RNA, 15 nt, Pseudomonas aeruginosa PA01
ccgcucaccaggccc

SEQ ID NO: 3445708 - RNA, 20 nt, Pseudomonas aeruginosa PA01
ccgcucaccaggcccgccgg

SEQ ID NO: 3445709 - RNA, 23 nt, Pseudomonas aeruginosa PA01
ccgcucaccaggcccgccgguca

SEQ ID NO: 3445710 - RNA, 15 nt, Pseudomonas aeruginosa PA01
ccgcucaccgccacc

SEQ ID NO: 3445711 - RNA, 23 nt, Pseudomonas aeruginosa PA01
ccgcucaccgccaccccgccggc

SEQ ID NO: 3445712 - RNA, 16 nt, Pseudomonas aeruginosa PA01
ccgcucaggcgucccg

SEQ ID NO: 3445713 - RNA, 17 nt, Pseudomonas aeruginosa PA01
ccgcucagucgaccguc

SEQ ID NO: 3445714 - RNA, 21 nt, Pseudomonas aeruginosa PA01
ccgcucagucgaccgucgcca

SEQ ID NO: 3445715 - RNA, 20 nt, Pseudomonas aeruginosa PA01
ccgcucaugagauccgccag

SEQ ID NO: 3445716 - RNA, 22 nt, Pseudomonas aeruginosa PA01
ccgcucaugagauccgccagca

SEQ ID NO: 3445717 - RNA, 18 nt, Pseudomonas aeruginosa PA01
ccgcuccagcaguucguc

SEQ ID NO: 3445718 - RNA, 14 nt, Pseudomonas aeruginosa PA01
ccgcuccagccggc

SEQ ID NO: 3445719 - RNA, 16 nt, Pseudomonas aeruginosa PA01
ccgcuccagccggcaa

SEQ ID NO: 3445720 - RNA, 18 nt, Pseudomonas aeruginosa PA01
ccgcuccagccggcaagc

SEQ ID NO: 3445721 - RNA, 13 nt, Pseudomonas aeruginosa PA01
ccgcuccagcgcc

SEQ ID NO: 3445722 - RNA, 15 nt, Pseudomonas aeruginosa PA01
ccgcuccagcgccuc

SEQ ID NO: 3445723 - RNA, 21 nt, Pseudomonas aeruginosa PA01
ccgcuccagcgccucgaccag

SEQ ID NO: 3445724 - RNA, 19 nt, Pseudomonas aeruginosa PA01
ccgcuccaggaucgccucc

SEQ ID NO: 3445725 - RNA, 13 nt, Pseudomonas aeruginosa PA01
ccgcuccaggcug

SEQ ID NO: 3445726 - RNA, 23 nt, Pseudomonas aeruginosa PA01
ccgcucccaccgcuuucagcgcc

SEQ ID NO: 3445727 - RNA, 14 nt, Pseudomonas aeruginosa PA01
ccgcugcgcugcca

SEQ ID NO: 3445728 - RNA, 20 nt, Pseudomonas aeruginosa PA01
ccgcugcgcugccagcgccg

SEQ ID NO: 3445729 - RNA, 13 nt, Pseudomonas aeruginosa PA01
ccgcugcggccgg

SEQ ID NO: 3445730 - RNA, 14 nt, Pseudomonas aeruginosa PA01
ccgcugcggccggc

SEQ ID NO: 3445731 - RNA, 16 nt, Pseudomonas aeruginosa PA01
ccgcugcggccggcgc

SEQ ID NO: 3445732 - RNA, 24 nt, Pseudomonas aeruginosa PA01
ccgcugcggcggucccagaccagc

SEQ ID NO: 3445733 - RNA, 18 nt, Pseudomonas aeruginosa PA01
ccgcugcggcucgccgau

SEQ ID NO: 3445734 - RNA, 15 nt, Pseudomonas aeruginosa PA01
ccgcugcggcugcag

SEQ ID NO: 3445735 - RNA, 21 nt, Pseudomonas aeruginosa PA01
ccgcugcggcugcagggccag

SEQ ID NO: 3445736 - RNA, 22 nt, Pseudomonas aeruginosa PA01
ccgcugcggcugcagggccagg

SEQ ID NO: 3445737 - RNA, 17 nt, Pseudomonas aeruginosa PA01
ccgcugcguagggcgag

SEQ ID NO: 3445738 - RNA, 20 nt, Pseudomonas aeruginosa PA01
ccgcugcgucgucgcggcgc

SEQ ID NO: 3445739 - RNA, 15 nt, Pseudomonas aeruginosa PA01
ccgcugcuggauggg

SEQ ID NO: 3445740 - RNA, 14 nt, Pseudomonas aeruginosa PA01
ccgcuggaaccggc

SEQ ID NO: 3445741 - RNA, 21 nt, Pseudomonas aeruginosa PA01
ccgcuggaaccggccggcagg

SEQ ID NO: 3445742 - RNA, 21 nt, Pseudomonas aeruginosa PA01
ccgcuggaccaguucagcgcg

SEQ ID NO: 3445743 - RNA, 23 nt, Pseudomonas aeruginosa PA01
ccgcuggaccaguucagcgcgcu

SEQ ID NO: 3445744 - RNA, 20 nt, Pseudomonas aeruginosa PA01
ccgcuggcauaaccggaagc

SEQ ID NO: 3445745 - RNA, 18 nt, Pseudomonas aeruginosa PA01
ccgcuggccugcagcagg

SEQ ID NO: 3445746 - RNA, 14 nt, Pseudomonas aeruginosa PA01
ccgcuggccuggcc

SEQ ID NO: 3445747 - RNA, 15 nt, Pseudomonas aeruginosa PA01
ccgcuggccuggcca

SEQ ID NO: 3445748 - RNA, 13 nt, Pseudomonas aeruginosa PA01
ccgcuggcgagga

SEQ ID NO: 3445749 - RNA, 14 nt, Pseudomonas aeruginosa PA01
ccgcuggcgaucuc

SEQ ID NO: 3445750 - RNA, 20 nt, Pseudomonas aeruginosa PA01
ccgcuggcggccuucggcgu

SEQ ID NO: 3445751 - RNA, 22 nt, Pseudomonas aeruginosa PA01
ccgcuggcggccuucggcgucg

SEQ ID NO: 3445752 - RNA, 15 nt, Pseudomonas aeruginosa PA01
ccgcuggcggcgacg

SEQ ID NO: 3445753 - RNA, 18 nt, Pseudomonas aeruginosa PA01
ccgcuggcggcgacgaag

SEQ ID NO: 3445754 - RNA, 20 nt, Pseudomonas aeruginosa PA01
ccgcuggcggcgacgaaggu

SEQ ID NO: 3445755 - RNA, 21 nt, Pseudomonas aeruginosa PA01
ccgcuggcggcgcucacccac

SEQ ID NO: 3445756 - RNA, 22 nt, Pseudomonas aeruginosa PA01
ccgcuggcgucgaaugcggcgu

SEQ ID NO: 3445757 - RNA, 14 nt, Pseudomonas aeruginosa PA01
ccgcuggcguuauu

SEQ ID NO: 3445758 - RNA, 18 nt, Pseudomonas aeruginosa PA01
ccgcuggcguuauucgcc

SEQ ID NO: 3445759 - RNA, 19 nt, Pseudomonas aeruginosa PA01
ccgcuggcguuauucgccc

SEQ ID NO: 3445760 - RNA, 21 nt, Pseudomonas aeruginosa PA01
ccgcuggcguuguugccgccg

SEQ ID NO: 3445761 - RNA, 17 nt, Pseudomonas aeruginosa PA01
ccgcugggacggcggcu

SEQ ID NO: 3445762 - RNA, 16 nt, Pseudomonas aeruginosa PA01
ccgcugggcagcacgc

SEQ ID NO: 3445763 - RNA, 18 nt, Pseudomonas aeruginosa PA01
ccgcugggcagcacgcug

SEQ ID NO: 3445764 - RNA, 21 nt, Pseudomonas aeruginosa PA01
ccgcuggggaccgcaccuggu

SEQ ID NO: 3445765 - RNA, 20 nt, Pseudomonas aeruginosa PA01
ccgcuggguuuccugcaugg

SEQ ID NO: 3445766 - RNA, 23 nt, Pseudomonas aeruginosa PA01
ccgcugguaauggugaucaccuu

SEQ ID NO: 3445767 - RNA, 17 nt, Pseudomonas aeruginosa PA01
ccgcugguagcccaggc

SEQ ID NO: 3445768 - RNA, 19 nt, Pseudomonas aeruginosa PA01
ccgcugguagcccaggccg

SEQ ID NO: 3445769 - RNA, 20 nt, Pseudomonas aeruginosa PA01
ccgcugguagcccaggccga

SEQ ID NO: 3445770 - RNA, 21 nt, Pseudomonas aeruginosa PA01
ccgcugguagcccaggccgaa

SEQ ID NO: 3445771 - RNA, 13 nt, Pseudomonas aeruginosa PA01
ccgcugguccagc

SEQ ID NO: 3445772 - RNA, 18 nt, Pseudomonas aeruginosa PA01
ccgcugguccagcuggcg

SEQ ID NO: 3445773 - RNA, 20 nt, Pseudomonas aeruginosa PA01
ccgcugguccagcuggcgca

SEQ ID NO: 3445774 - RNA, 13 nt, Pseudomonas aeruginosa PA01
ccgcuggucggca

SEQ ID NO: 3445775 - RNA, 15 nt, Pseudomonas aeruginosa PA01
ccgcuggucggcauc

SEQ ID NO: 3445776 - RNA, 21 nt, Pseudomonas aeruginosa PA01
ccgcuggucggcauccggcag

SEQ ID NO: 3445777 - RNA, 22 nt, Pseudomonas aeruginosa PA01
ccgcuggucggcauccggcagg

SEQ ID NO: 3445778 - RNA, 23 nt, Pseudomonas aeruginosa PA01
ccgcuggucggcauccggcaggc

SEQ ID NO: 3445779 - RNA, 17 nt, Pseudomonas aeruginosa PA01
ccgcuggugacggugac

SEQ ID NO: 3445780 - RNA, 17 nt, Pseudomonas aeruginosa PA01
ccgcuggugaucgacca

SEQ ID NO: 3445781 - RNA, 17 nt, Pseudomonas aeruginosa PA01
ccgcuguccgccgccgc

SEQ ID NO: 3445782 - RNA, 19 nt, Pseudomonas aeruginosa PA01
ccgcuguccgccgccgcgg

SEQ ID NO: 3445783 - RNA, 20 nt, Pseudomonas aeruginosa PA01
ccgcuguccgccgccgcggc

SEQ ID NO: 3445784 - RNA, 15 nt, Pseudomonas aeruginosa PA01
ccgcuguccgccggc

SEQ ID NO: 3445785 - RNA, 13 nt, Pseudomonas aeruginosa PA01
ccgcugucgucca

SEQ ID NO: 3445786 - RNA, 21 nt, Pseudomonas aeruginosa PA01
ccgcugucgucuucggccagu

SEQ ID NO: 3445787 - RNA, 15 nt, Pseudomonas aeruginosa PA01
ccgcuguggaaguac

SEQ ID NO: 3445788 - RNA, 20 nt, Pseudomonas aeruginosa PA01
ccgcuguggaaguacggcgc

SEQ ID NO: 3445789 - RNA, 18 nt, Pseudomonas aeruginosa PA01
ccgcuguuggcgugacug

SEQ ID NO: 3445790 - RNA, 19 nt, Pseudomonas aeruginosa PA01
ccgcuguuucuccaguucg

SEQ ID NO: 3445791 - RNA, 14 nt, Pseudomonas aeruginosa PA01
ccgcuucagcgcgc

SEQ ID NO: 3445792 - RNA, 17 nt, Pseudomonas aeruginosa PA01
ccgcuuccgccggcgcc

SEQ ID NO: 3445793 - RNA, 19 nt, Pseudomonas aeruginosa PA01
ccgcuuccgccggcgccgc

SEQ ID NO: 3445794 - RNA, 14 nt, Pseudomonas aeruginosa PA01
ccgcuuccggcccg

SEQ ID NO: 3445795 - RNA, 17 nt, Pseudomonas aeruginosa PA01
ccgcuuccggcccggcc

SEQ ID NO: 3445796 - RNA, 20 nt, Pseudomonas aeruginosa PA01
ccgcuuccggcccggccagg

SEQ ID NO: 3445797 - RNA, 14 nt, Pseudomonas aeruginosa PA01
ccgcuuccugggcu

SEQ ID NO: 3445798 - RNA, 16 nt, Pseudomonas aeruginosa PA01
ccgcuucgagcgggcu

SEQ ID NO: 3445799 - RNA, 16 nt, Pseudomonas aeruginosa PA01
ccgcuucggcggggcu

SEQ ID NO: 3445800 - RNA, 12 nt, Pseudomonas aeruginosa PA01
ccgcuucggcug

SEQ ID NO: 3445801 - RNA, 13 nt, Pseudomonas aeruginosa PA01
ccgcuucgucggu

SEQ ID NO: 3445802 - RNA, 16 nt, Pseudomonas aeruginosa PA01
ccgcuugaagcggcca

SEQ ID NO: 3445803 - RNA, 18 nt, Pseudomonas aeruginosa PA01
ccgcuugagaccuucgcg

SEQ ID NO: 3445804 - RNA, 13 nt, Pseudomonas aeruginosa PA01
ccgcuugccagcc

SEQ ID NO: 3445805 - RNA, 15 nt, Pseudomonas aeruginosa PA01
ccgcuugccagccgc

SEQ ID NO: 3445806 - RNA, 21 nt, Pseudomonas aeruginosa PA01
ccgcuugccgucgaccugcgg

SEQ ID NO: 3445807 - RNA, 12 nt, Pseudomonas aeruginosa PA01
ccgcuugcgccg

SEQ ID NO: 3445808 - RNA, 13 nt, Pseudomonas aeruginosa PA01
ccgcuugcgccgc

SEQ ID NO: 3445809 - RNA, 15 nt, Pseudomonas aeruginosa PA01
ccgcuugcgccgccu

SEQ ID NO: 3445810 - RNA, 21 nt, Pseudomonas aeruginosa PA01
ccgcuugcggucauccgccgg

SEQ ID NO: 3445811 - RNA, 15 nt, Pseudomonas aeruginosa PA01
ccgcuugcgguuauc

SEQ ID NO: 3445812 - RNA, 19 nt, Pseudomonas aeruginosa PA01
ccgcuugcgguuauccgcc

SEQ ID NO: 3445813 - RNA, 19 nt, Pseudomonas aeruginosa PA01
ccgcuuggagcgggcgccg

SEQ ID NO: 3445814 - RNA, 23 nt, Pseudomonas aeruginosa PA01
ccgcuuucaccagggucgccagg

SEQ ID NO: 3445815 - RNA, 15 nt, Pseudomonas aeruginosa PA01
ccgcuuucagcgccg

SEQ ID NO: 3445816 - RNA, 20 nt, Pseudomonas aeruginosa PA01
ccgcuuucagcgccgcucgg

SEQ ID NO: 3445817 - RNA, 18 nt, Pseudomonas aeruginosa PA01
ccgcuuuccccggcggca

SEQ ID NO: 3445818 - RNA, 18 nt, Pseudomonas aeruginosa PA01
ccgcuuucguagggcgaa

SEQ ID NO: 3445819 - RNA, 13 nt, Pseudomonas aeruginosa PA01
ccggaaaaagcac

SEQ ID NO: 3445820 - RNA, 16 nt, Pseudomonas aeruginosa PA01
ccggaaaacagcgagc

SEQ ID NO: 3445821 - RNA, 16 nt, Pseudomonas aeruginosa PA01
ccggaaaagaagccgc

SEQ ID NO: 3445822 - RNA, 20 nt, Pseudomonas aeruginosa PA01
ccggaaaagaagccgcgcaa

SEQ ID NO: 3445823 - RNA, 16 nt, Pseudomonas aeruginosa PA01
ccggaaagccuggccg

SEQ ID NO: 3445824 - RNA, 17 nt, Pseudomonas aeruginosa PA01
ccggaaagccuggccgg

SEQ ID NO: 3445825 - RNA, 19 nt, Pseudomonas aeruginosa PA01
ccggaaagccuggccggcg

SEQ ID NO: 3445826 - RNA, 23 nt, Pseudomonas aeruginosa PA01
ccggaaccgggguuuccucgaug

SEQ ID NO: 3445827 - RNA, 22 nt, Pseudomonas aeruginosa PA01
ccggaagacggaaacgcgcgcu

SEQ ID NO: 3445828 - RNA, 12 nt, Pseudomonas aeruginosa PA01
ccggaagcgcuc

SEQ ID NO: 3445829 - RNA, 18 nt, Pseudomonas aeruginosa PA01
ccggcaagcuccgcgaug

SEQ ID NO: 3445830 - RNA, 13 nt, Pseudomonas aeruginosa PA01
ccggcaauagccg

SEQ ID NO: 3445831 - RNA, 17 nt, Pseudomonas aeruginosa PA01
ccggcaauagccgggcu

SEQ ID NO: 3445832 - RNA, 13 nt, Pseudomonas aeruginosa PA01
ccggcaccaccac

SEQ ID NO: 3445833 - RNA, 19 nt, Pseudomonas aeruginosa PA01
ccggcaccaccagcgcgcg

SEQ ID NO: 3445834 - RNA, 14 nt, Pseudomonas aeruginosa PA01
ccggcaccaggccg

SEQ ID NO: 3445835 - RNA, 15 nt, Pseudomonas aeruginosa PA01
ccggcaccagucgca

SEQ ID NO: 3445836 - RNA, 13 nt, Pseudomonas aeruginosa PA01
ccggcacccggag

SEQ ID NO: 3445837 - RNA, 15 nt, Pseudomonas aeruginosa PA01
ccggcaccgaggaga

SEQ ID NO: 3445838 - RNA, 15 nt, Pseudomonas aeruginosa PA01
ccggcaccgggguga

SEQ ID NO: 3445839 - RNA, 22 nt, Pseudomonas aeruginosa PA01
ccggcaccgucgagcaccaggc

SEQ ID NO: 3445840 - RNA, 22 nt, Pseudomonas aeruginosa PA01
ccggcaccuugcgaaaagcccg

SEQ ID NO: 3445841 - RNA, 20 nt, Pseudomonas aeruginosa PA01
ccggcacgccauccuccgag

SEQ ID NO: 3445842 - RNA, 15 nt, Pseudomonas aeruginosa PA01
ccggcacgcuccagg

SEQ ID NO: 3445843 - RNA, 15 nt, Pseudomonas aeruginosa PA01
ccggcacgcugccgc

SEQ ID NO: 3445844 - RNA, 18 nt, Pseudomonas aeruginosa PA01
ccggcacgcugccgccga

SEQ ID NO: 3445845 - RNA, 14 nt, Pseudomonas aeruginosa PA01
ccggcacggcaucg

SEQ ID NO: 3445846 - RNA, 14 nt, Pseudomonas aeruginosa PA01
ccggcacucgccgg

SEQ ID NO: 3445847 - RNA, 22 nt, Pseudomonas aeruginosa PA01
ccggcacuuccuuggugaucac

SEQ ID NO: 3445848 - RNA, 15 nt, Pseudomonas aeruginosa PA01
ccggcagaugccggg

SEQ ID NO: 3445849 - RNA, 16 nt, Pseudomonas aeruginosa PA01
ccggcagcacccgcac

SEQ ID NO: 3445850 - RNA, 15 nt, Pseudomonas aeruginosa PA01
ccggcagcacggcga

SEQ ID NO: 3445851 - RNA, 12 nt, Pseudomonas aeruginosa PA01
ccggcagcagcg

SEQ ID NO: 3445852 - RNA, 14 nt, Pseudomonas aeruginosa PA01
ccggcagcagcgga

SEQ ID NO: 3445853 - RNA, 13 nt, Pseudomonas aeruginosa PA01
ccggcagcaggcc

SEQ ID NO: 3445854 - RNA, 14 nt, Pseudomonas aeruginosa PA01
ccggcagccagccg

SEQ ID NO: 3445855 - RNA, 16 nt, Pseudomonas aeruginosa PA01
ccggcagccagccgcc

SEQ ID NO: 3445856 - RNA, 12 nt, Pseudomonas aeruginosa PA01
ccggcagccggg

SEQ ID NO: 3445857 - RNA, 15 nt, Pseudomonas aeruginosa PA01
ccggcagcgaccacc

SEQ ID NO: 3445858 - RNA, 23 nt, Pseudomonas aeruginosa PA01
ccggcagcgaccaccaccagguc

SEQ ID NO: 3445859 - RNA, 15 nt, Pseudomonas aeruginosa PA01
ccggcagcgccgagg

SEQ ID NO: 3445860 - RNA, 16 nt, Pseudomonas aeruginosa PA01
ccggcagcgccgccag

SEQ ID NO: 3445861 - RNA, 17 nt, Pseudomonas aeruginosa PA01
ccggcagcgccgccagc

SEQ ID NO: 3445862 - RNA, 21 nt, Pseudomonas aeruginosa PA01
ccggcagcgccgcgcggcaac

SEQ ID NO: 3445863 - RNA, 13 nt, Pseudomonas aeruginosa PA01
ccggcagcgccgg

SEQ ID NO: 3445864 - RNA, 15 nt, Pseudomonas aeruginosa PA01
ccggcagcgccgggc

SEQ ID NO: 3445865 - RNA, 12 nt, Pseudomonas aeruginosa PA01
ccggcagcgccu

SEQ ID NO: 3445866 - RNA, 20 nt, Pseudomonas aeruginosa PA01
ccggcagcgcguagaccacc

SEQ ID NO: 3445867 - RNA, 22 nt, Pseudomonas aeruginosa PA01
ccggcagcgcguagaccaccuc

SEQ ID NO: 3445868 - RNA, 22 nt, Pseudomonas aeruginosa PA01
ccggcagcucccuugccgccgg

SEQ ID NO: 3445869 - RNA, 14 nt, Pseudomonas aeruginosa PA01
ccggcagcuccggc

SEQ ID NO: 3445870 - RNA, 14 nt, Pseudomonas aeruginosa PA01
ccggcagcucggcc

SEQ ID NO: 3445871 - RNA, 18 nt, Pseudomonas aeruginosa PA01
ccggcagcucggccgagg

SEQ ID NO: 3445872 - RNA, 13 nt, Pseudomonas aeruginosa PA01
ccggcaggacgau

SEQ ID NO: 3445873 - RNA, 17 nt, Pseudomonas aeruginosa PA01
ccggcaggaggaucgcg

SEQ ID NO: 3445874 - RNA, 19 nt, Pseudomonas aeruginosa PA01
ccggcaggaggaucgcggc

SEQ ID NO: 3445875 - RNA, 20 nt, Pseudomonas aeruginosa PA01
ccggcaggaggaucgcggcc

SEQ ID NO: 3445876 - RNA, 16 nt, Pseudomonas aeruginosa PA01
ccggcaggaucggcgc

SEQ ID NO: 3445877 - RNA, 17 nt, Pseudomonas aeruginosa PA01
ccggcaggaucggcgcg

SEQ ID NO: 3445878 - RNA, 16 nt, Pseudomonas aeruginosa PA01
ccggcaggcaggccug

SEQ ID NO: 3445879 - RNA, 16 nt, Pseudomonas aeruginosa PA01
ccggcaggcagugccg

SEQ ID NO: 3445880 - RNA, 17 nt, Pseudomonas aeruginosa PA01
ccggcaggcagugccgg

SEQ ID NO: 3445881 - RNA, 18 nt, Pseudomonas aeruginosa PA01
ccggcaggcagugccggg

SEQ ID NO: 3445882 - RNA, 19 nt, Pseudomonas aeruginosa PA01
ccggcaggcagugccgggc

SEQ ID NO: 3445883 - RNA, 17 nt, Pseudomonas aeruginosa PA01
ccggcaggccgauggcc

SEQ ID NO: 3445884 - RNA, 19 nt, Pseudomonas aeruginosa PA01
ccggcaggccgauggcccc

SEQ ID NO: 3445885 - RNA, 20 nt, Pseudomonas aeruginosa PA01
ccggcaggccgauggccccg

SEQ ID NO: 3445886 - RNA, 22 nt, Pseudomonas aeruginosa PA01
ccggcaggccgauggccccggc

SEQ ID NO: 3445887 - RNA, 20 nt, Pseudomonas aeruginosa PA01
ccggcaggccuucgacgguu

SEQ ID NO: 3445888 - RNA, 20 nt, Pseudomonas aeruginosa PA01
ccggcaggccuucggcgccg

SEQ ID NO: 3445889 - RNA, 14 nt, Pseudomonas aeruginosa PA01
ccggcaggcgcacg

SEQ ID NO: 3445890 - RNA, 16 nt, Pseudomonas aeruginosa PA01
ccggcaggcgcacgcg

SEQ ID NO: 3445891 - RNA, 12 nt, Pseudomonas aeruginosa PA01
ccggcaggcgcu

SEQ ID NO: 3445892 - RNA, 13 nt, Pseudomonas aeruginosa PA01
ccggcaggcgcuc

SEQ ID NO: 3445893 - RNA, 20 nt, Pseudomonas aeruginosa PA01
ccggcaggcucagcgcaugc

SEQ ID NO: 3445894 - RNA, 22 nt, Pseudomonas aeruginosa PA01
ccggcaggcucagcgcaugcgg

SEQ ID NO: 3445895 - RNA, 14 nt, Pseudomonas aeruginosa PA01
ccggcaggcugugc

SEQ ID NO: 3445896 - RNA, 20 nt, Pseudomonas aeruginosa PA01
ccggcaggcugugccauucc

SEQ ID NO: 3445897 - RNA, 19 nt, Pseudomonas aeruginosa PA01
ccggcagggccagcggaac

SEQ ID NO: 3445898 - RNA, 14 nt, Pseudomonas aeruginosa PA01
ccggcagggccucg

SEQ ID NO: 3445899 - RNA, 15 nt, Pseudomonas aeruginosa PA01
ccggcagggccucgg

SEQ ID NO: 3445900 - RNA, 19 nt, Pseudomonas aeruginosa PA01
ccggcagggccucgggcgg

SEQ ID NO: 3445901 - RNA, 22 nt, Pseudomonas aeruginosa PA01
ccggcagggccucgggcgggau

SEQ ID NO: 3445902 - RNA, 13 nt, Pseudomonas aeruginosa PA01
ccggcagggcgau

SEQ ID NO: 3445903 - RNA, 18 nt, Pseudomonas aeruginosa PA01
ccggcagggcgauccgcc

SEQ ID NO: 3445904 - RNA, 18 nt, Pseudomonas aeruginosa PA01
ccggcagggucacgccgg

SEQ ID NO: 3445905 - RNA, 18 nt, Pseudomonas aeruginosa PA01
ccggcaggucgaggacga

SEQ ID NO: 3445906 - RNA, 14 nt, Pseudomonas aeruginosa PA01
ccggcaggucgggc

SEQ ID NO: 3445907 - RNA, 15 nt, Pseudomonas aeruginosa PA01
ccggcaggucgggca

SEQ ID NO: 3445908 - RNA, 16 nt, Pseudomonas aeruginosa PA01
ccggcagguggccgga

SEQ ID NO: 3445909 - RNA, 18 nt, Pseudomonas aeruginosa PA01
ccggcagucccugccagg

SEQ ID NO: 3445910 - RNA, 20 nt, Pseudomonas aeruginosa PA01
ccggcagucccugccagggg

SEQ ID NO: 3445911 - RNA, 18 nt, Pseudomonas aeruginosa PA01
ccggcauaggcgccagcc

SEQ ID NO: 3445912 - RNA, 18 nt, Pseudomonas aeruginosa PA01
ccggcaucgaccagcagc

SEQ ID NO: 3445913 - RNA, 22 nt, Pseudomonas aeruginosa PA01
ccggcaucgaccagcagcggcu

SEQ ID NO: 3445914 - RNA, 13 nt, Pseudomonas aeruginosa PA01
ccggcaucgccau

SEQ ID NO: 3445915 - RNA, 17 nt, Pseudomonas aeruginosa PA01
ccggcaucgccauggcg

SEQ ID NO: 3445916 - RNA, 21 nt, Pseudomonas aeruginosa PA01
ccggcaucgccauggcgcugc

SEQ ID NO: 3445917 - RNA, 12 nt, Pseudomonas aeruginosa PA01
ccggcaucgccg

SEQ ID NO: 3445918 - RNA, 14 nt, Pseudomonas aeruginosa PA01
ccggcaucgccggg

SEQ ID NO: 3445919 - RNA, 21 nt, Pseudomonas aeruginosa PA01
ccggcaucgguauucaucggc

SEQ ID NO: 3445920 - RNA, 17 nt, Pseudomonas aeruginosa PA01
ccggcaucgugccgcgg

SEQ ID NO: 3445921 - RNA, 14 nt, Pseudomonas aeruginosa PA01
ccggcaucugccgg

SEQ ID NO: 3445922 - RNA, 17 nt, Pseudomonas aeruginosa PA01
ccggcaugcagguggcg

SEQ ID NO: 3445923 - RNA, 18 nt, Pseudomonas aeruginosa PA01
ccggcaugcagguggcgc

SEQ ID NO: 3445924 - RNA, 17 nt, Pseudomonas aeruginosa PA01
ccggcaugcucagccgc

SEQ ID NO: 3445925 - RNA, 18 nt, Pseudomonas aeruginosa PA01
ccggcaugcucagccgcg

SEQ ID NO: 3445926 - RNA, 20 nt, Pseudomonas aeruginosa PA01
ccggcaugcucagccgcgcc

SEQ ID NO: 3445927 - RNA, 21 nt, Pseudomonas aeruginosa PA01
ccggcaugcucagccgcgccg

SEQ ID NO: 3445928 - RNA, 22 nt, Pseudomonas aeruginosa PA01
ccggcaugcucagccgcgccgg

SEQ ID NO: 3445929 - RNA, 15 nt, Pseudomonas aeruginosa PA01
ccggcaugcuugcca

SEQ ID NO: 3445930 - RNA, 14 nt, Pseudomonas aeruginosa PA01
ccggcauggaucaa

SEQ ID NO: 3445931 - RNA, 19 nt, Pseudomonas aeruginosa PA01
ccggcauguagcgcgccga

SEQ ID NO: 3445932 - RNA, 17 nt, Pseudomonas aeruginosa PA01
ccggccgaucuccuggc

SEQ ID NO: 3445933 - RNA, 21 nt, Pseudomonas aeruginosa PA01
ccggccgauggaaaucggcca

SEQ ID NO: 3445934 - RNA, 12 nt, Pseudomonas aeruginosa PA01
ccggccgcagca

SEQ ID NO: 3445935 - RNA, 15 nt, Pseudomonas aeruginosa PA01
ccggccgccagcagg

SEQ ID NO: 3445936 - RNA, 16 nt, Pseudomonas aeruginosa PA01
ccggccgccagcaggu

SEQ ID NO: 3445937 - RNA, 14 nt, Pseudomonas aeruginosa PA01
ccggccgcccgagc

SEQ ID NO: 3445938 - RNA, 20 nt, Pseudomonas aeruginosa PA01
ccggccgccuuccucggccg

SEQ ID NO: 3445939 - RNA, 14 nt, Pseudomonas aeruginosa PA01
ccggccgcgccagc

SEQ ID NO: 3445940 - RNA, 15 nt, Pseudomonas aeruginosa PA01
ccggccgcgccagcc

SEQ ID NO: 3445941 - RNA, 11 nt, Pseudomonas aeruginosa PA01
ccggccgcgcu

SEQ ID NO: 3445942 - RNA, 14 nt, Pseudomonas aeruginosa PA01
ccggccgcgcucga

SEQ ID NO: 3445943 - RNA, 15 nt, Pseudomonas aeruginosa PA01
ccggccgcgcucgac

SEQ ID NO: 3445944 - RNA, 22 nt, Pseudomonas aeruginosa PA01
ccggccgcgucgcccaggccgc

SEQ ID NO: 3445945 - RNA, 17 nt, Pseudomonas aeruginosa PA01
ccggccgcugccgggcu

SEQ ID NO: 3445946 - RNA, 23 nt, Pseudomonas aeruginosa PA01
ccggccgcuggaugccgaccacg

SEQ ID NO: 3445947 - RNA, 15 nt, Pseudomonas aeruginosa PA01
ccggccggaggggau

SEQ ID NO: 3445948 - RNA, 12 nt, Pseudomonas aeruginosa PA01
ccggccggcagc

SEQ ID NO: 3445949 - RNA, 13 nt, Pseudomonas aeruginosa PA01
ccggccggcagcg

SEQ ID NO: 3445950 - RNA, 19 nt, Pseudomonas aeruginosa PA01
ccggccggcagcgagcggg

SEQ ID NO: 3445951 - RNA, 15 nt, Pseudomonas aeruginosa PA01
ccggccggcaggccg

SEQ ID NO: 3445952 - RNA, 16 nt, Pseudomonas aeruginosa PA01
ccggccggcaggccga

SEQ ID NO: 3445953 - RNA, 16 nt, Pseudomonas aeruginosa PA01
ccggccggcggccuga

SEQ ID NO: 3445954 - RNA, 12 nt, Pseudomonas aeruginosa PA01
ccggccggcuca

SEQ ID NO: 3445955 - RNA, 14 nt, Pseudomonas aeruginosa PA01
ccggccggcucaga

SEQ ID NO: 3445956 - RNA, 23 nt, Pseudomonas aeruginosa PA01
ccggccgggcuagguuuccccgu

SEQ ID NO: 3445957 - RNA, 12 nt, Pseudomonas aeruginosa PA01
ccggccggggcc

SEQ ID NO: 3445958 - RNA, 16 nt, Pseudomonas aeruginosa PA01
ccggccggggccggca

SEQ ID NO: 3445959 - RNA, 14 nt, Pseudomonas aeruginosa PA01
ccggccggggcgcg

SEQ ID NO: 3445960 - RNA, 17 nt, Pseudomonas aeruginosa PA01
ccggccggggcgcgccc

SEQ ID NO: 3445961 - RNA, 18 nt, Pseudomonas aeruginosa PA01
ccggccggggcgcgcccg

SEQ ID NO: 3445962 - RNA, 22 nt, Pseudomonas aeruginosa PA01
ccggccggggcgcgcccgccag

SEQ ID NO: 3445963 - RNA, 13 nt, Pseudomonas aeruginosa PA01
ccggccgucccag

SEQ ID NO: 3445964 - RNA, 19 nt, Pseudomonas aeruginosa PA01
ccggccgucccagucggcg

SEQ ID NO: 3445965 - RNA, 20 nt, Pseudomonas aeruginosa PA01
ccggccgucccagucggcgu

SEQ ID NO: 3445966 - RNA, 13 nt, Pseudomonas aeruginosa PA01
ccggccgucgcgc

SEQ ID NO: 3445967 - RNA, 15 nt, Pseudomonas aeruginosa PA01
ccggccgucgcgcac

SEQ ID NO: 3445968 - RNA, 23 nt, Pseudomonas aeruginosa PA01
ccggccgugcggagggucaggcc

SEQ ID NO: 3445969 - RNA, 16 nt, Pseudomonas aeruginosa PA01
ccggccucaacgaccg

SEQ ID NO: 3445970 - RNA, 19 nt, Pseudomonas aeruginosa PA01
ccggccucaacgaccgccc

SEQ ID NO: 3445971 - RNA, 22 nt, Pseudomonas aeruginosa PA01
ccggccucaacgaccgcccagg

SEQ ID NO: 3445972 - RNA, 23 nt, Pseudomonas aeruginosa PA01
ccggccucaacgaccgcccaggc

SEQ ID NO: 3445973 - RNA, 15 nt, Pseudomonas aeruginosa PA01
ccggccuccagcgcc

SEQ ID NO: 3445974 - RNA, 17 nt, Pseudomonas aeruginosa PA01
ccggccuccagcgccuc

SEQ ID NO: 3445975 - RNA, 20 nt, Pseudomonas aeruginosa PA01
ccggccuccagcgccuggcg

SEQ ID NO: 3445976 - RNA, 13 nt, Pseudomonas aeruginosa PA01
ccggccuccaggc

SEQ ID NO: 3445977 - RNA, 16 nt, Pseudomonas aeruginosa PA01
ccggccuccaggcugg

SEQ ID NO: 3445978 - RNA, 21 nt, Pseudomonas aeruginosa PA01
ccggccuccccggcccgcgcc

SEQ ID NO: 3445979 - RNA, 22 nt, Pseudomonas aeruginosa PA01
ccggccuccccggcccgcgccg

SEQ ID NO: 3445980 - RNA, 14 nt, Pseudomonas aeruginosa PA01
ccggccucgacgca

SEQ ID NO: 3445981 - RNA, 18 nt, Pseudomonas aeruginosa PA01
ccggccucgacgcagagc

SEQ ID NO: 3445982 - RNA, 16 nt, Pseudomonas aeruginosa PA01
ccggccucgaggaaca

SEQ ID NO: 3445983 - RNA, 13 nt, Pseudomonas aeruginosa PA01
ccggccucgccgg

SEQ ID NO: 3445984 - RNA, 15 nt, Pseudomonas aeruginosa PA01
ccggccucgcgcaac

SEQ ID NO: 3445985 - RNA, 16 nt, Pseudomonas aeruginosa PA01
ccggccucgcugccgc

SEQ ID NO: 3445986 - RNA, 15 nt, Pseudomonas aeruginosa PA01
ccggccucggcggcg

SEQ ID NO: 3445987 - RNA, 18 nt, Pseudomonas aeruginosa PA01
ccggccucggcggcgcga

SEQ ID NO: 3445988 - RNA, 23 nt, Pseudomonas aeruginosa PA01
ccggccugcacguggaguucacc

SEQ ID NO: 3445989 - RNA, 13 nt, Pseudomonas aeruginosa PA01
ccggccugcgcgc

SEQ ID NO: 3445990 - RNA, 17 nt, Pseudomonas aeruginosa PA01
ccggccugcgcgcacca

SEQ ID NO: 3445991 - RNA, 21 nt, Pseudomonas aeruginosa PA01
ccggccugcgcgcaccaggcc

SEQ ID NO: 3445992 - RNA, 22 nt, Pseudomonas aeruginosa PA01
ccggccugcgcgcaccaggccu

SEQ ID NO: 3445993 - RNA, 17 nt, Pseudomonas aeruginosa PA01
ccggccuggaucucggc

SEQ ID NO: 3445994 - RNA, 14 nt, Pseudomonas aeruginosa PA01
ccggccuggcgccg

SEQ ID NO: 3445995 - RNA, 15 nt, Pseudomonas aeruginosa PA01
ccggccuggcgccgg

SEQ ID NO: 3445996 - RNA, 16 nt, Pseudomonas aeruginosa PA01
ccggccuggcuggccu

SEQ ID NO: 3445997 - RNA, 12 nt, Pseudomonas aeruginosa PA01
ccggccugggcc

SEQ ID NO: 3445998 - RNA, 13 nt, Pseudomonas aeruginosa PA01
ccggccugguagg

SEQ ID NO: 3445999 - RNA, 17 nt, Pseudomonas aeruginosa PA01
ccggccugguaggccuc

SEQ ID NO: 3446000 - RNA, 18 nt, Pseudomonas aeruginosa PA01
ccggccugguaggccucg

SEQ ID NO: 3446001 - RNA, 12 nt, Pseudomonas aeruginosa PA01
ccggccugguga

SEQ ID NO: 3446002 - RNA, 17 nt, Pseudomonas aeruginosa PA01
ccggccugucacgccgg

SEQ ID NO: 3446003 - RNA, 15 nt, Pseudomonas aeruginosa PA01
ccggccuucaccgcg

SEQ ID NO: 3446004 - RNA, 16 nt, Pseudomonas aeruginosa PA01
ccggccuucaccgcgc

SEQ ID NO: 3446005 - RNA, 17 nt, Pseudomonas aeruginosa PA01
ccggccuucaccgcgcc

SEQ ID NO: 3446006 - RNA, 21 nt, Pseudomonas aeruginosa PA01
ccggccuucaccgcgccgcgc

SEQ ID NO: 3446007 - RNA, 22 nt, Pseudomonas aeruginosa PA01
ccggccuucaccgcgccgcgcu

SEQ ID NO: 3446008 - RNA, 20 nt, Pseudomonas aeruginosa PA01
ccggccuugcuuugcgccuc

SEQ ID NO: 3446009 - RNA, 17 nt, Pseudomonas aeruginosa PA01
ccggcgaacagccagcg

SEQ ID NO: 3446010 - RNA, 18 nt, Pseudomonas aeruginosa PA01
ccggcgaacagccagcgg

SEQ ID NO: 3446011 - RNA, 22 nt, Pseudomonas aeruginosa PA01
ccggcgaacagcgcuuccuggg

SEQ ID NO: 3446012 - RNA, 16 nt, Pseudomonas aeruginosa PA01
ccggcgaaccaggcgg

SEQ ID NO: 3446013 - RNA, 13 nt, Pseudomonas aeruginosa PA01
ccggcgaaccagu

SEQ ID NO: 3446014 - RNA, 21 nt, Pseudomonas aeruginosa PA01
ccggcgaaccagugcaccgcc

SEQ ID NO: 3446015 - RNA, 23 nt, Pseudomonas aeruginosa PA01
ccggcgaaccagugcaccgccgg

SEQ ID NO: 3446016 - RNA, 13 nt, Pseudomonas aeruginosa PA01
ccggcgaacgccg

SEQ ID NO: 3446017 - RNA, 17 nt, Pseudomonas aeruginosa PA01
ccggcgaacgcuugagc

SEQ ID NO: 3446018 - RNA, 23 nt, Pseudomonas aeruginosa PA01
ccggcgaacgcuugagccccggc

SEQ ID NO: 3446019 - RNA, 16 nt, Pseudomonas aeruginosa PA01
ccggcgaagcuccucg

SEQ ID NO: 3446020 - RNA, 18 nt, Pseudomonas aeruginosa PA01
ccggcgaagggcaggccg

SEQ ID NO: 3446021 - RNA, 19 nt, Pseudomonas aeruginosa PA01
ccggcgaagggcaggccga

SEQ ID NO: 3446022 - RNA, 19 nt, Pseudomonas aeruginosa PA01
ccggcgaaguccggguuga

SEQ ID NO: 3446023 - RNA, 13 nt, Pseudomonas aeruginosa PA01
ccggcgaaugccg

SEQ ID NO: 3446024 - RNA, 22 nt, Pseudomonas aeruginosa PA01
ccggcgaccaccacgucgaugc

SEQ ID NO: 3446025 - RNA, 14 nt, Pseudomonas aeruginosa PA01
ccggcgaccaccgc

SEQ ID NO: 3446026 - RNA, 17 nt, Pseudomonas aeruginosa PA01
ccggcgaccaccgccgg

SEQ ID NO: 3446027 - RNA, 19 nt, Pseudomonas aeruginosa PA01
ccggcgaccaccgccggga

SEQ ID NO: 3446028 - RNA, 13 nt, Pseudomonas aeruginosa PA01
ccggcgaccagcg

SEQ ID NO: 3446029 - RNA, 15 nt, Pseudomonas aeruginosa PA01
ccggcgaccagcguc

SEQ ID NO: 3446030 - RNA, 13 nt, Pseudomonas aeruginosa PA01
ccggcgaccagcu

SEQ ID NO: 3446031 - RNA, 14 nt, Pseudomonas aeruginosa PA01
ccggcgaccagcuc

SEQ ID NO: 3446032 - RNA, 16 nt, Pseudomonas aeruginosa PA01
ccggcgaccagcucga

SEQ ID NO: 3446033 - RNA, 19 nt, Pseudomonas aeruginosa PA01
ccggcgaccgcgcgcaugg

SEQ ID NO: 3446034 - RNA, 12 nt, Pseudomonas aeruginosa PA01
ccggcgaccuca

SEQ ID NO: 3446035 - RNA, 17 nt, Pseudomonas aeruginosa PA01
ccggcgcgauccuggcg

SEQ ID NO: 3446036 - RNA, 13 nt, Pseudomonas aeruginosa PA01
ccggcgcgcacgg

SEQ ID NO: 3446037 - RNA, 19 nt, Pseudomonas aeruginosa PA01
ccggcgcgcacggaggcgc

SEQ ID NO: 3446038 - RNA, 21 nt, Pseudomonas aeruginosa PA01
ccggcgcgcacggaggcgcuc

SEQ ID NO: 3446039 - RNA, 14 nt, Pseudomonas aeruginosa PA01
ccggcgcgcacggu

SEQ ID NO: 3446040 - RNA, 15 nt, Pseudomonas aeruginosa PA01
ccggcgcgcacgguc

SEQ ID NO: 3446041 - RNA, 16 nt, Pseudomonas aeruginosa PA01
ccggcgcgcacggucu

SEQ ID NO: 3446042 - RNA, 16 nt, Pseudomonas aeruginosa PA01
ccggcgcgcccaggcc

SEQ ID NO: 3446043 - RNA, 16 nt, Pseudomonas aeruginosa PA01
ccggcgcgccccugcg

SEQ ID NO: 3446044 - RNA, 18 nt, Pseudomonas aeruginosa PA01
ccggcgcgccccugcgcc

SEQ ID NO: 3446045 - RNA, 12 nt, Pseudomonas aeruginosa PA01
ccggcgcgcccg

SEQ ID NO: 3446046 - RNA, 17 nt, Pseudomonas aeruginosa PA01
ccggcgcgcccggcgcc

SEQ ID NO: 3446047 - RNA, 14 nt, Pseudomonas aeruginosa PA01
ccggcgcgccggac

SEQ ID NO: 3446048 - RNA, 15 nt, Pseudomonas aeruginosa PA01
ccggcgcgccggaca

SEQ ID NO: 3446049 - RNA, 17 nt, Pseudomonas aeruginosa PA01
ccggcgcgccggacagg

SEQ ID NO: 3446050 - RNA, 13 nt, Pseudomonas aeruginosa PA01
ccggcgcgcggcg

SEQ ID NO: 3446051 - RNA, 15 nt, Pseudomonas aeruginosa PA01
ccggcgcgcgguuuc

SEQ ID NO: 3446052 - RNA, 22 nt, Pseudomonas aeruginosa PA01
ccggcgcgcgguuucuucgccu

SEQ ID NO: 3446053 - RNA, 23 nt, Pseudomonas aeruginosa PA01
ccggcgcgcuuccuccaguagcg

SEQ ID NO: 3446054 - RNA, 23 nt, Pseudomonas aeruginosa PA01
ccggcgcggacgauggucgccgc

SEQ ID NO: 3446055 - RNA, 23 nt, Pseudomonas aeruginosa PA01
ccggcgcggacggccugcgcccu

SEQ ID NO: 3446056 - RNA, 20 nt, Pseudomonas aeruginosa PA01
ccggcgcggccugcagcgac

SEQ ID NO: 3446057 - RNA, 12 nt, Pseudomonas aeruginosa PA01
ccggcgcggcgc

SEQ ID NO: 3446058 - RNA, 13 nt, Pseudomonas aeruginosa PA01
ccggcgcggcgca

SEQ ID NO: 3446059 - RNA, 21 nt, Pseudomonas aeruginosa PA01
ccggcgcggcgcagcggcgaa

SEQ ID NO: 3446060 - RNA, 13 nt, Pseudomonas aeruginosa PA01
ccggcgcggcgcg

SEQ ID NO: 3446061 - RNA, 13 nt, Pseudomonas aeruginosa PA01
ccggcgcggcggc

SEQ ID NO: 3446062 - RNA, 16 nt, Pseudomonas aeruginosa PA01
ccggcgcggcggccgc

SEQ ID NO: 3446063 - RNA, 17 nt, Pseudomonas aeruginosa PA01
ccggcgcggcggccgcc

SEQ ID NO: 3446064 - RNA, 20 nt, Pseudomonas aeruginosa PA01
ccggcgcggcggccgccucg

SEQ ID NO: 3446065 - RNA, 11 nt, Pseudomonas aeruginosa PA01
ccggcgcggcu

SEQ ID NO: 3446066 - RNA, 22 nt, Pseudomonas aeruginosa PA01
ccggcgcggcuacccucucccc

SEQ ID NO: 3446067 - RNA, 18 nt, Pseudomonas aeruginosa PA01
ccggcgcgggcggccucg

SEQ ID NO: 3446068 - RNA, 21 nt, Pseudomonas aeruginosa PA01
ccggcgcgguuucgcagcgcu

SEQ ID NO: 3446069 - RNA, 20 nt, Pseudomonas aeruginosa PA01
ccggcgcguagaggaugccg

SEQ ID NO: 3446070 - RNA, 19 nt, Pseudomonas aeruginosa PA01
ccggcgcgucccugggcgc

SEQ ID NO: 3446071 - RNA, 17 nt, Pseudomonas aeruginosa PA01
ccggcgcgucgcugcgc

SEQ ID NO: 3446072 - RNA, 18 nt, Pseudomonas aeruginosa PA01
ccggcgcuacgccaaucc

SEQ ID NO: 3446073 - RNA, 16 nt, Pseudomonas aeruginosa PA01
ccggcgcuccaacagc

SEQ ID NO: 3446074 - RNA, 19 nt, Pseudomonas aeruginosa PA01
ccggcgcuccaacagcagg

SEQ ID NO: 3446075 - RNA, 21 nt, Pseudomonas aeruginosa PA01
ccggcgcuccaacagcaggua

SEQ ID NO: 3446076 - RNA, 16 nt, Pseudomonas aeruginosa PA01
ccggcgcuccuccucg

SEQ ID NO: 3446077 - RNA, 22 nt, Pseudomonas aeruginosa PA01
ccggcgcucgcugucaaucgcg

SEQ ID NO: 3446078 - RNA, 14 nt, Pseudomonas aeruginosa PA01
ccggcgcucggcca

SEQ ID NO: 3446079 - RNA, 22 nt, Pseudomonas aeruginosa PA01
ccggcgcucggccaggucgcga

SEQ ID NO: 3446080 - RNA, 14 nt, Pseudomonas aeruginosa PA01
ccggcgcugcccgg

SEQ ID NO: 3446081 - RNA, 13 nt, Pseudomonas aeruginosa PA01
ccggcgcugccga

SEQ ID NO: 3446082 - RNA, 14 nt, Pseudomonas aeruginosa PA01
ccggcgcugccgaa

SEQ ID NO: 3446083 - RNA, 19 nt, Pseudomonas aeruginosa PA01
ccggcgcugccgaacagca

SEQ ID NO: 3446084 - RNA, 20 nt, Pseudomonas aeruginosa PA01
ccggcgcugcuucuugucga

SEQ ID NO: 3446085 - RNA, 13 nt, Pseudomonas aeruginosa PA01
ccggcgcuggccg

SEQ ID NO: 3446086 - RNA, 20 nt, Pseudomonas aeruginosa PA01
ccggcgcugucucgccagcc

SEQ ID NO: 3446087 - RNA, 19 nt, Pseudomonas aeruginosa PA01
ccggcgcuucgcgcaggac

SEQ ID NO: 3446088 - RNA, 19 nt, Pseudomonas aeruginosa PA01
ccggcgcuucugcgagccg

SEQ ID NO: 3446089 - RNA, 20 nt, Pseudomonas aeruginosa PA01
ccggcggaacauggucgaga

SEQ ID NO: 3446090 - RNA, 16 nt, Pseudomonas aeruginosa PA01
ccggcggacaaccacc

SEQ ID NO: 3446091 - RNA, 20 nt, Pseudomonas aeruginosa PA01
ccggcggauaacgccugcgg

SEQ ID NO: 3446092 - RNA, 13 nt, Pseudomonas aeruginosa PA01
ccggcggaucagc

SEQ ID NO: 3446093 - RNA, 23 nt, Pseudomonas aeruginosa PA01
ccggcggaucagcccgcugaccg

SEQ ID NO: 3446094 - RNA, 22 nt, Pseudomonas aeruginosa PA01
ccggcggauuacuccgccggcg

SEQ ID NO: 3446095 - RNA, 23 nt, Pseudomonas aeruginosa PA01
ccggcggauuacuccgccggcgu

SEQ ID NO: 3446096 - RNA, 13 nt, Pseudomonas aeruginosa PA01
ccggcggcauccc

SEQ ID NO: 3446097 - RNA, 14 nt, Pseudomonas aeruginosa PA01
ccggcggcaugggc

SEQ ID NO: 3446098 - RNA, 13 nt, Pseudomonas aeruginosa PA01
ccggcggccaggg

SEQ ID NO: 3446099 - RNA, 14 nt, Pseudomonas aeruginosa PA01
ccggcggccggcgc

SEQ ID NO: 3446100 - RNA, 15 nt, Pseudomonas aeruginosa PA01
ccggcggccggcgca

SEQ ID NO: 3446101 - RNA, 16 nt, Pseudomonas aeruginosa PA01
ccggcggccugagccg

SEQ ID NO: 3446102 - RNA, 18 nt, Pseudomonas aeruginosa PA01
ccggcggccugagccggc

SEQ ID NO: 3446103 - RNA, 19 nt, Pseudomonas aeruginosa PA01
ccggcggccugagccggcc

SEQ ID NO: 3446104 - RNA, 20 nt, Pseudomonas aeruginosa PA01
ccggcggccugagccggccg

SEQ ID NO: 3446105 - RNA, 21 nt, Pseudomonas aeruginosa PA01
ccggcggccugagccggccgg

SEQ ID NO: 3446106 - RNA, 18 nt, Pseudomonas aeruginosa PA01
ccggcggccugccccgcc

SEQ ID NO: 3446107 - RNA, 23 nt, Pseudomonas aeruginosa PA01
ccggcggccugccccgccggcgc

SEQ ID NO: 3446108 - RNA, 14 nt, Pseudomonas aeruginosa PA01
ccggcggcgaacag

SEQ ID NO: 3446109 - RNA, 15 nt, Pseudomonas aeruginosa PA01
ccggcggcgacccag

SEQ ID NO: 3446110 - RNA, 16 nt, Pseudomonas aeruginosa PA01
ccggcggcgacccaga

SEQ ID NO: 3446111 - RNA, 22 nt, Pseudomonas aeruginosa PA01
ccggcggcgacccagaccugcc

SEQ ID NO: 3446112 - RNA, 21 nt, Pseudomonas aeruginosa PA01
ccggcggcgaugaagcugaug

SEQ ID NO: 3446113 - RNA, 18 nt, Pseudomonas aeruginosa PA01
ccggcggcgaugaucggc

SEQ ID NO: 3446114 - RNA, 22 nt, Pseudomonas aeruginosa PA01
ccggcggcgaugaucggcagcc

SEQ ID NO: 3446115 - RNA, 14 nt, Pseudomonas aeruginosa PA01
ccggcggcgccagg

SEQ ID NO: 3446116 - RNA, 18 nt, Pseudomonas aeruginosa PA01
ccggcggcgccaggccgg

SEQ ID NO: 3446117 - RNA, 20 nt, Pseudomonas aeruginosa PA01
ccggcggcgccaggccggcg

SEQ ID NO: 3446118 - RNA, 21 nt, Pseudomonas aeruginosa PA01
ccggcggcgccaggccggcga

SEQ ID NO: 3446119 - RNA, 15 nt, Pseudomonas aeruginosa PA01
ccggcggcgcggcag

SEQ ID NO: 3446120 - RNA, 18 nt, Pseudomonas aeruginosa PA01
ccggcggcgcggcagugc

SEQ ID NO: 3446121 - RNA, 13 nt, Pseudomonas aeruginosa PA01
ccggcggcgcggg

SEQ ID NO: 3446122 - RNA, 19 nt, Pseudomonas aeruginosa PA01
ccggcggcgcguccaccug

SEQ ID NO: 3446123 - RNA, 20 nt, Pseudomonas aeruginosa PA01
ccggcggcgcguuccacguc

SEQ ID NO: 3446124 - RNA, 13 nt, Pseudomonas aeruginosa PA01
ccggcggcgcuga

SEQ ID NO: 3446125 - RNA, 15 nt, Pseudomonas aeruginosa PA01
ccggcggcggacgca

SEQ ID NO: 3446126 - RNA, 18 nt, Pseudomonas aeruginosa PA01
ccggcggcggacgcaggc

SEQ ID NO: 3446127 - RNA, 19 nt, Pseudomonas aeruginosa PA01
ccggcggcggacgcaggcc

SEQ ID NO: 3446128 - RNA, 21 nt, Pseudomonas aeruginosa PA01
ccggcggcggacgcaggccga

SEQ ID NO: 3446129 - RNA, 13 nt, Pseudomonas aeruginosa PA01
ccggcggcggcac

SEQ ID NO: 3446130 - RNA, 19 nt, Pseudomonas aeruginosa PA01
ccggcggcugcugcgccug

SEQ ID NO: 3446131 - RNA, 20 nt, Pseudomonas aeruginosa PA01
ccggcggcugcugcgccugg

SEQ ID NO: 3446132 - RNA, 22 nt, Pseudomonas aeruginosa PA01
ccggcggcugcugcgccuggcc

SEQ ID NO: 3446133 - RNA, 15 nt, Pseudomonas aeruginosa PA01
ccggcgggacgcgca

SEQ ID NO: 3446134 - RNA, 19 nt, Pseudomonas aeruginosa PA01
ccggcgggacgcgcaugca

SEQ ID NO: 3446135 - RNA, 21 nt, Pseudomonas aeruginosa PA01
ccggcgggcgcgaggcgcccg

SEQ ID NO: 3446136 - RNA, 15 nt, Pseudomonas aeruginosa PA01
ccggcgggcgguagc

SEQ ID NO: 3446137 - RNA, 18 nt, Pseudomonas aeruginosa PA01
ccggcuggcggcucggcu

SEQ ID NO: 3446138 - RNA, 13 nt, Pseudomonas aeruginosa PA01
ccggcuggucaga

SEQ ID NO: 3446139 - RNA, 22 nt, Pseudomonas aeruginosa PA01
ccggcuggucagaaccaccggu

SEQ ID NO: 3446140 - RNA, 14 nt, Pseudomonas aeruginosa PA01
ccggcugguugcca

SEQ ID NO: 3446141 - RNA, 17 nt, Pseudomonas aeruginosa PA01
ccggcugucgacgcagc

SEQ ID NO: 3446142 - RNA, 19 nt, Pseudomonas aeruginosa PA01
ccggcugucgacgcagccg

SEQ ID NO: 3446143 - RNA, 20 nt, Pseudomonas aeruginosa PA01
ccggcugucgacgcagccgg

SEQ ID NO: 3446144 - RNA, 24 nt, Pseudomonas aeruginosa PA01
ccggcugucgacgcagccgggccg

SEQ ID NO: 3446145 - RNA, 18 nt, Pseudomonas aeruginosa PA01
ccggcugugcagggcagc

SEQ ID NO: 3446146 - RNA, 19 nt, Pseudomonas aeruginosa PA01
ccggcugugcagggcagcg

SEQ ID NO: 3446147 - RNA, 22 nt, Pseudomonas aeruginosa PA01
ccggcugugcucgacgggcgcu

SEQ ID NO: 3446148 - RNA, 15 nt, Pseudomonas aeruginosa PA01
ccggcuucagcaacu

SEQ ID NO: 3446149 - RNA, 19 nt, Pseudomonas aeruginosa PA01
ccggcuuccaccagacgca

SEQ ID NO: 3446150 - RNA, 22 nt, Pseudomonas aeruginosa PA01
ccggcuuccaccagacgcagca

SEQ ID NO: 3446151 - RNA, 15 nt, Pseudomonas aeruginosa PA01
ccggcuuccucgccc

SEQ ID NO: 3446152 - RNA, 16 nt, Pseudomonas aeruginosa PA01
ccggcuuccucgcccu

SEQ ID NO: 3446153 - RNA, 16 nt, Pseudomonas aeruginosa PA01
ccggcuucgcggguga

SEQ ID NO: 3446154 - RNA, 20 nt, Pseudomonas aeruginosa PA01
ccggcuucgcgggugaccug

SEQ ID NO: 3446155 - RNA, 15 nt, Pseudomonas aeruginosa PA01
ccggcuucggcggcg

SEQ ID NO: 3446156 - RNA, 19 nt, Pseudomonas aeruginosa PA01
ccggcuucggcggcgcgcu

SEQ ID NO: 3446157 - RNA, 24 nt, Pseudomonas aeruginosa PA01
ccggcuucuacgccuugcggcgcc

SEQ ID NO: 3446158 - RNA, 18 nt, Pseudomonas aeruginosa PA01
ccggcuugaccgccgccg

SEQ ID NO: 3446159 - RNA, 18 nt, Pseudomonas aeruginosa PA01
ccggcuugccgaugucgc

SEQ ID NO: 3446160 - RNA, 22 nt, Pseudomonas aeruginosa PA01
ccggcuugccgaugucgccggc

SEQ ID NO: 3446161 - RNA, 14 nt, Pseudomonas aeruginosa PA01
ccggcuugccggca

SEQ ID NO: 3446162 - RNA, 16 nt, Pseudomonas aeruginosa PA01
ccggcuugccggcagc

SEQ ID NO: 3446163 - RNA, 17 nt, Pseudomonas aeruginosa PA01
ccggcuugccggcagcg

SEQ ID NO: 3446164 - RNA, 12 nt, Pseudomonas aeruginosa PA01
ccggcuugccgu

SEQ ID NO: 3446165 - RNA, 14 nt, Pseudomonas aeruginosa PA01
ccggcuugccgucg

SEQ ID NO: 3446166 - RNA, 23 nt, Pseudomonas aeruginosa PA01
ccggcuuggcgggcucgcccauc

SEQ ID NO: 3446167 - RNA, 14 nt, Pseudomonas aeruginosa PA01
ccggcuuuccucgg

SEQ ID NO: 3446168 - RNA, 21 nt, Pseudomonas aeruginosa PA01
ccggcuuuccucggccaugcc

SEQ ID NO: 3446169 - RNA, 22 nt, Pseudomonas aeruginosa PA01
ccggcuuuuucauucggcuugc

SEQ ID NO: 3446170 - RNA, 15 nt, Pseudomonas aeruginosa PA01
ccgggaaacagggcg

SEQ ID NO: 3446171 - RNA, 17 nt, Pseudomonas aeruginosa PA01
ccgggaaacagggcgac

SEQ ID NO: 3446172 - RNA, 20 nt, Pseudomonas aeruginosa PA01
ccgggaaacagggcgacgcc

SEQ ID NO: 3446173 - RNA, 23 nt, Pseudomonas aeruginosa PA01
ccgggaaacagggcgacgccgau

SEQ ID NO: 3446174 - RNA, 18 nt, Pseudomonas aeruginosa PA01
ccgggaaagucugugauc

SEQ ID NO: 3446175 - RNA, 22 nt, Pseudomonas aeruginosa PA01
ccgggaaagucugugaucaggc

SEQ ID NO: 3446176 - RNA, 20 nt, Pseudomonas aeruginosa PA01
ccgggaacagcccgucgcgc

SEQ ID NO: 3446177 - RNA, 15 nt, Pseudomonas aeruginosa PA01
ccgggaagcaggucu

SEQ ID NO: 3446178 - RNA, 16 nt, Pseudomonas aeruginosa PA01
ccgggaagcaggucuc

SEQ ID NO: 3446179 - RNA, 16 nt, Pseudomonas aeruginosa PA01
ccgggaagccgcucgg

SEQ ID NO: 3446180 - RNA, 17 nt, Pseudomonas aeruginosa PA01
ccgggaagccgcucggc

SEQ ID NO: 3446181 - RNA, 18 nt, Pseudomonas aeruginosa PA01
ccgggaagccgcucggcg

SEQ ID NO: 3446182 - RNA, 15 nt, Pseudomonas aeruginosa PA01
ccgggaagcggucgu

SEQ ID NO: 3446183 - RNA, 23 nt, Pseudomonas aeruginosa PA01
ccgggaaggccugacgcaagcgc

SEQ ID NO: 3446184 - RNA, 11 nt, Pseudomonas aeruginosa PA01
ccgggaagucc

SEQ ID NO: 3446185 - RNA, 17 nt, Pseudomonas aeruginosa PA01
ccgggaaguccgggcgc

SEQ ID NO: 3446186 - RNA, 22 nt, Pseudomonas aeruginosa PA01
ccgggaaguccgggcgcggcug

SEQ ID NO: 3446187 - RNA, 16 nt, Pseudomonas aeruginosa PA01
ccgggaagucguuccc

SEQ ID NO: 3446188 - RNA, 19 nt, Pseudomonas aeruginosa PA01
ccgggaagucguucccggc

SEQ ID NO: 3446189 - RNA, 16 nt, Pseudomonas aeruginosa PA01
ccgggaaucuggccga

SEQ ID NO: 3446190 - RNA, 22 nt, Pseudomonas aeruginosa PA01
ccgggaaucuggccgaugccga

SEQ ID NO: 3446191 - RNA, 19 nt, Pseudomonas aeruginosa PA01
ccgggaaugcucagcacgg

SEQ ID NO: 3446192 - RNA, 21 nt, Pseudomonas aeruginosa PA01
ccgggaaugcucagcacggcg

SEQ ID NO: 3446193 - RNA, 23 nt, Pseudomonas aeruginosa PA01
ccgggaaugcucagcacggcgac

SEQ ID NO: 3446194 - RNA, 13 nt, Pseudomonas aeruginosa PA01
ccgggaccacgcu

SEQ ID NO: 3446195 - RNA, 19 nt, Pseudomonas aeruginosa PA01
ccgggaccacgcucagguc

SEQ ID NO: 3446196 - RNA, 16 nt, Pseudomonas aeruginosa PA01
ccgggacccugguagu

SEQ ID NO: 3446197 - RNA, 22 nt, Pseudomonas aeruginosa PA01
ccgggaccggcugcuuggccag

SEQ ID NO: 3446198 - RNA, 16 nt, Pseudomonas aeruginosa PA01
ccgggacgaagcggaa

SEQ ID NO: 3446199 - RNA, 13 nt, Pseudomonas aeruginosa PA01
ccgggaggcgccg

SEQ ID NO: 3446200 - RNA, 20 nt, Pseudomonas aeruginosa PA01
ccgggaggcgccgcgccagg

SEQ ID NO: 3446201 - RNA, 20 nt, Pseudomonas aeruginosa PA01
ccgggauacagcagccaagg

SEQ ID NO: 3446202 - RNA, 19 nt, Pseudomonas aeruginosa PA01
ccgggaucaccucgaaccc

SEQ ID NO: 3446203 - RNA, 22 nt, Pseudomonas aeruginosa PA01
ccgggaucaccucgaaccccug

SEQ ID NO: 3446204 - RNA, 15 nt, Pseudomonas aeruginosa PA01
ccgggaucagcggcg

SEQ ID NO: 3446205 - RNA, 16 nt, Pseudomonas aeruginosa PA01
ccgggaucagcggcgg

SEQ ID NO: 3446206 - RNA, 19 nt, Pseudomonas aeruginosa PA01
ccgggaucagcggcggggc

SEQ ID NO: 3446207 - RNA, 21 nt, Pseudomonas aeruginosa PA01
ccgggaucagcggcggggcca

SEQ ID NO: 3446208 - RNA, 22 nt, Pseudomonas aeruginosa PA01
ccgggaucgaugcgcgcccuga

SEQ ID NO: 3446209 - RNA, 19 nt, Pseudomonas aeruginosa PA01
ccgggaucuccucgacggc

SEQ ID NO: 3446210 - RNA, 23 nt, Pseudomonas aeruginosa PA01
ccgggaucuccucgacggcggga

SEQ ID NO: 3446211 - RNA, 21 nt, Pseudomonas aeruginosa PA01
ccgggaucuggcccugcaaca

SEQ ID NO: 3446212 - RNA, 17 nt, Pseudomonas aeruginosa PA01
ccgggaugaacccggcu

SEQ ID NO: 3446213 - RNA, 17 nt, Pseudomonas aeruginosa PA01
ccgggaugaacugcagc

SEQ ID NO: 3446214 - RNA, 21 nt, Pseudomonas aeruginosa PA01
ccgggaugaacugcagcuugu

SEQ ID NO: 3446215 - RNA, 21 nt, Pseudomonas aeruginosa PA01
ccgggaugaagaucaucuggg

SEQ ID NO: 3446216 - RNA, 16 nt, Pseudomonas aeruginosa PA01
ccgggaugcccggccg

SEQ ID NO: 3446217 - RNA, 22 nt, Pseudomonas aeruginosa PA01
ccgggauggucgagggcgcguu

SEQ ID NO: 3446218 - RNA, 20 nt, Pseudomonas aeruginosa PA01
ccgggcaacgauucgacgca

SEQ ID NO: 3446219 - RNA, 18 nt, Pseudomonas aeruginosa PA01
ccgggcaacgccaggccg

SEQ ID NO: 3446220 - RNA, 19 nt, Pseudomonas aeruginosa PA01
ccgggcaacgccaggccgc

SEQ ID NO: 3446221 - RNA, 14 nt, Pseudomonas aeruginosa PA01
ccgggcaacgcgca

SEQ ID NO: 3446222 - RNA, 16 nt, Pseudomonas aeruginosa PA01
ccgggcaacgcgcaga

SEQ ID NO: 3446223 - RNA, 18 nt, Pseudomonas aeruginosa PA01
ccgggcaacgcgcagagg

SEQ ID NO: 3446224 - RNA, 19 nt, Pseudomonas aeruginosa PA01
ccgggcaacugaucagccg

SEQ ID NO: 3446225 - RNA, 15 nt, Pseudomonas aeruginosa PA01
ccgggcaacugccga

SEQ ID NO: 3446226 - RNA, 17 nt, Pseudomonas aeruginosa PA01
ccgggcaagcucgacga

SEQ ID NO: 3446227 - RNA, 17 nt, Pseudomonas aeruginosa PA01
ccgggcaccccgagcgg

SEQ ID NO: 3446228 - RNA, 20 nt, Pseudomonas aeruginosa PA01
ccgggcaccccgagcggcgc

SEQ ID NO: 3446229 - RNA, 20 nt, Pseudomonas aeruginosa PA01
ccgggcacgcauagcgcgcu

SEQ ID NO: 3446230 - RNA, 21 nt, Pseudomonas aeruginosa PA01
ccgggcacgcauagcgcgcug

SEQ ID NO: 3446231 - RNA, 22 nt, Pseudomonas aeruginosa PA01
ccgggcacgcauagcgcgcugu

SEQ ID NO: 3446232 - RNA, 19 nt, Pseudomonas aeruginosa PA01
ccgggcacggaaucggacg

SEQ ID NO: 3446233 - RNA, 15 nt, Pseudomonas aeruginosa PA01
ccgggcacuugucga

SEQ ID NO: 3446234 - RNA, 14 nt, Pseudomonas aeruginosa PA01
ccgggcagaccagc

SEQ ID NO: 3446235 - RNA, 22 nt, Pseudomonas aeruginosa PA01
ccgggcagacuucgccgugcuc

SEQ ID NO: 3446236 - RNA, 13 nt, Pseudomonas aeruginosa PA01
ccgggcagcggcg

SEQ ID NO: 3446237 - RNA, 16 nt, Pseudomonas aeruginosa PA01
ccgggcagcggcgcaa

SEQ ID NO: 3446238 - RNA, 19 nt, Pseudomonas aeruginosa PA01
ccgggcuuuuucauuuccu

SEQ ID NO: 3446239 - RNA, 23 nt, Pseudomonas aeruginosa PA01
ccgggcuuuuucucgucgcgcga

SEQ ID NO: 3446240 - RNA, 22 nt, Pseudomonas aeruginosa PA01
ccggggaacagguucggcuuga

SEQ ID NO: 3446241 - RNA, 15 nt, Pseudomonas aeruginosa PA01
ccggggaaccacacc

SEQ ID NO: 3446242 - RNA, 23 nt, Pseudomonas aeruginosa PA01
ccggggaagauguucgccgccgc

SEQ ID NO: 3446243 - RNA, 18 nt, Pseudomonas aeruginosa PA01
ccggggaucagcgagagc

SEQ ID NO: 3446244 - RNA, 19 nt, Pseudomonas aeruginosa PA01
ccggggaucagcgagagcu

SEQ ID NO: 3446245 - RNA, 19 nt, Pseudomonas aeruginosa PA01
ccggggaucaggucgccgc

SEQ ID NO: 3446246 - RNA, 21 nt, Pseudomonas aeruginosa PA01
ccggggaucaggucgccgcug

SEQ ID NO: 3446247 - RNA, 16 nt, Pseudomonas aeruginosa PA01
ccggggcagcagggcg

SEQ ID NO: 3446248 - RNA, 22 nt, Pseudomonas aeruginosa PA01
ccggggcaggcaugcggccccg

SEQ ID NO: 3446249 - RNA, 14 nt, Pseudomonas aeruginosa PA01
ccggggcccggcag

SEQ ID NO: 3446250 - RNA, 15 nt, Pseudomonas aeruginosa PA01
ccggggccggcaccc

SEQ ID NO: 3446251 - RNA, 19 nt, Pseudomonas aeruginosa PA01
ccggggccuucaggcgcuc

SEQ ID NO: 3446252 - RNA, 18 nt, Pseudomonas aeruginosa PA01
ccggggcgcgggcgaagc

SEQ ID NO: 3446253 - RNA, 20 nt, Pseudomonas aeruginosa PA01
ccggggcgcgggcgaagcgc

SEQ ID NO: 3446254 - RNA, 19 nt, Pseudomonas aeruginosa PA01
ccggggcgcuguuggccug

SEQ ID NO: 3446255 - RNA, 20 nt, Pseudomonas aeruginosa PA01
ccggggcggauucaggcgcg

SEQ ID NO: 3446256 - RNA, 18 nt, Pseudomonas aeruginosa PA01
ccggggcggccgcucuuu

SEQ ID NO: 3446257 - RNA, 16 nt, Pseudomonas aeruginosa PA01
ccggggcgggccgcgc

SEQ ID NO: 3446258 - RNA, 17 nt, Pseudomonas aeruginosa PA01
ccggggcgggccgcgcc

SEQ ID NO: 3446259 - RNA, 20 nt, Pseudomonas aeruginosa PA01
ccggggcgugcaggccgccg

SEQ ID NO: 3446260 - RNA, 21 nt, Pseudomonas aeruginosa PA01
ccggggcgugcaggccgccga

SEQ ID NO: 3446261 - RNA, 22 nt, Pseudomonas aeruginosa PA01
ccggggcgugcaggccgccgag

SEQ ID NO: 3446262 - RNA, 15 nt, Pseudomonas aeruginosa PA01
ccggggcucaggccu

SEQ ID NO: 3446263 - RNA, 15 nt, Pseudomonas aeruginosa PA01
ccggggcucugccgg

SEQ ID NO: 3446264 - RNA, 13 nt, Pseudomonas aeruginosa PA01
ccgggggcggcga

SEQ ID NO: 3446265 - RNA, 24 nt, Pseudomonas aeruginosa PA01
ccgggggucgcggguucgaguccc

SEQ ID NO: 3446266 - RNA, 16 nt, Pseudomonas aeruginosa PA01
ccgggguauggccuuc

SEQ ID NO: 3446267 - RNA, 21 nt, Pseudomonas aeruginosa PA01
ccggggucaggccgaggcgcu

SEQ ID NO: 3446268 - RNA, 13 nt, Pseudomonas aeruginosa PA01
ccggggucgaggu

SEQ ID NO: 3446269 - RNA, 20 nt, Pseudomonas aeruginosa PA01
ccggggugauccagcuggcg

SEQ ID NO: 3446270 - RNA, 21 nt, Pseudomonas aeruginosa PA01
ccgggguggaguaccaggcca

SEQ ID NO: 3446271 - RNA, 20 nt, Pseudomonas aeruginosa PA01
ccggggugggcauagauguc

SEQ ID NO: 3446272 - RNA, 22 nt, Pseudomonas aeruginosa PA01
ccgggguugaguugcaggccgg

SEQ ID NO: 3446273 - RNA, 14 nt, Pseudomonas aeruginosa PA01
ccgggguuggcgcu

SEQ ID NO: 3446274 - RNA, 15 nt, Pseudomonas aeruginosa PA01
ccgggguuggcgcug

SEQ ID NO: 3446275 - RNA, 18 nt, Pseudomonas aeruginosa PA01
ccggguacagcgccacgg

SEQ ID NO: 3446276 - RNA, 19 nt, Pseudomonas aeruginosa PA01
ccggguacagcgccacggc

SEQ ID NO: 3446277 - RNA, 17 nt, Pseudomonas aeruginosa PA01
ccggguaccugcucgcg

SEQ ID NO: 3446278 - RNA, 16 nt, Pseudomonas aeruginosa PA01
ccggguacuggcgcug

SEQ ID NO: 3446279 - RNA, 17 nt, Pseudomonas aeruginosa PA01
ccggguacuggcgcugc

SEQ ID NO: 3446280 - RNA, 23 nt, Pseudomonas aeruginosa PA01
ccggguacuggcgcugcgcggcg

SEQ ID NO: 3446281 - RNA, 20 nt, Pseudomonas aeruginosa PA01
ccggguagcguuaucgccgg

SEQ ID NO: 3446282 - RNA, 22 nt, Pseudomonas aeruginosa PA01
ccggguagcguuaucgccgguc

SEQ ID NO: 3446283 - RNA, 22 nt, Pseudomonas aeruginosa PA01
ccggguaugcaggaucaguucg

SEQ ID NO: 3446284 - RNA, 20 nt, Pseudomonas aeruginosa PA01
ccgggucacggucagcucgg

SEQ ID NO: 3446285 - RNA, 22 nt, Pseudomonas aeruginosa PA01
ccgggucacggucagcucggca

SEQ ID NO: 3446286 - RNA, 15 nt, Pseudomonas aeruginosa PA01
ccgggucaucaccgg

SEQ ID NO: 3446287 - RNA, 19 nt, Pseudomonas aeruginosa PA01
ccgggucaucaccggcagg

SEQ ID NO: 3446288 - RNA, 13 nt, Pseudomonas aeruginosa PA01
ccgggucauuggc

SEQ ID NO: 3446289 - RNA, 15 nt, Pseudomonas aeruginosa PA01
ccggguccaccgcgg

SEQ ID NO: 3446290 - RNA, 22 nt, Pseudomonas aeruginosa PA01
ccggguccaccgcggccucgcu

SEQ ID NO: 3446291 - RNA, 16 nt, Pseudomonas aeruginosa PA01
ccggguccagcggccg

SEQ ID NO: 3446292 - RNA, 17 nt, Pseudomonas aeruginosa PA01
ccggguccagcggccgc

SEQ ID NO: 3446293 - RNA, 20 nt, Pseudomonas aeruginosa PA01
ccggguccagcggccgcgcc

SEQ ID NO: 3446294 - RNA, 18 nt, Pseudomonas aeruginosa PA01
ccgggucgaccuugccga

SEQ ID NO: 3446295 - RNA, 19 nt, Pseudomonas aeruginosa PA01
ccgggucgacuucgcacca

SEQ ID NO: 3446296 - RNA, 12 nt, Pseudomonas aeruginosa PA01
ccgggucgaggc

SEQ ID NO: 3446297 - RNA, 20 nt, Pseudomonas aeruginosa PA01
ccgggucgaugggccguagg

SEQ ID NO: 3446298 - RNA, 21 nt, Pseudomonas aeruginosa PA01
ccgggucgaugggccguaggu

SEQ ID NO: 3446299 - RNA, 15 nt, Pseudomonas aeruginosa PA01
ccgggucgcagccgg

SEQ ID NO: 3446300 - RNA, 14 nt, Pseudomonas aeruginosa PA01
ccgggucgccgcag

SEQ ID NO: 3446301 - RNA, 15 nt, Pseudomonas aeruginosa PA01
ccgggucgccgcagc

SEQ ID NO: 3446302 - RNA, 16 nt, Pseudomonas aeruginosa PA01
ccgggucgcgcagcgg

SEQ ID NO: 3446303 - RNA, 18 nt, Pseudomonas aeruginosa PA01
ccgggucgcgcagcggcu

SEQ ID NO: 3446304 - RNA, 14 nt, Pseudomonas aeruginosa PA01
ccgggucgcugccc

SEQ ID NO: 3446305 - RNA, 14 nt, Pseudomonas aeruginosa PA01
ccgggucgcugcuc

SEQ ID NO: 3446306 - RNA, 21 nt, Pseudomonas aeruginosa PA01
ccgggucgcugcucagggccg

SEQ ID NO: 3446307 - RNA, 22 nt, Pseudomonas aeruginosa PA01
ccgggucgcugcucagggccgc

SEQ ID NO: 3446308 - RNA, 16 nt, Pseudomonas aeruginosa PA01
ccgggucgucagcagg

SEQ ID NO: 3446309 - RNA, 14 nt, Pseudomonas aeruginosa PA01
ccgggucgucgguc

SEQ ID NO: 3446310 - RNA, 19 nt, Pseudomonas aeruginosa PA01
ccgggucgucggucggcca

SEQ ID NO: 3446311 - RNA, 21 nt, Pseudomonas aeruginosa PA01
ccgggucgucggucggccagg

SEQ ID NO: 3446312 - RNA, 13 nt, Pseudomonas aeruginosa PA01
ccgggucuucagu

SEQ ID NO: 3446313 - RNA, 16 nt, Pseudomonas aeruginosa PA01
ccgggugacggcguuc

SEQ ID NO: 3446314 - RNA, 15 nt, Pseudomonas aeruginosa PA01
ccgggugaugcccgg

SEQ ID NO: 3446315 - RNA, 20 nt, Pseudomonas aeruginosa PA01
ccgggugcagguucaccgcc

SEQ ID NO: 3446316 - RNA, 17 nt, Pseudomonas aeruginosa PA01
ccgggugccccaggcga

SEQ ID NO: 3446317 - RNA, 16 nt, Pseudomonas aeruginosa PA01
ccgggugccuuccgcg

SEQ ID NO: 3446318 - RNA, 20 nt, Pseudomonas aeruginosa PA01
ccgggugccuuccgcgccca

SEQ ID NO: 3446319 - RNA, 19 nt, Pseudomonas aeruginosa PA01
ccggguggagaggcgugcu

SEQ ID NO: 3446320 - RNA, 23 nt, Pseudomonas aeruginosa PA01
ccggguguuguucuucauccagu

SEQ ID NO: 3446321 - RNA, 14 nt, Pseudomonas aeruginosa PA01
ccggguucccaguu

SEQ ID NO: 3446322 - RNA, 14 nt, Pseudomonas aeruginosa PA01
ccggguucugcucg

SEQ ID NO: 3446323 - RNA, 17 nt, Pseudomonas aeruginosa PA01
ccggguugaaggcgcgg

SEQ ID NO: 3446324 - RNA, 21 nt, Pseudomonas aeruginosa PA01
ccggguugacccagagccgcu

SEQ ID NO: 3446325 - RNA, 14 nt, Pseudomonas aeruginosa PA01
ccggguugaccuug

SEQ ID NO: 3446326 - RNA, 24 nt, Pseudomonas aeruginosa PA01
ccggguugagguagagcacgccgu

SEQ ID NO: 3446327 - RNA, 14 nt, Pseudomonas aeruginosa PA01
ccggguugcgccgc

SEQ ID NO: 3446328 - RNA, 19 nt, Pseudomonas aeruginosa PA01
ccggguugcgccgcaagug

SEQ ID NO: 3446329 - RNA, 20 nt, Pseudomonas aeruginosa PA01
ccggguuggcgcaggccggg

SEQ ID NO: 3446330 - RNA, 18 nt, Pseudomonas aeruginosa PA01
ccggguugguggccgcgc

SEQ ID NO: 3446331 - RNA, 19 nt, Pseudomonas aeruginosa PA01
ccggguugguggccgcgcc

SEQ ID NO: 3446332 - RNA, 22 nt, Pseudomonas aeruginosa PA01
ccggguugucguugcgcagcuu

SEQ ID NO: 3446333 - RNA, 20 nt, Pseudomonas aeruginosa PA01
ccgguaaugaaaagccccgc

SEQ ID NO: 3446334 - RNA, 20 nt, Pseudomonas aeruginosa PA01
ccgguaaugacgaucucgau

SEQ ID NO: 3446335 - RNA, 21 nt, Pseudomonas aeruginosa PA01
ccgguaaugacgaucucgaug

SEQ ID NO: 3446336 - RNA, 22 nt, Pseudomonas aeruginosa PA01
ccgguaauuggccaggcucgcg

SEQ ID NO: 3446337 - RNA, 13 nt, Pseudomonas aeruginosa PA01
ccgguacagccaa

SEQ ID NO: 3446338 - RNA, 17 nt, Pseudomonas aeruginosa PA01
ccgguacagcgccuggu

SEQ ID NO: 3446339 - RNA, 17 nt, Pseudomonas aeruginosa PA01
ccggugaugucggcgcu

SEQ ID NO: 3446340 - RNA, 17 nt, Pseudomonas aeruginosa PA01
ccggugcaccaggcgau

SEQ ID NO: 3446341 - RNA, 19 nt, Pseudomonas aeruginosa PA01
ccggugcaccaggcgaugc

SEQ ID NO: 3446342 - RNA, 14 nt, Pseudomonas aeruginosa PA01
ccggugcaccuggg

SEQ ID NO: 3446343 - RNA, 17 nt, Pseudomonas aeruginosa PA01
ccggugcaggaacaggu

SEQ ID NO: 3446344 - RNA, 19 nt, Pseudomonas aeruginosa PA01
ccggugcaggaacagguuc

SEQ ID NO: 3446345 - RNA, 14 nt, Pseudomonas aeruginosa PA01
ccggugcaggccga

SEQ ID NO: 3446346 - RNA, 17 nt, Pseudomonas aeruginosa PA01
ccggugcaggccgagcu

SEQ ID NO: 3446347 - RNA, 14 nt, Pseudomonas aeruginosa PA01
ccggugcaugcgca

SEQ ID NO: 3446348 - RNA, 19 nt, Pseudomonas aeruginosa PA01
ccggugcaugcgcacgguc

SEQ ID NO: 3446349 - RNA, 15 nt, Pseudomonas aeruginosa PA01
ccggugccaggacca

SEQ ID NO: 3446350 - RNA, 19 nt, Pseudomonas aeruginosa PA01
ccggugccaggaccagccc

SEQ ID NO: 3446351 - RNA, 19 nt, Pseudomonas aeruginosa PA01
ccggugccagggcggucgg

SEQ ID NO: 3446352 - RNA, 22 nt, Pseudomonas aeruginosa PA01
ccggugccagggcggucggcca

SEQ ID NO: 3446353 - RNA, 19 nt, Pseudomonas aeruginosa PA01
ccggugccauacagcgccc

SEQ ID NO: 3446354 - RNA, 20 nt, Pseudomonas aeruginosa PA01
ccggugccauacagcgccca

SEQ ID NO: 3446355 - RNA, 13 nt, Pseudomonas aeruginosa PA01
ccggugccgcccu

SEQ ID NO: 3446356 - RNA, 15 nt, Pseudomonas aeruginosa PA01
ccggugccgcccugg

SEQ ID NO: 3446357 - RNA, 14 nt, Pseudomonas aeruginosa PA01
ccggugccgccggc

SEQ ID NO: 3446358 - RNA, 16 nt, Pseudomonas aeruginosa PA01
ccggugccgccggcca

SEQ ID NO: 3446359 - RNA, 13 nt, Pseudomonas aeruginosa PA01
ccggugccggcgg

SEQ ID NO: 3446360 - RNA, 19 nt, Pseudomonas aeruginosa PA01
ccggugccuucggcggcgc

SEQ ID NO: 3446361 - RNA, 21 nt, Pseudomonas aeruginosa PA01
ccggugccuucggcggcgccu

SEQ ID NO: 3446362 - RNA, 15 nt, Pseudomonas aeruginosa PA01
ccggugcgaaccggc

SEQ ID NO: 3446363 - RNA, 19 nt, Pseudomonas aeruginosa PA01
ccggugcggguggucgccg

SEQ ID NO: 3446364 - RNA, 22 nt, Pseudomonas aeruginosa PA01
ccggugcggguggucgccgccc

SEQ ID NO: 3446365 - RNA, 13 nt, Pseudomonas aeruginosa PA01
ccggugcucggcc

SEQ ID NO: 3446366 - RNA, 16 nt, Pseudomonas aeruginosa PA01
ccggugcucggccuga

SEQ ID NO: 3446367 - RNA, 16 nt, Pseudomonas aeruginosa PA01
ccggugcuggcgagca

SEQ ID NO: 3446368 - RNA, 19 nt, Pseudomonas aeruginosa PA01
ccggugcuggugcggccga

SEQ ID NO: 3446369 - RNA, 19 nt, Pseudomonas aeruginosa PA01
ccgguggaauaccgcugcg

SEQ ID NO: 3446370 - RNA, 16 nt, Pseudomonas aeruginosa PA01
ccgguggacugguuga

SEQ ID NO: 3446371 - RNA, 21 nt, Pseudomonas aeruginosa PA01
ccgguggccaggacgcuggcg

SEQ ID NO: 3446372 - RNA, 13 nt, Pseudomonas aeruginosa PA01
ccgguggccaggc

SEQ ID NO: 3446373 - RNA, 14 nt, Pseudomonas aeruginosa PA01
ccgguggccuccug

SEQ ID NO: 3446374 - RNA, 14 nt, Pseudomonas aeruginosa PA01
ccgguggcgcccag

SEQ ID NO: 3446375 - RNA, 12 nt, Pseudomonas aeruginosa PA01
ccgguggcgguu

SEQ ID NO: 3446376 - RNA, 18 nt, Pseudomonas aeruginosa PA01
ccgguggcgguugcgguu

SEQ ID NO: 3446377 - RNA, 17 nt, Pseudomonas aeruginosa PA01
ccgguggcguacccgcc

SEQ ID NO: 3446378 - RNA, 18 nt, Pseudomonas aeruginosa PA01
ccgguggcguuauucgcc

SEQ ID NO: 3446379 - RNA, 20 nt, Pseudomonas aeruginosa PA01
ccgguggcguuauucgcccu

SEQ ID NO: 3446380 - RNA, 19 nt, Pseudomonas aeruginosa PA01
ccgguggggcgggcgaagc

SEQ ID NO: 3446381 - RNA, 21 nt, Pseudomonas aeruginosa PA01
ccgguggggcgggcgaagcga

SEQ ID NO: 3446382 - RNA, 15 nt, Pseudomonas aeruginosa PA01
ccggugucgacgacg

SEQ ID NO: 3446383 - RNA, 21 nt, Pseudomonas aeruginosa PA01
ccggugucgacgacgaaaggc

SEQ ID NO: 3446384 - RNA, 19 nt, Pseudomonas aeruginosa PA01
ccgguuaucgaggcgucgg

SEQ ID NO: 3446385 - RNA, 15 nt, Pseudomonas aeruginosa PA01
ccgguuccagcggcc

SEQ ID NO: 3446386 - RNA, 21 nt, Pseudomonas aeruginosa PA01
ccgguuccagcggccgcgagc

SEQ ID NO: 3446387 - RNA, 13 nt, Pseudomonas aeruginosa PA01
ccgguucccgcag

SEQ ID NO: 3446388 - RNA, 17 nt, Pseudomonas aeruginosa PA01
ccgguucccgcagcgau

SEQ ID NO: 3446389 - RNA, 20 nt, Pseudomonas aeruginosa PA01
ccgguucccgcagcgaucag

SEQ ID NO: 3446390 - RNA, 18 nt, Pseudomonas aeruginosa PA01
ccgguucgacacgcucag

SEQ ID NO: 3446391 - RNA, 17 nt, Pseudomonas aeruginosa PA01
ccgguucgcaggccagg

SEQ ID NO: 3446392 - RNA, 20 nt, Pseudomonas aeruginosa PA01
ccgguucgcaggccaggcgc

SEQ ID NO: 3446393 - RNA, 19 nt, Pseudomonas aeruginosa PA01
ccgguucguagaguucgcu

SEQ ID NO: 3446394 - RNA, 21 nt, Pseudomonas aeruginosa PA01
ccgguugcagccaccagccga

SEQ ID NO: 3446395 - RNA, 16 nt, Pseudomonas aeruginosa PA01
ccgguugcgaccggcc

SEQ ID NO: 3446396 - RNA, 23 nt, Pseudomonas aeruginosa PA01
ccgguugcugcuugcgcgcggcg

SEQ ID NO: 3446397 - RNA, 19 nt, Pseudomonas aeruginosa PA01
ccgguugcuggcacagguc

SEQ ID NO: 3446398 - RNA, 14 nt, Pseudomonas aeruginosa PA01
ccgguuggcgcccc

SEQ ID NO: 3446399 - RNA, 15 nt, Pseudomonas aeruginosa PA01
ccgguuggcggauga

SEQ ID NO: 3446400 - RNA, 18 nt, Pseudomonas aeruginosa PA01
ccgguuggcuacccgcag

SEQ ID NO: 3446401 - RNA, 23 nt, Pseudomonas aeruginosa PA01
ccgguuggcuacccgcagggcuc

SEQ ID NO: 3446402 - RNA, 14 nt, Pseudomonas aeruginosa PA01
ccgguugugcgccc

SEQ ID NO: 3446403 - RNA, 18 nt, Pseudomonas aeruginosa PA01
ccgguuucccucgagcac

SEQ ID NO: 3446404 - RNA, 15 nt, Pseudomonas aeruginosa PA01
ccgguuuccgcagcg

SEQ ID NO: 3446405 - RNA, 17 nt, Pseudomonas aeruginosa PA01
ccgguuuccgcagcgcu

SEQ ID NO: 3446406 - RNA, 20 nt, Pseudomonas aeruginosa PA01
ccgguuuguugcaggcuggg

SEQ ID NO: 3446407 - RNA, 22 nt, Pseudomonas aeruginosa PA01
ccgguuuuuuauugccagcgac

SEQ ID NO: 3446408 - RNA, 18 nt, Pseudomonas aeruginosa PA01
ccguaaaauggcgcgccu

SEQ ID NO: 3446409 - RNA, 20 nt, Pseudomonas aeruginosa PA01
ccguaaaauggcgcgccucu

SEQ ID NO: 3446410 - RNA, 14 nt, Pseudomonas aeruginosa PA01
ccguacagcaggca

SEQ ID NO: 3446411 - RNA, 18 nt, Pseudomonas aeruginosa PA01
ccguacagcaggcaggca

SEQ ID NO: 3446412 - RNA, 20 nt, Pseudomonas aeruginosa PA01
ccguacagcccccgccggcc

SEQ ID NO: 3446413 - RNA, 22 nt, Pseudomonas aeruginosa PA01
ccguacaggucggcgccggugc

SEQ ID NO: 3446414 - RNA, 13 nt, Pseudomonas aeruginosa PA01
ccguaccagcgcg

SEQ ID NO: 3446415 - RNA, 17 nt, Pseudomonas aeruginosa PA01
ccguaccagucgcccgc

SEQ ID NO: 3446416 - RNA, 13 nt, Pseudomonas aeruginosa PA01
ccguaccccgacg

SEQ ID NO: 3446417 - RNA, 14 nt, Pseudomonas aeruginosa PA01
ccguacgcaccgcg

SEQ ID NO: 3446418 - RNA, 17 nt, Pseudomonas aeruginosa PA01
ccguacgcaccgcguag

SEQ ID NO: 3446419 - RNA, 20 nt, Pseudomonas aeruginosa PA01
ccguacucauggccgcagcg

SEQ ID NO: 3446420 - RNA, 13 nt, Pseudomonas aeruginosa PA01
ccguacuggcgcc

SEQ ID NO: 3446421 - RNA, 18 nt, Pseudomonas aeruginosa PA01
ccguacuggcgccaggcc

SEQ ID NO: 3446422 - RNA, 21 nt, Pseudomonas aeruginosa PA01
ccguacuggcgccaggccgcg

SEQ ID NO: 3446423 - RNA, 22 nt, Pseudomonas aeruginosa PA01
ccguacuggcgccaggccgcgu

SEQ ID NO: 3446424 - RNA, 14 nt, Pseudomonas aeruginosa PA01
ccguagaacgccag

SEQ ID NO: 3446425 - RNA, 21 nt, Pseudomonas aeruginosa PA01
ccguagaacgccaggaucggc

SEQ ID NO: 3446426 - RNA, 22 nt, Pseudomonas aeruginosa PA01
ccguagaacgccaggaucggca

SEQ ID NO: 3446427 - RNA, 14 nt, Pseudomonas aeruginosa PA01
ccguagaccaccag

SEQ ID NO: 3446428 - RNA, 15 nt, Pseudomonas aeruginosa PA01
ccguagaccaccagc

SEQ ID NO: 3446429 - RNA, 16 nt, Pseudomonas aeruginosa PA01
ccguagaccaccagca

SEQ ID NO: 3446430 - RNA, 19 nt, Pseudomonas aeruginosa PA01
ccguagaccaccagcagca

SEQ ID NO: 3446431 - RNA, 18 nt, Pseudomonas aeruginosa PA01
ccguagaccggcuccagg

SEQ ID NO: 3446432 - RNA, 17 nt, Pseudomonas aeruginosa PA01
ccguagaguucggcugc

SEQ ID NO: 3446433 - RNA, 13 nt, Pseudomonas aeruginosa PA01
ccguagcacaugg

SEQ ID NO: 3446434 - RNA, 20 nt, Pseudomonas aeruginosa PA01
ccguagccaugcccggcugg

SEQ ID NO: 3446435 - RNA, 22 nt, Pseudomonas aeruginosa PA01
ccguagccaugcccggcuggcg

SEQ ID NO: 3446436 - RNA, 13 nt, Pseudomonas aeruginosa PA01
ccguagccggugc

SEQ ID NO: 3446437 - RNA, 15 nt, Pseudomonas aeruginosa PA01
ccguagccguagaug

SEQ ID NO: 3446438 - RNA, 13 nt, Pseudomonas aeruginosa PA01
ccguagccgucga

SEQ ID NO: 3446439 - RNA, 21 nt, Pseudomonas aeruginosa PA01
ccguagccgucgaacagcagc

SEQ ID NO: 3446440 - RNA, 22 nt, Pseudomonas aeruginosa PA01
ccguagccgucguagcgcagcg

SEQ ID NO: 3446441 - RNA, 22 nt, Pseudomonas aeruginosa PA01
ccgucgaucagguaggccggcg

SEQ ID NO: 3446442 - RNA, 17 nt, Pseudomonas aeruginosa PA01
ccgucgccauucggcga

SEQ ID NO: 3446443 - RNA, 19 nt, Pseudomonas aeruginosa PA01
ccgucgccauucggcgacg

SEQ ID NO: 3446444 - RNA, 13 nt, Pseudomonas aeruginosa PA01
ccgucgcccuggu

SEQ ID NO: 3446445 - RNA, 15 nt, Pseudomonas aeruginosa PA01
ccgucgcccuggugc

SEQ ID NO: 3446446 - RNA, 16 nt, Pseudomonas aeruginosa PA01
ccgucgcccuggugca

SEQ ID NO: 3446447 - RNA, 12 nt, Pseudomonas aeruginosa PA01
ccgucgccggcg

SEQ ID NO: 3446448 - RNA, 15 nt, Pseudomonas aeruginosa PA01
ccgucgccggcgacg

SEQ ID NO: 3446449 - RNA, 22 nt, Pseudomonas aeruginosa PA01
ccgucgcgaagaccggccggcu

SEQ ID NO: 3446450 - RNA, 18 nt, Pseudomonas aeruginosa PA01
ccgucgcgaccuucggug

SEQ ID NO: 3446451 - RNA, 21 nt, Pseudomonas aeruginosa PA01
ccgucgcgauagacgccggcg

SEQ ID NO: 3446452 - RNA, 13 nt, Pseudomonas aeruginosa PA01
ccgucgcgccgcg

SEQ ID NO: 3446453 - RNA, 14 nt, Pseudomonas aeruginosa PA01
ccgucgcgccggcc

SEQ ID NO: 3446454 - RNA, 15 nt, Pseudomonas aeruginosa PA01
ccgucgcgcgcccgu

SEQ ID NO: 3446455 - RNA, 13 nt, Pseudomonas aeruginosa PA01
ccgucgcgcgccg

SEQ ID NO: 3446456 - RNA, 14 nt, Pseudomonas aeruginosa PA01
ccgucgcgcgccgg

SEQ ID NO: 3446457 - RNA, 17 nt, Pseudomonas aeruginosa PA01
ccgucgcggaagccgug

SEQ ID NO: 3446458 - RNA, 19 nt, Pseudomonas aeruginosa PA01
ccgucgcggaagccgugca

SEQ ID NO: 3446459 - RNA, 21 nt, Pseudomonas aeruginosa PA01
ccgucgcggucaucgccggcg

SEQ ID NO: 3446460 - RNA, 22 nt, Pseudomonas aeruginosa PA01
ccgucgcggucaucgccggcgc

SEQ ID NO: 3446461 - RNA, 13 nt, Pseudomonas aeruginosa PA01
ccgucgcuggagc

SEQ ID NO: 3446462 - RNA, 14 nt, Pseudomonas aeruginosa PA01
ccgucgcuucgccc

SEQ ID NO: 3446463 - RNA, 15 nt, Pseudomonas aeruginosa PA01
ccgucgcuucgcccg

SEQ ID NO: 3446464 - RNA, 18 nt, Pseudomonas aeruginosa PA01
ccgucgcuucgcccgccg

SEQ ID NO: 3446465 - RNA, 17 nt, Pseudomonas aeruginosa PA01
ccgucggacucgacguc

SEQ ID NO: 3446466 - RNA, 13 nt, Pseudomonas aeruginosa PA01
ccgucggauggcc

SEQ ID NO: 3446467 - RNA, 19 nt, Pseudomonas aeruginosa PA01
ccgucggauggccguccag

SEQ ID NO: 3446468 - RNA, 20 nt, Pseudomonas aeruginosa PA01
ccgucggauggccguccagg

SEQ ID NO: 3446469 - RNA, 19 nt, Pseudomonas aeruginosa PA01
ccgucggcaagcaggccgc

SEQ ID NO: 3446470 - RNA, 22 nt, Pseudomonas aeruginosa PA01
ccgucggcaagcaggccgcggu

SEQ ID NO: 3446471 - RNA, 16 nt, Pseudomonas aeruginosa PA01
ccgucggcccuccccu

SEQ ID NO: 3446472 - RNA, 12 nt, Pseudomonas aeruginosa PA01
ccgucggccggg

SEQ ID NO: 3446473 - RNA, 18 nt, Pseudomonas aeruginosa PA01
ccgucggccggggucagg

SEQ ID NO: 3446474 - RNA, 14 nt, Pseudomonas aeruginosa PA01
ccgucggccucgcc

SEQ ID NO: 3446475 - RNA, 12 nt, Pseudomonas aeruginosa PA01
ccgucggccugg

SEQ ID NO: 3446476 - RNA, 16 nt, Pseudomonas aeruginosa PA01
ccgucggccuggcggu

SEQ ID NO: 3446477 - RNA, 12 nt, Pseudomonas aeruginosa PA01
ccgucggcgacg

SEQ ID NO: 3446478 - RNA, 20 nt, Pseudomonas aeruginosa PA01
ccgucggcggucagcuugcc

SEQ ID NO: 3446479 - RNA, 20 nt, Pseudomonas aeruginosa PA01
ccgucgggcaguuccgccag

SEQ ID NO: 3446480 - RNA, 17 nt, Pseudomonas aeruginosa PA01
ccgucgggcauggcgau

SEQ ID NO: 3446481 - RNA, 23 nt, Pseudomonas aeruginosa PA01
ccgucgggcuucgguguaucggc

SEQ ID NO: 3446482 - RNA, 18 nt, Pseudomonas aeruginosa PA01
ccgucguagcgcagcggc

SEQ ID NO: 3446483 - RNA, 23 nt, Pseudomonas aeruginosa PA01
ccgucgucguccaccgaguggcg

SEQ ID NO: 3446484 - RNA, 17 nt, Pseudomonas aeruginosa PA01
ccgucgucguggcgaac

SEQ ID NO: 3446485 - RNA, 23 nt, Pseudomonas aeruginosa PA01
ccgucguucggcuguuucaggcc

SEQ ID NO: 3446486 - RNA, 21 nt, Pseudomonas aeruginosa PA01
ccgucguuuuguccggcggcu

SEQ ID NO: 3446487 - RNA, 22 nt, Pseudomonas aeruginosa PA01
ccgucguuuuguccggcggcug

SEQ ID NO: 3446488 - RNA, 16 nt, Pseudomonas aeruginosa PA01
ccgucuagcgcaggcg

SEQ ID NO: 3446489 - RNA, 14 nt, Pseudomonas aeruginosa PA01
ccgucucaggcgcc

SEQ ID NO: 3446490 - RNA, 17 nt, Pseudomonas aeruginosa PA01
ccgucuccagcaaccca

SEQ ID NO: 3446491 - RNA, 23 nt, Pseudomonas aeruginosa PA01
ccgucuccagcaacccaugccgc

SEQ ID NO: 3446492 - RNA, 13 nt, Pseudomonas aeruginosa PA01
ccgucuccaggcg

SEQ ID NO: 3446493 - RNA, 15 nt, Pseudomonas aeruginosa PA01
ccgucuccaggcgcg

SEQ ID NO: 3446494 - RNA, 15 nt, Pseudomonas aeruginosa PA01
ccgucucgucgagcg

SEQ ID NO: 3446495 - RNA, 13 nt, Pseudomonas aeruginosa PA01
ccgucuggcgcau

SEQ ID NO: 3446496 - RNA, 18 nt, Pseudomonas aeruginosa PA01
ccgucuggcgcauccgcc

SEQ ID NO: 3446497 - RNA, 21 nt, Pseudomonas aeruginosa PA01
ccgucuggcgcauccgcccga

SEQ ID NO: 3446498 - RNA, 20 nt, Pseudomonas aeruginosa PA01
ccgucuucaguaggccagcg

SEQ ID NO: 3446499 - RNA, 22 nt, Pseudomonas aeruginosa PA01
ccgucuucaguaggccagcggc

SEQ ID NO: 3446500 - RNA, 15 nt, Pseudomonas aeruginosa PA01
ccgucuucgaugaag

SEQ ID NO: 3446501 - RNA, 16 nt, Pseudomonas aeruginosa PA01
ccgucuugccgcugcg

SEQ ID NO: 3446502 - RNA, 15 nt, Pseudomonas aeruginosa PA01
ccgugaaaagcggcg

SEQ ID NO: 3446503 - RNA, 22 nt, Pseudomonas aeruginosa PA01
ccgugaagcacggugacacccu

SEQ ID NO: 3446504 - RNA, 20 nt, Pseudomonas aeruginosa PA01
ccgugaccagcauggcgggc

SEQ ID NO: 3446505 - RNA, 16 nt, Pseudomonas aeruginosa PA01
ccgugacgucggcggc

SEQ ID NO: 3446506 - RNA, 19 nt, Pseudomonas aeruginosa PA01
ccgugagcuuguccagggc

SEQ ID NO: 3446507 - RNA, 18 nt, Pseudomonas aeruginosa PA01
ccgugaggcgcaggggcu

SEQ ID NO: 3446508 - RNA, 23 nt, Pseudomonas aeruginosa PA01
ccgugaucaccuggaucgccagg

SEQ ID NO: 3446509 - RNA, 16 nt, Pseudomonas aeruginosa PA01
ccgugaucccgcgcgg

SEQ ID NO: 3446510 - RNA, 18 nt, Pseudomonas aeruginosa PA01
ccgugaugcccagcggcg

SEQ ID NO: 3446511 - RNA, 20 nt, Pseudomonas aeruginosa PA01
ccgugaugcccagcggcgcc

SEQ ID NO: 3446512 - RNA, 20 nt, Pseudomonas aeruginosa PA01
ccgugcaccgaggcgcgccg

SEQ ID NO: 3446513 - RNA, 12 nt, Pseudomonas aeruginosa PA01
ccgugcagcagc

SEQ ID NO: 3446514 - RNA, 13 nt, Pseudomonas aeruginosa PA01
ccgugcagcagcg

SEQ ID NO: 3446515 - RNA, 12 nt, Pseudomonas aeruginosa PA01
ccgugcagcccu

SEQ ID NO: 3446516 - RNA, 15 nt, Pseudomonas aeruginosa PA01
ccgugcagggucagg

SEQ ID NO: 3446517 - RNA, 18 nt, Pseudomonas aeruginosa PA01
ccgugcaucaccggcagc

SEQ ID NO: 3446518 - RNA, 23 nt, Pseudomonas aeruginosa PA01
ccgugcaucaccggcagcagcgg

SEQ ID NO: 3446519 - RNA, 17 nt, Pseudomonas aeruginosa PA01
ccgugcaugccgacgag

SEQ ID NO: 3446520 - RNA, 13 nt, Pseudomonas aeruginosa PA01
ccgugccaggcgc

SEQ ID NO: 3446521 - RNA, 20 nt, Pseudomonas aeruginosa PA01
ccgugcccgccggcgcgccc

SEQ ID NO: 3446522 - RNA, 20 nt, Pseudomonas aeruginosa PA01
ccgugccgccggggcgcagg

SEQ ID NO: 3446523 - RNA, 13 nt, Pseudomonas aeruginosa PA01
ccgugccgggcca

SEQ ID NO: 3446524 - RNA, 15 nt, Pseudomonas aeruginosa PA01
ccgugccgggccagc

SEQ ID NO: 3446525 - RNA, 16 nt, Pseudomonas aeruginosa PA01
ccgugccggucgcgca

SEQ ID NO: 3446526 - RNA, 14 nt, Pseudomonas aeruginosa PA01
ccgugccucggcgg

SEQ ID NO: 3446527 - RNA, 14 nt, Pseudomonas aeruginosa PA01
ccgugcgcaccucg

SEQ ID NO: 3446528 - RNA, 15 nt, Pseudomonas aeruginosa PA01
ccgugcgcaccucgc

SEQ ID NO: 3446529 - RNA, 20 nt, Pseudomonas aeruginosa PA01
ccgugcgccccagcucagca

SEQ ID NO: 3446530 - RNA, 14 nt, Pseudomonas aeruginosa PA01
ccgugcgccgggcu

SEQ ID NO: 3446531 - RNA, 23 nt, Pseudomonas aeruginosa PA01
ccgugcgcgcggccuguucggcc

SEQ ID NO: 3446532 - RNA, 16 nt, Pseudomonas aeruginosa PA01
ccgugcgcuccgccag

SEQ ID NO: 3446533 - RNA, 17 nt, Pseudomonas aeruginosa PA01
ccgugcgcuccgccagg

SEQ ID NO: 3446534 - RNA, 19 nt, Pseudomonas aeruginosa PA01
ccgugcgcuccgccaggcc

SEQ ID NO: 3446535 - RNA, 22 nt, Pseudomonas aeruginosa PA01
ccgugcgcuccgccaggccgcg

SEQ ID NO: 3446536 - RNA, 22 nt, Pseudomonas aeruginosa PA01
ccgugcggaaaccgcggccggc

SEQ ID NO: 3446537 - RNA, 20 nt, Pseudomonas aeruginosa PA01
ccgugcggagggucaggccg

SEQ ID NO: 3446538 - RNA, 21 nt, Pseudomonas aeruginosa PA01
ccgugcggagggucaggccga

SEQ ID NO: 3446539 - RNA, 22 nt, Pseudomonas aeruginosa PA01
ccgugcggagggucaggccgag

SEQ ID NO: 3446540 - RNA, 11 nt, Pseudomonas aeruginosa PA01
ccgugcggccu

SEQ ID NO: 3446541 - RNA, 19 nt, Pseudomonas aeruginosa PA01
ccgugcggcguucgccgcg

SEQ ID NO: 3446542 - RNA, 20 nt, Pseudomonas aeruginosa PA01
ccgugcuggccggcagcagc

SEQ ID NO: 3446543 - RNA, 21 nt, Pseudomonas aeruginosa PA01
ccgugcuggccggcagcagcg

SEQ ID NO: 3446544 - RNA, 15 nt, Pseudomonas aeruginosa PA01
ccgugcuucaucggc

SEQ ID NO: 3446545 - RNA, 17 nt, Pseudomonas aeruginosa PA01
ccguggaaaccucgccg

SEQ ID NO: 3446546 - RNA, 20 nt, Pseudomonas aeruginosa PA01
ccguggaaaccucgccgauc

SEQ ID NO: 3446547 - RNA, 20 nt, Pseudomonas aeruginosa PA01
ccguggaccaacagccggcg

SEQ ID NO: 3446548 - RNA, 16 nt, Pseudomonas aeruginosa PA01
ccguggagaggucgcc

SEQ ID NO: 3446549 - RNA, 18 nt, Pseudomonas aeruginosa PA01
ccguggagaggucgccga

SEQ ID NO: 3446550 - RNA, 15 nt, Pseudomonas aeruginosa PA01
ccguggaucgcccgg

SEQ ID NO: 3446551 - RNA, 17 nt, Pseudomonas aeruginosa PA01
ccguggaucgcccggcu

SEQ ID NO: 3446552 - RNA, 17 nt, Pseudomonas aeruginosa PA01
ccguggauuucagcagg

SEQ ID NO: 3446553 - RNA, 16 nt, Pseudomonas aeruginosa PA01
ccguggcaccaggucg

SEQ ID NO: 3446554 - RNA, 16 nt, Pseudomonas aeruginosa PA01
ccguggcacccaggcc

SEQ ID NO: 3446555 - RNA, 21 nt, Pseudomonas aeruginosa PA01
ccguggcacccaggccacgcc

SEQ ID NO: 3446556 - RNA, 16 nt, Pseudomonas aeruginosa PA01
ccguggcaggcgcccg

SEQ ID NO: 3446557 - RNA, 21 nt, Pseudomonas aeruginosa PA01
ccguggcaggugacgcagggc

SEQ ID NO: 3446558 - RNA, 17 nt, Pseudomonas aeruginosa PA01
ccguggcgccauccucc

SEQ ID NO: 3446559 - RNA, 13 nt, Pseudomonas aeruginosa PA01
ccguggcgcccca

SEQ ID NO: 3446560 - RNA, 18 nt, Pseudomonas aeruginosa PA01
ccguggcgccccaggcgg

SEQ ID NO: 3446561 - RNA, 20 nt, Pseudomonas aeruginosa PA01
ccguggcgccccaggcgggc

SEQ ID NO: 3446562 - RNA, 17 nt, Pseudomonas aeruginosa PA01
ccguggcgccgcagggc

SEQ ID NO: 3446563 - RNA, 13 nt, Pseudomonas aeruginosa PA01
ccguggcgccggc

SEQ ID NO: 3446564 - RNA, 14 nt, Pseudomonas aeruginosa PA01
ccguggcgccggcg

SEQ ID NO: 3446565 - RNA, 15 nt, Pseudomonas aeruginosa PA01
ccguggcgccggcgc

SEQ ID NO: 3446566 - RNA, 20 nt, Pseudomonas aeruginosa PA01
ccguggcgcggacgggccgc

SEQ ID NO: 3446567 - RNA, 20 nt, Pseudomonas aeruginosa PA01
ccguggcgcuacgcucgccg

SEQ ID NO: 3446568 - RNA, 21 nt, Pseudomonas aeruginosa PA01
ccguggcgcuacgcucgccga

SEQ ID NO: 3446569 - RNA, 16 nt, Pseudomonas aeruginosa PA01
ccguggcgcuggccga

SEQ ID NO: 3446570 - RNA, 12 nt, Pseudomonas aeruginosa PA01
ccguggcggccg

SEQ ID NO: 3446571 - RNA, 15 nt, Pseudomonas aeruginosa PA01
ccguggcggccgccg

SEQ ID NO: 3446572 - RNA, 14 nt, Pseudomonas aeruginosa PA01
ccguggcggcgcgc

SEQ ID NO: 3446573 - RNA, 15 nt, Pseudomonas aeruginosa PA01
ccguggcggcgcgcg

SEQ ID NO: 3446574 - RNA, 15 nt, Pseudomonas aeruginosa PA01
ccguggcgggccagc

SEQ ID NO: 3446575 - RNA, 18 nt, Pseudomonas aeruginosa PA01
ccguggcgggccagcagg

SEQ ID NO: 3446576 - RNA, 22 nt, Pseudomonas aeruginosa PA01
ccguggcgggccagcaggcgcu

SEQ ID NO: 3446577 - RNA, 19 nt, Pseudomonas aeruginosa PA01
ccguggcgguacuccgggu

SEQ ID NO: 3446578 - RNA, 14 nt, Pseudomonas aeruginosa PA01
ccguggcucgauga

SEQ ID NO: 3446579 - RNA, 18 nt, Pseudomonas aeruginosa PA01
ccguggcucggcggcagg

SEQ ID NO: 3446580 - RNA, 19 nt, Pseudomonas aeruginosa PA01
ccguggcucggcggcaggc

SEQ ID NO: 3446581 - RNA, 20 nt, Pseudomonas aeruginosa PA01
ccguggcucggcggcaggcu

SEQ ID NO: 3446582 - RNA, 19 nt, Pseudomonas aeruginosa PA01
ccguggcuggggccggccu

SEQ ID NO: 3446583 - RNA, 13 nt, Pseudomonas aeruginosa PA01
ccgugggaucgcc

SEQ ID NO: 3446584 - RNA, 21 nt, Pseudomonas aeruginosa PA01
ccgugggaucgccacgccggc

SEQ ID NO: 3446585 - RNA, 13 nt, Pseudomonas aeruginosa PA01
ccgugggccgccg

SEQ ID NO: 3446586 - RNA, 14 nt, Pseudomonas aeruginosa PA01
ccgugggccgccga

SEQ ID NO: 3446587 - RNA, 18 nt, Pseudomonas aeruginosa PA01
ccgugggccggcgcgccg

SEQ ID NO: 3446588 - RNA, 19 nt, Pseudomonas aeruginosa PA01
ccgugggcgccgccgguga

SEQ ID NO: 3446589 - RNA, 16 nt, Pseudomonas aeruginosa PA01
ccgugggggggaaggg

SEQ ID NO: 3446590 - RNA, 18 nt, Pseudomonas aeruginosa PA01
ccgugggggggaagggcc

SEQ ID NO: 3446591 - RNA, 20 nt, Pseudomonas aeruginosa PA01
ccgugggguauuccaggcga

SEQ ID NO: 3446592 - RNA, 21 nt, Pseudomonas aeruginosa PA01
ccgugggucgccucgaacaug

SEQ ID NO: 3446593 - RNA, 23 nt, Pseudomonas aeruginosa PA01
ccgugggucgccucgaacauggc

SEQ ID NO: 3446594 - RNA, 12 nt, Pseudomonas aeruginosa PA01
ccgugguacacc

SEQ ID NO: 3446595 - RNA, 14 nt, Pseudomonas aeruginosa PA01
ccgugguacaccgc

SEQ ID NO: 3446596 - RNA, 16 nt, Pseudomonas aeruginosa PA01
ccguggucagcaccag

SEQ ID NO: 3446597 - RNA, 20 nt, Pseudomonas aeruginosa PA01
ccguggucagcaccagggcc

SEQ ID NO: 3446598 - RNA, 22 nt, Pseudomonas aeruginosa PA01
ccguggucagcaccagggccag

SEQ ID NO: 3446599 - RNA, 16 nt, Pseudomonas aeruginosa PA01
ccguggucauggcgca

SEQ ID NO: 3446600 - RNA, 15 nt, Pseudomonas aeruginosa PA01
ccgugguccgccagc

SEQ ID NO: 3446601 - RNA, 19 nt, Pseudomonas aeruginosa PA01
ccgugguccgccagcaggc

SEQ ID NO: 3446602 - RNA, 13 nt, Pseudomonas aeruginosa PA01
ccguggucgccgc

SEQ ID NO: 3446603 - RNA, 13 nt, Pseudomonas aeruginosa PA01
ccguggucgcgca

SEQ ID NO: 3446604 - RNA, 16 nt, Pseudomonas aeruginosa PA01
ccguggucgcgcaggc

SEQ ID NO: 3446605 - RNA, 23 nt, Pseudomonas aeruginosa PA01
ccgugguucucggucgggcgggc

SEQ ID NO: 3446606 - RNA, 16 nt, Pseudomonas aeruginosa PA01
ccguguaccacgcccg

SEQ ID NO: 3446607 - RNA, 18 nt, Pseudomonas aeruginosa PA01
ccgugucgagggcgaaca

SEQ ID NO: 3446608 - RNA, 14 nt, Pseudomonas aeruginosa PA01
ccgugucggcggcg

SEQ ID NO: 3446609 - RNA, 15 nt, Pseudomonas aeruginosa PA01
ccgugucggcggcgc

SEQ ID NO: 3446610 - RNA, 23 nt, Pseudomonas aeruginosa PA01
ccgugucggcggcgccuucgccg

SEQ ID NO: 3446611 - RNA, 16 nt, Pseudomonas aeruginosa PA01
ccgugugcagcagggu

SEQ ID NO: 3446612 - RNA, 22 nt, Pseudomonas aeruginosa PA01
ccguguucggccagccggcgcc

SEQ ID NO: 3446613 - RNA, 23 nt, Pseudomonas aeruginosa PA01
ccguguucggccagccggcgccg

SEQ ID NO: 3446614 - RNA, 14 nt, Pseudomonas aeruginosa PA01
ccguguugaucgcc

SEQ ID NO: 3446615 - RNA, 17 nt, Pseudomonas aeruginosa PA01
ccguguugaucgccgcg

SEQ ID NO: 3446616 - RNA, 18 nt, Pseudomonas aeruginosa PA01
ccguguugaucgccgcgc

SEQ ID NO: 3446617 - RNA, 19 nt, Pseudomonas aeruginosa PA01
ccguguugaucgccgcgcc

SEQ ID NO: 3446618 - RNA, 16 nt, Pseudomonas aeruginosa PA01
ccguguugaugccgau

SEQ ID NO: 3446619 - RNA, 20 nt, Pseudomonas aeruginosa PA01
ccguuaccuuggccacgacg

SEQ ID NO: 3446620 - RNA, 13 nt, Pseudomonas aeruginosa PA01
ccguucacgccug

SEQ ID NO: 3446621 - RNA, 20 nt, Pseudomonas aeruginosa PA01
ccguucacgccuggcggcug

SEQ ID NO: 3446622 - RNA, 17 nt, Pseudomonas aeruginosa PA01
ccguucaggccggcgcc

SEQ ID NO: 3446623 - RNA, 18 nt, Pseudomonas aeruginosa PA01
ccguucaggccggcgccg

SEQ ID NO: 3446624 - RNA, 22 nt, Pseudomonas aeruginosa PA01
ccguucagggacaugucgaggg

SEQ ID NO: 3446625 - RNA, 20 nt, Pseudomonas aeruginosa PA01
ccguucagggucagguugcc

SEQ ID NO: 3446626 - RNA, 18 nt, Pseudomonas aeruginosa PA01
ccguucagguucagggug

SEQ ID NO: 3446627 - RNA, 19 nt, Pseudomonas aeruginosa PA01
ccguucaucgaaaugccgc

SEQ ID NO: 3446628 - RNA, 16 nt, Pseudomonas aeruginosa PA01
ccguuccaccgccugg

SEQ ID NO: 3446629 - RNA, 14 nt, Pseudomonas aeruginosa PA01
ccguuccagcggca

SEQ ID NO: 3446630 - RNA, 23 nt, Pseudomonas aeruginosa PA01
ccguuccagcggcacuucccgcc

SEQ ID NO: 3446631 - RNA, 12 nt, Pseudomonas aeruginosa PA01
ccguucccagca

SEQ ID NO: 3446632 - RNA, 17 nt, Pseudomonas aeruginosa PA01
ccguucccagcagcgcc

SEQ ID NO: 3446633 - RNA, 14 nt, Pseudomonas aeruginosa PA01
ccguuccgacccgg

SEQ ID NO: 3446634 - RNA, 15 nt, Pseudomonas aeruginosa PA01
ccguuccgacccggc

SEQ ID NO: 3446635 - RNA, 16 nt, Pseudomonas aeruginosa PA01
ccguuccgacccggcc

SEQ ID NO: 3446636 - RNA, 18 nt, Pseudomonas aeruginosa PA01
ccguuccgcucaccaggc

SEQ ID NO: 3446637 - RNA, 18 nt, Pseudomonas aeruginosa PA01
ccguuccuccucgccgcc

SEQ ID NO: 3446638 - RNA, 12 nt, Pseudomonas aeruginosa PA01
ccguuccuugcg

SEQ ID NO: 3446639 - RNA, 19 nt, Pseudomonas aeruginosa PA01
ccguuccuugcgcggcagg

SEQ ID NO: 3446640 - RNA, 14 nt, Pseudomonas aeruginosa PA01
ccguucgcccgcca

SEQ ID NO: 3446641 - RNA, 19 nt, Pseudomonas aeruginosa PA01
ccguucgcuggacaggcgc

SEQ ID NO: 3446642 - RNA, 22 nt, Pseudomonas aeruginosa PA01
ccguucgcuggacaggcgcagg

SEQ ID NO: 3446643 - RNA, 15 nt, Pseudomonas aeruginosa PA01
ccguucgucaccggc

SEQ ID NO: 3446644 - RNA, 18 nt, Pseudomonas aeruginosa PA01
ccguucgucaccggcgcc

SEQ ID NO: 3446645 - RNA, 14 nt, Pseudomonas aeruginosa PA01
ccguucucccgcgc

SEQ ID NO: 3446646 - RNA, 15 nt, Pseudomonas aeruginosa PA01
ccguucucgaagagc

SEQ ID NO: 3446647 - RNA, 11 nt, Pseudomonas aeruginosa PA01
ccucaggcgcc

SEQ ID NO: 3446648 - RNA, 18 nt, Pseudomonas aeruginosa PA01
ccucaggcgcugcgcggc

SEQ ID NO: 3446649 - RNA, 21 nt, Pseudomonas aeruginosa PA01
ccucaggcgcugcgcggccug

SEQ ID NO: 3446650 - RNA, 22 nt, Pseudomonas aeruginosa PA01
ccucagggaagaugcacaccag

SEQ ID NO: 3446651 - RNA, 13 nt, Pseudomonas aeruginosa PA01
ccucagggcgcga

SEQ ID NO: 3446652 - RNA, 18 nt, Pseudomonas aeruginosa PA01
ccucaggggugcagcccu

SEQ ID NO: 3446653 - RNA, 22 nt, Pseudomonas aeruginosa PA01
ccucaggggugcagcccuggcg

SEQ ID NO: 3446654 - RNA, 17 nt, Pseudomonas aeruginosa PA01
ccucagguagucggcga

SEQ ID NO: 3446655 - RNA, 19 nt, Pseudomonas aeruginosa PA01
ccucagguagucggcgaug

SEQ ID NO: 3446656 - RNA, 22 nt, Pseudomonas aeruginosa PA01
ccucagguagucggcgaugcgc

SEQ ID NO: 3446657 - RNA, 13 nt, Pseudomonas aeruginosa PA01
ccucaggucggcg

SEQ ID NO: 3446658 - RNA, 16 nt, Pseudomonas aeruginosa PA01
ccucagucgugcaggu

SEQ ID NO: 3446659 - RNA, 18 nt, Pseudomonas aeruginosa PA01
ccucagucgugcaggugu

SEQ ID NO: 3446660 - RNA, 21 nt, Pseudomonas aeruginosa PA01
ccucagugagccccggcgucg

SEQ ID NO: 3446661 - RNA, 14 nt, Pseudomonas aeruginosa PA01
ccucagugcgggca

SEQ ID NO: 3446662 - RNA, 23 nt, Pseudomonas aeruginosa PA01
ccucagugcgggcaguccuggcg

SEQ ID NO: 3446663 - RNA, 19 nt, Pseudomonas aeruginosa PA01
ccucauagugcugcggcag

SEQ ID NO: 3446664 - RNA, 15 nt, Pseudomonas aeruginosa PA01
ccucaugcugcgcgg

SEQ ID NO: 3446665 - RNA, 18 nt, Pseudomonas aeruginosa PA01
ccucauggaaaccccggc

SEQ ID NO: 3446666 - RNA, 20 nt, Pseudomonas aeruginosa PA01
ccucauggaaaccccggccu

SEQ ID NO: 3446667 - RNA, 22 nt, Pseudomonas aeruginosa PA01
ccucauggaaaccccggccugg

SEQ ID NO: 3446668 - RNA, 14 nt, Pseudomonas aeruginosa PA01
ccucauggcuguag

SEQ ID NO: 3446669 - RNA, 16 nt, Pseudomonas aeruginosa PA01
ccucauucgcucugcg

SEQ ID NO: 3446670 - RNA, 14 nt, Pseudomonas aeruginosa PA01
ccuccacccgcgaa

SEQ ID NO: 3446671 - RNA, 15 nt, Pseudomonas aeruginosa PA01
ccuccacccgcgaag

SEQ ID NO: 3446672 - RNA, 13 nt, Pseudomonas aeruginosa PA01
ccuccaccuugcg

SEQ ID NO: 3446673 - RNA, 13 nt, Pseudomonas aeruginosa PA01
ccuccacggcggc

SEQ ID NO: 3446674 - RNA, 18 nt, Pseudomonas aeruginosa PA01
ccuccagagugcgcagca

SEQ ID NO: 3446675 - RNA, 20 nt, Pseudomonas aeruginosa PA01
ccuccagagugcgcagcagc

SEQ ID NO: 3446676 - RNA, 23 nt, Pseudomonas aeruginosa PA01
ccuccagagugcgcagcagcguc

SEQ ID NO: 3446677 - RNA, 13 nt, Pseudomonas aeruginosa PA01
ccuccagcaacgc

SEQ ID NO: 3446678 - RNA, 14 nt, Pseudomonas aeruginosa PA01
ccuccagcaacgcc

SEQ ID NO: 3446679 - RNA, 23 nt, Pseudomonas aeruginosa PA01
ccuccagcaacgccgcccccagc

SEQ ID NO: 3446680 - RNA, 16 nt, Pseudomonas aeruginosa PA01
ccuccagcaccgccug

SEQ ID NO: 3446681 - RNA, 15 nt, Pseudomonas aeruginosa PA01
ccuccagcaccggga

SEQ ID NO: 3446682 - RNA, 23 nt, Pseudomonas aeruginosa PA01
ccuccagcacuacgcccauggcg

SEQ ID NO: 3446683 - RNA, 15 nt, Pseudomonas aeruginosa PA01
ccuccagcaggaccu

SEQ ID NO: 3446684 - RNA, 19 nt, Pseudomonas aeruginosa PA01
ccuccagcaggaccuggcc

SEQ ID NO: 3446685 - RNA, 17 nt, Pseudomonas aeruginosa PA01
ccuccagcauccagcga

SEQ ID NO: 3446686 - RNA, 14 nt, Pseudomonas aeruginosa PA01
ccuccagccagcag

SEQ ID NO: 3446687 - RNA, 20 nt, Pseudomonas aeruginosa PA01
ccuccagccagcagcccggc

SEQ ID NO: 3446688 - RNA, 13 nt, Pseudomonas aeruginosa PA01
ccuccagccggcg

SEQ ID NO: 3446689 - RNA, 14 nt, Pseudomonas aeruginosa PA01
ccuccagccggcga

SEQ ID NO: 3446690 - RNA, 16 nt, Pseudomonas aeruginosa PA01
ccuccagccggcgacg

SEQ ID NO: 3446691 - RNA, 14 nt, Pseudomonas aeruginosa PA01
ccuccagcgccgcc

SEQ ID NO: 3446692 - RNA, 17 nt, Pseudomonas aeruginosa PA01
ccuccagcgccgccagg

SEQ ID NO: 3446693 - RNA, 15 nt, Pseudomonas aeruginosa PA01
ccuccagcgccucgc

SEQ ID NO: 3446694 - RNA, 13 nt, Pseudomonas aeruginosa PA01
ccuccagcgccug

SEQ ID NO: 3446695 - RNA, 11 nt, Pseudomonas aeruginosa PA01
ccuccagcggc

SEQ ID NO: 3446696 - RNA, 13 nt, Pseudomonas aeruginosa PA01
ccuccagcggcgg

SEQ ID NO: 3446697 - RNA, 12 nt, Pseudomonas aeruginosa PA01
ccuccagcggcu

SEQ ID NO: 3446698 - RNA, 22 nt, Pseudomonas aeruginosa PA01
ccuccagcgggccuucgccagc

SEQ ID NO: 3446699 - RNA, 15 nt, Pseudomonas aeruginosa PA01
ccuccagcugcgccu

SEQ ID NO: 3446700 - RNA, 14 nt, Pseudomonas aeruginosa PA01
ccuccaggaccagg

SEQ ID NO: 3446701 - RNA, 19 nt, Pseudomonas aeruginosa PA01
ccuccaggccgaagccgcc

SEQ ID NO: 3446702 - RNA, 20 nt, Pseudomonas aeruginosa PA01
ccuccaggccgaagccgccg

SEQ ID NO: 3446703 - RNA, 13 nt, Pseudomonas aeruginosa PA01
ccuccaggccgcc

SEQ ID NO: 3446704 - RNA, 14 nt, Pseudomonas aeruginosa PA01
ccuccaggccgccg

SEQ ID NO: 3446705 - RNA, 15 nt, Pseudomonas aeruginosa PA01
ccuccaggccgccgg

SEQ ID NO: 3446706 - RNA, 16 nt, Pseudomonas aeruginosa PA01
ccuccaggccgccggc

SEQ ID NO: 3446707 - RNA, 18 nt, Pseudomonas aeruginosa PA01
ccuccaggccgccggcga

SEQ ID NO: 3446708 - RNA, 21 nt, Pseudomonas aeruginosa PA01
ccuccaggccgccggcgaccg

SEQ ID NO: 3446709 - RNA, 19 nt, Pseudomonas aeruginosa PA01
ccuccaggcgcgccuggau

SEQ ID NO: 3446710 - RNA, 16 nt, Pseudomonas aeruginosa PA01
ccuccaggcucuucag

SEQ ID NO: 3446711 - RNA, 22 nt, Pseudomonas aeruginosa PA01
ccuccaggcucuucagcacgcg

SEQ ID NO: 3446712 - RNA, 15 nt, Pseudomonas aeruginosa PA01
ccuccagggucgccc

SEQ ID NO: 3446713 - RNA, 16 nt, Pseudomonas aeruginosa PA01
ccuccagggucgcccg

SEQ ID NO: 3446714 - RNA, 19 nt, Pseudomonas aeruginosa PA01
ccuccagguagaccuugcc

SEQ ID NO: 3446715 - RNA, 17 nt, Pseudomonas aeruginosa PA01
ccuccagguaggcgccc

SEQ ID NO: 3446716 - RNA, 15 nt, Pseudomonas aeruginosa PA01
ccuccaguuccucgc

SEQ ID NO: 3446717 - RNA, 21 nt, Pseudomonas aeruginosa PA01
ccuccaguuccugcuccuccg

SEQ ID NO: 3446718 - RNA, 19 nt, Pseudomonas aeruginosa PA01
ccuccaucagcgccuccau

SEQ ID NO: 3446719 - RNA, 15 nt, Pseudomonas aeruginosa PA01
ccuccaucgccucgc

SEQ ID NO: 3446720 - RNA, 20 nt, Pseudomonas aeruginosa PA01
ccuccauuagcgucgcgcgg

SEQ ID NO: 3446721 - RNA, 23 nt, Pseudomonas aeruginosa PA01
ccuccauuagcgucgcgcggcca

SEQ ID NO: 3446722 - RNA, 12 nt, Pseudomonas aeruginosa PA01
ccucccaccgcg

SEQ ID NO: 3446723 - RNA, 16 nt, Pseudomonas aeruginosa PA01
ccucccaccgcgcggc

SEQ ID NO: 3446724 - RNA, 18 nt, Pseudomonas aeruginosa PA01
ccucccagggucgccucg

SEQ ID NO: 3446725 - RNA, 16 nt, Pseudomonas aeruginosa PA01
ccuccccguccuggcg

SEQ ID NO: 3446726 - RNA, 17 nt, Pseudomonas aeruginosa PA01
ccuccccguccuggcgg

SEQ ID NO: 3446727 - RNA, 16 nt, Pseudomonas aeruginosa PA01
ccuccccuguggucag

SEQ ID NO: 3446728 - RNA, 13 nt, Pseudomonas aeruginosa PA01
ccucccgccgcgg

SEQ ID NO: 3446729 - RNA, 16 nt, Pseudomonas aeruginosa PA01
ccucccgccgcggcgu

SEQ ID NO: 3446730 - RNA, 12 nt, Pseudomonas aeruginosa PA01
ccucccgcgcca

SEQ ID NO: 3446731 - RNA, 14 nt, Pseudomonas aeruginosa PA01
ccucccgcgccagc

SEQ ID NO: 3446732 - RNA, 17 nt, Pseudomonas aeruginosa PA01
ccucccgcgccagcgcc

SEQ ID NO: 3446733 - RNA, 16 nt, Pseudomonas aeruginosa PA01
ccucccggcucgccga

SEQ ID NO: 3446734 - RNA, 15 nt, Pseudomonas aeruginosa PA01
ccucccugcccgcuc

SEQ ID NO: 3446735 - RNA, 17 nt, Pseudomonas aeruginosa PA01
ccucccugcccgcucgg

SEQ ID NO: 3446736 - RNA, 21 nt, Pseudomonas aeruginosa PA01
ccuccgacgccccccacucgc

SEQ ID NO: 3446737 - RNA, 14 nt, Pseudomonas aeruginosa PA01
ccuccgccagcccc

SEQ ID NO: 3446738 - RNA, 15 nt, Pseudomonas aeruginosa PA01
ccuccgccagcccca

SEQ ID NO: 3446739 - RNA, 21 nt, Pseudomonas aeruginosa PA01
ccuccgccagccccaggccgc

SEQ ID NO: 3446740 - RNA, 13 nt, Pseudomonas aeruginosa PA01
ccuccgccagcgu

SEQ ID NO: 3446741 - RNA, 16 nt, Pseudomonas aeruginosa PA01
ccuccgccagcguuuc

SEQ ID NO: 3446742 - RNA, 19 nt, Pseudomonas aeruginosa PA01
ccuccgccaggaccuccug

SEQ ID NO: 3446743 - RNA, 22 nt, Pseudomonas aeruginosa PA01
ccuccgccaggaccuccugcac

SEQ ID NO: 3446744 - RNA, 15 nt, Pseudomonas aeruginosa PA01
ccuccgccaggucga

SEQ ID NO: 3446745 - RNA, 20 nt, Pseudomonas aeruginosa PA01
ccuccgccaggucgaucccc

SEQ ID NO: 3446746 - RNA, 14 nt, Pseudomonas aeruginosa PA01
ccuccgcgcccagg

SEQ ID NO: 3446747 - RNA, 14 nt, Pseudomonas aeruginosa PA01
ccuccggacgccga

SEQ ID NO: 3446748 - RNA, 16 nt, Pseudomonas aeruginosa PA01
ccuccggacgccgaac

SEQ ID NO: 3446749 - RNA, 17 nt, Pseudomonas aeruginosa PA01
ccuccggacgccgaacg

SEQ ID NO: 3446750 - RNA, 14 nt, Pseudomonas aeruginosa PA01
ccucgcagccggcg

SEQ ID NO: 3446751 - RNA, 15 nt, Pseudomonas aeruginosa PA01
ccucgccaaccagga

SEQ ID NO: 3446752 - RNA, 16 nt, Pseudomonas aeruginosa PA01
ccucgccaaccaggaa

SEQ ID NO: 3446753 - RNA, 19 nt, Pseudomonas aeruginosa PA01
ccucgccaaccaggaaggc

SEQ ID NO: 3446754 - RNA, 16 nt, Pseudomonas aeruginosa PA01
ccucgccaagcuggcg

SEQ ID NO: 3446755 - RNA, 13 nt, Pseudomonas aeruginosa PA01
ccucgccaggcug

SEQ ID NO: 3446756 - RNA, 17 nt, Pseudomonas aeruginosa PA01
ccucgcccaggugcgcc

SEQ ID NO: 3446757 - RNA, 15 nt, Pseudomonas aeruginosa PA01
ccucgcccaucgcca

SEQ ID NO: 3446758 - RNA, 17 nt, Pseudomonas aeruginosa PA01
ccucgcccaucgccagg

SEQ ID NO: 3446759 - RNA, 15 nt, Pseudomonas aeruginosa PA01
ccucgccccgccggg

SEQ ID NO: 3446760 - RNA, 15 nt, Pseudomonas aeruginosa PA01
ccucgcccucauggc

SEQ ID NO: 3446761 - RNA, 16 nt, Pseudomonas aeruginosa PA01
ccucgcccucgaagcc

SEQ ID NO: 3446762 - RNA, 20 nt, Pseudomonas aeruginosa PA01
ccucgcccuugcugcccagu

SEQ ID NO: 3446763 - RNA, 15 nt, Pseudomonas aeruginosa PA01
ccucgccgaccgcca

SEQ ID NO: 3446764 - RNA, 17 nt, Pseudomonas aeruginosa PA01
ccucgccgagcauccag

SEQ ID NO: 3446765 - RNA, 14 nt, Pseudomonas aeruginosa PA01
ccucgccgaggcgg

SEQ ID NO: 3446766 - RNA, 14 nt, Pseudomonas aeruginosa PA01
ccucgccgaucucc

SEQ ID NO: 3446767 - RNA, 17 nt, Pseudomonas aeruginosa PA01
ccucgccgaucuccucc

SEQ ID NO: 3446768 - RNA, 20 nt, Pseudomonas aeruginosa PA01
ccucgccgaucuccuccgcc

SEQ ID NO: 3446769 - RNA, 22 nt, Pseudomonas aeruginosa PA01
ccucgccgaucuccuccgcccc

SEQ ID NO: 3446770 - RNA, 22 nt, Pseudomonas aeruginosa PA01
ccucgccgaugucguagccgcg

SEQ ID NO: 3446771 - RNA, 16 nt, Pseudomonas aeruginosa PA01
ccucgccgccgaccgg

SEQ ID NO: 3446772 - RNA, 13 nt, Pseudomonas aeruginosa PA01
ccucgccgcggca

SEQ ID NO: 3446773 - RNA, 22 nt, Pseudomonas aeruginosa PA01
ccucgccgcggcagaucccauc

SEQ ID NO: 3446774 - RNA, 12 nt, Pseudomonas aeruginosa PA01
ccucgccgcucc

SEQ ID NO: 3446775 - RNA, 15 nt, Pseudomonas aeruginosa PA01
ccucgccgcuccgcg

SEQ ID NO: 3446776 - RNA, 15 nt, Pseudomonas aeruginosa PA01
ccucgccgcugcugg

SEQ ID NO: 3446777 - RNA, 18 nt, Pseudomonas aeruginosa PA01
ccucgccgcuggcgcuga

SEQ ID NO: 3446778 - RNA, 23 nt, Pseudomonas aeruginosa PA01
ccucgccggucagguaggcaucg

SEQ ID NO: 3446779 - RNA, 22 nt, Pseudomonas aeruginosa PA01
ccucgccggucgcgcucaggcg

SEQ ID NO: 3446780 - RNA, 16 nt, Pseudomonas aeruginosa PA01
ccucgccguacagcag

SEQ ID NO: 3446781 - RNA, 20 nt, Pseudomonas aeruginosa PA01
ccucgccguuggcgaggacu

SEQ ID NO: 3446782 - RNA, 12 nt, Pseudomonas aeruginosa PA01
ccucgccucgcg

SEQ ID NO: 3446783 - RNA, 18 nt, Pseudomonas aeruginosa PA01
ccucgccucgcgccagag

SEQ ID NO: 3446784 - RNA, 15 nt, Pseudomonas aeruginosa PA01
ccucgccugcggcgc

SEQ ID NO: 3446785 - RNA, 17 nt, Pseudomonas aeruginosa PA01
ccucgcgcaacgccgac

SEQ ID NO: 3446786 - RNA, 18 nt, Pseudomonas aeruginosa PA01
ccucgcgcaacgccgacg

SEQ ID NO: 3446787 - RNA, 21 nt, Pseudomonas aeruginosa PA01
ccucgcgcaacgccgacggcg

SEQ ID NO: 3446788 - RNA, 15 nt, Pseudomonas aeruginosa PA01
ccucgcgcaccgcgg

SEQ ID NO: 3446789 - RNA, 18 nt, Pseudomonas aeruginosa PA01
ccucgcgcaccgcggcga

SEQ ID NO: 3446790 - RNA, 21 nt, Pseudomonas aeruginosa PA01
ccucgcgcaucuggcugcgcg

SEQ ID NO: 3446791 - RNA, 19 nt, Pseudomonas aeruginosa PA01
ccucgcgccagagaucgcc

SEQ ID NO: 3446792 - RNA, 23 nt, Pseudomonas aeruginosa PA01
ccucgcgccagagaucgcccagc

SEQ ID NO: 3446793 - RNA, 18 nt, Pseudomonas aeruginosa PA01
ccucgcgccgcgccagca

SEQ ID NO: 3446794 - RNA, 14 nt, Pseudomonas aeruginosa PA01
ccucgcgcguggcc

SEQ ID NO: 3446795 - RNA, 17 nt, Pseudomonas aeruginosa PA01
ccucgcgcguggccgcc

SEQ ID NO: 3446796 - RNA, 22 nt, Pseudomonas aeruginosa PA01
ccucgcgcguggccgccagggu

SEQ ID NO: 3446797 - RNA, 15 nt, Pseudomonas aeruginosa PA01
ccucgcgcugcccgg

SEQ ID NO: 3446798 - RNA, 16 nt, Pseudomonas aeruginosa PA01
ccucgcgcugcccggc

SEQ ID NO: 3446799 - RNA, 18 nt, Pseudomonas aeruginosa PA01
ccucgcgcugcccggcgc

SEQ ID NO: 3446800 - RNA, 15 nt, Pseudomonas aeruginosa PA01
ccucgcggaagucgg

SEQ ID NO: 3446801 - RNA, 20 nt, Pseudomonas aeruginosa PA01
ccucgcggaccucgggcagc

SEQ ID NO: 3446802 - RNA, 14 nt, Pseudomonas aeruginosa PA01
ccucgcggagcugg

SEQ ID NO: 3446803 - RNA, 16 nt, Pseudomonas aeruginosa PA01
ccucgcggaucugcuc

SEQ ID NO: 3446804 - RNA, 14 nt, Pseudomonas aeruginosa PA01
ccucgcggcggcag

SEQ ID NO: 3446805 - RNA, 15 nt, Pseudomonas aeruginosa PA01
ccucgcggcggcagg

SEQ ID NO: 3446806 - RNA, 22 nt, Pseudomonas aeruginosa PA01
ccucgcggcucaccgagaacca

SEQ ID NO: 3446807 - RNA, 20 nt, Pseudomonas aeruginosa PA01
ccucgcggguaucgauccag

SEQ ID NO: 3446808 - RNA, 16 nt, Pseudomonas aeruginosa PA01
ccucgcuagucuuccu

SEQ ID NO: 3446809 - RNA, 22 nt, Pseudomonas aeruginosa PA01
ccucgcuagucuuccugcacgc

SEQ ID NO: 3446810 - RNA, 18 nt, Pseudomonas aeruginosa PA01
ccucgcucugcgccgcgg

SEQ ID NO: 3446811 - RNA, 17 nt, Pseudomonas aeruginosa PA01
ccucgcugagcaggaac

SEQ ID NO: 3446812 - RNA, 18 nt, Pseudomonas aeruginosa PA01
ccucgcugaugugccgca

SEQ ID NO: 3446813 - RNA, 19 nt, Pseudomonas aeruginosa PA01
ccucggagaacagcagcgg

SEQ ID NO: 3446814 - RNA, 14 nt, Pseudomonas aeruginosa PA01
ccucggagucaggc

SEQ ID NO: 3446815 - RNA, 17 nt, Pseudomonas aeruginosa PA01
ccucggagucaggcucc

SEQ ID NO: 3446816 - RNA, 22 nt, Pseudomonas aeruginosa PA01
ccucggauaugccgcucagcgg

SEQ ID NO: 3446817 - RNA, 17 nt, Pseudomonas aeruginosa PA01
ccucggcacucagccag

SEQ ID NO: 3446818 - RNA, 18 nt, Pseudomonas aeruginosa PA01
ccucggcacucagccagc

SEQ ID NO: 3446819 - RNA, 19 nt, Pseudomonas aeruginosa PA01
ccucggcacucagccagcg

SEQ ID NO: 3446820 - RNA, 17 nt, Pseudomonas aeruginosa PA01
ccucggcagcgcuggcg

SEQ ID NO: 3446821 - RNA, 23 nt, Pseudomonas aeruginosa PA01
ccucggcagcgcuggcgaucacc

SEQ ID NO: 3446822 - RNA, 15 nt, Pseudomonas aeruginosa PA01
ccucggcagggcgcc

SEQ ID NO: 3446823 - RNA, 18 nt, Pseudomonas aeruginosa PA01
ccucggcagggcgcccgc

SEQ ID NO: 3446824 - RNA, 20 nt, Pseudomonas aeruginosa PA01
ccucggcauccucgccccgc

SEQ ID NO: 3446825 - RNA, 16 nt, Pseudomonas aeruginosa PA01
ccucggcaucgaccag

SEQ ID NO: 3446826 - RNA, 18 nt, Pseudomonas aeruginosa PA01
ccucggcaucgaccaggg

SEQ ID NO: 3446827 - RNA, 23 nt, Pseudomonas aeruginosa PA01
ccucggcaucgaccagggccggg

SEQ ID NO: 3446828 - RNA, 15 nt, Pseudomonas aeruginosa PA01
ccucggccagccagg

SEQ ID NO: 3446829 - RNA, 17 nt, Pseudomonas aeruginosa PA01
ccucggccagccagggc

SEQ ID NO: 3446830 - RNA, 15 nt, Pseudomonas aeruginosa PA01
ccucggccagcgccg

SEQ ID NO: 3446831 - RNA, 16 nt, Pseudomonas aeruginosa PA01
ccucggccagcgccgc

SEQ ID NO: 3446832 - RNA, 20 nt, Pseudomonas aeruginosa PA01
ccucggccagcgccgccgcu

SEQ ID NO: 3446833 - RNA, 13 nt, Pseudomonas aeruginosa PA01
ccucggccaggca

SEQ ID NO: 3446834 - RNA, 13 nt, Pseudomonas aeruginosa PA01
ccucggccaggcg

SEQ ID NO: 3446835 - RNA, 14 nt, Pseudomonas aeruginosa PA01
ccucggccaggcgg

SEQ ID NO: 3446836 - RNA, 18 nt, Pseudomonas aeruginosa PA01
ccucggccauaccuccag

SEQ ID NO: 3446837 - RNA, 16 nt, Pseudomonas aeruginosa PA01
ccucggccaugccggc

SEQ ID NO: 3446838 - RNA, 18 nt, Pseudomonas aeruginosa PA01
ccucggccaugccggcca

SEQ ID NO: 3446839 - RNA, 19 nt, Pseudomonas aeruginosa PA01
ccucggccaugccggccag

SEQ ID NO: 3446840 - RNA, 21 nt, Pseudomonas aeruginosa PA01
ccucggcccggagccaacgcc

SEQ ID NO: 3446841 - RNA, 16 nt, Pseudomonas aeruginosa PA01
ccucggcccuggcggc

SEQ ID NO: 3446842 - RNA, 13 nt, Pseudomonas aeruginosa PA01
ccucggccgacag

SEQ ID NO: 3446843 - RNA, 12 nt, Pseudomonas aeruginosa PA01
ccucggccgcca

SEQ ID NO: 3446844 - RNA, 13 nt, Pseudomonas aeruginosa PA01
ccucggccgccag

SEQ ID NO: 3446845 - RNA, 15 nt, Pseudomonas aeruginosa PA01
ccucggccgccaggc

SEQ ID NO: 3446846 - RNA, 16 nt, Pseudomonas aeruginosa PA01
ccucggccgccaggcg

SEQ ID NO: 3446847 - RNA, 17 nt, Pseudomonas aeruginosa PA01
ccucggccgccaggcgc

SEQ ID NO: 3446848 - RNA, 16 nt, Pseudomonas aeruginosa PA01
ccucggccugggcgca

SEQ ID NO: 3446849 - RNA, 18 nt, Pseudomonas aeruginosa PA01
ccucggccugggcgcagg

SEQ ID NO: 3446850 - RNA, 19 nt, Pseudomonas aeruginosa PA01
ccucggccugggcgcaggc

SEQ ID NO: 3446851 - RNA, 18 nt, Pseudomonas aeruginosa PA01
ccucggccuugcuggcga

SEQ ID NO: 3446852 - RNA, 17 nt, Pseudomonas aeruginosa PA01
ccucggcgaagucgccg

SEQ ID NO: 3446853 - RNA, 22 nt, Pseudomonas aeruginosa PA01
ccugcccagugggccaccggcu

SEQ ID NO: 3446854 - RNA, 17 nt, Pseudomonas aeruginosa PA01
ccugccccagcaucgcc

SEQ ID NO: 3446855 - RNA, 16 nt, Pseudomonas aeruginosa PA01
ccugccccgugcaccg

SEQ ID NO: 3446856 - RNA, 20 nt, Pseudomonas aeruginosa PA01
ccugccccgugcaccgaggc

SEQ ID NO: 3446857 - RNA, 22 nt, Pseudomonas aeruginosa PA01
ccugccccgugcaccgaggcgc

SEQ ID NO: 3446858 - RNA, 15 nt, Pseudomonas aeruginosa PA01
ccugccccuucggcu

SEQ ID NO: 3446859 - RNA, 16 nt, Pseudomonas aeruginosa PA01
ccugcccgcgccucgc

SEQ ID NO: 3446860 - RNA, 19 nt, Pseudomonas aeruginosa PA01
ccugcccguaccacgucca

SEQ ID NO: 3446861 - RNA, 13 nt, Pseudomonas aeruginosa PA01
ccugcccuccugc

SEQ ID NO: 3446862 - RNA, 15 nt, Pseudomonas aeruginosa PA01
ccugccgaucgccgc

SEQ ID NO: 3446863 - RNA, 16 nt, Pseudomonas aeruginosa PA01
ccugccgaucgccgcg

SEQ ID NO: 3446864 - RNA, 13 nt, Pseudomonas aeruginosa PA01
ccugccgcaggcg

SEQ ID NO: 3446865 - RNA, 14 nt, Pseudomonas aeruginosa PA01
ccugccgcaggcgg

SEQ ID NO: 3446866 - RNA, 13 nt, Pseudomonas aeruginosa PA01
ccugccgcccggc

SEQ ID NO: 3446867 - RNA, 14 nt, Pseudomonas aeruginosa PA01
ccugccgcccuucg

SEQ ID NO: 3446868 - RNA, 14 nt, Pseudomonas aeruginosa PA01
ccugccgcgccgga

SEQ ID NO: 3446869 - RNA, 15 nt, Pseudomonas aeruginosa PA01
ccugccgcgccggau

SEQ ID NO: 3446870 - RNA, 14 nt, Pseudomonas aeruginosa PA01
ccugccggcacgcu

SEQ ID NO: 3446871 - RNA, 14 nt, Pseudomonas aeruginosa PA01
ccugccggcgcaga

SEQ ID NO: 3446872 - RNA, 22 nt, Pseudomonas aeruginosa PA01
ccugccggcgcagaucgcggcg

SEQ ID NO: 3446873 - RNA, 12 nt, Pseudomonas aeruginosa PA01
ccugccggcggu

SEQ ID NO: 3446874 - RNA, 19 nt, Pseudomonas aeruginosa PA01
ccugccgggcaagcucgac

SEQ ID NO: 3446875 - RNA, 15 nt, Pseudomonas aeruginosa PA01
ccugccgggcucuuc

SEQ ID NO: 3446876 - RNA, 16 nt, Pseudomonas aeruginosa PA01
ccugccggugcucggc

SEQ ID NO: 3446877 - RNA, 18 nt, Pseudomonas aeruginosa PA01
ccugccggugcucggccu

SEQ ID NO: 3446878 - RNA, 19 nt, Pseudomonas aeruginosa PA01
ccugccggugcucggccug

SEQ ID NO: 3446879 - RNA, 20 nt, Pseudomonas aeruginosa PA01
ccugccggugcucggccuga

SEQ ID NO: 3446880 - RNA, 18 nt, Pseudomonas aeruginosa PA01
ccugccguauccgcggca

SEQ ID NO: 3446881 - RNA, 22 nt, Pseudomonas aeruginosa PA01
ccugccgucacuugaaguccca

SEQ ID NO: 3446882 - RNA, 21 nt, Pseudomonas aeruginosa PA01
ccugccguucgucaccggcgc

SEQ ID NO: 3446883 - RNA, 22 nt, Pseudomonas aeruginosa PA01
ccugccuuccuugaccacggcg

SEQ ID NO: 3446884 - RNA, 21 nt, Pseudomonas aeruginosa PA01
ccugcgaauugcgcuggaagu

SEQ ID NO: 3446885 - RNA, 21 nt, Pseudomonas aeruginosa PA01
ccugcgaccgugaggcgcagg

SEQ ID NO: 3446886 - RNA, 22 nt, Pseudomonas aeruginosa PA01
ccugcgcaaggaacuggaagcc

SEQ ID NO: 3446887 - RNA, 23 nt, Pseudomonas aeruginosa PA01
ccugcgcaaggaacuggaagccu

SEQ ID NO: 3446888 - RNA, 17 nt, Pseudomonas aeruginosa PA01
ccugcgccagcaucgca

SEQ ID NO: 3446889 - RNA, 22 nt, Pseudomonas aeruginosa PA01
ccugcgccagcaucgcaucggc

SEQ ID NO: 3446890 - RNA, 22 nt, Pseudomonas aeruginosa PA01
ccugcgcccucaagucuccagc

SEQ ID NO: 3446891 - RNA, 14 nt, Pseudomonas aeruginosa PA01
ccugcgccgcagcg

SEQ ID NO: 3446892 - RNA, 15 nt, Pseudomonas aeruginosa PA01
ccugcgccgcagcgg

SEQ ID NO: 3446893 - RNA, 18 nt, Pseudomonas aeruginosa PA01
ccugcgccgcagcggcca

SEQ ID NO: 3446894 - RNA, 22 nt, Pseudomonas aeruginosa PA01
ccugcgccggaccagaucggcg

SEQ ID NO: 3446895 - RNA, 22 nt, Pseudomonas aeruginosa PA01
ccugcgccucacggucgcaggg

SEQ ID NO: 3446896 - RNA, 19 nt, Pseudomonas aeruginosa PA01
ccugcgccucgaccuggcc

SEQ ID NO: 3446897 - RNA, 12 nt, Pseudomonas aeruginosa PA01
ccugcgccucgg

SEQ ID NO: 3446898 - RNA, 23 nt, Pseudomonas aeruginosa PA01
ccugcgccucggcccuggcggcg

SEQ ID NO: 3446899 - RNA, 17 nt, Pseudomonas aeruginosa PA01
ccugcgcgaucccccgc

SEQ ID NO: 3446900 - RNA, 21 nt, Pseudomonas aeruginosa PA01
ccugcgcgcaccaggccuccc

SEQ ID NO: 3446901 - RNA, 14 nt, Pseudomonas aeruginosa PA01
ccugcgcuuccggc

SEQ ID NO: 3446902 - RNA, 21 nt, Pseudomonas aeruginosa PA01
ccugcgcuuccggcagccagc

SEQ ID NO: 3446903 - RNA, 22 nt, Pseudomonas aeruginosa PA01
ccugcgcuucguuggcgacgac

SEQ ID NO: 3446904 - RNA, 16 nt, Pseudomonas aeruginosa PA01
ccugcggaccgcagaa

SEQ ID NO: 3446905 - RNA, 18 nt, Pseudomonas aeruginosa PA01
ccugcggauagccaacca

SEQ ID NO: 3446906 - RNA, 19 nt, Pseudomonas aeruginosa PA01
ccugcggauagccaaccag

SEQ ID NO: 3446907 - RNA, 14 nt, Pseudomonas aeruginosa PA01
ccugcggaucgagg

SEQ ID NO: 3446908 - RNA, 16 nt, Pseudomonas aeruginosa PA01
ccugcggauggcgcgg

SEQ ID NO: 3446909 - RNA, 19 nt, Pseudomonas aeruginosa PA01
ccugcggauucaucggcgg

SEQ ID NO: 3446910 - RNA, 20 nt, Pseudomonas aeruginosa PA01
ccugcggauucaucggcggc

SEQ ID NO: 3446911 - RNA, 21 nt, Pseudomonas aeruginosa PA01
ccugcggauucaucggcggca

SEQ ID NO: 3446912 - RNA, 15 nt, Pseudomonas aeruginosa PA01
ccugcggccgcaacc

SEQ ID NO: 3446913 - RNA, 18 nt, Pseudomonas aeruginosa PA01
ccugcggccgcaaccagc

SEQ ID NO: 3446914 - RNA, 18 nt, Pseudomonas aeruginosa PA01
ccugcggccguucgcccu

SEQ ID NO: 3446915 - RNA, 20 nt, Pseudomonas aeruginosa PA01
ccugcggccguucgcccuuc

SEQ ID NO: 3446916 - RNA, 12 nt, Pseudomonas aeruginosa PA01
ccugcggcgaga

SEQ ID NO: 3446917 - RNA, 13 nt, Pseudomonas aeruginosa PA01
ccugcggcgagaa

SEQ ID NO: 3446918 - RNA, 22 nt, Pseudomonas aeruginosa PA01
ccugcggcgccuagacccuggg

SEQ ID NO: 3446919 - RNA, 13 nt, Pseudomonas aeruginosa PA01
ccugcggcuggcg

SEQ ID NO: 3446920 - RNA, 23 nt, Pseudomonas aeruginosa PA01
ccugcggcuggcgaaccagucca

SEQ ID NO: 3446921 - RNA, 14 nt, Pseudomonas aeruginosa PA01
ccugcggcuugccc

SEQ ID NO: 3446922 - RNA, 15 nt, Pseudomonas aeruginosa PA01
ccugcggcuugcccu

SEQ ID NO: 3446923 - RNA, 20 nt, Pseudomonas aeruginosa PA01
ccugcgggacccagacaggc

SEQ ID NO: 3446924 - RNA, 18 nt, Pseudomonas aeruginosa PA01
ccugcgggcugcgugcca

SEQ ID NO: 3446925 - RNA, 18 nt, Pseudomonas aeruginosa PA01
ccugcggguuggucggca

SEQ ID NO: 3446926 - RNA, 15 nt, Pseudomonas aeruginosa PA01
ccugcgucagcgagg

SEQ ID NO: 3446927 - RNA, 13 nt, Pseudomonas aeruginosa PA01
ccugcgucgcaga

SEQ ID NO: 3446928 - RNA, 18 nt, Pseudomonas aeruginosa PA01
ccugcgucgcauccacca

SEQ ID NO: 3446929 - RNA, 20 nt, Pseudomonas aeruginosa PA01
ccugcgucgcauccaccagc

SEQ ID NO: 3446930 - RNA, 19 nt, Pseudomonas aeruginosa PA01
ccugcgugagcugggcagg

SEQ ID NO: 3446931 - RNA, 18 nt, Pseudomonas aeruginosa PA01
ccugcguggaaccgcggc

SEQ ID NO: 3446932 - RNA, 21 nt, Pseudomonas aeruginosa PA01
ccugcguggaaccgcggcgcc

SEQ ID NO: 3446933 - RNA, 21 nt, Pseudomonas aeruginosa PA01
ccugcguggcgaacgcccggc

SEQ ID NO: 3446934 - RNA, 23 nt, Pseudomonas aeruginosa PA01
ccugcguggcgaacgcccggcuu

SEQ ID NO: 3446935 - RNA, 17 nt, Pseudomonas aeruginosa PA01
ccugcguuucgccgggc

SEQ ID NO: 3446936 - RNA, 18 nt, Pseudomonas aeruginosa PA01
ccugcucagcggcccagc

SEQ ID NO: 3446937 - RNA, 20 nt, Pseudomonas aeruginosa PA01
ccugcucagcggcccagcgc

SEQ ID NO: 3446938 - RNA, 22 nt, Pseudomonas aeruginosa PA01
ccugcucagcggcccagcgccc

SEQ ID NO: 3446939 - RNA, 12 nt, Pseudomonas aeruginosa PA01
ccugcuccagca

SEQ ID NO: 3446940 - RNA, 14 nt, Pseudomonas aeruginosa PA01
ccugcuccagcagg

SEQ ID NO: 3446941 - RNA, 15 nt, Pseudomonas aeruginosa PA01
ccugcuccagcaggg

SEQ ID NO: 3446942 - RNA, 18 nt, Pseudomonas aeruginosa PA01
ccugcuccagcagggcca

SEQ ID NO: 3446943 - RNA, 22 nt, Pseudomonas aeruginosa PA01
ccugcuccagcagggccagcgc

SEQ ID NO: 3446944 - RNA, 24 nt, Pseudomonas aeruginosa PA01
ccugcuccagcagggccagcgccu

SEQ ID NO: 3446945 - RNA, 14 nt, Pseudomonas aeruginosa PA01
ccugcuccagcgga

SEQ ID NO: 3446946 - RNA, 16 nt, Pseudomonas aeruginosa PA01
ccugcuccagcggagc

SEQ ID NO: 3446947 - RNA, 15 nt, Pseudomonas aeruginosa PA01
ccugcucccuggcgg

SEQ ID NO: 3446948 - RNA, 16 nt, Pseudomonas aeruginosa PA01
ccugcucccuggcgga

SEQ ID NO: 3446949 - RNA, 18 nt, Pseudomonas aeruginosa PA01
ccugcucccuggcggaua

SEQ ID NO: 3446950 - RNA, 13 nt, Pseudomonas aeruginosa PA01
ccugcuccucggc

SEQ ID NO: 3446951 - RNA, 16 nt, Pseudomonas aeruginosa PA01
ccugcuccucggcagc

SEQ ID NO: 3446952 - RNA, 17 nt, Pseudomonas aeruginosa PA01
ccugcuccucggcagcg

SEQ ID NO: 3446953 - RNA, 12 nt, Pseudomonas aeruginosa PA01
ccugcucgaacg

SEQ ID NO: 3446954 - RNA, 23 nt, Pseudomonas aeruginosa PA01
ccugcucgaacggcggaucgauc

SEQ ID NO: 3446955 - RNA, 22 nt, Pseudomonas aeruginosa PA01
ccuggagguagcugcgccgccu

SEQ ID NO: 3446956 - RNA, 15 nt, Pseudomonas aeruginosa PA01
ccuggauaagccgcg

SEQ ID NO: 3446957 - RNA, 15 nt, Pseudomonas aeruginosa PA01
ccuggauacgcucgg

SEQ ID NO: 3446958 - RNA, 16 nt, Pseudomonas aeruginosa PA01
ccuggauacgcucggc

SEQ ID NO: 3446959 - RNA, 18 nt, Pseudomonas aeruginosa PA01
ccuggauacgcucggcca

SEQ ID NO: 3446960 - RNA, 15 nt, Pseudomonas aeruginosa PA01
ccuggauacgggcgc

SEQ ID NO: 3446961 - RNA, 20 nt, Pseudomonas aeruginosa PA01
ccuggauaucugggccaucg

SEQ ID NO: 3446962 - RNA, 15 nt, Pseudomonas aeruginosa PA01
ccuggaucaccgcgg

SEQ ID NO: 3446963 - RNA, 18 nt, Pseudomonas aeruginosa PA01
ccuggaucaccgcggcgc

SEQ ID NO: 3446964 - RNA, 19 nt, Pseudomonas aeruginosa PA01
ccuggaucaccgcggcgcu

SEQ ID NO: 3446965 - RNA, 16 nt, Pseudomonas aeruginosa PA01
ccuggaucacgcugag

SEQ ID NO: 3446966 - RNA, 18 nt, Pseudomonas aeruginosa PA01
ccuggaucgccaggcuga

SEQ ID NO: 3446967 - RNA, 19 nt, Pseudomonas aeruginosa PA01
ccuggaucgccaggcugau

SEQ ID NO: 3446968 - RNA, 13 nt, Pseudomonas aeruginosa PA01
ccuggaucgccuu

SEQ ID NO: 3446969 - RNA, 12 nt, Pseudomonas aeruginosa PA01
ccuggaucggca

SEQ ID NO: 3446970 - RNA, 14 nt, Pseudomonas aeruginosa PA01
ccuggaucggcagc

SEQ ID NO: 3446971 - RNA, 15 nt, Pseudomonas aeruginosa PA01
ccuggaucggcagcu

SEQ ID NO: 3446972 - RNA, 18 nt, Pseudomonas aeruginosa PA01
ccuggaucggcagcucgc

SEQ ID NO: 3446973 - RNA, 15 nt, Pseudomonas aeruginosa PA01
ccuggaucuccuggg

SEQ ID NO: 3446974 - RNA, 15 nt, Pseudomonas aeruginosa PA01
ccuggaucucggcgg

SEQ ID NO: 3446975 - RNA, 23 nt, Pseudomonas aeruginosa PA01
ccuggaucucggcggccaggcgg

SEQ ID NO: 3446976 - RNA, 21 nt, Pseudomonas aeruginosa PA01
ccuggaugaucgcgugggcca

SEQ ID NO: 3446977 - RNA, 18 nt, Pseudomonas aeruginosa PA01
ccuggaugaucucgcagu

SEQ ID NO: 3446978 - RNA, 18 nt, Pseudomonas aeruginosa PA01
ccuggaugcuccgcgccu

SEQ ID NO: 3446979 - RNA, 19 nt, Pseudomonas aeruginosa PA01
ccuggaugucgaagcgcag

SEQ ID NO: 3446980 - RNA, 23 nt, Pseudomonas aeruginosa PA01
ccuggcaacaaggcauucaccag

SEQ ID NO: 3446981 - RNA, 17 nt, Pseudomonas aeruginosa PA01
ccuggcagacgcugcuc

SEQ ID NO: 3446982 - RNA, 22 nt, Pseudomonas aeruginosa PA01
ccuggcagguaucgcugggcgc

SEQ ID NO: 3446983 - RNA, 23 nt, Pseudomonas aeruginosa PA01
ccuggcagguaucgcugggcgcc

SEQ ID NO: 3446984 - RNA, 15 nt, Pseudomonas aeruginosa PA01
ccuggcagguccgac

SEQ ID NO: 3446985 - RNA, 23 nt, Pseudomonas aeruginosa PA01
ccuggcagugcgccggcaucgcc

SEQ ID NO: 3446986 - RNA, 23 nt, Pseudomonas aeruginosa PA01
ccuggcauggcuuuccaggcgcc

SEQ ID NO: 3446987 - RNA, 16 nt, Pseudomonas aeruginosa PA01
ccuggccacguccagc

SEQ ID NO: 3446988 - RNA, 18 nt, Pseudomonas aeruginosa PA01
ccuggccaggcgcuccuc

SEQ ID NO: 3446989 - RNA, 16 nt, Pseudomonas aeruginosa PA01
ccuggcccucggugcg

SEQ ID NO: 3446990 - RNA, 18 nt, Pseudomonas aeruginosa PA01
ccuggcccugcaucgcga

SEQ ID NO: 3446991 - RNA, 22 nt, Pseudomonas aeruginosa PA01
ccuggcccuggauaucugggcc

SEQ ID NO: 3446992 - RNA, 23 nt, Pseudomonas aeruginosa PA01
ccuggcccuggauaucugggcca

SEQ ID NO: 3446993 - RNA, 12 nt, Pseudomonas aeruginosa PA01
ccuggccgaccc

SEQ ID NO: 3446994 - RNA, 18 nt, Pseudomonas aeruginosa PA01
ccuggccgacccgcagcg

SEQ ID NO: 3446995 - RNA, 23 nt, Pseudomonas aeruginosa PA01
ccuggccgacccgcagcggcgcu

SEQ ID NO: 3446996 - RNA, 22 nt, Pseudomonas aeruginosa PA01
ccuggccgacgcugaggaucac

SEQ ID NO: 3446997 - RNA, 17 nt, Pseudomonas aeruginosa PA01
ccuggccgagcaucagc

SEQ ID NO: 3446998 - RNA, 13 nt, Pseudomonas aeruginosa PA01
ccuggccgagcgg

SEQ ID NO: 3446999 - RNA, 18 nt, Pseudomonas aeruginosa PA01
ccuggccgagcgggaagc

SEQ ID NO: 3447000 - RNA, 23 nt, Pseudomonas aeruginosa PA01
ccuggccgaucagcuuggccuug

SEQ ID NO: 3447001 - RNA, 11 nt, Pseudomonas aeruginosa PA01
ccuggccgcca

SEQ ID NO: 3447002 - RNA, 12 nt, Pseudomonas aeruginosa PA01
ccuggccgccgu

SEQ ID NO: 3447003 - RNA, 13 nt, Pseudomonas aeruginosa PA01
ccuggccgcgcag

SEQ ID NO: 3447004 - RNA, 16 nt, Pseudomonas aeruginosa PA01
ccuggccgcgcaggac

SEQ ID NO: 3447005 - RNA, 12 nt, Pseudomonas aeruginosa PA01
ccuggccgcgcg

SEQ ID NO: 3447006 - RNA, 15 nt, Pseudomonas aeruginosa PA01
ccuggccgcgcggcu

SEQ ID NO: 3447007 - RNA, 16 nt, Pseudomonas aeruginosa PA01
ccuggccgcgcggcuu

SEQ ID NO: 3447008 - RNA, 21 nt, Pseudomonas aeruginosa PA01
ccuggccgcgcggcuugccgg

SEQ ID NO: 3447009 - RNA, 18 nt, Pseudomonas aeruginosa PA01
ccuggccgcugccgcucu

SEQ ID NO: 3447010 - RNA, 13 nt, Pseudomonas aeruginosa PA01
ccuggccggccuc

SEQ ID NO: 3447011 - RNA, 14 nt, Pseudomonas aeruginosa PA01
ccuggccggccucg

SEQ ID NO: 3447012 - RNA, 12 nt, Pseudomonas aeruginosa PA01
ccuggccggcga

SEQ ID NO: 3447013 - RNA, 16 nt, Pseudomonas aeruginosa PA01
ccuggccggcgaaccg

SEQ ID NO: 3447014 - RNA, 23 nt, Pseudomonas aeruginosa PA01
ccuggccggcgaccuuguccagg

SEQ ID NO: 3447015 - RNA, 22 nt, Pseudomonas aeruginosa PA01
ccuggccggcgauggccgccug

SEQ ID NO: 3447016 - RNA, 13 nt, Pseudomonas aeruginosa PA01
ccuggccggcggc

SEQ ID NO: 3447017 - RNA, 19 nt, Pseudomonas aeruginosa PA01
ccuggccggucguucgccc

SEQ ID NO: 3447018 - RNA, 22 nt, Pseudomonas aeruginosa PA01
ccuggccggucguucgcccuuc

SEQ ID NO: 3447019 - RNA, 17 nt, Pseudomonas aeruginosa PA01
ccuggccgugcucgaug

SEQ ID NO: 3447020 - RNA, 20 nt, Pseudomonas aeruginosa PA01
ccuggccguugaccagcgcg

SEQ ID NO: 3447021 - RNA, 18 nt, Pseudomonas aeruginosa PA01
ccuggccguugcgcaggc

SEQ ID NO: 3447022 - RNA, 15 nt, Pseudomonas aeruginosa PA01
ccuggccguuggcga

SEQ ID NO: 3447023 - RNA, 15 nt, Pseudomonas aeruginosa PA01
ccuggccuuggccac

SEQ ID NO: 3447024 - RNA, 19 nt, Pseudomonas aeruginosa PA01
ccuggccuuggccacgacc

SEQ ID NO: 3447025 - RNA, 21 nt, Pseudomonas aeruginosa PA01
ccuggcgacgucccuuccccg

SEQ ID NO: 3447026 - RNA, 16 nt, Pseudomonas aeruginosa PA01
ccuggcgaucaggcca

SEQ ID NO: 3447027 - RNA, 17 nt, Pseudomonas aeruginosa PA01
ccuggcgaucaggccaa

SEQ ID NO: 3447028 - RNA, 17 nt, Pseudomonas aeruginosa PA01
ccuggcgaugcccuggc

SEQ ID NO: 3447029 - RNA, 20 nt, Pseudomonas aeruginosa PA01
ccuggcgaugcccuggccgc

SEQ ID NO: 3447030 - RNA, 21 nt, Pseudomonas aeruginosa PA01
ccuggcgaugcccuggccgcu

SEQ ID NO: 3447031 - RNA, 23 nt, Pseudomonas aeruginosa PA01
ccuggcgaugcccuggccgcugc

SEQ ID NO: 3447032 - RNA, 17 nt, Pseudomonas aeruginosa PA01
ccuggcgcaacgccggc

SEQ ID NO: 3447033 - RNA, 13 nt, Pseudomonas aeruginosa PA01
ccuggcgcacggc

SEQ ID NO: 3447034 - RNA, 14 nt, Pseudomonas aeruginosa PA01
ccuggcgcagcggc

SEQ ID NO: 3447035 - RNA, 15 nt, Pseudomonas aeruginosa PA01
ccuggcgcagcggca

SEQ ID NO: 3447036 - RNA, 18 nt, Pseudomonas aeruginosa PA01
ccuggcgcagcggcagcg

SEQ ID NO: 3447037 - RNA, 20 nt, Pseudomonas aeruginosa PA01
ccuggcgcagcggcagcgcc

SEQ ID NO: 3447038 - RNA, 22 nt, Pseudomonas aeruginosa PA01
ccuggcgcagcggcagcgccag

SEQ ID NO: 3447039 - RNA, 16 nt, Pseudomonas aeruginosa PA01
ccuggcgcaggcggcg

SEQ ID NO: 3447040 - RNA, 18 nt, Pseudomonas aeruginosa PA01
ccuggcgcaggcggcgcu

SEQ ID NO: 3447041 - RNA, 13 nt, Pseudomonas aeruginosa PA01
ccuggcgcaggua

SEQ ID NO: 3447042 - RNA, 14 nt, Pseudomonas aeruginosa PA01
ccuggcgcagguag

SEQ ID NO: 3447043 - RNA, 21 nt, Pseudomonas aeruginosa PA01
ccuggcgcagguagaaggugc

SEQ ID NO: 3447044 - RNA, 20 nt, Pseudomonas aeruginosa PA01
ccuggcgcauggcgcucuuc

SEQ ID NO: 3447045 - RNA, 22 nt, Pseudomonas aeruginosa PA01
ccuggcgccagcguugcagguc

SEQ ID NO: 3447046 - RNA, 13 nt, Pseudomonas aeruginosa PA01
ccuggcgccgacc

SEQ ID NO: 3447047 - RNA, 20 nt, Pseudomonas aeruginosa PA01
ccuggcgcgacgaggcgcgg

SEQ ID NO: 3447048 - RNA, 22 nt, Pseudomonas aeruginosa PA01
ccuggcgcgacgaggcgcggcg

SEQ ID NO: 3447049 - RNA, 19 nt, Pseudomonas aeruginosa PA01
ccuggcgcgagaagccagc

SEQ ID NO: 3447050 - RNA, 23 nt, Pseudomonas aeruginosa PA01
ccuggcgcgagaagccagccagg

SEQ ID NO: 3447051 - RNA, 20 nt, Pseudomonas aeruginosa PA01
ccuggcgcgcgcgccagguc

SEQ ID NO: 3447052 - RNA, 18 nt, Pseudomonas aeruginosa PA01
ccuggcgcgcggccgcgu

SEQ ID NO: 3447053 - RNA, 18 nt, Pseudomonas aeruginosa PA01
ccuggcgcgcugcggcag

SEQ ID NO: 3447054 - RNA, 17 nt, Pseudomonas aeruginosa PA01
ccuggcgcguacgcccg

SEQ ID NO: 3447055 - RNA, 18 nt, Pseudomonas aeruginosa PA01
ccuggcgcguacgcccgc

SEQ ID NO: 3447056 - RNA, 20 nt, Pseudomonas aeruginosa PA01
ccuggcgcguacgcccgcag

SEQ ID NO: 3447057 - RNA, 18 nt, Pseudomonas aeruginosa PA01
ccuggguugccgcgccga

SEQ ID NO: 3447058 - RNA, 19 nt, Pseudomonas aeruginosa PA01
ccuggguugccgcgccgau

SEQ ID NO: 3447059 - RNA, 15 nt, Pseudomonas aeruginosa PA01
ccugguacagcaccc

SEQ ID NO: 3447060 - RNA, 19 nt, Pseudomonas aeruginosa PA01
ccugguacagcacccaggc

SEQ ID NO: 3447061 - RNA, 16 nt, Pseudomonas aeruginosa PA01
ccugguacagcgccug

SEQ ID NO: 3447062 - RNA, 23 nt, Pseudomonas aeruginosa PA01
ccugguacucguccucccagugc

SEQ ID NO: 3447063 - RNA, 22 nt, Pseudomonas aeruginosa PA01
ccugguagaaacgcuugagcug

SEQ ID NO: 3447064 - RNA, 17 nt, Pseudomonas aeruginosa PA01
ccugguagcagaggguc

SEQ ID NO: 3447065 - RNA, 18 nt, Pseudomonas aeruginosa PA01
ccugguaggcggcgacga

SEQ ID NO: 3447066 - RNA, 19 nt, Pseudomonas aeruginosa PA01
ccugguaggugcgcuggcg

SEQ ID NO: 3447067 - RNA, 22 nt, Pseudomonas aeruginosa PA01
ccugguaggugcgcuggcgcca

SEQ ID NO: 3447068 - RNA, 17 nt, Pseudomonas aeruginosa PA01
ccuggucauccuggccc

SEQ ID NO: 3447069 - RNA, 18 nt, Pseudomonas aeruginosa PA01
ccuggucauccuggcccu

SEQ ID NO: 3447070 - RNA, 22 nt, Pseudomonas aeruginosa PA01
ccugguccaaccgggcaucgcc

SEQ ID NO: 3447071 - RNA, 23 nt, Pseudomonas aeruginosa PA01
ccugguccaaccgggcaucgccg

SEQ ID NO: 3447072 - RNA, 18 nt, Pseudomonas aeruginosa PA01
ccugguccagccagccgc

SEQ ID NO: 3447073 - RNA, 20 nt, Pseudomonas aeruginosa PA01
ccugguccgucucgucgagc

SEQ ID NO: 3447074 - RNA, 20 nt, Pseudomonas aeruginosa PA01
ccugguccuuauucggccca

SEQ ID NO: 3447075 - RNA, 21 nt, Pseudomonas aeruginosa PA01
ccugguccuuauucggcccau

SEQ ID NO: 3447076 - RNA, 23 nt, Pseudomonas aeruginosa PA01
ccugguccuuauucggcccaugc

SEQ ID NO: 3447077 - RNA, 21 nt, Pseudomonas aeruginosa PA01
ccuggucgacauagcgcagca

SEQ ID NO: 3447078 - RNA, 19 nt, Pseudomonas aeruginosa PA01
ccuggucgauauagcccug

SEQ ID NO: 3447079 - RNA, 17 nt, Pseudomonas aeruginosa PA01
ccuggucgaucucgucg

SEQ ID NO: 3447080 - RNA, 14 nt, Pseudomonas aeruginosa PA01
ccuggucggcgcgg

SEQ ID NO: 3447081 - RNA, 16 nt, Pseudomonas aeruginosa PA01
ccuggucggcgcggcg

SEQ ID NO: 3447082 - RNA, 23 nt, Pseudomonas aeruginosa PA01
ccuggucggcgcggcgcuccagg

SEQ ID NO: 3447083 - RNA, 18 nt, Pseudomonas aeruginosa PA01
ccuggucggggccggcga

SEQ ID NO: 3447084 - RNA, 19 nt, Pseudomonas aeruginosa PA01
ccuggucggggccggcgau

SEQ ID NO: 3447085 - RNA, 20 nt, Pseudomonas aeruginosa PA01
ccuggucggggccggcgaug

SEQ ID NO: 3447086 - RNA, 19 nt, Pseudomonas aeruginosa PA01
ccuggucgucguaguggcc

SEQ ID NO: 3447087 - RNA, 22 nt, Pseudomonas aeruginosa PA01
ccuggucuucgguggcggcgac

SEQ ID NO: 3447088 - RNA, 23 nt, Pseudomonas aeruginosa PA01
ccuggugagcggaacgggacgcc

SEQ ID NO: 3447089 - RNA, 17 nt, Pseudomonas aeruginosa PA01
ccuggugaucaucgucc

SEQ ID NO: 3447090 - RNA, 17 nt, Pseudomonas aeruginosa PA01
ccuggugcaccuggcga

SEQ ID NO: 3447091 - RNA, 13 nt, Pseudomonas aeruginosa PA01
ccuggugcacggc

SEQ ID NO: 3447092 - RNA, 14 nt, Pseudomonas aeruginosa PA01
ccuggugcacggcg

SEQ ID NO: 3447093 - RNA, 16 nt, Pseudomonas aeruginosa PA01
ccuggugcacggcgac

SEQ ID NO: 3447094 - RNA, 19 nt, Pseudomonas aeruginosa PA01
ccuggugcacggcgacccg

SEQ ID NO: 3447095 - RNA, 22 nt, Pseudomonas aeruginosa PA01
ccuggugcacggcgacccgccg

SEQ ID NO: 3447096 - RNA, 19 nt, Pseudomonas aeruginosa PA01
ccuggugcaggucgcgcgg

SEQ ID NO: 3447097 - RNA, 21 nt, Pseudomonas aeruginosa PA01
ccuggugcaggucgcgcggcg

SEQ ID NO: 3447098 - RNA, 23 nt, Pseudomonas aeruginosa PA01
ccuggugcccgaugccgcgccgg

SEQ ID NO: 3447099 - RNA, 17 nt, Pseudomonas aeruginosa PA01
ccuggugcggcaccagc

SEQ ID NO: 3447100 - RNA, 19 nt, Pseudomonas aeruginosa PA01
ccuggugcggcaccagcca

SEQ ID NO: 3447101 - RNA, 23 nt, Pseudomonas aeruginosa PA01
ccuggugcggcaccagccaggug

SEQ ID NO: 3447102 - RNA, 15 nt, Pseudomonas aeruginosa PA01
ccugguggaacagcc

SEQ ID NO: 3447103 - RNA, 16 nt, Pseudomonas aeruginosa PA01
ccugguggaacagccg

SEQ ID NO: 3447104 - RNA, 18 nt, Pseudomonas aeruginosa PA01
ccugguggaacagccgca

SEQ ID NO: 3447105 - RNA, 19 nt, Pseudomonas aeruginosa PA01
ccugguggaacagccgcag

SEQ ID NO: 3447106 - RNA, 23 nt, Pseudomonas aeruginosa PA01
ccugguggaacagccgcagcggc

SEQ ID NO: 3447107 - RNA, 17 nt, Pseudomonas aeruginosa PA01
ccugguggacacccugc

SEQ ID NO: 3447108 - RNA, 19 nt, Pseudomonas aeruginosa PA01
ccugguggacacccugcug

SEQ ID NO: 3447109 - RNA, 14 nt, Pseudomonas aeruginosa PA01
ccuggugucgggug

SEQ ID NO: 3447110 - RNA, 19 nt, Pseudomonas aeruginosa PA01
ccugguucaucgagcggcg

SEQ ID NO: 3447111 - RNA, 23 nt, Pseudomonas aeruginosa PA01
ccugguucugcuccggacugccg

SEQ ID NO: 3447112 - RNA, 18 nt, Pseudomonas aeruginosa PA01
ccugguugcgccauugcc

SEQ ID NO: 3447113 - RNA, 19 nt, Pseudomonas aeruginosa PA01
ccugguuguaggcgccgcc

SEQ ID NO: 3447114 - RNA, 12 nt, Pseudomonas aeruginosa PA01
ccuguacagaaa

SEQ ID NO: 3447115 - RNA, 13 nt, Pseudomonas aeruginosa PA01
ccuguaccagggg

SEQ ID NO: 3447116 - RNA, 18 nt, Pseudomonas aeruginosa PA01
ccuguaccccguagcgcu

SEQ ID NO: 3447117 - RNA, 19 nt, Pseudomonas aeruginosa PA01
ccuguaccgcuccccacuc

SEQ ID NO: 3447118 - RNA, 13 nt, Pseudomonas aeruginosa PA01
ccuguagcagggu

SEQ ID NO: 3447119 - RNA, 14 nt, Pseudomonas aeruginosa PA01
ccuguagcagggug

SEQ ID NO: 3447120 - RNA, 20 nt, Pseudomonas aeruginosa PA01
ccuguaguacaugacgaagc

SEQ ID NO: 3447121 - RNA, 17 nt, Pseudomonas aeruginosa PA01
ccugucacucaggcaug

SEQ ID NO: 3447122 - RNA, 12 nt, Pseudomonas aeruginosa PA01
ccuguccagcuc

SEQ ID NO: 3447123 - RNA, 19 nt, Pseudomonas aeruginosa PA01
ccuguccauuuccacgcuc

SEQ ID NO: 3447124 - RNA, 20 nt, Pseudomonas aeruginosa PA01
ccugucccaucacggccccg

SEQ ID NO: 3447125 - RNA, 21 nt, Pseudomonas aeruginosa PA01
ccugucccaucacggccccga

SEQ ID NO: 3447126 - RNA, 14 nt, Pseudomonas aeruginosa PA01
ccuguccccucacg

SEQ ID NO: 3447127 - RNA, 14 nt, Pseudomonas aeruginosa PA01
ccugucccgccgcg

SEQ ID NO: 3447128 - RNA, 18 nt, Pseudomonas aeruginosa PA01
ccuguccgaacagggcga

SEQ ID NO: 3447129 - RNA, 13 nt, Pseudomonas aeruginosa PA01
ccuguccgcugcg

SEQ ID NO: 3447130 - RNA, 20 nt, Pseudomonas aeruginosa PA01
ccuguccgcugcgcgaagcc

SEQ ID NO: 3447131 - RNA, 17 nt, Pseudomonas aeruginosa PA01
ccuguccguccgaaccg

SEQ ID NO: 3447132 - RNA, 15 nt, Pseudomonas aeruginosa PA01
ccugucgaggccucg

SEQ ID NO: 3447133 - RNA, 17 nt, Pseudomonas aeruginosa PA01
ccugucgaggccucguc

SEQ ID NO: 3447134 - RNA, 17 nt, Pseudomonas aeruginosa PA01
ccugucgcagcgggcau

SEQ ID NO: 3447135 - RNA, 14 nt, Pseudomonas aeruginosa PA01
ccugucggcacgac

SEQ ID NO: 3447136 - RNA, 20 nt, Pseudomonas aeruginosa PA01
ccugucggcacgacaccaaa

SEQ ID NO: 3447137 - RNA, 20 nt, Pseudomonas aeruginosa PA01
ccugucggcucgcgccggcg

SEQ ID NO: 3447138 - RNA, 16 nt, Pseudomonas aeruginosa PA01
ccugugccuuggcucc

SEQ ID NO: 3447139 - RNA, 19 nt, Pseudomonas aeruginosa PA01
ccugugcgguaacgaagcg

SEQ ID NO: 3447140 - RNA, 16 nt, Pseudomonas aeruginosa PA01
ccugugcugcgcgccg

SEQ ID NO: 3447141 - RNA, 18 nt, Pseudomonas aeruginosa PA01
ccugugcugcgcgccgca

SEQ ID NO: 3447142 - RNA, 21 nt, Pseudomonas aeruginosa PA01
ccugugcugcgcgccgcaacg

SEQ ID NO: 3447143 - RNA, 23 nt, Pseudomonas aeruginosa PA01
ccugugggugaaaaucauccaca

SEQ ID NO: 3447144 - RNA, 16 nt, Pseudomonas aeruginosa PA01
ccuguggucaggcgcc

SEQ ID NO: 3447145 - RNA, 18 nt, Pseudomonas aeruginosa PA01
ccuguggucaggcgccag

SEQ ID NO: 3447146 - RNA, 14 nt, Pseudomonas aeruginosa PA01
ccuguuccuccgcc

SEQ ID NO: 3447147 - RNA, 19 nt, Pseudomonas aeruginosa PA01
ccuguucgaaguucuccag

SEQ ID NO: 3447148 - RNA, 16 nt, Pseudomonas aeruginosa PA01
ccuguucgcgcccguc

SEQ ID NO: 3447149 - RNA, 14 nt, Pseudomonas aeruginosa PA01
ccuguucgcgcgcc

SEQ ID NO: 3447150 - RNA, 15 nt, Pseudomonas aeruginosa PA01
ccuguucggcgcuga

SEQ ID NO: 3447151 - RNA, 19 nt, Pseudomonas aeruginosa PA01
ccuguucggcgggaucgac

SEQ ID NO: 3447152 - RNA, 17 nt, Pseudomonas aeruginosa PA01
ccuguugcagagcggcc

SEQ ID NO: 3447153 - RNA, 20 nt, Pseudomonas aeruginosa PA01
ccuguugcagagcggccagg

SEQ ID NO: 3447154 - RNA, 18 nt, Pseudomonas aeruginosa PA01
ccuguuucugcuguggag

SEQ ID NO: 3447155 - RNA, 22 nt, Pseudomonas aeruginosa PA01
ccuguuucugcuguggagccgg

SEQ ID NO: 3447156 - RNA, 15 nt, Pseudomonas aeruginosa PA01
ccuucaaaacgcauc

SEQ ID NO: 3447157 - RNA, 22 nt, Pseudomonas aeruginosa PA01
ccuucaaaggaaucuucggcgc

SEQ ID NO: 3447158 - RNA, 17 nt, Pseudomonas aeruginosa PA01
ccuucgugggccugcuc

SEQ ID NO: 3447159 - RNA, 23 nt, Pseudomonas aeruginosa PA01
ccuucguuggccuugaugccggc

SEQ ID NO: 3447160 - RNA, 22 nt, Pseudomonas aeruginosa PA01
ccuucuacaccguacucguuga

SEQ ID NO: 3447161 - RNA, 13 nt, Pseudomonas aeruginosa PA01
ccuucuccgccag

SEQ ID NO: 3447162 - RNA, 18 nt, Pseudomonas aeruginosa PA01
ccuucuccgccagccagc

SEQ ID NO: 3447163 - RNA, 21 nt, Pseudomonas aeruginosa PA01
ccuucuccggggcccggcagg

SEQ ID NO: 3447164 - RNA, 21 nt, Pseudomonas aeruginosa PA01
ccuucugcaauugcuugcgcu

SEQ ID NO: 3447165 - RNA, 20 nt, Pseudomonas aeruginosa PA01
ccuucuuccaguuggccggg

SEQ ID NO: 3447166 - RNA, 20 nt, Pseudomonas aeruginosa PA01
ccuugaacaggcuggcgucg

SEQ ID NO: 3447167 - RNA, 21 nt, Pseudomonas aeruginosa PA01
ccuugaacucgcccggcucgg

SEQ ID NO: 3447168 - RNA, 14 nt, Pseudomonas aeruginosa PA01
ccuugaccaccgcc

SEQ ID NO: 3447169 - RNA, 20 nt, Pseudomonas aeruginosa PA01
ccuugaccagcggcccggcg

SEQ ID NO: 3447170 - RNA, 20 nt, Pseudomonas aeruginosa PA01
ccuugacccgguacagcgcc

SEQ ID NO: 3447171 - RNA, 15 nt, Pseudomonas aeruginosa PA01
ccuugacccucuggu

SEQ ID NO: 3447172 - RNA, 12 nt, Pseudomonas aeruginosa PA01
ccuugaccucga

SEQ ID NO: 3447173 - RNA, 18 nt, Pseudomonas aeruginosa PA01
ccuugaccugcugggcca

SEQ ID NO: 3447174 - RNA, 19 nt, Pseudomonas aeruginosa PA01
ccuugaccugcugggccag

SEQ ID NO: 3447175 - RNA, 13 nt, Pseudomonas aeruginosa PA01
ccuugagcacguc

SEQ ID NO: 3447176 - RNA, 18 nt, Pseudomonas aeruginosa PA01
ccuugagcacgucgccuu

SEQ ID NO: 3447177 - RNA, 15 nt, Pseudomonas aeruginosa PA01
ccuugagcaggcggc

SEQ ID NO: 3447178 - RNA, 19 nt, Pseudomonas aeruginosa PA01
ccuugagcaggcggccguc

SEQ ID NO: 3447179 - RNA, 22 nt, Pseudomonas aeruginosa PA01
ccuugagcaugauggugccgcc

SEQ ID NO: 3447180 - RNA, 17 nt, Pseudomonas aeruginosa PA01
ccuugagccuugccccg

SEQ ID NO: 3447181 - RNA, 15 nt, Pseudomonas aeruginosa PA01
ccuugagcgccagca

SEQ ID NO: 3447182 - RNA, 17 nt, Pseudomonas aeruginosa PA01
ccuugagcgccagcagg

SEQ ID NO: 3447183 - RNA, 14 nt, Pseudomonas aeruginosa PA01
ccuugagcggcgcc

SEQ ID NO: 3447184 - RNA, 17 nt, Pseudomonas aeruginosa PA01
ccuugagcggcgcccug

SEQ ID NO: 3447185 - RNA, 22 nt, Pseudomonas aeruginosa PA01
ccuugagcggcgcccuggcucu

SEQ ID NO: 3447186 - RNA, 20 nt, Pseudomonas aeruginosa PA01
ccuugagggccucggcgaag

SEQ ID NO: 3447187 - RNA, 19 nt, Pseudomonas aeruginosa PA01
ccuugagggccuuggccuc

SEQ ID NO: 3447188 - RNA, 17 nt, Pseudomonas aeruginosa PA01
ccuugagguaacgcgga

SEQ ID NO: 3447189 - RNA, 20 nt, Pseudomonas aeruginosa PA01
ccuugaggucguuggccagg

SEQ ID NO: 3447190 - RNA, 23 nt, Pseudomonas aeruginosa PA01
ccuugaggucguuggccaggcgc

SEQ ID NO: 3447191 - RNA, 19 nt, Pseudomonas aeruginosa PA01
ccuugaguagcuggcgcag

SEQ ID NO: 3447192 - RNA, 20 nt, Pseudomonas aeruginosa PA01
ccuugaguagcuggcgcagg

SEQ ID NO: 3447193 - RNA, 22 nt, Pseudomonas aeruginosa PA01
ccuugaguagcuggcgcagggc

SEQ ID NO: 3447194 - RNA, 21 nt, Pseudomonas aeruginosa PA01
ccuugaguucccagaccuggc

SEQ ID NO: 3447195 - RNA, 16 nt, Pseudomonas aeruginosa PA01
ccuugaguucgccacu

SEQ ID NO: 3447196 - RNA, 19 nt, Pseudomonas aeruginosa PA01
ccuugaucaccuugccauc

SEQ ID NO: 3447197 - RNA, 15 nt, Pseudomonas aeruginosa PA01
ccuugaucacgguga

SEQ ID NO: 3447198 - RNA, 21 nt, Pseudomonas aeruginosa PA01
ccuugaucggauaccagauca

SEQ ID NO: 3447199 - RNA, 23 nt, Pseudomonas aeruginosa PA01
ccuugaugaucaggucggccgcc

SEQ ID NO: 3447200 - RNA, 13 nt, Pseudomonas aeruginosa PA01
ccuugauggcggg

SEQ ID NO: 3447201 - RNA, 19 nt, Pseudomonas aeruginosa PA01
ccuugcaaccgccgccgca

SEQ ID NO: 3447202 - RNA, 14 nt, Pseudomonas aeruginosa PA01
ccuugcacauccag

SEQ ID NO: 3447203 - RNA, 15 nt, Pseudomonas aeruginosa PA01
ccuugcacauccagc

SEQ ID NO: 3447204 - RNA, 18 nt, Pseudomonas aeruginosa PA01
ccuugcacuugcggcagu

SEQ ID NO: 3447205 - RNA, 15 nt, Pseudomonas aeruginosa PA01
ccuugcagcaccgcc

SEQ ID NO: 3447206 - RNA, 14 nt, Pseudomonas aeruginosa PA01
ccuugcagccagcc

SEQ ID NO: 3447207 - RNA, 17 nt, Pseudomonas aeruginosa PA01
ccuugcagcgccaugcu

SEQ ID NO: 3447208 - RNA, 19 nt, Pseudomonas aeruginosa PA01
ccuugcagggccgccagcc

SEQ ID NO: 3447209 - RNA, 14 nt, Pseudomonas aeruginosa PA01
ccuugccauccucc

SEQ ID NO: 3447210 - RNA, 20 nt, Pseudomonas aeruginosa PA01
ccuugccauccuccagcacu

SEQ ID NO: 3447211 - RNA, 14 nt, Pseudomonas aeruginosa PA01
ccuugccccaggug

SEQ ID NO: 3447212 - RNA, 22 nt, Pseudomonas aeruginosa PA01
ccuugcccgaggugucgccgcg

SEQ ID NO: 3447213 - RNA, 16 nt, Pseudomonas aeruginosa PA01
ccuugcccggcgccag

SEQ ID NO: 3447214 - RNA, 15 nt, Pseudomonas aeruginosa PA01
ccuugcccggcgcgu

SEQ ID NO: 3447215 - RNA, 13 nt, Pseudomonas aeruginosa PA01
ccuugcccgucgg

SEQ ID NO: 3447216 - RNA, 23 nt, Pseudomonas aeruginosa PA01
ccuugcccucgcggaucugcucc

SEQ ID NO: 3447217 - RNA, 16 nt, Pseudomonas aeruginosa PA01
ccuugcccucggcgcc

SEQ ID NO: 3447218 - RNA, 17 nt, Pseudomonas aeruginosa PA01
ccuugcccucggcgccc

SEQ ID NO: 3447219 - RNA, 21 nt, Pseudomonas aeruginosa PA01
ccuugcccucggcgcccgccu

SEQ ID NO: 3447220 - RNA, 23 nt, Pseudomonas aeruginosa PA01
ccuugcccucggcgcccgccugc

SEQ ID NO: 3447221 - RNA, 14 nt, Pseudomonas aeruginosa PA01
ccuugcccuggccg

SEQ ID NO: 3447222 - RNA, 16 nt, Pseudomonas aeruginosa PA01
ccuugcccuggccggc

SEQ ID NO: 3447223 - RNA, 23 nt, Pseudomonas aeruginosa PA01
ccuugccgacgccgcggccggcg

SEQ ID NO: 3447224 - RNA, 20 nt, Pseudomonas aeruginosa PA01
ccuugccgaggaagucggcg

SEQ ID NO: 3447225 - RNA, 22 nt, Pseudomonas aeruginosa PA01
ccuugccgaggaagucggcggc

SEQ ID NO: 3447226 - RNA, 13 nt, Pseudomonas aeruginosa PA01
ccuugccgcgacc

SEQ ID NO: 3447227 - RNA, 18 nt, Pseudomonas aeruginosa PA01
ccuugccgcgcccggccu

SEQ ID NO: 3447228 - RNA, 16 nt, Pseudomonas aeruginosa PA01
ccuugccguaguggcg

SEQ ID NO: 3447229 - RNA, 19 nt, Pseudomonas aeruginosa PA01
ccuugccguccagccggcg

SEQ ID NO: 3447230 - RNA, 21 nt, Pseudomonas aeruginosa PA01
ccuugccguccagccggcgcu

SEQ ID NO: 3447231 - RNA, 23 nt, Pseudomonas aeruginosa PA01
ccuugccguccagccggcgcuuc

SEQ ID NO: 3447232 - RNA, 13 nt, Pseudomonas aeruginosa PA01
ccuugccguggcu

SEQ ID NO: 3447233 - RNA, 19 nt, Pseudomonas aeruginosa PA01
ccuugccguggcuccugga

SEQ ID NO: 3447234 - RNA, 21 nt, Pseudomonas aeruginosa PA01
ccuugccguugcucacgccga

SEQ ID NO: 3447235 - RNA, 15 nt, Pseudomonas aeruginosa PA01
ccuugcgaaaagccc

SEQ ID NO: 3447236 - RNA, 17 nt, Pseudomonas aeruginosa PA01
ccuugcgaaaagcccgc

SEQ ID NO: 3447237 - RNA, 14 nt, Pseudomonas aeruginosa PA01
ccuugcgaucgagg

SEQ ID NO: 3447238 - RNA, 18 nt, Pseudomonas aeruginosa PA01
ccuugcgcaccagggcca

SEQ ID NO: 3447239 - RNA, 20 nt, Pseudomonas aeruginosa PA01
ccuugcgcaccagggccagg

SEQ ID NO: 3447240 - RNA, 12 nt, Pseudomonas aeruginosa PA01
ccuugcgcaccg

SEQ ID NO: 3447241 - RNA, 13 nt, Pseudomonas aeruginosa PA01
ccuugcgcaccgc

SEQ ID NO: 3447242 - RNA, 19 nt, Pseudomonas aeruginosa PA01
ccuugcgcaccgccugcag

SEQ ID NO: 3447243 - RNA, 21 nt, Pseudomonas aeruginosa PA01
ccuugcgcaccgccugcagca

SEQ ID NO: 3447244 - RNA, 11 nt, Pseudomonas aeruginosa PA01
ccuugcgcagg

SEQ ID NO: 3447245 - RNA, 21 nt, Pseudomonas aeruginosa PA01
ccuugcgcagguacucgccgg

SEQ ID NO: 3447246 - RNA, 22 nt, Pseudomonas aeruginosa PA01
ccuugcgcagguacucgccggc

SEQ ID NO: 3447247 - RNA, 23 nt, Pseudomonas aeruginosa PA01
ccuugcgcagguacucgccggcg

SEQ ID NO: 3447248 - RNA, 12 nt, Pseudomonas aeruginosa PA01
ccuugcgccagg

SEQ ID NO: 3447249 - RNA, 14 nt, Pseudomonas aeruginosa PA01
ccuugcgccaggcc

SEQ ID NO: 3447250 - RNA, 19 nt, Pseudomonas aeruginosa PA01
ccuugcgccaggcccggcg

SEQ ID NO: 3447251 - RNA, 23 nt, Pseudomonas aeruginosa PA01
ccuugcgccaggcccggcgcugc

SEQ ID NO: 3447252 - RNA, 15 nt, Pseudomonas aeruginosa PA01
ccuugcgccaggccu

SEQ ID NO: 3447253 - RNA, 13 nt, Pseudomonas aeruginosa PA01
ccuugcgcccggc

SEQ ID NO: 3447254 - RNA, 15 nt, Pseudomonas aeruginosa PA01
ccuugcgcggcaggc

SEQ ID NO: 3447255 - RNA, 20 nt, Pseudomonas aeruginosa PA01
ccuugcgcggcaggccgucc

SEQ ID NO: 3447256 - RNA, 21 nt, Pseudomonas aeruginosa PA01
ccuugcgcggcaggccguccu

SEQ ID NO: 3447257 - RNA, 22 nt, Pseudomonas aeruginosa PA01
ccuugcgcuccuuggcuggcca

SEQ ID NO: 3447258 - RNA, 13 nt, Pseudomonas aeruginosa PA01
ccuugcggcagac

SEQ ID NO: 3447259 - RNA, 15 nt, Pseudomonas aeruginosa PA01
ccuugcggcccccag

SEQ ID NO: 3447260 - RNA, 22 nt, Pseudomonas aeruginosa PA01
cgaaagcacugcggcggucccu

SEQ ID NO: 3447261 - RNA, 17 nt, Pseudomonas aeruginosa PA01
cgaaagccgaagcgcga

SEQ ID NO: 3447262 - RNA, 13 nt, Pseudomonas aeruginosa PA01
cgaaagccgccgc

SEQ ID NO: 3447263 - RNA, 17 nt, Pseudomonas aeruginosa PA01
cgaaagccuccagcagc

SEQ ID NO: 3447264 - RNA, 18 nt, Pseudomonas aeruginosa PA01
cgaaagccuccagcagcu

SEQ ID NO: 3447265 - RNA, 15 nt, Pseudomonas aeruginosa PA01
cgaaagccucgacga

SEQ ID NO: 3447266 - RNA, 17 nt, Pseudomonas aeruginosa PA01
cgaaagccucgacgaca

SEQ ID NO: 3447267 - RNA, 15 nt, Pseudomonas aeruginosa PA01
cgaaagccugccggg

SEQ ID NO: 3447268 - RNA, 17 nt, Pseudomonas aeruginosa PA01
cgaaagcggugccgcgu

SEQ ID NO: 3447269 - RNA, 22 nt, Pseudomonas aeruginosa PA01
cgaaagcgucagcgcgccagca

SEQ ID NO: 3447270 - RNA, 15 nt, Pseudomonas aeruginosa PA01
cgaaagcuucgucgc

SEQ ID NO: 3447271 - RNA, 21 nt, Pseudomonas aeruginosa PA01
cgaaagcuucgucgcgcaggc

SEQ ID NO: 3447272 - RNA, 14 nt, Pseudomonas aeruginosa PA01
cgaaaggccgcgcc

SEQ ID NO: 3447273 - RNA, 16 nt, Pseudomonas aeruginosa PA01
cgaaaggccgcgccgg

SEQ ID NO: 3447274 - RNA, 14 nt, Pseudomonas aeruginosa PA01
cgaaagucggcgcg

SEQ ID NO: 3447275 - RNA, 17 nt, Pseudomonas aeruginosa PA01
cgaaauaaugcggcgcg

SEQ ID NO: 3447276 - RNA, 19 nt, Pseudomonas aeruginosa PA01
cgaaauccggugccuugaa

SEQ ID NO: 3447277 - RNA, 13 nt, Pseudomonas aeruginosa PA01
cgaaaucggcagg

SEQ ID NO: 3447278 - RNA, 14 nt, Pseudomonas aeruginosa PA01
cgaaaugcugcagg

SEQ ID NO: 3447279 - RNA, 16 nt, Pseudomonas aeruginosa PA01
cgaaaugcugcaggcc

SEQ ID NO: 3447280 - RNA, 15 nt, Pseudomonas aeruginosa PA01
cgaaauggcagaaca

SEQ ID NO: 3447281 - RNA, 16 nt, Pseudomonas aeruginosa PA01
cgaaauggcagaacau

SEQ ID NO: 3447282 - RNA, 21 nt, Pseudomonas aeruginosa PA01
cgaaauggcgguggccguggg

SEQ ID NO: 3447283 - RNA, 23 nt, Pseudomonas aeruginosa PA01
cgaaauggguucccagcagcaac

SEQ ID NO: 3447284 - RNA, 14 nt, Pseudomonas aeruginosa PA01
cgaaauugccuccg

SEQ ID NO: 3447285 - RNA, 15 nt, Pseudomonas aeruginosa PA01
cgaaauugccuccgc

SEQ ID NO: 3447286 - RNA, 17 nt, Pseudomonas aeruginosa PA01
cgaacaaccgcucgcgg

SEQ ID NO: 3447287 - RNA, 14 nt, Pseudomonas aeruginosa PA01
cgaacaacgccgcc

SEQ ID NO: 3447288 - RNA, 14 nt, Pseudomonas aeruginosa PA01
cgaacacacccugc

SEQ ID NO: 3447289 - RNA, 19 nt, Pseudomonas aeruginosa PA01
cgaacaccaggcgccaggg

SEQ ID NO: 3447290 - RNA, 21 nt, Pseudomonas aeruginosa PA01
cgaacaccggcgagcaacgca

SEQ ID NO: 3447291 - RNA, 14 nt, Pseudomonas aeruginosa PA01
cgaacaccggcgcc

SEQ ID NO: 3447292 - RNA, 19 nt, Pseudomonas aeruginosa PA01
cgaacaccgggccgccggc

SEQ ID NO: 3447293 - RNA, 16 nt, Pseudomonas aeruginosa PA01
cgaacacgucggcgcg

SEQ ID NO: 3447294 - RNA, 17 nt, Pseudomonas aeruginosa PA01
cgaacacuugaccgucg

SEQ ID NO: 3447295 - RNA, 15 nt, Pseudomonas aeruginosa PA01
cgaacagcacccagg

SEQ ID NO: 3447296 - RNA, 12 nt, Pseudomonas aeruginosa PA01
cgaacagcagca

SEQ ID NO: 3447297 - RNA, 13 nt, Pseudomonas aeruginosa PA01
cgaacagcagcaa

SEQ ID NO: 3447298 - RNA, 16 nt, Pseudomonas aeruginosa PA01
cgaacagcagcaagcc

SEQ ID NO: 3447299 - RNA, 17 nt, Pseudomonas aeruginosa PA01
cgaacagcagcaagccg

SEQ ID NO: 3447300 - RNA, 17 nt, Pseudomonas aeruginosa PA01
cgaacagcagcgguagg

SEQ ID NO: 3447301 - RNA, 18 nt, Pseudomonas aeruginosa PA01
cgaacagcagggaggcgc

SEQ ID NO: 3447302 - RNA, 12 nt, Pseudomonas aeruginosa PA01
cgaacagccagc

SEQ ID NO: 3447303 - RNA, 20 nt, Pseudomonas aeruginosa PA01
cgaacagccagcgguugagc

SEQ ID NO: 3447304 - RNA, 18 nt, Pseudomonas aeruginosa PA01
cgaacagccgccccacca

SEQ ID NO: 3447305 - RNA, 12 nt, Pseudomonas aeruginosa PA01
cgaacagcgaga

SEQ ID NO: 3447306 - RNA, 16 nt, Pseudomonas aeruginosa PA01
cgaacagcgagucguc

SEQ ID NO: 3447307 - RNA, 14 nt, Pseudomonas aeruginosa PA01
cgaacagcgccgcg

SEQ ID NO: 3447308 - RNA, 14 nt, Pseudomonas aeruginosa PA01
cgaacagcgcuucc

SEQ ID NO: 3447309 - RNA, 18 nt, Pseudomonas aeruginosa PA01
cgaacagcuccuccagcc

SEQ ID NO: 3447310 - RNA, 19 nt, Pseudomonas aeruginosa PA01
cgaacagcuccuccagccg

SEQ ID NO: 3447311 - RNA, 21 nt, Pseudomonas aeruginosa PA01
cgaacagcuccuccagccgcg

SEQ ID NO: 3447312 - RNA, 22 nt, Pseudomonas aeruginosa PA01
cgaacagcuccuccagccgcgg

SEQ ID NO: 3447313 - RNA, 16 nt, Pseudomonas aeruginosa PA01
cgaacagcuugccgcu

SEQ ID NO: 3447314 - RNA, 15 nt, Pseudomonas aeruginosa PA01
cgaacaggaucuccu

SEQ ID NO: 3447315 - RNA, 15 nt, Pseudomonas aeruginosa PA01
cgaacaggcagcggg

SEQ ID NO: 3447316 - RNA, 16 nt, Pseudomonas aeruginosa PA01
cgaacaggcagcgggc

SEQ ID NO: 3447317 - RNA, 19 nt, Pseudomonas aeruginosa PA01
cgaacaggcagcgggccag

SEQ ID NO: 3447318 - RNA, 12 nt, Pseudomonas aeruginosa PA01
cgaacaggcguc

SEQ ID NO: 3447319 - RNA, 20 nt, Pseudomonas aeruginosa PA01
cgaacaggcugugcgccagg

SEQ ID NO: 3447320 - RNA, 22 nt, Pseudomonas aeruginosa PA01
cgaacagggccaucagggcgaa

SEQ ID NO: 3447321 - RNA, 17 nt, Pseudomonas aeruginosa PA01
cgaacagggcgaaggcc

SEQ ID NO: 3447322 - RNA, 16 nt, Pseudomonas aeruginosa PA01
cgaacagggcgagcag

SEQ ID NO: 3447323 - RNA, 17 nt, Pseudomonas aeruginosa PA01
cgaacagggcgagcagg

SEQ ID NO: 3447324 - RNA, 19 nt, Pseudomonas aeruginosa PA01
cgaacagggucuucaggcc

SEQ ID NO: 3447325 - RNA, 23 nt, Pseudomonas aeruginosa PA01
cgaacaggguggugucguugcgc

SEQ ID NO: 3447326 - RNA, 18 nt, Pseudomonas aeruginosa PA01
cgaacagguggcuuucca

SEQ ID NO: 3447327 - RNA, 13 nt, Pseudomonas aeruginosa PA01
cgaacaguucggc

SEQ ID NO: 3447328 - RNA, 16 nt, Pseudomonas aeruginosa PA01
cgaacaguucggcggu

SEQ ID NO: 3447329 - RNA, 15 nt, Pseudomonas aeruginosa PA01
cgaacaucagcagca

SEQ ID NO: 3447330 - RNA, 17 nt, Pseudomonas aeruginosa PA01
cgaacaucagcagcagg

SEQ ID NO: 3447331 - RNA, 20 nt, Pseudomonas aeruginosa PA01
cgaacaucagcagcgccagc

SEQ ID NO: 3447332 - RNA, 22 nt, Pseudomonas aeruginosa PA01
cgaacaucauccacagcgugca

SEQ ID NO: 3447333 - RNA, 15 nt, Pseudomonas aeruginosa PA01
cgaacaucgccagcg

SEQ ID NO: 3447334 - RNA, 16 nt, Pseudomonas aeruginosa PA01
cgaacaucucgaagca

SEQ ID NO: 3447335 - RNA, 17 nt, Pseudomonas aeruginosa PA01
cgaacaucucgaagcag

SEQ ID NO: 3447336 - RNA, 17 nt, Pseudomonas aeruginosa PA01
cgaacaugaagccgcgc

SEQ ID NO: 3447337 - RNA, 15 nt, Pseudomonas aeruginosa PA01
cgaacaugagcgauc

SEQ ID NO: 3447338 - RNA, 17 nt, Pseudomonas aeruginosa PA01
cgaaccacaccaggucg

SEQ ID NO: 3447339 - RNA, 15 nt, Pseudomonas aeruginosa PA01
cgaaccacucggcgc

SEQ ID NO: 3447340 - RNA, 16 nt, Pseudomonas aeruginosa PA01
cgaaccacugcgccau

SEQ ID NO: 3447341 - RNA, 17 nt, Pseudomonas aeruginosa PA01
cgaaccacugcgccaug

SEQ ID NO: 3447342 - RNA, 20 nt, Pseudomonas aeruginosa PA01
cgaaccacugcgccaugccg

SEQ ID NO: 3447343 - RNA, 13 nt, Pseudomonas aeruginosa PA01
cgaaccagcagca

SEQ ID NO: 3447344 - RNA, 14 nt, Pseudomonas aeruginosa PA01
cgaaccagccgcgu

SEQ ID NO: 3447345 - RNA, 15 nt, Pseudomonas aeruginosa PA01
cgaaccagcucagcu

SEQ ID NO: 3447346 - RNA, 17 nt, Pseudomonas aeruginosa PA01
cgaaccagcucagcucc

SEQ ID NO: 3447347 - RNA, 20 nt, Pseudomonas aeruginosa PA01
cgaaccagcucagcuccagg

SEQ ID NO: 3447348 - RNA, 21 nt, Pseudomonas aeruginosa PA01
cgaaccaggcaauggccggcg

SEQ ID NO: 3447349 - RNA, 18 nt, Pseudomonas aeruginosa PA01
cgaaccagggacgcccgg

SEQ ID NO: 3447350 - RNA, 12 nt, Pseudomonas aeruginosa PA01
cgaaccagucca

SEQ ID NO: 3447351 - RNA, 15 nt, Pseudomonas aeruginosa PA01
cgaaccaguccagca

SEQ ID NO: 3447352 - RNA, 16 nt, Pseudomonas aeruginosa PA01
cgaaccaguccagcac

SEQ ID NO: 3447353 - RNA, 17 nt, Pseudomonas aeruginosa PA01
cgaaccaguccagcacg

SEQ ID NO: 3447354 - RNA, 19 nt, Pseudomonas aeruginosa PA01
cgaaccagugcaccgccgg

SEQ ID NO: 3447355 - RNA, 21 nt, Pseudomonas aeruginosa PA01
cgaaccagugcaccgccgggu

SEQ ID NO: 3447356 - RNA, 15 nt, Pseudomonas aeruginosa PA01
cgaacccaggccgcg

SEQ ID NO: 3447357 - RNA, 16 nt, Pseudomonas aeruginosa PA01
cgaacccaggcgcugc

SEQ ID NO: 3447358 - RNA, 22 nt, Pseudomonas aeruginosa PA01
cgaaccccaugaaaaaggccgg

SEQ ID NO: 3447359 - RNA, 18 nt, Pseudomonas aeruginosa PA01
cgaaccccgggccgcgca

SEQ ID NO: 3447360 - RNA, 20 nt, Pseudomonas aeruginosa PA01
cgaaccccuggcgcucgaag

SEQ ID NO: 3447361 - RNA, 20 nt, Pseudomonas aeruginosa PA01
cgaaccgaagguacugccgc

SEQ ID NO: 3447362 - RNA, 13 nt, Pseudomonas aeruginosa PA01
cgaaccgcagaag

SEQ ID NO: 3447363 - RNA, 17 nt, Pseudomonas aeruginosa PA01
cgaagccgagcugccgg

SEQ ID NO: 3447364 - RNA, 12 nt, Pseudomonas aeruginosa PA01
cgaagccgccgc

SEQ ID NO: 3447365 - RNA, 19 nt, Pseudomonas aeruginosa PA01
cgaagccgccgccgagaac

SEQ ID NO: 3447366 - RNA, 23 nt, Pseudomonas aeruginosa PA01
cgaagccgccgggaaucuggccg

SEQ ID NO: 3447367 - RNA, 13 nt, Pseudomonas aeruginosa PA01
cgaagccgccguu

SEQ ID NO: 3447368 - RNA, 12 nt, Pseudomonas aeruginosa PA01
cgaagccgcgca

SEQ ID NO: 3447369 - RNA, 15 nt, Pseudomonas aeruginosa PA01
cgaagccgcgcagca

SEQ ID NO: 3447370 - RNA, 17 nt, Pseudomonas aeruginosa PA01
cgaagccgcgcagcacu

SEQ ID NO: 3447371 - RNA, 12 nt, Pseudomonas aeruginosa PA01
cgaagccgcgcc

SEQ ID NO: 3447372 - RNA, 18 nt, Pseudomonas aeruginosa PA01
cgaagccgcgcccggccu

SEQ ID NO: 3447373 - RNA, 20 nt, Pseudomonas aeruginosa PA01
cgaagccggauucgcgcagc

SEQ ID NO: 3447374 - RNA, 23 nt, Pseudomonas aeruginosa PA01
cgaagccggauucgcgcagcagg

SEQ ID NO: 3447375 - RNA, 23 nt, Pseudomonas aeruginosa PA01
cgaagccggcacgguagccgccc

SEQ ID NO: 3447376 - RNA, 14 nt, Pseudomonas aeruginosa PA01
cgaagccggcgaug

SEQ ID NO: 3447377 - RNA, 12 nt, Pseudomonas aeruginosa PA01
cgaagccggcgg

SEQ ID NO: 3447378 - RNA, 15 nt, Pseudomonas aeruginosa PA01
cgaagccggcggcgc

SEQ ID NO: 3447379 - RNA, 21 nt, Pseudomonas aeruginosa PA01
cgaagccggcggcgcggcagu

SEQ ID NO: 3447380 - RNA, 20 nt, Pseudomonas aeruginosa PA01
cgaagccguuguagaucggc

SEQ ID NO: 3447381 - RNA, 23 nt, Pseudomonas aeruginosa PA01
cgaagccguuguagaucggcagc

SEQ ID NO: 3447382 - RNA, 22 nt, Pseudomonas aeruginosa PA01
cgaagcgauuccaugggcagac

SEQ ID NO: 3447383 - RNA, 15 nt, Pseudomonas aeruginosa PA01
cgaagcgcaccaggg

SEQ ID NO: 3447384 - RNA, 14 nt, Pseudomonas aeruginosa PA01
cgaagcgcagcacg

SEQ ID NO: 3447385 - RNA, 16 nt, Pseudomonas aeruginosa PA01
cgaagcgcagcagguc

SEQ ID NO: 3447386 - RNA, 15 nt, Pseudomonas aeruginosa PA01
cgaagcgcagcuccg

SEQ ID NO: 3447387 - RNA, 16 nt, Pseudomonas aeruginosa PA01
cgaagcgcagcuccgg

SEQ ID NO: 3447388 - RNA, 23 nt, Pseudomonas aeruginosa PA01
cgaagcgcagcuccggcagcagg

SEQ ID NO: 3447389 - RNA, 21 nt, Pseudomonas aeruginosa PA01
cgaagcgcaggugcaccgcgc

SEQ ID NO: 3447390 - RNA, 12 nt, Pseudomonas aeruginosa PA01
cgaagcgccagg

SEQ ID NO: 3447391 - RNA, 13 nt, Pseudomonas aeruginosa PA01
cgaagcgccaggc

SEQ ID NO: 3447392 - RNA, 18 nt, Pseudomonas aeruginosa PA01
cgaagcgccggcggccug

SEQ ID NO: 3447393 - RNA, 14 nt, Pseudomonas aeruginosa PA01
cgaagcgcgccugc

SEQ ID NO: 3447394 - RNA, 16 nt, Pseudomonas aeruginosa PA01
cgaagcgcucccagac

SEQ ID NO: 3447395 - RNA, 16 nt, Pseudomonas aeruginosa PA01
cgaagcgcucgacaua

SEQ ID NO: 3447396 - RNA, 21 nt, Pseudomonas aeruginosa PA01
cgaagcgcucggucagcuccc

SEQ ID NO: 3447397 - RNA, 22 nt, Pseudomonas aeruginosa PA01
cgaagcgcucggucagcucccu

SEQ ID NO: 3447398 - RNA, 19 nt, Pseudomonas aeruginosa PA01
cgaagcggaagccgggaag

SEQ ID NO: 3447399 - RNA, 18 nt, Pseudomonas aeruginosa PA01
cgaagcggaucucgucgc

SEQ ID NO: 3447400 - RNA, 20 nt, Pseudomonas aeruginosa PA01
cgaagcggaucucgucgccg

SEQ ID NO: 3447401 - RNA, 23 nt, Pseudomonas aeruginosa PA01
cgaagcggaucucgucgccgacc

SEQ ID NO: 3447402 - RNA, 13 nt, Pseudomonas aeruginosa PA01
cgaagcggcucgg

SEQ ID NO: 3447403 - RNA, 15 nt, Pseudomonas aeruginosa PA01
cgaagcggcucggcc

SEQ ID NO: 3447404 - RNA, 17 nt, Pseudomonas aeruginosa PA01
cgaagcggcucggccag

SEQ ID NO: 3447405 - RNA, 18 nt, Pseudomonas aeruginosa PA01
cgaagcggcucggccagg

SEQ ID NO: 3447406 - RNA, 19 nt, Pseudomonas aeruginosa PA01
cgaagcggcucggccaggg

SEQ ID NO: 3447407 - RNA, 15 nt, Pseudomonas aeruginosa PA01
cgaagcggcuggccg

SEQ ID NO: 3447408 - RNA, 17 nt, Pseudomonas aeruginosa PA01
cgaagcggcuggccgcg

SEQ ID NO: 3447409 - RNA, 20 nt, Pseudomonas aeruginosa PA01
cgaagcggcuggccgcggug

SEQ ID NO: 3447410 - RNA, 22 nt, Pseudomonas aeruginosa PA01
cgaagcggggcuuuuuccaacg

SEQ ID NO: 3447411 - RNA, 23 nt, Pseudomonas aeruginosa PA01
cgaagcggucgccggcgcgcacg

SEQ ID NO: 3447412 - RNA, 18 nt, Pseudomonas aeruginosa PA01
cgaagcgugggcggccgg

SEQ ID NO: 3447413 - RNA, 21 nt, Pseudomonas aeruginosa PA01
cgaagcgugggcggccggcca

SEQ ID NO: 3447414 - RNA, 22 nt, Pseudomonas aeruginosa PA01
cgaagcgugggcggccggccag

SEQ ID NO: 3447415 - RNA, 18 nt, Pseudomonas aeruginosa PA01
cgaagcguugcagcgucu

SEQ ID NO: 3447416 - RNA, 23 nt, Pseudomonas aeruginosa PA01
cgaagcuccucgauaaacggcgc

SEQ ID NO: 3447417 - RNA, 13 nt, Pseudomonas aeruginosa PA01
cgaagcucggcgc

SEQ ID NO: 3447418 - RNA, 14 nt, Pseudomonas aeruginosa PA01
cgaagcucucgccg

SEQ ID NO: 3447419 - RNA, 15 nt, Pseudomonas aeruginosa PA01
cgaagcucucgccgc

SEQ ID NO: 3447420 - RNA, 17 nt, Pseudomonas aeruginosa PA01
cgaagcucucgccgcgc

SEQ ID NO: 3447421 - RNA, 18 nt, Pseudomonas aeruginosa PA01
cgaagcucucgccgcgcu

SEQ ID NO: 3447422 - RNA, 14 nt, Pseudomonas aeruginosa PA01
cgaagcuggccagu

SEQ ID NO: 3447423 - RNA, 22 nt, Pseudomonas aeruginosa PA01
cgaagcuggccaguugcaccgc

SEQ ID NO: 3447424 - RNA, 14 nt, Pseudomonas aeruginosa PA01
cgaagcuggggcug

SEQ ID NO: 3447425 - RNA, 19 nt, Pseudomonas aeruginosa PA01
cgaagcugucgagcacggc

SEQ ID NO: 3447426 - RNA, 16 nt, Pseudomonas aeruginosa PA01
cgaagcugucggcccg

SEQ ID NO: 3447427 - RNA, 12 nt, Pseudomonas aeruginosa PA01
cgaagcugucgu

SEQ ID NO: 3447428 - RNA, 19 nt, Pseudomonas aeruginosa PA01
cgaagcuguuggccaacca

SEQ ID NO: 3447429 - RNA, 21 nt, Pseudomonas aeruginosa PA01
cgaagcuguuggccaaccagg

SEQ ID NO: 3447430 - RNA, 19 nt, Pseudomonas aeruginosa PA01
cgaagcuucuucggcagcc

SEQ ID NO: 3447431 - RNA, 13 nt, Pseudomonas aeruginosa PA01
cgaaggacaggcc

SEQ ID NO: 3447432 - RNA, 15 nt, Pseudomonas aeruginosa PA01
cgaaggacaggccgu

SEQ ID NO: 3447433 - RNA, 14 nt, Pseudomonas aeruginosa PA01
cgaaggaucgccuu

SEQ ID NO: 3447434 - RNA, 22 nt, Pseudomonas aeruginosa PA01
cgaaggcaacagcccgcgccgc

SEQ ID NO: 3447435 - RNA, 14 nt, Pseudomonas aeruginosa PA01
cgaaggcaaugccg

SEQ ID NO: 3447436 - RNA, 16 nt, Pseudomonas aeruginosa PA01
cgaaggcaaugccgcc

SEQ ID NO: 3447437 - RNA, 15 nt, Pseudomonas aeruginosa PA01
cgaaggccaccaucg

SEQ ID NO: 3447438 - RNA, 16 nt, Pseudomonas aeruginosa PA01
cgaaggccacgccgac

SEQ ID NO: 3447439 - RNA, 23 nt, Pseudomonas aeruginosa PA01
cgaaggccaggaccgcgauggua

SEQ ID NO: 3447440 - RNA, 12 nt, Pseudomonas aeruginosa PA01
cgaaggccaggc

SEQ ID NO: 3447441 - RNA, 20 nt, Pseudomonas aeruginosa PA01
cgaaggccaggccggcgccu

SEQ ID NO: 3447442 - RNA, 18 nt, Pseudomonas aeruginosa PA01
cgaaggccaguccggcac

SEQ ID NO: 3447443 - RNA, 22 nt, Pseudomonas aeruginosa PA01
cgaaggccaguccggcaccgcu

SEQ ID NO: 3447444 - RNA, 16 nt, Pseudomonas aeruginosa PA01
cgaaggccuccucgua

SEQ ID NO: 3447445 - RNA, 15 nt, Pseudomonas aeruginosa PA01
cgaaggccucgucgc

SEQ ID NO: 3447446 - RNA, 17 nt, Pseudomonas aeruginosa PA01
cgaaggccucgucgccc

SEQ ID NO: 3447447 - RNA, 19 nt, Pseudomonas aeruginosa PA01
cgaaggccucgucgcccgg

SEQ ID NO: 3447448 - RNA, 23 nt, Pseudomonas aeruginosa PA01
cgaaggccuggccguugcgcagg

SEQ ID NO: 3447449 - RNA, 17 nt, Pseudomonas aeruginosa PA01
cgaaggcgauauggccg

SEQ ID NO: 3447450 - RNA, 13 nt, Pseudomonas aeruginosa PA01
cgaaggcgaucac

SEQ ID NO: 3447451 - RNA, 15 nt, Pseudomonas aeruginosa PA01
cgaaggcgaucccgu

SEQ ID NO: 3447452 - RNA, 23 nt, Pseudomonas aeruginosa PA01
cgaaggcgauguaggucaccgcg

SEQ ID NO: 3447453 - RNA, 17 nt, Pseudomonas aeruginosa PA01
cgaaggcgccuuccagg

SEQ ID NO: 3447454 - RNA, 17 nt, Pseudomonas aeruginosa PA01
cgaaggcgcgcucgauc

SEQ ID NO: 3447455 - RNA, 14 nt, Pseudomonas aeruginosa PA01
cgaaggcggcagcg

SEQ ID NO: 3447456 - RNA, 16 nt, Pseudomonas aeruginosa PA01
cgaaggcggcgcggcg

SEQ ID NO: 3447457 - RNA, 16 nt, Pseudomonas aeruginosa PA01
cgaaggcgucgggcag

SEQ ID NO: 3447458 - RNA, 13 nt, Pseudomonas aeruginosa PA01
cgaaggcgugccg

SEQ ID NO: 3447459 - RNA, 14 nt, Pseudomonas aeruginosa PA01
cgaaggcgugccgc

SEQ ID NO: 3447460 - RNA, 19 nt, Pseudomonas aeruginosa PA01
cgaaggcgugggcgccggc

SEQ ID NO: 3447461 - RNA, 22 nt, Pseudomonas aeruginosa PA01
cgaaggcuccgcugcucagggc

SEQ ID NO: 3447462 - RNA, 19 nt, Pseudomonas aeruginosa PA01
cgaagggaaacaccaggcc

SEQ ID NO: 3447463 - RNA, 19 nt, Pseudomonas aeruginosa PA01
cgaagggaacccgcggcgc

SEQ ID NO: 3447464 - RNA, 23 nt, Pseudomonas aeruginosa PA01
cgaagggaaucuuuccuccagag

SEQ ID NO: 3447465 - RNA, 13 nt, Pseudomonas aeruginosa PA01
cgacaaggagcgc

SEQ ID NO: 3447466 - RNA, 15 nt, Pseudomonas aeruginosa PA01
cgacaaggagcgcga

SEQ ID NO: 3447467 - RNA, 20 nt, Pseudomonas aeruginosa PA01
cgacaaggagcgcgagcggc

SEQ ID NO: 3447468 - RNA, 21 nt, Pseudomonas aeruginosa PA01
cgacaaggagcgcgagcggca

SEQ ID NO: 3447469 - RNA, 23 nt, Pseudomonas aeruginosa PA01
cgacaaggagcgcgagcggcaga

SEQ ID NO: 3447470 - RNA, 21 nt, Pseudomonas aeruginosa PA01
cgacaaggcugaggccgacga

SEQ ID NO: 3447471 - RNA, 17 nt, Pseudomonas aeruginosa PA01
cgacaaucagcggcggg

SEQ ID NO: 3447472 - RNA, 14 nt, Pseudomonas aeruginosa PA01
cgacacagacgcag

SEQ ID NO: 3447473 - RNA, 17 nt, Pseudomonas aeruginosa PA01
cgacacagacgcagccg

SEQ ID NO: 3447474 - RNA, 17 nt, Pseudomonas aeruginosa PA01
cgacacauggucggcca

SEQ ID NO: 3447475 - RNA, 18 nt, Pseudomonas aeruginosa PA01
cgacacauggucggccag

SEQ ID NO: 3447476 - RNA, 16 nt, Pseudomonas aeruginosa PA01
cgacaccaugcuccgc

SEQ ID NO: 3447477 - RNA, 20 nt, Pseudomonas aeruginosa PA01
cgacaccaugcuccgccugg

SEQ ID NO: 3447478 - RNA, 13 nt, Pseudomonas aeruginosa PA01
cgacaccccgaag

SEQ ID NO: 3447479 - RNA, 20 nt, Pseudomonas aeruginosa PA01
cgacaccccggucaggccga

SEQ ID NO: 3447480 - RNA, 15 nt, Pseudomonas aeruginosa PA01
cgacacccgcgccgc

SEQ ID NO: 3447481 - RNA, 16 nt, Pseudomonas aeruginosa PA01
cgacacccgcgccgcc

SEQ ID NO: 3447482 - RNA, 23 nt, Pseudomonas aeruginosa PA01
cgacacccgcgccgccgcggcca

SEQ ID NO: 3447483 - RNA, 13 nt, Pseudomonas aeruginosa PA01
cgacaccgggccu

SEQ ID NO: 3447484 - RNA, 21 nt, Pseudomonas aeruginosa PA01
cgacaccugcaacgcccgcga

SEQ ID NO: 3447485 - RNA, 23 nt, Pseudomonas aeruginosa PA01
cgacaccugcaacgcccgcgagc

SEQ ID NO: 3447486 - RNA, 15 nt, Pseudomonas aeruginosa PA01
cgacacgcacucaua

SEQ ID NO: 3447487 - RNA, 15 nt, Pseudomonas aeruginosa PA01
cgacacgcucagccc

SEQ ID NO: 3447488 - RNA, 21 nt, Pseudomonas aeruginosa PA01
cgacacucugguagcugcggc

SEQ ID NO: 3447489 - RNA, 22 nt, Pseudomonas aeruginosa PA01
cgacacucugguagcugcggcc

SEQ ID NO: 3447490 - RNA, 15 nt, Pseudomonas aeruginosa PA01
cgacagagcggccgg

SEQ ID NO: 3447491 - RNA, 16 nt, Pseudomonas aeruginosa PA01
cgacagagcggccggc

SEQ ID NO: 3447492 - RNA, 19 nt, Pseudomonas aeruginosa PA01
cgacagagcggccggcgcg

SEQ ID NO: 3447493 - RNA, 22 nt, Pseudomonas aeruginosa PA01
cgacagauagcaggucacgccc

SEQ ID NO: 3447494 - RNA, 16 nt, Pseudomonas aeruginosa PA01
cgacagcacgauggcg

SEQ ID NO: 3447495 - RNA, 19 nt, Pseudomonas aeruginosa PA01
cgacagcacgauggcgagg

SEQ ID NO: 3447496 - RNA, 12 nt, Pseudomonas aeruginosa PA01
cgacagcagcgc

SEQ ID NO: 3447497 - RNA, 14 nt, Pseudomonas aeruginosa PA01
cgacagcagcgcca

SEQ ID NO: 3447498 - RNA, 14 nt, Pseudomonas aeruginosa PA01
cgacagcaggucgu

SEQ ID NO: 3447499 - RNA, 20 nt, Pseudomonas aeruginosa PA01
cgacagcaggucgugcugga

SEQ ID NO: 3447500 - RNA, 16 nt, Pseudomonas aeruginosa PA01
cgacagcagguggcug

SEQ ID NO: 3447501 - RNA, 19 nt, Pseudomonas aeruginosa PA01
cgacagcagguggcugguc

SEQ ID NO: 3447502 - RNA, 17 nt, Pseudomonas aeruginosa PA01
cgacagcauggccuugc

SEQ ID NO: 3447503 - RNA, 16 nt, Pseudomonas aeruginosa PA01
cgacagccccggcccg

SEQ ID NO: 3447504 - RNA, 15 nt, Pseudomonas aeruginosa PA01
cgacagcggcuggcg

SEQ ID NO: 3447505 - RNA, 19 nt, Pseudomonas aeruginosa PA01
cgacagcucguggcuggcg

SEQ ID NO: 3447506 - RNA, 21 nt, Pseudomonas aeruginosa PA01
cgacagcucguggcuggcgcc

SEQ ID NO: 3447507 - RNA, 18 nt, Pseudomonas aeruginosa PA01
cgacaggcagcgccgccc

SEQ ID NO: 3447508 - RNA, 19 nt, Pseudomonas aeruginosa PA01
cgacaggcagcgccgccca

SEQ ID NO: 3447509 - RNA, 22 nt, Pseudomonas aeruginosa PA01
cgacaggccauucuucuccaga

SEQ ID NO: 3447510 - RNA, 18 nt, Pseudomonas aeruginosa PA01
cgacaggccgaccagcag

SEQ ID NO: 3447511 - RNA, 13 nt, Pseudomonas aeruginosa PA01
cgacaggccgccg

SEQ ID NO: 3447512 - RNA, 12 nt, Pseudomonas aeruginosa PA01
cgacaggccggu

SEQ ID NO: 3447513 - RNA, 14 nt, Pseudomonas aeruginosa PA01
cgacaggccggugc

SEQ ID NO: 3447514 - RNA, 18 nt, Pseudomonas aeruginosa PA01
cgacaggccggugccgcc

SEQ ID NO: 3447515 - RNA, 16 nt, Pseudomonas aeruginosa PA01
cgacaggcgaucgacg

SEQ ID NO: 3447516 - RNA, 21 nt, Pseudomonas aeruginosa PA01
cgacaggcggcgggccggcgu

SEQ ID NO: 3447517 - RNA, 15 nt, Pseudomonas aeruginosa PA01
cgacaggcuggugcc

SEQ ID NO: 3447518 - RNA, 20 nt, Pseudomonas aeruginosa PA01
cgacaggucgcuuucgcgca

SEQ ID NO: 3447519 - RNA, 19 nt, Pseudomonas aeruginosa PA01
cgacaggucggccggcagc

SEQ ID NO: 3447520 - RNA, 23 nt, Pseudomonas aeruginosa PA01
cgacaggucggccggcagcuccg

SEQ ID NO: 3447521 - RNA, 13 nt, Pseudomonas aeruginosa PA01
cgacagguucagg

SEQ ID NO: 3447522 - RNA, 22 nt, Pseudomonas aeruginosa PA01
cgacagguucaggacgcuccug

SEQ ID NO: 3447523 - RNA, 23 nt, Pseudomonas aeruginosa PA01
cgacagguucaggacgcuccugc

SEQ ID NO: 3447524 - RNA, 17 nt, Pseudomonas aeruginosa PA01
cgacagucagaacacac

SEQ ID NO: 3447525 - RNA, 14 nt, Pseudomonas aeruginosa PA01
cgacaguucgccgc

SEQ ID NO: 3447526 - RNA, 13 nt, Pseudomonas aeruginosa PA01
cgacaguugcggu

SEQ ID NO: 3447527 - RNA, 13 nt, Pseudomonas aeruginosa PA01
cgacauacuccgc

SEQ ID NO: 3447528 - RNA, 16 nt, Pseudomonas aeruginosa PA01
cgacauacuccgccgc

SEQ ID NO: 3447529 - RNA, 18 nt, Pseudomonas aeruginosa PA01
cgacauacuccgccgcuu

SEQ ID NO: 3447530 - RNA, 18 nt, Pseudomonas aeruginosa PA01
cgacauagcggcugcugu

SEQ ID NO: 3447531 - RNA, 19 nt, Pseudomonas aeruginosa PA01
cgacauagcggcugcuguc

SEQ ID NO: 3447532 - RNA, 23 nt, Pseudomonas aeruginosa PA01
cgacauccugucgaggccucguc

SEQ ID NO: 3447533 - RNA, 13 nt, Pseudomonas aeruginosa PA01
cgacaucgacgcc

SEQ ID NO: 3447534 - RNA, 20 nt, Pseudomonas aeruginosa PA01
cgacaucgacgcccucggcg

SEQ ID NO: 3447535 - RNA, 14 nt, Pseudomonas aeruginosa PA01
cgacaucgucucgc

SEQ ID NO: 3447536 - RNA, 14 nt, Pseudomonas aeruginosa PA01
cgacaucuccaggc

SEQ ID NO: 3447537 - RNA, 19 nt, Pseudomonas aeruginosa PA01
cgacaucuccaggccgcuc

SEQ ID NO: 3447538 - RNA, 23 nt, Pseudomonas aeruginosa PA01
cgacaugcaccaggccgccaugc

SEQ ID NO: 3447539 - RNA, 16 nt, Pseudomonas aeruginosa PA01
cgacaugcaggccggc

SEQ ID NO: 3447540 - RNA, 23 nt, Pseudomonas aeruginosa PA01
cgacaugcaggccggccuccagc

SEQ ID NO: 3447541 - RNA, 21 nt, Pseudomonas aeruginosa PA01
cgacaugcaguagagcccucg

SEQ ID NO: 3447542 - RNA, 17 nt, Pseudomonas aeruginosa PA01
cgacaugccccgccgac

SEQ ID NO: 3447543 - RNA, 23 nt, Pseudomonas aeruginosa PA01
cgacaugccgguucccgcagcga

SEQ ID NO: 3447544 - RNA, 15 nt, Pseudomonas aeruginosa PA01
cgacaugcucaucuu

SEQ ID NO: 3447545 - RNA, 13 nt, Pseudomonas aeruginosa PA01
cgacauggaucac

SEQ ID NO: 3447546 - RNA, 14 nt, Pseudomonas aeruginosa PA01
cgacauggaucacc

SEQ ID NO: 3447547 - RNA, 14 nt, Pseudomonas aeruginosa PA01
cgacaugggccgcg

SEQ ID NO: 3447548 - RNA, 20 nt, Pseudomonas aeruginosa PA01
cgacauugcugccgaggccg

SEQ ID NO: 3447549 - RNA, 22 nt, Pseudomonas aeruginosa PA01
cgacauugcugccgaggccgag

SEQ ID NO: 3447550 - RNA, 15 nt, Pseudomonas aeruginosa PA01
cgaccaacagggcgu

SEQ ID NO: 3447551 - RNA, 16 nt, Pseudomonas aeruginosa PA01
cgaccacacaugcagg

SEQ ID NO: 3447552 - RNA, 23 nt, Pseudomonas aeruginosa PA01
cgaccacaggcggcggaagaagc

SEQ ID NO: 3447553 - RNA, 16 nt, Pseudomonas aeruginosa PA01
cgaccacaucggccag

SEQ ID NO: 3447554 - RNA, 14 nt, Pseudomonas aeruginosa PA01
cgaccaccaccagg

SEQ ID NO: 3447555 - RNA, 15 nt, Pseudomonas aeruginosa PA01
cgaccaccaucaccg

SEQ ID NO: 3447556 - RNA, 17 nt, Pseudomonas aeruginosa PA01
cgaccaccaucaccgcc

SEQ ID NO: 3447557 - RNA, 13 nt, Pseudomonas aeruginosa PA01
cgaccacccggcg

SEQ ID NO: 3447558 - RNA, 19 nt, Pseudomonas aeruginosa PA01
cgaccacccggcgguccgc

SEQ ID NO: 3447559 - RNA, 22 nt, Pseudomonas aeruginosa PA01
cgaccacccggcgguccgccgc

SEQ ID NO: 3447560 - RNA, 13 nt, Pseudomonas aeruginosa PA01
cgaccaccgcgug

SEQ ID NO: 3447561 - RNA, 19 nt, Pseudomonas aeruginosa PA01
cgaccaccgcguggugcug

SEQ ID NO: 3447562 - RNA, 16 nt, Pseudomonas aeruginosa PA01
cgaccaccucggcguc

SEQ ID NO: 3447563 - RNA, 12 nt, Pseudomonas aeruginosa PA01
cgaccacgccug

SEQ ID NO: 3447564 - RNA, 17 nt, Pseudomonas aeruginosa PA01
cgaccacgcucuugauc

SEQ ID NO: 3447565 - RNA, 15 nt, Pseudomonas aeruginosa PA01
cgaccacggccuucg

SEQ ID NO: 3447566 - RNA, 18 nt, Pseudomonas aeruginosa PA01
cgaccacggccuucggca

SEQ ID NO: 3447567 - RNA, 19 nt, Pseudomonas aeruginosa PA01
cgacccuggcgccgaccuc

SEQ ID NO: 3447568 - RNA, 21 nt, Pseudomonas aeruginosa PA01
cgacccuucaacggcgaccgc

SEQ ID NO: 3447569 - RNA, 14 nt, Pseudomonas aeruginosa PA01
cgaccgaacagcgc

SEQ ID NO: 3447570 - RNA, 13 nt, Pseudomonas aeruginosa PA01
cgaccgaagccgc

SEQ ID NO: 3447571 - RNA, 19 nt, Pseudomonas aeruginosa PA01
cgaccgaagccgcgcagca

SEQ ID NO: 3447572 - RNA, 20 nt, Pseudomonas aeruginosa PA01
cgaccgacuggccguuggcg

SEQ ID NO: 3447573 - RNA, 18 nt, Pseudomonas aeruginosa PA01
cgaccgacuuggcagucg

SEQ ID NO: 3447574 - RNA, 18 nt, Pseudomonas aeruginosa PA01
cgaccgagaugcucgcgc

SEQ ID NO: 3447575 - RNA, 21 nt, Pseudomonas aeruginosa PA01
cgaccgagaugcucgcgcagc

SEQ ID NO: 3447576 - RNA, 16 nt, Pseudomonas aeruginosa PA01
cgaccgagaugcugcc

SEQ ID NO: 3447577 - RNA, 18 nt, Pseudomonas aeruginosa PA01
cgaccgagaugcugccga

SEQ ID NO: 3447578 - RNA, 13 nt, Pseudomonas aeruginosa PA01
cgaccgagcagcg

SEQ ID NO: 3447579 - RNA, 15 nt, Pseudomonas aeruginosa PA01
cgaccgagcagcgga

SEQ ID NO: 3447580 - RNA, 16 nt, Pseudomonas aeruginosa PA01
cgaccgcaccgccagc

SEQ ID NO: 3447581 - RNA, 20 nt, Pseudomonas aeruginosa PA01
cgaccgcaucguuggcgccg

SEQ ID NO: 3447582 - RNA, 15 nt, Pseudomonas aeruginosa PA01
cgaccgccaggccga

SEQ ID NO: 3447583 - RNA, 20 nt, Pseudomonas aeruginosa PA01
cgaccgccaggccgacccgc

SEQ ID NO: 3447584 - RNA, 15 nt, Pseudomonas aeruginosa PA01
cgaccgccaggcggc

SEQ ID NO: 3447585 - RNA, 21 nt, Pseudomonas aeruginosa PA01
cgaccgccaggcggccgcugg

SEQ ID NO: 3447586 - RNA, 17 nt, Pseudomonas aeruginosa PA01
cgaccgcccaggcugcc

SEQ ID NO: 3447587 - RNA, 18 nt, Pseudomonas aeruginosa PA01
cgaccgcccaggcugccg

SEQ ID NO: 3447588 - RNA, 22 nt, Pseudomonas aeruginosa PA01
cgaccgcccaggcugccgccgc

SEQ ID NO: 3447589 - RNA, 20 nt, Pseudomonas aeruginosa PA01
cgaccgcccgccucaggccg

SEQ ID NO: 3447590 - RNA, 13 nt, Pseudomonas aeruginosa PA01
cgaccgccugcca

SEQ ID NO: 3447591 - RNA, 18 nt, Pseudomonas aeruginosa PA01
cgaccgcgaguucgccgg

SEQ ID NO: 3447592 - RNA, 12 nt, Pseudomonas aeruginosa PA01
cgaccgcgccgg

SEQ ID NO: 3447593 - RNA, 15 nt, Pseudomonas aeruginosa PA01
cgaccgcgccggcga

SEQ ID NO: 3447594 - RNA, 17 nt, Pseudomonas aeruginosa PA01
cgaccgcgcgccugcaa

SEQ ID NO: 3447595 - RNA, 21 nt, Pseudomonas aeruginosa PA01
cgaccgcgcgccugcaacgcc

SEQ ID NO: 3447596 - RNA, 11 nt, Pseudomonas aeruginosa PA01
cgaccgcggcg

SEQ ID NO: 3447597 - RNA, 13 nt, Pseudomonas aeruginosa PA01
cgaccgcggcgcu

SEQ ID NO: 3447598 - RNA, 20 nt, Pseudomonas aeruginosa PA01
cgaccgcggcgcucggcauc

SEQ ID NO: 3447599 - RNA, 13 nt, Pseudomonas aeruginosa PA01
cgaccgcuggacc

SEQ ID NO: 3447600 - RNA, 14 nt, Pseudomonas aeruginosa PA01
cgaccgcuggacca

SEQ ID NO: 3447601 - RNA, 18 nt, Pseudomonas aeruginosa PA01
cgaccggaaucacgucga

SEQ ID NO: 3447602 - RNA, 18 nt, Pseudomonas aeruginosa PA01
cgaccggaugcuccaggu

SEQ ID NO: 3447603 - RNA, 21 nt, Pseudomonas aeruginosa PA01
cgaccggcagucccugccagg

SEQ ID NO: 3447604 - RNA, 12 nt, Pseudomonas aeruginosa PA01
cgaccggcgccg

SEQ ID NO: 3447605 - RNA, 14 nt, Pseudomonas aeruginosa PA01
cgaccggcgccggg

SEQ ID NO: 3447606 - RNA, 13 nt, Pseudomonas aeruginosa PA01
cgaccggcgcgcc

SEQ ID NO: 3447607 - RNA, 14 nt, Pseudomonas aeruginosa PA01
cgaccggcgcgccu

SEQ ID NO: 3447608 - RNA, 15 nt, Pseudomonas aeruginosa PA01
cgaccggcgcgccuu

SEQ ID NO: 3447609 - RNA, 15 nt, Pseudomonas aeruginosa PA01
cgaccgggcaugccg

SEQ ID NO: 3447610 - RNA, 19 nt, Pseudomonas aeruginosa PA01
cgaccgguagccaugauca

SEQ ID NO: 3447611 - RNA, 18 nt, Pseudomonas aeruginosa PA01
cgaccgguuccagcggcc

SEQ ID NO: 3447612 - RNA, 16 nt, Pseudomonas aeruginosa PA01
cgaccguccgccugcg

SEQ ID NO: 3447613 - RNA, 12 nt, Pseudomonas aeruginosa PA01
cgaccgucggcc

SEQ ID NO: 3447614 - RNA, 16 nt, Pseudomonas aeruginosa PA01
cgaccgugaggcgcag

SEQ ID NO: 3447615 - RNA, 17 nt, Pseudomonas aeruginosa PA01
cgaccgugaggcgcagg

SEQ ID NO: 3447616 - RNA, 18 nt, Pseudomonas aeruginosa PA01
cgaccgugaggcgcaggg

SEQ ID NO: 3447617 - RNA, 18 nt, Pseudomonas aeruginosa PA01
cgaccucagaccacgccc

SEQ ID NO: 3447618 - RNA, 20 nt, Pseudomonas aeruginosa PA01
cgaccucagaccacgcccug

SEQ ID NO: 3447619 - RNA, 21 nt, Pseudomonas aeruginosa PA01
cgaccucagaccacgcccugc

SEQ ID NO: 3447620 - RNA, 16 nt, Pseudomonas aeruginosa PA01
cgaccuccaggccgaa

SEQ ID NO: 3447621 - RNA, 17 nt, Pseudomonas aeruginosa PA01
cgaccuccgccgcuucc

SEQ ID NO: 3447622 - RNA, 15 nt, Pseudomonas aeruginosa PA01
cgaccuccggcgcca

SEQ ID NO: 3447623 - RNA, 13 nt, Pseudomonas aeruginosa PA01
cgaccucgcgggc

SEQ ID NO: 3447624 - RNA, 13 nt, Pseudomonas aeruginosa PA01
cgaccucggccgc

SEQ ID NO: 3447625 - RNA, 16 nt, Pseudomonas aeruginosa PA01
cgaccucggcggucag

SEQ ID NO: 3447626 - RNA, 14 nt, Pseudomonas aeruginosa PA01
cgaccugcccgcug

SEQ ID NO: 3447627 - RNA, 21 nt, Pseudomonas aeruginosa PA01
cgaccugcggguuggucggca

SEQ ID NO: 3447628 - RNA, 22 nt, Pseudomonas aeruginosa PA01
cgaccugcggguuggucggcac

SEQ ID NO: 3447629 - RNA, 23 nt, Pseudomonas aeruginosa PA01
cgaccugcggguuggucggcacc

SEQ ID NO: 3447630 - RNA, 14 nt, Pseudomonas aeruginosa PA01
cgaccugcucgcgc

SEQ ID NO: 3447631 - RNA, 16 nt, Pseudomonas aeruginosa PA01
cgaccugcucgcgcac

SEQ ID NO: 3447632 - RNA, 17 nt, Pseudomonas aeruginosa PA01
cgaccugcucgcgcacc

SEQ ID NO: 3447633 - RNA, 21 nt, Pseudomonas aeruginosa PA01
cgaccugcucgcgcaccgcgg

SEQ ID NO: 3447634 - RNA, 23 nt, Pseudomonas aeruginosa PA01
cgaccugcucgcgcaccgcggcc

SEQ ID NO: 3447635 - RNA, 15 nt, Pseudomonas aeruginosa PA01
cgaccuggccacgcc

SEQ ID NO: 3447636 - RNA, 13 nt, Pseudomonas aeruginosa PA01
cgaccuggcgccg

SEQ ID NO: 3447637 - RNA, 14 nt, Pseudomonas aeruginosa PA01
cgaccuggcgccga

SEQ ID NO: 3447638 - RNA, 16 nt, Pseudomonas aeruginosa PA01
cgaccuggcgccgaaa

SEQ ID NO: 3447639 - RNA, 12 nt, Pseudomonas aeruginosa PA01
cgaccugggcgu

SEQ ID NO: 3447640 - RNA, 17 nt, Pseudomonas aeruginosa PA01
cgaccuggggcggccuc

SEQ ID NO: 3447641 - RNA, 18 nt, Pseudomonas aeruginosa PA01
cgaccuggggcggccuca

SEQ ID NO: 3447642 - RNA, 22 nt, Pseudomonas aeruginosa PA01
cgaccuggggcggccucaggcc

SEQ ID NO: 3447643 - RNA, 13 nt, Pseudomonas aeruginosa PA01
cgaccugguagcc

SEQ ID NO: 3447644 - RNA, 20 nt, Pseudomonas aeruginosa PA01
cgaccugguagccgaagucg

SEQ ID NO: 3447645 - RNA, 23 nt, Pseudomonas aeruginosa PA01
cgaccugguggcgccggcugacg

SEQ ID NO: 3447646 - RNA, 20 nt, Pseudomonas aeruginosa PA01
cgaccuguucgaaguucucc

SEQ ID NO: 3447647 - RNA, 19 nt, Pseudomonas aeruginosa PA01
cgaccuguugaaaaccggu

SEQ ID NO: 3447648 - RNA, 15 nt, Pseudomonas aeruginosa PA01
cgaccuucaucaggc

SEQ ID NO: 3447649 - RNA, 14 nt, Pseudomonas aeruginosa PA01
cgaccuugcccacc

SEQ ID NO: 3447650 - RNA, 17 nt, Pseudomonas aeruginosa PA01
cgaccuugcccaccggg

SEQ ID NO: 3447651 - RNA, 15 nt, Pseudomonas aeruginosa PA01
cgaccuugccgacgc

SEQ ID NO: 3447652 - RNA, 17 nt, Pseudomonas aeruginosa PA01
cgaccuugccgacgccg

SEQ ID NO: 3447653 - RNA, 15 nt, Pseudomonas aeruginosa PA01
cgaccuugccgagcg

SEQ ID NO: 3447654 - RNA, 20 nt, Pseudomonas aeruginosa PA01
cgaccuugcgcaccagggcc

SEQ ID NO: 3447655 - RNA, 17 nt, Pseudomonas aeruginosa PA01
cgaccuuguccacgucg

SEQ ID NO: 3447656 - RNA, 16 nt, Pseudomonas aeruginosa PA01
cgaccuuguccaggcg

SEQ ID NO: 3447657 - RNA, 17 nt, Pseudomonas aeruginosa PA01
cgaccuuguccaggcgc

SEQ ID NO: 3447658 - RNA, 18 nt, Pseudomonas aeruginosa PA01
cgaccuuguccaggcgcu

SEQ ID NO: 3447659 - RNA, 17 nt, Pseudomonas aeruginosa PA01
cgaccuuguccugcggc

SEQ ID NO: 3447660 - RNA, 19 nt, Pseudomonas aeruginosa PA01
cgaccuuguccugcggccg

SEQ ID NO: 3447661 - RNA, 21 nt, Pseudomonas aeruginosa PA01
cgaccuuguccugcggccggg

SEQ ID NO: 3447662 - RNA, 16 nt, Pseudomonas aeruginosa PA01
cgaccuugucgauggu

SEQ ID NO: 3447663 - RNA, 20 nt, Pseudomonas aeruginosa PA01
cgaccuugucgauggucuug

SEQ ID NO: 3447664 - RNA, 23 nt, Pseudomonas aeruginosa PA01
cgaccuuugagggucagaccagc

SEQ ID NO: 3447665 - RNA, 23 nt, Pseudomonas aeruginosa PA01
cgacgaaaagcgguuucgccacc

SEQ ID NO: 3447666 - RNA, 20 nt, Pseudomonas aeruginosa PA01
cgacgaaacggcucugcuuc

SEQ ID NO: 3447667 - RNA, 17 nt, Pseudomonas aeruginosa PA01
cgacgaaaggccgcgcc

SEQ ID NO: 3447668 - RNA, 21 nt, Pseudomonas aeruginosa PA01
cgacgaaaggccgcgccggau

SEQ ID NO: 3447669 - RNA, 21 nt, Pseudomonas aeruginosa PA01
cgacgaaauaaugcggcgcga

SEQ ID NO: 3447670 - RNA, 20 nt, Pseudomonas aeruginosa PA01
cgacgccgcccggcaccggg

SEQ ID NO: 3447671 - RNA, 11 nt, Pseudomonas aeruginosa PA01
cgacgccgccg

SEQ ID NO: 3447672 - RNA, 12 nt, Pseudomonas aeruginosa PA01
cgacgccgccga

SEQ ID NO: 3447673 - RNA, 15 nt, Pseudomonas aeruginosa PA01
cgacgccgccgagca

SEQ ID NO: 3447674 - RNA, 12 nt, Pseudomonas aeruginosa PA01
cgacgccgcgau

SEQ ID NO: 3447675 - RNA, 14 nt, Pseudomonas aeruginosa PA01
cgacgccgcgcugc

SEQ ID NO: 3447676 - RNA, 15 nt, Pseudomonas aeruginosa PA01
cgacgccgcgcugca

SEQ ID NO: 3447677 - RNA, 17 nt, Pseudomonas aeruginosa PA01
cgacgccgcggccggcg

SEQ ID NO: 3447678 - RNA, 14 nt, Pseudomonas aeruginosa PA01
cgacgccgcuggaa

SEQ ID NO: 3447679 - RNA, 22 nt, Pseudomonas aeruginosa PA01
cgacgccgcuggaaccggccgg

SEQ ID NO: 3447680 - RNA, 14 nt, Pseudomonas aeruginosa PA01
cgacgccgcuggcg

SEQ ID NO: 3447681 - RNA, 16 nt, Pseudomonas aeruginosa PA01
cgacgccgcuggcggc

SEQ ID NO: 3447682 - RNA, 18 nt, Pseudomonas aeruginosa PA01
cgacgccgcuggcggcgc

SEQ ID NO: 3447683 - RNA, 20 nt, Pseudomonas aeruginosa PA01
cgacgccgcuggcggcgcuc

SEQ ID NO: 3447684 - RNA, 19 nt, Pseudomonas aeruginosa PA01
cgacgccggacgcaccagc

SEQ ID NO: 3447685 - RNA, 21 nt, Pseudomonas aeruginosa PA01
cgacgccggacgcaccagcag

SEQ ID NO: 3447686 - RNA, 22 nt, Pseudomonas aeruginosa PA01
cgacgccggacgcaccagcagg

SEQ ID NO: 3447687 - RNA, 18 nt, Pseudomonas aeruginosa PA01
cgacgccggugccaggac

SEQ ID NO: 3447688 - RNA, 13 nt, Pseudomonas aeruginosa PA01
cgacgccucggcg

SEQ ID NO: 3447689 - RNA, 14 nt, Pseudomonas aeruginosa PA01
cgacgccucggcgc

SEQ ID NO: 3447690 - RNA, 17 nt, Pseudomonas aeruginosa PA01
cgacgccuugcccggcg

SEQ ID NO: 3447691 - RNA, 20 nt, Pseudomonas aeruginosa PA01
cgacgccuugcccggcgcgu

SEQ ID NO: 3447692 - RNA, 14 nt, Pseudomonas aeruginosa PA01
cgacgcgaccuccg

SEQ ID NO: 3447693 - RNA, 12 nt, Pseudomonas aeruginosa PA01
cgacgcgcagcg

SEQ ID NO: 3447694 - RNA, 14 nt, Pseudomonas aeruginosa PA01
cgacgcgcagcggu

SEQ ID NO: 3447695 - RNA, 13 nt, Pseudomonas aeruginosa PA01
cgacgcgcaggag

SEQ ID NO: 3447696 - RNA, 13 nt, Pseudomonas aeruginosa PA01
cgacgcgcaggcc

SEQ ID NO: 3447697 - RNA, 15 nt, Pseudomonas aeruginosa PA01
cgacgcgcaggccgg

SEQ ID NO: 3447698 - RNA, 16 nt, Pseudomonas aeruginosa PA01
cgacgcgcaggccggu

SEQ ID NO: 3447699 - RNA, 18 nt, Pseudomonas aeruginosa PA01
cgacgcgcaugucgaggu

SEQ ID NO: 3447700 - RNA, 20 nt, Pseudomonas aeruginosa PA01
cgacgcgccacgcaggaaca

SEQ ID NO: 3447701 - RNA, 14 nt, Pseudomonas aeruginosa PA01
cgacgcgcggcugc

SEQ ID NO: 3447702 - RNA, 15 nt, Pseudomonas aeruginosa PA01
cgacgcgcggcugcu

SEQ ID NO: 3447703 - RNA, 21 nt, Pseudomonas aeruginosa PA01
cgacgcgcuggaccauggccg

SEQ ID NO: 3447704 - RNA, 22 nt, Pseudomonas aeruginosa PA01
cgacgcgcuggaccauggccgg

SEQ ID NO: 3447705 - RNA, 20 nt, Pseudomonas aeruginosa PA01
cgacgcgucguccgaggcgg

SEQ ID NO: 3447706 - RNA, 20 nt, Pseudomonas aeruginosa PA01
cgacgcuacguuccagggcc

SEQ ID NO: 3447707 - RNA, 23 nt, Pseudomonas aeruginosa PA01
cgacgcuacguuccagggccugg

SEQ ID NO: 3447708 - RNA, 14 nt, Pseudomonas aeruginosa PA01
cgacgcucagcacc

SEQ ID NO: 3447709 - RNA, 15 nt, Pseudomonas aeruginosa PA01
cgacgcucagcaccc

SEQ ID NO: 3447710 - RNA, 13 nt, Pseudomonas aeruginosa PA01
cgacgcuccagcg

SEQ ID NO: 3447711 - RNA, 17 nt, Pseudomonas aeruginosa PA01
cgacgcucgcggcaucc

SEQ ID NO: 3447712 - RNA, 15 nt, Pseudomonas aeruginosa PA01
cgacgcucggacagc

SEQ ID NO: 3447713 - RNA, 21 nt, Pseudomonas aeruginosa PA01
cgacgcucuccgucagggcgu

SEQ ID NO: 3447714 - RNA, 12 nt, Pseudomonas aeruginosa PA01
cgacgcucugcu

SEQ ID NO: 3447715 - RNA, 23 nt, Pseudomonas aeruginosa PA01
cgacgcucugcucggccagcgcc

SEQ ID NO: 3447716 - RNA, 18 nt, Pseudomonas aeruginosa PA01
cgacgcucuucagcgguc

SEQ ID NO: 3447717 - RNA, 14 nt, Pseudomonas aeruginosa PA01
cgacgcugaucauc

SEQ ID NO: 3447718 - RNA, 21 nt, Pseudomonas aeruginosa PA01
cgacgcugaugaugccgcggc

SEQ ID NO: 3447719 - RNA, 14 nt, Pseudomonas aeruginosa PA01
cgacgcugaugccg

SEQ ID NO: 3447720 - RNA, 16 nt, Pseudomonas aeruginosa PA01
cgacgcugcccagccc

SEQ ID NO: 3447721 - RNA, 21 nt, Pseudomonas aeruginosa PA01
cgacgcugcccagcccgccuu

SEQ ID NO: 3447722 - RNA, 14 nt, Pseudomonas aeruginosa PA01
cgacgcuggccugc

SEQ ID NO: 3447723 - RNA, 16 nt, Pseudomonas aeruginosa PA01
cgacgcuggccugccg

SEQ ID NO: 3447724 - RNA, 18 nt, Pseudomonas aeruginosa PA01
cgacgcuggucaggcuga

SEQ ID NO: 3447725 - RNA, 15 nt, Pseudomonas aeruginosa PA01
cgacgcugucgugga

SEQ ID NO: 3447726 - RNA, 19 nt, Pseudomonas aeruginosa PA01
cgacgcugucguggacgcc

SEQ ID NO: 3447727 - RNA, 20 nt, Pseudomonas aeruginosa PA01
cgacgcugucguggacgccg

SEQ ID NO: 3447728 - RNA, 19 nt, Pseudomonas aeruginosa PA01
cgacgcuguugccggcaaa

SEQ ID NO: 3447729 - RNA, 16 nt, Pseudomonas aeruginosa PA01
cgacgcuuccucgcuc

SEQ ID NO: 3447730 - RNA, 17 nt, Pseudomonas aeruginosa PA01
cgacgcuuccucgcucg

SEQ ID NO: 3447731 - RNA, 17 nt, Pseudomonas aeruginosa PA01
cgacggaaauaggcguc

SEQ ID NO: 3447732 - RNA, 19 nt, Pseudomonas aeruginosa PA01
cgacggaaauaggcgucgu

SEQ ID NO: 3447733 - RNA, 20 nt, Pseudomonas aeruginosa PA01
cgacggaaauaggcgucguc

SEQ ID NO: 3447734 - RNA, 14 nt, Pseudomonas aeruginosa PA01
cgacggaagcccuc

SEQ ID NO: 3447735 - RNA, 20 nt, Pseudomonas aeruginosa PA01
cgacggaaggugcgguugaa

SEQ ID NO: 3447736 - RNA, 14 nt, Pseudomonas aeruginosa PA01
cgacggcaccagcg

SEQ ID NO: 3447737 - RNA, 15 nt, Pseudomonas aeruginosa PA01
cgacggcaccagcgc

SEQ ID NO: 3447738 - RNA, 13 nt, Pseudomonas aeruginosa PA01
cgacggcaggugg

SEQ ID NO: 3447739 - RNA, 15 nt, Pseudomonas aeruginosa PA01
cgacggcagguggcg

SEQ ID NO: 3447740 - RNA, 13 nt, Pseudomonas aeruginosa PA01
cgacggcccacgg

SEQ ID NO: 3447741 - RNA, 16 nt, Pseudomonas aeruginosa PA01
cgacggcccacggcga

SEQ ID NO: 3447742 - RNA, 18 nt, Pseudomonas aeruginosa PA01
cgacggcccacggcgaga

SEQ ID NO: 3447743 - RNA, 15 nt, Pseudomonas aeruginosa PA01
cgacggcccuccggc

SEQ ID NO: 3447744 - RNA, 17 nt, Pseudomonas aeruginosa PA01
cgacggcccuccggcgc

SEQ ID NO: 3447745 - RNA, 12 nt, Pseudomonas aeruginosa PA01
cgacggcccuga

SEQ ID NO: 3447746 - RNA, 20 nt, Pseudomonas aeruginosa PA01
cgacggccuuggucucgcgg

SEQ ID NO: 3447747 - RNA, 22 nt, Pseudomonas aeruginosa PA01
cgacggccuuggucucgcgggc

SEQ ID NO: 3447748 - RNA, 17 nt, Pseudomonas aeruginosa PA01
cgacggcgcaagggcgc

SEQ ID NO: 3447749 - RNA, 21 nt, Pseudomonas aeruginosa PA01
cgacggcgcaagggcgccgcc

SEQ ID NO: 3447750 - RNA, 15 nt, Pseudomonas aeruginosa PA01
cgacggcggccgcca

SEQ ID NO: 3447751 - RNA, 19 nt, Pseudomonas aeruginosa PA01
cgacggcggccgccaucgc

SEQ ID NO: 3447752 - RNA, 14 nt, Pseudomonas aeruginosa PA01
cgacggcggcggcg

SEQ ID NO: 3447753 - RNA, 15 nt, Pseudomonas aeruginosa PA01
cgacggcggcggcgg

SEQ ID NO: 3447754 - RNA, 20 nt, Pseudomonas aeruginosa PA01
cgacggcgggagcggccuga

SEQ ID NO: 3447755 - RNA, 15 nt, Pseudomonas aeruginosa PA01
cgacggcggugcgca

SEQ ID NO: 3447756 - RNA, 16 nt, Pseudomonas aeruginosa PA01
cgacggcgugccgugg

SEQ ID NO: 3447757 - RNA, 20 nt, Pseudomonas aeruginosa PA01
cgacggcucuggaugcggcg

SEQ ID NO: 3447758 - RNA, 23 nt, Pseudomonas aeruginosa PA01
cgacggcucuuccccuaccggca

SEQ ID NO: 3447759 - RNA, 23 nt, Pseudomonas aeruginosa PA01
cgacggcuucgaccacgacccgg

SEQ ID NO: 3447760 - RNA, 19 nt, Pseudomonas aeruginosa PA01
cgacggcuugaucacgccg

SEQ ID NO: 3447761 - RNA, 19 nt, Pseudomonas aeruginosa PA01
cgacgggagcgcgaggcgc

SEQ ID NO: 3447762 - RNA, 19 nt, Pseudomonas aeruginosa PA01
cgacgggucgccauggucg

SEQ ID NO: 3447763 - RNA, 22 nt, Pseudomonas aeruginosa PA01
cgacggguuugugccguuccag

SEQ ID NO: 3447764 - RNA, 16 nt, Pseudomonas aeruginosa PA01
cgacggucaggccgag

SEQ ID NO: 3447765 - RNA, 22 nt, Pseudomonas aeruginosa PA01
cgacggucaggccgagcagcgc

SEQ ID NO: 3447766 - RNA, 17 nt, Pseudomonas aeruginosa PA01
cgacggucggcaggugg

SEQ ID NO: 3447767 - RNA, 16 nt, Pseudomonas aeruginosa PA01
cgacgguucgaucccg

SEQ ID NO: 3447768 - RNA, 22 nt, Pseudomonas aeruginosa PA01
cgacgguuucaggccuugcuga

SEQ ID NO: 3447769 - RNA, 16 nt, Pseudomonas aeruginosa PA01
cgacguaccgccugcc

SEQ ID NO: 3447770 - RNA, 17 nt, Pseudomonas aeruginosa PA01
cgacguaggcggcgagg

SEQ ID NO: 3447771 - RNA, 20 nt, Pseudomonas aeruginosa PA01
cgacguagggcaucgccgac

SEQ ID NO: 3447772 - RNA, 16 nt, Pseudomonas aeruginosa PA01
cgacgucauaggccuu

SEQ ID NO: 3447773 - RNA, 15 nt, Pseudomonas aeruginosa PA01
cgagacccccgggau

SEQ ID NO: 3447774 - RNA, 22 nt, Pseudomonas aeruginosa PA01
cgagacccccgggaugcccggc

SEQ ID NO: 3447775 - RNA, 18 nt, Pseudomonas aeruginosa PA01
cgagacccuggcgcuguc

SEQ ID NO: 3447776 - RNA, 23 nt, Pseudomonas aeruginosa PA01
cgagaccgacgcucgcggcaucc

SEQ ID NO: 3447777 - RNA, 17 nt, Pseudomonas aeruginosa PA01
cgagaccgcagcccagu

SEQ ID NO: 3447778 - RNA, 17 nt, Pseudomonas aeruginosa PA01
cgagaccggggaucagc

SEQ ID NO: 3447779 - RNA, 21 nt, Pseudomonas aeruginosa PA01
cgagaccucgcccaucgccag

SEQ ID NO: 3447780 - RNA, 16 nt, Pseudomonas aeruginosa PA01
cgagacgccagccgcc

SEQ ID NO: 3447781 - RNA, 15 nt, Pseudomonas aeruginosa PA01
cgagacgcccuggau

SEQ ID NO: 3447782 - RNA, 19 nt, Pseudomonas aeruginosa PA01
cgagacgcccuggaugauc

SEQ ID NO: 3447783 - RNA, 14 nt, Pseudomonas aeruginosa PA01
cgagacgccgagga

SEQ ID NO: 3447784 - RNA, 19 nt, Pseudomonas aeruginosa PA01
cgagacgccgccccagccu

SEQ ID NO: 3447785 - RNA, 13 nt, Pseudomonas aeruginosa PA01
cgagacgccguag

SEQ ID NO: 3447786 - RNA, 19 nt, Pseudomonas aeruginosa PA01
cgagacgcgggcccagcgg

SEQ ID NO: 3447787 - RNA, 18 nt, Pseudomonas aeruginosa PA01
cgagacgcugcaccgcgg

SEQ ID NO: 3447788 - RNA, 19 nt, Pseudomonas aeruginosa PA01
cgagacgcugcaccgcggc

SEQ ID NO: 3447789 - RNA, 13 nt, Pseudomonas aeruginosa PA01
cgagacgggcgag

SEQ ID NO: 3447790 - RNA, 18 nt, Pseudomonas aeruginosa PA01
cgagacgugaagccccug

SEQ ID NO: 3447791 - RNA, 21 nt, Pseudomonas aeruginosa PA01
cgagacuccggagaaccggcg

SEQ ID NO: 3447792 - RNA, 14 nt, Pseudomonas aeruginosa PA01
cgagagcgccgacc

SEQ ID NO: 3447793 - RNA, 17 nt, Pseudomonas aeruginosa PA01
cgagagcgccgaccagc

SEQ ID NO: 3447794 - RNA, 19 nt, Pseudomonas aeruginosa PA01
cgagagcggcgccaggcgu

SEQ ID NO: 3447795 - RNA, 18 nt, Pseudomonas aeruginosa PA01
cgagagcuguccggcgcu

SEQ ID NO: 3447796 - RNA, 16 nt, Pseudomonas aeruginosa PA01
cgagaggguggucgcg

SEQ ID NO: 3447797 - RNA, 23 nt, Pseudomonas aeruginosa PA01
cgagaggguggucgcgcucuggc

SEQ ID NO: 3447798 - RNA, 20 nt, Pseudomonas aeruginosa PA01
cgagaggucggcgcgcccgg

SEQ ID NO: 3447799 - RNA, 22 nt, Pseudomonas aeruginosa PA01
cgagagguugcuguagaaugcg

SEQ ID NO: 3447800 - RNA, 18 nt, Pseudomonas aeruginosa PA01
cgagaucuucaggccgaa

SEQ ID NO: 3447801 - RNA, 20 nt, Pseudomonas aeruginosa PA01
cgagaugcugcgggcgccgc

SEQ ID NO: 3447802 - RNA, 22 nt, Pseudomonas aeruginosa PA01
cgagaugcugcgggcgccgccg

SEQ ID NO: 3447803 - RNA, 24 nt, Pseudomonas aeruginosa PA01
cgagaugcugcgggcgccgccgcu

SEQ ID NO: 3447804 - RNA, 17 nt, Pseudomonas aeruginosa PA01
cgagauucugcaggcgc

SEQ ID NO: 3447805 - RNA, 18 nt, Pseudomonas aeruginosa PA01
cgagauucugcaggcgcu

SEQ ID NO: 3447806 - RNA, 19 nt, Pseudomonas aeruginosa PA01
cgagauugaugaagcgcug

SEQ ID NO: 3447807 - RNA, 20 nt, Pseudomonas aeruginosa PA01
cgagauugaugaagcgcugc

SEQ ID NO: 3447808 - RNA, 17 nt, Pseudomonas aeruginosa PA01
cgagauuggccgccugc

SEQ ID NO: 3447809 - RNA, 18 nt, Pseudomonas aeruginosa PA01
cgagauuggccgccugcu

SEQ ID NO: 3447810 - RNA, 20 nt, Pseudomonas aeruginosa PA01
cgagauuggccgccugcucg

SEQ ID NO: 3447811 - RNA, 14 nt, Pseudomonas aeruginosa PA01
cgagcaacagcagg

SEQ ID NO: 3447812 - RNA, 17 nt, Pseudomonas aeruginosa PA01
cgagcaacucggcggcg

SEQ ID NO: 3447813 - RNA, 20 nt, Pseudomonas aeruginosa PA01
cgagcaacucggcggcgagc

SEQ ID NO: 3447814 - RNA, 18 nt, Pseudomonas aeruginosa PA01
cgagcaacugcucgggcg

SEQ ID NO: 3447815 - RNA, 20 nt, Pseudomonas aeruginosa PA01
cgagcaagccuuccagguag

SEQ ID NO: 3447816 - RNA, 23 nt, Pseudomonas aeruginosa PA01
cgagcaagccuuccagguagucc

SEQ ID NO: 3447817 - RNA, 20 nt, Pseudomonas aeruginosa PA01
cgagcaauccggcgcugccg

SEQ ID NO: 3447818 - RNA, 21 nt, Pseudomonas aeruginosa PA01
cgagcaauugccagaggcugc

SEQ ID NO: 3447819 - RNA, 23 nt, Pseudomonas aeruginosa PA01
cgagcaauugccagaggcugcgc

SEQ ID NO: 3447820 - RNA, 18 nt, Pseudomonas aeruginosa PA01
cgagcaccagcaggucgg

SEQ ID NO: 3447821 - RNA, 14 nt, Pseudomonas aeruginosa PA01
cgagcaccaggcgg

SEQ ID NO: 3447822 - RNA, 18 nt, Pseudomonas aeruginosa PA01
cgagcaccccgaccaccc

SEQ ID NO: 3447823 - RNA, 19 nt, Pseudomonas aeruginosa PA01
cgagcaccccgaccacccu

SEQ ID NO: 3447824 - RNA, 18 nt, Pseudomonas aeruginosa PA01
cgagcaccccgagcccgg

SEQ ID NO: 3447825 - RNA, 20 nt, Pseudomonas aeruginosa PA01
cgagcaccccgagcccggcc

SEQ ID NO: 3447826 - RNA, 22 nt, Pseudomonas aeruginosa PA01
cgagcaccccgagcccggccgg

SEQ ID NO: 3447827 - RNA, 12 nt, Pseudomonas aeruginosa PA01
cgagcaccgcgc

SEQ ID NO: 3447828 - RNA, 16 nt, Pseudomonas aeruginosa PA01
cgagcaccgcgcagac

SEQ ID NO: 3447829 - RNA, 18 nt, Pseudomonas aeruginosa PA01
cgagcaccgcgcagacca

SEQ ID NO: 3447830 - RNA, 23 nt, Pseudomonas aeruginosa PA01
cgagcaccgcgcagaccaucagc

SEQ ID NO: 3447831 - RNA, 22 nt, Pseudomonas aeruginosa PA01
cgagcacggcgaacaccgggcc

SEQ ID NO: 3447832 - RNA, 15 nt, Pseudomonas aeruginosa PA01
cgagcacggcgcugg

SEQ ID NO: 3447833 - RNA, 14 nt, Pseudomonas aeruginosa PA01
cgagcacuucccag

SEQ ID NO: 3447834 - RNA, 18 nt, Pseudomonas aeruginosa PA01
cgagcacuucccaggugc

SEQ ID NO: 3447835 - RNA, 14 nt, Pseudomonas aeruginosa PA01
cgagcagacugaua

SEQ ID NO: 3447836 - RNA, 21 nt, Pseudomonas aeruginosa PA01
cgagcagaguuuagccgccag

SEQ ID NO: 3447837 - RNA, 22 nt, Pseudomonas aeruginosa PA01
cgagcagaguuuagccgccagu

SEQ ID NO: 3447838 - RNA, 11 nt, Pseudomonas aeruginosa PA01
cgagcagcacc

SEQ ID NO: 3447839 - RNA, 14 nt, Pseudomonas aeruginosa PA01
cgagcagccgacga

SEQ ID NO: 3447840 - RNA, 13 nt, Pseudomonas aeruginosa PA01
cgagcagcgccag

SEQ ID NO: 3447841 - RNA, 14 nt, Pseudomonas aeruginosa PA01
cgagcagcgccagc

SEQ ID NO: 3447842 - RNA, 13 nt, Pseudomonas aeruginosa PA01
cgagcagcgccgc

SEQ ID NO: 3447843 - RNA, 14 nt, Pseudomonas aeruginosa PA01
cgagcagcgccgcg

SEQ ID NO: 3447844 - RNA, 14 nt, Pseudomonas aeruginosa PA01
cgagcagcgcgcgg

SEQ ID NO: 3447845 - RNA, 18 nt, Pseudomonas aeruginosa PA01
cgagcagcgcgcggcucg

SEQ ID NO: 3447846 - RNA, 19 nt, Pseudomonas aeruginosa PA01
cgagcagcggacgcagcgg

SEQ ID NO: 3447847 - RNA, 17 nt, Pseudomonas aeruginosa PA01
cgagcagcggcacgcuc

SEQ ID NO: 3447848 - RNA, 15 nt, Pseudomonas aeruginosa PA01
cgagcagcggcgcca

SEQ ID NO: 3447849 - RNA, 20 nt, Pseudomonas aeruginosa PA01
cgagcagcggcgccaacucg

SEQ ID NO: 3447850 - RNA, 14 nt, Pseudomonas aeruginosa PA01
cgagcagcggcgcg

SEQ ID NO: 3447851 - RNA, 14 nt, Pseudomonas aeruginosa PA01
cgagcagcggcgcu

SEQ ID NO: 3447852 - RNA, 14 nt, Pseudomonas aeruginosa PA01
cgagcagcucgccg

SEQ ID NO: 3447853 - RNA, 15 nt, Pseudomonas aeruginosa PA01
cgagcagcucgccgg

SEQ ID NO: 3447854 - RNA, 21 nt, Pseudomonas aeruginosa PA01
cgagcagcucgccggcguccu

SEQ ID NO: 3447855 - RNA, 16 nt, Pseudomonas aeruginosa PA01
cgagcagcucguucgc

SEQ ID NO: 3447856 - RNA, 18 nt, Pseudomonas aeruginosa PA01
cgagcagcucguucgccc

SEQ ID NO: 3447857 - RNA, 17 nt, Pseudomonas aeruginosa PA01
cgagcaggaagaagccg

SEQ ID NO: 3447858 - RNA, 21 nt, Pseudomonas aeruginosa PA01
cgagcaggaagaagccgauca

SEQ ID NO: 3447859 - RNA, 12 nt, Pseudomonas aeruginosa PA01
cgagcaggacag

SEQ ID NO: 3447860 - RNA, 22 nt, Pseudomonas aeruginosa PA01
cgagcaggacagcagggucgcg

SEQ ID NO: 3447861 - RNA, 17 nt, Pseudomonas aeruginosa PA01
cgagcaggaugaucacg

SEQ ID NO: 3447862 - RNA, 15 nt, Pseudomonas aeruginosa PA01
cgagcaggcacccgc

SEQ ID NO: 3447863 - RNA, 19 nt, Pseudomonas aeruginosa PA01
cgagcaggcacccgcggua

SEQ ID NO: 3447864 - RNA, 23 nt, Pseudomonas aeruginosa PA01
cgagcaggccacgcaccagcucc

SEQ ID NO: 3447865 - RNA, 20 nt, Pseudomonas aeruginosa PA01
cgagcaggccgaggaggacg

SEQ ID NO: 3447866 - RNA, 14 nt, Pseudomonas aeruginosa PA01
cgagcaggcgcgcc

SEQ ID NO: 3447867 - RNA, 13 nt, Pseudomonas aeruginosa PA01
cgagcaggcugcc

SEQ ID NO: 3447868 - RNA, 21 nt, Pseudomonas aeruginosa PA01
cgagcagggagaaccaggcgg

SEQ ID NO: 3447869 - RNA, 13 nt, Pseudomonas aeruginosa PA01
cgagcagggcgcu

SEQ ID NO: 3447870 - RNA, 16 nt, Pseudomonas aeruginosa PA01
cgagcagggucacgcc

SEQ ID NO: 3447871 - RNA, 17 nt, Pseudomonas aeruginosa PA01
cgagcagggucacgccg

SEQ ID NO: 3447872 - RNA, 19 nt, Pseudomonas aeruginosa PA01
cgagcagguagaccgccuc

SEQ ID NO: 3447873 - RNA, 15 nt, Pseudomonas aeruginosa PA01
cgagcagguccuguc

SEQ ID NO: 3447874 - RNA, 13 nt, Pseudomonas aeruginosa PA01
cgagcaggucgcg

SEQ ID NO: 3447875 - RNA, 23 nt, Pseudomonas aeruginosa PA01
cgagcgcucgccgucaucgagca

SEQ ID NO: 3447876 - RNA, 17 nt, Pseudomonas aeruginosa PA01
cgagcgcuucauccugc

SEQ ID NO: 3447877 - RNA, 21 nt, Pseudomonas aeruginosa PA01
cgagcgcuucauccugcgcgc

SEQ ID NO: 3447878 - RNA, 15 nt, Pseudomonas aeruginosa PA01
cgagcggcaaggcca

SEQ ID NO: 3447879 - RNA, 13 nt, Pseudomonas aeruginosa PA01
cgagcggcccgcg

SEQ ID NO: 3447880 - RNA, 13 nt, Pseudomonas aeruginosa PA01
cgagcggcggccg

SEQ ID NO: 3447881 - RNA, 14 nt, Pseudomonas aeruginosa PA01
cgagcgggaagcgu

SEQ ID NO: 3447882 - RNA, 18 nt, Pseudomonas aeruginosa PA01
cgagcgggaagcguuccu

SEQ ID NO: 3447883 - RNA, 14 nt, Pseudomonas aeruginosa PA01
cgagcgggucagca

SEQ ID NO: 3447884 - RNA, 21 nt, Pseudomonas aeruginosa PA01
cgagcgggucagcagcaccgc

SEQ ID NO: 3447885 - RNA, 22 nt, Pseudomonas aeruginosa PA01
cgagcgggucagcagcaccgcg

SEQ ID NO: 3447886 - RNA, 13 nt, Pseudomonas aeruginosa PA01
cgagcggucggag

SEQ ID NO: 3447887 - RNA, 21 nt, Pseudomonas aeruginosa PA01
cgagcggucggagguucgaau

SEQ ID NO: 3447888 - RNA, 22 nt, Pseudomonas aeruginosa PA01
cgagcggucuuuuuccaggcaa

SEQ ID NO: 3447889 - RNA, 17 nt, Pseudomonas aeruginosa PA01
cgagcgguuauucgccc

SEQ ID NO: 3447890 - RNA, 18 nt, Pseudomonas aeruginosa PA01
cgagcgguuauucgcccu

SEQ ID NO: 3447891 - RNA, 16 nt, Pseudomonas aeruginosa PA01
cgagcguccgccgccg

SEQ ID NO: 3447892 - RNA, 17 nt, Pseudomonas aeruginosa PA01
cgagcguccgccgccgu

SEQ ID NO: 3447893 - RNA, 12 nt, Pseudomonas aeruginosa PA01
cgagcgucgagu

SEQ ID NO: 3447894 - RNA, 17 nt, Pseudomonas aeruginosa PA01
cgagcgucgagucgcgc

SEQ ID NO: 3447895 - RNA, 20 nt, Pseudomonas aeruginosa PA01
cgagcgugcgcaugcccgcg

SEQ ID NO: 3447896 - RNA, 20 nt, Pseudomonas aeruginosa PA01
cgagcguucggaucggcccg

SEQ ID NO: 3447897 - RNA, 22 nt, Pseudomonas aeruginosa PA01
cgagcguuucgcggaaggcguc

SEQ ID NO: 3447898 - RNA, 19 nt, Pseudomonas aeruginosa PA01
cgagcguuuuuggcaaacc

SEQ ID NO: 3447899 - RNA, 14 nt, Pseudomonas aeruginosa PA01
cgagcucggccagg

SEQ ID NO: 3447900 - RNA, 15 nt, Pseudomonas aeruginosa PA01
cgagcucggccaggc

SEQ ID NO: 3447901 - RNA, 17 nt, Pseudomonas aeruginosa PA01
cgagcucggccaggcac

SEQ ID NO: 3447902 - RNA, 14 nt, Pseudomonas aeruginosa PA01
cgagcugaccacca

SEQ ID NO: 3447903 - RNA, 16 nt, Pseudomonas aeruginosa PA01
cgagcugaccaccagg

SEQ ID NO: 3447904 - RNA, 21 nt, Pseudomonas aeruginosa PA01
cgagcugaccaccagggcgau

SEQ ID NO: 3447905 - RNA, 22 nt, Pseudomonas aeruginosa PA01
cgagcugaucgcgcagaucgcc

SEQ ID NO: 3447906 - RNA, 22 nt, Pseudomonas aeruginosa PA01
cgagcugccccucguggcgcga

SEQ ID NO: 3447907 - RNA, 14 nt, Pseudomonas aeruginosa PA01
cgagcugccgcacc

SEQ ID NO: 3447908 - RNA, 18 nt, Pseudomonas aeruginosa PA01
cgagcugccgcaccgccu

SEQ ID NO: 3447909 - RNA, 14 nt, Pseudomonas aeruginosa PA01
cgagcugccgggcg

SEQ ID NO: 3447910 - RNA, 19 nt, Pseudomonas aeruginosa PA01
cgagcugccgggcgagcug

SEQ ID NO: 3447911 - RNA, 16 nt, Pseudomonas aeruginosa PA01
cgagcuggacgcgcuu

SEQ ID NO: 3447912 - RNA, 21 nt, Pseudomonas aeruginosa PA01
cgagcuggaucggcaggcugg

SEQ ID NO: 3447913 - RNA, 16 nt, Pseudomonas aeruginosa PA01
cgagcugggcguugcc

SEQ ID NO: 3447914 - RNA, 18 nt, Pseudomonas aeruginosa PA01
cgagcugggcguugccca

SEQ ID NO: 3447915 - RNA, 19 nt, Pseudomonas aeruginosa PA01
cgagcuguccaucucgccg

SEQ ID NO: 3447916 - RNA, 18 nt, Pseudomonas aeruginosa PA01
cgagcuugaggucggccu

SEQ ID NO: 3447917 - RNA, 16 nt, Pseudomonas aeruginosa PA01
cgagcuuggccacucc

SEQ ID NO: 3447918 - RNA, 14 nt, Pseudomonas aeruginosa PA01
cgagcuuggcccug

SEQ ID NO: 3447919 - RNA, 18 nt, Pseudomonas aeruginosa PA01
cgagcuuggcccuggccu

SEQ ID NO: 3447920 - RNA, 20 nt, Pseudomonas aeruginosa PA01
cgagcuuggcccuggccuug

SEQ ID NO: 3447921 - RNA, 20 nt, Pseudomonas aeruginosa PA01
cgagcuuguuggccagcagc

SEQ ID NO: 3447922 - RNA, 22 nt, Pseudomonas aeruginosa PA01
cgagcuuugcgcagccacccgc

SEQ ID NO: 3447923 - RNA, 19 nt, Pseudomonas aeruginosa PA01
cgaggaaaaggaucgccgc

SEQ ID NO: 3447924 - RNA, 22 nt, Pseudomonas aeruginosa PA01
cgaggaaaugauguugcgccag

SEQ ID NO: 3447925 - RNA, 15 nt, Pseudomonas aeruginosa PA01
cgaggaacacccaga

SEQ ID NO: 3447926 - RNA, 23 nt, Pseudomonas aeruginosa PA01
cgaggaacacccagaagccgacc

SEQ ID NO: 3447927 - RNA, 20 nt, Pseudomonas aeruginosa PA01
cgaggaacagcaccagcaau

SEQ ID NO: 3447928 - RNA, 17 nt, Pseudomonas aeruginosa PA01
cgaggaacagcgagagg

SEQ ID NO: 3447929 - RNA, 15 nt, Pseudomonas aeruginosa PA01
cgaggaacgccgaca

SEQ ID NO: 3447930 - RNA, 17 nt, Pseudomonas aeruginosa PA01
cgaggaacgccgacagg

SEQ ID NO: 3447931 - RNA, 20 nt, Pseudomonas aeruginosa PA01
cgaggaagaaaaagcccgcu

SEQ ID NO: 3447932 - RNA, 22 nt, Pseudomonas aeruginosa PA01
cgaggaagaaaaagcccgcuuc

SEQ ID NO: 3447933 - RNA, 14 nt, Pseudomonas aeruginosa PA01
cgaggaagccgacc

SEQ ID NO: 3447934 - RNA, 15 nt, Pseudomonas aeruginosa PA01
cgaggaagccgaccg

SEQ ID NO: 3447935 - RNA, 23 nt, Pseudomonas aeruginosa PA01
cgaggaagccgaccggcgccggg

SEQ ID NO: 3447936 - RNA, 13 nt, Pseudomonas aeruginosa PA01
cgaggaaggccag

SEQ ID NO: 3447937 - RNA, 15 nt, Pseudomonas aeruginosa PA01
cgaggaaggccagca

SEQ ID NO: 3447938 - RNA, 17 nt, Pseudomonas aeruginosa PA01
cgaggaaggccagcagg

SEQ ID NO: 3447939 - RNA, 20 nt, Pseudomonas aeruginosa PA01
cgaggaaggccagcaggguc

SEQ ID NO: 3447940 - RNA, 16 nt, Pseudomonas aeruginosa PA01
cgaggaaggccagguc

SEQ ID NO: 3447941 - RNA, 15 nt, Pseudomonas aeruginosa PA01
cgaggaaggcgcugg

SEQ ID NO: 3447942 - RNA, 19 nt, Pseudomonas aeruginosa PA01
cgaggaaggcgcuggcgcu

SEQ ID NO: 3447943 - RNA, 17 nt, Pseudomonas aeruginosa PA01
cgaggaagucggcggcc

SEQ ID NO: 3447944 - RNA, 18 nt, Pseudomonas aeruginosa PA01
cgaggaauuccggcagcg

SEQ ID NO: 3447945 - RNA, 14 nt, Pseudomonas aeruginosa PA01
cgaggacgccgccg

SEQ ID NO: 3447946 - RNA, 15 nt, Pseudomonas aeruginosa PA01
cgaggacgccgggcu

SEQ ID NO: 3447947 - RNA, 20 nt, Pseudomonas aeruginosa PA01
cgaggacgugcaccaucgca

SEQ ID NO: 3447948 - RNA, 23 nt, Pseudomonas aeruginosa PA01
cgaggacuuucuugaccauggug

SEQ ID NO: 3447949 - RNA, 15 nt, Pseudomonas aeruginosa PA01
cgaggagacgcggca

SEQ ID NO: 3447950 - RNA, 20 nt, Pseudomonas aeruginosa PA01
cgaggaggacgauggaacgc

SEQ ID NO: 3447951 - RNA, 20 nt, Pseudomonas aeruginosa PA01
cgaggaggaucucgcgcccc

SEQ ID NO: 3447952 - RNA, 14 nt, Pseudomonas aeruginosa PA01
cgaggaggccagca

SEQ ID NO: 3447953 - RNA, 21 nt, Pseudomonas aeruginosa PA01
cgaggagguuggucugcucgg

SEQ ID NO: 3447954 - RNA, 22 nt, Pseudomonas aeruginosa PA01
cgaggagguuggucugcucggc

SEQ ID NO: 3447955 - RNA, 19 nt, Pseudomonas aeruginosa PA01
cgaggauaccgcacggccg

SEQ ID NO: 3447956 - RNA, 22 nt, Pseudomonas aeruginosa PA01
cgaggauaccgcacggccguca

SEQ ID NO: 3447957 - RNA, 19 nt, Pseudomonas aeruginosa PA01
cgaggauacgcucaggaag

SEQ ID NO: 3447958 - RNA, 17 nt, Pseudomonas aeruginosa PA01
cgaggauagcguccagc

SEQ ID NO: 3447959 - RNA, 19 nt, Pseudomonas aeruginosa PA01
cgaggauagcguccagcuc

SEQ ID NO: 3447960 - RNA, 17 nt, Pseudomonas aeruginosa PA01
cgaggaucacgcagcag

SEQ ID NO: 3447961 - RNA, 20 nt, Pseudomonas aeruginosa PA01
cgaggaucacgcagcaggcg

SEQ ID NO: 3447962 - RNA, 21 nt, Pseudomonas aeruginosa PA01
cgaggaucacgcagcaggcga

SEQ ID NO: 3447963 - RNA, 20 nt, Pseudomonas aeruginosa PA01
cgaggaucagccacgggcgc

SEQ ID NO: 3447964 - RNA, 21 nt, Pseudomonas aeruginosa PA01
cgaggaucagccacgggcgcc

SEQ ID NO: 3447965 - RNA, 16 nt, Pseudomonas aeruginosa PA01
cgaggaucgccagcaa

SEQ ID NO: 3447966 - RNA, 17 nt, Pseudomonas aeruginosa PA01
cgaggaucgccagcaau

SEQ ID NO: 3447967 - RNA, 14 nt, Pseudomonas aeruginosa PA01
cgaggaucgcgcug

SEQ ID NO: 3447968 - RNA, 15 nt, Pseudomonas aeruginosa PA01
cgaggaucgcgcugg

SEQ ID NO: 3447969 - RNA, 17 nt, Pseudomonas aeruginosa PA01
cgaggaucgcgcuggcc

SEQ ID NO: 3447970 - RNA, 14 nt, Pseudomonas aeruginosa PA01
cgaggaucggcacg

SEQ ID NO: 3447971 - RNA, 23 nt, Pseudomonas aeruginosa PA01
cgaggaucuguuucaacucccag

SEQ ID NO: 3447972 - RNA, 17 nt, Pseudomonas aeruginosa PA01
cgaggaucuugcgcccg

SEQ ID NO: 3447973 - RNA, 18 nt, Pseudomonas aeruginosa PA01
cgaggaucuugcgcccgg

SEQ ID NO: 3447974 - RNA, 22 nt, Pseudomonas aeruginosa PA01
cgaggaucuugcgcccggcgcg

SEQ ID NO: 3447975 - RNA, 16 nt, Pseudomonas aeruginosa PA01
cgaggaugaucagggc

SEQ ID NO: 3447976 - RNA, 18 nt, Pseudomonas aeruginosa PA01
cgaggaugaucagggcac

SEQ ID NO: 3447977 - RNA, 22 nt, Pseudomonas aeruginosa PA01
cgagggcaugaccgauggcgcc

SEQ ID NO: 3447978 - RNA, 23 nt, Pseudomonas aeruginosa PA01
cgagggcauguuggcgccuucgg

SEQ ID NO: 3447979 - RNA, 20 nt, Pseudomonas aeruginosa PA01
cgagggccgcgccgacccag

SEQ ID NO: 3447980 - RNA, 14 nt, Pseudomonas aeruginosa PA01
cgagggcgaacagc

SEQ ID NO: 3447981 - RNA, 18 nt, Pseudomonas aeruginosa PA01
cgagggcgaacagcagcg

SEQ ID NO: 3447982 - RNA, 19 nt, Pseudomonas aeruginosa PA01
cgagggcgaacagcagcgg

SEQ ID NO: 3447983 - RNA, 19 nt, Pseudomonas aeruginosa PA01
cgagggcgaguucggcgag

SEQ ID NO: 3447984 - RNA, 21 nt, Pseudomonas aeruginosa PA01
cgagggcgaguucggcgagca

SEQ ID NO: 3447985 - RNA, 15 nt, Pseudomonas aeruginosa PA01
cgagggcgccaggug

SEQ ID NO: 3447986 - RNA, 12 nt, Pseudomonas aeruginosa PA01
cgagggcgcgca

SEQ ID NO: 3447987 - RNA, 22 nt, Pseudomonas aeruginosa PA01
cgagggcgcgcacuuccucggc

SEQ ID NO: 3447988 - RNA, 14 nt, Pseudomonas aeruginosa PA01
cgagggcgcggcgc

SEQ ID NO: 3447989 - RNA, 16 nt, Pseudomonas aeruginosa PA01
cgagggcgcggcgcca

SEQ ID NO: 3447990 - RNA, 18 nt, Pseudomonas aeruginosa PA01
cgagggcgcggcgccagc

SEQ ID NO: 3447991 - RNA, 20 nt, Pseudomonas aeruginosa PA01
cgagggcgcggcgccagcgc

SEQ ID NO: 3447992 - RNA, 15 nt, Pseudomonas aeruginosa PA01
cgagggcggcagggg

SEQ ID NO: 3447993 - RNA, 12 nt, Pseudomonas aeruginosa PA01
cgagggcggcgc

SEQ ID NO: 3447994 - RNA, 13 nt, Pseudomonas aeruginosa PA01
cgagggcggcgcg

SEQ ID NO: 3447995 - RNA, 18 nt, Pseudomonas aeruginosa PA01
cgagggcggcgcgggcgc

SEQ ID NO: 3447996 - RNA, 17 nt, Pseudomonas aeruginosa PA01
cgagggcguccuugccc

SEQ ID NO: 3447997 - RNA, 15 nt, Pseudomonas aeruginosa PA01
cgagggcucgggcgc

SEQ ID NO: 3447998 - RNA, 21 nt, Pseudomonas aeruginosa PA01
cgagggcugagacgcugccgu

SEQ ID NO: 3447999 - RNA, 23 nt, Pseudomonas aeruginosa PA01
cgagggcugagacgcugccguuc

SEQ ID NO: 3448000 - RNA, 18 nt, Pseudomonas aeruginosa PA01
cgagggcugggcagcgcc

SEQ ID NO: 3448001 - RNA, 19 nt, Pseudomonas aeruginosa PA01
cgagggcuguaaucgccgc

SEQ ID NO: 3448002 - RNA, 21 nt, Pseudomonas aeruginosa PA01
cgaggggaacauugccaccac

SEQ ID NO: 3448003 - RNA, 14 nt, Pseudomonas aeruginosa PA01
cgaggggaaccggg

SEQ ID NO: 3448004 - RNA, 15 nt, Pseudomonas aeruginosa PA01
cgaggggccgccgua

SEQ ID NO: 3448005 - RNA, 22 nt, Pseudomonas aeruginosa PA01
cgaggggcgggauugucgccgc

SEQ ID NO: 3448006 - RNA, 19 nt, Pseudomonas aeruginosa PA01
cgagggggccucggccagc

SEQ ID NO: 3448007 - RNA, 21 nt, Pseudomonas aeruginosa PA01
cgagggggccucggccagcgc

SEQ ID NO: 3448008 - RNA, 22 nt, Pseudomonas aeruginosa PA01
cgagggggccucggccagcgcc

SEQ ID NO: 3448009 - RNA, 13 nt, Pseudomonas aeruginosa PA01
cgagggucgccuu

SEQ ID NO: 3448010 - RNA, 20 nt, Pseudomonas aeruginosa PA01
cgagggucgccuugaccagc

SEQ ID NO: 3448011 - RNA, 22 nt, Pseudomonas aeruginosa PA01
cgagggucgccuugaccagcgg

SEQ ID NO: 3448012 - RNA, 17 nt, Pseudomonas aeruginosa PA01
cgagggucugcucgacg

SEQ ID NO: 3448013 - RNA, 17 nt, Pseudomonas aeruginosa PA01
cgagggugaacuggccg

SEQ ID NO: 3448014 - RNA, 19 nt, Pseudomonas aeruginosa PA01
cgagggugaacuggccguc

SEQ ID NO: 3448015 - RNA, 15 nt, Pseudomonas aeruginosa PA01
cgagggugaucagcc

SEQ ID NO: 3448016 - RNA, 19 nt, Pseudomonas aeruginosa PA01
cgagggugaucagccgagg

SEQ ID NO: 3448017 - RNA, 22 nt, Pseudomonas aeruginosa PA01
cgaggguggcgcccaugccgcc

SEQ ID NO: 3448018 - RNA, 15 nt, Pseudomonas aeruginosa PA01
cgaggguggucagcc

SEQ ID NO: 3448019 - RNA, 18 nt, Pseudomonas aeruginosa PA01
cgaggguggucagccagc

SEQ ID NO: 3448020 - RNA, 19 nt, Pseudomonas aeruginosa PA01
cgaggguggucagccagcc

SEQ ID NO: 3448021 - RNA, 17 nt, Pseudomonas aeruginosa PA01
cgagguagaacaggcug

SEQ ID NO: 3448022 - RNA, 20 nt, Pseudomonas aeruginosa PA01
cgagguagaacaggcugccg

SEQ ID NO: 3448023 - RNA, 23 nt, Pseudomonas aeruginosa PA01
cgagguagaacaggcugccgcag

SEQ ID NO: 3448024 - RNA, 23 nt, Pseudomonas aeruginosa PA01
cgagguccaucuugaugccgaag

SEQ ID NO: 3448025 - RNA, 21 nt, Pseudomonas aeruginosa PA01
cgagguccggcuccggcugcg

SEQ ID NO: 3448026 - RNA, 14 nt, Pseudomonas aeruginosa PA01
cgaggucgaccagc

SEQ ID NO: 3448027 - RNA, 12 nt, Pseudomonas aeruginosa PA01
cgaggucgccgc

SEQ ID NO: 3448028 - RNA, 14 nt, Pseudomonas aeruginosa PA01
cgaggucgccgcca

SEQ ID NO: 3448029 - RNA, 13 nt, Pseudomonas aeruginosa PA01
cgaggucgccggg

SEQ ID NO: 3448030 - RNA, 20 nt, Pseudomonas aeruginosa PA01
cgaggucgcggacgaggaug

SEQ ID NO: 3448031 - RNA, 13 nt, Pseudomonas aeruginosa PA01
cgaggucgcgggc

SEQ ID NO: 3448032 - RNA, 18 nt, Pseudomonas aeruginosa PA01
cgaggucgcgggccaggc

SEQ ID NO: 3448033 - RNA, 14 nt, Pseudomonas aeruginosa PA01
cgaggucggccugg

SEQ ID NO: 3448034 - RNA, 18 nt, Pseudomonas aeruginosa PA01
cgaggucggccuggcugc

SEQ ID NO: 3448035 - RNA, 21 nt, Pseudomonas aeruginosa PA01
cgaggucucgauggugaucac

SEQ ID NO: 3448036 - RNA, 13 nt, Pseudomonas aeruginosa PA01
cgaggucugugcc

SEQ ID NO: 3448037 - RNA, 21 nt, Pseudomonas aeruginosa PA01
cgaggucugugccgugaucac

SEQ ID NO: 3448038 - RNA, 15 nt, Pseudomonas aeruginosa PA01
cgaggucuuggccag

SEQ ID NO: 3448039 - RNA, 17 nt, Pseudomonas aeruginosa PA01
cgaggucuuggccagcc

SEQ ID NO: 3448040 - RNA, 20 nt, Pseudomonas aeruginosa PA01
cgaggucuuggccagccgcg

SEQ ID NO: 3448041 - RNA, 22 nt, Pseudomonas aeruginosa PA01
cgaggucuuggccagccgcgcg

SEQ ID NO: 3448042 - RNA, 16 nt, Pseudomonas aeruginosa PA01
cgaggugaucgagggc

SEQ ID NO: 3448043 - RNA, 16 nt, Pseudomonas aeruginosa PA01
cgagguggagaucagc

SEQ ID NO: 3448044 - RNA, 22 nt, Pseudomonas aeruginosa PA01
cgaggugguauugcagcucguu

SEQ ID NO: 3448045 - RNA, 14 nt, Pseudomonas aeruginosa PA01
cgaggugucgccgc

SEQ ID NO: 3448046 - RNA, 18 nt, Pseudomonas aeruginosa PA01
cgaggugucguccaucga

SEQ ID NO: 3448047 - RNA, 22 nt, Pseudomonas aeruginosa PA01
cgagguguucccggaucagcuc

SEQ ID NO: 3448048 - RNA, 15 nt, Pseudomonas aeruginosa PA01
cgagguucucgaccc

SEQ ID NO: 3448049 - RNA, 16 nt, Pseudomonas aeruginosa PA01
cgagguucucgacccg

SEQ ID NO: 3448050 - RNA, 17 nt, Pseudomonas aeruginosa PA01
cgagguucuugcccagc

SEQ ID NO: 3448051 - RNA, 23 nt, Pseudomonas aeruginosa PA01
cgagguucuugucuucgauccgg

SEQ ID NO: 3448052 - RNA, 16 nt, Pseudomonas aeruginosa PA01
cgagguugcccacggc

SEQ ID NO: 3448053 - RNA, 19 nt, Pseudomonas aeruginosa PA01
cgagguugcccacggccag

SEQ ID NO: 3448054 - RNA, 22 nt, Pseudomonas aeruginosa PA01
cgagguugcccacggccaggcc

SEQ ID NO: 3448055 - RNA, 23 nt, Pseudomonas aeruginosa PA01
cgagguugcccacggccaggccc

SEQ ID NO: 3448056 - RNA, 14 nt, Pseudomonas aeruginosa PA01
cgagguugcgcagg

SEQ ID NO: 3448057 - RNA, 13 nt, Pseudomonas aeruginosa PA01
cgagguugcgcgg

SEQ ID NO: 3448058 - RNA, 21 nt, Pseudomonas aeruginosa PA01
cgagguugcucugggcauggc

SEQ ID NO: 3448059 - RNA, 18 nt, Pseudomonas aeruginosa PA01
cgagguuguagcccuggg

SEQ ID NO: 3448060 - RNA, 23 nt, Pseudomonas aeruginosa PA01
cgagguuuccaguugcagggugc

SEQ ID NO: 3448061 - RNA, 19 nt, Pseudomonas aeruginosa PA01
cgaguaaccaccgcucucg

SEQ ID NO: 3448062 - RNA, 14 nt, Pseudomonas aeruginosa PA01
cgaguaagcgcggu

SEQ ID NO: 3448063 - RNA, 17 nt, Pseudomonas aeruginosa PA01
cgaguaagcgcggugcg

SEQ ID NO: 3448064 - RNA, 21 nt, Pseudomonas aeruginosa PA01
cgaguaagcgcggugcgguug

SEQ ID NO: 3448065 - RNA, 17 nt, Pseudomonas aeruginosa PA01
cgaguaagugccgacca

SEQ ID NO: 3448066 - RNA, 19 nt, Pseudomonas aeruginosa PA01
cgaguaccaccgugcccgc

SEQ ID NO: 3448067 - RNA, 20 nt, Pseudomonas aeruginosa PA01
cgaguaccaccgugcccgcc

SEQ ID NO: 3448068 - RNA, 17 nt, Pseudomonas aeruginosa PA01
cgaguaccgcugcggcc

SEQ ID NO: 3448069 - RNA, 17 nt, Pseudomonas aeruginosa PA01
cgaguaggcgaagccca

SEQ ID NO: 3448070 - RNA, 15 nt, Pseudomonas aeruginosa PA01
cgaguagguccaggc

SEQ ID NO: 3448071 - RNA, 23 nt, Pseudomonas aeruginosa PA01
cgaguagguccaggcgucggcgc

SEQ ID NO: 3448072 - RNA, 17 nt, Pseudomonas aeruginosa PA01
cgaguagucgcggggcg

SEQ ID NO: 3448073 - RNA, 19 nt, Pseudomonas aeruginosa PA01
cgaguagucgcggggcgga

SEQ ID NO: 3448074 - RNA, 17 nt, Pseudomonas aeruginosa PA01
cgagucaccccgaccag

SEQ ID NO: 3448075 - RNA, 18 nt, Pseudomonas aeruginosa PA01
cgagucaccccgaccagc

SEQ ID NO: 3448076 - RNA, 21 nt, Pseudomonas aeruginosa PA01
cgagucaccccgaccagcgcg

SEQ ID NO: 3448077 - RNA, 11 nt, Pseudomonas aeruginosa PA01
cgaguccaggu

SEQ ID NO: 3448078 - RNA, 17 nt, Pseudomonas aeruginosa PA01
cgagucccguccgcugc

SEQ ID NO: 3448079 - RNA, 14 nt, Pseudomonas aeruginosa PA01
cgaucagcccgccg

SEQ ID NO: 3448080 - RNA, 16 nt, Pseudomonas aeruginosa PA01
cgaucagcccgccggc

SEQ ID NO: 3448081 - RNA, 18 nt, Pseudomonas aeruginosa PA01
cgaucagcccgccggcga

SEQ ID NO: 3448082 - RNA, 15 nt, Pseudomonas aeruginosa PA01
cgaucagcccgucgg

SEQ ID NO: 3448083 - RNA, 16 nt, Pseudomonas aeruginosa PA01
cgaucagcccgucggc

SEQ ID NO: 3448084 - RNA, 10 nt, Pseudomonas aeruginosa PA01
cgaucagccg

SEQ ID NO: 3448085 - RNA, 18 nt, Pseudomonas aeruginosa PA01
cgaucagcgagcuucgcc

SEQ ID NO: 3448086 - RNA, 22 nt, Pseudomonas aeruginosa PA01
cgaucagcgagcuucgccgcgc

SEQ ID NO: 3448087 - RNA, 14 nt, Pseudomonas aeruginosa PA01
cgaucagcgccggg

SEQ ID NO: 3448088 - RNA, 16 nt, Pseudomonas aeruginosa PA01
cgaucagcgcgccuuc

SEQ ID NO: 3448089 - RNA, 15 nt, Pseudomonas aeruginosa PA01
cgaucagcgcggcca

SEQ ID NO: 3448090 - RNA, 14 nt, Pseudomonas aeruginosa PA01
cgaucagcgcuucc

SEQ ID NO: 3448091 - RNA, 12 nt, Pseudomonas aeruginosa PA01
cgaucagcgggc

SEQ ID NO: 3448092 - RNA, 13 nt, Pseudomonas aeruginosa PA01
cgaucagcucgcg

SEQ ID NO: 3448093 - RNA, 14 nt, Pseudomonas aeruginosa PA01
cgaucagcucgcgg

SEQ ID NO: 3448094 - RNA, 15 nt, Pseudomonas aeruginosa PA01
cgaucagcucgcggu

SEQ ID NO: 3448095 - RNA, 17 nt, Pseudomonas aeruginosa PA01
cgaucagcucguugccc

SEQ ID NO: 3448096 - RNA, 12 nt, Pseudomonas aeruginosa PA01
cgaucaggaaau

SEQ ID NO: 3448097 - RNA, 20 nt, Pseudomonas aeruginosa PA01
cgaucaggaaauaaccggcg

SEQ ID NO: 3448098 - RNA, 22 nt, Pseudomonas aeruginosa PA01
cgaucaggaacacccgguccug

SEQ ID NO: 3448099 - RNA, 21 nt, Pseudomonas aeruginosa PA01
cgaucaggcccuuuuccaccg

SEQ ID NO: 3448100 - RNA, 20 nt, Pseudomonas aeruginosa PA01
cgaucaggcgggcgucgucg

SEQ ID NO: 3448101 - RNA, 12 nt, Pseudomonas aeruginosa PA01
cgaucaggcuga

SEQ ID NO: 3448102 - RNA, 22 nt, Pseudomonas aeruginosa PA01
cgaucaggcugaagcggccgcc

SEQ ID NO: 3448103 - RNA, 18 nt, Pseudomonas aeruginosa PA01
cgaucaggcugugcaucu

SEQ ID NO: 3448104 - RNA, 19 nt, Pseudomonas aeruginosa PA01
cgaucagguaggccggcgu

SEQ ID NO: 3448105 - RNA, 16 nt, Pseudomonas aeruginosa PA01
cgaucagguaggcgcc

SEQ ID NO: 3448106 - RNA, 20 nt, Pseudomonas aeruginosa PA01
cgaucagguaggcgccgugc

SEQ ID NO: 3448107 - RNA, 14 nt, Pseudomonas aeruginosa PA01
cgaucaggucgccg

SEQ ID NO: 3448108 - RNA, 17 nt, Pseudomonas aeruginosa PA01
cgaucaggucgccgccg

SEQ ID NO: 3448109 - RNA, 18 nt, Pseudomonas aeruginosa PA01
cgaucaggucgcgcgccu

SEQ ID NO: 3448110 - RNA, 20 nt, Pseudomonas aeruginosa PA01
cgaucaggucgcgcgccuuc

SEQ ID NO: 3448111 - RNA, 20 nt, Pseudomonas aeruginosa PA01
cgaucagugcaucggccgcc

SEQ ID NO: 3448112 - RNA, 23 nt, Pseudomonas aeruginosa PA01
cgaucagugcaucggccgccagg

SEQ ID NO: 3448113 - RNA, 17 nt, Pseudomonas aeruginosa PA01
cgaucaguggucgcagc

SEQ ID NO: 3448114 - RNA, 20 nt, Pseudomonas aeruginosa PA01
cgaucaguggucgcagcucc

SEQ ID NO: 3448115 - RNA, 13 nt, Pseudomonas aeruginosa PA01
cgaucaucgccac

SEQ ID NO: 3448116 - RNA, 15 nt, Pseudomonas aeruginosa PA01
cgaucaucgccaccg

SEQ ID NO: 3448117 - RNA, 16 nt, Pseudomonas aeruginosa PA01
cgaucaucgccagcgg

SEQ ID NO: 3448118 - RNA, 23 nt, Pseudomonas aeruginosa PA01
cgaucaucggcuggucgucgcgg

SEQ ID NO: 3448119 - RNA, 22 nt, Pseudomonas aeruginosa PA01
cgaucaucugcggguugccgca

SEQ ID NO: 3448120 - RNA, 21 nt, Pseudomonas aeruginosa PA01
cgaucaucugcugcagcauca

SEQ ID NO: 3448121 - RNA, 12 nt, Pseudomonas aeruginosa PA01
cgaucaugccuu

SEQ ID NO: 3448122 - RNA, 21 nt, Pseudomonas aeruginosa PA01
cgaucaugccuucgaucucau

SEQ ID NO: 3448123 - RNA, 15 nt, Pseudomonas aeruginosa PA01
cgauccaccgccagg

SEQ ID NO: 3448124 - RNA, 19 nt, Pseudomonas aeruginosa PA01
cgauccagaagaucagcgc

SEQ ID NO: 3448125 - RNA, 20 nt, Pseudomonas aeruginosa PA01
cgauccagcagucgcggccc

SEQ ID NO: 3448126 - RNA, 22 nt, Pseudomonas aeruginosa PA01
cgauccagcagucgcggcccug

SEQ ID NO: 3448127 - RNA, 12 nt, Pseudomonas aeruginosa PA01
cgauccagccgg

SEQ ID NO: 3448128 - RNA, 13 nt, Pseudomonas aeruginosa PA01
cgauccagccggg

SEQ ID NO: 3448129 - RNA, 16 nt, Pseudomonas aeruginosa PA01
cgauccaggaaccggc

SEQ ID NO: 3448130 - RNA, 16 nt, Pseudomonas aeruginosa PA01
cgauccaggcgugggg

SEQ ID NO: 3448131 - RNA, 17 nt, Pseudomonas aeruginosa PA01
cgaucccaggucggcgg

SEQ ID NO: 3448132 - RNA, 16 nt, Pseudomonas aeruginosa PA01
cgauccccaacccggc

SEQ ID NO: 3448133 - RNA, 18 nt, Pseudomonas aeruginosa PA01
cgauccccaacccggcca

SEQ ID NO: 3448134 - RNA, 14 nt, Pseudomonas aeruginosa PA01
cgaucccccgcccc

SEQ ID NO: 3448135 - RNA, 20 nt, Pseudomonas aeruginosa PA01
cgaucccgacgcccuccagc

SEQ ID NO: 3448136 - RNA, 19 nt, Pseudomonas aeruginosa PA01
cgaucccggauucgccgag

SEQ ID NO: 3448137 - RNA, 23 nt, Pseudomonas aeruginosa PA01
cgaucccggauucgccgaggaac

SEQ ID NO: 3448138 - RNA, 20 nt, Pseudomonas aeruginosa PA01
cgaucccggcggcgacccag

SEQ ID NO: 3448139 - RNA, 22 nt, Pseudomonas aeruginosa PA01
cgaucccggcggcgacccagac

SEQ ID NO: 3448140 - RNA, 23 nt, Pseudomonas aeruginosa PA01
cgaucccggcggcgacccagacc

SEQ ID NO: 3448141 - RNA, 14 nt, Pseudomonas aeruginosa PA01
cgauccgaccuggg

SEQ ID NO: 3448142 - RNA, 17 nt, Pseudomonas aeruginosa PA01
cgauccgaccuggggcg

SEQ ID NO: 3448143 - RNA, 21 nt, Pseudomonas aeruginosa PA01
cgauccgcgcauaggaggcgc

SEQ ID NO: 3448144 - RNA, 21 nt, Pseudomonas aeruginosa PA01
cgauccgcgcuuccgcaucgg

SEQ ID NO: 3448145 - RNA, 23 nt, Pseudomonas aeruginosa PA01
cgauccgcgcuuccgcaucggcc

SEQ ID NO: 3448146 - RNA, 19 nt, Pseudomonas aeruginosa PA01
cgauccgcuccagcaguuc

SEQ ID NO: 3448147 - RNA, 17 nt, Pseudomonas aeruginosa PA01
cgauccuccgccagccc

SEQ ID NO: 3448148 - RNA, 22 nt, Pseudomonas aeruginosa PA01
cgauccuccgccagccccaggc

SEQ ID NO: 3448149 - RNA, 16 nt, Pseudomonas aeruginosa PA01
cgauccugaccccggc

SEQ ID NO: 3448150 - RNA, 21 nt, Pseudomonas aeruginosa PA01
cgauccugaccccggccuggc

SEQ ID NO: 3448151 - RNA, 20 nt, Pseudomonas aeruginosa PA01
cgauccugaccguccuggcc

SEQ ID NO: 3448152 - RNA, 22 nt, Pseudomonas aeruginosa PA01
cgauccuucggaggucgagcag

SEQ ID NO: 3448153 - RNA, 15 nt, Pseudomonas aeruginosa PA01
cgaucgaagaagcgc

SEQ ID NO: 3448154 - RNA, 22 nt, Pseudomonas aeruginosa PA01
cgaucgaagaagcgcaccaccu

SEQ ID NO: 3448155 - RNA, 23 nt, Pseudomonas aeruginosa PA01
cgaucgaagaagcgcaccaccug

SEQ ID NO: 3448156 - RNA, 13 nt, Pseudomonas aeruginosa PA01
cgaucgaccugcc

SEQ ID NO: 3448157 - RNA, 14 nt, Pseudomonas aeruginosa PA01
cgaucgaccugccg

SEQ ID NO: 3448158 - RNA, 19 nt, Pseudomonas aeruginosa PA01
cgaucgaccugccgguagu

SEQ ID NO: 3448159 - RNA, 17 nt, Pseudomonas aeruginosa PA01
cgaucgacgccucggcg

SEQ ID NO: 3448160 - RNA, 13 nt, Pseudomonas aeruginosa PA01
cgaucgagcggcc

SEQ ID NO: 3448161 - RNA, 14 nt, Pseudomonas aeruginosa PA01
cgaucgagcggccc

SEQ ID NO: 3448162 - RNA, 15 nt, Pseudomonas aeruginosa PA01
cgaucgagcggcccg

SEQ ID NO: 3448163 - RNA, 17 nt, Pseudomonas aeruginosa PA01
cgaucgagcggcccgcg

SEQ ID NO: 3448164 - RNA, 18 nt, Pseudomonas aeruginosa PA01
cgaucgagcggcccgcgg

SEQ ID NO: 3448165 - RNA, 15 nt, Pseudomonas aeruginosa PA01
cgaucgagcugucca

SEQ ID NO: 3448166 - RNA, 21 nt, Pseudomonas aeruginosa PA01
cgaucgaggaugaucggcucc

SEQ ID NO: 3448167 - RNA, 19 nt, Pseudomonas aeruginosa PA01
cgaucgccaggcgauccag

SEQ ID NO: 3448168 - RNA, 22 nt, Pseudomonas aeruginosa PA01
cgaucgccaggcgauccagcgg

SEQ ID NO: 3448169 - RNA, 14 nt, Pseudomonas aeruginosa PA01
cgaucgccaggugg

SEQ ID NO: 3448170 - RNA, 20 nt, Pseudomonas aeruginosa PA01
cgaucgccagguggaagcgc

SEQ ID NO: 3448171 - RNA, 16 nt, Pseudomonas aeruginosa PA01
cgaucgccccgcuacc

SEQ ID NO: 3448172 - RNA, 22 nt, Pseudomonas aeruginosa PA01
cgaucgccccgcuacccugccc

SEQ ID NO: 3448173 - RNA, 13 nt, Pseudomonas aeruginosa PA01
cgaucgccccguu

SEQ ID NO: 3448174 - RNA, 14 nt, Pseudomonas aeruginosa PA01
cgaucgcccgcgcc

SEQ ID NO: 3448175 - RNA, 14 nt, Pseudomonas aeruginosa PA01
cgaucgccgcgcgg

SEQ ID NO: 3448176 - RNA, 14 nt, Pseudomonas aeruginosa PA01
cgaucgccgcggcg

SEQ ID NO: 3448177 - RNA, 15 nt, Pseudomonas aeruginosa PA01
cgaucgccgcggcga

SEQ ID NO: 3448178 - RNA, 18 nt, Pseudomonas aeruginosa PA01
cgaucgccgcggcgaagc

SEQ ID NO: 3448179 - RNA, 23 nt, Pseudomonas aeruginosa PA01
cgaucgccgcggcgaagcguugc

SEQ ID NO: 3448180 - RNA, 17 nt, Pseudomonas aeruginosa PA01
cgaucgccucggccauc

SEQ ID NO: 3448181 - RNA, 12 nt, Pseudomonas aeruginosa PA01
cgaugaggcugu

SEQ ID NO: 3448182 - RNA, 14 nt, Pseudomonas aeruginosa PA01
cgaugaggcugucc

SEQ ID NO: 3448183 - RNA, 19 nt, Pseudomonas aeruginosa PA01
cgaugaggcuguccagcag

SEQ ID NO: 3448184 - RNA, 20 nt, Pseudomonas aeruginosa PA01
cgaugaggcuguccagcagg

SEQ ID NO: 3448185 - RNA, 21 nt, Pseudomonas aeruginosa PA01
cgaugauccacuugccgccgc

SEQ ID NO: 3448186 - RNA, 13 nt, Pseudomonas aeruginosa PA01
cgaugaucccgau

SEQ ID NO: 3448187 - RNA, 23 nt, Pseudomonas aeruginosa PA01
cgaugauccgcucgaucccggcg

SEQ ID NO: 3448188 - RNA, 15 nt, Pseudomonas aeruginosa PA01
cgaugaucggcagcc

SEQ ID NO: 3448189 - RNA, 18 nt, Pseudomonas aeruginosa PA01
cgaugaucgguucccgcc

SEQ ID NO: 3448190 - RNA, 19 nt, Pseudomonas aeruginosa PA01
cgaugaucuccgcgccggg

SEQ ID NO: 3448191 - RNA, 17 nt, Pseudomonas aeruginosa PA01
cgaugaucuggccaccc

SEQ ID NO: 3448192 - RNA, 12 nt, Pseudomonas aeruginosa PA01
cgaugaugccgc

SEQ ID NO: 3448193 - RNA, 14 nt, Pseudomonas aeruginosa PA01
cgaugaugccgccg

SEQ ID NO: 3448194 - RNA, 15 nt, Pseudomonas aeruginosa PA01
cgaugaugccgccgu

SEQ ID NO: 3448195 - RNA, 16 nt, Pseudomonas aeruginosa PA01
cgaugaugccgccguu

SEQ ID NO: 3448196 - RNA, 18 nt, Pseudomonas aeruginosa PA01
cgaugaugccgccguuga

SEQ ID NO: 3448197 - RNA, 20 nt, Pseudomonas aeruginosa PA01
cgaugauggucaacaccagc

SEQ ID NO: 3448198 - RNA, 23 nt, Pseudomonas aeruginosa PA01
cgaugauggucaacaccagcgcc

SEQ ID NO: 3448199 - RNA, 19 nt, Pseudomonas aeruginosa PA01
cgaugauggugcgguggaa

SEQ ID NO: 3448200 - RNA, 14 nt, Pseudomonas aeruginosa PA01
cgaugcacaggcgu

SEQ ID NO: 3448201 - RNA, 12 nt, Pseudomonas aeruginosa PA01
cgaugccaucga

SEQ ID NO: 3448202 - RNA, 18 nt, Pseudomonas aeruginosa PA01
cgaugccaucgaggccag

SEQ ID NO: 3448203 - RNA, 13 nt, Pseudomonas aeruginosa PA01
cgaugcccaccug

SEQ ID NO: 3448204 - RNA, 21 nt, Pseudomonas aeruginosa PA01
cgaugcccaccugaacgcgcc

SEQ ID NO: 3448205 - RNA, 22 nt, Pseudomonas aeruginosa PA01
cgaugcccagccagggccgcga

SEQ ID NO: 3448206 - RNA, 12 nt, Pseudomonas aeruginosa PA01
cgaugcccaggc

SEQ ID NO: 3448207 - RNA, 13 nt, Pseudomonas aeruginosa PA01
cgaugcccaggcc

SEQ ID NO: 3448208 - RNA, 15 nt, Pseudomonas aeruginosa PA01
cgaugcccaggccgc

SEQ ID NO: 3448209 - RNA, 16 nt, Pseudomonas aeruginosa PA01
cgaugcccaggccgcc

SEQ ID NO: 3448210 - RNA, 22 nt, Pseudomonas aeruginosa PA01
cgaugcccaggccgccgaucca

SEQ ID NO: 3448211 - RNA, 20 nt, Pseudomonas aeruginosa PA01
cgaugccccauccgacgccg

SEQ ID NO: 3448212 - RNA, 21 nt, Pseudomonas aeruginosa PA01
cgaugccccauccgacgccgg

SEQ ID NO: 3448213 - RNA, 14 nt, Pseudomonas aeruginosa PA01
cgaugcccgccagc

SEQ ID NO: 3448214 - RNA, 16 nt, Pseudomonas aeruginosa PA01
cgaugcccgccagcag

SEQ ID NO: 3448215 - RNA, 17 nt, Pseudomonas aeruginosa PA01
cgaugcccgccagcagg

SEQ ID NO: 3448216 - RNA, 14 nt, Pseudomonas aeruginosa PA01
cgaugcccgccucg

SEQ ID NO: 3448217 - RNA, 23 nt, Pseudomonas aeruginosa PA01
cgaugcccggcugguugccagca

SEQ ID NO: 3448218 - RNA, 11 nt, Pseudomonas aeruginosa PA01
cgaugcccucg

SEQ ID NO: 3448219 - RNA, 14 nt, Pseudomonas aeruginosa PA01
cgaugcccuggccg

SEQ ID NO: 3448220 - RNA, 23 nt, Pseudomonas aeruginosa PA01
cgaugcccuuggccagcgcggcg

SEQ ID NO: 3448221 - RNA, 20 nt, Pseudomonas aeruginosa PA01
cgaugccgaggaggaugccg

SEQ ID NO: 3448222 - RNA, 15 nt, Pseudomonas aeruginosa PA01
cgaugccgaucucgc

SEQ ID NO: 3448223 - RNA, 16 nt, Pseudomonas aeruginosa PA01
cgaugccgaucucgcc

SEQ ID NO: 3448224 - RNA, 15 nt, Pseudomonas aeruginosa PA01
cgaugccgaugccgc

SEQ ID NO: 3448225 - RNA, 16 nt, Pseudomonas aeruginosa PA01
cgaugccgaugccgcc

SEQ ID NO: 3448226 - RNA, 19 nt, Pseudomonas aeruginosa PA01
cgaugccgaugccgccgac

SEQ ID NO: 3448227 - RNA, 16 nt, Pseudomonas aeruginosa PA01
cgaugccgauggcgcc

SEQ ID NO: 3448228 - RNA, 20 nt, Pseudomonas aeruginosa PA01
cgaugccgauggcgccgccg

SEQ ID NO: 3448229 - RNA, 22 nt, Pseudomonas aeruginosa PA01
cgaugccgauggcgccgccgag

SEQ ID NO: 3448230 - RNA, 14 nt, Pseudomonas aeruginosa PA01
cgaugccgcaggca

SEQ ID NO: 3448231 - RNA, 15 nt, Pseudomonas aeruginosa PA01
cgaugccgcaggcau

SEQ ID NO: 3448232 - RNA, 17 nt, Pseudomonas aeruginosa PA01
cgaugccgcccagcacc

SEQ ID NO: 3448233 - RNA, 19 nt, Pseudomonas aeruginosa PA01
cgaugccgcccagcaccga

SEQ ID NO: 3448234 - RNA, 13 nt, Pseudomonas aeruginosa PA01
cgaugccgccgac

SEQ ID NO: 3448235 - RNA, 18 nt, Pseudomonas aeruginosa PA01
cgaugccgccgaccucgg

SEQ ID NO: 3448236 - RNA, 20 nt, Pseudomonas aeruginosa PA01
cgaugccgccgaccucggcc

SEQ ID NO: 3448237 - RNA, 14 nt, Pseudomonas aeruginosa PA01
cgaugccgccgccg

SEQ ID NO: 3448238 - RNA, 22 nt, Pseudomonas aeruginosa PA01
cgaugccgccgccgccccagca

SEQ ID NO: 3448239 - RNA, 15 nt, Pseudomonas aeruginosa PA01
cgaugccgccgggca

SEQ ID NO: 3448240 - RNA, 12 nt, Pseudomonas aeruginosa PA01
cgaugccgcgcc

SEQ ID NO: 3448241 - RNA, 18 nt, Pseudomonas aeruginosa PA01
cgaugccgcgccaggcgc

SEQ ID NO: 3448242 - RNA, 16 nt, Pseudomonas aeruginosa PA01
cgaugccgcgccggaa

SEQ ID NO: 3448243 - RNA, 17 nt, Pseudomonas aeruginosa PA01
cgaugccgcgcgccugg

SEQ ID NO: 3448244 - RNA, 18 nt, Pseudomonas aeruginosa PA01
cgaugccgcgcgccuggc

SEQ ID NO: 3448245 - RNA, 18 nt, Pseudomonas aeruginosa PA01
cgaugccggagagcagca

SEQ ID NO: 3448246 - RNA, 18 nt, Pseudomonas aeruginosa PA01
cgaugccggccggcagcg

SEQ ID NO: 3448247 - RNA, 17 nt, Pseudomonas aeruginosa PA01
cgaugccguucucggug

SEQ ID NO: 3448248 - RNA, 18 nt, Pseudomonas aeruginosa PA01
cgaugccguuguagcuga

SEQ ID NO: 3448249 - RNA, 16 nt, Pseudomonas aeruginosa PA01
cgaugccuucggcggc

SEQ ID NO: 3448250 - RNA, 19 nt, Pseudomonas aeruginosa PA01
cgaugccuugcggccccca

SEQ ID NO: 3448251 - RNA, 17 nt, Pseudomonas aeruginosa PA01
cgaugcgacgcacaccg

SEQ ID NO: 3448252 - RNA, 20 nt, Pseudomonas aeruginosa PA01
cgaugcgcaacgggcggcgg

SEQ ID NO: 3448253 - RNA, 22 nt, Pseudomonas aeruginosa PA01
cgaugcgcagcuugcucgaugc

SEQ ID NO: 3448254 - RNA, 15 nt, Pseudomonas aeruginosa PA01
cgaugcgcaggccgg

SEQ ID NO: 3448255 - RNA, 20 nt, Pseudomonas aeruginosa PA01
cgaugcgccccagcgccugg

SEQ ID NO: 3448256 - RNA, 22 nt, Pseudomonas aeruginosa PA01
cgaugcgccccagcgccugggc

SEQ ID NO: 3448257 - RNA, 14 nt, Pseudomonas aeruginosa PA01
cgaugcgccgacgc

SEQ ID NO: 3448258 - RNA, 13 nt, Pseudomonas aeruginosa PA01
cgaugcgcgacuc

SEQ ID NO: 3448259 - RNA, 19 nt, Pseudomonas aeruginosa PA01
cgaugcgcgacucgaagcu

SEQ ID NO: 3448260 - RNA, 21 nt, Pseudomonas aeruginosa PA01
cgaugcgcgugguaucggcgc

SEQ ID NO: 3448261 - RNA, 17 nt, Pseudomonas aeruginosa PA01
cgaugcggcccgccggc

SEQ ID NO: 3448262 - RNA, 17 nt, Pseudomonas aeruginosa PA01
cgaugcgguuccuggcu

SEQ ID NO: 3448263 - RNA, 18 nt, Pseudomonas aeruginosa PA01
cgaugcguuccagggcga

SEQ ID NO: 3448264 - RNA, 21 nt, Pseudomonas aeruginosa PA01
cgaugcguuugucgaccugcc

SEQ ID NO: 3448265 - RNA, 13 nt, Pseudomonas aeruginosa PA01
cgaugcucagcgc

SEQ ID NO: 3448266 - RNA, 14 nt, Pseudomonas aeruginosa PA01
cgaugcucagcgcc

SEQ ID NO: 3448267 - RNA, 15 nt, Pseudomonas aeruginosa PA01
cgaugcucagcgccg

SEQ ID NO: 3448268 - RNA, 19 nt, Pseudomonas aeruginosa PA01
cgaugcucagcgccggcca

SEQ ID NO: 3448269 - RNA, 15 nt, Pseudomonas aeruginosa PA01
cgaugcucgcgccag

SEQ ID NO: 3448270 - RNA, 22 nt, Pseudomonas aeruginosa PA01
cgaugcucgcgccagccccagg

SEQ ID NO: 3448271 - RNA, 23 nt, Pseudomonas aeruginosa PA01
cgaugcucggugugaucaccagc

SEQ ID NO: 3448272 - RNA, 19 nt, Pseudomonas aeruginosa PA01
cgaugcugaucacccgccc

SEQ ID NO: 3448273 - RNA, 20 nt, Pseudomonas aeruginosa PA01
cgaugcugaucacccgcccg

SEQ ID NO: 3448274 - RNA, 21 nt, Pseudomonas aeruginosa PA01
cgaugcugaucacccgcccgc

SEQ ID NO: 3448275 - RNA, 23 nt, Pseudomonas aeruginosa PA01
cgaugcugaucacccgcccgccg

SEQ ID NO: 3448276 - RNA, 18 nt, Pseudomonas aeruginosa PA01
cgaugcugaucuucuguc

SEQ ID NO: 3448277 - RNA, 18 nt, Pseudomonas aeruginosa PA01
cgaugcugccguagcgcu

SEQ ID NO: 3448278 - RNA, 21 nt, Pseudomonas aeruginosa PA01
cgaugcugcugaucaggagga

SEQ ID NO: 3448279 - RNA, 22 nt, Pseudomonas aeruginosa PA01
cgaugcugcugaucaggaggau

SEQ ID NO: 3448280 - RNA, 20 nt, Pseudomonas aeruginosa PA01
cgaugcuggcaacggcgggc

SEQ ID NO: 3448281 - RNA, 23 nt, Pseudomonas aeruginosa PA01
cgaugcuguaguugacgucgccg

SEQ ID NO: 3448282 - RNA, 18 nt, Pseudomonas aeruginosa PA01
cgaugcugugcagggagg

SEQ ID NO: 3448283 - RNA, 21 nt, Pseudomonas aeruginosa PA01
cgauuucagcuucaucgcgcc

SEQ ID NO: 3448284 - RNA, 21 nt, Pseudomonas aeruginosa PA01
cgauuuccccaaggcacgccc

SEQ ID NO: 3448285 - RNA, 13 nt, Pseudomonas aeruginosa PA01
cgauuucgcugcg

SEQ ID NO: 3448286 - RNA, 15 nt, Pseudomonas aeruginosa PA01
cgauuucgcugcgca

SEQ ID NO: 3448287 - RNA, 16 nt, Pseudomonas aeruginosa PA01
cgcaaacccccugcgc

SEQ ID NO: 3448288 - RNA, 19 nt, Pseudomonas aeruginosa PA01
cgcaaaccggcagcaucuc

SEQ ID NO: 3448289 - RNA, 23 nt, Pseudomonas aeruginosa PA01
cgcaaagcgagcgcccgccguca

SEQ ID NO: 3448290 - RNA, 19 nt, Pseudomonas aeruginosa PA01
cgcaaagcucgcgcaagcg

SEQ ID NO: 3448291 - RNA, 17 nt, Pseudomonas aeruginosa PA01
cgcaaaggucggcgaag

SEQ ID NO: 3448292 - RNA, 18 nt, Pseudomonas aeruginosa PA01
cgcaaaggucggcgaagg

SEQ ID NO: 3448293 - RNA, 18 nt, Pseudomonas aeruginosa PA01
cgcaacaccuguaccuac

SEQ ID NO: 3448294 - RNA, 22 nt, Pseudomonas aeruginosa PA01
cgcaacaccuugcgcaccgccu

SEQ ID NO: 3448295 - RNA, 16 nt, Pseudomonas aeruginosa PA01
cgcaaccagaccagca

SEQ ID NO: 3448296 - RNA, 13 nt, Pseudomonas aeruginosa PA01
cgcaaccagcccu

SEQ ID NO: 3448297 - RNA, 17 nt, Pseudomonas aeruginosa PA01
cgcaaccagcccuggcg

SEQ ID NO: 3448298 - RNA, 19 nt, Pseudomonas aeruginosa PA01
cgcaaccagcccuggcgca

SEQ ID NO: 3448299 - RNA, 21 nt, Pseudomonas aeruginosa PA01
cgcaaccagcccuggcgcaga

SEQ ID NO: 3448300 - RNA, 20 nt, Pseudomonas aeruginosa PA01
cgcaaccccuucggucgcgc

SEQ ID NO: 3448301 - RNA, 18 nt, Pseudomonas aeruginosa PA01
cgcaacccgcccggcuca

SEQ ID NO: 3448302 - RNA, 14 nt, Pseudomonas aeruginosa PA01
cgcaaccgcccgag

SEQ ID NO: 3448303 - RNA, 14 nt, Pseudomonas aeruginosa PA01
cgcaaccgcugccg

SEQ ID NO: 3448304 - RNA, 18 nt, Pseudomonas aeruginosa PA01
cgcaaccgcugccgccgu

SEQ ID NO: 3448305 - RNA, 23 nt, Pseudomonas aeruginosa PA01
cgcaaccgguuucccucgagcac

SEQ ID NO: 3448306 - RNA, 15 nt, Pseudomonas aeruginosa PA01
cgcaaccguuccagc

SEQ ID NO: 3448307 - RNA, 19 nt, Pseudomonas aeruginosa PA01
cgcaaccguuccagcgccu

SEQ ID NO: 3448308 - RNA, 13 nt, Pseudomonas aeruginosa PA01
cgcaacgccgacg

SEQ ID NO: 3448309 - RNA, 15 nt, Pseudomonas aeruginosa PA01
cgcaacgcgcgcagg

SEQ ID NO: 3448310 - RNA, 17 nt, Pseudomonas aeruginosa PA01
cgcaacgcgcgcaggac

SEQ ID NO: 3448311 - RNA, 21 nt, Pseudomonas aeruginosa PA01
cgcaacgcgguuauccgccgc

SEQ ID NO: 3448312 - RNA, 23 nt, Pseudomonas aeruginosa PA01
cgcaacgcgguuauccgccgcug

SEQ ID NO: 3448313 - RNA, 19 nt, Pseudomonas aeruginosa PA01
cgcaacgcuuccagcaccu

SEQ ID NO: 3448314 - RNA, 21 nt, Pseudomonas aeruginosa PA01
cgcaacgcuuccagcaccucc

SEQ ID NO: 3448315 - RNA, 12 nt, Pseudomonas aeruginosa PA01
cgcaacggcagc

SEQ ID NO: 3448316 - RNA, 17 nt, Pseudomonas aeruginosa PA01
cgcaacgggacgccagg

SEQ ID NO: 3448317 - RNA, 20 nt, Pseudomonas aeruginosa PA01
cgcaacgggacgccaggcgu

SEQ ID NO: 3448318 - RNA, 21 nt, Pseudomonas aeruginosa PA01
cgcaacgggacgccaggcguc

SEQ ID NO: 3448319 - RNA, 14 nt, Pseudomonas aeruginosa PA01
cgcaacgggcggcg

SEQ ID NO: 3448320 - RNA, 19 nt, Pseudomonas aeruginosa PA01
cgcaacugccggucggccu

SEQ ID NO: 3448321 - RNA, 16 nt, Pseudomonas aeruginosa PA01
cgcaacugcgccagcc

SEQ ID NO: 3448322 - RNA, 17 nt, Pseudomonas aeruginosa PA01
cgcaacugcgccagccg

SEQ ID NO: 3448323 - RNA, 12 nt, Pseudomonas aeruginosa PA01
cgcaacugcggg

SEQ ID NO: 3448324 - RNA, 21 nt, Pseudomonas aeruginosa PA01
cgcaacugcggggcgcucagg

SEQ ID NO: 3448325 - RNA, 15 nt, Pseudomonas aeruginosa PA01
cgcaagcccaagggc

SEQ ID NO: 3448326 - RNA, 15 nt, Pseudomonas aeruginosa PA01
cgcaagcgcccggcg

SEQ ID NO: 3448327 - RNA, 18 nt, Pseudomonas aeruginosa PA01
cgcaagcgcccggcgaac

SEQ ID NO: 3448328 - RNA, 13 nt, Pseudomonas aeruginosa PA01
cgcaagcgcucgg

SEQ ID NO: 3448329 - RNA, 18 nt, Pseudomonas aeruginosa PA01
cgcaagcgcucggccugc

SEQ ID NO: 3448330 - RNA, 13 nt, Pseudomonas aeruginosa PA01
cgcaagcggcggc

SEQ ID NO: 3448331 - RNA, 23 nt, Pseudomonas aeruginosa PA01
cgcaagcggcggcuucagccaga

SEQ ID NO: 3448332 - RNA, 20 nt, Pseudomonas aeruginosa PA01
cgcaagcgguuauucgcccc

SEQ ID NO: 3448333 - RNA, 21 nt, Pseudomonas aeruginosa PA01
cgcaagcgguuauucgcccca

SEQ ID NO: 3448334 - RNA, 20 nt, Pseudomonas aeruginosa PA01
cgcaagcgguuauucgcccu

SEQ ID NO: 3448335 - RNA, 18 nt, Pseudomonas aeruginosa PA01
cgcaagcuccccgccgcc

SEQ ID NO: 3448336 - RNA, 19 nt, Pseudomonas aeruginosa PA01
cgcaagcucgucacccgcg

SEQ ID NO: 3448337 - RNA, 16 nt, Pseudomonas aeruginosa PA01
cgcaagcuuuuccgaa

SEQ ID NO: 3448338 - RNA, 17 nt, Pseudomonas aeruginosa PA01
cgcaaggaacuggaagc

SEQ ID NO: 3448339 - RNA, 18 nt, Pseudomonas aeruginosa PA01
cgcaaggaacuggaagcc

SEQ ID NO: 3448340 - RNA, 13 nt, Pseudomonas aeruginosa PA01
cgcaaggccaggg

SEQ ID NO: 3448341 - RNA, 20 nt, Pseudomonas aeruginosa PA01
cgcaaggccagggcggcgcc

SEQ ID NO: 3448342 - RNA, 16 nt, Pseudomonas aeruginosa PA01
cgcaagggcgccgccg

SEQ ID NO: 3448343 - RNA, 19 nt, Pseudomonas aeruginosa PA01
cgcaagggcgccgccgacg

SEQ ID NO: 3448344 - RNA, 19 nt, Pseudomonas aeruginosa PA01
cgcaagggugcucaggacg

SEQ ID NO: 3448345 - RNA, 17 nt, Pseudomonas aeruginosa PA01
cgcaaggugcgggccgu

SEQ ID NO: 3448346 - RNA, 19 nt, Pseudomonas aeruginosa PA01
cgcaaggugcgggccgucg

SEQ ID NO: 3448347 - RNA, 20 nt, Pseudomonas aeruginosa PA01
cgcaaggugcgggccgucgu

SEQ ID NO: 3448348 - RNA, 18 nt, Pseudomonas aeruginosa PA01
cgcaaguaccgccggcag

SEQ ID NO: 3448349 - RNA, 15 nt, Pseudomonas aeruginosa PA01
cgcaagucggccugc

SEQ ID NO: 3448350 - RNA, 21 nt, Pseudomonas aeruginosa PA01
cgcaagucggccugcaccagc

SEQ ID NO: 3448351 - RNA, 22 nt, Pseudomonas aeruginosa PA01
cgcaagucggccugcaccagcc

SEQ ID NO: 3448352 - RNA, 17 nt, Pseudomonas aeruginosa PA01
cgcaagugcccugggcg

SEQ ID NO: 3448353 - RNA, 21 nt, Pseudomonas aeruginosa PA01
cgcaagugcccugggcgaaca

SEQ ID NO: 3448354 - RNA, 15 nt, Pseudomonas aeruginosa PA01
cgcaaguggcggcug

SEQ ID NO: 3448355 - RNA, 17 nt, Pseudomonas aeruginosa PA01
cgcaaguuacgcgcagc

SEQ ID NO: 3448356 - RNA, 18 nt, Pseudomonas aeruginosa PA01
cgcaaguuacgcgcagcg

SEQ ID NO: 3448357 - RNA, 23 nt, Pseudomonas aeruginosa PA01
cgcaauacaccgcugcgccgccg

SEQ ID NO: 3448358 - RNA, 17 nt, Pseudomonas aeruginosa PA01
cgcaauagugcagcucc

SEQ ID NO: 3448359 - RNA, 14 nt, Pseudomonas aeruginosa PA01
cgcaaucagggcug

SEQ ID NO: 3448360 - RNA, 22 nt, Pseudomonas aeruginosa PA01
cgcaaucagggcugggcgcccu

SEQ ID NO: 3448361 - RNA, 18 nt, Pseudomonas aeruginosa PA01
cgcaauccgccgcucccg

SEQ ID NO: 3448362 - RNA, 22 nt, Pseudomonas aeruginosa PA01
cgcaauccucggugcgcacgca

SEQ ID NO: 3448363 - RNA, 17 nt, Pseudomonas aeruginosa PA01
cgcaauggcgcagccgc

SEQ ID NO: 3448364 - RNA, 18 nt, Pseudomonas aeruginosa PA01
cgcacaaaaaagcccgcc

SEQ ID NO: 3448365 - RNA, 19 nt, Pseudomonas aeruginosa PA01
cgcacaaaaaagcccgcca

SEQ ID NO: 3448366 - RNA, 20 nt, Pseudomonas aeruginosa PA01
cgcacaaaaaagcccgccag

SEQ ID NO: 3448367 - RNA, 17 nt, Pseudomonas aeruginosa PA01
cgcacacggucgagacc

SEQ ID NO: 3448368 - RNA, 16 nt, Pseudomonas aeruginosa PA01
cgcacaggcuggccag

SEQ ID NO: 3448369 - RNA, 17 nt, Pseudomonas aeruginosa PA01
cgcacaggcuggccaga

SEQ ID NO: 3448370 - RNA, 13 nt, Pseudomonas aeruginosa PA01
cgcacagguagag

SEQ ID NO: 3448371 - RNA, 17 nt, Pseudomonas aeruginosa PA01
cgcacaguacgccuugc

SEQ ID NO: 3448372 - RNA, 21 nt, Pseudomonas aeruginosa PA01
cgcacaguugcgcgccggcgg

SEQ ID NO: 3448373 - RNA, 13 nt, Pseudomonas aeruginosa PA01
cgcacaucacccg

SEQ ID NO: 3448374 - RNA, 22 nt, Pseudomonas aeruginosa PA01
cgcacaucacccgguucucgcc

SEQ ID NO: 3448375 - RNA, 13 nt, Pseudomonas aeruginosa PA01
cgcaccacaucuu

SEQ ID NO: 3448376 - RNA, 13 nt, Pseudomonas aeruginosa PA01
cgcaccacccauc

SEQ ID NO: 3448377 - RNA, 22 nt, Pseudomonas aeruginosa PA01
cgcaccacccaucugccggcca

SEQ ID NO: 3448378 - RNA, 15 nt, Pseudomonas aeruginosa PA01
cgcaccacguagccg

SEQ ID NO: 3448379 - RNA, 13 nt, Pseudomonas aeruginosa PA01
cgcaccagcacuu

SEQ ID NO: 3448380 - RNA, 21 nt, Pseudomonas aeruginosa PA01
cgcaccagcacuuccggcgcg

SEQ ID NO: 3448381 - RNA, 13 nt, Pseudomonas aeruginosa PA01
cgcaccagcaggc

SEQ ID NO: 3448382 - RNA, 14 nt, Pseudomonas aeruginosa PA01
cgcaccagcaggcc

SEQ ID NO: 3448383 - RNA, 13 nt, Pseudomonas aeruginosa PA01
cgcaccagccagc

SEQ ID NO: 3448384 - RNA, 12 nt, Pseudomonas aeruginosa PA01
cgcaccagccgg

SEQ ID NO: 3448385 - RNA, 22 nt, Pseudomonas aeruginosa PA01
cgcacugguggcgaacagcacc

SEQ ID NO: 3448386 - RNA, 23 nt, Pseudomonas aeruginosa PA01
cgcacugguggcgaacagcaccu

SEQ ID NO: 3448387 - RNA, 15 nt, Pseudomonas aeruginosa PA01
cgcacugguugaagc

SEQ ID NO: 3448388 - RNA, 14 nt, Pseudomonas aeruginosa PA01
cgcacuuccaggcg

SEQ ID NO: 3448389 - RNA, 13 nt, Pseudomonas aeruginosa PA01
cgcacuuccaggu

SEQ ID NO: 3448390 - RNA, 16 nt, Pseudomonas aeruginosa PA01
cgcacuuccucggcga

SEQ ID NO: 3448391 - RNA, 23 nt, Pseudomonas aeruginosa PA01
cgcacuuccucggcgaccaccgc

SEQ ID NO: 3448392 - RNA, 17 nt, Pseudomonas aeruginosa PA01
cgcacuucguccgccac

SEQ ID NO: 3448393 - RNA, 19 nt, Pseudomonas aeruginosa PA01
cgcagaaccagacgcucgg

SEQ ID NO: 3448394 - RNA, 23 nt, Pseudomonas aeruginosa PA01
cgcagaaccagacgcucggccag

SEQ ID NO: 3448395 - RNA, 21 nt, Pseudomonas aeruginosa PA01
cgcagaacugccgggccagcu

SEQ ID NO: 3448396 - RNA, 21 nt, Pseudomonas aeruginosa PA01
cgcagaaggcgcuuucguagg

SEQ ID NO: 3448397 - RNA, 22 nt, Pseudomonas aeruginosa PA01
cgcagaaggcgcuuucguaggg

SEQ ID NO: 3448398 - RNA, 16 nt, Pseudomonas aeruginosa PA01
cgcagacaggccucca

SEQ ID NO: 3448399 - RNA, 17 nt, Pseudomonas aeruginosa PA01
cgcagacaucgccgagg

SEQ ID NO: 3448400 - RNA, 20 nt, Pseudomonas aeruginosa PA01
cgcagacaucgccgagggcg

SEQ ID NO: 3448401 - RNA, 12 nt, Pseudomonas aeruginosa PA01
cgcagaccagcg

SEQ ID NO: 3448402 - RNA, 21 nt, Pseudomonas aeruginosa PA01
cgcagaccagcgaaccgccgg

SEQ ID NO: 3448403 - RNA, 22 nt, Pseudomonas aeruginosa PA01
cgcagaccagcgaaccgccggc

SEQ ID NO: 3448404 - RNA, 23 nt, Pseudomonas aeruginosa PA01
cgcagaccagcgaaccgccggcc

SEQ ID NO: 3448405 - RNA, 20 nt, Pseudomonas aeruginosa PA01
cgcagacgaucuccugcugg

SEQ ID NO: 3448406 - RNA, 16 nt, Pseudomonas aeruginosa PA01
cgcagacgauugaccu

SEQ ID NO: 3448407 - RNA, 18 nt, Pseudomonas aeruginosa PA01
cgcagacgauugaccucc

SEQ ID NO: 3448408 - RNA, 20 nt, Pseudomonas aeruginosa PA01
cgcagacgauugaccucccg

SEQ ID NO: 3448409 - RNA, 23 nt, Pseudomonas aeruginosa PA01
cgcagacgauugaccucccgcgc

SEQ ID NO: 3448410 - RNA, 14 nt, Pseudomonas aeruginosa PA01
cgcagacgggugcu

SEQ ID NO: 3448411 - RNA, 18 nt, Pseudomonas aeruginosa PA01
cgcagacgggugcugaag

SEQ ID NO: 3448412 - RNA, 19 nt, Pseudomonas aeruginosa PA01
cgcagacgucuuccgggac

SEQ ID NO: 3448413 - RNA, 22 nt, Pseudomonas aeruginosa PA01
cgcagacguggcauucgucgcc

SEQ ID NO: 3448414 - RNA, 23 nt, Pseudomonas aeruginosa PA01
cgcagacguggcauucgucgccg

SEQ ID NO: 3448415 - RNA, 24 nt, Pseudomonas aeruginosa PA01
cgcagacguggcauucgucgccgc

SEQ ID NO: 3448416 - RNA, 15 nt, Pseudomonas aeruginosa PA01
cgcagacuccggcgc

SEQ ID NO: 3448417 - RNA, 16 nt, Pseudomonas aeruginosa PA01
cgcagacuccggcgca

SEQ ID NO: 3448418 - RNA, 18 nt, Pseudomonas aeruginosa PA01
cgcagacuccggcgcagc

SEQ ID NO: 3448419 - RNA, 20 nt, Pseudomonas aeruginosa PA01
cgcagacuccggcgcagccc

SEQ ID NO: 3448420 - RNA, 16 nt, Pseudomonas aeruginosa PA01
cgcagagacgcagcgc

SEQ ID NO: 3448421 - RNA, 18 nt, Pseudomonas aeruginosa PA01
cgcagagacgcagcgcua

SEQ ID NO: 3448422 - RNA, 13 nt, Pseudomonas aeruginosa PA01
cgcagagaucggc

SEQ ID NO: 3448423 - RNA, 16 nt, Pseudomonas aeruginosa PA01
cgcagagaucggcggc

SEQ ID NO: 3448424 - RNA, 17 nt, Pseudomonas aeruginosa PA01
cgcagagaucggcggcg

SEQ ID NO: 3448425 - RNA, 18 nt, Pseudomonas aeruginosa PA01
cgcagagaucggcggcgc

SEQ ID NO: 3448426 - RNA, 17 nt, Pseudomonas aeruginosa PA01
cgcagagcaucacccgc

SEQ ID NO: 3448427 - RNA, 18 nt, Pseudomonas aeruginosa PA01
cgcagagcaucacccgcg

SEQ ID NO: 3448428 - RNA, 13 nt, Pseudomonas aeruginosa PA01
cgcagagccagcc

SEQ ID NO: 3448429 - RNA, 17 nt, Pseudomonas aeruginosa PA01
cgcagagccagccgcag

SEQ ID NO: 3448430 - RNA, 18 nt, Pseudomonas aeruginosa PA01
cgcagagccagccgcagc

SEQ ID NO: 3448431 - RNA, 20 nt, Pseudomonas aeruginosa PA01
cgcagagccagccgcagccc

SEQ ID NO: 3448432 - RNA, 16 nt, Pseudomonas aeruginosa PA01
cgcagagcgccagcca

SEQ ID NO: 3448433 - RNA, 19 nt, Pseudomonas aeruginosa PA01
cgcagagcgccagccagcg

SEQ ID NO: 3448434 - RNA, 16 nt, Pseudomonas aeruginosa PA01
cgcagagcggcaggcc

SEQ ID NO: 3448435 - RNA, 22 nt, Pseudomonas aeruginosa PA01
cgcagagcggcaggccgccgau

SEQ ID NO: 3448436 - RNA, 13 nt, Pseudomonas aeruginosa PA01
cgcagagcgguga

SEQ ID NO: 3448437 - RNA, 21 nt, Pseudomonas aeruginosa PA01
cgcagagcggugaaaccggca

SEQ ID NO: 3448438 - RNA, 12 nt, Pseudomonas aeruginosa PA01
cgcagaggcgcu

SEQ ID NO: 3448439 - RNA, 13 nt, Pseudomonas aeruginosa PA01
cgcagaggcgcuc

SEQ ID NO: 3448440 - RNA, 13 nt, Pseudomonas aeruginosa PA01
cgcagagggcgau

SEQ ID NO: 3448441 - RNA, 14 nt, Pseudomonas aeruginosa PA01
cgcagauagaggcg

SEQ ID NO: 3448442 - RNA, 16 nt, Pseudomonas aeruginosa PA01
cgcagauagaggcguu

SEQ ID NO: 3448443 - RNA, 18 nt, Pseudomonas aeruginosa PA01
cgcagauagggcaucagc

SEQ ID NO: 3448444 - RNA, 14 nt, Pseudomonas aeruginosa PA01
cgcagaucgccgcg

SEQ ID NO: 3448445 - RNA, 15 nt, Pseudomonas aeruginosa PA01
cgcagaucgccgcgu

SEQ ID NO: 3448446 - RNA, 20 nt, Pseudomonas aeruginosa PA01
cgcagaucgcggcgcaggcu

SEQ ID NO: 3448447 - RNA, 17 nt, Pseudomonas aeruginosa PA01
cgcagaucgcguccagg

SEQ ID NO: 3448448 - RNA, 22 nt, Pseudomonas aeruginosa PA01
cgcagaucgcguccagggugcu

SEQ ID NO: 3448449 - RNA, 18 nt, Pseudomonas aeruginosa PA01
cgcagaugaucgccaccg

SEQ ID NO: 3448450 - RNA, 19 nt, Pseudomonas aeruginosa PA01
cgcagaugcggggcgacca

SEQ ID NO: 3448451 - RNA, 21 nt, Pseudomonas aeruginosa PA01
cgcagaugcggggcgaccagc

SEQ ID NO: 3448452 - RNA, 13 nt, Pseudomonas aeruginosa PA01
cgcagaugcucca

SEQ ID NO: 3448453 - RNA, 14 nt, Pseudomonas aeruginosa PA01
cgcagaugcuccag

SEQ ID NO: 3448454 - RNA, 19 nt, Pseudomonas aeruginosa PA01
cgcagaugucggucaugcc

SEQ ID NO: 3448455 - RNA, 15 nt, Pseudomonas aeruginosa PA01
cgcagcaacgcgacg

SEQ ID NO: 3448456 - RNA, 15 nt, Pseudomonas aeruginosa PA01
cgcagcaacuggucg

SEQ ID NO: 3448457 - RNA, 20 nt, Pseudomonas aeruginosa PA01
cgcagcaacuggucgccgca

SEQ ID NO: 3448458 - RNA, 21 nt, Pseudomonas aeruginosa PA01
cgcagcaacuggucgccgcag

SEQ ID NO: 3448459 - RNA, 20 nt, Pseudomonas aeruginosa PA01
cgcagcaagucgaacaggcc

SEQ ID NO: 3448460 - RNA, 16 nt, Pseudomonas aeruginosa PA01
cgcagcaccacauggg

SEQ ID NO: 3448461 - RNA, 15 nt, Pseudomonas aeruginosa PA01
cgcagcacccggucg

SEQ ID NO: 3448462 - RNA, 16 nt, Pseudomonas aeruginosa PA01
cgcagcacccggucga

SEQ ID NO: 3448463 - RNA, 11 nt, Pseudomonas aeruginosa PA01
cgcagcaccgg

SEQ ID NO: 3448464 - RNA, 13 nt, Pseudomonas aeruginosa PA01
cgcagcaccggcu

SEQ ID NO: 3448465 - RNA, 15 nt, Pseudomonas aeruginosa PA01
cgcagcaccggcuug

SEQ ID NO: 3448466 - RNA, 15 nt, Pseudomonas aeruginosa PA01
cgcagcacggcggcu

SEQ ID NO: 3448467 - RNA, 13 nt, Pseudomonas aeruginosa PA01
cgcagcagcaggu

SEQ ID NO: 3448468 - RNA, 12 nt, Pseudomonas aeruginosa PA01
cgcagcagcaug

SEQ ID NO: 3448469 - RNA, 21 nt, Pseudomonas aeruginosa PA01
cgcagcagcaugaugccgagg

SEQ ID NO: 3448470 - RNA, 14 nt, Pseudomonas aeruginosa PA01
cgcagcagcgccag

SEQ ID NO: 3448471 - RNA, 13 nt, Pseudomonas aeruginosa PA01
cgcagcagcggca

SEQ ID NO: 3448472 - RNA, 13 nt, Pseudomonas aeruginosa PA01
cgcagcagcggcg

SEQ ID NO: 3448473 - RNA, 15 nt, Pseudomonas aeruginosa PA01
cgcagcagcggcgac

SEQ ID NO: 3448474 - RNA, 13 nt, Pseudomonas aeruginosa PA01
cgcagcagcgucg

SEQ ID NO: 3448475 - RNA, 23 nt, Pseudomonas aeruginosa PA01
cgcagcagcgucgcgucggccug

SEQ ID NO: 3448476 - RNA, 13 nt, Pseudomonas aeruginosa PA01
cgcagcagcucgu

SEQ ID NO: 3448477 - RNA, 18 nt, Pseudomonas aeruginosa PA01
cgcagcagcucguccaug

SEQ ID NO: 3448478 - RNA, 21 nt, Pseudomonas aeruginosa PA01
cgcagcagcuucggcgcgacg

SEQ ID NO: 3448479 - RNA, 13 nt, Pseudomonas aeruginosa PA01
cgcagcaggaucu

SEQ ID NO: 3448480 - RNA, 13 nt, Pseudomonas aeruginosa PA01
cgcagcaggccgc

SEQ ID NO: 3448481 - RNA, 21 nt, Pseudomonas aeruginosa PA01
cgcagcaggccgcuggcgacg

SEQ ID NO: 3448482 - RNA, 14 nt, Pseudomonas aeruginosa PA01
cgcagcaggcgacg

SEQ ID NO: 3448483 - RNA, 19 nt, Pseudomonas aeruginosa PA01
cgcagcaggcgacggucag

SEQ ID NO: 3448484 - RNA, 21 nt, Pseudomonas aeruginosa PA01
cgcagcaggcguucggcgaug

SEQ ID NO: 3448485 - RNA, 14 nt, Pseudomonas aeruginosa PA01
cgcagcagggcguc

SEQ ID NO: 3448486 - RNA, 14 nt, Pseudomonas aeruginosa PA01
cgcagcagguagug

SEQ ID NO: 3448487 - RNA, 22 nt, Pseudomonas aeruginosa PA01
cgcagcagguagugcggcgggc

SEQ ID NO: 3448488 - RNA, 12 nt, Pseudomonas aeruginosa PA01
cgcagcguucca

SEQ ID NO: 3448489 - RNA, 21 nt, Pseudomonas aeruginosa PA01
cgcagcuaggcgaggaucgcu

SEQ ID NO: 3448490 - RNA, 13 nt, Pseudomonas aeruginosa PA01
cgcagcuccagcg

SEQ ID NO: 3448491 - RNA, 13 nt, Pseudomonas aeruginosa PA01
cgcagcuccggca

SEQ ID NO: 3448492 - RNA, 14 nt, Pseudomonas aeruginosa PA01
cgcagcuccggcag

SEQ ID NO: 3448493 - RNA, 17 nt, Pseudomonas aeruginosa PA01
cgcagcuccggcagcag

SEQ ID NO: 3448494 - RNA, 18 nt, Pseudomonas aeruginosa PA01
cgcagcuccggcagcagg

SEQ ID NO: 3448495 - RNA, 15 nt, Pseudomonas aeruginosa PA01
cgcagcucggccaac

SEQ ID NO: 3448496 - RNA, 18 nt, Pseudomonas aeruginosa PA01
cgcagcucggccaacugg

SEQ ID NO: 3448497 - RNA, 15 nt, Pseudomonas aeruginosa PA01
cgcagcucggccucg

SEQ ID NO: 3448498 - RNA, 16 nt, Pseudomonas aeruginosa PA01
cgcagcucggugagca

SEQ ID NO: 3448499 - RNA, 21 nt, Pseudomonas aeruginosa PA01
cgcagcucggugagcaggcgc

SEQ ID NO: 3448500 - RNA, 20 nt, Pseudomonas aeruginosa PA01
cgcagcucugcgaucagggc

SEQ ID NO: 3448501 - RNA, 18 nt, Pseudomonas aeruginosa PA01
cgcagcugguaggagccg

SEQ ID NO: 3448502 - RNA, 22 nt, Pseudomonas aeruginosa PA01
cgcagcuugccuuccaggcugu

SEQ ID NO: 3448503 - RNA, 21 nt, Pseudomonas aeruginosa PA01
cgcagcuugcucgaugccauc

SEQ ID NO: 3448504 - RNA, 13 nt, Pseudomonas aeruginosa PA01
cgcaggaaacccc

SEQ ID NO: 3448505 - RNA, 19 nt, Pseudomonas aeruginosa PA01
cgcaggaaaccccucggcu

SEQ ID NO: 3448506 - RNA, 16 nt, Pseudomonas aeruginosa PA01
cgcaggaacagcuccu

SEQ ID NO: 3448507 - RNA, 21 nt, Pseudomonas aeruginosa PA01
cgcaggaacagcuccuccagc

SEQ ID NO: 3448508 - RNA, 15 nt, Pseudomonas aeruginosa PA01
cgcaggaaccgacgc

SEQ ID NO: 3448509 - RNA, 17 nt, Pseudomonas aeruginosa PA01
cgcaggaaccgacgcgc

SEQ ID NO: 3448510 - RNA, 18 nt, Pseudomonas aeruginosa PA01
cgcaggaaccgacgcgca

SEQ ID NO: 3448511 - RNA, 21 nt, Pseudomonas aeruginosa PA01
cgcaggaaccgacgcgcagga

SEQ ID NO: 3448512 - RNA, 19 nt, Pseudomonas aeruginosa PA01
cgcaggaagaaggcgucca

SEQ ID NO: 3448513 - RNA, 23 nt, Pseudomonas aeruginosa PA01
cgcaggaagaaggcguccagggc

SEQ ID NO: 3448514 - RNA, 12 nt, Pseudomonas aeruginosa PA01
cgcaggaccgcc

SEQ ID NO: 3448515 - RNA, 19 nt, Pseudomonas aeruginosa PA01
cgcaggaccgccauggcgc

SEQ ID NO: 3448516 - RNA, 20 nt, Pseudomonas aeruginosa PA01
cgcaggaccuggcugaggcg

SEQ ID NO: 3448517 - RNA, 22 nt, Pseudomonas aeruginosa PA01
cgcaggaccuggcugaggcguu

SEQ ID NO: 3448518 - RNA, 23 nt, Pseudomonas aeruginosa PA01
cgcaggacgaggaaggcgcgcac

SEQ ID NO: 3448519 - RNA, 22 nt, Pseudomonas aeruginosa PA01
cgcaggacggauaacggcagcc

SEQ ID NO: 3448520 - RNA, 18 nt, Pseudomonas aeruginosa PA01
cgcaggacgucguagcca

SEQ ID NO: 3448521 - RNA, 22 nt, Pseudomonas aeruginosa PA01
cgcaggacgucguagccaggca

SEQ ID NO: 3448522 - RNA, 16 nt, Pseudomonas aeruginosa PA01
cgcaggagucgacgaa

SEQ ID NO: 3448523 - RNA, 17 nt, Pseudomonas aeruginosa PA01
cgcaggauagaugcguc

SEQ ID NO: 3448524 - RNA, 21 nt, Pseudomonas aeruginosa PA01
cgcaggauagaugcguccguu

SEQ ID NO: 3448525 - RNA, 18 nt, Pseudomonas aeruginosa PA01
cgcaggaugccgccugcg

SEQ ID NO: 3448526 - RNA, 18 nt, Pseudomonas aeruginosa PA01
cgcaggauguugaacagg

SEQ ID NO: 3448527 - RNA, 13 nt, Pseudomonas aeruginosa PA01
cgcaggcagcaca

SEQ ID NO: 3448528 - RNA, 22 nt, Pseudomonas aeruginosa PA01
cgcaggcagcacaugccacgca

SEQ ID NO: 3448529 - RNA, 15 nt, Pseudomonas aeruginosa PA01
cgcaggcaggucgcu

SEQ ID NO: 3448530 - RNA, 15 nt, Pseudomonas aeruginosa PA01
cgcaggcaguggcgc

SEQ ID NO: 3448531 - RNA, 20 nt, Pseudomonas aeruginosa PA01
cgcaggcaguggcgccagcc

SEQ ID NO: 3448532 - RNA, 17 nt, Pseudomonas aeruginosa PA01
cgcaggcauuggaagug

SEQ ID NO: 3448533 - RNA, 19 nt, Pseudomonas aeruginosa PA01
cgcaggccagcgccagggg

SEQ ID NO: 3448534 - RNA, 14 nt, Pseudomonas aeruginosa PA01
cgcaggccaggcgc

SEQ ID NO: 3448535 - RNA, 18 nt, Pseudomonas aeruginosa PA01
cgcaggcccuugagggug

SEQ ID NO: 3448536 - RNA, 17 nt, Pseudomonas aeruginosa PA01
cgcaggccgaccucggc

SEQ ID NO: 3448537 - RNA, 18 nt, Pseudomonas aeruginosa PA01
cgcaggccgaccucggcg

SEQ ID NO: 3448538 - RNA, 13 nt, Pseudomonas aeruginosa PA01
cgcaggccgccgg

SEQ ID NO: 3448539 - RNA, 15 nt, Pseudomonas aeruginosa PA01
cgcaggccgccggcg

SEQ ID NO: 3448540 - RNA, 18 nt, Pseudomonas aeruginosa PA01
cgcaggccgccggcggcc

SEQ ID NO: 3448541 - RNA, 19 nt, Pseudomonas aeruginosa PA01
cgcaggccgccggcggcca

SEQ ID NO: 3448542 - RNA, 22 nt, Pseudomonas aeruginosa PA01
cgcaggccgccggcggccaggg

SEQ ID NO: 3448543 - RNA, 12 nt, Pseudomonas aeruginosa PA01
cgcaggccgcug

SEQ ID NO: 3448544 - RNA, 13 nt, Pseudomonas aeruginosa PA01
cgcaggccgcugc

SEQ ID NO: 3448545 - RNA, 14 nt, Pseudomonas aeruginosa PA01
cgcaggccggccag

SEQ ID NO: 3448546 - RNA, 11 nt, Pseudomonas aeruginosa PA01
cgcaggccggg

SEQ ID NO: 3448547 - RNA, 17 nt, Pseudomonas aeruginosa PA01
cgcaggccgggaaugga

SEQ ID NO: 3448548 - RNA, 17 nt, Pseudomonas aeruginosa PA01
cgcaggccgggcggacg

SEQ ID NO: 3448549 - RNA, 23 nt, Pseudomonas aeruginosa PA01
cgcaggccggugaucucgcggcg

SEQ ID NO: 3448550 - RNA, 22 nt, Pseudomonas aeruginosa PA01
cgcaggccuucgacuucgacga

SEQ ID NO: 3448551 - RNA, 15 nt, Pseudomonas aeruginosa PA01
cgcaggcgaacugcc

SEQ ID NO: 3448552 - RNA, 13 nt, Pseudomonas aeruginosa PA01
cgcaggcgaggau

SEQ ID NO: 3448553 - RNA, 17 nt, Pseudomonas aeruginosa PA01
cgcaggcgaugaucagc

SEQ ID NO: 3448554 - RNA, 18 nt, Pseudomonas aeruginosa PA01
cgcaggcgaugaucagcc

SEQ ID NO: 3448555 - RNA, 13 nt, Pseudomonas aeruginosa PA01
cgcaggcgaugcc

SEQ ID NO: 3448556 - RNA, 22 nt, Pseudomonas aeruginosa PA01
cgcaggcgcguugcuuccaggc

SEQ ID NO: 3448557 - RNA, 20 nt, Pseudomonas aeruginosa PA01
cgcaggcgcucgcgggccgc

SEQ ID NO: 3448558 - RNA, 21 nt, Pseudomonas aeruginosa PA01
cgcaggcgcucgcgggccgcc

SEQ ID NO: 3448559 - RNA, 14 nt, Pseudomonas aeruginosa PA01
cgcaggcgcuggcc

SEQ ID NO: 3448560 - RNA, 15 nt, Pseudomonas aeruginosa PA01
cgcaggcgcuggccg

SEQ ID NO: 3448561 - RNA, 22 nt, Pseudomonas aeruginosa PA01
cgcaggcggacacgcaggcgcc

SEQ ID NO: 3448562 - RNA, 18 nt, Pseudomonas aeruginosa PA01
cgcaggcggaucgcccgg

SEQ ID NO: 3448563 - RNA, 22 nt, Pseudomonas aeruginosa PA01
cgcaggcggaucgcccggcgcu

SEQ ID NO: 3448564 - RNA, 15 nt, Pseudomonas aeruginosa PA01
cgcaggcggcuggcg

SEQ ID NO: 3448565 - RNA, 13 nt, Pseudomonas aeruginosa PA01
cgcaggcgggcgc

SEQ ID NO: 3448566 - RNA, 15 nt, Pseudomonas aeruginosa PA01
cgcaggcgggcgcca

SEQ ID NO: 3448567 - RNA, 16 nt, Pseudomonas aeruginosa PA01
cgcaggcgggcggcgu

SEQ ID NO: 3448568 - RNA, 13 nt, Pseudomonas aeruginosa PA01
cgcaggcggucgg

SEQ ID NO: 3448569 - RNA, 21 nt, Pseudomonas aeruginosa PA01
cgcaggcggucggccaucugg

SEQ ID NO: 3448570 - RNA, 16 nt, Pseudomonas aeruginosa PA01
cgcaggcucaguucgg

SEQ ID NO: 3448571 - RNA, 16 nt, Pseudomonas aeruginosa PA01
cgcaggcugccgucca

SEQ ID NO: 3448572 - RNA, 17 nt, Pseudomonas aeruginosa PA01
cgcaggcugccguccag

SEQ ID NO: 3448573 - RNA, 12 nt, Pseudomonas aeruginosa PA01
cgcaggcugccu

SEQ ID NO: 3448574 - RNA, 16 nt, Pseudomonas aeruginosa PA01
cgcaggcugcgggcga

SEQ ID NO: 3448575 - RNA, 20 nt, Pseudomonas aeruginosa PA01
cgcaggcuggccgagcgccg

SEQ ID NO: 3448576 - RNA, 23 nt, Pseudomonas aeruginosa PA01
cgcaggcuggccgagcgccgccu

SEQ ID NO: 3448577 - RNA, 15 nt, Pseudomonas aeruginosa PA01
cgcaggcugguaugc

SEQ ID NO: 3448578 - RNA, 22 nt, Pseudomonas aeruginosa PA01
cgcaggcugguaugcagcaacc

SEQ ID NO: 3448579 - RNA, 15 nt, Pseudomonas aeruginosa PA01
cgcaggcugucggcc

SEQ ID NO: 3448580 - RNA, 20 nt, Pseudomonas aeruginosa PA01
cgcaggcugucggccagccc

SEQ ID NO: 3448581 - RNA, 22 nt, Pseudomonas aeruginosa PA01
cgcaggcugucggccagccccu

SEQ ID NO: 3448582 - RNA, 23 nt, Pseudomonas aeruginosa PA01
cgcaggcuuuccagcccggcgug

SEQ ID NO: 3448583 - RNA, 13 nt, Pseudomonas aeruginosa PA01
cgcagggcagcgc

SEQ ID NO: 3448584 - RNA, 16 nt, Pseudomonas aeruginosa PA01
cgcagggcagcgcgau

SEQ ID NO: 3448585 - RNA, 14 nt, Pseudomonas aeruginosa PA01
cgcagggcaucgac

SEQ ID NO: 3448586 - RNA, 16 nt, Pseudomonas aeruginosa PA01
cgcagggcaucgauga

SEQ ID NO: 3448587 - RNA, 16 nt, Pseudomonas aeruginosa PA01
cgcagggccagcaaca

SEQ ID NO: 3448588 - RNA, 20 nt, Pseudomonas aeruginosa PA01
cgcagggccagggcggcggc

SEQ ID NO: 3448589 - RNA, 13 nt, Pseudomonas aeruginosa PA01
cgcagggccgcgg

SEQ ID NO: 3448590 - RNA, 17 nt, Pseudomonas aeruginosa PA01
cgcagggccgcggcguu

SEQ ID NO: 3448591 - RNA, 17 nt, Pseudomonas aeruginosa PA01
cgcauagccaccgccga

SEQ ID NO: 3448592 - RNA, 20 nt, Pseudomonas aeruginosa PA01
cgcauagccaccgccgacau

SEQ ID NO: 3448593 - RNA, 15 nt, Pseudomonas aeruginosa PA01
cgcauagccggcgcg

SEQ ID NO: 3448594 - RNA, 19 nt, Pseudomonas aeruginosa PA01
cgcauagcgcgcuguagcc

SEQ ID NO: 3448595 - RNA, 14 nt, Pseudomonas aeruginosa PA01
cgcauagcugaucu

SEQ ID NO: 3448596 - RNA, 22 nt, Pseudomonas aeruginosa PA01
cgcauagcugaucucggcgacu

SEQ ID NO: 3448597 - RNA, 16 nt, Pseudomonas aeruginosa PA01
cgcauaggccugggcg

SEQ ID NO: 3448598 - RNA, 18 nt, Pseudomonas aeruginosa PA01
cgcauaggcggccagccu

SEQ ID NO: 3448599 - RNA, 23 nt, Pseudomonas aeruginosa PA01
cgcauaggucaugcccaggccga

SEQ ID NO: 3448600 - RNA, 14 nt, Pseudomonas aeruginosa PA01
cgcauagucgcgau

SEQ ID NO: 3448601 - RNA, 17 nt, Pseudomonas aeruginosa PA01
cgcauagugaccccaau

SEQ ID NO: 3448602 - RNA, 22 nt, Pseudomonas aeruginosa PA01
cgcaucaccccgcaaccgcaga

SEQ ID NO: 3448603 - RNA, 20 nt, Pseudomonas aeruginosa PA01
cgcaucagcgccgguucguu

SEQ ID NO: 3448604 - RNA, 14 nt, Pseudomonas aeruginosa PA01
cgcauccaccagcg

SEQ ID NO: 3448605 - RNA, 15 nt, Pseudomonas aeruginosa PA01
cgcauccucguucca

SEQ ID NO: 3448606 - RNA, 19 nt, Pseudomonas aeruginosa PA01
cgcaucgaaggcgccggca

SEQ ID NO: 3448607 - RNA, 22 nt, Pseudomonas aeruginosa PA01
cgcaucgaccuugcccucggcg

SEQ ID NO: 3448608 - RNA, 14 nt, Pseudomonas aeruginosa PA01
cgcaucgaggccgc

SEQ ID NO: 3448609 - RNA, 16 nt, Pseudomonas aeruginosa PA01
cgcaucgaggccgccc

SEQ ID NO: 3448610 - RNA, 17 nt, Pseudomonas aeruginosa PA01
cgcaucgaggccgccca

SEQ ID NO: 3448611 - RNA, 16 nt, Pseudomonas aeruginosa PA01
cgcaucgaggccggca

SEQ ID NO: 3448612 - RNA, 16 nt, Pseudomonas aeruginosa PA01
cgcaucgccaccgcgg

SEQ ID NO: 3448613 - RNA, 17 nt, Pseudomonas aeruginosa PA01
cgcaucgccugggccgg

SEQ ID NO: 3448614 - RNA, 19 nt, Pseudomonas aeruginosa PA01
cgcaucgcgcacaugccga

SEQ ID NO: 3448615 - RNA, 16 nt, Pseudomonas aeruginosa PA01
cgcaucgcggacaccg

SEQ ID NO: 3448616 - RNA, 21 nt, Pseudomonas aeruginosa PA01
cgcaucgcgguuauccgccga

SEQ ID NO: 3448617 - RNA, 22 nt, Pseudomonas aeruginosa PA01
cgcaucgcgguuauccgccggc

SEQ ID NO: 3448618 - RNA, 17 nt, Pseudomonas aeruginosa PA01
cgcaucggccaccuucg

SEQ ID NO: 3448619 - RNA, 14 nt, Pseudomonas aeruginosa PA01
cgcaucggccgaca

SEQ ID NO: 3448620 - RNA, 18 nt, Pseudomonas aeruginosa PA01
cgcaucggcgccucccag

SEQ ID NO: 3448621 - RNA, 23 nt, Pseudomonas aeruginosa PA01
cgcaucggcggauaacgccgcug

SEQ ID NO: 3448622 - RNA, 12 nt, Pseudomonas aeruginosa PA01
cgcaucgucgaa

SEQ ID NO: 3448623 - RNA, 21 nt, Pseudomonas aeruginosa PA01
cgcaucgucgaugcguccgcg

SEQ ID NO: 3448624 - RNA, 15 nt, Pseudomonas aeruginosa PA01
cgcaucuggugcgcg

SEQ ID NO: 3448625 - RNA, 17 nt, Pseudomonas aeruginosa PA01
cgcaucuggugcgcguc

SEQ ID NO: 3448626 - RNA, 19 nt, Pseudomonas aeruginosa PA01
cgcaugaaaaagcccggca

SEQ ID NO: 3448627 - RNA, 17 nt, Pseudomonas aeruginosa PA01
cgcaugaccuucagcac

SEQ ID NO: 3448628 - RNA, 19 nt, Pseudomonas aeruginosa PA01
cgcaugaccuucagcaccu

SEQ ID NO: 3448629 - RNA, 22 nt, Pseudomonas aeruginosa PA01
cgcaugaccuucagcaccugcg

SEQ ID NO: 3448630 - RNA, 12 nt, Pseudomonas aeruginosa PA01
cgcaugaucgcc

SEQ ID NO: 3448631 - RNA, 14 nt, Pseudomonas aeruginosa PA01
cgcaugaucgccuc

SEQ ID NO: 3448632 - RNA, 15 nt, Pseudomonas aeruginosa PA01
cgcaugaucgccucg

SEQ ID NO: 3448633 - RNA, 18 nt, Pseudomonas aeruginosa PA01
cgcaugaucgccucggcg

SEQ ID NO: 3448634 - RNA, 14 nt, Pseudomonas aeruginosa PA01
cgcaugcagggcgu

SEQ ID NO: 3448635 - RNA, 14 nt, Pseudomonas aeruginosa PA01
cgcaugccagggcc

SEQ ID NO: 3448636 - RNA, 21 nt, Pseudomonas aeruginosa PA01
cgcaugccaucuuccugugcg

SEQ ID NO: 3448637 - RNA, 22 nt, Pseudomonas aeruginosa PA01
cgcaugccaucuuccugugcga

SEQ ID NO: 3448638 - RNA, 14 nt, Pseudomonas aeruginosa PA01
cgcaugcccagggc

SEQ ID NO: 3448639 - RNA, 15 nt, Pseudomonas aeruginosa PA01
cgcaugcccagggcc

SEQ ID NO: 3448640 - RNA, 18 nt, Pseudomonas aeruginosa PA01
cgcaugcccagggccagc

SEQ ID NO: 3448641 - RNA, 21 nt, Pseudomonas aeruginosa PA01
cgcaugcccagggccagcagc

SEQ ID NO: 3448642 - RNA, 15 nt, Pseudomonas aeruginosa PA01
cgcaugcgcagcgcg

SEQ ID NO: 3448643 - RNA, 14 nt, Pseudomonas aeruginosa PA01
cgcaugcgccggcu

SEQ ID NO: 3448644 - RNA, 12 nt, Pseudomonas aeruginosa PA01
cgcaugcgcggc

SEQ ID NO: 3448645 - RNA, 22 nt, Pseudomonas aeruginosa PA01
cgcaugcugggucuccgcucgg

SEQ ID NO: 3448646 - RNA, 19 nt, Pseudomonas aeruginosa PA01
cgcauggagacggcccgcc

SEQ ID NO: 3448647 - RNA, 20 nt, Pseudomonas aeruginosa PA01
cgcauggagacggcccgccc

SEQ ID NO: 3448648 - RNA, 19 nt, Pseudomonas aeruginosa PA01
cgcauggcgaccugguggc

SEQ ID NO: 3448649 - RNA, 14 nt, Pseudomonas aeruginosa PA01
cgcauggcggcgac

SEQ ID NO: 3448650 - RNA, 21 nt, Pseudomonas aeruginosa PA01
cgcauggcguucugcgacauc

SEQ ID NO: 3448651 - RNA, 16 nt, Pseudomonas aeruginosa PA01
cgcauggcucguucgu

SEQ ID NO: 3448652 - RNA, 15 nt, Pseudomonas aeruginosa PA01
cgcauguccagccag

SEQ ID NO: 3448653 - RNA, 11 nt, Pseudomonas aeruginosa PA01
cgcaugucgcg

SEQ ID NO: 3448654 - RNA, 15 nt, Pseudomonas aeruginosa PA01
cgcauuccaccuugg

SEQ ID NO: 3448655 - RNA, 15 nt, Pseudomonas aeruginosa PA01
cgcauuggccaggcc

SEQ ID NO: 3448656 - RNA, 16 nt, Pseudomonas aeruginosa PA01
cgcauuggcuucgccc

SEQ ID NO: 3448657 - RNA, 17 nt, Pseudomonas aeruginosa PA01
cgccaaaaaaagccccg

SEQ ID NO: 3448658 - RNA, 19 nt, Pseudomonas aeruginosa PA01
cgccaaaaaaagccccggc

SEQ ID NO: 3448659 - RNA, 21 nt, Pseudomonas aeruginosa PA01
cgccaaaaaaagccccggcau

SEQ ID NO: 3448660 - RNA, 21 nt, Pseudomonas aeruginosa PA01
cgccaaacccagcgacaacgg

SEQ ID NO: 3448661 - RNA, 19 nt, Pseudomonas aeruginosa PA01
cgccaaccacuccgccacc

SEQ ID NO: 3448662 - RNA, 22 nt, Pseudomonas aeruginosa PA01
cgccaaccacuccgccacccgc

SEQ ID NO: 3448663 - RNA, 17 nt, Pseudomonas aeruginosa PA01
cgccaaccaggaaggcg

SEQ ID NO: 3448664 - RNA, 18 nt, Pseudomonas aeruginosa PA01
cgccaaccgggcagcagc

SEQ ID NO: 3448665 - RNA, 15 nt, Pseudomonas aeruginosa PA01
cgccaacgccaccgc

SEQ ID NO: 3448666 - RNA, 17 nt, Pseudomonas aeruginosa PA01
cgccaacgccaccgcgc

SEQ ID NO: 3448667 - RNA, 14 nt, Pseudomonas aeruginosa PA01
cgccaacgcgccgu

SEQ ID NO: 3448668 - RNA, 15 nt, Pseudomonas aeruginosa PA01
cgccaacucggccug

SEQ ID NO: 3448669 - RNA, 12 nt, Pseudomonas aeruginosa PA01
cgccaacugcuu

SEQ ID NO: 3448670 - RNA, 15 nt, Pseudomonas aeruginosa PA01
cgccaacugcuugcc

SEQ ID NO: 3448671 - RNA, 18 nt, Pseudomonas aeruginosa PA01
cgccaacuggcgcaacug

SEQ ID NO: 3448672 - RNA, 19 nt, Pseudomonas aeruginosa PA01
cgccaagcuggcgaucgac

SEQ ID NO: 3448673 - RNA, 22 nt, Pseudomonas aeruginosa PA01
cgccaaggcccgcaaucagcgg

SEQ ID NO: 3448674 - RNA, 14 nt, Pseudomonas aeruginosa PA01
cgccaaggcccugc

SEQ ID NO: 3448675 - RNA, 15 nt, Pseudomonas aeruginosa PA01
cgccaaggcccugcu

SEQ ID NO: 3448676 - RNA, 18 nt, Pseudomonas aeruginosa PA01
cgccaaggcccugcugca

SEQ ID NO: 3448677 - RNA, 13 nt, Pseudomonas aeruginosa PA01
cgccaaggccgcc

SEQ ID NO: 3448678 - RNA, 16 nt, Pseudomonas aeruginosa PA01
cgccaaggccgccagg

SEQ ID NO: 3448679 - RNA, 16 nt, Pseudomonas aeruginosa PA01
cgccaaggccucggca

SEQ ID NO: 3448680 - RNA, 15 nt, Pseudomonas aeruginosa PA01
cgccaaggcggggcu

SEQ ID NO: 3448681 - RNA, 13 nt, Pseudomonas aeruginosa PA01
cgccaagggcgcc

SEQ ID NO: 3448682 - RNA, 18 nt, Pseudomonas aeruginosa PA01
cgccaagggcgccgccga

SEQ ID NO: 3448683 - RNA, 17 nt, Pseudomonas aeruginosa PA01
cgccaagguacggggcu

SEQ ID NO: 3448684 - RNA, 13 nt, Pseudomonas aeruginosa PA01
cgccaauccgggc

SEQ ID NO: 3448685 - RNA, 21 nt, Pseudomonas aeruginosa PA01
cgccaaugccuuccgacgccg

SEQ ID NO: 3448686 - RNA, 17 nt, Pseudomonas aeruginosa PA01
cgccacacauccagugu

SEQ ID NO: 3448687 - RNA, 16 nt, Pseudomonas aeruginosa PA01
cgccacagaucgccag

SEQ ID NO: 3448688 - RNA, 17 nt, Pseudomonas aeruginosa PA01
cgccacagaucgccagc

SEQ ID NO: 3448689 - RNA, 18 nt, Pseudomonas aeruginosa PA01
cgccacagaucgccagcu

SEQ ID NO: 3448690 - RNA, 21 nt, Pseudomonas aeruginosa PA01
cgccacagaucgccagcucgc

SEQ ID NO: 3448691 - RNA, 22 nt, Pseudomonas aeruginosa PA01
cgccacagaucgccagcucgcc

SEQ ID NO: 3448692 - RNA, 21 nt, Pseudomonas aeruginosa PA01
cgccacaggcguuauccgccg

SEQ ID NO: 3448693 - RNA, 23 nt, Pseudomonas aeruginosa PA01
cgccacaggcguuauccgccgau

SEQ ID NO: 3448694 - RNA, 20 nt, Pseudomonas aeruginosa PA01
cgccagaaagccucaggcgc

SEQ ID NO: 3448695 - RNA, 21 nt, Pseudomonas aeruginosa PA01
cgccagaaagccucaggcgcu

SEQ ID NO: 3448696 - RNA, 22 nt, Pseudomonas aeruginosa PA01
cgccagaaagccucaggcgcug

SEQ ID NO: 3448697 - RNA, 16 nt, Pseudomonas aeruginosa PA01
cgccagaagcggccga

SEQ ID NO: 3448698 - RNA, 17 nt, Pseudomonas aeruginosa PA01
cgccagaagcggccgac

SEQ ID NO: 3448699 - RNA, 13 nt, Pseudomonas aeruginosa PA01
cgccagacaggcc

SEQ ID NO: 3448700 - RNA, 16 nt, Pseudomonas aeruginosa PA01
cgccagacaggccagc

SEQ ID NO: 3448701 - RNA, 17 nt, Pseudomonas aeruginosa PA01
cgccagacaggccagcu

SEQ ID NO: 3448702 - RNA, 22 nt, Pseudomonas aeruginosa PA01
cgccagacaggccagcucgccc

SEQ ID NO: 3448703 - RNA, 14 nt, Pseudomonas aeruginosa PA01
cgccagaccagccc

SEQ ID NO: 3448704 - RNA, 16 nt, Pseudomonas aeruginosa PA01
cgccagaccagcccca

SEQ ID NO: 3448705 - RNA, 16 nt, Pseudomonas aeruginosa PA01
cgccagagaucgccca

SEQ ID NO: 3448706 - RNA, 13 nt, Pseudomonas aeruginosa PA01
cgccagagcaggc

SEQ ID NO: 3448707 - RNA, 20 nt, Pseudomonas aeruginosa PA01
cgccagagcgcgcuacucag

SEQ ID NO: 3448708 - RNA, 14 nt, Pseudomonas aeruginosa PA01
cgccagaugacgau

SEQ ID NO: 3448709 - RNA, 22 nt, Pseudomonas aeruginosa PA01
cgccagaugacgauggccgccg

SEQ ID NO: 3448710 - RNA, 23 nt, Pseudomonas aeruginosa PA01
cgccagaugacgauggccgccgc

SEQ ID NO: 3448711 - RNA, 17 nt, Pseudomonas aeruginosa PA01
cgccagaugcgcgucgc

SEQ ID NO: 3448712 - RNA, 18 nt, Pseudomonas aeruginosa PA01
cgccagaugcgcgucgcc

SEQ ID NO: 3448713 - RNA, 19 nt, Pseudomonas aeruginosa PA01
cgccagaugcgcgucgccg

SEQ ID NO: 3448714 - RNA, 22 nt, Pseudomonas aeruginosa PA01
cgccagaugcgcgucgccgaac

SEQ ID NO: 3448715 - RNA, 23 nt, Pseudomonas aeruginosa PA01
cgccagcaacaguugccgcagca

SEQ ID NO: 3448716 - RNA, 15 nt, Pseudomonas aeruginosa PA01
cgccagcaacccgcc

SEQ ID NO: 3448717 - RNA, 15 nt, Pseudomonas aeruginosa PA01
cgccagcaacgccuu

SEQ ID NO: 3448718 - RNA, 17 nt, Pseudomonas aeruginosa PA01
cgccagcaacgccuucu

SEQ ID NO: 3448719 - RNA, 19 nt, Pseudomonas aeruginosa PA01
cgccagcaacgccuucugc

SEQ ID NO: 3448720 - RNA, 17 nt, Pseudomonas aeruginosa PA01
cgccagcaacggcuccu

SEQ ID NO: 3448721 - RNA, 19 nt, Pseudomonas aeruginosa PA01
cgccagcaauugccgcugc

SEQ ID NO: 3448722 - RNA, 11 nt, Pseudomonas aeruginosa PA01
cgccagcacca

SEQ ID NO: 3448723 - RNA, 14 nt, Pseudomonas aeruginosa PA01
cgccagcaccaccc

SEQ ID NO: 3448724 - RNA, 16 nt, Pseudomonas aeruginosa PA01
cgccagcaccacccgg

SEQ ID NO: 3448725 - RNA, 21 nt, Pseudomonas aeruginosa PA01
cgccagcaccacccggccgcg

SEQ ID NO: 3448726 - RNA, 22 nt, Pseudomonas aeruginosa PA01
cgccagcaccacccggccgcgc

SEQ ID NO: 3448727 - RNA, 15 nt, Pseudomonas aeruginosa PA01
cgccagcaccagcag

SEQ ID NO: 3448728 - RNA, 14 nt, Pseudomonas aeruginosa PA01
cgccagcacccagu

SEQ ID NO: 3448729 - RNA, 20 nt, Pseudomonas aeruginosa PA01
cgccagcacccagucuucgc

SEQ ID NO: 3448730 - RNA, 15 nt, Pseudomonas aeruginosa PA01
cgccagcaccguggu

SEQ ID NO: 3448731 - RNA, 23 nt, Pseudomonas aeruginosa PA01
cgccagcaccguggucagcacca

SEQ ID NO: 3448732 - RNA, 22 nt, Pseudomonas aeruginosa PA01
cgccagcaccucguaggccgac

SEQ ID NO: 3448733 - RNA, 24 nt, Pseudomonas aeruginosa PA01
cgccagcaccucguaggccgacuc

SEQ ID NO: 3448734 - RNA, 16 nt, Pseudomonas aeruginosa PA01
cgccagcaccuggcag

SEQ ID NO: 3448735 - RNA, 20 nt, Pseudomonas aeruginosa PA01
cgccagcaccuggcagugcg

SEQ ID NO: 3448736 - RNA, 12 nt, Pseudomonas aeruginosa PA01
cgccagcacggc

SEQ ID NO: 3448737 - RNA, 15 nt, Pseudomonas aeruginosa PA01
cgccagcagacggca

SEQ ID NO: 3448738 - RNA, 14 nt, Pseudomonas aeruginosa PA01
cgccagcaggaucg

SEQ ID NO: 3448739 - RNA, 17 nt, Pseudomonas aeruginosa PA01
cgccagcaggaucggag

SEQ ID NO: 3448740 - RNA, 15 nt, Pseudomonas aeruginosa PA01
cgccagcaggccgaa

SEQ ID NO: 3448741 - RNA, 19 nt, Pseudomonas aeruginosa PA01
cgccagcaggccgaaggcc

SEQ ID NO: 3448742 - RNA, 22 nt, Pseudomonas aeruginosa PA01
cgccagcaggccgaaggccagg

SEQ ID NO: 3448743 - RNA, 12 nt, Pseudomonas aeruginosa PA01
cgccagcaggcg

SEQ ID NO: 3448744 - RNA, 15 nt, Pseudomonas aeruginosa PA01
cgccagcaggcgcag

SEQ ID NO: 3448745 - RNA, 19 nt, Pseudomonas aeruginosa PA01
cgccagcaggcgcagcagc

SEQ ID NO: 3448746 - RNA, 22 nt, Pseudomonas aeruginosa PA01
cgccagcaggcgcagcagcgac

SEQ ID NO: 3448747 - RNA, 22 nt, Pseudomonas aeruginosa PA01
cgccagcaggcgcaggucggcc

SEQ ID NO: 3448748 - RNA, 17 nt, Pseudomonas aeruginosa PA01
cgccagcaggcgccggc

SEQ ID NO: 3448749 - RNA, 19 nt, Pseudomonas aeruginosa PA01
cgccagcaggcgccggcgg

SEQ ID NO: 3448750 - RNA, 15 nt, Pseudomonas aeruginosa PA01
cgccagcaggcgcgg

SEQ ID NO: 3448751 - RNA, 18 nt, Pseudomonas aeruginosa PA01
cgccagcaggcgcgggcu

SEQ ID NO: 3448752 - RNA, 22 nt, Pseudomonas aeruginosa PA01
cgccagcaggcguugcagugcg

SEQ ID NO: 3448753 - RNA, 23 nt, Pseudomonas aeruginosa PA01
cgccagcaggcguugcagugcgc

SEQ ID NO: 3448754 - RNA, 15 nt, Pseudomonas aeruginosa PA01
cgccagcaggcucau

SEQ ID NO: 3448755 - RNA, 18 nt, Pseudomonas aeruginosa PA01
cgccagcaggcucaugcc

SEQ ID NO: 3448756 - RNA, 13 nt, Pseudomonas aeruginosa PA01
cgccagcaggcug

SEQ ID NO: 3448757 - RNA, 14 nt, Pseudomonas aeruginosa PA01
cgccagcaggucgc

SEQ ID NO: 3448758 - RNA, 16 nt, Pseudomonas aeruginosa PA01
cgccagcaggucgcgc

SEQ ID NO: 3448759 - RNA, 22 nt, Pseudomonas aeruginosa PA01
cgccagcaggucgcgcugggcg

SEQ ID NO: 3448760 - RNA, 18 nt, Pseudomonas aeruginosa PA01
cgccagcaggucggccug

SEQ ID NO: 3448761 - RNA, 22 nt, Pseudomonas aeruginosa PA01
cgccagcaggucggccugcugc

SEQ ID NO: 3448762 - RNA, 21 nt, Pseudomonas aeruginosa PA01
cgccagcagguggucgauggg

SEQ ID NO: 3448763 - RNA, 21 nt, Pseudomonas aeruginosa PA01
cgccagcaucgcaucggcgac

SEQ ID NO: 3448764 - RNA, 14 nt, Pseudomonas aeruginosa PA01
cgccagcauggcga

SEQ ID NO: 3448765 - RNA, 16 nt, Pseudomonas aeruginosa PA01
cgccagccacucccgg

SEQ ID NO: 3448766 - RNA, 13 nt, Pseudomonas aeruginosa PA01
cgccagccagagc

SEQ ID NO: 3448767 - RNA, 18 nt, Pseudomonas aeruginosa PA01
cgccagccagagcagcgu

SEQ ID NO: 3448768 - RNA, 16 nt, Pseudomonas aeruginosa PA01
cgccagccagcccggc

SEQ ID NO: 3448769 - RNA, 17 nt, Pseudomonas aeruginosa PA01
cgccagccagcccggcg

SEQ ID NO: 3448770 - RNA, 16 nt, Pseudomonas aeruginosa PA01
cgccagccagccgcgc

SEQ ID NO: 3448771 - RNA, 17 nt, Pseudomonas aeruginosa PA01
cgccagccagccgcgcg

SEQ ID NO: 3448772 - RNA, 18 nt, Pseudomonas aeruginosa PA01
cgccagccagccgcgcgc

SEQ ID NO: 3448773 - RNA, 20 nt, Pseudomonas aeruginosa PA01
cgccagccagccgcgcgccg

SEQ ID NO: 3448774 - RNA, 22 nt, Pseudomonas aeruginosa PA01
cgccagccagccgcgcgccgca

SEQ ID NO: 3448775 - RNA, 23 nt, Pseudomonas aeruginosa PA01
cgccagccagccgcgcgccgcau

SEQ ID NO: 3448776 - RNA, 16 nt, Pseudomonas aeruginosa PA01
cgccagccagcgcggc

SEQ ID NO: 3448777 - RNA, 17 nt, Pseudomonas aeruginosa PA01
cgccagccagcgcggcu

SEQ ID NO: 3448778 - RNA, 17 nt, Pseudomonas aeruginosa PA01
cgccagccaggaagagc

SEQ ID NO: 3448779 - RNA, 22 nt, Pseudomonas aeruginosa PA01
cgccagccaggaagagcccgcc

SEQ ID NO: 3448780 - RNA, 16 nt, Pseudomonas aeruginosa PA01
cgccagccaggguacu

SEQ ID NO: 3448781 - RNA, 16 nt, Pseudomonas aeruginosa PA01
cgccagcccagugcug

SEQ ID NO: 3448782 - RNA, 20 nt, Pseudomonas aeruginosa PA01
cgccagcccagugcuggcgu

SEQ ID NO: 3448783 - RNA, 16 nt, Pseudomonas aeruginosa PA01
cgccagccccaggcgc

SEQ ID NO: 3448784 - RNA, 21 nt, Pseudomonas aeruginosa PA01
cgccagccccaggcgcggcgu

SEQ ID NO: 3448785 - RNA, 22 nt, Pseudomonas aeruginosa PA01
cgccagccccaggcgcggcguc

SEQ ID NO: 3448786 - RNA, 13 nt, Pseudomonas aeruginosa PA01
cgccagcccgcca

SEQ ID NO: 3448787 - RNA, 16 nt, Pseudomonas aeruginosa PA01
cgccagcccgccaccg

SEQ ID NO: 3448788 - RNA, 17 nt, Pseudomonas aeruginosa PA01
cgccagcccgccaccga

SEQ ID NO: 3448789 - RNA, 15 nt, Pseudomonas aeruginosa PA01
cgccagcccucgccc

SEQ ID NO: 3448790 - RNA, 17 nt, Pseudomonas aeruginosa PA01
cgccagcccucgcccag

SEQ ID NO: 3448791 - RNA, 18 nt, Pseudomonas aeruginosa PA01
cgccagcccucgcccagg

SEQ ID NO: 3448792 - RNA, 19 nt, Pseudomonas aeruginosa PA01
cgccagcccucgcccaggu

SEQ ID NO: 3448793 - RNA, 16 nt, Pseudomonas aeruginosa PA01
cgccagccgacuggcg

SEQ ID NO: 3448794 - RNA, 13 nt, Pseudomonas aeruginosa PA01
cgccagccgcccu

SEQ ID NO: 3448795 - RNA, 14 nt, Pseudomonas aeruginosa PA01
cgccagccgcccug

SEQ ID NO: 3448796 - RNA, 18 nt, Pseudomonas aeruginosa PA01
cgccaggccgcgcagucc

SEQ ID NO: 3448797 - RNA, 13 nt, Pseudomonas aeruginosa PA01
cgccaggccgcgu

SEQ ID NO: 3448798 - RNA, 14 nt, Pseudomonas aeruginosa PA01
cgccaggccgcguc

SEQ ID NO: 3448799 - RNA, 13 nt, Pseudomonas aeruginosa PA01
cgccaggccgcuu

SEQ ID NO: 3448800 - RNA, 12 nt, Pseudomonas aeruginosa PA01
cgccaggccgga

SEQ ID NO: 3448801 - RNA, 18 nt, Pseudomonas aeruginosa PA01
cgccaggccggagccgcg

SEQ ID NO: 3448802 - RNA, 14 nt, Pseudomonas aeruginosa PA01
cgccaggccggcga

SEQ ID NO: 3448803 - RNA, 19 nt, Pseudomonas aeruginosa PA01
cgccaggccggcgagggcg

SEQ ID NO: 3448804 - RNA, 14 nt, Pseudomonas aeruginosa PA01
cgccaggccggugc

SEQ ID NO: 3448805 - RNA, 20 nt, Pseudomonas aeruginosa PA01
cgccaggccggugcagaaga

SEQ ID NO: 3448806 - RNA, 16 nt, Pseudomonas aeruginosa PA01
cgccaggccguagacc

SEQ ID NO: 3448807 - RNA, 21 nt, Pseudomonas aeruginosa PA01
cgccaggccguagaccaccag

SEQ ID NO: 3448808 - RNA, 22 nt, Pseudomonas aeruginosa PA01
cgccaggccguagaccaccagc

SEQ ID NO: 3448809 - RNA, 14 nt, Pseudomonas aeruginosa PA01
cgccaggccucggc

SEQ ID NO: 3448810 - RNA, 17 nt, Pseudomonas aeruginosa PA01
cgccaggccucggcgcg

SEQ ID NO: 3448811 - RNA, 19 nt, Pseudomonas aeruginosa PA01
cgccaggccucggcgcggg

SEQ ID NO: 3448812 - RNA, 13 nt, Pseudomonas aeruginosa PA01
cgccaggccuugc

SEQ ID NO: 3448813 - RNA, 20 nt, Pseudomonas aeruginosa PA01
cgccaggcgaagaaagcccc

SEQ ID NO: 3448814 - RNA, 18 nt, Pseudomonas aeruginosa PA01
cgccaggcgauccagcgg

SEQ ID NO: 3448815 - RNA, 17 nt, Pseudomonas aeruginosa PA01
cgccaggcgcagccagc

SEQ ID NO: 3448816 - RNA, 18 nt, Pseudomonas aeruginosa PA01
cgccaggcgcagccagca

SEQ ID NO: 3448817 - RNA, 21 nt, Pseudomonas aeruginosa PA01
cgccaggcgcagccagcacau

SEQ ID NO: 3448818 - RNA, 18 nt, Pseudomonas aeruginosa PA01
cgccaggcgcgguugccg

SEQ ID NO: 3448819 - RNA, 15 nt, Pseudomonas aeruginosa PA01
cgccaggcgcgucgc

SEQ ID NO: 3448820 - RNA, 18 nt, Pseudomonas aeruginosa PA01
cgccaggcgcgucgcggc

SEQ ID NO: 3448821 - RNA, 20 nt, Pseudomonas aeruginosa PA01
cgccaggcgcgucgcggccu

SEQ ID NO: 3448822 - RNA, 20 nt, Pseudomonas aeruginosa PA01
cgccaggcgcgucuccagcu

SEQ ID NO: 3448823 - RNA, 22 nt, Pseudomonas aeruginosa PA01
cgccaggcgcgucuccagcucg

SEQ ID NO: 3448824 - RNA, 12 nt, Pseudomonas aeruginosa PA01
cgccaggcgcuc

SEQ ID NO: 3448825 - RNA, 14 nt, Pseudomonas aeruginosa PA01
cgccaggcggaacg

SEQ ID NO: 3448826 - RNA, 17 nt, Pseudomonas aeruginosa PA01
cgccaggcggaacggcu

SEQ ID NO: 3448827 - RNA, 14 nt, Pseudomonas aeruginosa PA01
cgccaggcggccgc

SEQ ID NO: 3448828 - RNA, 19 nt, Pseudomonas aeruginosa PA01
cgccaggcggccgcuggcg

SEQ ID NO: 3448829 - RNA, 20 nt, Pseudomonas aeruginosa PA01
cgccaggcggccgcuggcga

SEQ ID NO: 3448830 - RNA, 17 nt, Pseudomonas aeruginosa PA01
cgccaggcgugcagacc

SEQ ID NO: 3448831 - RNA, 14 nt, Pseudomonas aeruginosa PA01
cgccaggcguucca

SEQ ID NO: 3448832 - RNA, 16 nt, Pseudomonas aeruginosa PA01
cgccaggcguuccagc

SEQ ID NO: 3448833 - RNA, 19 nt, Pseudomonas aeruginosa PA01
cgccaggcguuccagcucg

SEQ ID NO: 3448834 - RNA, 20 nt, Pseudomonas aeruginosa PA01
cgccaggcguuccagcucgg

SEQ ID NO: 3448835 - RNA, 16 nt, Pseudomonas aeruginosa PA01
cgccaggcugaccgcg

SEQ ID NO: 3448836 - RNA, 16 nt, Pseudomonas aeruginosa PA01
cgccaggcugauccgc

SEQ ID NO: 3448837 - RNA, 22 nt, Pseudomonas aeruginosa PA01
cgccaggcuggccacgaacagg

SEQ ID NO: 3448838 - RNA, 19 nt, Pseudomonas aeruginosa PA01
cgccaggcuggcuaucuuu

SEQ ID NO: 3448839 - RNA, 20 nt, Pseudomonas aeruginosa PA01
cgccaggcuggguuggcgcg

SEQ ID NO: 3448840 - RNA, 21 nt, Pseudomonas aeruginosa PA01
cgccaggcuggguuggcgcga

SEQ ID NO: 3448841 - RNA, 19 nt, Pseudomonas aeruginosa PA01
cgccaggcugucagggcgc

SEQ ID NO: 3448842 - RNA, 17 nt, Pseudomonas aeruginosa PA01
cgccaggcuuuccgccg

SEQ ID NO: 3448843 - RNA, 19 nt, Pseudomonas aeruginosa PA01
cgccaggcuuuccgccgag

SEQ ID NO: 3448844 - RNA, 14 nt, Pseudomonas aeruginosa PA01
cgccagggacgcgc

SEQ ID NO: 3448845 - RNA, 20 nt, Pseudomonas aeruginosa PA01
cgccagggacgcgcagcggc

SEQ ID NO: 3448846 - RNA, 22 nt, Pseudomonas aeruginosa PA01
cgccagggacgcgcagcggcgc

SEQ ID NO: 3448847 - RNA, 13 nt, Pseudomonas aeruginosa PA01
cgccagggaggcg

SEQ ID NO: 3448848 - RNA, 15 nt, Pseudomonas aeruginosa PA01
cgccagggaggcgau

SEQ ID NO: 3448849 - RNA, 14 nt, Pseudomonas aeruginosa PA01
cgccagggccaggg

SEQ ID NO: 3448850 - RNA, 20 nt, Pseudomonas aeruginosa PA01
cgccagggccagggaaauca

SEQ ID NO: 3448851 - RNA, 19 nt, Pseudomonas aeruginosa PA01
cgccagggcccacagugcc

SEQ ID NO: 3448852 - RNA, 20 nt, Pseudomonas aeruginosa PA01
cgccagggcccacagugcca

SEQ ID NO: 3448853 - RNA, 14 nt, Pseudomonas aeruginosa PA01
cgccagggccgggu

SEQ ID NO: 3448854 - RNA, 17 nt, Pseudomonas aeruginosa PA01
cgccagggggaucgcga

SEQ ID NO: 3448855 - RNA, 19 nt, Pseudomonas aeruginosa PA01
cgccagggggaucgcgaag

SEQ ID NO: 3448856 - RNA, 21 nt, Pseudomonas aeruginosa PA01
cgccagggggaucgcgaagaa

SEQ ID NO: 3448857 - RNA, 19 nt, Pseudomonas aeruginosa PA01
cgccaggggugccuugcca

SEQ ID NO: 3448858 - RNA, 16 nt, Pseudomonas aeruginosa PA01
cgccagggucagcucg

SEQ ID NO: 3448859 - RNA, 22 nt, Pseudomonas aeruginosa PA01
cgccagggucagcucgacagcg

SEQ ID NO: 3448860 - RNA, 16 nt, Pseudomonas aeruginosa PA01
cgccagggucuugccg

SEQ ID NO: 3448861 - RNA, 18 nt, Pseudomonas aeruginosa PA01
cgccagggucuugccgac

SEQ ID NO: 3448862 - RNA, 19 nt, Pseudomonas aeruginosa PA01
cgccagggucuugccgacc

SEQ ID NO: 3448863 - RNA, 22 nt, Pseudomonas aeruginosa PA01
cgccagggucuugccgaccuuc

SEQ ID NO: 3448864 - RNA, 22 nt, Pseudomonas aeruginosa PA01
cgccaggguguuguucgccagc

SEQ ID NO: 3448865 - RNA, 16 nt, Pseudomonas aeruginosa PA01
cgccagguagccugga

SEQ ID NO: 3448866 - RNA, 15 nt, Pseudomonas aeruginosa PA01
cgccagguaguccag

SEQ ID NO: 3448867 - RNA, 16 nt, Pseudomonas aeruginosa PA01
cgccagguaguccagc

SEQ ID NO: 3448868 - RNA, 18 nt, Pseudomonas aeruginosa PA01
cgccagguagugccgccc

SEQ ID NO: 3448869 - RNA, 19 nt, Pseudomonas aeruginosa PA01
cgccagguagugccgcccu

SEQ ID NO: 3448870 - RNA, 14 nt, Pseudomonas aeruginosa PA01
cgccagguccaggc

SEQ ID NO: 3448871 - RNA, 16 nt, Pseudomonas aeruginosa PA01
cgccagguccgccugg

SEQ ID NO: 3448872 - RNA, 22 nt, Pseudomonas aeruginosa PA01
cgccaggucgagacgcgggccc

SEQ ID NO: 3448873 - RNA, 16 nt, Pseudomonas aeruginosa PA01
cgccaggucgagggca

SEQ ID NO: 3448874 - RNA, 15 nt, Pseudomonas aeruginosa PA01
cgccaggucgauccc

SEQ ID NO: 3448875 - RNA, 13 nt, Pseudomonas aeruginosa PA01
cgccaggugcagg

SEQ ID NO: 3448876 - RNA, 20 nt, Pseudomonas aeruginosa PA01
cgccaggugcaggaagcgcc

SEQ ID NO: 3448877 - RNA, 15 nt, Pseudomonas aeruginosa PA01
cgccagguggaagcg

SEQ ID NO: 3448878 - RNA, 17 nt, Pseudomonas aeruginosa PA01
cgccagguggaagcgcg

SEQ ID NO: 3448879 - RNA, 21 nt, Pseudomonas aeruginosa PA01
cgccagguggaagcgcgcguc

SEQ ID NO: 3448880 - RNA, 22 nt, Pseudomonas aeruginosa PA01
cgccagguggaagcgcgcgucg

SEQ ID NO: 3448881 - RNA, 19 nt, Pseudomonas aeruginosa PA01
cgccagguguacaucggga

SEQ ID NO: 3448882 - RNA, 21 nt, Pseudomonas aeruginosa PA01
cgccagguguacaucgggaua

SEQ ID NO: 3448883 - RNA, 13 nt, Pseudomonas aeruginosa PA01
cgccagguugcgc

SEQ ID NO: 3448884 - RNA, 18 nt, Pseudomonas aeruginosa PA01
cgccagguugcgcaacca

SEQ ID NO: 3448885 - RNA, 20 nt, Pseudomonas aeruginosa PA01
cgccagguuggccuggcccg

SEQ ID NO: 3448886 - RNA, 16 nt, Pseudomonas aeruginosa PA01
cgccaguacuccgagg

SEQ ID NO: 3448887 - RNA, 22 nt, Pseudomonas aeruginosa PA01
cgccaguccacgacgaacggcg

SEQ ID NO: 3448888 - RNA, 17 nt, Pseudomonas aeruginosa PA01
cgccagucggccuggcu

SEQ ID NO: 3448889 - RNA, 15 nt, Pseudomonas aeruginosa PA01
cgccagugcaugcgu

SEQ ID NO: 3448890 - RNA, 23 nt, Pseudomonas aeruginosa PA01
cgccagugcaugcguucgccgaa

SEQ ID NO: 3448891 - RNA, 21 nt, Pseudomonas aeruginosa PA01
cgccagugccugcaccacgca

SEQ ID NO: 3448892 - RNA, 13 nt, Pseudomonas aeruginosa PA01
cgccaguuccggc

SEQ ID NO: 3448893 - RNA, 16 nt, Pseudomonas aeruginosa PA01
cgccaguuccggcaac

SEQ ID NO: 3448894 - RNA, 21 nt, Pseudomonas aeruginosa PA01
cgccaguuccggggucagcgc

SEQ ID NO: 3448895 - RNA, 22 nt, Pseudomonas aeruginosa PA01
cgccaguuccggggucagcgcc

SEQ ID NO: 3448896 - RNA, 22 nt, Pseudomonas aeruginosa PA01
cgccaguuccgugucgagggcg

SEQ ID NO: 3448897 - RNA, 15 nt, Pseudomonas aeruginosa PA01
cgccaguucgccggu

SEQ ID NO: 3448898 - RNA, 18 nt, Pseudomonas aeruginosa PA01
cgcccacuccuccgccug

SEQ ID NO: 3448899 - RNA, 23 nt, Pseudomonas aeruginosa PA01
cgcccacucuucagucccucguc

SEQ ID NO: 3448900 - RNA, 17 nt, Pseudomonas aeruginosa PA01
cgcccagaaaaaagccc

SEQ ID NO: 3448901 - RNA, 21 nt, Pseudomonas aeruginosa PA01
cgcccagaaaaaagccccgca

SEQ ID NO: 3448902 - RNA, 14 nt, Pseudomonas aeruginosa PA01
cgcccagaccugca

SEQ ID NO: 3448903 - RNA, 16 nt, Pseudomonas aeruginosa PA01
cgcccagaccugcaau

SEQ ID NO: 3448904 - RNA, 23 nt, Pseudomonas aeruginosa PA01
cgcccagaguucgcccagcucgc

SEQ ID NO: 3448905 - RNA, 15 nt, Pseudomonas aeruginosa PA01
cgcccagcaccacag

SEQ ID NO: 3448906 - RNA, 16 nt, Pseudomonas aeruginosa PA01
cgcccagcaccacagc

SEQ ID NO: 3448907 - RNA, 21 nt, Pseudomonas aeruginosa PA01
cgcccagcaccacagcaccac

SEQ ID NO: 3448908 - RNA, 23 nt, Pseudomonas aeruginosa PA01
cgcccagcaccacagcaccacgc

SEQ ID NO: 3448909 - RNA, 12 nt, Pseudomonas aeruginosa PA01
cgcccagcagca

SEQ ID NO: 3448910 - RNA, 14 nt, Pseudomonas aeruginosa PA01
cgcccagcagcagg

SEQ ID NO: 3448911 - RNA, 15 nt, Pseudomonas aeruginosa PA01
cgcccagcagcaggc

SEQ ID NO: 3448912 - RNA, 17 nt, Pseudomonas aeruginosa PA01
cgcccagcagcaggccg

SEQ ID NO: 3448913 - RNA, 18 nt, Pseudomonas aeruginosa PA01
cgcccagcagcaggccgg

SEQ ID NO: 3448914 - RNA, 19 nt, Pseudomonas aeruginosa PA01
cgcccagcagcaggccggc

SEQ ID NO: 3448915 - RNA, 23 nt, Pseudomonas aeruginosa PA01
cgcccagcagcaggccggcgacc

SEQ ID NO: 3448916 - RNA, 12 nt, Pseudomonas aeruginosa PA01
cgcccagcagcg

SEQ ID NO: 3448917 - RNA, 19 nt, Pseudomonas aeruginosa PA01
cgcccagcagcggcaggag

SEQ ID NO: 3448918 - RNA, 18 nt, Pseudomonas aeruginosa PA01
cgcccagcaggcgcgccc

SEQ ID NO: 3448919 - RNA, 14 nt, Pseudomonas aeruginosa PA01
cgcccagcagggcc

SEQ ID NO: 3448920 - RNA, 15 nt, Pseudomonas aeruginosa PA01
cgcccagcagggcca

SEQ ID NO: 3448921 - RNA, 13 nt, Pseudomonas aeruginosa PA01
cgcccagccagag

SEQ ID NO: 3448922 - RNA, 15 nt, Pseudomonas aeruginosa PA01
cgcccagcgcagccu

SEQ ID NO: 3448923 - RNA, 11 nt, Pseudomonas aeruginosa PA01
cgcccagcgcc

SEQ ID NO: 3448924 - RNA, 12 nt, Pseudomonas aeruginosa PA01
cgcccagcgccu

SEQ ID NO: 3448925 - RNA, 15 nt, Pseudomonas aeruginosa PA01
cgcccagcggcuggc

SEQ ID NO: 3448926 - RNA, 16 nt, Pseudomonas aeruginosa PA01
cgcccagcggcuggcg

SEQ ID NO: 3448927 - RNA, 16 nt, Pseudomonas aeruginosa PA01
cgcccagcucgccgcu

SEQ ID NO: 3448928 - RNA, 17 nt, Pseudomonas aeruginosa PA01
cgcccagcucgccgcuc

SEQ ID NO: 3448929 - RNA, 22 nt, Pseudomonas aeruginosa PA01
cgcccaggacaacgacagcccc

SEQ ID NO: 3448930 - RNA, 13 nt, Pseudomonas aeruginosa PA01
cgcccaggcccag

SEQ ID NO: 3448931 - RNA, 15 nt, Pseudomonas aeruginosa PA01
cgcccaggcccagcg

SEQ ID NO: 3448932 - RNA, 18 nt, Pseudomonas aeruginosa PA01
cgcccaggccgcuggcgg

SEQ ID NO: 3448933 - RNA, 14 nt, Pseudomonas aeruginosa PA01
cgcccaggccgggu

SEQ ID NO: 3448934 - RNA, 16 nt, Pseudomonas aeruginosa PA01
cgcccaggccgggucg

SEQ ID NO: 3448935 - RNA, 17 nt, Pseudomonas aeruginosa PA01
cgcccaggccgggucgc

SEQ ID NO: 3448936 - RNA, 22 nt, Pseudomonas aeruginosa PA01
cgcccaggcgcaccuccucggg

SEQ ID NO: 3448937 - RNA, 14 nt, Pseudomonas aeruginosa PA01
cgcccaggcgcucg

SEQ ID NO: 3448938 - RNA, 19 nt, Pseudomonas aeruginosa PA01
cgcccaggcgcucggcgac

SEQ ID NO: 3448939 - RNA, 14 nt, Pseudomonas aeruginosa PA01
cgcccaggcugccg

SEQ ID NO: 3448940 - RNA, 17 nt, Pseudomonas aeruginosa PA01
cgcccaggcugccgccg

SEQ ID NO: 3448941 - RNA, 19 nt, Pseudomonas aeruginosa PA01
cgcccaggcugccgccgcc

SEQ ID NO: 3448942 - RNA, 20 nt, Pseudomonas aeruginosa PA01
cgcccaggcugccgccgccg

SEQ ID NO: 3448943 - RNA, 17 nt, Pseudomonas aeruginosa PA01
cgcccaggcugccggcc

SEQ ID NO: 3448944 - RNA, 18 nt, Pseudomonas aeruginosa PA01
cgcccaggcugccggcca

SEQ ID NO: 3448945 - RNA, 15 nt, Pseudomonas aeruginosa PA01
cgcccagggacgcgc

SEQ ID NO: 3448946 - RNA, 20 nt, Pseudomonas aeruginosa PA01
cgcccagggacgcgccggcg

SEQ ID NO: 3448947 - RNA, 12 nt, Pseudomonas aeruginosa PA01
cgcccagggcca

SEQ ID NO: 3448948 - RNA, 14 nt, Pseudomonas aeruginosa PA01
cgcccagggccagc

SEQ ID NO: 3448949 - RNA, 12 nt, Pseudomonas aeruginosa PA01
cgcccagggcgu

SEQ ID NO: 3448950 - RNA, 13 nt, Pseudomonas aeruginosa PA01
cgcccagggggcc

SEQ ID NO: 3448951 - RNA, 16 nt, Pseudomonas aeruginosa PA01
cgcccagggggccggg

SEQ ID NO: 3448952 - RNA, 17 nt, Pseudomonas aeruginosa PA01
cgcccagggggccgggc

SEQ ID NO: 3448953 - RNA, 22 nt, Pseudomonas aeruginosa PA01
cgcccagggggccgggccgauc

SEQ ID NO: 3448954 - RNA, 20 nt, Pseudomonas aeruginosa PA01
cgcccagguaggcgaugcgc

SEQ ID NO: 3448955 - RNA, 16 nt, Pseudomonas aeruginosa PA01
cgcccagguccggcug

SEQ ID NO: 3448956 - RNA, 20 nt, Pseudomonas aeruginosa PA01
cgcccaggugcgagucaccc

SEQ ID NO: 3448957 - RNA, 14 nt, Pseudomonas aeruginosa PA01
cgcccaggugcgcc

SEQ ID NO: 3448958 - RNA, 15 nt, Pseudomonas aeruginosa PA01
cgcccaggugcgccg

SEQ ID NO: 3448959 - RNA, 19 nt, Pseudomonas aeruginosa PA01
cgcccaggugcgccgagcg

SEQ ID NO: 3448960 - RNA, 16 nt, Pseudomonas aeruginosa PA01
cgcccaguaccacgca

SEQ ID NO: 3448961 - RNA, 18 nt, Pseudomonas aeruginosa PA01
cgcccaguaccacgcagc

SEQ ID NO: 3448962 - RNA, 16 nt, Pseudomonas aeruginosa PA01
cgcccagugcccggca

SEQ ID NO: 3448963 - RNA, 12 nt, Pseudomonas aeruginosa PA01
cgcccagugguu

SEQ ID NO: 3448964 - RNA, 15 nt, Pseudomonas aeruginosa PA01
cgcccagugguucca

SEQ ID NO: 3448965 - RNA, 18 nt, Pseudomonas aeruginosa PA01
cgcccaguucgccggcca

SEQ ID NO: 3448966 - RNA, 20 nt, Pseudomonas aeruginosa PA01
cgcccaguucgccggccagc

SEQ ID NO: 3448967 - RNA, 18 nt, Pseudomonas aeruginosa PA01
cgcccaguucgcgcggag

SEQ ID NO: 3448968 - RNA, 17 nt, Pseudomonas aeruginosa PA01
cgcccaguugcgccgcc

SEQ ID NO: 3448969 - RNA, 21 nt, Pseudomonas aeruginosa PA01
cgcccaguugcgccgccugcg

SEQ ID NO: 3448970 - RNA, 17 nt, Pseudomonas aeruginosa PA01
cgcccaguugcgggccu

SEQ ID NO: 3448971 - RNA, 17 nt, Pseudomonas aeruginosa PA01
cgcccaucaacgagccg

SEQ ID NO: 3448972 - RNA, 23 nt, Pseudomonas aeruginosa PA01
cgcccaucaacgagccgagcagg

SEQ ID NO: 3448973 - RNA, 16 nt, Pseudomonas aeruginosa PA01
cgcccaucgagguauu

SEQ ID NO: 3448974 - RNA, 14 nt, Pseudomonas aeruginosa PA01
cgcccaucgccacc

SEQ ID NO: 3448975 - RNA, 16 nt, Pseudomonas aeruginosa PA01
cgcccaucgccaccag

SEQ ID NO: 3448976 - RNA, 15 nt, Pseudomonas aeruginosa PA01
cgcccaucgccaggg

SEQ ID NO: 3448977 - RNA, 19 nt, Pseudomonas aeruginosa PA01
cgcccaucggcgucggcug

SEQ ID NO: 3448978 - RNA, 20 nt, Pseudomonas aeruginosa PA01
cgcccaucggcgucggcugg

SEQ ID NO: 3448979 - RNA, 23 nt, Pseudomonas aeruginosa PA01
cgcccaucggcgucggcuggucg

SEQ ID NO: 3448980 - RNA, 15 nt, Pseudomonas aeruginosa PA01
cgcccaugccgcccg

SEQ ID NO: 3448981 - RNA, 16 nt, Pseudomonas aeruginosa PA01
cgcccaugccgcccgg

SEQ ID NO: 3448982 - RNA, 20 nt, Pseudomonas aeruginosa PA01
cgcccaugccgcccggccgc

SEQ ID NO: 3448983 - RNA, 21 nt, Pseudomonas aeruginosa PA01
cgcccaugccgcccggccgcu

SEQ ID NO: 3448984 - RNA, 17 nt, Pseudomonas aeruginosa PA01
cgcccaugccuugcagc

SEQ ID NO: 3448985 - RNA, 20 nt, Pseudomonas aeruginosa PA01
cgcccaugccuugcagcgcc

SEQ ID NO: 3448986 - RNA, 14 nt, Pseudomonas aeruginosa PA01
cgcccaugcgcggc

SEQ ID NO: 3448987 - RNA, 17 nt, Pseudomonas aeruginosa PA01
cgcccaugcgcggcgag

SEQ ID NO: 3448988 - RNA, 18 nt, Pseudomonas aeruginosa PA01
cgcccaugcgcggcgaga

SEQ ID NO: 3448989 - RNA, 20 nt, Pseudomonas aeruginosa PA01
cgcccauguagaccaccagc

SEQ ID NO: 3448990 - RNA, 21 nt, Pseudomonas aeruginosa PA01
cgcccauguagaccaccagcg

SEQ ID NO: 3448991 - RNA, 22 nt, Pseudomonas aeruginosa PA01
cgcccauguagaccaccagcgu

SEQ ID NO: 3448992 - RNA, 17 nt, Pseudomonas aeruginosa PA01
cgcccauugcccggcca

SEQ ID NO: 3448993 - RNA, 18 nt, Pseudomonas aeruginosa PA01
cgcccauugcccggccag

SEQ ID NO: 3448994 - RNA, 19 nt, Pseudomonas aeruginosa PA01
cgcccauugcccggccagg

SEQ ID NO: 3448995 - RNA, 14 nt, Pseudomonas aeruginosa PA01
cgcccauugccggg

SEQ ID NO: 3448996 - RNA, 21 nt, Pseudomonas aeruginosa PA01
cgccccaccaccaucgccgcg

SEQ ID NO: 3448997 - RNA, 13 nt, Pseudomonas aeruginosa PA01
cgccccaccaggc

SEQ ID NO: 3448998 - RNA, 23 nt, Pseudomonas aeruginosa PA01
cgccccaccccaggguuggcggc

SEQ ID NO: 3448999 - RNA, 18 nt, Pseudomonas aeruginosa PA01
cgccccacggcgcggccg

SEQ ID NO: 3449000 - RNA, 19 nt, Pseudomonas aeruginosa PA01
cgccccacggcgcggccgu

SEQ ID NO: 3449001 - RNA, 21 nt, Pseudomonas aeruginosa PA01
cgcccgccacggcgcgcuccg

SEQ ID NO: 3449002 - RNA, 13 nt, Pseudomonas aeruginosa PA01
cgcccgcccggaa

SEQ ID NO: 3449003 - RNA, 12 nt, Pseudomonas aeruginosa PA01
cgcccgcccggc

SEQ ID NO: 3449004 - RNA, 12 nt, Pseudomonas aeruginosa PA01
cgcccgccgccu

SEQ ID NO: 3449005 - RNA, 12 nt, Pseudomonas aeruginosa PA01
cgcccgccgcga

SEQ ID NO: 3449006 - RNA, 14 nt, Pseudomonas aeruginosa PA01
cgcccgccgcgagc

SEQ ID NO: 3449007 - RNA, 15 nt, Pseudomonas aeruginosa PA01
cgcccgccgcgagcg

SEQ ID NO: 3449008 - RNA, 12 nt, Pseudomonas aeruginosa PA01
cgcccgccggcg

SEQ ID NO: 3449009 - RNA, 14 nt, Pseudomonas aeruginosa PA01
cgcccgccguccuc

SEQ ID NO: 3449010 - RNA, 15 nt, Pseudomonas aeruginosa PA01
cgcccgccguccucc

SEQ ID NO: 3449011 - RNA, 17 nt, Pseudomonas aeruginosa PA01
cgcccgccucaggccgg

SEQ ID NO: 3449012 - RNA, 13 nt, Pseudomonas aeruginosa PA01
cgcccgccucgga

SEQ ID NO: 3449013 - RNA, 18 nt, Pseudomonas aeruginosa PA01
cgcccgccugauggcgaa

SEQ ID NO: 3449014 - RNA, 20 nt, Pseudomonas aeruginosa PA01
cgcccgccuggaaggcgcug

SEQ ID NO: 3449015 - RNA, 22 nt, Pseudomonas aeruginosa PA01
cgcccgccuggaaggcgcuggg

SEQ ID NO: 3449016 - RNA, 19 nt, Pseudomonas aeruginosa PA01
cgcccgccuuguucgccag

SEQ ID NO: 3449017 - RNA, 23 nt, Pseudomonas aeruginosa PA01
cgcccgccuuguucgccagcacc

SEQ ID NO: 3449018 - RNA, 20 nt, Pseudomonas aeruginosa PA01
cgcccgcgagccguccugcg

SEQ ID NO: 3449019 - RNA, 22 nt, Pseudomonas aeruginosa PA01
cgcccgcgagccguccugcggc

SEQ ID NO: 3449020 - RNA, 11 nt, Pseudomonas aeruginosa PA01
cgcccgcgcau

SEQ ID NO: 3449021 - RNA, 15 nt, Pseudomonas aeruginosa PA01
cgcccgcgcauggag

SEQ ID NO: 3449022 - RNA, 18 nt, Pseudomonas aeruginosa PA01
cgcccgcgcauggagacg

SEQ ID NO: 3449023 - RNA, 22 nt, Pseudomonas aeruginosa PA01
cgcccgcgcauggagacggccc

SEQ ID NO: 3449024 - RNA, 12 nt, Pseudomonas aeruginosa PA01
cgcccgcgccuc

SEQ ID NO: 3449025 - RNA, 13 nt, Pseudomonas aeruginosa PA01
cgcccgcgccucc

SEQ ID NO: 3449026 - RNA, 17 nt, Pseudomonas aeruginosa PA01
cgcccgcgccuccaggc

SEQ ID NO: 3449027 - RNA, 19 nt, Pseudomonas aeruginosa PA01
cgcccgcgccuccaggcgc

SEQ ID NO: 3449028 - RNA, 14 nt, Pseudomonas aeruginosa PA01
cgcccgcgccucga

SEQ ID NO: 3449029 - RNA, 17 nt, Pseudomonas aeruginosa PA01
cgcccgcggcagcagcc

SEQ ID NO: 3449030 - RNA, 14 nt, Pseudomonas aeruginosa PA01
cgcccgcggcggcg

SEQ ID NO: 3449031 - RNA, 15 nt, Pseudomonas aeruginosa PA01
cgcccgcggcggcga

SEQ ID NO: 3449032 - RNA, 17 nt, Pseudomonas aeruginosa PA01
cgcccgcggcggcgacg

SEQ ID NO: 3449033 - RNA, 23 nt, Pseudomonas aeruginosa PA01
cgcccgcggcggcgacgcuggcg

SEQ ID NO: 3449034 - RNA, 13 nt, Pseudomonas aeruginosa PA01
cgcccgcggcguu

SEQ ID NO: 3449035 - RNA, 14 nt, Pseudomonas aeruginosa PA01
cgcccgcgggcagc

SEQ ID NO: 3449036 - RNA, 14 nt, Pseudomonas aeruginosa PA01
cgcccgcgggcgcc

SEQ ID NO: 3449037 - RNA, 23 nt, Pseudomonas aeruginosa PA01
cgcccgcgguauucuccagcagg

SEQ ID NO: 3449038 - RNA, 22 nt, Pseudomonas aeruginosa PA01
cgcccgcucaagggcuggcagg

SEQ ID NO: 3449039 - RNA, 20 nt, Pseudomonas aeruginosa PA01
cgcccgcugcgcugccagcg

SEQ ID NO: 3449040 - RNA, 22 nt, Pseudomonas aeruginosa PA01
cgcccgcugcgcugccagcgcc

SEQ ID NO: 3449041 - RNA, 23 nt, Pseudomonas aeruginosa PA01
cgcccgcugcgcugccagcgccg

SEQ ID NO: 3449042 - RNA, 17 nt, Pseudomonas aeruginosa PA01
cgcccgcugugcgggga

SEQ ID NO: 3449043 - RNA, 15 nt, Pseudomonas aeruginosa PA01
cgcccgcuucgccau

SEQ ID NO: 3449044 - RNA, 17 nt, Pseudomonas aeruginosa PA01
cgcccgcuucgccaucg

SEQ ID NO: 3449045 - RNA, 18 nt, Pseudomonas aeruginosa PA01
cgcccgcuucgccaucga

SEQ ID NO: 3449046 - RNA, 18 nt, Pseudomonas aeruginosa PA01
cgcccgcuugcgccgccu

SEQ ID NO: 3449047 - RNA, 20 nt, Pseudomonas aeruginosa PA01
cgcccgcuugcgccgccucg

SEQ ID NO: 3449048 - RNA, 23 nt, Pseudomonas aeruginosa PA01
cgcccgcuugcgccgccucgcgc

SEQ ID NO: 3449049 - RNA, 21 nt, Pseudomonas aeruginosa PA01
cgcccggaaaaaaaagcccgc

SEQ ID NO: 3449050 - RNA, 23 nt, Pseudomonas aeruginosa PA01
cgcccggaccgaucucguucggg

SEQ ID NO: 3449051 - RNA, 14 nt, Pseudomonas aeruginosa PA01
cgcccggagcgcga

SEQ ID NO: 3449052 - RNA, 23 nt, Pseudomonas aeruginosa PA01
cgcccggauagacgccguccacc

SEQ ID NO: 3449053 - RNA, 17 nt, Pseudomonas aeruginosa PA01
cgcccggcaaucaggcg

SEQ ID NO: 3449054 - RNA, 18 nt, Pseudomonas aeruginosa PA01
cgcccggcaaucaggcgc

SEQ ID NO: 3449055 - RNA, 20 nt, Pseudomonas aeruginosa PA01
cgcccggcaaucaggcgcga

SEQ ID NO: 3449056 - RNA, 15 nt, Pseudomonas aeruginosa PA01
cgcccggcaccaccg

SEQ ID NO: 3449057 - RNA, 16 nt, Pseudomonas aeruginosa PA01
cgcccggcaccaccgg

SEQ ID NO: 3449058 - RNA, 19 nt, Pseudomonas aeruginosa PA01
cgcccggcaccaccgguca

SEQ ID NO: 3449059 - RNA, 15 nt, Pseudomonas aeruginosa PA01
cgcccggcacucgcc

SEQ ID NO: 3449060 - RNA, 18 nt, Pseudomonas aeruginosa PA01
cgcccggcacucgccggg

SEQ ID NO: 3449061 - RNA, 17 nt, Pseudomonas aeruginosa PA01
cgcccggcagcaggccg

SEQ ID NO: 3449062 - RNA, 20 nt, Pseudomonas aeruginosa PA01
cgcccggcagcaggccgccg

SEQ ID NO: 3449063 - RNA, 21 nt, Pseudomonas aeruginosa PA01
cgcccggcagcaggccgccgc

SEQ ID NO: 3449064 - RNA, 15 nt, Pseudomonas aeruginosa PA01
cgcccggcagcggcu

SEQ ID NO: 3449065 - RNA, 17 nt, Pseudomonas aeruginosa PA01
cgcccggcagcggcugg

SEQ ID NO: 3449066 - RNA, 18 nt, Pseudomonas aeruginosa PA01
cgcccggcagcggcuggc

SEQ ID NO: 3449067 - RNA, 16 nt, Pseudomonas aeruginosa PA01
cgcccggcaucugccg

SEQ ID NO: 3449068 - RNA, 22 nt, Pseudomonas aeruginosa PA01
cgcccggcaucugccgggcguu

SEQ ID NO: 3449069 - RNA, 13 nt, Pseudomonas aeruginosa PA01
cgcccggccaggc

SEQ ID NO: 3449070 - RNA, 14 nt, Pseudomonas aeruginosa PA01
cgcccggccaggcc

SEQ ID NO: 3449071 - RNA, 22 nt, Pseudomonas aeruginosa PA01
cgcccggccaggccacggcgga

SEQ ID NO: 3449072 - RNA, 16 nt, Pseudomonas aeruginosa PA01
cgcccggccaggccgc

SEQ ID NO: 3449073 - RNA, 19 nt, Pseudomonas aeruginosa PA01
cgcccggccaggccgccca

SEQ ID NO: 3449074 - RNA, 12 nt, Pseudomonas aeruginosa PA01
cgcccggccgga

SEQ ID NO: 3449075 - RNA, 22 nt, Pseudomonas aeruginosa PA01
cgcccggccggauuggccgagg

SEQ ID NO: 3449076 - RNA, 15 nt, Pseudomonas aeruginosa PA01
cgcccggccuccccg

SEQ ID NO: 3449077 - RNA, 21 nt, Pseudomonas aeruginosa PA01
cgcccggccuccccggcccgc

SEQ ID NO: 3449078 - RNA, 13 nt, Pseudomonas aeruginosa PA01
cgcccggccuuca

SEQ ID NO: 3449079 - RNA, 23 nt, Pseudomonas aeruginosa PA01
cgcccggccuucaccgcgccgcg

SEQ ID NO: 3449080 - RNA, 16 nt, Pseudomonas aeruginosa PA01
cgcccggcgaacagcg

SEQ ID NO: 3449081 - RNA, 18 nt, Pseudomonas aeruginosa PA01
cgcccggcgaacagcgcu

SEQ ID NO: 3449082 - RNA, 19 nt, Pseudomonas aeruginosa PA01
cgcccggcgaacagcgcuu

SEQ ID NO: 3449083 - RNA, 16 nt, Pseudomonas aeruginosa PA01
cgcccggcgcagaacu

SEQ ID NO: 3449084 - RNA, 16 nt, Pseudomonas aeruginosa PA01
cgcccggcgcaugccg

SEQ ID NO: 3449085 - RNA, 20 nt, Pseudomonas aeruginosa PA01
cgcccggcgcaugccgcagg

SEQ ID NO: 3449086 - RNA, 14 nt, Pseudomonas aeruginosa PA01
cgcccggcgccacc

SEQ ID NO: 3449087 - RNA, 16 nt, Pseudomonas aeruginosa PA01
cgcccggcgccacccc

SEQ ID NO: 3449088 - RNA, 15 nt, Pseudomonas aeruginosa PA01
cgcccggcgccaccg

SEQ ID NO: 3449089 - RNA, 24 nt, Pseudomonas aeruginosa PA01
cgcccggcgccaccgcguugacgc

SEQ ID NO: 3449090 - RNA, 15 nt, Pseudomonas aeruginosa PA01
cgcccggcgccaggc

SEQ ID NO: 3449091 - RNA, 12 nt, Pseudomonas aeruginosa PA01
cgcccggcgcga

SEQ ID NO: 3449092 - RNA, 22 nt, Pseudomonas aeruginosa PA01
cgcccggcgcgaccgucggccg

SEQ ID NO: 3449093 - RNA, 14 nt, Pseudomonas aeruginosa PA01
cgcccggcgcucca

SEQ ID NO: 3449094 - RNA, 20 nt, Pseudomonas aeruginosa PA01
cgcccggcgcuccaacagca

SEQ ID NO: 3449095 - RNA, 14 nt, Pseudomonas aeruginosa PA01
cgcccggcucgacc

SEQ ID NO: 3449096 - RNA, 20 nt, Pseudomonas aeruginosa PA01
cgcccggcucgcccaugcgc

SEQ ID NO: 3449097 - RNA, 14 nt, Pseudomonas aeruginosa PA01
cgcccggcucgccg

SEQ ID NO: 3449098 - RNA, 17 nt, Pseudomonas aeruginosa PA01
cgcccggcucgccgccg

SEQ ID NO: 3449099 - RNA, 18 nt, Pseudomonas aeruginosa PA01
cgcccggcucgccgccgg

SEQ ID NO: 3449100 - RNA, 19 nt, Pseudomonas aeruginosa PA01
cgcccggcucgccgccggg

SEQ ID NO: 3449101 - RNA, 22 nt, Pseudomonas aeruginosa PA01
cgcccggcucgccgccgggcgc

SEQ ID NO: 3449102 - RNA, 12 nt, Pseudomonas aeruginosa PA01
cgcccggcucgg

SEQ ID NO: 3449103 - RNA, 18 nt, Pseudomonas aeruginosa PA01
cgcccggcucggccgugu

SEQ ID NO: 3449104 - RNA, 20 nt, Pseudomonas aeruginosa PA01
cgcccuggccgucggccugc

SEQ ID NO: 3449105 - RNA, 15 nt, Pseudomonas aeruginosa PA01
cgcccuggccucggc

SEQ ID NO: 3449106 - RNA, 16 nt, Pseudomonas aeruginosa PA01
cgcccuggccucggcg

SEQ ID NO: 3449107 - RNA, 16 nt, Pseudomonas aeruginosa PA01
cgcccuggcgccagcg

SEQ ID NO: 3449108 - RNA, 14 nt, Pseudomonas aeruginosa PA01
cgcccuggcgcuug

SEQ ID NO: 3449109 - RNA, 13 nt, Pseudomonas aeruginosa PA01
cgcccugggcgcg

SEQ ID NO: 3449110 - RNA, 19 nt, Pseudomonas aeruginosa PA01
cgcccugggcgcgaauggc

SEQ ID NO: 3449111 - RNA, 23 nt, Pseudomonas aeruginosa PA01
cgcccugggguuucugcuggcca

SEQ ID NO: 3449112 - RNA, 12 nt, Pseudomonas aeruginosa PA01
cgcccugggugg

SEQ ID NO: 3449113 - RNA, 14 nt, Pseudomonas aeruginosa PA01
cgcccugggugguc

SEQ ID NO: 3449114 - RNA, 23 nt, Pseudomonas aeruginosa PA01
cgcccuggugcacggcgacccgc

SEQ ID NO: 3449115 - RNA, 15 nt, Pseudomonas aeruginosa PA01
cgcccuguucggcgg

SEQ ID NO: 3449116 - RNA, 16 nt, Pseudomonas aeruginosa PA01
cgcccuguucggcggg

SEQ ID NO: 3449117 - RNA, 17 nt, Pseudomonas aeruginosa PA01
cgcccuguucggcggga

SEQ ID NO: 3449118 - RNA, 18 nt, Pseudomonas aeruginosa PA01
cgcccuguucgucuggcg

SEQ ID NO: 3449119 - RNA, 22 nt, Pseudomonas aeruginosa PA01
cgcccuguucgucuggcgccug

SEQ ID NO: 3449120 - RNA, 22 nt, Pseudomonas aeruginosa PA01
cgcccuguuucggguccaggcg

SEQ ID NO: 3449121 - RNA, 23 nt, Pseudomonas aeruginosa PA01
cgcccuguuucggguccaggcgc

SEQ ID NO: 3449122 - RNA, 14 nt, Pseudomonas aeruginosa PA01
cgcccuucagcgcc

SEQ ID NO: 3449123 - RNA, 16 nt, Pseudomonas aeruginosa PA01
cgcccuucagcgccuc

SEQ ID NO: 3449124 - RNA, 17 nt, Pseudomonas aeruginosa PA01
cgcccuucagcgccucg

SEQ ID NO: 3449125 - RNA, 17 nt, Pseudomonas aeruginosa PA01
cgcccuucgaacccgcc

SEQ ID NO: 3449126 - RNA, 20 nt, Pseudomonas aeruginosa PA01
cgcccuucgaacccgcccuc

SEQ ID NO: 3449127 - RNA, 20 nt, Pseudomonas aeruginosa PA01
cgcccuucgagaaacugcag

SEQ ID NO: 3449128 - RNA, 21 nt, Pseudomonas aeruginosa PA01
cgcccuucgagaaacugcagg

SEQ ID NO: 3449129 - RNA, 13 nt, Pseudomonas aeruginosa PA01
cgcccuucuucca

SEQ ID NO: 3449130 - RNA, 11 nt, Pseudomonas aeruginosa PA01
cgcccuugacc

SEQ ID NO: 3449131 - RNA, 20 nt, Pseudomonas aeruginosa PA01
cgcccuugaccagucccggc

SEQ ID NO: 3449132 - RNA, 21 nt, Pseudomonas aeruginosa PA01
cgcccuugacguucaggcugu

SEQ ID NO: 3449133 - RNA, 19 nt, Pseudomonas aeruginosa PA01
cgcccuugagcacgucgcc

SEQ ID NO: 3449134 - RNA, 15 nt, Pseudomonas aeruginosa PA01
cgcccuugcgccgcg

SEQ ID NO: 3449135 - RNA, 16 nt, Pseudomonas aeruginosa PA01
cgcccuugcgccgcgg

SEQ ID NO: 3449136 - RNA, 19 nt, Pseudomonas aeruginosa PA01
cgcccuugcggcccgccuc

SEQ ID NO: 3449137 - RNA, 17 nt, Pseudomonas aeruginosa PA01
cgcccuugcucgcggcg

SEQ ID NO: 3449138 - RNA, 18 nt, Pseudomonas aeruginosa PA01
cgcccuugcucgcggcgu

SEQ ID NO: 3449139 - RNA, 20 nt, Pseudomonas aeruginosa PA01
cgcccuugcugcccaguacc

SEQ ID NO: 3449140 - RNA, 13 nt, Pseudomonas aeruginosa PA01
cgcccuuggcggc

SEQ ID NO: 3449141 - RNA, 15 nt, Pseudomonas aeruginosa PA01
cgcccuuggcggcgc

SEQ ID NO: 3449142 - RNA, 18 nt, Pseudomonas aeruginosa PA01
cgcccuuguagaucgaca

SEQ ID NO: 3449143 - RNA, 19 nt, Pseudomonas aeruginosa PA01
cgcccuuguagaucgacag

SEQ ID NO: 3449144 - RNA, 21 nt, Pseudomonas aeruginosa PA01
cgcccuuuuucgucgccagcc

SEQ ID NO: 3449145 - RNA, 21 nt, Pseudomonas aeruginosa PA01
cgccgaaaaauucagcgcagc

SEQ ID NO: 3449146 - RNA, 20 nt, Pseudomonas aeruginosa PA01
cgccgaaaagaaaaggccac

SEQ ID NO: 3449147 - RNA, 21 nt, Pseudomonas aeruginosa PA01
cgccgaaaagaaaaggccacc

SEQ ID NO: 3449148 - RNA, 23 nt, Pseudomonas aeruginosa PA01
cgccgaaaagaagccccgcagcc

SEQ ID NO: 3449149 - RNA, 16 nt, Pseudomonas aeruginosa PA01
cgccgaaacgccgacg

SEQ ID NO: 3449150 - RNA, 15 nt, Pseudomonas aeruginosa PA01
cgccgaaagcacgcg

SEQ ID NO: 3449151 - RNA, 16 nt, Pseudomonas aeruginosa PA01
cgccgaaagcacgcgc

SEQ ID NO: 3449152 - RNA, 20 nt, Pseudomonas aeruginosa PA01
cgccgaaagcacgcgcaucc

SEQ ID NO: 3449153 - RNA, 14 nt, Pseudomonas aeruginosa PA01
cgccgaaaggccgu

SEQ ID NO: 3449154 - RNA, 16 nt, Pseudomonas aeruginosa PA01
cgccgaaauagcgcgc

SEQ ID NO: 3449155 - RNA, 18 nt, Pseudomonas aeruginosa PA01
cgccgaaauagcgcgccc

SEQ ID NO: 3449156 - RNA, 21 nt, Pseudomonas aeruginosa PA01
cgccgaaaugcugcaggccga

SEQ ID NO: 3449157 - RNA, 22 nt, Pseudomonas aeruginosa PA01
cgccgaaaugcugcaggccgag

SEQ ID NO: 3449158 - RNA, 13 nt, Pseudomonas aeruginosa PA01
cgccgaacagcaa

SEQ ID NO: 3449159 - RNA, 14 nt, Pseudomonas aeruginosa PA01
cgccgaacagcaac

SEQ ID NO: 3449160 - RNA, 15 nt, Pseudomonas aeruginosa PA01
cgccgaacagcaaca

SEQ ID NO: 3449161 - RNA, 19 nt, Pseudomonas aeruginosa PA01
cgccgaacagcaacaccgc

SEQ ID NO: 3449162 - RNA, 20 nt, Pseudomonas aeruginosa PA01
cgccgaacagcaacaccgcg

SEQ ID NO: 3449163 - RNA, 21 nt, Pseudomonas aeruginosa PA01
cgccgaacagcaacaccgcgc

SEQ ID NO: 3449164 - RNA, 22 nt, Pseudomonas aeruginosa PA01
cgccgaacagcaacaccgcgca

SEQ ID NO: 3449165 - RNA, 12 nt, Pseudomonas aeruginosa PA01
cgccgaacagcc

SEQ ID NO: 3449166 - RNA, 15 nt, Pseudomonas aeruginosa PA01
cgccgaacagccgcc

SEQ ID NO: 3449167 - RNA, 17 nt, Pseudomonas aeruginosa PA01
cgccgaacagccgcccc

SEQ ID NO: 3449168 - RNA, 18 nt, Pseudomonas aeruginosa PA01
cgccgaacagccgcccca

SEQ ID NO: 3449169 - RNA, 19 nt, Pseudomonas aeruginosa PA01
cgccgaacagccgccccac

SEQ ID NO: 3449170 - RNA, 23 nt, Pseudomonas aeruginosa PA01
cgccgaacagccgccccaccacc

SEQ ID NO: 3449171 - RNA, 20 nt, Pseudomonas aeruginosa PA01
cgccgaacaggaucuccucg

SEQ ID NO: 3449172 - RNA, 23 nt, Pseudomonas aeruginosa PA01
cgccgaacaggaucuccucggcc

SEQ ID NO: 3449173 - RNA, 13 nt, Pseudomonas aeruginosa PA01
cgccgaacagggc

SEQ ID NO: 3449174 - RNA, 14 nt, Pseudomonas aeruginosa PA01
cgccgaacaggguu

SEQ ID NO: 3449175 - RNA, 18 nt, Pseudomonas aeruginosa PA01
cgccgaacaugccgaaga

SEQ ID NO: 3449176 - RNA, 20 nt, Pseudomonas aeruginosa PA01
cgccgaacaugccgaagagc

SEQ ID NO: 3449177 - RNA, 15 nt, Pseudomonas aeruginosa PA01
cgccgaacgccacca

SEQ ID NO: 3449178 - RNA, 18 nt, Pseudomonas aeruginosa PA01
cgccgaacgccaccaggg

SEQ ID NO: 3449179 - RNA, 20 nt, Pseudomonas aeruginosa PA01
cgccgaacgccaccagggcc

SEQ ID NO: 3449180 - RNA, 16 nt, Pseudomonas aeruginosa PA01
cgccgaacgccccagu

SEQ ID NO: 3449181 - RNA, 17 nt, Pseudomonas aeruginosa PA01
cgccgaacggaucgcgu

SEQ ID NO: 3449182 - RNA, 15 nt, Pseudomonas aeruginosa PA01
cgccgaacggcagcu

SEQ ID NO: 3449183 - RNA, 17 nt, Pseudomonas aeruginosa PA01
cgccgaagaacucggcg

SEQ ID NO: 3449184 - RNA, 18 nt, Pseudomonas aeruginosa PA01
cgccgaagaacucggcgc

SEQ ID NO: 3449185 - RNA, 19 nt, Pseudomonas aeruginosa PA01
cgccgaagaacucggcgcu

SEQ ID NO: 3449186 - RNA, 14 nt, Pseudomonas aeruginosa PA01
cgccgaagauccgc

SEQ ID NO: 3449187 - RNA, 19 nt, Pseudomonas aeruginosa PA01
cgccgaagauccgcuccag

SEQ ID NO: 3449188 - RNA, 20 nt, Pseudomonas aeruginosa PA01
cgccgaagauccgcuccagg

SEQ ID NO: 3449189 - RNA, 21 nt, Pseudomonas aeruginosa PA01
cgccgaagauccgcuccaggc

SEQ ID NO: 3449190 - RNA, 19 nt, Pseudomonas aeruginosa PA01
cgccgaagcccgugucgcc

SEQ ID NO: 3449191 - RNA, 20 nt, Pseudomonas aeruginosa PA01
cgccgaagccgacgccgagc

SEQ ID NO: 3449192 - RNA, 14 nt, Pseudomonas aeruginosa PA01
cgccgaagcggggc

SEQ ID NO: 3449193 - RNA, 13 nt, Pseudomonas aeruginosa PA01
cgccgaaggccag

SEQ ID NO: 3449194 - RNA, 15 nt, Pseudomonas aeruginosa PA01
cgccgaaggcgauau

SEQ ID NO: 3449195 - RNA, 15 nt, Pseudomonas aeruginosa PA01
cgccgaaggcgucgg

SEQ ID NO: 3449196 - RNA, 17 nt, Pseudomonas aeruginosa PA01
cgccgaagggccgcagg

SEQ ID NO: 3449197 - RNA, 21 nt, Pseudomonas aeruginosa PA01
cgccgaaggugaaguccggcg

SEQ ID NO: 3449198 - RNA, 23 nt, Pseudomonas aeruginosa PA01
cgccgaaggugaaguccggcgcg

SEQ ID NO: 3449199 - RNA, 22 nt, Pseudomonas aeruginosa PA01
cgccgaaggugcaggccgcgcg

SEQ ID NO: 3449200 - RNA, 19 nt, Pseudomonas aeruginosa PA01
cgccgaaguccugcaacag

SEQ ID NO: 3449201 - RNA, 22 nt, Pseudomonas aeruginosa PA01
cgccgaaguccugcaacagggc

SEQ ID NO: 3449202 - RNA, 15 nt, Pseudomonas aeruginosa PA01
cgccgaagucggcga

SEQ ID NO: 3449203 - RNA, 16 nt, Pseudomonas aeruginosa PA01
cgccgaagucggcgag

SEQ ID NO: 3449204 - RNA, 22 nt, Pseudomonas aeruginosa PA01
cgccgaagucggcgagccggcg

SEQ ID NO: 3449205 - RNA, 23 nt, Pseudomonas aeruginosa PA01
cgccgaagucggcgagccggcgc

SEQ ID NO: 3449206 - RNA, 20 nt, Pseudomonas aeruginosa PA01
cgccgaggauacgcucagga

SEQ ID NO: 3449207 - RNA, 22 nt, Pseudomonas aeruginosa PA01
cgccgaggauacgcucaggaag

SEQ ID NO: 3449208 - RNA, 19 nt, Pseudomonas aeruginosa PA01
cgccgaggauagcguccag

SEQ ID NO: 3449209 - RNA, 22 nt, Pseudomonas aeruginosa PA01
cgccgaggcccagcgacuccgc

SEQ ID NO: 3449210 - RNA, 14 nt, Pseudomonas aeruginosa PA01
cgccgaggcgcgcc

SEQ ID NO: 3449211 - RNA, 16 nt, Pseudomonas aeruginosa PA01
cgccgaggcgcgccac

SEQ ID NO: 3449212 - RNA, 19 nt, Pseudomonas aeruginosa PA01
cgccgaggcgcgccacgca

SEQ ID NO: 3449213 - RNA, 14 nt, Pseudomonas aeruginosa PA01
cgccgaggcggcgc

SEQ ID NO: 3449214 - RNA, 17 nt, Pseudomonas aeruginosa PA01
cgccgaggcggcgcagc

SEQ ID NO: 3449215 - RNA, 14 nt, Pseudomonas aeruginosa PA01
cgccgagggcaagg

SEQ ID NO: 3449216 - RNA, 18 nt, Pseudomonas aeruginosa PA01
cgccgagggcaagguagu

SEQ ID NO: 3449217 - RNA, 22 nt, Pseudomonas aeruginosa PA01
cgccgagggcaccgacgauggg

SEQ ID NO: 3449218 - RNA, 13 nt, Pseudomonas aeruginosa PA01
cgccgagggcgaa

SEQ ID NO: 3449219 - RNA, 19 nt, Pseudomonas aeruginosa PA01
cgccgagggcgaagacuuc

SEQ ID NO: 3449220 - RNA, 21 nt, Pseudomonas aeruginosa PA01
cgccgagggcgccaggugcag

SEQ ID NO: 3449221 - RNA, 15 nt, Pseudomonas aeruginosa PA01
cgccgagggcgcggc

SEQ ID NO: 3449222 - RNA, 18 nt, Pseudomonas aeruginosa PA01
cgccgagggcgcggcgcc

SEQ ID NO: 3449223 - RNA, 19 nt, Pseudomonas aeruginosa PA01
cgccgagggcgcggcgcca

SEQ ID NO: 3449224 - RNA, 22 nt, Pseudomonas aeruginosa PA01
cgccgagggcuguaaucgccgc

SEQ ID NO: 3449225 - RNA, 16 nt, Pseudomonas aeruginosa PA01
cgccgaggggcgggau

SEQ ID NO: 3449226 - RNA, 13 nt, Pseudomonas aeruginosa PA01
cgccgaggucagu

SEQ ID NO: 3449227 - RNA, 22 nt, Pseudomonas aeruginosa PA01
cgccgaggucaguucggugccg

SEQ ID NO: 3449228 - RNA, 17 nt, Pseudomonas aeruginosa PA01
cgccgaggucuuggcca

SEQ ID NO: 3449229 - RNA, 19 nt, Pseudomonas aeruginosa PA01
cgccgaggucuuggccagc

SEQ ID NO: 3449230 - RNA, 22 nt, Pseudomonas aeruginosa PA01
cgccgaggucuuggccagccgc

SEQ ID NO: 3449231 - RNA, 18 nt, Pseudomonas aeruginosa PA01
cgccgaggugcggcuugc

SEQ ID NO: 3449232 - RNA, 19 nt, Pseudomonas aeruginosa PA01
cgccgaggugcugcaccgg

SEQ ID NO: 3449233 - RNA, 13 nt, Pseudomonas aeruginosa PA01
cgccgagguugcg

SEQ ID NO: 3449234 - RNA, 15 nt, Pseudomonas aeruginosa PA01
cgccgagguugcugc

SEQ ID NO: 3449235 - RNA, 20 nt, Pseudomonas aeruginosa PA01
cgccgagguugcugcggcau

SEQ ID NO: 3449236 - RNA, 22 nt, Pseudomonas aeruginosa PA01
cgccgaguacacaaugaucgcg

SEQ ID NO: 3449237 - RNA, 14 nt, Pseudomonas aeruginosa PA01
cgccgaguggccgc

SEQ ID NO: 3449238 - RNA, 17 nt, Pseudomonas aeruginosa PA01
cgccgaguggccgcuga

SEQ ID NO: 3449239 - RNA, 16 nt, Pseudomonas aeruginosa PA01
cgccgagugugccggc

SEQ ID NO: 3449240 - RNA, 23 nt, Pseudomonas aeruginosa PA01
cgccgagugugccggccaugcag

SEQ ID NO: 3449241 - RNA, 17 nt, Pseudomonas aeruginosa PA01
cgccgaguucgccgcga

SEQ ID NO: 3449242 - RNA, 18 nt, Pseudomonas aeruginosa PA01
cgccgauacagcgcgcga

SEQ ID NO: 3449243 - RNA, 13 nt, Pseudomonas aeruginosa PA01
cgccgauaccggc

SEQ ID NO: 3449244 - RNA, 22 nt, Pseudomonas aeruginosa PA01
cgccgauaccggccucgaugaa

SEQ ID NO: 3449245 - RNA, 17 nt, Pseudomonas aeruginosa PA01
cgccgauauugaacgac

SEQ ID NO: 3449246 - RNA, 15 nt, Pseudomonas aeruginosa PA01
cgccgaucaccagga

SEQ ID NO: 3449247 - RNA, 20 nt, Pseudomonas aeruginosa PA01
cgccgaucaccccgcccagu

SEQ ID NO: 3449248 - RNA, 13 nt, Pseudomonas aeruginosa PA01
cgccgaucagcgc

SEQ ID NO: 3449249 - RNA, 15 nt, Pseudomonas aeruginosa PA01
cgccgaucagcgcgc

SEQ ID NO: 3449250 - RNA, 17 nt, Pseudomonas aeruginosa PA01
cgccgaucagcgcgccu

SEQ ID NO: 3449251 - RNA, 12 nt, Pseudomonas aeruginosa PA01
cgccgaucaggc

SEQ ID NO: 3449252 - RNA, 22 nt, Pseudomonas aeruginosa PA01
cgccgaucaggcguaggccguc

SEQ ID NO: 3449253 - RNA, 12 nt, Pseudomonas aeruginosa PA01
cgccgauccagg

SEQ ID NO: 3449254 - RNA, 15 nt, Pseudomonas aeruginosa PA01
cgccgauccaggaac

SEQ ID NO: 3449255 - RNA, 14 nt, Pseudomonas aeruginosa PA01
cgccgauccaggcg

SEQ ID NO: 3449256 - RNA, 18 nt, Pseudomonas aeruginosa PA01
cgccgaucccgaucggca

SEQ ID NO: 3449257 - RNA, 19 nt, Pseudomonas aeruginosa PA01
cgccgaucccggcggcgac

SEQ ID NO: 3449258 - RNA, 13 nt, Pseudomonas aeruginosa PA01
cgccgaucuccuc

SEQ ID NO: 3449259 - RNA, 20 nt, Pseudomonas aeruginosa PA01
cgccgaucuccuccgccccg

SEQ ID NO: 3449260 - RNA, 23 nt, Pseudomonas aeruginosa PA01
cgccgaugaaagagcccgcggaa

SEQ ID NO: 3449261 - RNA, 15 nt, Pseudomonas aeruginosa PA01
cgccgaugcccaggc

SEQ ID NO: 3449262 - RNA, 17 nt, Pseudomonas aeruginosa PA01
cgccgaugcccaggccg

SEQ ID NO: 3449263 - RNA, 20 nt, Pseudomonas aeruginosa PA01
cgccgaugcccaggccgaug

SEQ ID NO: 3449264 - RNA, 14 nt, Pseudomonas aeruginosa PA01
cgccgaugcccggg

SEQ ID NO: 3449265 - RNA, 12 nt, Pseudomonas aeruginosa PA01
cgccgaugccga

SEQ ID NO: 3449266 - RNA, 14 nt, Pseudomonas aeruginosa PA01
cgccgaugccgacg

SEQ ID NO: 3449267 - RNA, 15 nt, Pseudomonas aeruginosa PA01
cgccgaugccggccg

SEQ ID NO: 3449268 - RNA, 18 nt, Pseudomonas aeruginosa PA01
cgccgaugccggccggca

SEQ ID NO: 3449269 - RNA, 20 nt, Pseudomonas aeruginosa PA01
cgccgaugccggccggcagc

SEQ ID NO: 3449270 - RNA, 14 nt, Pseudomonas aeruginosa PA01
cgccgaugcgccga

SEQ ID NO: 3449271 - RNA, 15 nt, Pseudomonas aeruginosa PA01
cgccgaugcgccgac

SEQ ID NO: 3449272 - RNA, 15 nt, Pseudomonas aeruginosa PA01
cgccgaugcgcuacg

SEQ ID NO: 3449273 - RNA, 15 nt, Pseudomonas aeruginosa PA01
cgccgaugcuguuca

SEQ ID NO: 3449274 - RNA, 19 nt, Pseudomonas aeruginosa PA01
cgccgaugcuguucagcag

SEQ ID NO: 3449275 - RNA, 19 nt, Pseudomonas aeruginosa PA01
cgccgauggcugucggcgc

SEQ ID NO: 3449276 - RNA, 16 nt, Pseudomonas aeruginosa PA01
cgccgauguacggcac

SEQ ID NO: 3449277 - RNA, 18 nt, Pseudomonas aeruginosa PA01
cgccgauguacggcacca

SEQ ID NO: 3449278 - RNA, 20 nt, Pseudomonas aeruginosa PA01
cgccgaugucguagccgcgc

SEQ ID NO: 3449279 - RNA, 22 nt, Pseudomonas aeruginosa PA01
cgccgaugucguagccgcgcgc

SEQ ID NO: 3449280 - RNA, 17 nt, Pseudomonas aeruginosa PA01
cgccgauugcaugaccu

SEQ ID NO: 3449281 - RNA, 22 nt, Pseudomonas aeruginosa PA01
cgccgauugcaugaccuucagg

SEQ ID NO: 3449282 - RNA, 21 nt, Pseudomonas aeruginosa PA01
cgccgauugugcagggccgcg

SEQ ID NO: 3449283 - RNA, 16 nt, Pseudomonas aeruginosa PA01
cgccgcaaccgcccga

SEQ ID NO: 3449284 - RNA, 22 nt, Pseudomonas aeruginosa PA01
cgccgcaacgaaaaagggcggc

SEQ ID NO: 3449285 - RNA, 18 nt, Pseudomonas aeruginosa PA01
cgccgcaagcuuuuccga

SEQ ID NO: 3449286 - RNA, 17 nt, Pseudomonas aeruginosa PA01
cgccgcaaguggcggcu

SEQ ID NO: 3449287 - RNA, 15 nt, Pseudomonas aeruginosa PA01
cgccgcacaccgcgc

SEQ ID NO: 3449288 - RNA, 20 nt, Pseudomonas aeruginosa PA01
cgccgcaccacguagccggc

SEQ ID NO: 3449289 - RNA, 12 nt, Pseudomonas aeruginosa PA01
cgccgcaccggc

SEQ ID NO: 3449290 - RNA, 14 nt, Pseudomonas aeruginosa PA01
cgccgcaccggcga

SEQ ID NO: 3449291 - RNA, 16 nt, Pseudomonas aeruginosa PA01
cgccgcagaccagcga

SEQ ID NO: 3449292 - RNA, 17 nt, Pseudomonas aeruginosa PA01
cgccgcagagccagccg

SEQ ID NO: 3449293 - RNA, 22 nt, Pseudomonas aeruginosa PA01
cgccgcagagccagccgcagcc

SEQ ID NO: 3449294 - RNA, 15 nt, Pseudomonas aeruginosa PA01
cgccgcagcaagucg

SEQ ID NO: 3449295 - RNA, 16 nt, Pseudomonas aeruginosa PA01
cgccgcagccguggcg

SEQ ID NO: 3449296 - RNA, 12 nt, Pseudomonas aeruginosa PA01
cgccgcagcgca

SEQ ID NO: 3449297 - RNA, 20 nt, Pseudomonas aeruginosa PA01
cgccgcagcgcaagucggcc

SEQ ID NO: 3449298 - RNA, 21 nt, Pseudomonas aeruginosa PA01
cgccgcagcgcaagucggccu

SEQ ID NO: 3449299 - RNA, 12 nt, Pseudomonas aeruginosa PA01
cgccgcagcggc

SEQ ID NO: 3449300 - RNA, 18 nt, Pseudomonas aeruginosa PA01
cgccgcagcggcgucugc

SEQ ID NO: 3449301 - RNA, 13 nt, Pseudomonas aeruginosa PA01
cgccgcagcucgg

SEQ ID NO: 3449302 - RNA, 15 nt, Pseudomonas aeruginosa PA01
cgccgcaggaaggcg

SEQ ID NO: 3449303 - RNA, 12 nt, Pseudomonas aeruginosa PA01
cgccgcaggcgc

SEQ ID NO: 3449304 - RNA, 14 nt, Pseudomonas aeruginosa PA01
cgccgcaggcgcua

SEQ ID NO: 3449305 - RNA, 12 nt, Pseudomonas aeruginosa PA01
cgccgcaggcgu

SEQ ID NO: 3449306 - RNA, 12 nt, Pseudomonas aeruginosa PA01
cgccgcagggcc

SEQ ID NO: 3449307 - RNA, 15 nt, Pseudomonas aeruginosa PA01
cgccgcagggcccau

SEQ ID NO: 3449308 - RNA, 22 nt, Pseudomonas aeruginosa PA01
cgccgcagggugcggcugcuca

SEQ ID NO: 3449309 - RNA, 16 nt, Pseudomonas aeruginosa PA01
cgccgccggccagccg

SEQ ID NO: 3449310 - RNA, 14 nt, Pseudomonas aeruginosa PA01
cgccgccggccugc

SEQ ID NO: 3449311 - RNA, 12 nt, Pseudomonas aeruginosa PA01
cgccgccggcga

SEQ ID NO: 3449312 - RNA, 14 nt, Pseudomonas aeruginosa PA01
cgccgccggcgaac

SEQ ID NO: 3449313 - RNA, 17 nt, Pseudomonas aeruginosa PA01
cgccgccggcgaacagc

SEQ ID NO: 3449314 - RNA, 15 nt, Pseudomonas aeruginosa PA01
cgccgccggcgaacg

SEQ ID NO: 3449315 - RNA, 22 nt, Pseudomonas aeruginosa PA01
cgccgccggcguuauccgccga

SEQ ID NO: 3449316 - RNA, 13 nt, Pseudomonas aeruginosa PA01
cgccgccggcucc

SEQ ID NO: 3449317 - RNA, 11 nt, Pseudomonas aeruginosa PA01
cgccgccgggc

SEQ ID NO: 3449318 - RNA, 12 nt, Pseudomonas aeruginosa PA01
cgccgccgggcg

SEQ ID NO: 3449319 - RNA, 14 nt, Pseudomonas aeruginosa PA01
cgccgccgggcgcc

SEQ ID NO: 3449320 - RNA, 18 nt, Pseudomonas aeruginosa PA01
cgccgccgggcgcccggc

SEQ ID NO: 3449321 - RNA, 17 nt, Pseudomonas aeruginosa PA01
cgccgccgggcgcgcgc

SEQ ID NO: 3449322 - RNA, 18 nt, Pseudomonas aeruginosa PA01
cgccgccgggcgcgcgcc

SEQ ID NO: 3449323 - RNA, 13 nt, Pseudomonas aeruginosa PA01
cgccgccggggcg

SEQ ID NO: 3449324 - RNA, 21 nt, Pseudomonas aeruginosa PA01
cgccgccggggcgggccgcgc

SEQ ID NO: 3449325 - RNA, 21 nt, Pseudomonas aeruginosa PA01
cgccgccgguaucccggcuga

SEQ ID NO: 3449326 - RNA, 21 nt, Pseudomonas aeruginosa PA01
cgccgccggugaacagguagc

SEQ ID NO: 3449327 - RNA, 19 nt, Pseudomonas aeruginosa PA01
cgccgccggugcaccaggc

SEQ ID NO: 3449328 - RNA, 20 nt, Pseudomonas aeruginosa PA01
cgccgccgucuugccgcugc

SEQ ID NO: 3449329 - RNA, 14 nt, Pseudomonas aeruginosa PA01
cgccgccgugaucu

SEQ ID NO: 3449330 - RNA, 17 nt, Pseudomonas aeruginosa PA01
cgccgccgugaucucga

SEQ ID NO: 3449331 - RNA, 12 nt, Pseudomonas aeruginosa PA01
cgccgccguggc

SEQ ID NO: 3449332 - RNA, 15 nt, Pseudomonas aeruginosa PA01
cgccgccucgaaggc

SEQ ID NO: 3449333 - RNA, 15 nt, Pseudomonas aeruginosa PA01
cgccgccucgauggc

SEQ ID NO: 3449334 - RNA, 17 nt, Pseudomonas aeruginosa PA01
cgccgccucgauggcgg

SEQ ID NO: 3449335 - RNA, 19 nt, Pseudomonas aeruginosa PA01
cgccgccucgauggcggca

SEQ ID NO: 3449336 - RNA, 13 nt, Pseudomonas aeruginosa PA01
cgccgccucgcgc

SEQ ID NO: 3449337 - RNA, 14 nt, Pseudomonas aeruginosa PA01
cgccgccucgcgca

SEQ ID NO: 3449338 - RNA, 15 nt, Pseudomonas aeruginosa PA01
cgccgccucgcgcaa

SEQ ID NO: 3449339 - RNA, 18 nt, Pseudomonas aeruginosa PA01
cgccgccucgcugggcgg

SEQ ID NO: 3449340 - RNA, 13 nt, Pseudomonas aeruginosa PA01
cgccgccugcgcc

SEQ ID NO: 3449341 - RNA, 12 nt, Pseudomonas aeruginosa PA01
cgccgccugcgg

SEQ ID NO: 3449342 - RNA, 22 nt, Pseudomonas aeruginosa PA01
cgccgccugcggcuugcccugc

SEQ ID NO: 3449343 - RNA, 18 nt, Pseudomonas aeruginosa PA01
cgccgccugcucgccgcu

SEQ ID NO: 3449344 - RNA, 22 nt, Pseudomonas aeruginosa PA01
cgccgccugcucgccgcugaag

SEQ ID NO: 3449345 - RNA, 17 nt, Pseudomonas aeruginosa PA01
cgccgccugcuggcugc

SEQ ID NO: 3449346 - RNA, 13 nt, Pseudomonas aeruginosa PA01
cgccgccuggccg

SEQ ID NO: 3449347 - RNA, 14 nt, Pseudomonas aeruginosa PA01
cgccgccuggccgg

SEQ ID NO: 3449348 - RNA, 15 nt, Pseudomonas aeruginosa PA01
cgccgccuggccggu

SEQ ID NO: 3449349 - RNA, 13 nt, Pseudomonas aeruginosa PA01
cgccgccugggcc

SEQ ID NO: 3449350 - RNA, 16 nt, Pseudomonas aeruginosa PA01
cgccgccugggccgcc

SEQ ID NO: 3449351 - RNA, 19 nt, Pseudomonas aeruginosa PA01
cgccgccugggccgccucg

SEQ ID NO: 3449352 - RNA, 20 nt, Pseudomonas aeruginosa PA01
cgccgccuggguggcgacga

SEQ ID NO: 3449353 - RNA, 21 nt, Pseudomonas aeruginosa PA01
cgccgccuugagcggcgcccu

SEQ ID NO: 3449354 - RNA, 21 nt, Pseudomonas aeruginosa PA01
cgccgccuugcguaccagcgc

SEQ ID NO: 3449355 - RNA, 13 nt, Pseudomonas aeruginosa PA01
cgccgccuuggca

SEQ ID NO: 3449356 - RNA, 19 nt, Pseudomonas aeruginosa PA01
cgccgccuuucugcccggc

SEQ ID NO: 3449357 - RNA, 16 nt, Pseudomonas aeruginosa PA01
cgccgcgaaauggcag

SEQ ID NO: 3449358 - RNA, 20 nt, Pseudomonas aeruginosa PA01
cgccgcgaaauggcagaaca

SEQ ID NO: 3449359 - RNA, 13 nt, Pseudomonas aeruginosa PA01
cgccgcgaacaca

SEQ ID NO: 3449360 - RNA, 19 nt, Pseudomonas aeruginosa PA01
cgccgcgaacacacccugc

SEQ ID NO: 3449361 - RNA, 17 nt, Pseudomonas aeruginosa PA01
cgccgcgaccgaagccg

SEQ ID NO: 3449362 - RNA, 20 nt, Pseudomonas aeruginosa PA01
cgccgcgaccugcucgucga

SEQ ID NO: 3449363 - RNA, 23 nt, Pseudomonas aeruginosa PA01
cgccgcgaccugcucgucgaugc

SEQ ID NO: 3449364 - RNA, 17 nt, Pseudomonas aeruginosa PA01
cgccgcgacgcuccagc

SEQ ID NO: 3449365 - RNA, 14 nt, Pseudomonas aeruginosa PA01
cgccgcgagcacca

SEQ ID NO: 3449366 - RNA, 17 nt, Pseudomonas aeruginosa PA01
cgccgcgagcaccaugc

SEQ ID NO: 3449367 - RNA, 23 nt, Pseudomonas aeruginosa PA01
cgccgcgagcgaaacggcgcuga

SEQ ID NO: 3449368 - RNA, 13 nt, Pseudomonas aeruginosa PA01
cgccgcgagcgcc

SEQ ID NO: 3449369 - RNA, 15 nt, Pseudomonas aeruginosa PA01
cgccgcgagcgccgc

SEQ ID NO: 3449370 - RNA, 16 nt, Pseudomonas aeruginosa PA01
cgccgcgagcgccgcc

SEQ ID NO: 3449371 - RNA, 18 nt, Pseudomonas aeruginosa PA01
cgccgcgagcgccgccgg

SEQ ID NO: 3449372 - RNA, 15 nt, Pseudomonas aeruginosa PA01
cgccgcgagguggau

SEQ ID NO: 3449373 - RNA, 20 nt, Pseudomonas aeruginosa PA01
cgccgcgauauucgcccuac

SEQ ID NO: 3449374 - RNA, 13 nt, Pseudomonas aeruginosa PA01
cgccgcgauggcu

SEQ ID NO: 3449375 - RNA, 20 nt, Pseudomonas aeruginosa PA01
cgccgcgauggcucgcggcg

SEQ ID NO: 3449376 - RNA, 22 nt, Pseudomonas aeruginosa PA01
cgccgcgauggcucgcggcgcu

SEQ ID NO: 3449377 - RNA, 15 nt, Pseudomonas aeruginosa PA01
cgccgcgcaccagca

SEQ ID NO: 3449378 - RNA, 16 nt, Pseudomonas aeruginosa PA01
cgccgcgcaccagcac

SEQ ID NO: 3449379 - RNA, 14 nt, Pseudomonas aeruginosa PA01
cgccgcgcacgucg

SEQ ID NO: 3449380 - RNA, 18 nt, Pseudomonas aeruginosa PA01
cgccgcgcacgucgaggu

SEQ ID NO: 3449381 - RNA, 14 nt, Pseudomonas aeruginosa PA01
cgccgcgcagcacc

SEQ ID NO: 3449382 - RNA, 18 nt, Pseudomonas aeruginosa PA01
cgccgcgcagcgcggcgc

SEQ ID NO: 3449383 - RNA, 19 nt, Pseudomonas aeruginosa PA01
cgccgcgcagcgcggcgcu

SEQ ID NO: 3449384 - RNA, 12 nt, Pseudomonas aeruginosa PA01
cgccgcgcaggc

SEQ ID NO: 3449385 - RNA, 13 nt, Pseudomonas aeruginosa PA01
cgccgcgcaggcg

SEQ ID NO: 3449386 - RNA, 18 nt, Pseudomonas aeruginosa PA01
cgccgcgcaucaccccgc

SEQ ID NO: 3449387 - RNA, 20 nt, Pseudomonas aeruginosa PA01
cgccgcgcaucaccccgcaa

SEQ ID NO: 3449388 - RNA, 12 nt, Pseudomonas aeruginosa PA01
cgccgcgcaucc

SEQ ID NO: 3449389 - RNA, 20 nt, Pseudomonas aeruginosa PA01
cgccgcgcauccucggcauc

SEQ ID NO: 3449390 - RNA, 15 nt, Pseudomonas aeruginosa PA01
cgccgcgccaacugg

SEQ ID NO: 3449391 - RNA, 13 nt, Pseudomonas aeruginosa PA01
cgccgcgccagca

SEQ ID NO: 3449392 - RNA, 16 nt, Pseudomonas aeruginosa PA01
cgccgcgccagcaggc

SEQ ID NO: 3449393 - RNA, 17 nt, Pseudomonas aeruginosa PA01
cgccgcgccagcaggcg

SEQ ID NO: 3449394 - RNA, 20 nt, Pseudomonas aeruginosa PA01
cgccgcgccagcaggcgcag

SEQ ID NO: 3449395 - RNA, 13 nt, Pseudomonas aeruginosa PA01
cgccgcgcccggc

SEQ ID NO: 3449396 - RNA, 14 nt, Pseudomonas aeruginosa PA01
cgccgcgcccggcg

SEQ ID NO: 3449397 - RNA, 17 nt, Pseudomonas aeruginosa PA01
cgccgcgcccggcgcca

SEQ ID NO: 3449398 - RNA, 19 nt, Pseudomonas aeruginosa PA01
cgccgcgcccggcgccagg

SEQ ID NO: 3449399 - RNA, 12 nt, Pseudomonas aeruginosa PA01
cgccgcgccgcc

SEQ ID NO: 3449400 - RNA, 13 nt, Pseudomonas aeruginosa PA01
cgccgcgccgccg

SEQ ID NO: 3449401 - RNA, 16 nt, Pseudomonas aeruginosa PA01
cgccgcgccgccgagg

SEQ ID NO: 3449402 - RNA, 12 nt, Pseudomonas aeruginosa PA01
cgccgcgccgcu

SEQ ID NO: 3449403 - RNA, 12 nt, Pseudomonas aeruginosa PA01
cgccgcgccggc

SEQ ID NO: 3449404 - RNA, 15 nt, Pseudomonas aeruginosa PA01
cgccgcgccucgucg

SEQ ID NO: 3449405 - RNA, 20 nt, Pseudomonas aeruginosa PA01
cgccgcgccucgucgcgcca

SEQ ID NO: 3449406 - RNA, 16 nt, Pseudomonas aeruginosa PA01
cgccgcgcggcaacac

SEQ ID NO: 3449407 - RNA, 21 nt, Pseudomonas aeruginosa PA01
cgccgcgcguucgcgcgaggc

SEQ ID NO: 3449408 - RNA, 14 nt, Pseudomonas aeruginosa PA01
cgccgcgcucgcgc

SEQ ID NO: 3449409 - RNA, 18 nt, Pseudomonas aeruginosa PA01
cgccgcgcucgcgcauga

SEQ ID NO: 3449410 - RNA, 19 nt, Pseudomonas aeruginosa PA01
cgccgcgcugauaucgaua

SEQ ID NO: 3449411 - RNA, 15 nt, Pseudomonas aeruginosa PA01
cgccgcgcugcaggc

SEQ ID NO: 3449412 - RNA, 13 nt, Pseudomonas aeruginosa PA01
cgccgcgcugcau

SEQ ID NO: 3449413 - RNA, 21 nt, Pseudomonas aeruginosa PA01
cgccgcugaauaccaccgggc

SEQ ID NO: 3449414 - RNA, 20 nt, Pseudomonas aeruginosa PA01
cgccgcugaggcucgccggg

SEQ ID NO: 3449415 - RNA, 23 nt, Pseudomonas aeruginosa PA01
cgccgcugaucaguaccggcagc

SEQ ID NO: 3449416 - RNA, 20 nt, Pseudomonas aeruginosa PA01
cgccgcugaugcgcuggucg

SEQ ID NO: 3449417 - RNA, 23 nt, Pseudomonas aeruginosa PA01
cgccgcugcaccgaacggugcag

SEQ ID NO: 3449418 - RNA, 13 nt, Pseudomonas aeruginosa PA01
cgccgcugcggcu

SEQ ID NO: 3449419 - RNA, 15 nt, Pseudomonas aeruginosa PA01
cgccgcugcggcugc

SEQ ID NO: 3449420 - RNA, 16 nt, Pseudomonas aeruginosa PA01
cgccgcugcggcugca

SEQ ID NO: 3449421 - RNA, 13 nt, Pseudomonas aeruginosa PA01
cgccgcugcuggc

SEQ ID NO: 3449422 - RNA, 13 nt, Pseudomonas aeruginosa PA01
cgccgcuggaacc

SEQ ID NO: 3449423 - RNA, 16 nt, Pseudomonas aeruginosa PA01
cgccgcuggaaccggc

SEQ ID NO: 3449424 - RNA, 21 nt, Pseudomonas aeruginosa PA01
cgccgcuggcauaaccggaag

SEQ ID NO: 3449425 - RNA, 15 nt, Pseudomonas aeruginosa PA01
cgccgcuggccuggc

SEQ ID NO: 3449426 - RNA, 19 nt, Pseudomonas aeruginosa PA01
cgccgcuggccuggccacc

SEQ ID NO: 3449427 - RNA, 16 nt, Pseudomonas aeruginosa PA01
cgccgcuggcgaggau

SEQ ID NO: 3449428 - RNA, 23 nt, Pseudomonas aeruginosa PA01
cgccgcuggcgaggauuuccucg

SEQ ID NO: 3449429 - RNA, 12 nt, Pseudomonas aeruginosa PA01
cgccgcuggcgg

SEQ ID NO: 3449430 - RNA, 13 nt, Pseudomonas aeruginosa PA01
cgccgcuggcggc

SEQ ID NO: 3449431 - RNA, 19 nt, Pseudomonas aeruginosa PA01
cgccgcuggcggcaugccg

SEQ ID NO: 3449432 - RNA, 14 nt, Pseudomonas aeruginosa PA01
cgccgcuggcggcg

SEQ ID NO: 3449433 - RNA, 15 nt, Pseudomonas aeruginosa PA01
cgccgcuggcggcgc

SEQ ID NO: 3449434 - RNA, 16 nt, Pseudomonas aeruginosa PA01
cgccgcugucguccag

SEQ ID NO: 3449435 - RNA, 20 nt, Pseudomonas aeruginosa PA01
cgccgcugucguccagcggg

SEQ ID NO: 3449436 - RNA, 22 nt, Pseudomonas aeruginosa PA01
cgccgcugucuaucugcgccga

SEQ ID NO: 3449437 - RNA, 17 nt, Pseudomonas aeruginosa PA01
cgccgcugugcaggguc

SEQ ID NO: 3449438 - RNA, 19 nt, Pseudomonas aeruginosa PA01
cgccgcugugcagggucag

SEQ ID NO: 3449439 - RNA, 15 nt, Pseudomonas aeruginosa PA01
cgccgcuuccgccag

SEQ ID NO: 3449440 - RNA, 17 nt, Pseudomonas aeruginosa PA01
cgccgcuuccgccaggc

SEQ ID NO: 3449441 - RNA, 20 nt, Pseudomonas aeruginosa PA01
cgccgcuuccgccaggcgca

SEQ ID NO: 3449442 - RNA, 21 nt, Pseudomonas aeruginosa PA01
cgccgcuuccgccaggcgcag

SEQ ID NO: 3449443 - RNA, 22 nt, Pseudomonas aeruginosa PA01
cgccgcuuccgccggcgccgcc

SEQ ID NO: 3449444 - RNA, 20 nt, Pseudomonas aeruginosa PA01
cgccgcuugagaccuucgcg

SEQ ID NO: 3449445 - RNA, 15 nt, Pseudomonas aeruginosa PA01
cgccgcuuucgguga

SEQ ID NO: 3449446 - RNA, 19 nt, Pseudomonas aeruginosa PA01
cgccggaaccugcauguca

SEQ ID NO: 3449447 - RNA, 18 nt, Pseudomonas aeruginosa PA01
cgccggaagcuuccagcu

SEQ ID NO: 3449448 - RNA, 21 nt, Pseudomonas aeruginosa PA01
cgccggaagcuuccagcuugg

SEQ ID NO: 3449449 - RNA, 17 nt, Pseudomonas aeruginosa PA01
cgccggaaguggcagcg

SEQ ID NO: 3449450 - RNA, 19 nt, Pseudomonas aeruginosa PA01
cgccggaaguggcagcgcc

SEQ ID NO: 3449451 - RNA, 21 nt, Pseudomonas aeruginosa PA01
cgccggaaguggcagcgccgu

SEQ ID NO: 3449452 - RNA, 22 nt, Pseudomonas aeruginosa PA01
cgccggaaugacgagccgcagg

SEQ ID NO: 3449453 - RNA, 13 nt, Pseudomonas aeruginosa PA01
cgccggacaggcc

SEQ ID NO: 3449454 - RNA, 16 nt, Pseudomonas aeruginosa PA01
cgccggacaggccacc

SEQ ID NO: 3449455 - RNA, 20 nt, Pseudomonas aeruginosa PA01
cgccggacaggccacccgcc

SEQ ID NO: 3449456 - RNA, 23 nt, Pseudomonas aeruginosa PA01
cgccggacaggccacccgccucg

SEQ ID NO: 3449457 - RNA, 16 nt, Pseudomonas aeruginosa PA01
cgccggaccaacugcg

SEQ ID NO: 3449458 - RNA, 12 nt, Pseudomonas aeruginosa PA01
cgccggaccaga

SEQ ID NO: 3449459 - RNA, 15 nt, Pseudomonas aeruginosa PA01
cgccggaccagaucg

SEQ ID NO: 3449460 - RNA, 20 nt, Pseudomonas aeruginosa PA01
cgccggaccagaucggcgcg

SEQ ID NO: 3449461 - RNA, 21 nt, Pseudomonas aeruginosa PA01
cgccggaccagaucggcgcgc

SEQ ID NO: 3449462 - RNA, 22 nt, Pseudomonas aeruginosa PA01
cgccggaccagaucggcgcgca

SEQ ID NO: 3449463 - RNA, 15 nt, Pseudomonas aeruginosa PA01
cgccggaccagccgg

SEQ ID NO: 3449464 - RNA, 16 nt, Pseudomonas aeruginosa PA01
cgccggaccagccggu

SEQ ID NO: 3449465 - RNA, 15 nt, Pseudomonas aeruginosa PA01
cgccggacccugccg

SEQ ID NO: 3449466 - RNA, 19 nt, Pseudomonas aeruginosa PA01
cgccggacgagcuuuccug

SEQ ID NO: 3449467 - RNA, 14 nt, Pseudomonas aeruginosa PA01
cgccggacgcacca

SEQ ID NO: 3449468 - RNA, 19 nt, Pseudomonas aeruginosa PA01
cgccggacgcaccagcagg

SEQ ID NO: 3449469 - RNA, 23 nt, Pseudomonas aeruginosa PA01
cgccggacgcaccagcaggccga

SEQ ID NO: 3449470 - RNA, 24 nt, Pseudomonas aeruginosa PA01
cgccggacgcaccagcaggccgau

SEQ ID NO: 3449471 - RNA, 18 nt, Pseudomonas aeruginosa PA01
cgccggagacuucagcgc

SEQ ID NO: 3449472 - RNA, 19 nt, Pseudomonas aeruginosa PA01
cgccggagacuucagcgca

SEQ ID NO: 3449473 - RNA, 22 nt, Pseudomonas aeruginosa PA01
cgccggagccaccgggaucugg

SEQ ID NO: 3449474 - RNA, 15 nt, Pseudomonas aeruginosa PA01
cgccggagcugguca

SEQ ID NO: 3449475 - RNA, 21 nt, Pseudomonas aeruginosa PA01
cgccggagggaaugaagaagc

SEQ ID NO: 3449476 - RNA, 23 nt, Pseudomonas aeruginosa PA01
cgccggagggaaugaagaagccc

SEQ ID NO: 3449477 - RNA, 14 nt, Pseudomonas aeruginosa PA01
cgccggaggggcgg

SEQ ID NO: 3449478 - RNA, 17 nt, Pseudomonas aeruginosa PA01
cgccggaggggcggccg

SEQ ID NO: 3449479 - RNA, 21 nt, Pseudomonas aeruginosa PA01
cgccggaggggcggccgccga

SEQ ID NO: 3449480 - RNA, 17 nt, Pseudomonas aeruginosa PA01
cgccggagucguagcgc

SEQ ID NO: 3449481 - RNA, 21 nt, Pseudomonas aeruginosa PA01
cgccggagucguagcgcgcgg

SEQ ID NO: 3449482 - RNA, 20 nt, Pseudomonas aeruginosa PA01
cgccggauuagcucagucgg

SEQ ID NO: 3449483 - RNA, 15 nt, Pseudomonas aeruginosa PA01
cgccggcaacagcag

SEQ ID NO: 3449484 - RNA, 17 nt, Pseudomonas aeruginosa PA01
cgccggcaacagcagca

SEQ ID NO: 3449485 - RNA, 18 nt, Pseudomonas aeruginosa PA01
cgccggcaacagcagcag

SEQ ID NO: 3449486 - RNA, 18 nt, Pseudomonas aeruginosa PA01
cgccggcaccgaggagaa

SEQ ID NO: 3449487 - RNA, 15 nt, Pseudomonas aeruginosa PA01
cgccggcaccgucga

SEQ ID NO: 3449488 - RNA, 22 nt, Pseudomonas aeruginosa PA01
cgccggcaccgucgagcaccag

SEQ ID NO: 3449489 - RNA, 16 nt, Pseudomonas aeruginosa PA01
cgccggcacggcaucg

SEQ ID NO: 3449490 - RNA, 23 nt, Pseudomonas aeruginosa PA01
cgccggcacggcaucgauccgca

SEQ ID NO: 3449491 - RNA, 22 nt, Pseudomonas aeruginosa PA01
cgccggcacuguuccucagccc

SEQ ID NO: 3449492 - RNA, 12 nt, Pseudomonas aeruginosa PA01
cgccggcagcgc

SEQ ID NO: 3449493 - RNA, 13 nt, Pseudomonas aeruginosa PA01
cgccggcagcgcc

SEQ ID NO: 3449494 - RNA, 14 nt, Pseudomonas aeruginosa PA01
cgccggcagcgccg

SEQ ID NO: 3449495 - RNA, 15 nt, Pseudomonas aeruginosa PA01
cgccggcagcgccgc

SEQ ID NO: 3449496 - RNA, 19 nt, Pseudomonas aeruginosa PA01
cgccggcagcgccgcgcgg

SEQ ID NO: 3449497 - RNA, 18 nt, Pseudomonas aeruginosa PA01
cgccggcagcucggccga

SEQ ID NO: 3449498 - RNA, 20 nt, Pseudomonas aeruginosa PA01
cgccggcagcucggccgagg

SEQ ID NO: 3449499 - RNA, 20 nt, Pseudomonas aeruginosa PA01
cgccggcaggaacgcccgcg

SEQ ID NO: 3449500 - RNA, 12 nt, Pseudomonas aeruginosa PA01
cgccggcaggcc

SEQ ID NO: 3449501 - RNA, 20 nt, Pseudomonas aeruginosa PA01
cgccggcaggccuucggcgc

SEQ ID NO: 3449502 - RNA, 14 nt, Pseudomonas aeruginosa PA01
cgccggcagguaga

SEQ ID NO: 3449503 - RNA, 15 nt, Pseudomonas aeruginosa PA01
cgccggcaucgccau

SEQ ID NO: 3449504 - RNA, 19 nt, Pseudomonas aeruginosa PA01
cgccggcaucgccauggcg

SEQ ID NO: 3449505 - RNA, 20 nt, Pseudomonas aeruginosa PA01
cgccggcaucgccauggcgc

SEQ ID NO: 3449506 - RNA, 20 nt, Pseudomonas aeruginosa PA01
cgccggcauggaucaacugg

SEQ ID NO: 3449507 - RNA, 18 nt, Pseudomonas aeruginosa PA01
cgccggcauuggcacccu

SEQ ID NO: 3449508 - RNA, 20 nt, Pseudomonas aeruginosa PA01
cgccggcauuggcacccugg

SEQ ID NO: 3449509 - RNA, 21 nt, Pseudomonas aeruginosa PA01
cgccggcauuggcacccugga

SEQ ID NO: 3449510 - RNA, 15 nt, Pseudomonas aeruginosa PA01
cgccggccaccagca

SEQ ID NO: 3449511 - RNA, 17 nt, Pseudomonas aeruginosa PA01
cgccggccaccagcagc

SEQ ID NO: 3449512 - RNA, 18 nt, Pseudomonas aeruginosa PA01
cgccggccaccagcagca

SEQ ID NO: 3449513 - RNA, 14 nt, Pseudomonas aeruginosa PA01
cgccggccaccagg

SEQ ID NO: 3449514 - RNA, 15 nt, Pseudomonas aeruginosa PA01
cgccggccaccaggc

SEQ ID NO: 3449515 - RNA, 20 nt, Pseudomonas aeruginosa PA01
cgccgggaaucgccagcagg

SEQ ID NO: 3449516 - RNA, 23 nt, Pseudomonas aeruginosa PA01
cgccgggaaucuggccgaugccg

SEQ ID NO: 3449517 - RNA, 13 nt, Pseudomonas aeruginosa PA01
cgccgggacccug

SEQ ID NO: 3449518 - RNA, 16 nt, Pseudomonas aeruginosa PA01
cgccgggaucaccucg

SEQ ID NO: 3449519 - RNA, 21 nt, Pseudomonas aeruginosa PA01
cgccgggaugcucaccgcgcu

SEQ ID NO: 3449520 - RNA, 18 nt, Pseudomonas aeruginosa PA01
cgccgggauuguugcggc

SEQ ID NO: 3449521 - RNA, 19 nt, Pseudomonas aeruginosa PA01
cgccgggauuguugcggcg

SEQ ID NO: 3449522 - RNA, 17 nt, Pseudomonas aeruginosa PA01
cgccgggcaacgccagg

SEQ ID NO: 3449523 - RNA, 18 nt, Pseudomonas aeruginosa PA01
cgccgggcaacgccaggc

SEQ ID NO: 3449524 - RNA, 19 nt, Pseudomonas aeruginosa PA01
cgccgggcaacgccaggcc

SEQ ID NO: 3449525 - RNA, 21 nt, Pseudomonas aeruginosa PA01
cgccgggcaacgccaggccgc

SEQ ID NO: 3449526 - RNA, 21 nt, Pseudomonas aeruginosa PA01
cgccgggcaucaugccgagca

SEQ ID NO: 3449527 - RNA, 22 nt, Pseudomonas aeruginosa PA01
cgccgggcaugaaaaaacccgc

SEQ ID NO: 3449528 - RNA, 15 nt, Pseudomonas aeruginosa PA01
cgccgggccgcaucg

SEQ ID NO: 3449529 - RNA, 16 nt, Pseudomonas aeruginosa PA01
cgccgggccgcaucgc

SEQ ID NO: 3449530 - RNA, 14 nt, Pseudomonas aeruginosa PA01
cgccgggccgccuu

SEQ ID NO: 3449531 - RNA, 24 nt, Pseudomonas aeruginosa PA01
cgccgggccgccuugcgcagcaac

SEQ ID NO: 3449532 - RNA, 14 nt, Pseudomonas aeruginosa PA01
cgccgggccucggc

SEQ ID NO: 3449533 - RNA, 15 nt, Pseudomonas aeruginosa PA01
cgccgggccucggca

SEQ ID NO: 3449534 - RNA, 13 nt, Pseudomonas aeruginosa PA01
cgccgggcgcgau

SEQ ID NO: 3449535 - RNA, 17 nt, Pseudomonas aeruginosa PA01
cgccgggcgcgaugccg

SEQ ID NO: 3449536 - RNA, 20 nt, Pseudomonas aeruginosa PA01
cgccgggcgcgaugccgaug

SEQ ID NO: 3449537 - RNA, 17 nt, Pseudomonas aeruginosa PA01
cgccgggcgcgcgccuc

SEQ ID NO: 3449538 - RNA, 21 nt, Pseudomonas aeruginosa PA01
cgccgggcgcgcgccucagcg

SEQ ID NO: 3449539 - RNA, 22 nt, Pseudomonas aeruginosa PA01
cgccgggcgcgcgccucagcgg

SEQ ID NO: 3449540 - RNA, 16 nt, Pseudomonas aeruginosa PA01
cgccgggcggcgucgc

SEQ ID NO: 3449541 - RNA, 21 nt, Pseudomonas aeruginosa PA01
cgccgggcggcgucgcggaga

SEQ ID NO: 3449542 - RNA, 14 nt, Pseudomonas aeruginosa PA01
cgccgggcguaacg

SEQ ID NO: 3449543 - RNA, 17 nt, Pseudomonas aeruginosa PA01
cgccgggcguaacggcu

SEQ ID NO: 3449544 - RNA, 18 nt, Pseudomonas aeruginosa PA01
cgccgggcgucugcccgg

SEQ ID NO: 3449545 - RNA, 19 nt, Pseudomonas aeruginosa PA01
cgccgggcucacucccguc

SEQ ID NO: 3449546 - RNA, 14 nt, Pseudomonas aeruginosa PA01
cgccgggcucagcg

SEQ ID NO: 3449547 - RNA, 16 nt, Pseudomonas aeruginosa PA01
cgccgggcucagcgcg

SEQ ID NO: 3449548 - RNA, 17 nt, Pseudomonas aeruginosa PA01
cgccgggcucagcgcgc

SEQ ID NO: 3449549 - RNA, 18 nt, Pseudomonas aeruginosa PA01
cgccgggcucagcgcgcg

SEQ ID NO: 3449550 - RNA, 23 nt, Pseudomonas aeruginosa PA01
cgccgggcugccgaacaggcguc

SEQ ID NO: 3449551 - RNA, 16 nt, Pseudomonas aeruginosa PA01
cgccgggcuggccguc

SEQ ID NO: 3449552 - RNA, 18 nt, Pseudomonas aeruginosa PA01
cgccgggcuggccgucga

SEQ ID NO: 3449553 - RNA, 13 nt, Pseudomonas aeruginosa PA01
cgccgggcugguu

SEQ ID NO: 3449554 - RNA, 19 nt, Pseudomonas aeruginosa PA01
cgccgggcugguucagcgg

SEQ ID NO: 3449555 - RNA, 17 nt, Pseudomonas aeruginosa PA01
cgccgggcuugcaaucc

SEQ ID NO: 3449556 - RNA, 21 nt, Pseudomonas aeruginosa PA01
cgccgggcuuuucaaggcgaa

SEQ ID NO: 3449557 - RNA, 24 nt, Pseudomonas aeruginosa PA01
cgccgggcuuuucaaggcgaaacg

SEQ ID NO: 3449558 - RNA, 22 nt, Pseudomonas aeruginosa PA01
cgccggggaagcugccuuccag

SEQ ID NO: 3449559 - RNA, 15 nt, Pseudomonas aeruginosa PA01
cgccggggaucaggu

SEQ ID NO: 3449560 - RNA, 18 nt, Pseudomonas aeruginosa PA01
cgccggggaucaggucgc

SEQ ID NO: 3449561 - RNA, 22 nt, Pseudomonas aeruginosa PA01
cgccggggaucaggucgccgcu

SEQ ID NO: 3449562 - RNA, 17 nt, Pseudomonas aeruginosa PA01
cgccggggccuacugcu

SEQ ID NO: 3449563 - RNA, 19 nt, Pseudomonas aeruginosa PA01
cgccggggccuacugcugg

SEQ ID NO: 3449564 - RNA, 23 nt, Pseudomonas aeruginosa PA01
cgccggggcgcaggucgcuggcg

SEQ ID NO: 3449565 - RNA, 15 nt, Pseudomonas aeruginosa PA01
cgccggggcgggccg

SEQ ID NO: 3449566 - RNA, 16 nt, Pseudomonas aeruginosa PA01
cgccggggcgggccgc

SEQ ID NO: 3449567 - RNA, 18 nt, Pseudomonas aeruginosa PA01
cgccggggcgggccgcgc

SEQ ID NO: 3449568 - RNA, 17 nt, Pseudomonas aeruginosa PA01
cgccggggcgugcaggc

SEQ ID NO: 3449569 - RNA, 22 nt, Pseudomonas aeruginosa PA01
cgccggggcgugcaggccgccg

SEQ ID NO: 3449570 - RNA, 23 nt, Pseudomonas aeruginosa PA01
cgccggggcgugcaggccgccga

SEQ ID NO: 3449571 - RNA, 18 nt, Pseudomonas aeruginosa PA01
cgccgggggucucguagc

SEQ ID NO: 3449572 - RNA, 18 nt, Pseudomonas aeruginosa PA01
cgccgggguuuucuuuuu

SEQ ID NO: 3449573 - RNA, 15 nt, Pseudomonas aeruginosa PA01
cgccggguacagcgc

SEQ ID NO: 3449574 - RNA, 17 nt, Pseudomonas aeruginosa PA01
cgccggguacagcgcca

SEQ ID NO: 3449575 - RNA, 19 nt, Pseudomonas aeruginosa PA01
cgccggguacagcgccacg

SEQ ID NO: 3449576 - RNA, 18 nt, Pseudomonas aeruginosa PA01
cgccggguccaccgcggc

SEQ ID NO: 3449577 - RNA, 20 nt, Pseudomonas aeruginosa PA01
cgccgggucgacaugcaggc

SEQ ID NO: 3449578 - RNA, 23 nt, Pseudomonas aeruginosa PA01
cgccgggucgacaugcaggccgg

SEQ ID NO: 3449579 - RNA, 16 nt, Pseudomonas aeruginosa PA01
cgccgggucgaccuug

SEQ ID NO: 3449580 - RNA, 21 nt, Pseudomonas aeruginosa PA01
cgccgggucgacuucgcacca

SEQ ID NO: 3449581 - RNA, 22 nt, Pseudomonas aeruginosa PA01
cgccgggucgacuucgcaccag

SEQ ID NO: 3449582 - RNA, 21 nt, Pseudomonas aeruginosa PA01
cgccgggucgaugggccguag

SEQ ID NO: 3449583 - RNA, 16 nt, Pseudomonas aeruginosa PA01
cgccgggucgccgcag

SEQ ID NO: 3449584 - RNA, 18 nt, Pseudomonas aeruginosa PA01
cgccgggucgccgcagcc

SEQ ID NO: 3449585 - RNA, 19 nt, Pseudomonas aeruginosa PA01
cgccgggugaccgugcggg

SEQ ID NO: 3449586 - RNA, 14 nt, Pseudomonas aeruginosa PA01
cgccggguggaacg

SEQ ID NO: 3449587 - RNA, 19 nt, Pseudomonas aeruginosa PA01
cgccggguggaacgaggcg

SEQ ID NO: 3449588 - RNA, 21 nt, Pseudomonas aeruginosa PA01
cgccggguggaacgaggcgac

SEQ ID NO: 3449589 - RNA, 22 nt, Pseudomonas aeruginosa PA01
cgccggguggaacgaggcgacc

SEQ ID NO: 3449590 - RNA, 21 nt, Pseudomonas aeruginosa PA01
cgccggguguuuuuccucgga

SEQ ID NO: 3449591 - RNA, 22 nt, Pseudomonas aeruginosa PA01
cgccggguguuuuuccucggau

SEQ ID NO: 3449592 - RNA, 22 nt, Pseudomonas aeruginosa PA01
cgccggguugccgcuggccucg

SEQ ID NO: 3449593 - RNA, 23 nt, Pseudomonas aeruginosa PA01
cgccggguugccgcuggccucga

SEQ ID NO: 3449594 - RNA, 16 nt, Pseudomonas aeruginosa PA01
cgccggguugcgccgc

SEQ ID NO: 3449595 - RNA, 21 nt, Pseudomonas aeruginosa PA01
cgccggguugcgccgcaagug

SEQ ID NO: 3449596 - RNA, 19 nt, Pseudomonas aeruginosa PA01
cgccggguuucacggcgga

SEQ ID NO: 3449597 - RNA, 12 nt, Pseudomonas aeruginosa PA01
cgccggguuuuu

SEQ ID NO: 3449598 - RNA, 21 nt, Pseudomonas aeruginosa PA01
cgccgguaaugaaaagccccg

SEQ ID NO: 3449599 - RNA, 23 nt, Pseudomonas aeruginosa PA01
cgccgguaaugaaaagccccgcg

SEQ ID NO: 3449600 - RNA, 21 nt, Pseudomonas aeruginosa PA01
cgccgguaaugacgaucucga

SEQ ID NO: 3449601 - RNA, 22 nt, Pseudomonas aeruginosa PA01
cgccgguagccguucgacgcug

SEQ ID NO: 3449602 - RNA, 16 nt, Pseudomonas aeruginosa PA01
cgccgguaucccggcu

SEQ ID NO: 3449603 - RNA, 14 nt, Pseudomonas aeruginosa PA01
cgccggucaacagc

SEQ ID NO: 3449604 - RNA, 17 nt, Pseudomonas aeruginosa PA01
cgccggucaccacugga

SEQ ID NO: 3449605 - RNA, 21 nt, Pseudomonas aeruginosa PA01
cgccggucaccacuggaaacg

SEQ ID NO: 3449606 - RNA, 18 nt, Pseudomonas aeruginosa PA01
cgccggucagagacaggu

SEQ ID NO: 3449607 - RNA, 16 nt, Pseudomonas aeruginosa PA01
cgccggucaggcugcg

SEQ ID NO: 3449608 - RNA, 17 nt, Pseudomonas aeruginosa PA01
cgccggucaggcugcgg

SEQ ID NO: 3449609 - RNA, 20 nt, Pseudomonas aeruginosa PA01
cgccggucaggcugcggcgg

SEQ ID NO: 3449610 - RNA, 15 nt, Pseudomonas aeruginosa PA01
cgccggucagguagg

SEQ ID NO: 3449611 - RNA, 19 nt, Pseudomonas aeruginosa PA01
cgccggucagguaggcauc

SEQ ID NO: 3449612 - RNA, 16 nt, Pseudomonas aeruginosa PA01
cgccgguccucgacau

SEQ ID NO: 3449613 - RNA, 14 nt, Pseudomonas aeruginosa PA01
cgccggucgcgcuc

SEQ ID NO: 3449614 - RNA, 20 nt, Pseudomonas aeruginosa PA01
cgccggucgcgcucaggcgc

SEQ ID NO: 3449615 - RNA, 21 nt, Pseudomonas aeruginosa PA01
cgccggucgcgcucaggcgca

SEQ ID NO: 3449616 - RNA, 20 nt, Pseudomonas aeruginosa PA01
cgccgucuugccgcugcgcg

SEQ ID NO: 3449617 - RNA, 23 nt, Pseudomonas aeruginosa PA01
cgccgucuugccgcugcgcgcag

SEQ ID NO: 3449618 - RNA, 13 nt, Pseudomonas aeruginosa PA01
cgccgugacgagg

SEQ ID NO: 3449619 - RNA, 16 nt, Pseudomonas aeruginosa PA01
cgccgugacgaggggc

SEQ ID NO: 3449620 - RNA, 18 nt, Pseudomonas aeruginosa PA01
cgccgugacgaggggcug

SEQ ID NO: 3449621 - RNA, 20 nt, Pseudomonas aeruginosa PA01
cgccgugacgaggggcugcg

SEQ ID NO: 3449622 - RNA, 18 nt, Pseudomonas aeruginosa PA01
cgccgugaggcgcgcgcc

SEQ ID NO: 3449623 - RNA, 19 nt, Pseudomonas aeruginosa PA01
cgccgugaggcgcgcgccg

SEQ ID NO: 3449624 - RNA, 21 nt, Pseudomonas aeruginosa PA01
cgccgugaggcgcgcgccgaa

SEQ ID NO: 3449625 - RNA, 16 nt, Pseudomonas aeruginosa PA01
cgccgugcagggucag

SEQ ID NO: 3449626 - RNA, 15 nt, Pseudomonas aeruginosa PA01
cgccgugcaucaccg

SEQ ID NO: 3449627 - RNA, 16 nt, Pseudomonas aeruginosa PA01
cgccgugcaucaccgg

SEQ ID NO: 3449628 - RNA, 17 nt, Pseudomonas aeruginosa PA01
cgccgugcaucaccggc

SEQ ID NO: 3449629 - RNA, 20 nt, Pseudomonas aeruginosa PA01
cgccgugcaucaccggcagc

SEQ ID NO: 3449630 - RNA, 22 nt, Pseudomonas aeruginosa PA01
cgccgugcaucaccggcagcag

SEQ ID NO: 3449631 - RNA, 15 nt, Pseudomonas aeruginosa PA01
cgccgugcgcuccgc

SEQ ID NO: 3449632 - RNA, 17 nt, Pseudomonas aeruginosa PA01
cgccgugcgcuccgcca

SEQ ID NO: 3449633 - RNA, 19 nt, Pseudomonas aeruginosa PA01
cgccgugcgcuccgccagg

SEQ ID NO: 3449634 - RNA, 14 nt, Pseudomonas aeruginosa PA01
cgccgugcggcguu

SEQ ID NO: 3449635 - RNA, 17 nt, Pseudomonas aeruginosa PA01
cgccgugcggcguucgc

SEQ ID NO: 3449636 - RNA, 16 nt, Pseudomonas aeruginosa PA01
cgccguggaucgcccg

SEQ ID NO: 3449637 - RNA, 18 nt, Pseudomonas aeruginosa PA01
cgccguggaucgcccggc

SEQ ID NO: 3449638 - RNA, 14 nt, Pseudomonas aeruginosa PA01
cgccguggaugucg

SEQ ID NO: 3449639 - RNA, 14 nt, Pseudomonas aeruginosa PA01
cgccguggcaccag

SEQ ID NO: 3449640 - RNA, 18 nt, Pseudomonas aeruginosa PA01
cgccguggcaccaggucg

SEQ ID NO: 3449641 - RNA, 24 nt, Pseudomonas aeruginosa PA01
cgccguggcugugcuggccacccu

SEQ ID NO: 3449642 - RNA, 15 nt, Pseudomonas aeruginosa PA01
cgccgugggaacgcg

SEQ ID NO: 3449643 - RNA, 19 nt, Pseudomonas aeruginosa PA01
cgccgugggaacgcgagga

SEQ ID NO: 3449644 - RNA, 21 nt, Pseudomonas aeruginosa PA01
cgccgugggaacgcgaggaga

SEQ ID NO: 3449645 - RNA, 17 nt, Pseudomonas aeruginosa PA01
cgccgugggaguccagg

SEQ ID NO: 3449646 - RNA, 19 nt, Pseudomonas aeruginosa PA01
cgccgugguggccguggcg

SEQ ID NO: 3449647 - RNA, 17 nt, Pseudomonas aeruginosa PA01
cgccguguugaugccga

SEQ ID NO: 3449648 - RNA, 21 nt, Pseudomonas aeruginosa PA01
cgccguguugaugccgaucag

SEQ ID NO: 3449649 - RNA, 15 nt, Pseudomonas aeruginosa PA01
cgccguuacgccgga

SEQ ID NO: 3449650 - RNA, 15 nt, Pseudomonas aeruginosa PA01
cgccguuacgccggg

SEQ ID NO: 3449651 - RNA, 13 nt, Pseudomonas aeruginosa PA01
cgccguucacgcc

SEQ ID NO: 3449652 - RNA, 17 nt, Pseudomonas aeruginosa PA01
cgccguucacgccuggc

SEQ ID NO: 3449653 - RNA, 18 nt, Pseudomonas aeruginosa PA01
cgccguucacguugaccu

SEQ ID NO: 3449654 - RNA, 14 nt, Pseudomonas aeruginosa PA01
cgccguucaggguc

SEQ ID NO: 3449655 - RNA, 20 nt, Pseudomonas aeruginosa PA01
cgccguuccuccucgccgcc

SEQ ID NO: 3449656 - RNA, 21 nt, Pseudomonas aeruginosa PA01
cgccguuccuccucgccgccg

SEQ ID NO: 3449657 - RNA, 12 nt, Pseudomonas aeruginosa PA01
cgccguucgccc

SEQ ID NO: 3449658 - RNA, 20 nt, Pseudomonas aeruginosa PA01
cgccguucucauugcgccgc

SEQ ID NO: 3449659 - RNA, 21 nt, Pseudomonas aeruginosa PA01
cgccguucucauugcgccgcc

SEQ ID NO: 3449660 - RNA, 23 nt, Pseudomonas aeruginosa PA01
cgccguucucauugcgccgccgg

SEQ ID NO: 3449661 - RNA, 17 nt, Pseudomonas aeruginosa PA01
cgccguucucgaucaac

SEQ ID NO: 3449662 - RNA, 14 nt, Pseudomonas aeruginosa PA01
cgccguugaugacg

SEQ ID NO: 3449663 - RNA, 17 nt, Pseudomonas aeruginosa PA01
cgccguugaugacgaac

SEQ ID NO: 3449664 - RNA, 17 nt, Pseudomonas aeruginosa PA01
cgccguugccgaugccg

SEQ ID NO: 3449665 - RNA, 21 nt, Pseudomonas aeruginosa PA01
cgccguugccuucgccgucga

SEQ ID NO: 3449666 - RNA, 23 nt, Pseudomonas aeruginosa PA01
cgccguugccuucgccgucgagc

SEQ ID NO: 3449667 - RNA, 20 nt, Pseudomonas aeruginosa PA01
cgccguugcggcagcauccg

SEQ ID NO: 3449668 - RNA, 14 nt, Pseudomonas aeruginosa PA01
cgccguuggccuuc

SEQ ID NO: 3449669 - RNA, 17 nt, Pseudomonas aeruginosa PA01
cgccguuggcgaggacu

SEQ ID NO: 3449670 - RNA, 22 nt, Pseudomonas aeruginosa PA01
cgccguuggcguuaugcgcccu

SEQ ID NO: 3449671 - RNA, 21 nt, Pseudomonas aeruginosa PA01
cgccguuguucaggcgcgcgg

SEQ ID NO: 3449672 - RNA, 17 nt, Pseudomonas aeruginosa PA01
cgccguuguugaccgca

SEQ ID NO: 3449673 - RNA, 19 nt, Pseudomonas aeruginosa PA01
cgccguuucgacgaugcuc

SEQ ID NO: 3449674 - RNA, 23 nt, Pseudomonas aeruginosa PA01
cgccguuuuugcauuucagcgga

SEQ ID NO: 3449675 - RNA, 15 nt, Pseudomonas aeruginosa PA01
cgccuaccagaccgc

SEQ ID NO: 3449676 - RNA, 23 nt, Pseudomonas aeruginosa PA01
cgccuaccagaccgcagccggcg

SEQ ID NO: 3449677 - RNA, 13 nt, Pseudomonas aeruginosa PA01
cgccuaccggcgc

SEQ ID NO: 3449678 - RNA, 15 nt, Pseudomonas aeruginosa PA01
cgccuaccggcgccg

SEQ ID NO: 3449679 - RNA, 15 nt, Pseudomonas aeruginosa PA01
cgccuaccggggcgc

SEQ ID NO: 3449680 - RNA, 18 nt, Pseudomonas aeruginosa PA01
cgccuagacccugggcca

SEQ ID NO: 3449681 - RNA, 20 nt, Pseudomonas aeruginosa PA01
cgccuagacccugggccaac

SEQ ID NO: 3449682 - RNA, 21 nt, Pseudomonas aeruginosa PA01
cgccuagacccugggccaacg

SEQ ID NO: 3449683 - RNA, 23 nt, Pseudomonas aeruginosa PA01
cgccucaaggugaagugaucgau

SEQ ID NO: 3449684 - RNA, 14 nt, Pseudomonas aeruginosa PA01
cgccucacggucgc

SEQ ID NO: 3449685 - RNA, 20 nt, Pseudomonas aeruginosa PA01
cgccucacggucgcaggggc

SEQ ID NO: 3449686 - RNA, 11 nt, Pseudomonas aeruginosa PA01
cgccucagcgg

SEQ ID NO: 3449687 - RNA, 20 nt, Pseudomonas aeruginosa PA01
cgccucagcggaacuugcgc

SEQ ID NO: 3449688 - RNA, 14 nt, Pseudomonas aeruginosa PA01
cgccucagcggccu

SEQ ID NO: 3449689 - RNA, 20 nt, Pseudomonas aeruginosa PA01
cgccucagcggccuucgacg

SEQ ID NO: 3449690 - RNA, 15 nt, Pseudomonas aeruginosa PA01
cgccucagcggcugg

SEQ ID NO: 3449691 - RNA, 17 nt, Pseudomonas aeruginosa PA01
cgccucagcggcuggcg

SEQ ID NO: 3449692 - RNA, 14 nt, Pseudomonas aeruginosa PA01
cgccuccaccagcg

SEQ ID NO: 3449693 - RNA, 15 nt, Pseudomonas aeruginosa PA01
cgccuccaccagcgc

SEQ ID NO: 3449694 - RNA, 16 nt, Pseudomonas aeruginosa PA01
cgccuccaccagcgcc

SEQ ID NO: 3449695 - RNA, 19 nt, Pseudomonas aeruginosa PA01
cgccuccaccagcgccggc

SEQ ID NO: 3449696 - RNA, 13 nt, Pseudomonas aeruginosa PA01
cgccuccacggcg

SEQ ID NO: 3449697 - RNA, 15 nt, Pseudomonas aeruginosa PA01
cgccuccacggcggc

SEQ ID NO: 3449698 - RNA, 16 nt, Pseudomonas aeruginosa PA01
cgccuccacggcggcc

SEQ ID NO: 3449699 - RNA, 18 nt, Pseudomonas aeruginosa PA01
cgccuccacggcggccuc

SEQ ID NO: 3449700 - RNA, 19 nt, Pseudomonas aeruginosa PA01
cgccuccagcgucugccgc

SEQ ID NO: 3449701 - RNA, 12 nt, Pseudomonas aeruginosa PA01
cgccuccaggcg

SEQ ID NO: 3449702 - RNA, 17 nt, Pseudomonas aeruginosa PA01
cgccuccaggcgcgccu

SEQ ID NO: 3449703 - RNA, 14 nt, Pseudomonas aeruginosa PA01
cgccuccagguaga

SEQ ID NO: 3449704 - RNA, 22 nt, Pseudomonas aeruginosa PA01
cgccuccagguagaccuugccg

SEQ ID NO: 3449705 - RNA, 16 nt, Pseudomonas aeruginosa PA01
cgccucccaccgcgcg

SEQ ID NO: 3449706 - RNA, 19 nt, Pseudomonas aeruginosa PA01
cgccucccaccgcgcggca

SEQ ID NO: 3449707 - RNA, 12 nt, Pseudomonas aeruginosa PA01
cgccucccaggg

SEQ ID NO: 3449708 - RNA, 16 nt, Pseudomonas aeruginosa PA01
cgccucccagggucgc

SEQ ID NO: 3449709 - RNA, 11 nt, Pseudomonas aeruginosa PA01
cgccucccggc

SEQ ID NO: 3449710 - RNA, 15 nt, Pseudomonas aeruginosa PA01
cgccuccggcacgcu

SEQ ID NO: 3449711 - RNA, 13 nt, Pseudomonas aeruginosa PA01
cgccuccggcagc

SEQ ID NO: 3449712 - RNA, 14 nt, Pseudomonas aeruginosa PA01
cgccuccggcagcg

SEQ ID NO: 3449713 - RNA, 19 nt, Pseudomonas aeruginosa PA01
cgccuccgggcggaggcga

SEQ ID NO: 3449714 - RNA, 13 nt, Pseudomonas aeruginosa PA01
cgccuccgggcgu

SEQ ID NO: 3449715 - RNA, 14 nt, Pseudomonas aeruginosa PA01
cgccuccucggcgg

SEQ ID NO: 3449716 - RNA, 15 nt, Pseudomonas aeruginosa PA01
cgccuccucggcggc

SEQ ID NO: 3449717 - RNA, 18 nt, Pseudomonas aeruginosa PA01
cgccuccucuaccaggcg

SEQ ID NO: 3449718 - RNA, 19 nt, Pseudomonas aeruginosa PA01
cgccucgaacauggccacc

SEQ ID NO: 3449719 - RNA, 13 nt, Pseudomonas aeruginosa PA01
cgccugccagacc

SEQ ID NO: 3449720 - RNA, 20 nt, Pseudomonas aeruginosa PA01
cgccugccagaccguggcgc

SEQ ID NO: 3449721 - RNA, 13 nt, Pseudomonas aeruginosa PA01
cgccugccaggcg

SEQ ID NO: 3449722 - RNA, 15 nt, Pseudomonas aeruginosa PA01
cgccugccaggcggg

SEQ ID NO: 3449723 - RNA, 17 nt, Pseudomonas aeruginosa PA01
cgccugccaggcgggga

SEQ ID NO: 3449724 - RNA, 16 nt, Pseudomonas aeruginosa PA01
cgccugccccacuucc

SEQ ID NO: 3449725 - RNA, 15 nt, Pseudomonas aeruginosa PA01
cgccugccuuccuug

SEQ ID NO: 3449726 - RNA, 18 nt, Pseudomonas aeruginosa PA01
cgccugcgcuucguuggc

SEQ ID NO: 3449727 - RNA, 21 nt, Pseudomonas aeruginosa PA01
cgccugcggauagccaaccag

SEQ ID NO: 3449728 - RNA, 17 nt, Pseudomonas aeruginosa PA01
cgccugcgucagcgagg

SEQ ID NO: 3449729 - RNA, 21 nt, Pseudomonas aeruginosa PA01
cgccugcgucagcgaggcggg

SEQ ID NO: 3449730 - RNA, 15 nt, Pseudomonas aeruginosa PA01
cgccugcucgccgcu

SEQ ID NO: 3449731 - RNA, 17 nt, Pseudomonas aeruginosa PA01
cgccugcucgccgcuga

SEQ ID NO: 3449732 - RNA, 18 nt, Pseudomonas aeruginosa PA01
cgccugcucgccgcugaa

SEQ ID NO: 3449733 - RNA, 18 nt, Pseudomonas aeruginosa PA01
cgccugcucgcggcuggc

SEQ ID NO: 3449734 - RNA, 14 nt, Pseudomonas aeruginosa PA01
cgccugcucggccu

SEQ ID NO: 3449735 - RNA, 15 nt, Pseudomonas aeruginosa PA01
cgccugcucggccug

SEQ ID NO: 3449736 - RNA, 16 nt, Pseudomonas aeruginosa PA01
cgccugcucggccugc

SEQ ID NO: 3449737 - RNA, 17 nt, Pseudomonas aeruginosa PA01
cgccugcucggccugcu

SEQ ID NO: 3449738 - RNA, 17 nt, Pseudomonas aeruginosa PA01
cgccugcucuucggcgg

SEQ ID NO: 3449739 - RNA, 20 nt, Pseudomonas aeruginosa PA01
cgccugcucuucggcggcca

SEQ ID NO: 3449740 - RNA, 23 nt, Pseudomonas aeruginosa PA01
cgccugcucuucggcggccagcg

SEQ ID NO: 3449741 - RNA, 20 nt, Pseudomonas aeruginosa PA01
cgccugcugcgggucgcggg

SEQ ID NO: 3449742 - RNA, 14 nt, Pseudomonas aeruginosa PA01
cgccugcuggccgg

SEQ ID NO: 3449743 - RNA, 15 nt, Pseudomonas aeruginosa PA01
cgccugcuggccggu

SEQ ID NO: 3449744 - RNA, 21 nt, Pseudomonas aeruginosa PA01
cgccugcuggccggugccaua

SEQ ID NO: 3449745 - RNA, 21 nt, Pseudomonas aeruginosa PA01
cgccugcuggugggugaucuc

SEQ ID NO: 3449746 - RNA, 17 nt, Pseudomonas aeruginosa PA01
cgccugcuucagcccgg

SEQ ID NO: 3449747 - RNA, 19 nt, Pseudomonas aeruginosa PA01
cgccugcuucagcccggca

SEQ ID NO: 3449748 - RNA, 17 nt, Pseudomonas aeruginosa PA01
cgccugcuucagguagu

SEQ ID NO: 3449749 - RNA, 23 nt, Pseudomonas aeruginosa PA01
cgccugcuucagguagugcaaca

SEQ ID NO: 3449750 - RNA, 12 nt, Pseudomonas aeruginosa PA01
cgccugcuugaa

SEQ ID NO: 3449751 - RNA, 22 nt, Pseudomonas aeruginosa PA01
cgccugcuugaaauggcggacg

SEQ ID NO: 3449752 - RNA, 18 nt, Pseudomonas aeruginosa PA01
cgccugcuuggcggcggu

SEQ ID NO: 3449753 - RNA, 15 nt, Pseudomonas aeruginosa PA01
cgccuggaaggcgcu

SEQ ID NO: 3449754 - RNA, 17 nt, Pseudomonas aeruginosa PA01
cgccuggaaggcgcugg

SEQ ID NO: 3449755 - RNA, 19 nt, Pseudomonas aeruginosa PA01
cgccuggagcagaaccgcc

SEQ ID NO: 3449756 - RNA, 23 nt, Pseudomonas aeruginosa PA01
cgccuggagcagaaccgccagca

SEQ ID NO: 3449757 - RNA, 21 nt, Pseudomonas aeruginosa PA01
cgccuggagcaguuucggauc

SEQ ID NO: 3449758 - RNA, 16 nt, Pseudomonas aeruginosa PA01
cgccuggaucagcgcc

SEQ ID NO: 3449759 - RNA, 22 nt, Pseudomonas aeruginosa PA01
cgccuggaucagcgccucgacc

SEQ ID NO: 3449760 - RNA, 23 nt, Pseudomonas aeruginosa PA01
cgccuggaucagcgccucgaccu

SEQ ID NO: 3449761 - RNA, 21 nt, Pseudomonas aeruginosa PA01
cgccuggaugaucgcgugggc

SEQ ID NO: 3449762 - RNA, 19 nt, Pseudomonas aeruginosa PA01
cgccuggcaaccgucgaac

SEQ ID NO: 3449763 - RNA, 18 nt, Pseudomonas aeruginosa PA01
cgccuggccgcgcaggac

SEQ ID NO: 3449764 - RNA, 14 nt, Pseudomonas aeruginosa PA01
cgccuggccggcca

SEQ ID NO: 3449765 - RNA, 15 nt, Pseudomonas aeruginosa PA01
cgccuggccggccag

SEQ ID NO: 3449766 - RNA, 18 nt, Pseudomonas aeruginosa PA01
cgccuggccggccagcca

SEQ ID NO: 3449767 - RNA, 20 nt, Pseudomonas aeruginosa PA01
cgccuggccggccagccagg

SEQ ID NO: 3449768 - RNA, 23 nt, Pseudomonas aeruginosa PA01
cgccuggccgucuuccagggcgg

SEQ ID NO: 3449769 - RNA, 14 nt, Pseudomonas aeruginosa PA01
cgccuggcgcaacg

SEQ ID NO: 3449770 - RNA, 22 nt, Pseudomonas aeruginosa PA01
cgccuggcgcaacgccggcagg

SEQ ID NO: 3449771 - RNA, 17 nt, Pseudomonas aeruginosa PA01
cgccuggcgcaaggugc

SEQ ID NO: 3449772 - RNA, 15 nt, Pseudomonas aeruginosa PA01
cgccuggcgcauggc

SEQ ID NO: 3449773 - RNA, 20 nt, Pseudomonas aeruginosa PA01
cgccuggcgcgacgaggcgc

SEQ ID NO: 3449774 - RNA, 16 nt, Pseudomonas aeruginosa PA01
cgccuggcggcuggcg

SEQ ID NO: 3449775 - RNA, 20 nt, Pseudomonas aeruginosa PA01
cgccuggcguagcguugcgc

SEQ ID NO: 3449776 - RNA, 17 nt, Pseudomonas aeruginosa PA01
cgccuggcgucccguug

SEQ ID NO: 3449777 - RNA, 20 nt, Pseudomonas aeruginosa PA01
cgccuggcgucccguugcgc

SEQ ID NO: 3449778 - RNA, 21 nt, Pseudomonas aeruginosa PA01
cgccuggcgucccguugcgca

SEQ ID NO: 3449779 - RNA, 16 nt, Pseudomonas aeruginosa PA01
cgccuggcgugccgcc

SEQ ID NO: 3449780 - RNA, 18 nt, Pseudomonas aeruginosa PA01
cgccuggcgugccgccag

SEQ ID NO: 3449781 - RNA, 19 nt, Pseudomonas aeruginosa PA01
cgccuggcgugccgccagg

SEQ ID NO: 3449782 - RNA, 15 nt, Pseudomonas aeruginosa PA01
cgccuggcuggccag

SEQ ID NO: 3449783 - RNA, 17 nt, Pseudomonas aeruginosa PA01
cgccuggcuggccagca

SEQ ID NO: 3449784 - RNA, 19 nt, Pseudomonas aeruginosa PA01
cgccuggcuggccagcagg

SEQ ID NO: 3449785 - RNA, 23 nt, Pseudomonas aeruginosa PA01
cgccugggacggaacgucggccu

SEQ ID NO: 3449786 - RNA, 15 nt, Pseudomonas aeruginosa PA01
cgccugggccgccuc

SEQ ID NO: 3449787 - RNA, 14 nt, Pseudomonas aeruginosa PA01
cgccugggccgcga

SEQ ID NO: 3449788 - RNA, 14 nt, Pseudomonas aeruginosa PA01
cgccugggccgcgc

SEQ ID NO: 3449789 - RNA, 20 nt, Pseudomonas aeruginosa PA01
cgccugggcggucggcucag

SEQ ID NO: 3449790 - RNA, 22 nt, Pseudomonas aeruginosa PA01
cgccuggguggcgacgaagacg

SEQ ID NO: 3449791 - RNA, 18 nt, Pseudomonas aeruginosa PA01
cgccugguaggcggcgac

SEQ ID NO: 3449792 - RNA, 14 nt, Pseudomonas aeruginosa PA01
cgccugguccagca

SEQ ID NO: 3449793 - RNA, 15 nt, Pseudomonas aeruginosa PA01
cgccugguccagcag

SEQ ID NO: 3449794 - RNA, 16 nt, Pseudomonas aeruginosa PA01
cgccugguccagcagg

SEQ ID NO: 3449795 - RNA, 21 nt, Pseudomonas aeruginosa PA01
cgccuggucgaucucgucgaa

SEQ ID NO: 3449796 - RNA, 14 nt, Pseudomonas aeruginosa PA01
cgccuggucggcgg

SEQ ID NO: 3449797 - RNA, 15 nt, Pseudomonas aeruginosa PA01
cgccuggucggcggc

SEQ ID NO: 3449798 - RNA, 17 nt, Pseudomonas aeruginosa PA01
cgccuggucggcggccu

SEQ ID NO: 3449799 - RNA, 18 nt, Pseudomonas aeruginosa PA01
cgccuggucggggccggc

SEQ ID NO: 3449800 - RNA, 21 nt, Pseudomonas aeruginosa PA01
cgccuggucggggccggcgau

SEQ ID NO: 3449801 - RNA, 22 nt, Pseudomonas aeruginosa PA01
cgccuggucggggccggcgaug

SEQ ID NO: 3449802 - RNA, 14 nt, Pseudomonas aeruginosa PA01
cgccuggugcaggu

SEQ ID NO: 3449803 - RNA, 19 nt, Pseudomonas aeruginosa PA01
cgccuggugcaggucgcgc

SEQ ID NO: 3449804 - RNA, 18 nt, Pseudomonas aeruginosa PA01
cgccuggugcccgaugcc

SEQ ID NO: 3449805 - RNA, 19 nt, Pseudomonas aeruginosa PA01
cgccuguaccccguagcgc

SEQ ID NO: 3449806 - RNA, 19 nt, Pseudomonas aeruginosa PA01
cgccuguccaccgguggcg

SEQ ID NO: 3449807 - RNA, 20 nt, Pseudomonas aeruginosa PA01
cgccuguccaccgguggcga

SEQ ID NO: 3449808 - RNA, 23 nt, Pseudomonas aeruginosa PA01
cgccuguccgggaaugcucagca

SEQ ID NO: 3449809 - RNA, 12 nt, Pseudomonas aeruginosa PA01
cgccugucgcuc

SEQ ID NO: 3449810 - RNA, 16 nt, Pseudomonas aeruginosa PA01
cgccugucgcuccggc

SEQ ID NO: 3449811 - RNA, 21 nt, Pseudomonas aeruginosa PA01
cgccugucgcuccggcagcgc

SEQ ID NO: 3449812 - RNA, 13 nt, Pseudomonas aeruginosa PA01
cgccugucggcac

SEQ ID NO: 3449813 - RNA, 21 nt, Pseudomonas aeruginosa PA01
cgccuguggcguuauucgccc

SEQ ID NO: 3449814 - RNA, 14 nt, Pseudomonas aeruginosa PA01
cgccuguuccaggg

SEQ ID NO: 3449815 - RNA, 16 nt, Pseudomonas aeruginosa PA01
cgccuguuccagggcc

SEQ ID NO: 3449816 - RNA, 21 nt, Pseudomonas aeruginosa PA01
cgccuguuccagggccugcuc

SEQ ID NO: 3449817 - RNA, 22 nt, Pseudomonas aeruginosa PA01
cgccuucaccguucccagcagc

SEQ ID NO: 3449818 - RNA, 14 nt, Pseudomonas aeruginosa PA01
cgccuucagcccca

SEQ ID NO: 3449819 - RNA, 23 nt, Pseudomonas aeruginosa PA01
cgccuucagccccagcacgccga

SEQ ID NO: 3449820 - RNA, 14 nt, Pseudomonas aeruginosa PA01
cgccuucagcgcca

SEQ ID NO: 3449821 - RNA, 15 nt, Pseudomonas aeruginosa PA01
cgcgaacucggcgcc

SEQ ID NO: 3449822 - RNA, 18 nt, Pseudomonas aeruginosa PA01
cgcgaacucggcgccgau

SEQ ID NO: 3449823 - RNA, 19 nt, Pseudomonas aeruginosa PA01
cgcgaacucggcgccgauc

SEQ ID NO: 3449824 - RNA, 20 nt, Pseudomonas aeruginosa PA01
cgcgaacucggcgccgaucu

SEQ ID NO: 3449825 - RNA, 14 nt, Pseudomonas aeruginosa PA01
cgcgaagaacacgc

SEQ ID NO: 3449826 - RNA, 18 nt, Pseudomonas aeruginosa PA01
cgcgaagaacacgcccca

SEQ ID NO: 3449827 - RNA, 18 nt, Pseudomonas aeruginosa PA01
cgcgaagaccggccggcu

SEQ ID NO: 3449828 - RNA, 15 nt, Pseudomonas aeruginosa PA01
cgcgaagcacgcucu

SEQ ID NO: 3449829 - RNA, 19 nt, Pseudomonas aeruginosa PA01
cgcgaagcacgcucuucuu

SEQ ID NO: 3449830 - RNA, 22 nt, Pseudomonas aeruginosa PA01
cgcgaagcacgcucuucuuaca

SEQ ID NO: 3449831 - RNA, 15 nt, Pseudomonas aeruginosa PA01
cgcgaagcccagcgc

SEQ ID NO: 3449832 - RNA, 18 nt, Pseudomonas aeruginosa PA01
cgcgaagcccagcgccgc

SEQ ID NO: 3449833 - RNA, 23 nt, Pseudomonas aeruginosa PA01
cgcgaagcgguuagccggcgauc

SEQ ID NO: 3449834 - RNA, 17 nt, Pseudomonas aeruginosa PA01
cgcgaaggccacgccga

SEQ ID NO: 3449835 - RNA, 12 nt, Pseudomonas aeruginosa PA01
cgcgaaggcgcc

SEQ ID NO: 3449836 - RNA, 18 nt, Pseudomonas aeruginosa PA01
cgcgaaggcgccuuccag

SEQ ID NO: 3449837 - RNA, 21 nt, Pseudomonas aeruginosa PA01
cgcgaaggcgccuuccaggcg

SEQ ID NO: 3449838 - RNA, 22 nt, Pseudomonas aeruginosa PA01
cgcgaaggcgccuuccaggcgu

SEQ ID NO: 3449839 - RNA, 14 nt, Pseudomonas aeruginosa PA01
cgcgaagucgcagu

SEQ ID NO: 3449840 - RNA, 20 nt, Pseudomonas aeruginosa PA01
cgcgaauaccgcgcgcgcaa

SEQ ID NO: 3449841 - RNA, 21 nt, Pseudomonas aeruginosa PA01
cgcgaauaccgcgcgcgcaag

SEQ ID NO: 3449842 - RNA, 22 nt, Pseudomonas aeruginosa PA01
cgcgaauaccgcgcgcgcaagg

SEQ ID NO: 3449843 - RNA, 17 nt, Pseudomonas aeruginosa PA01
cgcgaauagggcggcgc

SEQ ID NO: 3449844 - RNA, 21 nt, Pseudomonas aeruginosa PA01
cgcgaauagggcggcgccacc

SEQ ID NO: 3449845 - RNA, 22 nt, Pseudomonas aeruginosa PA01
cgcgaauagggcggcgccaccg

SEQ ID NO: 3449846 - RNA, 13 nt, Pseudomonas aeruginosa PA01
cgcgaauccgcgg

SEQ ID NO: 3449847 - RNA, 22 nt, Pseudomonas aeruginosa PA01
cgcgaauccggucggacuccgc

SEQ ID NO: 3449848 - RNA, 19 nt, Pseudomonas aeruginosa PA01
cgcgaaucuucggcgcgcc

SEQ ID NO: 3449849 - RNA, 15 nt, Pseudomonas aeruginosa PA01
cgcgaaugcccggca

SEQ ID NO: 3449850 - RNA, 18 nt, Pseudomonas aeruginosa PA01
cgcgaaugcccggcagcg

SEQ ID NO: 3449851 - RNA, 19 nt, Pseudomonas aeruginosa PA01
cgcgaaugcccggcagcgc

SEQ ID NO: 3449852 - RNA, 15 nt, Pseudomonas aeruginosa PA01
cgcgaauggcagcag

SEQ ID NO: 3449853 - RNA, 16 nt, Pseudomonas aeruginosa PA01
cgcgaauggcagcagg

SEQ ID NO: 3449854 - RNA, 21 nt, Pseudomonas aeruginosa PA01
cgcgaaugguucaucuucgcg

SEQ ID NO: 3449855 - RNA, 20 nt, Pseudomonas aeruginosa PA01
cgcgaaugugguggaagagg

SEQ ID NO: 3449856 - RNA, 17 nt, Pseudomonas aeruginosa PA01
cgcgacaacccuguccc

SEQ ID NO: 3449857 - RNA, 15 nt, Pseudomonas aeruginosa PA01
cgcgacacaccgaca

SEQ ID NO: 3449858 - RNA, 15 nt, Pseudomonas aeruginosa PA01
cgcgacacauggucg

SEQ ID NO: 3449859 - RNA, 13 nt, Pseudomonas aeruginosa PA01
cgcgacaccgggc

SEQ ID NO: 3449860 - RNA, 14 nt, Pseudomonas aeruginosa PA01
cgcgacagauagca

SEQ ID NO: 3449861 - RNA, 21 nt, Pseudomonas aeruginosa PA01
cgcgacagcgacucuucaaca

SEQ ID NO: 3449862 - RNA, 13 nt, Pseudomonas aeruginosa PA01
cgcgacagcucug

SEQ ID NO: 3449863 - RNA, 13 nt, Pseudomonas aeruginosa PA01
cgcgacaggaugg

SEQ ID NO: 3449864 - RNA, 17 nt, Pseudomonas aeruginosa PA01
cgcgacaguucgccgcc

SEQ ID NO: 3449865 - RNA, 18 nt, Pseudomonas aeruginosa PA01
cgcgacaguucgccgccc

SEQ ID NO: 3449866 - RNA, 15 nt, Pseudomonas aeruginosa PA01
cgcgacaucggcgau

SEQ ID NO: 3449867 - RNA, 16 nt, Pseudomonas aeruginosa PA01
cgcgaccacaggcggc

SEQ ID NO: 3449868 - RNA, 11 nt, Pseudomonas aeruginosa PA01
cgcgaccagcg

SEQ ID NO: 3449869 - RNA, 13 nt, Pseudomonas aeruginosa PA01
cgcgaccagcgcc

SEQ ID NO: 3449870 - RNA, 18 nt, Pseudomonas aeruginosa PA01
cgcgaccagcgccaggcg

SEQ ID NO: 3449871 - RNA, 22 nt, Pseudomonas aeruginosa PA01
cgcgaccagcgccaggcgcggu

SEQ ID NO: 3449872 - RNA, 14 nt, Pseudomonas aeruginosa PA01
cgcgacccaucgcc

SEQ ID NO: 3449873 - RNA, 17 nt, Pseudomonas aeruginosa PA01
cgcgacccaucgccgaa

SEQ ID NO: 3449874 - RNA, 20 nt, Pseudomonas aeruginosa PA01
cgcgacccucagucgccccc

SEQ ID NO: 3449875 - RNA, 14 nt, Pseudomonas aeruginosa PA01
cgcgacccuggccg

SEQ ID NO: 3449876 - RNA, 16 nt, Pseudomonas aeruginosa PA01
cgcgacccuggccgcg

SEQ ID NO: 3449877 - RNA, 23 nt, Pseudomonas aeruginosa PA01
cgcgaccgagaugcucgcgcagc

SEQ ID NO: 3449878 - RNA, 18 nt, Pseudomonas aeruginosa PA01
cgcgaccgcccgccucag

SEQ ID NO: 3449879 - RNA, 14 nt, Pseudomonas aeruginosa PA01
cgcgaccgggcaug

SEQ ID NO: 3449880 - RNA, 19 nt, Pseudomonas aeruginosa PA01
cgcgaccgguaacuggcca

SEQ ID NO: 3449881 - RNA, 20 nt, Pseudomonas aeruginosa PA01
cgcgaccggucaggcaaucu

SEQ ID NO: 3449882 - RNA, 16 nt, Pseudomonas aeruginosa PA01
cgcgaccgucggccgg

SEQ ID NO: 3449883 - RNA, 13 nt, Pseudomonas aeruginosa PA01
cgcgaccuccggc

SEQ ID NO: 3449884 - RNA, 17 nt, Pseudomonas aeruginosa PA01
cgcgaccuccggcgcca

SEQ ID NO: 3449885 - RNA, 14 nt, Pseudomonas aeruginosa PA01
cgcgaccugcucgu

SEQ ID NO: 3449886 - RNA, 21 nt, Pseudomonas aeruginosa PA01
cgcgaccugcucgucgaugcu

SEQ ID NO: 3449887 - RNA, 17 nt, Pseudomonas aeruginosa PA01
cgcgaccuucggugucg

SEQ ID NO: 3449888 - RNA, 13 nt, Pseudomonas aeruginosa PA01
cgcgacgacugcg

SEQ ID NO: 3449889 - RNA, 16 nt, Pseudomonas aeruginosa PA01
cgcgacgacugcggca

SEQ ID NO: 3449890 - RNA, 18 nt, Pseudomonas aeruginosa PA01
cgcgacgacugcggcagc

SEQ ID NO: 3449891 - RNA, 13 nt, Pseudomonas aeruginosa PA01
cgcgacgaggcgc

SEQ ID NO: 3449892 - RNA, 15 nt, Pseudomonas aeruginosa PA01
cgcgacgaggcgcgg

SEQ ID NO: 3449893 - RNA, 20 nt, Pseudomonas aeruginosa PA01
cgcgacgaggcgcggcggag

SEQ ID NO: 3449894 - RNA, 14 nt, Pseudomonas aeruginosa PA01
cgcgacgcgaccuc

SEQ ID NO: 3449895 - RNA, 16 nt, Pseudomonas aeruginosa PA01
cgcgacgcgaccuccg

SEQ ID NO: 3449896 - RNA, 15 nt, Pseudomonas aeruginosa PA01
cgcgacgcgcuggac

SEQ ID NO: 3449897 - RNA, 21 nt, Pseudomonas aeruginosa PA01
cgcgacgcuacguuccagggc

SEQ ID NO: 3449898 - RNA, 13 nt, Pseudomonas aeruginosa PA01
cgcgacgcuccag

SEQ ID NO: 3449899 - RNA, 16 nt, Pseudomonas aeruginosa PA01
cgcgacgcuccagcgg

SEQ ID NO: 3449900 - RNA, 17 nt, Pseudomonas aeruginosa PA01
cgcgacgcuccaggugc

SEQ ID NO: 3449901 - RNA, 18 nt, Pseudomonas aeruginosa PA01
cgcgacgcuccaggugca

SEQ ID NO: 3449902 - RNA, 23 nt, Pseudomonas aeruginosa PA01
cgcgacggaccgcgacaacccug

SEQ ID NO: 3449903 - RNA, 24 nt, Pseudomonas aeruginosa PA01
cgcgacggaccgcgacaacccugu

SEQ ID NO: 3449904 - RNA, 13 nt, Pseudomonas aeruginosa PA01
cgcgacggcauuc

SEQ ID NO: 3449905 - RNA, 20 nt, Pseudomonas aeruginosa PA01
cgcgacggcauuccuggucc

SEQ ID NO: 3449906 - RNA, 19 nt, Pseudomonas aeruginosa PA01
cgcgacggcugcuccggau

SEQ ID NO: 3449907 - RNA, 22 nt, Pseudomonas aeruginosa PA01
cgcgacggcugcuccggaucgc

SEQ ID NO: 3449908 - RNA, 18 nt, Pseudomonas aeruginosa PA01
cgcgacucgaagcucuuc

SEQ ID NO: 3449909 - RNA, 21 nt, Pseudomonas aeruginosa PA01
cgcgacucgaagcucuucgcc

SEQ ID NO: 3449910 - RNA, 14 nt, Pseudomonas aeruginosa PA01
cgcgacucgagcac

SEQ ID NO: 3449911 - RNA, 16 nt, Pseudomonas aeruginosa PA01
cgcgacucgagcacca

SEQ ID NO: 3449912 - RNA, 18 nt, Pseudomonas aeruginosa PA01
cgcgacucgagcaccacc

SEQ ID NO: 3449913 - RNA, 15 nt, Pseudomonas aeruginosa PA01
cgcgacucggcugca

SEQ ID NO: 3449914 - RNA, 23 nt, Pseudomonas aeruginosa PA01
cgcgacucggcugcaacgccgcg

SEQ ID NO: 3449915 - RNA, 21 nt, Pseudomonas aeruginosa PA01
cgcgacucgguaaagcccagg

SEQ ID NO: 3449916 - RNA, 20 nt, Pseudomonas aeruginosa PA01
cgcgacugaccacgcagagc

SEQ ID NO: 3449917 - RNA, 20 nt, Pseudomonas aeruginosa PA01
cgcgacugccgucggcgccc

SEQ ID NO: 3449918 - RNA, 16 nt, Pseudomonas aeruginosa PA01
cgcgacugcugaucag

SEQ ID NO: 3449919 - RNA, 17 nt, Pseudomonas aeruginosa PA01
cgcgacugcugaucagc

SEQ ID NO: 3449920 - RNA, 18 nt, Pseudomonas aeruginosa PA01
cgcgacugcugaucagcu

SEQ ID NO: 3449921 - RNA, 23 nt, Pseudomonas aeruginosa PA01
cgcgacugcugcugcggggccug

SEQ ID NO: 3449922 - RNA, 15 nt, Pseudomonas aeruginosa PA01
cgcgacugucgagca

SEQ ID NO: 3449923 - RNA, 14 nt, Pseudomonas aeruginosa PA01
cgcgaugguagucc

SEQ ID NO: 3449924 - RNA, 23 nt, Pseudomonas aeruginosa PA01
cgcgaugguaguccgcugcgagc

SEQ ID NO: 3449925 - RNA, 22 nt, Pseudomonas aeruginosa PA01
cgcgaugguauggcggucggcc

SEQ ID NO: 3449926 - RNA, 15 nt, Pseudomonas aeruginosa PA01
cgcgauguccccggc

SEQ ID NO: 3449927 - RNA, 19 nt, Pseudomonas aeruginosa PA01
cgcgauguccccggccagc

SEQ ID NO: 3449928 - RNA, 17 nt, Pseudomonas aeruginosa PA01
cgcgauguuggcgucga

SEQ ID NO: 3449929 - RNA, 13 nt, Pseudomonas aeruginosa PA01
cgcgauucgccgg

SEQ ID NO: 3449930 - RNA, 15 nt, Pseudomonas aeruginosa PA01
cgcgauucgccgggc

SEQ ID NO: 3449931 - RNA, 23 nt, Pseudomonas aeruginosa PA01
cgcgauugcagcuccuggucgcg

SEQ ID NO: 3449932 - RNA, 16 nt, Pseudomonas aeruginosa PA01
cgcgcaaaccggcagc

SEQ ID NO: 3449933 - RNA, 17 nt, Pseudomonas aeruginosa PA01
cgcgcaaaccggcagca

SEQ ID NO: 3449934 - RNA, 16 nt, Pseudomonas aeruginosa PA01
cgcgcaaccagccgga

SEQ ID NO: 3449935 - RNA, 15 nt, Pseudomonas aeruginosa PA01
cgcgcaaccguucca

SEQ ID NO: 3449936 - RNA, 18 nt, Pseudomonas aeruginosa PA01
cgcgcaaccguuccagcg

SEQ ID NO: 3449937 - RNA, 24 nt, Pseudomonas aeruginosa PA01
cgcgcaaccguuccagcgccucgg

SEQ ID NO: 3449938 - RNA, 13 nt, Pseudomonas aeruginosa PA01
cgcgcaacgccga

SEQ ID NO: 3449939 - RNA, 14 nt, Pseudomonas aeruginosa PA01
cgcgcaacgccgac

SEQ ID NO: 3449940 - RNA, 15 nt, Pseudomonas aeruginosa PA01
cgcgcaacgccgacg

SEQ ID NO: 3449941 - RNA, 21 nt, Pseudomonas aeruginosa PA01
cgcgcaacgccgacggcgugc

SEQ ID NO: 3449942 - RNA, 22 nt, Pseudomonas aeruginosa PA01
cgcgcaacgccgacggcgugcc

SEQ ID NO: 3449943 - RNA, 15 nt, Pseudomonas aeruginosa PA01
cgcgcaacggcagcg

SEQ ID NO: 3449944 - RNA, 20 nt, Pseudomonas aeruginosa PA01
cgcgcaacggcagcgcuucg

SEQ ID NO: 3449945 - RNA, 12 nt, Pseudomonas aeruginosa PA01
cgcgcaacugcu

SEQ ID NO: 3449946 - RNA, 15 nt, Pseudomonas aeruginosa PA01
cgcgcaacugcucga

SEQ ID NO: 3449947 - RNA, 20 nt, Pseudomonas aeruginosa PA01
cgcgcaacugcucgaacugc

SEQ ID NO: 3449948 - RNA, 15 nt, Pseudomonas aeruginosa PA01
cgcgcaagccagcca

SEQ ID NO: 3449949 - RNA, 16 nt, Pseudomonas aeruginosa PA01
cgcgcaagccagccau

SEQ ID NO: 3449950 - RNA, 21 nt, Pseudomonas aeruginosa PA01
cgcgcaagccagccaugugcu

SEQ ID NO: 3449951 - RNA, 15 nt, Pseudomonas aeruginosa PA01
cgcgcaagcgcccgg

SEQ ID NO: 3449952 - RNA, 21 nt, Pseudomonas aeruginosa PA01
cgcgcaagcucgucacccgcg

SEQ ID NO: 3449953 - RNA, 14 nt, Pseudomonas aeruginosa PA01
cgcgcaaggccgaa

SEQ ID NO: 3449954 - RNA, 15 nt, Pseudomonas aeruginosa PA01
cgcgcaaggccgaag

SEQ ID NO: 3449955 - RNA, 20 nt, Pseudomonas aeruginosa PA01
cgcgcaaggccgaagaggcc

SEQ ID NO: 3449956 - RNA, 22 nt, Pseudomonas aeruginosa PA01
cgcgcacaaaaaagcccgccag

SEQ ID NO: 3449957 - RNA, 21 nt, Pseudomonas aeruginosa PA01
cgcgcaccacccaucugccgg

SEQ ID NO: 3449958 - RNA, 22 nt, Pseudomonas aeruginosa PA01
cgcgcaccacccaucugccggc

SEQ ID NO: 3449959 - RNA, 13 nt, Pseudomonas aeruginosa PA01
cgcgcaccaccug

SEQ ID NO: 3449960 - RNA, 15 nt, Pseudomonas aeruginosa PA01
cgcgcaccaccuggc

SEQ ID NO: 3449961 - RNA, 13 nt, Pseudomonas aeruginosa PA01
cgcgcaccagcgg

SEQ ID NO: 3449962 - RNA, 14 nt, Pseudomonas aeruginosa PA01
cgcgcaccagcggg

SEQ ID NO: 3449963 - RNA, 12 nt, Pseudomonas aeruginosa PA01
cgcgcaccaggc

SEQ ID NO: 3449964 - RNA, 21 nt, Pseudomonas aeruginosa PA01
cgcgcaccaggccucccagcc

SEQ ID NO: 3449965 - RNA, 19 nt, Pseudomonas aeruginosa PA01
cgcgcaccgccucgugcag

SEQ ID NO: 3449966 - RNA, 21 nt, Pseudomonas aeruginosa PA01
cgcgcaccgccucgugcagca

SEQ ID NO: 3449967 - RNA, 12 nt, Pseudomonas aeruginosa PA01
cgcgcaccgcgg

SEQ ID NO: 3449968 - RNA, 14 nt, Pseudomonas aeruginosa PA01
cgcgcaccgcggcg

SEQ ID NO: 3449969 - RNA, 13 nt, Pseudomonas aeruginosa PA01
cgcgcaccuggcg

SEQ ID NO: 3449970 - RNA, 18 nt, Pseudomonas aeruginosa PA01
cgcgcaccuggcggucgc

SEQ ID NO: 3449971 - RNA, 19 nt, Pseudomonas aeruginosa PA01
cgcgcaccuguuucagcgg

SEQ ID NO: 3449972 - RNA, 17 nt, Pseudomonas aeruginosa PA01
cgcgcaccuugcuggac

SEQ ID NO: 3449973 - RNA, 20 nt, Pseudomonas aeruginosa PA01
cgcgcacggaggcgcucagg

SEQ ID NO: 3449974 - RNA, 23 nt, Pseudomonas aeruginosa PA01
cgcgcacggaucgcgcugggcgc

SEQ ID NO: 3449975 - RNA, 14 nt, Pseudomonas aeruginosa PA01
cgcgcacggcgaag

SEQ ID NO: 3449976 - RNA, 17 nt, Pseudomonas aeruginosa PA01
cgcgcacgucaccgucc

SEQ ID NO: 3449977 - RNA, 18 nt, Pseudomonas aeruginosa PA01
cgcgcacuuccucggcga

SEQ ID NO: 3449978 - RNA, 19 nt, Pseudomonas aeruginosa PA01
cgcgcacuuccucggcgac

SEQ ID NO: 3449979 - RNA, 15 nt, Pseudomonas aeruginosa PA01
cgcgcagaccaucag

SEQ ID NO: 3449980 - RNA, 16 nt, Pseudomonas aeruginosa PA01
cgcgcagaccaucagc

SEQ ID NO: 3449981 - RNA, 20 nt, Pseudomonas aeruginosa PA01
cgcgcagaccaucagcugga

SEQ ID NO: 3449982 - RNA, 21 nt, Pseudomonas aeruginosa PA01
cgcgcagacgauugaccuccc

SEQ ID NO: 3449983 - RNA, 14 nt, Pseudomonas aeruginosa PA01
cgcgcagaggcgcu

SEQ ID NO: 3449984 - RNA, 16 nt, Pseudomonas aeruginosa PA01
cgcgcagaggcgcucc

SEQ ID NO: 3449985 - RNA, 21 nt, Pseudomonas aeruginosa PA01
cgcgcagauaaggcgugcagu

SEQ ID NO: 3449986 - RNA, 20 nt, Pseudomonas aeruginosa PA01
cgcgcagauagucgaaguac

SEQ ID NO: 3449987 - RNA, 15 nt, Pseudomonas aeruginosa PA01
cgcgcagaucgccgc

SEQ ID NO: 3449988 - RNA, 20 nt, Pseudomonas aeruginosa PA01
cgcgcagaucgccgcguagc

SEQ ID NO: 3449989 - RNA, 15 nt, Pseudomonas aeruginosa PA01
cgcgcagaucgcguc

SEQ ID NO: 3449990 - RNA, 13 nt, Pseudomonas aeruginosa PA01
cgcgcagaugauc

SEQ ID NO: 3449991 - RNA, 14 nt, Pseudomonas aeruginosa PA01
cgcgcagaugaucg

SEQ ID NO: 3449992 - RNA, 17 nt, Pseudomonas aeruginosa PA01
cgcgcagaugaucgcca

SEQ ID NO: 3449993 - RNA, 21 nt, Pseudomonas aeruginosa PA01
cgcgcagaugaucgccaccgg

SEQ ID NO: 3449994 - RNA, 22 nt, Pseudomonas aeruginosa PA01
cgcgcagaugaucgccaccggg

SEQ ID NO: 3449995 - RNA, 14 nt, Pseudomonas aeruginosa PA01
cgcgcagcaacggc

SEQ ID NO: 3449996 - RNA, 15 nt, Pseudomonas aeruginosa PA01
cgcgcagcaacggcg

SEQ ID NO: 3449997 - RNA, 13 nt, Pseudomonas aeruginosa PA01
cgcgcagcaccga

SEQ ID NO: 3449998 - RNA, 15 nt, Pseudomonas aeruginosa PA01
cgcgcagcacuuccu

SEQ ID NO: 3449999 - RNA, 13 nt, Pseudomonas aeruginosa PA01
cgcgcagcaggau

SEQ ID NO: 3450000 - RNA, 13 nt, Pseudomonas aeruginosa PA01
cgcgcagcaggcg

SEQ ID NO: 3450001 - RNA, 17 nt, Pseudomonas aeruginosa PA01
cgcgcagcaggcggccc

SEQ ID NO: 3450002 - RNA, 17 nt, Pseudomonas aeruginosa PA01
cgcgcagccacuggcgg

SEQ ID NO: 3450003 - RNA, 16 nt, Pseudomonas aeruginosa PA01
cgcgcagccaggcgag

SEQ ID NO: 3450004 - RNA, 17 nt, Pseudomonas aeruginosa PA01
cgcgcagccaggcgagg

SEQ ID NO: 3450005 - RNA, 15 nt, Pseudomonas aeruginosa PA01
cgcgcagccaguugg

SEQ ID NO: 3450006 - RNA, 13 nt, Pseudomonas aeruginosa PA01
cgcgcagcgacuc

SEQ ID NO: 3450007 - RNA, 13 nt, Pseudomonas aeruginosa PA01
cgcgcagcgccgc

SEQ ID NO: 3450008 - RNA, 16 nt, Pseudomonas aeruginosa PA01
cgcgcagcgccgccgc

SEQ ID NO: 3450009 - RNA, 17 nt, Pseudomonas aeruginosa PA01
cgcgcagcgccuccagc

SEQ ID NO: 3450010 - RNA, 24 nt, Pseudomonas aeruginosa PA01
cgcgcagcgccuccagcgucugcc

SEQ ID NO: 3450011 - RNA, 14 nt, Pseudomonas aeruginosa PA01
cgcgcagcgcggcg

SEQ ID NO: 3450012 - RNA, 16 nt, Pseudomonas aeruginosa PA01
cgcgcagcgcggcgcu

SEQ ID NO: 3450013 - RNA, 12 nt, Pseudomonas aeruginosa PA01
cgcgcagcggcg

SEQ ID NO: 3450014 - RNA, 13 nt, Pseudomonas aeruginosa PA01
cgcgcagcggcgc

SEQ ID NO: 3450015 - RNA, 14 nt, Pseudomonas aeruginosa PA01
cgcgcagcggcgcg

SEQ ID NO: 3450016 - RNA, 19 nt, Pseudomonas aeruginosa PA01
cgcgcagcggcgcgucgcu

SEQ ID NO: 3450017 - RNA, 12 nt, Pseudomonas aeruginosa PA01
cgcgcagcggcu

SEQ ID NO: 3450018 - RNA, 15 nt, Pseudomonas aeruginosa PA01
cgcgcagcuccucgg

SEQ ID NO: 3450019 - RNA, 16 nt, Pseudomonas aeruginosa PA01
cgcgcagcuccucggc

SEQ ID NO: 3450020 - RNA, 15 nt, Pseudomonas aeruginosa PA01
cgcgcagcucggcca

SEQ ID NO: 3450021 - RNA, 17 nt, Pseudomonas aeruginosa PA01
cgcgcagcucggccaac

SEQ ID NO: 3450022 - RNA, 14 nt, Pseudomonas aeruginosa PA01
cgcgcagcuugccu

SEQ ID NO: 3450023 - RNA, 22 nt, Pseudomonas aeruginosa PA01
cgcgcagcuugccuuccaggcu

SEQ ID NO: 3450024 - RNA, 23 nt, Pseudomonas aeruginosa PA01
cgcgcagcuugccuuccaggcug

SEQ ID NO: 3450025 - RNA, 16 nt, Pseudomonas aeruginosa PA01
cgcgcaggaccacgcu

SEQ ID NO: 3450026 - RNA, 15 nt, Pseudomonas aeruginosa PA01
cgcgcccaggcccag

SEQ ID NO: 3450027 - RNA, 23 nt, Pseudomonas aeruginosa PA01
cgcgcccaggcccagcgcggcgc

SEQ ID NO: 3450028 - RNA, 13 nt, Pseudomonas aeruginosa PA01
cgcgcccaggcgc

SEQ ID NO: 3450029 - RNA, 14 nt, Pseudomonas aeruginosa PA01
cgcgcccaggcgca

SEQ ID NO: 3450030 - RNA, 16 nt, Pseudomonas aeruginosa PA01
cgcgcccaggcgcacc

SEQ ID NO: 3450031 - RNA, 19 nt, Pseudomonas aeruginosa PA01
cgcgcccaggcugccggcc

SEQ ID NO: 3450032 - RNA, 14 nt, Pseudomonas aeruginosa PA01
cgcgccccacggcg

SEQ ID NO: 3450033 - RNA, 19 nt, Pseudomonas aeruginosa PA01
cgcgccccacggcgcggcc

SEQ ID NO: 3450034 - RNA, 14 nt, Pseudomonas aeruginosa PA01
cgcgccccagcggc

SEQ ID NO: 3450035 - RNA, 15 nt, Pseudomonas aeruginosa PA01
cgcgccccagcggca

SEQ ID NO: 3450036 - RNA, 17 nt, Pseudomonas aeruginosa PA01
cgcgccccagcggcagg

SEQ ID NO: 3450037 - RNA, 20 nt, Pseudomonas aeruginosa PA01
cgcgccccagcggcaggcac

SEQ ID NO: 3450038 - RNA, 18 nt, Pseudomonas aeruginosa PA01
cgcgcccccuggccguug

SEQ ID NO: 3450039 - RNA, 13 nt, Pseudomonas aeruginosa PA01
cgcgccccgccag

SEQ ID NO: 3450040 - RNA, 14 nt, Pseudomonas aeruginosa PA01
cgcgccccgccagg

SEQ ID NO: 3450041 - RNA, 13 nt, Pseudomonas aeruginosa PA01
cgcgccccggcga

SEQ ID NO: 3450042 - RNA, 19 nt, Pseudomonas aeruginosa PA01
cgcgccccggcgagcgagc

SEQ ID NO: 3450043 - RNA, 11 nt, Pseudomonas aeruginosa PA01
cgcgccccggg

SEQ ID NO: 3450044 - RNA, 14 nt, Pseudomonas aeruginosa PA01
cgcgccccugcgcc

SEQ ID NO: 3450045 - RNA, 19 nt, Pseudomonas aeruginosa PA01
cgcgccccugcgcccaggg

SEQ ID NO: 3450046 - RNA, 16 nt, Pseudomonas aeruginosa PA01
cgcgcccgccaggucg

SEQ ID NO: 3450047 - RNA, 19 nt, Pseudomonas aeruginosa PA01
cgcgcccgccaggucgagg

SEQ ID NO: 3450048 - RNA, 23 nt, Pseudomonas aeruginosa PA01
cgcgcccgccuggaaggcgcugg

SEQ ID NO: 3450049 - RNA, 13 nt, Pseudomonas aeruginosa PA01
cgcgcccggccag

SEQ ID NO: 3450050 - RNA, 16 nt, Pseudomonas aeruginosa PA01
cgcgcccggccaggcc

SEQ ID NO: 3450051 - RNA, 20 nt, Pseudomonas aeruginosa PA01
cgcgcccggccaggccgccc

SEQ ID NO: 3450052 - RNA, 24 nt, Pseudomonas aeruginosa PA01
cgcgcccggccaggccgcccagga

SEQ ID NO: 3450053 - RNA, 14 nt, Pseudomonas aeruginosa PA01
cgcgcccggccuuc

SEQ ID NO: 3450054 - RNA, 14 nt, Pseudomonas aeruginosa PA01
cgcgcccggcgcca

SEQ ID NO: 3450055 - RNA, 23 nt, Pseudomonas aeruginosa PA01
cgcgcccggcgccaccccgccgc

SEQ ID NO: 3450056 - RNA, 17 nt, Pseudomonas aeruginosa PA01
cgcgcccggcgccaggc

SEQ ID NO: 3450057 - RNA, 21 nt, Pseudomonas aeruginosa PA01
cgcgcccggcgccaggcugac

SEQ ID NO: 3450058 - RNA, 14 nt, Pseudomonas aeruginosa PA01
cgcgcccggcgccc

SEQ ID NO: 3450059 - RNA, 14 nt, Pseudomonas aeruginosa PA01
cgcgcccggcuggc

SEQ ID NO: 3450060 - RNA, 16 nt, Pseudomonas aeruginosa PA01
cgcgcccggcuggcca

SEQ ID NO: 3450061 - RNA, 14 nt, Pseudomonas aeruginosa PA01
cgcgcccugcaggc

SEQ ID NO: 3450062 - RNA, 16 nt, Pseudomonas aeruginosa PA01
cgcgcccugcaggccg

SEQ ID NO: 3450063 - RNA, 13 nt, Pseudomonas aeruginosa PA01
cgcgccgaacucg

SEQ ID NO: 3450064 - RNA, 14 nt, Pseudomonas aeruginosa PA01
cgcgccgaaggcga

SEQ ID NO: 3450065 - RNA, 12 nt, Pseudomonas aeruginosa PA01
cgcgccgacagc

SEQ ID NO: 3450066 - RNA, 15 nt, Pseudomonas aeruginosa PA01
cgcgccgacagcacg

SEQ ID NO: 3450067 - RNA, 22 nt, Pseudomonas aeruginosa PA01
cgcgccgacagcacgauggcga

SEQ ID NO: 3450068 - RNA, 23 nt, Pseudomonas aeruginosa PA01
cgcgccgacagcacgauggcgag

SEQ ID NO: 3450069 - RNA, 16 nt, Pseudomonas aeruginosa PA01
cgcgccgaccagccgc

SEQ ID NO: 3450070 - RNA, 13 nt, Pseudomonas aeruginosa PA01
cgcgccgacccag

SEQ ID NO: 3450071 - RNA, 21 nt, Pseudomonas aeruginosa PA01
cgcgccgacccagagcgcgcc

SEQ ID NO: 3450072 - RNA, 21 nt, Pseudomonas aeruginosa PA01
cgcgccgagauagcggcaacg

SEQ ID NO: 3450073 - RNA, 17 nt, Pseudomonas aeruginosa PA01
cgcgccgagcccccggc

SEQ ID NO: 3450074 - RNA, 19 nt, Pseudomonas aeruginosa PA01
cgcgccgaguucgccgcga

SEQ ID NO: 3450075 - RNA, 16 nt, Pseudomonas aeruginosa PA01
cgcgccgaguuggccc

SEQ ID NO: 3450076 - RNA, 15 nt, Pseudomonas aeruginosa PA01
cgcgccgauccaggc

SEQ ID NO: 3450077 - RNA, 23 nt, Pseudomonas aeruginosa PA01
cgcgccgauccaggcguggggcg

SEQ ID NO: 3450078 - RNA, 17 nt, Pseudomonas aeruginosa PA01
cgcgccgcaagggcguc

SEQ ID NO: 3450079 - RNA, 14 nt, Pseudomonas aeruginosa PA01
cgcgccgcccuggc

SEQ ID NO: 3450080 - RNA, 16 nt, Pseudomonas aeruginosa PA01
cgcgccgcccuggccg

SEQ ID NO: 3450081 - RNA, 17 nt, Pseudomonas aeruginosa PA01
cgcgccgcccuggccgc

SEQ ID NO: 3450082 - RNA, 13 nt, Pseudomonas aeruginosa PA01
cgcgccgccgaag

SEQ ID NO: 3450083 - RNA, 14 nt, Pseudomonas aeruginosa PA01
cgcgccgccgaagc

SEQ ID NO: 3450084 - RNA, 17 nt, Pseudomonas aeruginosa PA01
cgcgccgccgaagccga

SEQ ID NO: 3450085 - RNA, 22 nt, Pseudomonas aeruginosa PA01
cgcgccgccgaagccgacgccg

SEQ ID NO: 3450086 - RNA, 13 nt, Pseudomonas aeruginosa PA01
cgcgccgccgagg

SEQ ID NO: 3450087 - RNA, 20 nt, Pseudomonas aeruginosa PA01
cgcgccgccgaucugcuggg

SEQ ID NO: 3450088 - RNA, 14 nt, Pseudomonas aeruginosa PA01
cgcgccgccgccgc

SEQ ID NO: 3450089 - RNA, 15 nt, Pseudomonas aeruginosa PA01
cgcgccgccgcggcc

SEQ ID NO: 3450090 - RNA, 18 nt, Pseudomonas aeruginosa PA01
cgcgccgccgcggccagc

SEQ ID NO: 3450091 - RNA, 20 nt, Pseudomonas aeruginosa PA01
cgcgccgccgcggccagccc

SEQ ID NO: 3450092 - RNA, 21 nt, Pseudomonas aeruginosa PA01
cgcgccgccgcggccagcccc

SEQ ID NO: 3450093 - RNA, 14 nt, Pseudomonas aeruginosa PA01
cgcgccgccgggcg

SEQ ID NO: 3450094 - RNA, 15 nt, Pseudomonas aeruginosa PA01
cgcgccgccgggcgc

SEQ ID NO: 3450095 - RNA, 16 nt, Pseudomonas aeruginosa PA01
cgcgccgccgggcgcc

SEQ ID NO: 3450096 - RNA, 14 nt, Pseudomonas aeruginosa PA01
cgcgccgcgccagc

SEQ ID NO: 3450097 - RNA, 15 nt, Pseudomonas aeruginosa PA01
cgcgccgcgccagca

SEQ ID NO: 3450098 - RNA, 15 nt, Pseudomonas aeruginosa PA01
cgcgccgcggcggcg

SEQ ID NO: 3450099 - RNA, 20 nt, Pseudomonas aeruginosa PA01
cgcgccgcgguuuccgugcg

SEQ ID NO: 3450100 - RNA, 18 nt, Pseudomonas aeruginosa PA01
cgcgccgcgucgccgcca

SEQ ID NO: 3450101 - RNA, 20 nt, Pseudomonas aeruginosa PA01
cgcgccgcgucgccgccagc

SEQ ID NO: 3450102 - RNA, 21 nt, Pseudomonas aeruginosa PA01
cgcgccgcuaugggcaccgcg

SEQ ID NO: 3450103 - RNA, 19 nt, Pseudomonas aeruginosa PA01
cgcgccggaaguggcagcg

SEQ ID NO: 3450104 - RNA, 21 nt, Pseudomonas aeruginosa PA01
cgcgccggaaguggcagcgcc

SEQ ID NO: 3450105 - RNA, 16 nt, Pseudomonas aeruginosa PA01
cgcgccggacaggcca

SEQ ID NO: 3450106 - RNA, 21 nt, Pseudomonas aeruginosa PA01
cgcgccggaucgaaguagucg

SEQ ID NO: 3450107 - RNA, 11 nt, Pseudomonas aeruginosa PA01
cgcgccggaug

SEQ ID NO: 3450108 - RNA, 16 nt, Pseudomonas aeruginosa PA01
cgcgccggaugggcga

SEQ ID NO: 3450109 - RNA, 12 nt, Pseudomonas aeruginosa PA01
cgcgccggcagc

SEQ ID NO: 3450110 - RNA, 20 nt, Pseudomonas aeruginosa PA01
cgcgccggcagcucggccga

SEQ ID NO: 3450111 - RNA, 17 nt, Pseudomonas aeruginosa PA01
cgcgccggcgaucgcca

SEQ ID NO: 3450112 - RNA, 19 nt, Pseudomonas aeruginosa PA01
cgcgccggcgaucgccagg

SEQ ID NO: 3450113 - RNA, 20 nt, Pseudomonas aeruginosa PA01
cgcgccggcgaucgccaggc

SEQ ID NO: 3450114 - RNA, 19 nt, Pseudomonas aeruginosa PA01
cgcgccgggaagcaccgac

SEQ ID NO: 3450115 - RNA, 20 nt, Pseudomonas aeruginosa PA01
cgcgccgggaagcaccgacu

SEQ ID NO: 3450116 - RNA, 20 nt, Pseudomonas aeruginosa PA01
cgcgccgggcucagcgcgcg

SEQ ID NO: 3450117 - RNA, 14 nt, Pseudomonas aeruginosa PA01
cgcgccgggcuggc

SEQ ID NO: 3450118 - RNA, 16 nt, Pseudomonas aeruginosa PA01
cgcgccgggcuggccg

SEQ ID NO: 3450119 - RNA, 14 nt, Pseudomonas aeruginosa PA01
cgcgccggggcagc

SEQ ID NO: 3450120 - RNA, 19 nt, Pseudomonas aeruginosa PA01
cgcgccggguugcgccgca

SEQ ID NO: 3450121 - RNA, 21 nt, Pseudomonas aeruginosa PA01
cgcgccggguugcgccgcaag

SEQ ID NO: 3450122 - RNA, 23 nt, Pseudomonas aeruginosa PA01
cgcgccggugaucgagccgccgg

SEQ ID NO: 3450123 - RNA, 16 nt, Pseudomonas aeruginosa PA01
cgcgccgguggccagg

SEQ ID NO: 3450124 - RNA, 18 nt, Pseudomonas aeruginosa PA01
cgcgccgguuucgaccgg

SEQ ID NO: 3450125 - RNA, 22 nt, Pseudomonas aeruginosa PA01
cgcgccgguuucgaccggcgcg

SEQ ID NO: 3450126 - RNA, 16 nt, Pseudomonas aeruginosa PA01
cgcgccguccaucagg

SEQ ID NO: 3450127 - RNA, 15 nt, Pseudomonas aeruginosa PA01
cgcgccgucgcuggc

SEQ ID NO: 3450128 - RNA, 17 nt, Pseudomonas aeruginosa PA01
cgcgccgucgcuggcga

SEQ ID NO: 3450129 - RNA, 13 nt, Pseudomonas aeruginosa PA01
cgcgcggcgaggg

SEQ ID NO: 3450130 - RNA, 18 nt, Pseudomonas aeruginosa PA01
cgcgcggcgccccgucca

SEQ ID NO: 3450131 - RNA, 19 nt, Pseudomonas aeruginosa PA01
cgcgcggcgcccugccggg

SEQ ID NO: 3450132 - RNA, 21 nt, Pseudomonas aeruginosa PA01
cgcgcggcggguagagucgcu

SEQ ID NO: 3450133 - RNA, 13 nt, Pseudomonas aeruginosa PA01
cgcgcggcgucga

SEQ ID NO: 3450134 - RNA, 19 nt, Pseudomonas aeruginosa PA01
cgcgcggcugcuugccgcu

SEQ ID NO: 3450135 - RNA, 14 nt, Pseudomonas aeruginosa PA01
cgcgcggcuugccg

SEQ ID NO: 3450136 - RNA, 20 nt, Pseudomonas aeruginosa PA01
cgcgcgggccgaggucgcgg

SEQ ID NO: 3450137 - RNA, 13 nt, Pseudomonas aeruginosa PA01
cgcgcgggccggc

SEQ ID NO: 3450138 - RNA, 14 nt, Pseudomonas aeruginosa PA01
cgcgcgggccggcg

SEQ ID NO: 3450139 - RNA, 15 nt, Pseudomonas aeruginosa PA01
cgcgcgggccggcga

SEQ ID NO: 3450140 - RNA, 17 nt, Pseudomonas aeruginosa PA01
cgcgcgggccuucgccu

SEQ ID NO: 3450141 - RNA, 20 nt, Pseudomonas aeruginosa PA01
cgcgcgggccuucgccuucg

SEQ ID NO: 3450142 - RNA, 17 nt, Pseudomonas aeruginosa PA01
cgcgcggggcgcgcugc

SEQ ID NO: 3450143 - RNA, 16 nt, Pseudomonas aeruginosa PA01
cgcgcggggucuggcc

SEQ ID NO: 3450144 - RNA, 18 nt, Pseudomonas aeruginosa PA01
cgcgcggggucuggccgg

SEQ ID NO: 3450145 - RNA, 21 nt, Pseudomonas aeruginosa PA01
cgcgcgggguggccgugcagc

SEQ ID NO: 3450146 - RNA, 12 nt, Pseudomonas aeruginosa PA01
cgcgcgggucgu

SEQ ID NO: 3450147 - RNA, 21 nt, Pseudomonas aeruginosa PA01
cgcgcgggugcggcuggcgcg

SEQ ID NO: 3450148 - RNA, 18 nt, Pseudomonas aeruginosa PA01
cgcgcggucgagcagcgc

SEQ ID NO: 3450149 - RNA, 20 nt, Pseudomonas aeruginosa PA01
cgcgcggucgagcagcgccg

SEQ ID NO: 3450150 - RNA, 22 nt, Pseudomonas aeruginosa PA01
cgcgcggucgagcagcgccgcg

SEQ ID NO: 3450151 - RNA, 21 nt, Pseudomonas aeruginosa PA01
cgcgcggucgagcucggccag

SEQ ID NO: 3450152 - RNA, 19 nt, Pseudomonas aeruginosa PA01
cgcgcggucuucaucaccu

SEQ ID NO: 3450153 - RNA, 16 nt, Pseudomonas aeruginosa PA01
cgcgcguagcgugccg

SEQ ID NO: 3450154 - RNA, 21 nt, Pseudomonas aeruginosa PA01
cgcgcguaggcuuggucgggc

SEQ ID NO: 3450155 - RNA, 16 nt, Pseudomonas aeruginosa PA01
cgcgcguccagccggu

SEQ ID NO: 3450156 - RNA, 17 nt, Pseudomonas aeruginosa PA01
cgcgcgucggcgaaccc

SEQ ID NO: 3450157 - RNA, 13 nt, Pseudomonas aeruginosa PA01
cgcgcgucggcgg

SEQ ID NO: 3450158 - RNA, 20 nt, Pseudomonas aeruginosa PA01
cgcgcgucggucaggacagc

SEQ ID NO: 3450159 - RNA, 15 nt, Pseudomonas aeruginosa PA01
cgcgcgucguccagg

SEQ ID NO: 3450160 - RNA, 16 nt, Pseudomonas aeruginosa PA01
cgcgcgucguccaggg

SEQ ID NO: 3450161 - RNA, 12 nt, Pseudomonas aeruginosa PA01
cgcgcguggccg

SEQ ID NO: 3450162 - RNA, 15 nt, Pseudomonas aeruginosa PA01
cgcgcguggccgcca

SEQ ID NO: 3450163 - RNA, 21 nt, Pseudomonas aeruginosa PA01
cgcgcguggcuucguccagcg

SEQ ID NO: 3450164 - RNA, 14 nt, Pseudomonas aeruginosa PA01
cgcgcguuccaggu

SEQ ID NO: 3450165 - RNA, 15 nt, Pseudomonas aeruginosa PA01
cgcgcguucgcgcga

SEQ ID NO: 3450166 - RNA, 15 nt, Pseudomonas aeruginosa PA01
cgcgcguuucagcgc

SEQ ID NO: 3450167 - RNA, 13 nt, Pseudomonas aeruginosa PA01
cgcgcucagcgcg

SEQ ID NO: 3450168 - RNA, 13 nt, Pseudomonas aeruginosa PA01
cgcgcucaggcgc

SEQ ID NO: 3450169 - RNA, 16 nt, Pseudomonas aeruginosa PA01
cgcgcucaggcgcagc

SEQ ID NO: 3450170 - RNA, 13 nt, Pseudomonas aeruginosa PA01
cgcgcuccaggcc

SEQ ID NO: 3450171 - RNA, 14 nt, Pseudomonas aeruginosa PA01
cgcgcuccaggccc

SEQ ID NO: 3450172 - RNA, 16 nt, Pseudomonas aeruginosa PA01
cgcgcuccaggcccgg

SEQ ID NO: 3450173 - RNA, 18 nt, Pseudomonas aeruginosa PA01
cgcgcuccaggcccggca

SEQ ID NO: 3450174 - RNA, 12 nt, Pseudomonas aeruginosa PA01
cgcgcuccggcg

SEQ ID NO: 3450175 - RNA, 14 nt, Pseudomonas aeruginosa PA01
cgcgcuccggcgcg

SEQ ID NO: 3450176 - RNA, 15 nt, Pseudomonas aeruginosa PA01
cgcgcuccggcgcgc

SEQ ID NO: 3450177 - RNA, 17 nt, Pseudomonas aeruginosa PA01
cgcgcuccggcgcgcca

SEQ ID NO: 3450178 - RNA, 17 nt, Pseudomonas aeruginosa PA01
cgcgcuccucgauccgc

SEQ ID NO: 3450179 - RNA, 16 nt, Pseudomonas aeruginosa PA01
cgcgcucgacggucag

SEQ ID NO: 3450180 - RNA, 12 nt, Pseudomonas aeruginosa PA01
cgcgcucgcgga

SEQ ID NO: 3450181 - RNA, 14 nt, Pseudomonas aeruginosa PA01
cgcgcucgcggaac

SEQ ID NO: 3450182 - RNA, 14 nt, Pseudomonas aeruginosa PA01
cgcgcucgcugucg

SEQ ID NO: 3450183 - RNA, 16 nt, Pseudomonas aeruginosa PA01
cgcgcucgcugucgcu

SEQ ID NO: 3450184 - RNA, 22 nt, Pseudomonas aeruginosa PA01
cgcgcucgcugucgcucagcgg

SEQ ID NO: 3450185 - RNA, 22 nt, Pseudomonas aeruginosa PA01
cgcgcucggaucaggcgggcuc

SEQ ID NO: 3450186 - RNA, 14 nt, Pseudomonas aeruginosa PA01
cgcgcucggccagu

SEQ ID NO: 3450187 - RNA, 17 nt, Pseudomonas aeruginosa PA01
cgcgcucggccaguucg

SEQ ID NO: 3450188 - RNA, 21 nt, Pseudomonas aeruginosa PA01
cgcgcucggccaguucgucga

SEQ ID NO: 3450189 - RNA, 14 nt, Pseudomonas aeruginosa PA01
cgcgcucggccgcc

SEQ ID NO: 3450190 - RNA, 16 nt, Pseudomonas aeruginosa PA01
cgcgcucggccgccug

SEQ ID NO: 3450191 - RNA, 18 nt, Pseudomonas aeruginosa PA01
cgcgcucggccgccuggc

SEQ ID NO: 3450192 - RNA, 21 nt, Pseudomonas aeruginosa PA01
cgcgcucggccgccuggcgug

SEQ ID NO: 3450193 - RNA, 13 nt, Pseudomonas aeruginosa PA01
cgcgcucggccug

SEQ ID NO: 3450194 - RNA, 18 nt, Pseudomonas aeruginosa PA01
cgcgcucggccuggugca

SEQ ID NO: 3450195 - RNA, 12 nt, Pseudomonas aeruginosa PA01
cgcgcucggcga

SEQ ID NO: 3450196 - RNA, 12 nt, Pseudomonas aeruginosa PA01
cgcgcucggcgg

SEQ ID NO: 3450197 - RNA, 16 nt, Pseudomonas aeruginosa PA01
cgcgcucggcggucag

SEQ ID NO: 3450198 - RNA, 21 nt, Pseudomonas aeruginosa PA01
cgcgcucgguccagaucgcca

SEQ ID NO: 3450199 - RNA, 22 nt, Pseudomonas aeruginosa PA01
cgcgcucgguccagaucgccac

SEQ ID NO: 3450200 - RNA, 14 nt, Pseudomonas aeruginosa PA01
cgcgcucucgccgg

SEQ ID NO: 3450201 - RNA, 18 nt, Pseudomonas aeruginosa PA01
cgcgcucucgccggccug

SEQ ID NO: 3450202 - RNA, 12 nt, Pseudomonas aeruginosa PA01
cgcgcucuggcc

SEQ ID NO: 3450203 - RNA, 17 nt, Pseudomonas aeruginosa PA01
cgcgcucuuccuucagu

SEQ ID NO: 3450204 - RNA, 14 nt, Pseudomonas aeruginosa PA01
cgcgcucuucgccg

SEQ ID NO: 3450205 - RNA, 16 nt, Pseudomonas aeruginosa PA01
cgcgcucuucgccgcg

SEQ ID NO: 3450206 - RNA, 17 nt, Pseudomonas aeruginosa PA01
cgcgcucuucgccgcgg

SEQ ID NO: 3450207 - RNA, 18 nt, Pseudomonas aeruginosa PA01
cgcgcucuucgccgcggc

SEQ ID NO: 3450208 - RNA, 12 nt, Pseudomonas aeruginosa PA01
cgcgcugaccug

SEQ ID NO: 3450209 - RNA, 13 nt, Pseudomonas aeruginosa PA01
cgcgcugaccugg

SEQ ID NO: 3450210 - RNA, 15 nt, Pseudomonas aeruginosa PA01
cgcgcugacggcaag

SEQ ID NO: 3450211 - RNA, 21 nt, Pseudomonas aeruginosa PA01
cgcgcugcaugaaccaaccga

SEQ ID NO: 3450212 - RNA, 18 nt, Pseudomonas aeruginosa PA01
cgcgcugccaguggcggc

SEQ ID NO: 3450213 - RNA, 13 nt, Pseudomonas aeruginosa PA01
cgcgcugcccggc

SEQ ID NO: 3450214 - RNA, 20 nt, Pseudomonas aeruginosa PA01
cgcgcugcgaaucgucgccg

SEQ ID NO: 3450215 - RNA, 22 nt, Pseudomonas aeruginosa PA01
cgcgcugcgaaucgucgccgga

SEQ ID NO: 3450216 - RNA, 23 nt, Pseudomonas aeruginosa PA01
cgcgcugcgaaucgucgccggag

SEQ ID NO: 3450217 - RNA, 14 nt, Pseudomonas aeruginosa PA01
cgcgcugcgccagg

SEQ ID NO: 3450218 - RNA, 16 nt, Pseudomonas aeruginosa PA01
cgcgcugcgccaggcc

SEQ ID NO: 3450219 - RNA, 14 nt, Pseudomonas aeruginosa PA01
cgcgcugcggcagg

SEQ ID NO: 3450220 - RNA, 20 nt, Pseudomonas aeruginosa PA01
cgcgcugcgugcgccgcucg

SEQ ID NO: 3450221 - RNA, 23 nt, Pseudomonas aeruginosa PA01
cgcgcugcgugcgccgcucgcgc

SEQ ID NO: 3450222 - RNA, 23 nt, Pseudomonas aeruginosa PA01
cgcgcugcguggguagccgccca

SEQ ID NO: 3450223 - RNA, 20 nt, Pseudomonas aeruginosa PA01
cgcgcugcugccauccgcgc

SEQ ID NO: 3450224 - RNA, 17 nt, Pseudomonas aeruginosa PA01
cgcgcuggaccauggcc

SEQ ID NO: 3450225 - RNA, 20 nt, Pseudomonas aeruginosa PA01
cgcgcuggaccauggccggc

SEQ ID NO: 3450226 - RNA, 21 nt, Pseudomonas aeruginosa PA01
cgcgcuggaccauggccggcg

SEQ ID NO: 3450227 - RNA, 19 nt, Pseudomonas aeruginosa PA01
cgcgcuggacccgcaccug

SEQ ID NO: 3450228 - RNA, 18 nt, Pseudomonas aeruginosa PA01
cgcgcuggaccuggccgg

SEQ ID NO: 3450229 - RNA, 20 nt, Pseudomonas aeruginosa PA01
cgcgcuggaccuggccggcg

SEQ ID NO: 3450230 - RNA, 23 nt, Pseudomonas aeruginosa PA01
cgcgcuggaccuggccggcgacc

SEQ ID NO: 3450231 - RNA, 17 nt, Pseudomonas aeruginosa PA01
cgcgcuggagaccuugu

SEQ ID NO: 3450232 - RNA, 18 nt, Pseudomonas aeruginosa PA01
cgcgcuggaguaucgccc

SEQ ID NO: 3450233 - RNA, 13 nt, Pseudomonas aeruginosa PA01
cgcgcuggaugaa

SEQ ID NO: 3450234 - RNA, 19 nt, Pseudomonas aeruginosa PA01
cgcgcuggauuucgccgag

SEQ ID NO: 3450235 - RNA, 13 nt, Pseudomonas aeruginosa PA01
cgcgcuggccagu

SEQ ID NO: 3450236 - RNA, 16 nt, Pseudomonas aeruginosa PA01
cgcgcuggccaguucc

SEQ ID NO: 3450237 - RNA, 14 nt, Pseudomonas aeruginosa PA01
cgcgcuggcgcagc

SEQ ID NO: 3450238 - RNA, 15 nt, Pseudomonas aeruginosa PA01
cgcgcugggcgcagc

SEQ ID NO: 3450239 - RNA, 14 nt, Pseudomonas aeruginosa PA01
cgcgcuggucgacg

SEQ ID NO: 3450240 - RNA, 14 nt, Pseudomonas aeruginosa PA01
cgcgcuguagccgg

SEQ ID NO: 3450241 - RNA, 15 nt, Pseudomonas aeruginosa PA01
cgcgcuguagccggc

SEQ ID NO: 3450242 - RNA, 16 nt, Pseudomonas aeruginosa PA01
cgcgcuguagccggcg

SEQ ID NO: 3450243 - RNA, 17 nt, Pseudomonas aeruginosa PA01
cgcgcuguagccggcgc

SEQ ID NO: 3450244 - RNA, 16 nt, Pseudomonas aeruginosa PA01
cgcgcugucggccucg

SEQ ID NO: 3450245 - RNA, 19 nt, Pseudomonas aeruginosa PA01
cgcgcugucggccucgacg

SEQ ID NO: 3450246 - RNA, 17 nt, Pseudomonas aeruginosa PA01
cgcgcugugcacggucu

SEQ ID NO: 3450247 - RNA, 16 nt, Pseudomonas aeruginosa PA01
cgcgcuguugccgcgc

SEQ ID NO: 3450248 - RNA, 17 nt, Pseudomonas aeruginosa PA01
cgcgcuguugccgcgcu

SEQ ID NO: 3450249 - RNA, 22 nt, Pseudomonas aeruginosa PA01
cgcgcuguugccgcgcuugccg

SEQ ID NO: 3450250 - RNA, 15 nt, Pseudomonas aeruginosa PA01
cgcgcuuccaggcac

SEQ ID NO: 3450251 - RNA, 16 nt, Pseudomonas aeruginosa PA01
cgcgcuuccaggcacg

SEQ ID NO: 3450252 - RNA, 13 nt, Pseudomonas aeruginosa PA01
cgcgcuuccaggg

SEQ ID NO: 3450253 - RNA, 16 nt, Pseudomonas aeruginosa PA01
cgcgcuuccgcaucgg

SEQ ID NO: 3450254 - RNA, 17 nt, Pseudomonas aeruginosa PA01
cgcgcuuccgcaucggc

SEQ ID NO: 3450255 - RNA, 20 nt, Pseudomonas aeruginosa PA01
cgcgcuuccgcaucggccga

SEQ ID NO: 3450256 - RNA, 13 nt, Pseudomonas aeruginosa PA01
cgcgcuucuucga

SEQ ID NO: 3450257 - RNA, 16 nt, Pseudomonas aeruginosa PA01
cgcgcuugacgacugc

SEQ ID NO: 3450258 - RNA, 18 nt, Pseudomonas aeruginosa PA01
cgcgcuugaguugccaga

SEQ ID NO: 3450259 - RNA, 20 nt, Pseudomonas aeruginosa PA01
cgcgcuugccuuccugggcg

SEQ ID NO: 3450260 - RNA, 22 nt, Pseudomonas aeruginosa PA01
cgcgcuugccuuccugggcgug

SEQ ID NO: 3450261 - RNA, 14 nt, Pseudomonas aeruginosa PA01
cgcgcuuggacagc

SEQ ID NO: 3450262 - RNA, 18 nt, Pseudomonas aeruginosa PA01
cgcgcuuggacagcucgc

SEQ ID NO: 3450263 - RNA, 12 nt, Pseudomonas aeruginosa PA01
cgcgcuuggccu

SEQ ID NO: 3450264 - RNA, 15 nt, Pseudomonas aeruginosa PA01
cgcgcuuggccuugc
